United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 13

SEQ ID NO: 539734 - DNA, 16 bp, G. gallus
gttccaaccctcctgc

SEQ ID NO: 539735 - DNA, 16 bp, G. gallus
gttccccttcctgttt

SEQ ID NO: 539736 - DNA, 16 bp, G. gallus
gttcctcctcctgttt

SEQ ID NO: 539737 - DNA, 16 bp, G. gallus
gttctcagatggtgaa

SEQ ID NO: 539738 - DNA, 16 bp, G. gallus
gttctcagctacaaaa

SEQ ID NO: 539739 - DNA, 16 bp, G. gallus
gttctccctggagcct

SEQ ID NO: 539740 - DNA, 16 bp, G. gallus
gttctgcctggagaag

SEQ ID NO: 539741 - DNA, 16 bp, G. gallus
gttctggagcacctcc

SEQ ID NO: 539742 - DNA, 16 bp, G. gallus
gttgaaactggatgat

SEQ ID NO: 539743 - DNA, 16 bp, G. gallus
gttgaaggagagaaga

SEQ ID NO: 539744 - DNA, 16 bp, G. gallus
gttgacacaatggaag

SEQ ID NO: 539745 - DNA, 16 bp, G. gallus
gttgcagaaagcaaca

SEQ ID NO: 539746 - DNA, 16 bp, G. gallus
gttgcatttcagcagt

SEQ ID NO: 539747 - DNA, 16 bp, G. gallus
gttgccactgctgaaa

SEQ ID NO: 539748 - DNA, 16 bp, G. gallus
gttgctgctgctgaaa

SEQ ID NO: 539749 - DNA, 16 bp, G. gallus
gttggaaaagactgct

SEQ ID NO: 539750 - DNA, 16 bp, G. gallus
gttggaaaagagcact

SEQ ID NO: 539751 - DNA, 16 bp, G. gallus
gttggaactagatgat

SEQ ID NO: 539752 - DNA, 16 bp, G. gallus
gttggaagggacctct

SEQ ID NO: 539753 - DNA, 16 bp, G. gallus
gttggaagggagctta

SEQ ID NO: 539754 - DNA, 16 bp, G. gallus
gttggacgagatgatc

SEQ ID NO: 539755 - DNA, 16 bp, G. gallus
gttggactcagtgatc

SEQ ID NO: 539756 - DNA, 16 bp, G. gallus
gttggactcggtgatc

SEQ ID NO: 539757 - DNA, 16 bp, G. gallus
gttggactgaatgatc

SEQ ID NO: 539758 - DNA, 16 bp, G. gallus
gttggactggatgatc

SEQ ID NO: 539759 - DNA, 16 bp, G. gallus
gttggatatgaggagg

SEQ ID NO: 539760 - DNA, 16 bp, G. gallus
gttggatggggtcctg

SEQ ID NO: 539761 - DNA, 16 bp, G. gallus
gttggtggccctgact

SEQ ID NO: 539762 - DNA, 16 bp, G. gallus
gttggttgatgaaaga

SEQ ID NO: 539763 - DNA, 16 bp, G. gallus
gttgttgatgaagatg

SEQ ID NO: 539764 - DNA, 16 bp, G. gallus
gtttaactcatttaaa

SEQ ID NO: 539765 - DNA, 16 bp, G. gallus
gtttacatgggtggat

SEQ ID NO: 539766 - DNA, 16 bp, G. gallus
gtttcaaattaaaaga

SEQ ID NO: 539767 - DNA, 16 bp, G. gallus
gtttcacagctgctgt

SEQ ID NO: 539768 - DNA, 16 bp, G. gallus
gtttctgtggaaataa

SEQ ID NO: 539769 - DNA, 16 bp, G. gallus
gtttgaagaccatgga

SEQ ID NO: 539770 - DNA, 16 bp, G. gallus
gtttggggcagagtgg

SEQ ID NO: 539771 - DNA, 16 bp, G. gallus
gtttgggggaaaaaaa

SEQ ID NO: 539772 - DNA, 16 bp, G. gallus
gtttgtttgtttgtca

SEQ ID NO: 539773 - DNA, 16 bp, G. gallus
gtttgtttgttttcaa

SEQ ID NO: 539774 - DNA, 16 bp, G. gallus
gtttgttttttcccca

SEQ ID NO: 539775 - DNA, 16 bp, G. gallus
gttttaaactgaagga

SEQ ID NO: 539776 - DNA, 16 bp, G. gallus
gttttctttaaaaaaa

SEQ ID NO: 539777 - DNA, 16 bp, G. gallus
gttttgaatacctcca

SEQ ID NO: 539778 - DNA, 16 bp, G. gallus
gttttggatttaggat

SEQ ID NO: 539779 - DNA, 16 bp, G. gallus
gttttgtaattttgct

SEQ ID NO: 539780 - DNA, 16 bp, G. gallus
gttttgttacttatat

SEQ ID NO: 539781 - DNA, 16 bp, G. gallus
gttttgtttttaaact

SEQ ID NO: 539782 - DNA, 16 bp, G. gallus
gttttgtttttcccca

SEQ ID NO: 539783 - DNA, 16 bp, G. gallus
gtttttctcctagaac

SEQ ID NO: 539784 - DNA, 16 bp, G. gallus
gtttttttctttaaaa

SEQ ID NO: 539785 - DNA, 16 bp, G. gallus
taaaaaaaaatctgtt

SEQ ID NO: 539786 - DNA, 16 bp, G. gallus
taaaaaccatctggat

SEQ ID NO: 539787 - DNA, 16 bp, G. gallus
taaaaagctttttcct

SEQ ID NO: 539788 - DNA, 16 bp, G. gallus
taaaaatctgcagcag

SEQ ID NO: 539789 - DNA, 16 bp, G. gallus
taaaacagatgtttaa

SEQ ID NO: 539790 - DNA, 16 bp, G. gallus
taaaactgattttttt

SEQ ID NO: 539791 - DNA, 16 bp, G. gallus
taaaagagaggagatt

SEQ ID NO: 539792 - DNA, 16 bp, G. gallus
taaaagaggaggcatt

SEQ ID NO: 539793 - DNA, 16 bp, G. gallus
taaaagaggggaaatt

SEQ ID NO: 539794 - DNA, 16 bp, G. gallus
taaaatctaacctaaa

SEQ ID NO: 539795 - DNA, 16 bp, G. gallus
taaaatggcatctgac

SEQ ID NO: 539796 - DNA, 16 bp, G. gallus
taaacaggagggagac

SEQ ID NO: 539797 - DNA, 16 bp, G. gallus
taaacaggagggggag

SEQ ID NO: 539798 - DNA, 16 bp, G. gallus
taaactgaaagaggag

SEQ ID NO: 539799 - DNA, 16 bp, G. gallus
taaactggaagaggat

SEQ ID NO: 539800 - DNA, 16 bp, G. gallus
taaacttaccctggca

SEQ ID NO: 539801 - DNA, 16 bp, G. gallus
taaagaagttttttct

SEQ ID NO: 539802 - DNA, 16 bp, G. gallus
taaagatattaaagag

SEQ ID NO: 539803 - DNA, 16 bp, G. gallus
taaaggggggctgtaa

SEQ ID NO: 539804 - DNA, 16 bp, G. gallus
taaatacctgaaggga

SEQ ID NO: 539805 - DNA, 16 bp, G. gallus
taaatatatgtatgta

SEQ ID NO: 539806 - DNA, 16 bp, G. gallus
taaatctgccctcttc

SEQ ID NO: 539807 - DNA, 16 bp, G. gallus
taaatgagaagggaga

SEQ ID NO: 539808 - DNA, 16 bp, G. gallus
taaatgcatttttaaa

SEQ ID NO: 539809 - DNA, 18 bp, G. gallus
taacaaggaggatgaagg

SEQ ID NO: 539810 - DNA, 16 bp, G. gallus
taacacccaacctgac

SEQ ID NO: 539811 - DNA, 16 bp, G. gallus
taacagtggatgtgag

SEQ ID NO: 539812 - DNA, 16 bp, G. gallus
taagatcatctagtcc

SEQ ID NO: 539813 - DNA, 16 bp, G. gallus
taagatgatcagagga

SEQ ID NO: 539814 - DNA, 16 bp, G. gallus
taagcaatcttcttcc

SEQ ID NO: 539815 - DNA, 16 bp, G. gallus
taagcaattttttttt

SEQ ID NO: 539816 - DNA, 16 bp, G. gallus
taagcagtgttgtaca

SEQ ID NO: 539817 - DNA, 16 bp, G. gallus
taagcattcagcaagc

SEQ ID NO: 539818 - DNA, 16 bp, G. gallus
taagctctcttcaagt

SEQ ID NO: 539819 - DNA, 16 bp, G. gallus
taaggaaaaggctgag

SEQ ID NO: 539820 - DNA, 16 bp, G. gallus
taaggaagaagtgttt

SEQ ID NO: 539821 - DNA, 16 bp, G. gallus
taagtttacagatgac

SEQ ID NO: 539822 - DNA, 16 bp, G. gallus
taagtttgctgatgat

SEQ ID NO: 539823 - DNA, 16 bp, G. gallus
taataaaatcatagaa

SEQ ID NO: 539824 - DNA, 16 bp, G. gallus
taatcatctttgtagc

SEQ ID NO: 539825 - DNA, 16 bp, G. gallus
taatgaatatgtatcc

SEQ ID NO: 539826 - DNA, 16 bp, G. gallus
taatgatggtgatgat

SEQ ID NO: 539827 - DNA, 16 bp, G. gallus
taatgccaggccccat

SEQ ID NO: 539828 - DNA, 16 bp, G. gallus
tacaaaagatacaaag

SEQ ID NO: 539829 - DNA, 16 bp, G. gallus
tacaaagagcacgata

SEQ ID NO: 539830 - DNA, 16 bp, G. gallus
tacaaagcattatttt

SEQ ID NO: 539831 - DNA, 16 bp, G. gallus
tacaacactgcttagc

SEQ ID NO: 539832 - DNA, 16 bp, G. gallus
tacaacatctgaatgt

SEQ ID NO: 539833 - DNA, 16 bp, G. gallus
tacaactccctgacag

SEQ ID NO: 539834 - DNA, 16 bp, G. gallus
tacaagctgggggata

SEQ ID NO: 539835 - DNA, 16 bp, G. gallus
tacacacatatatata

SEQ ID NO: 539836 - DNA, 16 bp, G. gallus
tacagcccagaaagcc

SEQ ID NO: 539837 - DNA, 16 bp, G. gallus
tacagtaggttgcaca

SEQ ID NO: 539838 - DNA, 16 bp, G. gallus
tacatacatacataca

SEQ ID NO: 539839 - DNA, 16 bp, G. gallus
tacatacatatatatg

SEQ ID NO: 539840 - DNA, 16 bp, G. gallus
tacatccctcagtgcc

SEQ ID NO: 539841 - DNA, 16 bp, G. gallus
tacatgttgttgccat

SEQ ID NO: 539842 - DNA, 16 bp, G. gallus
taccagagaaaaatat

SEQ ID NO: 539843 - DNA, 16 bp, G. gallus
taccaggacccccagg

SEQ ID NO: 539844 - DNA, 16 bp, G. gallus
taccccagaggacttt

SEQ ID NO: 539845 - DNA, 16 bp, G. gallus
taccctaactctaaca

SEQ ID NO: 539846 - DNA, 16 bp, G. gallus
tacctccagggatgga

SEQ ID NO: 539847 - DNA, 20 bp, G. gallus
tacctgcttgctgcctaagg

SEQ ID NO: 539848 - DNA, 16 bp, G. gallus
tacctgtgcagcctgc

SEQ ID NO: 539849 - DNA, 16 bp, G. gallus
tacgaggagcagctga

SEQ ID NO: 539850 - DNA, 16 bp, G. gallus
tacgattctatgatct

SEQ ID NO: 539851 - DNA, 17 bp, G. gallus
tactcagcactggtgag

SEQ ID NO: 539852 - DNA, 16 bp, G. gallus
tactgaagtccagata

SEQ ID NO: 539853 - DNA, 16 bp, G. gallus
tactgccataccacca

SEQ ID NO: 539854 - DNA, 16 bp, G. gallus
tactgctcagcaacaa

SEQ ID NO: 539855 - DNA, 16 bp, G. gallus
tactggaaggccacac

SEQ ID NO: 539856 - DNA, 16 bp, G. gallus
tactgtatgggaactg

SEQ ID NO: 539857 - DNA, 16 bp, G. gallus
tactgtgaagaagttc

SEQ ID NO: 539858 - DNA, 16 bp, G. gallus
tacttaggaaaaaaaa

SEQ ID NO: 539859 - DNA, 16 bp, G. gallus
tacttccagagcagcc

SEQ ID NO: 539860 - DNA, 17 bp, G. gallus
tacttgaaggaagctta

SEQ ID NO: 539861 - DNA, 16 bp, G. gallus
tactttcagagcagcc

SEQ ID NO: 539862 - DNA, 16 bp, G. gallus
tacttttggagcagct

SEQ ID NO: 539863 - DNA, 16 bp, G. gallus
tagaactgaacttggc

SEQ ID NO: 539864 - DNA, 16 bp, G. gallus
tagaagaggtgctcca

SEQ ID NO: 539865 - DNA, 16 bp, G. gallus
tagaatagaatcacag

SEQ ID NO: 539866 - DNA, 16 bp, G. gallus
tagaatcacagaatgg

SEQ ID NO: 539867 - DNA, 17 bp, G. gallus
tagaatcatagaatcat

SEQ ID NO: 539868 - DNA, 16 bp, G. gallus
tagaatcatagaatct

SEQ ID NO: 539869 - DNA, 16 bp, G. gallus
tagaatcatagaattg

SEQ ID NO: 539870 - DNA, 16 bp, G. gallus
tagagaagaagaggct

SEQ ID NO: 539871 - DNA, 17 bp, G. gallus
tagagtagagtagagta

SEQ ID NO: 539872 - DNA, 16 bp, G. gallus
tagagttggaagagac

SEQ ID NO: 539873 - DNA, 16 bp, G. gallus
tagatgatcttgaagg

SEQ ID NO: 539874 - DNA, 16 bp, G. gallus
tagatgtcaggaggaa

SEQ ID NO: 539875 - DNA, 16 bp, G. gallus
tagcagagtctgtggt

SEQ ID NO: 539876 - DNA, 16 bp, G. gallus
tagccttctcttctcc

SEQ ID NO: 539877 - DNA, 16 bp, G. gallus
tagctatgcattttca

SEQ ID NO: 539878 - DNA, 16 bp, G. gallus
tagctgagaattcact

SEQ ID NO: 539879 - DNA, 16 bp, G. gallus
tagcttggagaaggga

SEQ ID NO: 539880 - DNA, 16 bp, G. gallus
taggaagcattacttt

SEQ ID NO: 539881 - DNA, 16 bp, G. gallus
taggagacattatttt

SEQ ID NO: 539882 - DNA, 16 bp, G. gallus
taggaggcattacttt

SEQ ID NO: 539883 - DNA, 16 bp, G. gallus
taggttgcacaggaaa

SEQ ID NO: 539884 - DNA, 16 bp, G. gallus
tagtcacggaaccagg

SEQ ID NO: 539885 - DNA, 16 bp, G. gallus
tagtgaagcactggaa

SEQ ID NO: 539886 - DNA, 16 bp, G. gallus
tagtgacaggataagg

SEQ ID NO: 539887 - DNA, 16 bp, G. gallus
tagtgcaaattctcag

SEQ ID NO: 539888 - DNA, 16 bp, G. gallus
tagtgtccatcctccc

SEQ ID NO: 539889 - DNA, 16 bp, G. gallus
tagtttaaaactgttt

SEQ ID NO: 539890 - DNA, 16 bp, G. gallus
tataaaagcatttact

SEQ ID NO: 539891 - DNA, 16 bp, G. gallus
tataaacaggaggggg

SEQ ID NO: 539892 - DNA, 16 bp, G. gallus
tataaaggaagggaag

SEQ ID NO: 539893 - DNA, 16 bp, G. gallus
tatacacacacacaca

SEQ ID NO: 539894 - DNA, 16 bp, G. gallus
tatacacacacataca

SEQ ID NO: 539895 - DNA, 16 bp, G. gallus
tatacacacatacaca

SEQ ID NO: 539896 - DNA, 16 bp, G. gallus
tatacatatatacatg

SEQ ID NO: 539897 - DNA, 16 bp, G. gallus
tatacatatatataca

SEQ ID NO: 539898 - DNA, 16 bp, G. gallus
tatacatatgtataca

SEQ ID NO: 539899 - DNA, 16 bp, G. gallus
tatacctggcatgaga

SEQ ID NO: 539900 - DNA, 16 bp, G. gallus
tatatacacacacaca

SEQ ID NO: 539901 - DNA, 16 bp, G. gallus
tatatatacacacaca

SEQ ID NO: 539902 - DNA, 16 bp, G. gallus
tatatatacacacata

SEQ ID NO: 539903 - DNA, 16 bp, G. gallus
tatatatacatatatg

SEQ ID NO: 539904 - DNA, 16 bp, G. gallus
tatatatacatatgta

SEQ ID NO: 539905 - DNA, 16 bp, G. gallus
tatatatatataagca

SEQ ID NO: 539906 - DNA, 16 bp, G. gallus
tatatatatatacaca

SEQ ID NO: 539907 - DNA, 16 bp, G. gallus
tatatatatatatgct

SEQ ID NO: 539908 - DNA, 16 bp, G. gallus
tatatatatgcacata

SEQ ID NO: 539909 - DNA, 16 bp, G. gallus
tatatatatgtacaca

SEQ ID NO: 539910 - DNA, 16 bp, G. gallus
tatatatatgtataca

SEQ ID NO: 539911 - DNA, 16 bp, G. gallus
tatatatatttctgtt

SEQ ID NO: 539912 - DNA, 16 bp, G. gallus
tatatatgcatacata

SEQ ID NO: 539913 - DNA, 16 bp, G. gallus
tatatatgcatatata

SEQ ID NO: 539914 - DNA, 16 bp, G. gallus
tatatatgtatatatg

SEQ ID NO: 539915 - DNA, 16 bp, G. gallus
tatatgcatgcatata

SEQ ID NO: 539916 - DNA, 16 bp, G. gallus
tatatgtatatacata

SEQ ID NO: 539917 - DNA, 16 bp, G. gallus
tatatgtatgcatata

SEQ ID NO: 539918 - DNA, 16 bp, G. gallus
tatcaggaagaaatta

SEQ ID NO: 539919 - DNA, 16 bp, G. gallus
tatcccagcagatatc

SEQ ID NO: 539920 - DNA, 16 bp, G. gallus
tatcccttctgaagag

SEQ ID NO: 539921 - DNA, 16 bp, G. gallus
tatctatctatttatc

SEQ ID NO: 539922 - DNA, 16 bp, G. gallus
tatctgggattgcccc

SEQ ID NO: 539923 - DNA, 17 bp, G. gallus
tatcttgcattctgata

SEQ ID NO: 539924 - DNA, 16 bp, G. gallus
tatctttgaggtcctt

SEQ ID NO: 539925 - DNA, 16 bp, G. gallus
tatcttttctattgcc

SEQ ID NO: 539926 - DNA, 16 bp, G. gallus
tatgaagaaatgttga

SEQ ID NO: 539927 - DNA, 16 bp, G. gallus
tatgaagaaattcttt

SEQ ID NO: 539928 - DNA, 16 bp, G. gallus
tatgaagatggtgaag

SEQ ID NO: 539929 - DNA, 16 bp, G. gallus
tatgaagcaaaggtgt

SEQ ID NO: 539930 - DNA, 16 bp, G. gallus
tatgagaagcagctga

SEQ ID NO: 539931 - DNA, 16 bp, G. gallus
tatgcatatatatatt

SEQ ID NO: 539932 - DNA, 16 bp, G. gallus
tatgcatgtgtgtgtg

SEQ ID NO: 539933 - DNA, 16 bp, G. gallus
tatgcattttcaccaa

SEQ ID NO: 539934 - DNA, 16 bp, G. gallus
tatgcattttgataca

SEQ ID NO: 539935 - DNA, 16 bp, G. gallus
tatgctccagtttatg

SEQ ID NO: 539936 - DNA, 16 bp, G. gallus
tatggagactgaacag

SEQ ID NO: 539937 - DNA, 16 bp, G. gallus
tatggatttgaaggct

SEQ ID NO: 539938 - DNA, 16 bp, G. gallus
tatggcaaacaggtat

SEQ ID NO: 539939 - DNA, 16 bp, G. gallus
tatgtacatacacaca

SEQ ID NO: 539940 - DNA, 16 bp, G. gallus
tatgtatacatatatt

SEQ ID NO: 539941 - DNA, 16 bp, G. gallus
tatgtatatgtataaa

SEQ ID NO: 539942 - DNA, 16 bp, G. gallus
tatgtatatgtatgta

SEQ ID NO: 539943 - DNA, 16 bp, G. gallus
tatgtatgtatatata

SEQ ID NO: 539944 - DNA, 16 bp, G. gallus
tatgtatgtgtgtgtg

SEQ ID NO: 539945 - DNA, 16 bp, G. gallus
tatgtgtatgtatgtg

SEQ ID NO: 539946 - DNA, 16 bp, G. gallus
tatgtgtgtgtatata

SEQ ID NO: 539947 - DNA, 16 bp, G. gallus
tatgttttgttgctgt

SEQ ID NO: 539948 - DNA, 16 bp, G. gallus
tattaaacatctgttt

SEQ ID NO: 539949 - DNA, 17 bp, G. gallus
tattaggaagaagtttt

SEQ ID NO: 539950 - DNA, 16 bp, G. gallus
tattattgctattatt

SEQ ID NO: 539951 - DNA, 16 bp, G. gallus
tattcaagacccagct

SEQ ID NO: 539952 - DNA, 16 bp, G. gallus
tattcagcctgaagaa

SEQ ID NO: 539953 - DNA, 20 bp, G. gallus
tattccacatcataacatca

SEQ ID NO: 539954 - DNA, 16 bp, G. gallus
tattcctgatacaagc

SEQ ID NO: 539955 - DNA, 16 bp, G. gallus
tattgatgaatgtcaa

SEQ ID NO: 539956 - DNA, 16 bp, G. gallus
tattgtattacagtgt

SEQ ID NO: 539957 - DNA, 16 bp, G. gallus
tatttaacatctttgt

SEQ ID NO: 539958 - DNA, 16 bp, G. gallus
tatttatgtatgtatg

SEQ ID NO: 539959 - DNA, 16 bp, G. gallus
tatttcctaatgtcca

SEQ ID NO: 539960 - DNA, 16 bp, G. gallus
tatttgacagagcaaa

SEQ ID NO: 539961 - DNA, 16 bp, G. gallus
tatttgatttattagc

SEQ ID NO: 539962 - DNA, 16 bp, G. gallus
tatttttcaatgtagt

SEQ ID NO: 539963 - DNA, 16 bp, G. gallus
tcaaactgaagagcaa

SEQ ID NO: 539964 - DNA, 17 bp, G. gallus
tcaaaggctttgctgaa

SEQ ID NO: 539965 - DNA, 16 bp, G. gallus
tcaaatccacatctct

SEQ ID NO: 539966 - DNA, 16 bp, G. gallus
tcaacaagaccaagtg

SEQ ID NO: 539967 - DNA, 16 bp, G. gallus
tcaacagctcagtgtc

SEQ ID NO: 539968 - DNA, 16 bp, G. gallus
tcaacagttcccatac

SEQ ID NO: 539969 - DNA, 16 bp, G. gallus
tcaacatcactgtgtg

SEQ ID NO: 539970 - DNA, 16 bp, G. gallus
tcaacatcttcatcaa

SEQ ID NO: 539971 - DNA, 16 bp, G. gallus
tcaacattgtttttct

SEQ ID NO: 539972 - DNA, 16 bp, G. gallus
tcaaccttttctcata

SEQ ID NO: 539973 - DNA, 17 bp, G. gallus
tcaactgttcccataca

SEQ ID NO: 539974 - DNA, 16 bp, G. gallus
tcaagacccagctgga

SEQ ID NO: 539975 - DNA, 16 bp, G. gallus
tcaagatcaggctgga

SEQ ID NO: 539976 - DNA, 16 bp, G. gallus
tcaagattgctgaaaa

SEQ ID NO: 539977 - DNA, 16 bp, G. gallus
tcaaggaagagatgca

SEQ ID NO: 539978 - DNA, 16 bp, G. gallus
tcaaggccaagctgga

SEQ ID NO: 539979 - DNA, 16 bp, G. gallus
tcaaggccagattgga

SEQ ID NO: 539980 - DNA, 16 bp, G. gallus
tcaaggtcaggttgga

SEQ ID NO: 539981 - DNA, 16 bp, G. gallus
tcaagtccaaccacag

SEQ ID NO: 539982 - DNA, 16 bp, G. gallus
tcaatcaatcaatcaa

SEQ ID NO: 539983 - DNA, 18 bp, G. gallus
tcaatcagaggttcaggc

SEQ ID NO: 539984 - DNA, 16 bp, G. gallus
tcaatcagtggttcag

SEQ ID NO: 539985 - DNA, 16 bp, G. gallus
tcaatcatcagttcag

SEQ ID NO: 539986 - DNA, 16 bp, G. gallus
tcaatcccctcatcta

SEQ ID NO: 539987 - DNA, 16 bp, G. gallus
tcacaagttttctttt

SEQ ID NO: 539988 - DNA, 16 bp, G. gallus
tcacacagcaacaaaa

SEQ ID NO: 539989 - DNA, 16 bp, G. gallus
tcacagaaccacagaa

SEQ ID NO: 539990 - DNA, 16 bp, G. gallus
tcacagagtcattaag

SEQ ID NO: 539991 - DNA, 16 bp, G. gallus
tcacagatcacagaat

SEQ ID NO: 539992 - DNA, 16 bp, G. gallus
tcacagattcacagaa

SEQ ID NO: 539993 - DNA, 16 bp, G. gallus
tcacaggcaaaacaga

SEQ ID NO: 539994 - DNA, 16 bp, G. gallus
tcacatccactgtctg

SEQ ID NO: 539995 - DNA, 16 bp, G. gallus
tcaccaactgcatgaa

SEQ ID NO: 539996 - DNA, 16 bp, G. gallus
tcaccaccatcacagt

SEQ ID NO: 539997 - DNA, 16 bp, G. gallus
tcaccaccctctgcat

SEQ ID NO: 539998 - DNA, 18 bp, G. gallus
tcaccaccctctgggtga

SEQ ID NO: 539999 - DNA, 16 bp, G. gallus
tcaccactcttactgt

SEQ ID NO: 540000 - DNA, 16 bp, G. gallus
tcaccagagatgaaca

SEQ ID NO: 540001 - DNA, 16 bp, G. gallus
tcaccatccctgcagg

SEQ ID NO: 540002 - DNA, 16 bp, G. gallus
tcaccctcagcaagtt

SEQ ID NO: 540003 - DNA, 16 bp, G. gallus
tcacctccctgccttc

SEQ ID NO: 540004 - DNA, 16 bp, G. gallus
tcacctctgctgctgc

SEQ ID NO: 540005 - DNA, 16 bp, G. gallus
tcactcaggtacattg

SEQ ID NO: 540006 - DNA, 17 bp, G. gallus
tcactcaggtgaaattg

SEQ ID NO: 540007 - DNA, 16 bp, G. gallus
tcactgagtccaactg

SEQ ID NO: 540008 - DNA, 16 bp, G. gallus
tcactgatgaagatat

SEQ ID NO: 540009 - DNA, 16 bp, G. gallus
tcactgcagaggagtt

SEQ ID NO: 540010 - DNA, 16 bp, G. gallus
tcactggaacaggttg

SEQ ID NO: 540011 - DNA, 16 bp, G. gallus
tcactggttcaagctg

SEQ ID NO: 540012 - DNA, 16 bp, G. gallus
tcactgtagaagactt

SEQ ID NO: 540013 - DNA, 16 bp, G. gallus
tcactgtcaccagaga

SEQ ID NO: 540014 - DNA, 16 bp, G. gallus
tcacttctctgctcct

SEQ ID NO: 540015 - DNA, 16 bp, G. gallus
tcagaaaaaaataatt

SEQ ID NO: 540016 - DNA, 16 bp, G. gallus
tcagaagagaagaatg

SEQ ID NO: 540017 - DNA, 16 bp, G. gallus
tcagaagctgcctgga

SEQ ID NO: 540018 - DNA, 16 bp, G. gallus
tcagaaggccaactgt

SEQ ID NO: 540019 - DNA, 16 bp, G. gallus
tcagaatatatatata

SEQ ID NO: 540020 - DNA, 16 bp, G. gallus
tcagacacagggtttg

SEQ ID NO: 540021 - DNA, 16 bp, G. gallus
tcagacactattttgt

SEQ ID NO: 540022 - DNA, 16 bp, G. gallus
tcagacatagaaaaag

SEQ ID NO: 540023 - DNA, 16 bp, G. gallus
tcagacatagggtttg

SEQ ID NO: 540024 - DNA, 16 bp, G. gallus
tcagagcagagcagag

SEQ ID NO: 540025 - DNA, 16 bp, G. gallus
tcagagcagccctcac

SEQ ID NO: 540026 - DNA, 16 bp, G. gallus
tcagagcagctcttgt

SEQ ID NO: 540027 - DNA, 16 bp, G. gallus
tcagagccttctcttt

SEQ ID NO: 540028 - DNA, 16 bp, G. gallus
tcagaggacagtgagg

SEQ ID NO: 540029 - DNA, 16 bp, G. gallus
tcagagggcagtgagg

SEQ ID NO: 540030 - DNA, 16 bp, G. gallus
tcagagggtggtgagg

SEQ ID NO: 540031 - DNA, 16 bp, G. gallus
tcagagtgtggtgagg

SEQ ID NO: 540032 - DNA, 16 bp, G. gallus
tcagatactgaaaggc

SEQ ID NO: 540033 - DNA, 16 bp, G. gallus
tcagatattggaagag

SEQ ID NO: 540034 - DNA, 16 bp, G. gallus
tcagcaagtctgctga

SEQ ID NO: 540035 - DNA, 16 bp, G. gallus
tcagcaatggcaacag

SEQ ID NO: 540036 - DNA, 16 bp, G. gallus
tcagcagaaactcctt

SEQ ID NO: 540037 - DNA, 16 bp, G. gallus
tcagcagcagcagcag

SEQ ID NO: 540038 - DNA, 16 bp, G. gallus
tcagcagcagtgacag

SEQ ID NO: 540039 - DNA, 16 bp, G. gallus
tcagcagggctgcact

SEQ ID NO: 540040 - DNA, 16 bp, G. gallus
tcagcagtggcagcag

SEQ ID NO: 540041 - DNA, 16 bp, G. gallus
tcagcagtgtgccctg

SEQ ID NO: 540042 - DNA, 16 bp, G. gallus
tcagcagtgtgtgctt

SEQ ID NO: 540043 - DNA, 16 bp, G. gallus
tcagcatcttcatcag

SEQ ID NO: 540044 - DNA, 16 bp, G. gallus
tcagcattcctggtca

SEQ ID NO: 540045 - DNA, 16 bp, G. gallus
tcagccacttccagga

SEQ ID NO: 540046 - DNA, 16 bp, G. gallus
tcagcctagagaagag

SEQ ID NO: 540047 - DNA, 16 bp, G. gallus
tcagcctggagaggag

SEQ ID NO: 540048 - DNA, 16 bp, G. gallus
tcagcgtggagaagag

SEQ ID NO: 540049 - DNA, 16 bp, G. gallus
tcagctctttcagcct

SEQ ID NO: 540050 - DNA, 16 bp, G. gallus
tcagctgcattgcatg

SEQ ID NO: 540051 - DNA, 16 bp, G. gallus
tcagctgctcctcaca

SEQ ID NO: 540052 - DNA, 16 bp, G. gallus
tcagctgtggtgacag

SEQ ID NO: 540053 - DNA, 16 bp, G. gallus
tcagcttagtgtcatc

SEQ ID NO: 540054 - DNA, 16 bp, G. gallus
tcagcttggagaagaa

SEQ ID NO: 540055 - DNA, 16 bp, G. gallus
tcagctttttctatgt

SEQ ID NO: 540056 - DNA, 16 bp, G. gallus
tcaggaacatgattta

SEQ ID NO: 540057 - DNA, 16 bp, G. gallus
tcaggaactgtggaga

SEQ ID NO: 540058 - DNA, 16 bp, G. gallus
tcaggaccctgaactt

SEQ ID NO: 540059 - DNA, 16 bp, G. gallus
tcaggcagtggaatgg

SEQ ID NO: 540060 - DNA, 16 bp, G. gallus
tcaggctgcccaggac

SEQ ID NO: 540061 - DNA, 16 bp, G. gallus
tcaggctgcccagggc

SEQ ID NO: 540062 - DNA, 16 bp, G. gallus
tcaggctggaggggct

SEQ ID NO: 540063 - DNA, 16 bp, G. gallus
tcaggctgtccagggc

SEQ ID NO: 540064 - DNA, 16 bp, G. gallus
tcaggggaaagttttt

SEQ ID NO: 540065 - DNA, 17 bp, G. gallus
tcaggggagaccttatc

SEQ ID NO: 540066 - DNA, 16 bp, G. gallus
tcagggggaaaaaaaa

SEQ ID NO: 540067 - DNA, 16 bp, G. gallus
tcaggtgcaagcagtg

SEQ ID NO: 540068 - DNA, 16 bp, G. gallus
tcaggtgctcagagcc

SEQ ID NO: 540069 - DNA, 16 bp, G. gallus
tcaggttgcttagagc

SEQ ID NO: 540070 - DNA, 16 bp, G. gallus
tcagtaagtttgaaga

SEQ ID NO: 540071 - DNA, 16 bp, G. gallus
tcagtgacctggatga

SEQ ID NO: 540072 - DNA, 16 bp, G. gallus
tcagtgcagagcagag

SEQ ID NO: 540073 - DNA, 16 bp, G. gallus
tcagtgcagggagtgg

SEQ ID NO: 540074 - DNA, 16 bp, G. gallus
tcagtgccacatctgc

SEQ ID NO: 540075 - DNA, 17 bp, G. gallus
tcagtgctggggcctgt

SEQ ID NO: 540076 - DNA, 16 bp, G. gallus
tcagtgtgctcacatc

SEQ ID NO: 540077 - DNA, 16 bp, G. gallus
tcagtttggaaaagac

SEQ ID NO: 540078 - DNA, 16 bp, G. gallus
tcataaatcatagaat

SEQ ID NO: 540079 - DNA, 16 bp, G. gallus
tcatagaaacattaag

SEQ ID NO: 540080 - DNA, 16 bp, G. gallus
tcataggatcacagaa

SEQ ID NO: 540081 - DNA, 16 bp, G. gallus
tcatcaagatcattaa

SEQ ID NO: 540082 - DNA, 16 bp, G. gallus
tcatcaagatcgttaa

SEQ ID NO: 540083 - DNA, 16 bp, G. gallus
tcatcatcatcatctt

SEQ ID NO: 540084 - DNA, 16 bp, G. gallus
tcatccactgaacagt

SEQ ID NO: 540085 - DNA, 16 bp, G. gallus
tcatctaccaggaccc

SEQ ID NO: 540086 - DNA, 16 bp, G. gallus
tcatctcgctgctgct

SEQ ID NO: 540087 - DNA, 16 bp, G. gallus
tcatctgtctcttcat

SEQ ID NO: 540088 - DNA, 16 bp, G. gallus
tcatgaagttcacctg

SEQ ID NO: 540089 - DNA, 16 bp, G. gallus
tcatggagcagatcct

SEQ ID NO: 540090 - DNA, 16 bp, G. gallus
tcatggcagctgcagc

SEQ ID NO: 540091 - DNA, 16 bp, G. gallus
tcatgggggacttcaa

SEQ ID NO: 540092 - DNA, 16 bp, G. gallus
tcatggtcagagaagg

SEQ ID NO: 540093 - DNA, 16 bp, G. gallus
tcatgtccagcttttt

SEQ ID NO: 540094 - DNA, 16 bp, G. gallus
tcatgttcctgagcac

SEQ ID NO: 540095 - DNA, 16 bp, G. gallus
tcattaatgttggaaa

SEQ ID NO: 540096 - DNA, 16 bp, G. gallus
tcattagggttggaaa

SEQ ID NO: 540097 - DNA, 16 bp, G. gallus
tcattatatttgattt

SEQ ID NO: 540098 - DNA, 16 bp, G. gallus
tcattcattcattcat

SEQ ID NO: 540099 - DNA, 16 bp, G. gallus
tcattgaatggcttgg

SEQ ID NO: 540100 - DNA, 16 bp, G. gallus
tcattgcagccttcca

SEQ ID NO: 540101 - DNA, 16 bp, G. gallus
tcattgctgctgtttt

SEQ ID NO: 540102 - DNA, 16 bp, G. gallus
tcattgtccctggagg

SEQ ID NO: 540103 - DNA, 16 bp, G. gallus
tcattgtggtcctttt

SEQ ID NO: 540104 - DNA, 16 bp, G. gallus
tcatttaagaaaaaaa

SEQ ID NO: 540105 - DNA, 16 bp, G. gallus
tcatttggaaaaaaaa

SEQ ID NO: 540106 - DNA, 16 bp, G. gallus
tcattttggtcctttt

SEQ ID NO: 540107 - DNA, 16 bp, G. gallus
tcattttgtgtgtgtg

SEQ ID NO: 540108 - DNA, 16 bp, G. gallus
tccaaaagcaatgcct

SEQ ID NO: 540109 - DNA, 16 bp, G. gallus
tccaaaagctgcctgg

SEQ ID NO: 540110 - DNA, 16 bp, G. gallus
tccaaccactgaccca

SEQ ID NO: 540111 - DNA, 16 bp, G. gallus
tccaacccctctgctg

SEQ ID NO: 540112 - DNA, 16 bp, G. gallus
tccaaccgtcctccca

SEQ ID NO: 540113 - DNA, 16 bp, G. gallus
tccaacctaagtcatt

SEQ ID NO: 540114 - DNA, 16 bp, G. gallus
tccaacctccctgcca

SEQ ID NO: 540115 - DNA, 16 bp, G. gallus
tccaacctgaacctcc

SEQ ID NO: 540116 - DNA, 16 bp, G. gallus
tccaacctttatgatt

SEQ ID NO: 540117 - DNA, 16 bp, G. gallus
tccaaccttttggctt

SEQ ID NO: 540118 - DNA, 16 bp, G. gallus
tccaactcccctgaaa

SEQ ID NO: 540119 - DNA, 16 bp, G. gallus
tccaactcttggctcc

SEQ ID NO: 540120 - DNA, 16 bp, G. gallus
tccaacttgagatatt

SEQ ID NO: 540121 - DNA, 22 bp, G. gallus
tccaagccgggcgccttcatca

SEQ ID NO: 540122 - DNA, 16 bp, G. gallus
tccacaacatcagagg

SEQ ID NO: 540123 - DNA, 16 bp, G. gallus
tccacagaactgcagc

SEQ ID NO: 540124 - DNA, 17 bp, G. gallus
tccaccacatggagctt

SEQ ID NO: 540125 - DNA, 16 bp, G. gallus
tccaccacctctctgg

SEQ ID NO: 540126 - DNA, 16 bp, G. gallus
tccaccaggacctcca

SEQ ID NO: 540127 - DNA, 16 bp, G. gallus
tccaccaggatcccca

SEQ ID NO: 540128 - DNA, 16 bp, G. gallus
tccaccctcacaaaca

SEQ ID NO: 540129 - DNA, 16 bp, G. gallus
tccacctctgacactg

SEQ ID NO: 540130 - DNA, 16 bp, G. gallus
tccactagatcaggtt

SEQ ID NO: 540131 - DNA, 16 bp, G. gallus
tccactgatgctgtca

SEQ ID NO: 540132 - DNA, 16 bp, G. gallus
tccagacccttcccca

SEQ ID NO: 540133 - DNA, 16 bp, G. gallus
tccagacgggtcttga

SEQ ID NO: 540134 - DNA, 16 bp, G. gallus
tccagagaagagccac

SEQ ID NO: 540135 - DNA, 16 bp, G. gallus
tccagagaaggaaact

SEQ ID NO: 540136 - DNA, 16 bp, G. gallus
tccagagagacctaga

SEQ ID NO: 540137 - DNA, 16 bp, G. gallus
tccagaggagggccac

SEQ ID NO: 540138 - DNA, 16 bp, G. gallus
tccagaggtcccttct

SEQ ID NO: 540139 - DNA, 16 bp, G. gallus
tccagaggtccctttc

SEQ ID NO: 540140 - DNA, 16 bp, G. gallus
tccagagtcaggccag

SEQ ID NO: 540141 - DNA, 16 bp, G. gallus
tccagatggccatgca

SEQ ID NO: 540142 - DNA, 16 bp, G. gallus
tccagatggggcctca

SEQ ID NO: 540143 - DNA, 16 bp, G. gallus
tccagcaaagcactta

SEQ ID NO: 540144 - DNA, 16 bp, G. gallus
tccagcacctcatcac

SEQ ID NO: 540145 - DNA, 16 bp, G. gallus
tccagcaccttaccac

SEQ ID NO: 540146 - DNA, 16 bp, G. gallus
tccagccaaccaattc

SEQ ID NO: 540147 - DNA, 16 bp, G. gallus
tccagcctgaacctct

SEQ ID NO: 540148 - DNA, 16 bp, G. gallus
tccagctctctgatca

SEQ ID NO: 540149 - DNA, 16 bp, G. gallus
tccagcttggccttga

SEQ ID NO: 540150 - DNA, 16 bp, G. gallus
tccagcttttcatcca

SEQ ID NO: 540151 - DNA, 16 bp, G. gallus
tccaggaaaagaaaaa

SEQ ID NO: 540152 - DNA, 17 bp, G. gallus
tccaggacaagtctggg

SEQ ID NO: 540153 - DNA, 16 bp, G. gallus
tccaggcccttcatca

SEQ ID NO: 540154 - DNA, 16 bp, G. gallus
tccaggctgaacaagc

SEQ ID NO: 540155 - DNA, 16 bp, G. gallus
tccagggtcagtgact

SEQ ID NO: 540156 - DNA, 16 bp, G. gallus
tccaggtccttctgga

SEQ ID NO: 540157 - DNA, 16 bp, G. gallus
tccaggttccaggaaa

SEQ ID NO: 540158 - DNA, 16 bp, G. gallus
tccagtacctgaagag

SEQ ID NO: 540159 - DNA, 16 bp, G. gallus
tccagtccaaccactc

SEQ ID NO: 540160 - DNA, 16 bp, G. gallus
tccagtgcctcaccac

SEQ ID NO: 540161 - DNA, 16 bp, G. gallus
tccagtttggagagaa

SEQ ID NO: 540162 - DNA, 16 bp, G. gallus
tccagtttgtgcccat

SEQ ID NO: 540163 - DNA, 16 bp, G. gallus
tccatcacccacacag

SEQ ID NO: 540164 - DNA, 16 bp, G. gallus
tccatcacttctctgg

SEQ ID NO: 540165 - DNA, 16 bp, G. gallus
tccatccccaccatgc

SEQ ID NO: 540166 - DNA, 16 bp, G. gallus
tccatcccttggatca

SEQ ID NO: 540167 - DNA, 16 bp, G. gallus
tccatgaagaaattct

SEQ ID NO: 540168 - DNA, 16 bp, G. gallus
tccatgcagaaaaaat

SEQ ID NO: 540169 - DNA, 16 bp, G. gallus
tccatggaaattaata

SEQ ID NO: 540170 - DNA, 17 bp, G. gallus
tccatgtggtggaattc

SEQ ID NO: 540171 - DNA, 16 bp, G. gallus
tccattgatgcagtta

SEQ ID NO: 540172 - DNA, 16 bp, G. gallus
tcccaaccccctgcca

SEQ ID NO: 540173 - DNA, 16 bp, G. gallus
tcccagagcacaccca

SEQ ID NO: 540174 - DNA, 16 bp, G. gallus
tcccagcagcagcagc

SEQ ID NO: 540175 - DNA, 16 bp, G. gallus
tcccagctctctcagt

SEQ ID NO: 540176 - DNA, 16 bp, G. gallus
tcccagggctgaccgg

SEQ ID NO: 540177 - DNA, 16 bp, G. gallus
tcccagtgctcccagt

SEQ ID NO: 540178 - DNA, 16 bp, G. gallus
tcccatccctggagac

SEQ ID NO: 540179 - DNA, 16 bp, G. gallus
tcccatttaaaaaaaa

SEQ ID NO: 540180 - DNA, 16 bp, G. gallus
tccccagagtcttctc

SEQ ID NO: 540181 - DNA, 16 bp, G. gallus
tccccaggcagcccat

SEQ ID NO: 540182 - DNA, 16 bp, G. gallus
tccccagggcagagca

SEQ ID NO: 540183 - DNA, 16 bp, G. gallus
tcccccatcccactgg

SEQ ID NO: 540184 - DNA, 16 bp, G. gallus
tccccctctactcagc

SEQ ID NO: 540185 - DNA, 16 bp, G. gallus
tcccctctgctcagca

SEQ ID NO: 540186 - DNA, 16 bp, G. gallus
tcccctcttgtagttt

SEQ ID NO: 540187 - DNA, 16 bp, G. gallus
tcccctcttttagttt

SEQ ID NO: 540188 - DNA, 16 bp, G. gallus
tcccctgcctcagttt

SEQ ID NO: 540189 - DNA, 16 bp, G. gallus
tcccctggcacaactt

SEQ ID NO: 540190 - DNA, 16 bp, G. gallus
tcccctggcacagctc

SEQ ID NO: 540191 - DNA, 16 bp, G. gallus
tcccctgggatgctgt

SEQ ID NO: 540192 - DNA, 16 bp, G. gallus
tccctcagcctttctt

SEQ ID NO: 540193 - DNA, 16 bp, G. gallus
tccctcagtacaacat

SEQ ID NO: 540194 - DNA, 16 bp, G. gallus
tccctctctactctgc

SEQ ID NO: 540195 - DNA, 16 bp, G. gallus
tccctctctgcagagc

SEQ ID NO: 540196 - DNA, 16 bp, G. gallus
tccctgaaggcactca

SEQ ID NO: 540197 - DNA, 16 bp, G. gallus
tccctgagcagcctgt

SEQ ID NO: 540198 - DNA, 16 bp, G. gallus
tccctgcactgagcag

SEQ ID NO: 540199 - DNA, 18 bp, G. gallus
tccctgcagcccttcttg

SEQ ID NO: 540200 - DNA, 16 bp, G. gallus
tccctgcctgcctgcc

SEQ ID NO: 540201 - DNA, 16 bp, G. gallus
tccctgctcaagcagg

SEQ ID NO: 540202 - DNA, 16 bp, G. gallus
tccctgctcactgcag

SEQ ID NO: 540203 - DNA, 16 bp, G. gallus
tccctggagacattca

SEQ ID NO: 540204 - DNA, 16 bp, G. gallus
tccctggagatgccca

SEQ ID NO: 540205 - DNA, 16 bp, G. gallus
tccctggaggagttca

SEQ ID NO: 540206 - DNA, 16 bp, G. gallus
tccctggaggtgctca

SEQ ID NO: 540207 - DNA, 16 bp, G. gallus
tccctgggcagcagtg

SEQ ID NO: 540208 - DNA, 16 bp, G. gallus
tccctgggccagccac

SEQ ID NO: 540209 - DNA, 16 bp, G. gallus
tccctgtccttcttga

SEQ ID NO: 540210 - DNA, 16 bp, G. gallus
tcccttccaacccaaa

SEQ ID NO: 540211 - DNA, 16 bp, G. gallus
tcccttccaacccctg

SEQ ID NO: 540212 - DNA, 16 bp, G. gallus
tcccttccaacccttg

SEQ ID NO: 540213 - DNA, 16 bp, G. gallus
tcccttccaacctcaa

SEQ ID NO: 540214 - DNA, 16 bp, G. gallus
tcccttccaactgaaa

SEQ ID NO: 540215 - DNA, 16 bp, G. gallus
tcccttccttctgtca

SEQ ID NO: 540216 - DNA, 16 bp, G. gallus
tccgtccctggaggtg

SEQ ID NO: 540217 - DNA, 16 bp, G. gallus
tcctaaggaaaaaaaa

SEQ ID NO: 540218 - DNA, 16 bp, G. gallus
tcctaatatccaacct

SEQ ID NO: 540219 - DNA, 16 bp, G. gallus
tcctattttatcatgt

SEQ ID NO: 540220 - DNA, 16 bp, G. gallus
tcctcagagctgctct

SEQ ID NO: 540221 - DNA, 16 bp, G. gallus
tcctcatcatctttgt

SEQ ID NO: 540222 - DNA, 16 bp, G. gallus
tcctccagccctctga

SEQ ID NO: 540223 - DNA, 16 bp, G. gallus
tcctcccattaccatt

SEQ ID NO: 540224 - DNA, 16 bp, G. gallus
tcctcctccatctgga

SEQ ID NO: 540225 - DNA, 16 bp, G. gallus
tcctcttctccagacc

SEQ ID NO: 540226 - DNA, 16 bp, G. gallus
tcctgcatggagccag

SEQ ID NO: 540227 - DNA, 16 bp, G. gallus
tcctgccaattgttag

SEQ ID NO: 540228 - DNA, 16 bp, G. gallus
tcctgccttcctgcct

SEQ ID NO: 540229 - DNA, 16 bp, G. gallus
tcctgctgctgctgcc

SEQ ID NO: 540230 - DNA, 16 bp, G. gallus
tcctgctgctgctgct

SEQ ID NO: 540231 - DNA, 16 bp, G. gallus
tcctgctggcagcact

SEQ ID NO: 540232 - DNA, 22 bp, G. gallus
tcctgctggccacactatttct

SEQ ID NO: 540233 - DNA, 16 bp, G. gallus
tcctggagaagagaag

SEQ ID NO: 540234 - DNA, 16 bp, G. gallus
tcctggccaccagtga

SEQ ID NO: 540235 - DNA, 16 bp, G. gallus
tcctggctccacacag

SEQ ID NO: 540236 - DNA, 16 bp, G. gallus
tcctgggaggaataca

SEQ ID NO: 540237 - DNA, 16 bp, G. gallus
tcctgggcaacctgct

SEQ ID NO: 540238 - DNA, 16 bp, G. gallus
tcctgggcagcctgag

SEQ ID NO: 540239 - DNA, 16 bp, G. gallus
tcctgggcagcctggt

SEQ ID NO: 540240 - DNA, 16 bp, G. gallus
tcctgtcactgttacc

SEQ ID NO: 540241 - DNA, 16 bp, G. gallus
tcctgtgctccagttt

SEQ ID NO: 540242 - DNA, 16 bp, G. gallus
tcctgtggagaaggac

SEQ ID NO: 540243 - DNA, 16 bp, G. gallus
tcctgtgtggaggcag

SEQ ID NO: 540244 - DNA, 16 bp, G. gallus
tcctgtgttcaagttt

SEQ ID NO: 540245 - DNA, 16 bp, G. gallus
tcctgtgttgcagttt

SEQ ID NO: 540246 - DNA, 16 bp, G. gallus
tccttaaaaaagaaaa

SEQ ID NO: 540247 - DNA, 16 bp, G. gallus
tccttcagagaagaaa

SEQ ID NO: 540248 - DNA, 16 bp, G. gallus
tccttcagccactcct

SEQ ID NO: 540249 - DNA, 16 bp, G. gallus
tccttcctcttggagc

SEQ ID NO: 540250 - DNA, 16 bp, G. gallus
tccttcctgtactggg

SEQ ID NO: 540251 - DNA, 16 bp, G. gallus
tccttctatgaagata

SEQ ID NO: 540252 - DNA, 16 bp, G. gallus
tccttctgtcatcaca

SEQ ID NO: 540253 - DNA, 17 bp, G. gallus
tccttcttaaagagcaa

SEQ ID NO: 540254 - DNA, 16 bp, G. gallus
tccttgaacatctcca

SEQ ID NO: 540255 - DNA, 16 bp, G. gallus
tccttgagcagctgga

SEQ ID NO: 540256 - DNA, 16 bp, G. gallus
tccttggagatactca

SEQ ID NO: 540257 - DNA, 16 bp, G. gallus
tccttggtgaagcttt

SEQ ID NO: 540258 - DNA, 16 bp, G. gallus
tcctttaaaaagaaaa

SEQ ID NO: 540259 - DNA, 16 bp, G. gallus
tccttttcctccatgc

SEQ ID NO: 540260 - DNA, 16 bp, G. gallus
tcctttttggagtttt

SEQ ID NO: 540261 - DNA, 16 bp, G. gallus
tcgagctgctctccag

SEQ ID NO: 540262 - DNA, 16 bp, G. gallus
tctaagatcaagtcca

SEQ ID NO: 540263 - DNA, 16 bp, G. gallus
tctaagttaaaaaaaa

SEQ ID NO: 540264 - DNA, 16 bp, G. gallus
tctacagcttcctgaa

SEQ ID NO: 540265 - DNA, 16 bp, G. gallus
tctaccccaagcctgt

SEQ ID NO: 540266 - DNA, 16 bp, G. gallus
tctacttggctcttgt

SEQ ID NO: 540267 - DNA, 16 bp, G. gallus
tctagagagagtccag

SEQ ID NO: 540268 - DNA, 16 bp, G. gallus
tctagccagttcctta

SEQ ID NO: 540269 - DNA, 16 bp, G. gallus
tctaggagaaaaacaa

SEQ ID NO: 540270 - DNA, 16 bp, G. gallus
tctaggcagcctgtgc

SEQ ID NO: 540271 - DNA, 16 bp, G. gallus
tctagtgggagatgtc

SEQ ID NO: 540272 - DNA, 16 bp, G. gallus
tctatgattccatgaa

SEQ ID NO: 540273 - DNA, 16 bp, G. gallus
tctatgattctgtgaa

SEQ ID NO: 540274 - DNA, 16 bp, G. gallus
tctcaccaccctctga

SEQ ID NO: 540275 - DNA, 16 bp, G. gallus
tctcagaaagagcggt

SEQ ID NO: 540276 - DNA, 16 bp, G. gallus
tctcagaaagagtggt

SEQ ID NO: 540277 - DNA, 16 bp, G. gallus
tctcagctccctcagc

SEQ ID NO: 540278 - DNA, 16 bp, G. gallus
tctcaggggaaaaaaa

SEQ ID NO: 540279 - DNA, 16 bp, G. gallus
tctccaagtagagatg

SEQ ID NO: 540280 - DNA, 16 bp, G. gallus
tctccacatttcttga

SEQ ID NO: 540281 - DNA, 16 bp, G. gallus
tctccagactgaagaa

SEQ ID NO: 540282 - DNA, 16 bp, G. gallus
tctccagagaagaaga

SEQ ID NO: 540283 - DNA, 16 bp, G. gallus
tctccagagaaggaga

SEQ ID NO: 540284 - DNA, 16 bp, G. gallus
tctccagaggaggaga

SEQ ID NO: 540285 - DNA, 16 bp, G. gallus
tctccagcaggtcagc

SEQ ID NO: 540286 - DNA, 16 bp, G. gallus
tctccagcctgaacaa

SEQ ID NO: 540287 - DNA, 16 bp, G. gallus
tctccagcctgtccag

SEQ ID NO: 540288 - DNA, 16 bp, G. gallus
tctccaggatgaacaa

SEQ ID NO: 540289 - DNA, 16 bp, G. gallus
tctccaggtatggggc

SEQ ID NO: 540290 - DNA, 16 bp, G. gallus
tctccatcatatttga

SEQ ID NO: 540291 - DNA, 16 bp, G. gallus
tctccctccttggaga

SEQ ID NO: 540292 - DNA, 16 bp, G. gallus
tctccctgcagccttc

SEQ ID NO: 540293 - DNA, 16 bp, G. gallus
tctccctggtcctcct

SEQ ID NO: 540294 - DNA, 16 bp, G. gallus
tctcctatgaggacag

SEQ ID NO: 540295 - DNA, 16 bp, G. gallus
tctcctccagaagctg

SEQ ID NO: 540296 - DNA, 16 bp, G. gallus
tctcctctttcagttt

SEQ ID NO: 540297 - DNA, 16 bp, G. gallus
tctcctgaagtccaga

SEQ ID NO: 540298 - DNA, 16 bp, G. gallus
tctcctggagaaactg

SEQ ID NO: 540299 - DNA, 16 bp, G. gallus
tctccttctctggaga

SEQ ID NO: 540300 - DNA, 16 bp, G. gallus
tctctatatatatata

SEQ ID NO: 540301 - DNA, 16 bp, G. gallus
tctctcagcctctcct

SEQ ID NO: 540302 - DNA, 16 bp, G. gallus
tctctcagcttctcct

SEQ ID NO: 540303 - DNA, 16 bp, G. gallus
tctctccagcagttcc

SEQ ID NO: 540304 - DNA, 16 bp, G. gallus
tctctcctatgaagaa

SEQ ID NO: 540305 - DNA, 16 bp, G. gallus
tctctgaaggcattca

SEQ ID NO: 540306 - DNA, 16 bp, G. gallus
tctctgactgtttcct

SEQ ID NO: 540307 - DNA, 16 bp, G. gallus
tctctgattctatgaa

SEQ ID NO: 540308 - DNA, 16 bp, G. gallus
tctctgctctctggtg

SEQ ID NO: 540309 - DNA, 16 bp, G. gallus
tctctggcaacctgtt

SEQ ID NO: 540310 - DNA, 16 bp, G. gallus
tctctggctgcaggga

SEQ ID NO: 540311 - DNA, 16 bp, G. gallus
tctctgggcagcctga

SEQ ID NO: 540312 - DNA, 16 bp, G. gallus
tctctgggcagcctgt

SEQ ID NO: 540313 - DNA, 16 bp, G. gallus
tctctgttcattgcag

SEQ ID NO: 540314 - DNA, 16 bp, G. gallus
tctcttccaacctcaa

SEQ ID NO: 540315 - DNA, 16 bp, G. gallus
tctcttcctggagatc

SEQ ID NO: 540316 - DNA, 16 bp, G. gallus
tctcttctccatgcta

SEQ ID NO: 540317 - DNA, 16 bp, G. gallus
tctcttgaggtctctt

SEQ ID NO: 540318 - DNA, 16 bp, G. gallus
tctgaaaaacaaaaca

SEQ ID NO: 540319 - DNA, 16 bp, G. gallus
tctgaaaggatggtca

SEQ ID NO: 540320 - DNA, 16 bp, G. gallus
tctgaaagtaatacct

SEQ ID NO: 540321 - DNA, 16 bp, G. gallus
tctgaagaagagaagg

SEQ ID NO: 540322 - DNA, 16 bp, G. gallus
tctgaaggaaaaaaaa

SEQ ID NO: 540323 - DNA, 16 bp, G. gallus
tctgaatggcagcaca

SEQ ID NO: 540324 - DNA, 16 bp, G. gallus
tctgacactgtgggcc

SEQ ID NO: 540325 - DNA, 16 bp, G. gallus
tctgacatggaagagt

SEQ ID NO: 540326 - DNA, 16 bp, G. gallus
tctgagccttctcttc

SEQ ID NO: 540327 - DNA, 16 bp, G. gallus
tctgaggaaaaaaaaa

SEQ ID NO: 540328 - DNA, 16 bp, G. gallus
tctgaggaaagaattt

SEQ ID NO: 540329 - DNA, 16 bp, G. gallus
tctgagggtttttttt

SEQ ID NO: 540330 - DNA, 16 bp, G. gallus
tctgaggtcttttcca

SEQ ID NO: 540331 - DNA, 19 bp, G. gallus
tctgatatcatcgccactg

SEQ ID NO: 540332 - DNA, 16 bp, G. gallus
tctgcagagctgcttt

SEQ ID NO: 540333 - DNA, 16 bp, G. gallus
tctgcagcagcagcag

SEQ ID NO: 540334 - DNA, 16 bp, G. gallus
tctgcagggctgctct

SEQ ID NO: 540335 - DNA, 16 bp, G. gallus
tctgccaactccctca

SEQ ID NO: 540336 - DNA, 16 bp, G. gallus
tctgcctctgacatca

SEQ ID NO: 540337 - DNA, 16 bp, G. gallus
tctgcctgctgctgct

SEQ ID NO: 540338 - DNA, 16 bp, G. gallus
tctgctaaagcagatt

SEQ ID NO: 540339 - DNA, 16 bp, G. gallus
tctggaagagaagaac

SEQ ID NO: 540340 - DNA, 16 bp, G. gallus
tctggaagttcaagat

SEQ ID NO: 540341 - DNA, 16 bp, G. gallus
tctggagaagaggagg

SEQ ID NO: 540342 - DNA, 16 bp, G. gallus
tctggagaggaggagg

SEQ ID NO: 540343 - DNA, 16 bp, G. gallus
tctggagatgttcaag

SEQ ID NO: 540344 - DNA, 16 bp, G. gallus
tctggagcacaagtcc

SEQ ID NO: 540345 - DNA, 16 bp, G. gallus
tctggagcccccagca

SEQ ID NO: 540346 - DNA, 16 bp, G. gallus
tctggagggaaaaaaa

SEQ ID NO: 540347 - DNA, 16 bp, G. gallus
tctggatggagatcag

SEQ ID NO: 540348 - DNA, 16 bp, G. gallus
tctggatggccatgca

SEQ ID NO: 540349 - DNA, 16 bp, G. gallus
tctggatttcctggaa

SEQ ID NO: 540350 - DNA, 16 bp, G. gallus
tctggccaaaaaaaaa

SEQ ID NO: 540351 - DNA, 17 bp, G. gallus
tctggctgctcaaggaa

SEQ ID NO: 540352 - DNA, 16 bp, G. gallus
tctgggaaaaaaaaaa

SEQ ID NO: 540353 - DNA, 16 bp, G. gallus
tctgggcaacctgctc

SEQ ID NO: 540354 - DNA, 16 bp, G. gallus
tctgggcaacgtgttc

SEQ ID NO: 540355 - DNA, 16 bp, G. gallus
tctgggctcctcagta

SEQ ID NO: 540356 - DNA, 16 bp, G. gallus
tctgggttgaaaagga

SEQ ID NO: 540357 - DNA, 16 bp, G. gallus
tctgtaaatgttcagc

SEQ ID NO: 540358 - DNA, 16 bp, G. gallus
tctgtataaacacctg

SEQ ID NO: 540359 - DNA, 16 bp, G. gallus
tctgtccaattgctac

SEQ ID NO: 540360 - DNA, 16 bp, G. gallus
tctgtgaagagcagtt

SEQ ID NO: 540361 - DNA, 16 bp, G. gallus
tctgtgatcctgtgat

SEQ ID NO: 540362 - DNA, 16 bp, G. gallus
tctgtgattctgtgct

SEQ ID NO: 540363 - DNA, 16 bp, G. gallus
tctgtgattctgtgga

SEQ ID NO: 540364 - DNA, 16 bp, G. gallus
tctgtgcctcagtttc

SEQ ID NO: 540365 - DNA, 16 bp, G. gallus
tctgtgctgctgctgc

SEQ ID NO: 540366 - DNA, 16 bp, G. gallus
tctgtgcttgggattg

SEQ ID NO: 540367 - DNA, 16 bp, G. gallus
tctgtggttctgtggt

SEQ ID NO: 540368 - DNA, 16 bp, G. gallus
tctgtgtccacagctg

SEQ ID NO: 540369 - DNA, 16 bp, G. gallus
tctgttccagtgctcc

SEQ ID NO: 540370 - DNA, 16 bp, G. gallus
tcttactgaaaaaaaa

SEQ ID NO: 540371 - DNA, 16 bp, G. gallus
tcttatgaagagcagc

SEQ ID NO: 540372 - DNA, 16 bp, G. gallus
tcttcaaaagaaaaaa

SEQ ID NO: 540373 - DNA, 16 bp, G. gallus
tcttcaacatcttcat

SEQ ID NO: 540374 - DNA, 16 bp, G. gallus
tcttcactcagtgcag

SEQ ID NO: 540375 - DNA, 16 bp, G. gallus
tcttcagcctgaagaa

SEQ ID NO: 540376 - DNA, 16 bp, G. gallus
tcttcagcctggaaaa

SEQ ID NO: 540377 - DNA, 16 bp, G. gallus
tcttcagcctggagaa

SEQ ID NO: 540378 - DNA, 16 bp, G. gallus
tcttcataggagagat

SEQ ID NO: 540379 - DNA, 16 bp, G. gallus
tcttcatggccttcct

SEQ ID NO: 540380 - DNA, 16 bp, G. gallus
tcttccagctactctg

SEQ ID NO: 540381 - DNA, 16 bp, G. gallus
tcttctccaaaacagt

SEQ ID NO: 540382 - DNA, 16 bp, G. gallus
tcttctccagacagaa

SEQ ID NO: 540383 - DNA, 16 bp, G. gallus
tcttgaacaccttcag

SEQ ID NO: 540384 - DNA, 16 bp, G. gallus
tcttgagagcagccct

SEQ ID NO: 540385 - DNA, 16 bp, G. gallus
tcttgctcatcactgg

SEQ ID NO: 540386 - DNA, 16 bp, G. gallus
tcttgctccacagctg

SEQ ID NO: 540387 - DNA, 16 bp, G. gallus
tcttgctgcccaagac

SEQ ID NO: 540388 - DNA, 16 bp, G. gallus
tcttgggggaaaaaaa

SEQ ID NO: 540389 - DNA, 16 bp, G. gallus
tcttggtgggggtctg

SEQ ID NO: 540390 - DNA, 16 bp, G. gallus
tcttgttcattgttgg

SEQ ID NO: 540391 - DNA, 16 bp, G. gallus
tctttaaaaaaagaaa

SEQ ID NO: 540392 - DNA, 16 bp, G. gallus
tctttagcagagtctg

SEQ ID NO: 540393 - DNA, 16 bp, G. gallus
tctttattgatgactt

SEQ ID NO: 540394 - DNA, 16 bp, G. gallus
tctttcagaaaagaaa

SEQ ID NO: 540395 - DNA, 16 bp, G. gallus
tctttccaatcttaat

SEQ ID NO: 540396 - DNA, 16 bp, G. gallus
tctttctgagaggaaa

SEQ ID NO: 540397 - DNA, 16 bp, G. gallus
tctttctggagatccc

SEQ ID NO: 540398 - DNA, 16 bp, G. gallus
tctttctgggaagaaa

SEQ ID NO: 540399 - DNA, 16 bp, G. gallus
tctttgaaaaaaaaaa

SEQ ID NO: 540400 - DNA, 16 bp, G. gallus
tcttttacagtgagag

SEQ ID NO: 540401 - DNA, 16 bp, G. gallus
tcttttccaagctgaa

SEQ ID NO: 540402 - DNA, 16 bp, G. gallus
tcttttgcatcattgt

SEQ ID NO: 540403 - DNA, 16 bp, G. gallus
tcttttggagaagttt

SEQ ID NO: 540404 - DNA, 16 bp, G. gallus
tcttttggagaataaa

SEQ ID NO: 540405 - DNA, 16 bp, G. gallus
tcttttttgaactggg

SEQ ID NO: 540406 - DNA, 16 bp, G. gallus
tgaaaaaattcctcct

SEQ ID NO: 540407 - DNA, 16 bp, G. gallus
tgaaaaacagtgtttt

SEQ ID NO: 540408 - DNA, 16 bp, G. gallus
tgaaaaagagaaggct

SEQ ID NO: 540409 - DNA, 16 bp, G. gallus
tgaaaaataacatttt

SEQ ID NO: 540410 - DNA, 16 bp, G. gallus
tgaaaacattttgaaa

SEQ ID NO: 540411 - DNA, 16 bp, G. gallus
tgaaaaggaccagaat

SEQ ID NO: 540412 - DNA, 16 bp, G. gallus
tgaaactggatggtca

SEQ ID NO: 540413 - DNA, 16 bp, G. gallus
tgaaagaagggagatt

SEQ ID NO: 540414 - DNA, 16 bp, G. gallus
tgaaagcaaagcaaaa

SEQ ID NO: 540415 - DNA, 16 bp, G. gallus
tgaaagcaattcacct

SEQ ID NO: 540416 - DNA, 28 bp, G. gallus
tgaaagcacaagaggtctccatccctct

SEQ ID NO: 540417 - DNA, 16 bp, G. gallus
tgaaagcattcaaggc

SEQ ID NO: 540418 - DNA, 16 bp, G. gallus
tgaaaggaggctgtgg

SEQ ID NO: 540419 - DNA, 16 bp, G. gallus
tgaaaggctgcagaca

SEQ ID NO: 540420 - DNA, 16 bp, G. gallus
tgaaaggtgcttacag

SEQ ID NO: 540421 - DNA, 16 bp, G. gallus
tgaaagtctccaagga

SEQ ID NO: 540422 - DNA, 16 bp, G. gallus
tgaaagtcttttccaa

SEQ ID NO: 540423 - DNA, 16 bp, G. gallus
tgaaagtgcttggaat

SEQ ID NO: 540424 - DNA, 16 bp, G. gallus
tgaaagtttccaggga

SEQ ID NO: 540425 - DNA, 16 bp, G. gallus
tgaaatgcaccaccta

SEQ ID NO: 540426 - DNA, 16 bp, G. gallus
tgaacaagagactgca

SEQ ID NO: 540427 - DNA, 16 bp, G. gallus
tgaacaagagcctgca

SEQ ID NO: 540428 - DNA, 16 bp, G. gallus
tgaacacagtattcaa

SEQ ID NO: 540429 - DNA, 16 bp, G. gallus
tgaacacctccaggga

SEQ ID NO: 540430 - DNA, 16 bp, G. gallus
tgaacatctgcctgcc

SEQ ID NO: 540431 - DNA, 16 bp, G. gallus
tgaactccagcagctc

SEQ ID NO: 540432 - DNA, 16 bp, G. gallus
tgaagaaaatattttt

SEQ ID NO: 540433 - DNA, 16 bp, G. gallus
tgaagaaacaggaaaa

SEQ ID NO: 540434 - DNA, 16 bp, G. gallus
tgaagaagagaagact

SEQ ID NO: 540435 - DNA, 16 bp, G. gallus
tgaagaatttcttctt

SEQ ID NO: 540436 - DNA, 16 bp, G. gallus
tgaagacattaaagag

SEQ ID NO: 540437 - DNA, 16 bp, G. gallus
tgaagataatcagagg

SEQ ID NO: 540438 - DNA, 16 bp, G. gallus
tgaagatgctgaagag

SEQ ID NO: 540439 - DNA, 16 bp, G. gallus
tgaagatggtgaaggg

SEQ ID NO: 540440 - DNA, 16 bp, G. gallus
tgaagcacctctccta

SEQ ID NO: 540441 - DNA, 16 bp, G. gallus
tgaagcactgaaacag

SEQ ID NO: 540442 - DNA, 16 bp, G. gallus
tgaagcactggaacag

SEQ ID NO: 540443 - DNA, 16 bp, G. gallus
tgaagcactggagcag

SEQ ID NO: 540444 - DNA, 16 bp, G. gallus
tgaagctccaacccct

SEQ ID NO: 540445 - DNA, 16 bp, G. gallus
tgaagctccaacctcc

SEQ ID NO: 540446 - DNA, 16 bp, G. gallus
tgaagctgtgaagggt

SEQ ID NO: 540447 - DNA, 16 bp, G. gallus
tgaaggaactggagct

SEQ ID NO: 540448 - DNA, 16 bp, G. gallus
tgaaggacttggagaa

SEQ ID NO: 540449 - DNA, 16 bp, G. gallus
tgaaggaggtgatcct

SEQ ID NO: 540450 - DNA, 16 bp, G. gallus
tgaaggctgtgctgcc

SEQ ID NO: 540451 - DNA, 16 bp, G. gallus
tgaagtcccccatgag

SEQ ID NO: 540452 - DNA, 16 bp, G. gallus
tgaagttgcaccaggg

SEQ ID NO: 540453 - DNA, 16 bp, G. gallus
tgaatgcctccatgga

SEQ ID NO: 540454 - DNA, 16 bp, G. gallus
tgaatggcagcacagc

SEQ ID NO: 540455 - DNA, 16 bp, G. gallus
tgaatgtgtacaagtc

SEQ ID NO: 540456 - DNA, 16 bp, G. gallus
tgaatgtttccaggga

SEQ ID NO: 540457 - DNA, 16 bp, G. gallus
tgaattatttctagct

SEQ ID NO: 540458 - DNA, 16 bp, G. gallus
tgaattccccattgaa

SEQ ID NO: 540459 - DNA, 16 bp, G. gallus
tgacaacaacaacaac

SEQ ID NO: 540460 - DNA, 16 bp, G. gallus
tgacaaccttccagat

SEQ ID NO: 540461 - DNA, 16 bp, G. gallus
tgacacagtggaagga

SEQ ID NO: 540462 - DNA, 16 bp, G. gallus
tgacaccaccacctcc

SEQ ID NO: 540463 - DNA, 16 bp, G. gallus
tgacagagaaaattct

SEQ ID NO: 540464 - DNA, 16 bp, G. gallus
tgacagagcaaattct

SEQ ID NO: 540465 - DNA, 16 bp, G. gallus
tgacagagccctggaa

SEQ ID NO: 540466 - DNA, 16 bp, G. gallus
tgacagagcctttatt

SEQ ID NO: 540467 - DNA, 16 bp, G. gallus
tgacagcagcagtggg

SEQ ID NO: 540468 - DNA, 16 bp, G. gallus
tgacagcaggtcacct

SEQ ID NO: 540469 - DNA, 16 bp, G. gallus
tgacagccatgacttt

SEQ ID NO: 540470 - DNA, 16 bp, G. gallus
tgacaggacaaggaga

SEQ ID NO: 540471 - DNA, 16 bp, G. gallus
tgacagtgacagtggg

SEQ ID NO: 540472 - DNA, 16 bp, G. gallus
tgacagtgggattgag

SEQ ID NO: 540473 - DNA, 16 bp, G. gallus
tgacatcatgcagaag

SEQ ID NO: 540474 - DNA, 16 bp, G. gallus
tgacatctaatctaaa

SEQ ID NO: 540475 - DNA, 16 bp, G. gallus
tgacatgctagaggga

SEQ ID NO: 540476 - DNA, 16 bp, G. gallus
tgaccactctttcaga

SEQ ID NO: 540477 - DNA, 16 bp, G. gallus
tgaccactgccctggg

SEQ ID NO: 540478 - DNA, 16 bp, G. gallus
tgaccaggaatgctga

SEQ ID NO: 540479 - DNA, 16 bp, G. gallus
tgaccccatcacctcc

SEQ ID NO: 540480 - DNA, 16 bp, G. gallus
tgaccctgcccatggc

SEQ ID NO: 540481 - DNA, 16 bp, G. gallus
tgactagcaaaactgc

SEQ ID NO: 540482 - DNA, 16 bp, G. gallus
tgactccaccaccacc

SEQ ID NO: 540483 - DNA, 16 bp, G. gallus
tgactccaccaccttc

SEQ ID NO: 540484 - DNA, 16 bp, G. gallus
tgactgtttctcagag

SEQ ID NO: 540485 - DNA, 16 bp, G. gallus
tgacttccagaggtcc

SEQ ID NO: 540486 - DNA, 16 bp, G. gallus
tgagaatttgctttat

SEQ ID NO: 540487 - DNA, 16 bp, G. gallus
tgagacactgaaacag

SEQ ID NO: 540488 - DNA, 16 bp, G. gallus
tgagactcactggcct

SEQ ID NO: 540489 - DNA, 16 bp, G. gallus
tgagactctggaacag

SEQ ID NO: 540490 - DNA, 16 bp, G. gallus
tgagagagctgaggct

SEQ ID NO: 540491 - DNA, 16 bp, G. gallus
tgagagaggatctgat

SEQ ID NO: 540492 - DNA, 16 bp, G. gallus
tgagagcagccctgaa

SEQ ID NO: 540493 - DNA, 16 bp, G. gallus
tgagagcgctgtccaa

SEQ ID NO: 540494 - DNA, 16 bp, G. gallus
tgagataaaaactatt

SEQ ID NO: 540495 - DNA, 16 bp, G. gallus
tgagatgctggaacag

SEQ ID NO: 540496 - DNA, 16 bp, G. gallus
tgagcaacaggtccag

SEQ ID NO: 540497 - DNA, 16 bp, G. gallus
tgagcaatcttcttcc

SEQ ID NO: 540498 - DNA, 16 bp, G. gallus
tgagcaattccatgat

SEQ ID NO: 540499 - DNA, 16 bp, G. gallus
tgagcacaacagcacc

SEQ ID NO: 540500 - DNA, 16 bp, G. gallus
tgagcaccaggtccag

SEQ ID NO: 540501 - DNA, 18 bp, G. gallus
tgagcactgctggagctg

SEQ ID NO: 540502 - DNA, 16 bp, G. gallus
tgagcacttttccttt

SEQ ID NO: 540503 - DNA, 16 bp, G. gallus
tgagcagcctgagctg

SEQ ID NO: 540504 - DNA, 16 bp, G. gallus
tgagcaggaggagcag

SEQ ID NO: 540505 - DNA, 16 bp, G. gallus
tgagccagctgtgtgc

SEQ ID NO: 540506 - DNA, 16 bp, G. gallus
tgagccatcagtgtgc

SEQ ID NO: 540507 - DNA, 16 bp, G. gallus
tgagcctggagaagag

SEQ ID NO: 540508 - DNA, 16 bp, G. gallus
tgagctgctggagctc

SEQ ID NO: 540509 - DNA, 16 bp, G. gallus
tgagctggaagagacc

SEQ ID NO: 540510 - DNA, 16 bp, G. gallus
tgagctggaagggacc

SEQ ID NO: 540511 - DNA, 16 bp, G. gallus
tgagctggcagtgtgc

SEQ ID NO: 540512 - DNA, 16 bp, G. gallus
tgagctggggggcagc

SEQ ID NO: 540513 - DNA, 16 bp, G. gallus
tgagctgttggagtgg

SEQ ID NO: 540514 - DNA, 16 bp, G. gallus
tgaggaataaaggaat

SEQ ID NO: 540515 - DNA, 16 bp, G. gallus
tgaggagaggctgagg

SEQ ID NO: 540516 - DNA, 16 bp, G. gallus
tgaggagcagctgaag

SEQ ID NO: 540517 - DNA, 16 bp, G. gallus
tgaggagcagctgagg

SEQ ID NO: 540518 - DNA, 17 bp, G. gallus
tgaggaggaaagttaat

SEQ ID NO: 540519 - DNA, 16 bp, G. gallus
tgaggatggatagtga

SEQ ID NO: 540520 - DNA, 16 bp, G. gallus
tgaggcactgtcacag

SEQ ID NO: 540521 - DNA, 16 bp, G. gallus
tgaggccccatctgga

SEQ ID NO: 540522 - DNA, 16 bp, G. gallus
tgaggccctggcacag

SEQ ID NO: 540523 - DNA, 16 bp, G. gallus
tgaggcctcctctcag

SEQ ID NO: 540524 - DNA, 16 bp, G. gallus
tgaggctctggcacag

SEQ ID NO: 540525 - DNA, 16 bp, G. gallus
tgagggaaatcaactt

SEQ ID NO: 540526 - DNA, 16 bp, G. gallus
tgagggacatggttta

SEQ ID NO: 540527 - DNA, 16 bp, G. gallus
tgagggacctgggctt

SEQ ID NO: 540528 - DNA, 18 bp, G. gallus
tgaggggtctggagcaca

SEQ ID NO: 540529 - DNA, 16 bp, G. gallus
tgaggtcccttccatc

SEQ ID NO: 540530 - DNA, 16 bp, G. gallus
tgaggtctccctggag

SEQ ID NO: 540531 - DNA, 16 bp, G. gallus
tgaggtctgggaagag

SEQ ID NO: 540532 - DNA, 16 bp, G. gallus
tgaggtgctggaagag

SEQ ID NO: 540533 - DNA, 16 bp, G. gallus
tgaggttggcagggac

SEQ ID NO: 540534 - DNA, 16 bp, G. gallus
tgaggttgtggatgtc

SEQ ID NO: 540535 - DNA, 16 bp, G. gallus
tgagtacagggagatg

SEQ ID NO: 540536 - DNA, 16 bp, G. gallus
tgagtactgtgctcag

SEQ ID NO: 540537 - DNA, 16 bp, G. gallus
tgagttcttctcccag

SEQ ID NO: 540538 - DNA, 16 bp, G. gallus
tgagttggaagagacc

SEQ ID NO: 540539 - DNA, 16 bp, G. gallus
tgagttggaagggacc

SEQ ID NO: 540540 - DNA, 16 bp, G. gallus
tgagttgggagggacc

SEQ ID NO: 540541 - DNA, 16 bp, G. gallus
tgataaaagccaggat

SEQ ID NO: 540542 - DNA, 16 bp, G. gallus
tgataaaggaatttga

SEQ ID NO: 540543 - DNA, 16 bp, G. gallus
tgataacacaccaatg

SEQ ID NO: 540544 - DNA, 16 bp, G. gallus
tgatacaaagctgaga

SEQ ID NO: 540545 - DNA, 16 bp, G. gallus
tgatagaacaagagga

SEQ ID NO: 540546 - DNA, 16 bp, G. gallus
tgatagtgacaggaca

SEQ ID NO: 540547 - DNA, 16 bp, G. gallus
tgatatgggagaacca

SEQ ID NO: 540548 - DNA, 16 bp, G. gallus
tgatcaggttgcccag

SEQ ID NO: 540549 - DNA, 16 bp, G. gallus
tgatccttgagatccc

SEQ ID NO: 540550 - DNA, 16 bp, G. gallus
tgatctagtacttgat

SEQ ID NO: 540551 - DNA, 16 bp, G. gallus
tgatctcagtggtctt

SEQ ID NO: 540552 - DNA, 16 bp, G. gallus
tgatctcctgaggtcc

SEQ ID NO: 540553 - DNA, 18 bp, G. gallus
tgatcttgtaggtccttt

SEQ ID NO: 540554 - DNA, 16 bp, G. gallus
tgatctttctgattgt

SEQ ID NO: 540555 - DNA, 16 bp, G. gallus
tgatgaaaaacttaac

SEQ ID NO: 540556 - DNA, 16 bp, G. gallus
tgatgaagatactgaa

SEQ ID NO: 540557 - DNA, 16 bp, G. gallus
tgatgaagatattaaa

SEQ ID NO: 540558 - DNA, 16 bp, G. gallus
tgatgaagatattgaa

SEQ ID NO: 540559 - DNA, 16 bp, G. gallus
tgatgaagatgctgaa

SEQ ID NO: 540560 - DNA, 16 bp, G. gallus
tgatgaagatgttgaa

SEQ ID NO: 540561 - DNA, 16 bp, G. gallus
tgatgaggcactggca

SEQ ID NO: 540562 - DNA, 16 bp, G. gallus
tgatgagtggactgtt

SEQ ID NO: 540563 - DNA, 16 bp, G. gallus
tgatgatcattgtggt

SEQ ID NO: 540564 - DNA, 16 bp, G. gallus
tgatgatctggatgag

SEQ ID NO: 540565 - DNA, 16 bp, G. gallus
tgatgatcttgaaagt

SEQ ID NO: 540566 - DNA, 16 bp, G. gallus
tgatgatgatgataat

SEQ ID NO: 540567 - DNA, 16 bp, G. gallus
tgatgatgatgatgat

SEQ ID NO: 540568 - DNA, 16 bp, G. gallus
tgatgcaacccaggat

SEQ ID NO: 540569 - DNA, 16 bp, G. gallus
tgatgcaatccaggat

SEQ ID NO: 540570 - DNA, 16 bp, G. gallus
tgatgcagaccaggat

SEQ ID NO: 540571 - DNA, 16 bp, G. gallus
tgatgcagcccaggat

SEQ ID NO: 540572 - DNA, 16 bp, G. gallus
tgatgcagcttgaagc

SEQ ID NO: 540573 - DNA, 16 bp, G. gallus
tgatggagctgtaggt

SEQ ID NO: 540574 - DNA, 16 bp, G. gallus
tgatggcagaaaaccc

SEQ ID NO: 540575 - DNA, 16 bp, G. gallus
tgatggctgcagatgg

SEQ ID NO: 540576 - DNA, 16 bp, G. gallus
tgattctatgaatttg

SEQ ID NO: 540577 - DNA, 16 bp, G. gallus
tgattctgtgaaaaaa

SEQ ID NO: 540578 - DNA, 16 bp, G. gallus
tgattctgtgattgtg

SEQ ID NO: 540579 - DNA, 16 bp, G. gallus
tgattctttgattcta

SEQ ID NO: 540580 - DNA, 16 bp, G. gallus
tgcaaaaaatatatat

SEQ ID NO: 540581 - DNA, 16 bp, G. gallus
tgcaaatgaagcaaag

SEQ ID NO: 540582 - DNA, 16 bp, G. gallus
tgcaacagccatgggc

SEQ ID NO: 540583 - DNA, 16 bp, G. gallus
tgcaaggtctttgaca

SEQ ID NO: 540584 - DNA, 16 bp, G. gallus
tgcaatgaacaaggac

SEQ ID NO: 540585 - DNA, 16 bp, G. gallus
tgcacaaggagctggg

SEQ ID NO: 540586 - DNA, 16 bp, G. gallus
tgcacacatacacaca

SEQ ID NO: 540587 - DNA, 16 bp, G. gallus
tgcacagagaggtggt

SEQ ID NO: 540588 - DNA, 16 bp, G. gallus
tgcacagggcagtggg

SEQ ID NO: 540589 - DNA, 16 bp, G. gallus
tgcacgctgctggctc

SEQ ID NO: 540590 - DNA, 16 bp, G. gallus
tgcacttggttttgtt

SEQ ID NO: 540591 - DNA, 16 bp, G. gallus
tgcagaaccttgcact

SEQ ID NO: 540592 - DNA, 16 bp, G. gallus
tgcagaaccttttcct

SEQ ID NO: 540593 - DNA, 16 bp, G. gallus
tgcagaagaggaggct

SEQ ID NO: 540594 - DNA, 16 bp, G. gallus
tgcagaagcagcagca

SEQ ID NO: 540595 - DNA, 16 bp, G. gallus
tgcagaaggaaaaaaa

SEQ ID NO: 540596 - DNA, 16 bp, G. gallus
tgcagagaaggacttg

SEQ ID NO: 540597 - DNA, 16 bp, G. gallus
tgcagagagagagaga

SEQ ID NO: 540598 - DNA, 16 bp, G. gallus
tgcagatgaagcaaaa

SEQ ID NO: 540599 - DNA, 16 bp, G. gallus
tgcagattttgatgag

SEQ ID NO: 540600 - DNA, 16 bp, G. gallus
tgcagcagaggggcag

SEQ ID NO: 540601 - DNA, 16 bp, G. gallus
tgcagcagcagagctg

SEQ ID NO: 540602 - DNA, 16 bp, G. gallus
tgcagcagcagaggtg

SEQ ID NO: 540603 - DNA, 16 bp, G. gallus
tgcagcagcagcagca

SEQ ID NO: 540604 - DNA, 16 bp, G. gallus
tgcagcaggtccagag

SEQ ID NO: 540605 - DNA, 16 bp, G. gallus
tgcagccagcaggagc

SEQ ID NO: 540606 - DNA, 16 bp, G. gallus
tgcagccatggaggag

SEQ ID NO: 540607 - DNA, 16 bp, G. gallus
tgcagcctggaaggcc

SEQ ID NO: 540608 - DNA, 16 bp, G. gallus
tgcagccttccagcac

SEQ ID NO: 540609 - DNA, 16 bp, G. gallus
tgcagctgagtgactg

SEQ ID NO: 540610 - DNA, 16 bp, G. gallus
tgcagctgctgctgct

SEQ ID NO: 540611 - DNA, 16 bp, G. gallus
tgcaggaaagaaaaaa

SEQ ID NO: 540612 - DNA, 16 bp, G. gallus
tgcaggagctgaccat

SEQ ID NO: 540613 - DNA, 16 bp, G. gallus
tgcaggctcttgttca

SEQ ID NO: 540614 - DNA, 16 bp, G. gallus
tgcagggagtggcacc

SEQ ID NO: 540615 - DNA, 16 bp, G. gallus
tgcagggcagttggac

SEQ ID NO: 540616 - DNA, 16 bp, G. gallus
tgcaggggagctggac

SEQ ID NO: 540617 - DNA, 16 bp, G. gallus
tgcaggggagttggac

SEQ ID NO: 540618 - DNA, 16 bp, G. gallus
tgcaggtcagggagga

SEQ ID NO: 540619 - DNA, 19 bp, G. gallus
tgcagtcatttggccctga

SEQ ID NO: 540620 - DNA, 16 bp, G. gallus
tgcagtgctccaggtg

SEQ ID NO: 540621 - DNA, 16 bp, G. gallus
tgcagtgctgctgctg

SEQ ID NO: 540622 - DNA, 16 bp, G. gallus
tgcagtgtgacagatg

SEQ ID NO: 540623 - DNA, 16 bp, G. gallus
tgcagttgggagcagc

SEQ ID NO: 540624 - DNA, 16 bp, G. gallus
tgcatatatatatatg

SEQ ID NO: 540625 - DNA, 16 bp, G. gallus
tgcatcagtacaggtt

SEQ ID NO: 540626 - DNA, 16 bp, G. gallus
tgcatccagaggaggg

SEQ ID NO: 540627 - DNA, 16 bp, G. gallus
tgcatcccagagtcct

SEQ ID NO: 540628 - DNA, 16 bp, G. gallus
tgcatcctcagcaagt

SEQ ID NO: 540629 - DNA, 16 bp, G. gallus
tgcatctgtggctgct

SEQ ID NO: 540630 - DNA, 16 bp, G. gallus
tgcatgatgttatgat

SEQ ID NO: 540631 - DNA, 16 bp, G. gallus
tgcatgtgtgtgcatg

SEQ ID NO: 540632 - DNA, 16 bp, G. gallus
tgcattctgataccat

SEQ ID NO: 540633 - DNA, 16 bp, G. gallus
tgcattttagcagtgg

SEQ ID NO: 540634 - DNA, 16 bp, G. gallus
tgcatttttaaaataa

SEQ ID NO: 540635 - DNA, 16 bp, G. gallus
tgccaagaagaacaag

SEQ ID NO: 540636 - DNA, 16 bp, G. gallus
tgccaagctgctttcc

SEQ ID NO: 540637 - DNA, 16 bp, G. gallus
tgccacatctctatgg

SEQ ID NO: 540638 - DNA, 16 bp, G. gallus
tgccactgaggaagga

SEQ ID NO: 540639 - DNA, 16 bp, G. gallus
tgccagagatgaacaa

SEQ ID NO: 540640 - DNA, 16 bp, G. gallus
tgccagcaaggagctg

SEQ ID NO: 540641 - DNA, 16 bp, G. gallus
tgccagcagtgctgct

SEQ ID NO: 540642 - DNA, 16 bp, G. gallus
tgccagcccatcccca

SEQ ID NO: 540643 - DNA, 16 bp, G. gallus
tgccagggatggtgac

SEQ ID NO: 540644 - DNA, 16 bp, G. gallus
tgccagtgcctcatca

SEQ ID NO: 540645 - DNA, 16 bp, G. gallus
tgccagtgcttaacaa

SEQ ID NO: 540646 - DNA, 16 bp, G. gallus
tgccagtgcttcatca

SEQ ID NO: 540647 - DNA, 16 bp, G. gallus
tgccatccaccagcac

SEQ ID NO: 540648 - DNA, 16 bp, G. gallus
tgccatgggcaaggtt

SEQ ID NO: 540649 - DNA, 16 bp, G. gallus
tgcccaaagaggctgt

SEQ ID NO: 540650 - DNA, 16 bp, G. gallus
tgcccacagcagggag

SEQ ID NO: 540651 - DNA, 16 bp, G. gallus
tgcccagagaatctgt

SEQ ID NO: 540652 - DNA, 16 bp, G. gallus
tgcccagagctccatc

SEQ ID NO: 540653 - DNA, 16 bp, G. gallus
tgcccagaggagctgt

SEQ ID NO: 540654 - DNA, 18 bp, G. gallus
tgcccagcgaggtggtgg

SEQ ID NO: 540655 - DNA, 16 bp, G. gallus
tgcccagctctccagc

SEQ ID NO: 540656 - DNA, 16 bp, G. gallus
tgcccaggaaggtggt

SEQ ID NO: 540657 - DNA, 16 bp, G. gallus
tgcccagggaagtggt

SEQ ID NO: 540658 - DNA, 18 bp, G. gallus
tgcccagggccacatcca

SEQ ID NO: 540659 - DNA, 17 bp, G. gallus
tgcccagggccccatct

SEQ ID NO: 540660 - DNA, 16 bp, G. gallus
tgcccaggggagtggt

SEQ ID NO: 540661 - DNA, 16 bp, G. gallus
tgcccagggggtggtg

SEQ ID NO: 540662 - DNA, 16 bp, G. gallus
tgcccaggtggccagg

SEQ ID NO: 540663 - DNA, 16 bp, G. gallus
tgccccaagcctgcag

SEQ ID NO: 540664 - DNA, 16 bp, G. gallus
tgccccagagggcggt

SEQ ID NO: 540665 - DNA, 16 bp, G. gallus
tgccccatccagcctg

SEQ ID NO: 540666 - DNA, 18 bp, G. gallus
tgccccatccctggaggc

SEQ ID NO: 540667 - DNA, 19 bp, G. gallus
tgccccatccctggaggcg

SEQ ID NO: 540668 - DNA, 16 bp, G. gallus
tgcccctctgctacca

SEQ ID NO: 540669 - DNA, 16 bp, G. gallus
tgcccctctgctgaca

SEQ ID NO: 540670 - DNA, 16 bp, G. gallus
tgccctatgaggagag

SEQ ID NO: 540671 - DNA, 16 bp, G. gallus
tgccctcacagcccag

SEQ ID NO: 540672 - DNA, 16 bp, G. gallus
tgccctcatccaggtc

SEQ ID NO: 540673 - DNA, 16 bp, G. gallus
tgccctccgctccctg

SEQ ID NO: 540674 - DNA, 16 bp, G. gallus
tgccctctgagtgaag

SEQ ID NO: 540675 - DNA, 16 bp, G. gallus
tgccctgagccacatc

SEQ ID NO: 540676 - DNA, 17 bp, G. gallus
tgcccttctttggacct

SEQ ID NO: 540677 - DNA, 16 bp, G. gallus
tgcccttgtgaggcct

SEQ ID NO: 540678 - DNA, 16 bp, G. gallus
tgcctcaccatcctct

SEQ ID NO: 540679 - DNA, 16 bp, G. gallus
tgcctcagtttcccca

SEQ ID NO: 540680 - DNA, 16 bp, G. gallus
tgcctcagtttccccc

SEQ ID NO: 540681 - DNA, 16 bp, G. gallus
tgcctgcagcagaggg

SEQ ID NO: 540682 - DNA, 16 bp, G. gallus
tgcctgcagctctgct

SEQ ID NO: 540683 - DNA, 16 bp, G. gallus
tgccttccagtacttg

SEQ ID NO: 540684 - DNA, 16 bp, G. gallus
tgcctttggccttctt

SEQ ID NO: 540685 - DNA, 16 bp, G. gallus
tgctactgctgctgct

SEQ ID NO: 540686 - DNA, 16 bp, G. gallus
tgctcaaatgcaacag

SEQ ID NO: 540687 - DNA, 16 bp, G. gallus
tgctcacatctactgt

SEQ ID NO: 540688 - DNA, 16 bp, G. gallus
tgctcacccagttcca

SEQ ID NO: 540689 - DNA, 16 bp, G. gallus
tgctcagagagctgtg

SEQ ID NO: 540690 - DNA, 16 bp, G. gallus
tgctcagagaggtggt

SEQ ID NO: 540691 - DNA, 16 bp, G. gallus
tgctcagagccccacc

SEQ ID NO: 540692 - DNA, 16 bp, G. gallus
tgctccaacagctctg

SEQ ID NO: 540693 - DNA, 16 bp, G. gallus
tgctccaagcctgtag

SEQ ID NO: 540694 - DNA, 16 bp, G. gallus
tgctccagcacctcac

SEQ ID NO: 540695 - DNA, 16 bp, G. gallus
tgctccagccctctga

SEQ ID NO: 540696 - DNA, 16 bp, G. gallus
tgctccatccctgggg

SEQ ID NO: 540697 - DNA, 16 bp, G. gallus
tgctcctcctgctcag

SEQ ID NO: 540698 - DNA, 16 bp, G. gallus
tgctctcaaggagatc

SEQ ID NO: 540699 - DNA, 16 bp, G. gallus
tgctctgaaagaaatg

SEQ ID NO: 540700 - DNA, 16 bp, G. gallus
tgctctggggagcctg

SEQ ID NO: 540701 - DNA, 16 bp, G. gallus
tgctctgggtggccct

SEQ ID NO: 540702 - DNA, 16 bp, G. gallus
tgctctgtcaaatagt

SEQ ID NO: 540703 - DNA, 16 bp, G. gallus
tgctcttctccagact

SEQ ID NO: 540704 - DNA, 16 bp, G. gallus
tgctgaaaaatagtgt

SEQ ID NO: 540705 - DNA, 16 bp, G. gallus
tgctgaatgtttctgg

SEQ ID NO: 540706 - DNA, 16 bp, G. gallus
tgctgactaagctgaa

SEQ ID NO: 540707 - DNA, 16 bp, G. gallus
tgctgagatcccagag

SEQ ID NO: 540708 - DNA, 16 bp, G. gallus
tgctgagctctgctct

SEQ ID NO: 540709 - DNA, 16 bp, G. gallus
tgctgagctgctgcag

SEQ ID NO: 540710 - DNA, 16 bp, G. gallus
tgctgagctgctgctg

SEQ ID NO: 540711 - DNA, 16 bp, G. gallus
tgctgaggcactggca

SEQ ID NO: 540712 - DNA, 16 bp, G. gallus
tgctgcagcacagctg

SEQ ID NO: 540713 - DNA, 16 bp, G. gallus
tgctgcagcagggctg

SEQ ID NO: 540714 - DNA, 16 bp, G. gallus
tgctgcagctgctgct

SEQ ID NO: 540715 - DNA, 16 bp, G. gallus
tgctgcaggcagggcc

SEQ ID NO: 540716 - DNA, 16 bp, G. gallus
tgctgccactgctgaa

SEQ ID NO: 540717 - DNA, 16 bp, G. gallus
tgctgccatgatggtg

SEQ ID NO: 540718 - DNA, 16 bp, G. gallus
tgctgcccagagctgc

SEQ ID NO: 540719 - DNA, 16 bp, G. gallus
tgctgccctgctctgc

SEQ ID NO: 540720 - DNA, 16 bp, G. gallus
tgctgcctccctgggg

SEQ ID NO: 540721 - DNA, 16 bp, G. gallus
tgctgctctgctgcca

SEQ ID NO: 540722 - DNA, 16 bp, G. gallus
tgctgctgaaacacac

SEQ ID NO: 540723 - DNA, 16 bp, G. gallus
tgctgctgctcctcct

SEQ ID NO: 540724 - DNA, 16 bp, G. gallus
tgctgctgctcctgct

SEQ ID NO: 540725 - DNA, 16 bp, G. gallus
tgctgctgctgagcag

SEQ ID NO: 540726 - DNA, 16 bp, G. gallus
tgctgctgctgcagag

SEQ ID NO: 540727 - DNA, 16 bp, G. gallus
tgctgctgctgcagct

SEQ ID NO: 540728 - DNA, 16 bp, G. gallus
tgctgctgctgcaggg

SEQ ID NO: 540729 - DNA, 16 bp, G. gallus
tgctgctgctgccagc

SEQ ID NO: 540730 - DNA, 16 bp, G. gallus
tgctgctgctgctccc

SEQ ID NO: 540731 - DNA, 16 bp, G. gallus
tgctgctgctgctgca

SEQ ID NO: 540732 - DNA, 16 bp, G. gallus
tgctgctgctgctgct

SEQ ID NO: 540733 - DNA, 16 bp, G. gallus
tgctgctgctgctgga

SEQ ID NO: 540734 - DNA, 16 bp, G. gallus
tgctgctgctgctggc

SEQ ID NO: 540735 - DNA, 16 bp, G. gallus
tgctgctgctgctgtt

SEQ ID NO: 540736 - DNA, 16 bp, G. gallus
tgctgctgctgcttcc

SEQ ID NO: 540737 - DNA, 16 bp, G. gallus
tgctgctgctgcttct

SEQ ID NO: 540738 - DNA, 16 bp, G. gallus
tgctgctgctgctttg

SEQ ID NO: 540739 - DNA, 16 bp, G. gallus
tgctgctgctgttgtt

SEQ ID NO: 540740 - DNA, 16 bp, G. gallus
tgctgctgcttctgct

SEQ ID NO: 540741 - DNA, 16 bp, G. gallus
tgctgctgctttgctg

SEQ ID NO: 540742 - DNA, 16 bp, G. gallus
tgctgctgggctgctg

SEQ ID NO: 540743 - DNA, 16 bp, G. gallus
tgctgctgtgctgctg

SEQ ID NO: 540744 - DNA, 16 bp, G. gallus
tgctgcttcctcctgg

SEQ ID NO: 540745 - DNA, 16 bp, G. gallus
tgctggaaaagtagca

SEQ ID NO: 540746 - DNA, 16 bp, G. gallus
tgctggagcaggctgc

SEQ ID NO: 540747 - DNA, 16 bp, G. gallus
tgctggagttcaggga

SEQ ID NO: 540748 - DNA, 16 bp, G. gallus
tgctggcagcaggcag

SEQ ID NO: 540749 - DNA, 17 bp, G. gallus
tgctggccacgctgctt

SEQ ID NO: 540750 - DNA, 16 bp, G. gallus
tgctggccatgctgct

SEQ ID NO: 540751 - DNA, 16 bp, G. gallus
tgctggctgtcttgaa

SEQ ID NO: 540752 - DNA, 16 bp, G. gallus
tgctgggaaaacaaca

SEQ ID NO: 540753 - DNA, 16 bp, G. gallus
tgctgggacaggctgc

SEQ ID NO: 540754 - DNA, 16 bp, G. gallus
tgctgggagcagagct

SEQ ID NO: 540755 - DNA, 16 bp, G. gallus
tgctgggcaccctgct

SEQ ID NO: 540756 - DNA, 16 bp, G. gallus
tgctgggcagcctgtt

SEQ ID NO: 540757 - DNA, 16 bp, G. gallus
tgctggggaaaaaaaa

SEQ ID NO: 540758 - DNA, 16 bp, G. gallus
tgctgtaccaccacca

SEQ ID NO: 540759 - DNA, 16 bp, G. gallus
tgctgtagtttccatg

SEQ ID NO: 540760 - DNA, 16 bp, G. gallus
tgctgtcattgctgtg

SEQ ID NO: 540761 - DNA, 16 bp, G. gallus
tgctgtccctggcagt

SEQ ID NO: 540762 - DNA, 16 bp, G. gallus
tgctgtgctgcagcag

SEQ ID NO: 540763 - DNA, 16 bp, G. gallus
tgctgtgctgctgtgg

SEQ ID NO: 540764 - DNA, 16 bp, G. gallus
tgctgtgctgtgctgc

SEQ ID NO: 540765 - DNA, 16 bp, G. gallus
tgctgtgcttgtaaaa

SEQ ID NO: 540766 - DNA, 16 bp, G. gallus
tgctgtgggcagggct

SEQ ID NO: 540767 - DNA, 16 bp, G. gallus
tgctgtgtgcattggt

SEQ ID NO: 540768 - DNA, 16 bp, G. gallus
tgctgtgtgctgtgct

SEQ ID NO: 540769 - DNA, 16 bp, G. gallus
tgctgtgtttaatgca

SEQ ID NO: 540770 - DNA, 16 bp, G. gallus
tgctgttgttgctgct

SEQ ID NO: 540771 - DNA, 16 bp, G. gallus
tgctgtttatcttgct

SEQ ID NO: 540772 - DNA, 16 bp, G. gallus
tgcttaaaaaataaaa

SEQ ID NO: 540773 - DNA, 16 bp, G. gallus
tgcttacctttggaag

SEQ ID NO: 540774 - DNA, 16 bp, G. gallus
tgcttcagaaaaaaaa

SEQ ID NO: 540775 - DNA, 16 bp, G. gallus
tgcttcatatgcactt

SEQ ID NO: 540776 - DNA, 16 bp, G. gallus
tgcttccacctgtgct

SEQ ID NO: 540777 - DNA, 16 bp, G. gallus
tgcttccactgccaac

SEQ ID NO: 540778 - DNA, 16 bp, G. gallus
tgcttccagggagggg

SEQ ID NO: 540779 - DNA, 16 bp, G. gallus
tgcttgcctcaggtgg

SEQ ID NO: 540780 - DNA, 16 bp, G. gallus
tgctttaaaaaaaaaa

SEQ ID NO: 540781 - DNA, 16 bp, G. gallus
tgctttaagaaaaaaa

SEQ ID NO: 540782 - DNA, 16 bp, G. gallus
tgctttgacagcttca

SEQ ID NO: 540783 - DNA, 16 bp, G. gallus
tgcttttaaaatattt

SEQ ID NO: 540784 - DNA, 16 bp, G. gallus
tgcttttgtttttaaa

SEQ ID NO: 540785 - DNA, 16 bp, G. gallus
tggaaaaaaaatcatt

SEQ ID NO: 540786 - DNA, 16 bp, G. gallus
tggaaaagaactccaa

SEQ ID NO: 540787 - DNA, 16 bp, G. gallus
tggaaaagaccactga

SEQ ID NO: 540788 - DNA, 16 bp, G. gallus
tggaaaagactgctaa

SEQ ID NO: 540789 - DNA, 16 bp, G. gallus
tggaaaagagaaggtt

SEQ ID NO: 540790 - DNA, 16 bp, G. gallus
tggaaaagatctctaa

SEQ ID NO: 540791 - DNA, 16 bp, G. gallus
tggaaaagatctctga

SEQ ID NO: 540792 - DNA, 16 bp, G. gallus
tggaaaaggccttcaa

SEQ ID NO: 540793 - DNA, 16 bp, G. gallus
tggaaacagggacagg

SEQ ID NO: 540794 - DNA, 16 bp, G. gallus
tggaaacattcaaggc

SEQ ID NO: 540795 - DNA, 16 bp, G. gallus
tggaaactgcagcaga

SEQ ID NO: 540796 - DNA, 16 bp, G. gallus
tggaaaggaccacagt

SEQ ID NO: 540797 - DNA, 16 bp, G. gallus
tggaaatcttaaaggc

SEQ ID NO: 540798 - DNA, 16 bp, G. gallus
tggaacaggctgccca

SEQ ID NO: 540799 - DNA, 16 bp, G. gallus
tggaacaggtccagag

SEQ ID NO: 540800 - DNA, 16 bp, G. gallus
tggaacaggttgccca

SEQ ID NO: 540801 - DNA, 16 bp, G. gallus
tggaactaggtgatct

SEQ ID NO: 540802 - DNA, 16 bp, G. gallus
tggaactggatgagct

SEQ ID NO: 540803 - DNA, 16 bp, G. gallus
tggaactggatgatcc

SEQ ID NO: 540804 - DNA, 16 bp, G. gallus
tggaactgggtgagct

SEQ ID NO: 540805 - DNA, 16 bp, G. gallus
tggaagccccatcctt

SEQ ID NO: 540806 - DNA, 16 bp, G. gallus
tggaaggaacccacaa

SEQ ID NO: 540807 - DNA, 16 bp, G. gallus
tggaagggatctcaaa

SEQ ID NO: 540808 - DNA, 16 bp, G. gallus
tggaataccaatagca

SEQ ID NO: 540809 - DNA, 16 bp, G. gallus
tggaatggaaaggaaa

SEQ ID NO: 540810 - DNA, 17 bp, G. gallus
tggaatgggctgcccag

SEQ ID NO: 540811 - DNA, 16 bp, G. gallus
tggaatggttgggttg

SEQ ID NO: 540812 - DNA, 16 bp, G. gallus
tggaattagatgatct

SEQ ID NO: 540813 - DNA, 16 bp, G. gallus
tggacaaagaactggc

SEQ ID NO: 540814 - DNA, 16 bp, G. gallus
tggacaacctggtcta

SEQ ID NO: 540815 - DNA, 16 bp, G. gallus
tggacacaaactggaa

SEQ ID NO: 540816 - DNA, 16 bp, G. gallus
tggacacactgctggc

SEQ ID NO: 540817 - DNA, 16 bp, G. gallus
tggacacagcactcca

SEQ ID NO: 540818 - DNA, 16 bp, G. gallus
tggacaccactgaaaa

SEQ ID NO: 540819 - DNA, 16 bp, G. gallus
tggacaggctggagag

SEQ ID NO: 540820 - DNA, 16 bp, G. gallus
tggacagttggactgg

SEQ ID NO: 540821 - DNA, 16 bp, G. gallus
tggaccagatggcctt

SEQ ID NO: 540822 - DNA, 16 bp, G. gallus
tggacccactccaaca

SEQ ID NO: 540823 - DNA, 16 bp, G. gallus
tggacctgctgctcac

SEQ ID NO: 540824 - DNA, 16 bp, G. gallus
tggacctgggggtgct

SEQ ID NO: 540825 - DNA, 16 bp, G. gallus
tggactcagtgatctc

SEQ ID NO: 540826 - DNA, 16 bp, G. gallus
tggactgcccagagag

SEQ ID NO: 540827 - DNA, 16 bp, G. gallus
tggacttcagcaaagc

SEQ ID NO: 540828 - DNA, 16 bp, G. gallus
tggacttgatggcctt

SEQ ID NO: 540829 - DNA, 16 bp, G. gallus
tggacttgctgatctt

SEQ ID NO: 540830 - DNA, 16 bp, G. gallus
tggagaaatatggatt

SEQ ID NO: 540831 - DNA, 16 bp, G. gallus
tggagaacaggaggct

SEQ ID NO: 540832 - DNA, 16 bp, G. gallus
tggagaacatgcccta

SEQ ID NO: 540833 - DNA, 16 bp, G. gallus
tggagaagaatttttt

SEQ ID NO: 540834 - DNA, 16 bp, G. gallus
tggagaagagaaggcc

SEQ ID NO: 540835 - DNA, 16 bp, G. gallus
tggagaagagaaggct

SEQ ID NO: 540836 - DNA, 16 bp, G. gallus
tggagaagagaaggtt

SEQ ID NO: 540837 - DNA, 16 bp, G. gallus
tggagaagaggaagct

SEQ ID NO: 540838 - DNA, 16 bp, G. gallus
tggagaagataaggct

SEQ ID NO: 540839 - DNA, 16 bp, G. gallus
tggagaagctggctgc

SEQ ID NO: 540840 - DNA, 16 bp, G. gallus
tggagaaggacttgga

SEQ ID NO: 540841 - DNA, 16 bp, G. gallus
tggagaagggaaagct

SEQ ID NO: 540842 - DNA, 16 bp, G. gallus
tggagaagtggaggct

SEQ ID NO: 540843 - DNA, 16 bp, G. gallus
tggagaatagaaggct

SEQ ID NO: 540844 - DNA, 16 bp, G. gallus
tggagacattcaaggc

SEQ ID NO: 540845 - DNA, 16 bp, G. gallus
tggagaccaaacagtg

SEQ ID NO: 540846 - DNA, 16 bp, G. gallus
tggagaccagacagtg

SEQ ID NO: 540847 - DNA, 16 bp, G. gallus
tggagagcggctcggc

SEQ ID NO: 540848 - DNA, 16 bp, G. gallus
tggagatactcaagac

SEQ ID NO: 540849 - DNA, 16 bp, G. gallus
tggagatattcaaaac

SEQ ID NO: 540850 - DNA, 16 bp, G. gallus
tggagatattcaagac

SEQ ID NO: 540851 - DNA, 16 bp, G. gallus
tggagatccctccttt

SEQ ID NO: 540852 - DNA, 16 bp, G. gallus
tggagatctccagaag

SEQ ID NO: 540853 - DNA, 16 bp, G. gallus
tggagcaacctacata

SEQ ID NO: 540854 - DNA, 16 bp, G. gallus
tggagcacaagtctga

SEQ ID NO: 540855 - DNA, 16 bp, G. gallus
tggagcacactgccaa

SEQ ID NO: 540856 - DNA, 16 bp, G. gallus
tggagcacctctcata

SEQ ID NO: 540857 - DNA, 16 bp, G. gallus
tggagcacctctgctg

SEQ ID NO: 540858 - DNA, 16 bp, G. gallus
tggagcacctttccta

SEQ ID NO: 540859 - DNA, 16 bp, G. gallus
tggagcagatccttct

SEQ ID NO: 540860 - DNA, 16 bp, G. gallus
tggagcagccctcata

SEQ ID NO: 540861 - DNA, 16 bp, G. gallus
tggagcaggttgccca

SEQ ID NO: 540862 - DNA, 16 bp, G. gallus
tggagcatgtccagag

SEQ ID NO: 540863 - DNA, 16 bp, G. gallus
tggagccaggggttgg

SEQ ID NO: 540864 - DNA, 16 bp, G. gallus
tggagccttctccagg

SEQ ID NO: 540865 - DNA, 16 bp, G. gallus
tggagctgaacttggt

SEQ ID NO: 540866 - DNA, 16 bp, G. gallus
tggagctgctggagca

SEQ ID NO: 540867 - DNA, 16 bp, G. gallus
tggagctgtgaggggt

SEQ ID NO: 540868 - DNA, 16 bp, G. gallus
tggagctgtgccaggg

SEQ ID NO: 540869 - DNA, 17 bp, G. gallus
tggagctgtggctgtcc

SEQ ID NO: 540870 - DNA, 16 bp, G. gallus
tggagctgttggaatg

SEQ ID NO: 540871 - DNA, 16 bp, G. gallus
tggagctgttggagag

SEQ ID NO: 540872 - DNA, 16 bp, G. gallus
tggagctgttggagca

SEQ ID NO: 540873 - DNA, 16 bp, G. gallus
tggaggaaggtgcttt

SEQ ID NO: 540874 - DNA, 16 bp, G. gallus
tggaggaattcaatta

SEQ ID NO: 540875 - DNA, 16 bp, G. gallus
tggaggatgaaaggat

SEQ ID NO: 540876 - DNA, 16 bp, G. gallus
tggaggtactggtgga

SEQ ID NO: 540877 - DNA, 16 bp, G. gallus
tggaggtggtggagtc

SEQ ID NO: 540878 - DNA, 16 bp, G. gallus
tggaggtgtccaagaa

SEQ ID NO: 540879 - DNA, 16 bp, G. gallus
tggaggttggcggccc

SEQ ID NO: 540880 - DNA, 16 bp, G. gallus
tggagtactgcatcca

SEQ ID NO: 540881 - DNA, 16 bp, G. gallus
tggagtctcctctgga

SEQ ID NO: 540882 - DNA, 16 bp, G. gallus
tggagtctgacatgga

SEQ ID NO: 540883 - DNA, 16 bp, G. gallus
tggagtgtgtccagag

SEQ ID NO: 540884 - DNA, 16 bp, G. gallus
tggataatgctctcag

SEQ ID NO: 540885 - DNA, 16 bp, G. gallus
tggatacaaggaagaa

SEQ ID NO: 540886 - DNA, 16 bp, G. gallus
tggatataaggaagaa

SEQ ID NO: 540887 - DNA, 16 bp, G. gallus
tggatattaggaaaaa

SEQ ID NO: 540888 - DNA, 16 bp, G. gallus
tggatattaggaaata

SEQ ID NO: 540889 - DNA, 16 bp, G. gallus
tggatccactccaaca

SEQ ID NO: 540890 - DNA, 16 bp, G. gallus
tggatcccttccaact

SEQ ID NO: 540891 - DNA, 16 bp, G. gallus
tggatctcagcaggaa

SEQ ID NO: 540892 - DNA, 16 bp, G. gallus
tggatctgttggagtg

SEQ ID NO: 540893 - DNA, 16 bp, G. gallus
tggatgaaaaacttaa

SEQ ID NO: 540894 - DNA, 16 bp, G. gallus
tggatgaggccctgag

SEQ ID NO: 540895 - DNA, 16 bp, G. gallus
tggatgaggctctggg

SEQ ID NO: 540896 - DNA, 16 bp, G. gallus
tggatgaggctgtgag

SEQ ID NO: 540897 - DNA, 16 bp, G. gallus
tggatgcagtactcca

SEQ ID NO: 540898 - DNA, 16 bp, G. gallus
tggatgctccatcctt

SEQ ID NO: 540899 - DNA, 16 bp, G. gallus
tggatggatggatgga

SEQ ID NO: 540900 - DNA, 16 bp, G. gallus
tggatggcaagctgaa

SEQ ID NO: 540901 - DNA, 18 bp, G. gallus
tggatggggccctgggca

SEQ ID NO: 540902 - DNA, 16 bp, G. gallus
tggatggtcattgtgg

SEQ ID NO: 540903 - DNA, 16 bp, G. gallus
tggatgttaggaaaaa

SEQ ID NO: 540904 - DNA, 16 bp, G. gallus
tggattgaaaaggacc

SEQ ID NO: 540905 - DNA, 17 bp, G. gallus
tggattggccctgcctt

SEQ ID NO: 540906 - DNA, 16 bp, G. gallus
tggatttaactctatt

SEQ ID NO: 540907 - DNA, 16 bp, G. gallus
tggatttcagtaaagc

SEQ ID NO: 540908 - DNA, 16 bp, G. gallus
tggatttggtgatctt

SEQ ID NO: 540909 - DNA, 16 bp, G. gallus
tggcaacagcaatgtg

SEQ ID NO: 540910 - DNA, 16 bp, G. gallus
tggcacaacttcaggc

SEQ ID NO: 540911 - DNA, 16 bp, G. gallus
tggcacaacttgaggc

SEQ ID NO: 540912 - DNA, 16 bp, G. gallus
tggcacagactgccca

SEQ ID NO: 540913 - DNA, 16 bp, G. gallus
tggcacagaggtgagg

SEQ ID NO: 540914 - DNA, 16 bp, G. gallus
tggcacagctgcccag

SEQ ID NO: 540915 - DNA, 16 bp, G. gallus
tggcacagctgccctg

SEQ ID NO: 540916 - DNA, 16 bp, G. gallus
tggcacaggctgccca

SEQ ID NO: 540917 - DNA, 16 bp, G. gallus
tggcacccactgacac

SEQ ID NO: 540918 - DNA, 16 bp, G. gallus
tggcagaggagttgga

SEQ ID NO: 540919 - DNA, 16 bp, G. gallus
tggcagaggggttgga

SEQ ID NO: 540920 - DNA, 16 bp, G. gallus
tggcagcacaggggca

SEQ ID NO: 540921 - DNA, 16 bp, G. gallus
tggcagcagagaggca

SEQ ID NO: 540922 - DNA, 16 bp, G. gallus
tggcagcagggagagg

SEQ ID NO: 540923 - DNA, 16 bp, G. gallus
tggcagccctgcctgc

SEQ ID NO: 540924 - DNA, 16 bp, G. gallus
tggcagggctgcactc

SEQ ID NO: 540925 - DNA, 16 bp, G. gallus
tggcagtggaggctga

SEQ ID NO: 540926 - DNA, 16 bp, G. gallus
tggcatccagaacaag

SEQ ID NO: 540927 - DNA, 16 bp, G. gallus
tggccaagaagaccaa

SEQ ID NO: 540928 - DNA, 16 bp, G. gallus
tggccatttccacatt

SEQ ID NO: 540929 - DNA, 16 bp, G. gallus
tggcccagttccatga

SEQ ID NO: 540930 - DNA, 16 bp, G. gallus
tggccctcctgtggac

SEQ ID NO: 540931 - DNA, 16 bp, G. gallus
tggccctcctttggat

SEQ ID NO: 540932 - DNA, 16 bp, G. gallus
tggccctgctggagca

SEQ ID NO: 540933 - DNA, 16 bp, G. gallus
tggcctcctctggacc

SEQ ID NO: 540934 - DNA, 17 bp, G. gallus
tggccttccaggctgca

SEQ ID NO: 540935 - DNA, 16 bp, G. gallus
tggccttcttggccac

SEQ ID NO: 540936 - DNA, 18 bp, G. gallus
tggccttgaacacctcca

SEQ ID NO: 540937 - DNA, 16 bp, G. gallus
tggccttgctgaactt

SEQ ID NO: 540938 - DNA, 16 bp, G. gallus
tggctcacaacatcag

SEQ ID NO: 540939 - DNA, 16 bp, G. gallus
tggctcagggcagcct

SEQ ID NO: 540940 - DNA, 16 bp, G. gallus
tggctggactggatga

SEQ ID NO: 540941 - DNA, 16 bp, G. gallus
tggctggggccctggg

SEQ ID NO: 540942 - DNA, 16 bp, G. gallus
tggcttgtaccagaaa

SEQ ID NO: 540943 - DNA, 16 bp, G. gallus
tggctttctgggctgc

SEQ ID NO: 540944 - DNA, 16 bp, G. gallus
tggctttctgggttgc

SEQ ID NO: 540945 - DNA, 16 bp, G. gallus
tggcttttgaagatct

SEQ ID NO: 540946 - DNA, 19 bp, G. gallus
tgggaagagtacagggatg

SEQ ID NO: 540947 - DNA, 16 bp, G. gallus
tgggaatacaagaaaa

SEQ ID NO: 540948 - DNA, 16 bp, G. gallus
tgggaattccaccaca

SEQ ID NO: 540949 - DNA, 16 bp, G. gallus
tgggacccccagcaca

SEQ ID NO: 540950 - DNA, 16 bp, G. gallus
tgggaccctgggcagc

SEQ ID NO: 540951 - DNA, 16 bp, G. gallus
tgggactctgagcaac

SEQ ID NO: 540952 - DNA, 16 bp, G. gallus
tgggactggtgctctt

SEQ ID NO: 540953 - DNA, 16 bp, G. gallus
tgggagaagaagctga

SEQ ID NO: 540954 - DNA, 16 bp, G. gallus
tgggagacttcaactt

SEQ ID NO: 540955 - DNA, 16 bp, G. gallus
tgggaggcattacttt

SEQ ID NO: 540956 - DNA, 16 bp, G. gallus
tgggaggggacagaac

SEQ ID NO: 540957 - DNA, 16 bp, G. gallus
tgggatattctgtgat

SEQ ID NO: 540958 - DNA, 16 bp, G. gallus
tgggatgttctatgat

SEQ ID NO: 540959 - DNA, 16 bp, G. gallus
tgggattgttcagcct

SEQ ID NO: 540960 - DNA, 16 bp, G. gallus
tgggcaaaggcagaga

SEQ ID NO: 540961 - DNA, 16 bp, G. gallus
tgggcaacctctgcca

SEQ ID NO: 540962 - DNA, 16 bp, G. gallus
tgggcaacctgttcca

SEQ ID NO: 540963 - DNA, 16 bp, G. gallus
tgggcaacctgttccc

SEQ ID NO: 540964 - DNA, 16 bp, G. gallus
tgggcaccactgaaag

SEQ ID NO: 540965 - DNA, 16 bp, G. gallus
tgggcacctccaggaa

SEQ ID NO: 540966 - DNA, 16 bp, G. gallus
tgggcactggcacagg

SEQ ID NO: 540967 - DNA, 16 bp, G. gallus
tgggcagcagtgccag

SEQ ID NO: 540968 - DNA, 16 bp, G. gallus
tgggcagcctgcacca

SEQ ID NO: 540969 - DNA, 16 bp, G. gallus
tgggcagcctgctcca

SEQ ID NO: 540970 - DNA, 16 bp, G. gallus
tgggcagcctggtgta

SEQ ID NO: 540971 - DNA, 16 bp, G. gallus
tgggcagcctgtacca

SEQ ID NO: 540972 - DNA, 16 bp, G. gallus
tgggcagcctgttcca

SEQ ID NO: 540973 - DNA, 16 bp, G. gallus
tgggcatggaacaggc

SEQ ID NO: 540974 - DNA, 16 bp, G. gallus
tgggccctgggcagcc

SEQ ID NO: 540975 - DNA, 16 bp, G. gallus
tgggctagatgatctt

SEQ ID NO: 540976 - DNA, 16 bp, G. gallus
tgggctgcaaacacac

SEQ ID NO: 540977 - DNA, 16 bp, G. gallus
tgggctgcagctccag

SEQ ID NO: 540978 - DNA, 16 bp, G. gallus
tgggctgcatcagcag

SEQ ID NO: 540979 - DNA, 16 bp, G. gallus
tgggctgctcagggag

SEQ ID NO: 540980 - DNA, 16 bp, G. gallus
tgggctgtgagggcac

SEQ ID NO: 540981 - DNA, 16 bp, G. gallus
tgggctttgagctccc

SEQ ID NO: 540982 - DNA, 16 bp, G. gallus
tggggaaaaacaaaac

SEQ ID NO: 540983 - DNA, 16 bp, G. gallus
tggggaaacctcattg

SEQ ID NO: 540984 - DNA, 16 bp, G. gallus
tggggaaactgaggca

SEQ ID NO: 540985 - DNA, 16 bp, G. gallus
tggggaagggaaggca

SEQ ID NO: 540986 - DNA, 16 bp, G. gallus
tggggagcctgttcca

SEQ ID NO: 540987 - DNA, 16 bp, G. gallus
tggggcacccacagct

SEQ ID NO: 540988 - DNA, 16 bp, G. gallus
tggggcagagcctttc

SEQ ID NO: 540989 - DNA, 16 bp, G. gallus
tggggccctgagcagc

SEQ ID NO: 540990 - DNA, 16 bp, G. gallus
tggggcctccagcaca

SEQ ID NO: 540991 - DNA, 16 bp, G. gallus
tggggcctggcattat

SEQ ID NO: 540992 - DNA, 16 bp, G. gallus
tggggctgcagggctg

SEQ ID NO: 540993 - DNA, 16 bp, G. gallus
tgggggtcagcctctg

SEQ ID NO: 540994 - DNA, 16 bp, G. gallus
tgggggtgctggtgga

SEQ ID NO: 540995 - DNA, 16 bp, G. gallus
tggggtgcattaaaag

SEQ ID NO: 540996 - DNA, 16 bp, G. gallus
tgggtcacctctgctg

SEQ ID NO: 540997 - DNA, 16 bp, G. gallus
tgggtcacttccactg

SEQ ID NO: 540998 - DNA, 16 bp, G. gallus
tgggtcatctccactg

SEQ ID NO: 540999 - DNA, 16 bp, G. gallus
tgggtgacctgggtct

SEQ ID NO: 541000 - DNA, 16 bp, G. gallus
tgggtgctgctgtgtg

SEQ ID NO: 541001 - DNA, 16 bp, G. gallus
tgggtggcagccctgc

SEQ ID NO: 541002 - DNA, 16 bp, G. gallus
tgggtgggctatgtga

SEQ ID NO: 541003 - DNA, 16 bp, G. gallus
tgggtgggctctgagg

SEQ ID NO: 541004 - DNA, 16 bp, G. gallus
tgggtggtgtgcttca

SEQ ID NO: 541005 - DNA, 16 bp, G. gallus
tgggttggaactagat

SEQ ID NO: 541006 - DNA, 16 bp, G. gallus
tgggtttaaaaaaaaa

SEQ ID NO: 541007 - DNA, 16 bp, G. gallus
tggtaaaaacaaacaa

SEQ ID NO: 541008 - DNA, 16 bp, G. gallus
tggtcaatggctccat

SEQ ID NO: 541009 - DNA, 16 bp, G. gallus
tggtcaggtgctggaa

SEQ ID NO: 541010 - DNA, 16 bp, G. gallus
tggtcagtgagcatgg

SEQ ID NO: 541011 - DNA, 16 bp, G. gallus
tggtcatgaacctgat

SEQ ID NO: 541012 - DNA, 16 bp, G. gallus
tggtcattgtggtcct

SEQ ID NO: 541013 - DNA, 16 bp, G. gallus
tggtgaaacacctttt

SEQ ID NO: 541014 - DNA, 16 bp, G. gallus
tggtgaagggtctgga

SEQ ID NO: 541015 - DNA, 16 bp, G. gallus
tggtgacagcaacagt

SEQ ID NO: 541016 - DNA, 16 bp, G. gallus
tggtgacagtgggtca

SEQ ID NO: 541017 - DNA, 16 bp, G. gallus
tggtgagcaattgctt

SEQ ID NO: 541018 - DNA, 16 bp, G. gallus
tggtgaggcactggaa

SEQ ID NO: 541019 - DNA, 16 bp, G. gallus
tggtgatatgacagta

SEQ ID NO: 541020 - DNA, 16 bp, G. gallus
tggtgcaatttaaggc

SEQ ID NO: 541021 - DNA, 16 bp, G. gallus
tggtgcctttcagcag

SEQ ID NO: 541022 - DNA, 16 bp, G. gallus
tggtgctcaggggcat

SEQ ID NO: 541023 - DNA, 16 bp, G. gallus
tggtggaaaggcaggg

SEQ ID NO: 541024 - DNA, 16 bp, G. gallus
tggtggagctgtaggt

SEQ ID NO: 541025 - DNA, 16 bp, G. gallus
tggtggataaggaatt

SEQ ID NO: 541026 - DNA, 16 bp, G. gallus
tggtggatgaaaaact

SEQ ID NO: 541027 - DNA, 16 bp, G. gallus
tggtggatggcaagtt

SEQ ID NO: 541028 - DNA, 16 bp, G. gallus
tggtggcatggcagta

SEQ ID NO: 541029 - DNA, 16 bp, G. gallus
tggtgggaaggcagga

SEQ ID NO: 541030 - DNA, 19 bp, G. gallus
tggtgggaaggcagggcca

SEQ ID NO: 541031 - DNA, 16 bp, G. gallus
tggtggggatgggctg

SEQ ID NO: 541032 - DNA, 16 bp, G. gallus
tggtgtcatcttcaaa

SEQ ID NO: 541033 - DNA, 16 bp, G. gallus
tggtgtctgacacaga

SEQ ID NO: 541034 - DNA, 16 bp, G. gallus
tggtgtggcctcacct

SEQ ID NO: 541035 - DNA, 16 bp, G. gallus
tggttcccttccaact

SEQ ID NO: 541036 - DNA, 16 bp, G. gallus
tggttcttctcttacc

SEQ ID NO: 541037 - DNA, 16 bp, G. gallus
tggttggaagggacct

SEQ ID NO: 541038 - DNA, 16 bp, G. gallus
tggttggtgactctgc

SEQ ID NO: 541039 - DNA, 16 bp, G. gallus
tggtttaacctggcag

SEQ ID NO: 541040 - DNA, 16 bp, G. gallus
tggtttcttctcactg

SEQ ID NO: 541041 - DNA, 16 bp, G. gallus
tggttttctgggctgt

SEQ ID NO: 541042 - DNA, 16 bp, G. gallus
tgtaaaaacaacaaca

SEQ ID NO: 541043 - DNA, 16 bp, G. gallus
tgtaaaaagtttattt

SEQ ID NO: 541044 - DNA, 16 bp, G. gallus
tgtaaaggttggaggc

SEQ ID NO: 541045 - DNA, 16 bp, G. gallus
tgtaatgtgatggaaa

SEQ ID NO: 541046 - DNA, 16 bp, G. gallus
tgtacatacatacata

SEQ ID NO: 541047 - DNA, 16 bp, G. gallus
tgtacatacatatata

SEQ ID NO: 541048 - DNA, 16 bp, G. gallus
tgtactgaagactcca

SEQ ID NO: 541049 - DNA, 16 bp, G. gallus
tgtactgaaggacatg

SEQ ID NO: 541050 - DNA, 16 bp, G. gallus
tgtagaatcatagaat

SEQ ID NO: 541051 - DNA, 16 bp, G. gallus
tgtagaggaaatggac

SEQ ID NO: 541052 - DNA, 16 bp, G. gallus
tgtagatgggagtcac

SEQ ID NO: 541053 - DNA, 16 bp, G. gallus
tgtatatgtgtgtgtg

SEQ ID NO: 541054 - DNA, 16 bp, G. gallus
tgtatcctcagcaagt

SEQ ID NO: 541055 - DNA, 16 bp, G. gallus
tgtatgcaatgcagct

SEQ ID NO: 541056 - DNA, 16 bp, G. gallus
tgtatgggaactgctg

SEQ ID NO: 541057 - DNA, 16 bp, G. gallus
tgtatgtatataaata

SEQ ID NO: 541058 - DNA, 16 bp, G. gallus
tgtatgtatatatata

SEQ ID NO: 541059 - DNA, 16 bp, G. gallus
tgtatgtatgtatatg

SEQ ID NO: 541060 - DNA, 16 bp, G. gallus
tgtatgtcttaactgt

SEQ ID NO: 541061 - DNA, 16 bp, G. gallus
tgtatgtgtatgtata

SEQ ID NO: 541062 - DNA, 16 bp, G. gallus
tgtatgtgtgtatata

SEQ ID NO: 541063 - DNA, 16 bp, G. gallus
tgtatgtgtgtgtgta

SEQ ID NO: 541064 - DNA, 16 bp, G. gallus
tgtattatctcacatt

SEQ ID NO: 541065 - DNA, 16 bp, G. gallus
tgtatttcagcagtgg

SEQ ID NO: 541066 - DNA, 16 bp, G. gallus
tgtattttcaccagtg

SEQ ID NO: 541067 - DNA, 16 bp, G. gallus
tgtcaaatgctttgca

SEQ ID NO: 541068 - DNA, 16 bp, G. gallus
tgtcaacccatcacca

SEQ ID NO: 541069 - DNA, 16 bp, G. gallus
tgtcaactgaaaatgg

SEQ ID NO: 541070 - DNA, 16 bp, G. gallus
tgtcaccacagctgaa

SEQ ID NO: 541071 - DNA, 16 bp, G. gallus
tgtcactgtcacacag

SEQ ID NO: 541072 - DNA, 16 bp, G. gallus
tgtcactgtcaccact

SEQ ID NO: 541073 - DNA, 16 bp, G. gallus
tgtcagaagcagatgt

SEQ ID NO: 541074 - DNA, 16 bp, G. gallus
tgtcagactgttcctc

SEQ ID NO: 541075 - DNA, 16 bp, G. gallus
tgtcaggaagttatct

SEQ ID NO: 541076 - DNA, 16 bp, G. gallus
tgtcatggttttgtaa

SEQ ID NO: 541077 - DNA, 16 bp, G. gallus
tgtccacctatcacca

SEQ ID NO: 541078 - DNA, 18 bp, G. gallus
tgtccaggtatggagccc

SEQ ID NO: 541079 - DNA, 17 bp, G. gallus
tgtccatcagtacacca

SEQ ID NO: 541080 - DNA, 18 bp, G. gallus
tgtccatctgtgctcctt

SEQ ID NO: 541081 - DNA, 16 bp, G. gallus
tgtccctcaatgccac

SEQ ID NO: 541082 - DNA, 16 bp, G. gallus
tgtccctcagtgcctc

SEQ ID NO: 541083 - DNA, 16 bp, G. gallus
tgtccctgttcattgc

SEQ ID NO: 541084 - DNA, 16 bp, G. gallus
tgtcctcacaggagag

SEQ ID NO: 541085 - DNA, 16 bp, G. gallus
tgtcctgcacatgctg

SEQ ID NO: 541086 - DNA, 16 bp, G. gallus
tgtccttcttgtgctg

SEQ ID NO: 541087 - DNA, 16 bp, G. gallus
tgtctcagcctgtcct

SEQ ID NO: 541088 - DNA, 16 bp, G. gallus
tgtctcagtttaaaat

SEQ ID NO: 541089 - DNA, 16 bp, G. gallus
tgtctgtcctcccctt

SEQ ID NO: 541090 - DNA, 16 bp, G. gallus
tgtctgtctgtctctc

SEQ ID NO: 541091 - DNA, 16 bp, G. gallus
tgtctgtctgtctgct

SEQ ID NO: 541092 - DNA, 16 bp, G. gallus
tgtctgtctgtctgtc

SEQ ID NO: 541093 - DNA, 16 bp, G. gallus
tgtcttagtttcagct

SEQ ID NO: 541094 - DNA, 16 bp, G. gallus
tgtcttcatagaagag

SEQ ID NO: 541095 - DNA, 16 bp, G. gallus
tgtcttccatgctttg

SEQ ID NO: 541096 - DNA, 16 bp, G. gallus
tgtctttaaaagacag

SEQ ID NO: 541097 - DNA, 16 bp, G. gallus
tgtctttcacgtcact

SEQ ID NO: 541098 - DNA, 16 bp, G. gallus
tgtgaaaaacaaacaa

SEQ ID NO: 541099 - DNA, 16 bp, G. gallus
tgtgaaaaatttcctc

SEQ ID NO: 541100 - DNA, 17 bp, G. gallus
tgtgaaagtgcttggaa

SEQ ID NO: 541101 - DNA, 16 bp, G. gallus
tgtgaacctcatgaag

SEQ ID NO: 541102 - DNA, 16 bp, G. gallus
tgtgaagagcttggag

SEQ ID NO: 541103 - DNA, 16 bp, G. gallus
tgtgaattccaccaca

SEQ ID NO: 541104 - DNA, 16 bp, G. gallus
tgtgagcacagtgagg

SEQ ID NO: 541105 - DNA, 16 bp, G. gallus
tgtgagcagagcccag

SEQ ID NO: 541106 - DNA, 16 bp, G. gallus
tgtgaggccccagctg

SEQ ID NO: 541107 - DNA, 16 bp, G. gallus
tgtgatggggagcagc

SEQ ID NO: 541108 - DNA, 16 bp, G. gallus
tgtgatgtgacagctg

SEQ ID NO: 541109 - DNA, 16 bp, G. gallus
tgtgattctatgattc

SEQ ID NO: 541110 - DNA, 16 bp, G. gallus
tgtgcaagtttggtgg

SEQ ID NO: 541111 - DNA, 16 bp, G. gallus
tgtgcagagaagagca

SEQ ID NO: 541112 - DNA, 16 bp, G. gallus
tgtgcagcagcagcag

SEQ ID NO: 541113 - DNA, 16 bp, G. gallus
tgtgcaggtgacagag

SEQ ID NO: 541114 - DNA, 16 bp, G. gallus
tgtgctgcctccctgg

SEQ ID NO: 541115 - DNA, 16 bp, G. gallus
tgtggaagaaatggac

SEQ ID NO: 541116 - DNA, 16 bp, G. gallus
tgtggagtttccttct

SEQ ID NO: 541117 - DNA, 16 bp, G. gallus
tgtggatgaacaggga

SEQ ID NO: 541118 - DNA, 16 bp, G. gallus
tgtggcaaagagcctc

SEQ ID NO: 541119 - DNA, 16 bp, G. gallus
tgtggcactgagtgac

SEQ ID NO: 541120 - DNA, 16 bp, G. gallus
tgtggccatttccttg

SEQ ID NO: 541121 - DNA, 16 bp, G. gallus
tgtggcctttcagtac

SEQ ID NO: 541122 - DNA, 16 bp, G. gallus
tgtgggagatggagag

SEQ ID NO: 541123 - DNA, 16 bp, G. gallus
tgtggtccttttcatc

SEQ ID NO: 541124 - DNA, 16 bp, G. gallus
tgtggtgctcaggaac

SEQ ID NO: 541125 - DNA, 16 bp, G. gallus
tgtggtggaattcatt

SEQ ID NO: 541126 - DNA, 16 bp, G. gallus
tgtggtggaattccct

SEQ ID NO: 541127 - DNA, 16 bp, G. gallus
tgtggtggaattccta

SEQ ID NO: 541128 - DNA, 16 bp, G. gallus
tgtggtggaattcctg

SEQ ID NO: 541129 - DNA, 16 bp, G. gallus
tgtggtggaattcgct

SEQ ID NO: 541130 - DNA, 16 bp, G. gallus
tgtggtggaattcgtt

SEQ ID NO: 541131 - DNA, 16 bp, G. gallus
tgtgtagagccaggag

SEQ ID NO: 541132 - DNA, 16 bp, G. gallus
tgtgtagatgtggcac

SEQ ID NO: 541133 - DNA, 16 bp, G. gallus
tgtgtatacatatata

SEQ ID NO: 541134 - DNA, 16 bp, G. gallus
tgtgtatatatgtaca

SEQ ID NO: 541135 - DNA, 16 bp, G. gallus
tgtgtatgtatatata

SEQ ID NO: 541136 - DNA, 16 bp, G. gallus
tgtgtatgtatgtaca

SEQ ID NO: 541137 - DNA, 16 bp, G. gallus
tgtgtatgtgtgtgta

SEQ ID NO: 541138 - DNA, 16 bp, G. gallus
tgtgtccagctctggg

SEQ ID NO: 541139 - DNA, 16 bp, G. gallus
tgtgtctacagcagct

SEQ ID NO: 541140 - DNA, 73 bp, G. gallus
tgtgtcttgggccaccaggttgcaggggctcaccccctacctgctcagtcattggttcatgctgtgaaggggt

SEQ ID NO: 541141 - DNA, 16 bp, G. gallus
tgtgtgagagagagag

SEQ ID NO: 541142 - DNA, 16 bp, G. gallus
tgtgtgcatgtgtgtg

SEQ ID NO: 541143 - DNA, 16 bp, G. gallus
tgtgtgcttgcagcct

SEQ ID NO: 541144 - DNA, 16 bp, G. gallus
tgtgtggaaccaggag

SEQ ID NO: 541145 - DNA, 16 bp, G. gallus
tgtgtgtatatatgtg

SEQ ID NO: 541146 - DNA, 16 bp, G. gallus
tgtgtgtatgtatata

SEQ ID NO: 541147 - DNA, 16 bp, G. gallus
tgtgtgtatgtatgtg

SEQ ID NO: 541148 - DNA, 16 bp, G. gallus
tgtgtgtgcatatata

SEQ ID NO: 541149 - DNA, 16 bp, G. gallus
tgtgtgtgcatgcatg

SEQ ID NO: 541150 - DNA, 16 bp, G. gallus
tgtgtgtgcgcgtgtg

SEQ ID NO: 541151 - DNA, 16 bp, G. gallus
tgtgtgtgtatatata

SEQ ID NO: 541152 - DNA, 16 bp, G. gallus
tgtgtgtgtatatgca

SEQ ID NO: 541153 - DNA, 16 bp, G. gallus
tgtgtgtgtgcacata

SEQ ID NO: 541154 - DNA, 16 bp, G. gallus
tgtgtgtgtgcacatg

SEQ ID NO: 541155 - DNA, 16 bp, G. gallus
tgtgtgtgtgcctgtg

SEQ ID NO: 541156 - DNA, 16 bp, G. gallus
tgtgtgtgtgtgcagc

SEQ ID NO: 541157 - DNA, 16 bp, G. gallus
tgtgtgtgtgtgctca

SEQ ID NO: 541158 - DNA, 16 bp, G. gallus
tgtgtgtgtgtgctgc

SEQ ID NO: 541159 - DNA, 16 bp, G. gallus
tgtgtgtgtgtgtaag

SEQ ID NO: 541160 - DNA, 16 bp, G. gallus
tgtgttcagttttgtg

SEQ ID NO: 541161 - DNA, 16 bp, G. gallus
tgtgttggaaggaacc

SEQ ID NO: 541162 - DNA, 16 bp, G. gallus
tgtgttggaagggacc

SEQ ID NO: 541163 - DNA, 16 bp, G. gallus
tgttaaaacaaacaaa

SEQ ID NO: 541164 - DNA, 16 bp, G. gallus
tgttacctgggagaag

SEQ ID NO: 541165 - DNA, 16 bp, G. gallus
tgttaggaagaagttt

SEQ ID NO: 541166 - DNA, 16 bp, G. gallus
tgttatcacagaatca

SEQ ID NO: 541167 - DNA, 16 bp, G. gallus
tgttattgtgcccttt

SEQ ID NO: 541168 - DNA, 16 bp, G. gallus
tgttattgtgctcttt

SEQ ID NO: 541169 - DNA, 16 bp, G. gallus
tgttcaacctggagaa

SEQ ID NO: 541170 - DNA, 16 bp, G. gallus
tgttcaatcactgctt

SEQ ID NO: 541171 - DNA, 16 bp, G. gallus
tgttcagcccggagaa

SEQ ID NO: 541172 - DNA, 16 bp, G. gallus
tgttcagcctgaagaa

SEQ ID NO: 541173 - DNA, 16 bp, G. gallus
tgttcagcctggacaa

SEQ ID NO: 541174 - DNA, 16 bp, G. gallus
tgttcaggctgatgaa

SEQ ID NO: 541175 - DNA, 16 bp, G. gallus
tgttcagtctgcagaa

SEQ ID NO: 541176 - DNA, 16 bp, G. gallus
tgttcatcctggagaa

SEQ ID NO: 541177 - DNA, 16 bp, G. gallus
tgttcctcagcaaact

SEQ ID NO: 541178 - DNA, 16 bp, G. gallus
tgttcctctgctgcca

SEQ ID NO: 541179 - DNA, 16 bp, G. gallus
tgttctcatttgctgt

SEQ ID NO: 541180 - DNA, 16 bp, G. gallus
tgttctgtctggagaa

SEQ ID NO: 541181 - DNA, 16 bp, G. gallus
tgttctgtgtgagaca

SEQ ID NO: 541182 - DNA, 16 bp, G. gallus
tgttgaaaaagagtgt

SEQ ID NO: 541183 - DNA, 16 bp, G. gallus
tgttgaggacaacttc

SEQ ID NO: 541184 - DNA, 16 bp, G. gallus
tgttgagtcatggcct

SEQ ID NO: 541185 - DNA, 16 bp, G. gallus
tgttgataacacactg

SEQ ID NO: 541186 - DNA, 16 bp, G. gallus
tgttgcaagagaaagg

SEQ ID NO: 541187 - DNA, 16 bp, G. gallus
tgttgctatgtgacag

SEQ ID NO: 541188 - DNA, 16 bp, G. gallus
tgttgctgtcaccact

SEQ ID NO: 541189 - DNA, 16 bp, G. gallus
tgttggagcagatcca

SEQ ID NO: 541190 - DNA, 16 bp, G. gallus
tgttggagcagtgctt

SEQ ID NO: 541191 - DNA, 16 bp, G. gallus
tgttgtcatgtgacag

SEQ ID NO: 541192 - DNA, 16 bp, G. gallus
tgtttaaaaaacaaac

SEQ ID NO: 541193 - DNA, 16 bp, G. gallus
tgtttaaaaactgttt

SEQ ID NO: 541194 - DNA, 16 bp, G. gallus
tgtttacaagggtgga

SEQ ID NO: 541195 - DNA, 16 bp, G. gallus
tgtttacgagggtgga

SEQ ID NO: 541196 - DNA, 16 bp, G. gallus
tgtttcagtgcatcac

SEQ ID NO: 541197 - DNA, 16 bp, G. gallus
tgtttcagtgcctcac

SEQ ID NO: 541198 - DNA, 16 bp, G. gallus
tgtttcttaaaaaaaa

SEQ ID NO: 541199 - DNA, 16 bp, G. gallus
tgtttgcttgcttgct

SEQ ID NO: 541200 - DNA, 16 bp, G. gallus
tgtttggaaaaaaaaa

SEQ ID NO: 541201 - DNA, 16 bp, G. gallus
tgtttgtttgcttact

SEQ ID NO: 541202 - DNA, 16 bp, G. gallus
tgttttctgaagaaaa

SEQ ID NO: 541203 - DNA, 16 bp, G. gallus
tgttttgttttccata

SEQ ID NO: 541204 - DNA, 16 bp, G. gallus
tgttttgtttttcagg

SEQ ID NO: 541205 - DNA, 16 bp, G. gallus
tgtttttaaagaaaaa

SEQ ID NO: 541206 - DNA, 16 bp, G. gallus
tgtttttttaaagaaa

SEQ ID NO: 541207 - DNA, 17 bp, G. gallus
ttaaacacatccaggga

SEQ ID NO: 541208 - DNA, 16 bp, G. gallus
ttaaactaaaagaaga

SEQ ID NO: 541209 - DNA, 18 bp, G. gallus
ttaaactgagacagggga

SEQ ID NO: 541210 - DNA, 17 bp, G. gallus
ttaaagataaagatgtt

SEQ ID NO: 541211 - DNA, 16 bp, G. gallus
ttaaaggtcccttcca

SEQ ID NO: 541212 - DNA, 16 bp, G. gallus
ttaaaggtcctttcca

SEQ ID NO: 541213 - DNA, 16 bp, G. gallus
ttaacgatcttgatga

SEQ ID NO: 541214 - DNA, 16 bp, G. gallus
ttaagcctggagaaga

SEQ ID NO: 541215 - DNA, 16 bp, G. gallus
ttaaggctgaaaaaga

SEQ ID NO: 541216 - DNA, 16 bp, G. gallus
ttaaggttggagaaga

SEQ ID NO: 541217 - DNA, 16 bp, G. gallus
ttaagttgtgccaggg

SEQ ID NO: 541218 - DNA, 16 bp, G. gallus
ttaatgatcttgatga

SEQ ID NO: 541219 - DNA, 16 bp, G. gallus
ttacagcccagaaggc

SEQ ID NO: 541220 - DNA, 16 bp, G. gallus
ttacagtgagggtggt

SEQ ID NO: 541221 - DNA, 16 bp, G. gallus
ttacattttgttgtca

SEQ ID NO: 541222 - DNA, 16 bp, G. gallus
ttaccagaagctggtg

SEQ ID NO: 541223 - DNA, 17 bp, G. gallus
ttacccttgctaccaca

SEQ ID NO: 541224 - DNA, 16 bp, G. gallus
ttacctccagggtctg

SEQ ID NO: 541225 - DNA, 16 bp, G. gallus
ttactggtattccaca

SEQ ID NO: 541226 - DNA, 16 bp, G. gallus
ttactgtgctctttgt

SEQ ID NO: 541227 - DNA, 16 bp, G. gallus
ttacttgaaaaaaaaa

SEQ ID NO: 541228 - DNA, 16 bp, G. gallus
ttactttcagagcaac

SEQ ID NO: 541229 - DNA, 16 bp, G. gallus
ttacttttggagcaac

SEQ ID NO: 541230 - DNA, 16 bp, G. gallus
ttagaaggaaattctt

SEQ ID NO: 541231 - DNA, 16 bp, G. gallus
ttagaatcacagaatc

SEQ ID NO: 541232 - DNA, 16 bp, G. gallus
ttagaatcatacaatc

SEQ ID NO: 541233 - DNA, 16 bp, G. gallus
ttagacataaggaaaa

SEQ ID NO: 541234 - DNA, 16 bp, G. gallus
ttagagggcatggtgg

SEQ ID NO: 541235 - DNA, 16 bp, G. gallus
ttagcagaggggttgg

SEQ ID NO: 541236 - DNA, 16 bp, G. gallus
ttagcagcagcagcag

SEQ ID NO: 541237 - DNA, 16 bp, G. gallus
ttaggaaaaaattctt

SEQ ID NO: 541238 - DNA, 16 bp, G. gallus
ttaggaaaagattctt

SEQ ID NO: 541239 - DNA, 16 bp, G. gallus
ttaggaaacatttctt

SEQ ID NO: 541240 - DNA, 16 bp, G. gallus
ttaggcagaaattctt

SEQ ID NO: 541241 - DNA, 17 bp, G. gallus
ttagtggcttgtggtag

SEQ ID NO: 541242 - DNA, 16 bp, G. gallus
ttagtgtttttttcca

SEQ ID NO: 541243 - DNA, 16 bp, G. gallus
ttatacacacacacac

SEQ ID NO: 541244 - DNA, 16 bp, G. gallus
ttatagttgctgctaa

SEQ ID NO: 541245 - DNA, 18 bp, G. gallus
ttatctagatagatctgt

SEQ ID NO: 541246 - DNA, 16 bp, G. gallus
ttatctcaacccatga

SEQ ID NO: 541247 - DNA, 16 bp, G. gallus
ttatgaggagcagctg

SEQ ID NO: 541248 - DNA, 16 bp, G. gallus
ttatgatgatgatgat

SEQ ID NO: 541249 - DNA, 16 bp, G. gallus
ttatgtggaaaaaaaa

SEQ ID NO: 541250 - DNA, 19 bp, G. gallus
ttattacaagttctcacat

SEQ ID NO: 541251 - DNA, 16 bp, G. gallus
ttattacagaaaaaaa

SEQ ID NO: 541252 - DNA, 16 bp, G. gallus
ttattattattgctat

SEQ ID NO: 541253 - DNA, 16 bp, G. gallus
ttattattattttgcc

SEQ ID NO: 541254 - DNA, 16 bp, G. gallus
ttattcctccccagat

SEQ ID NO: 541255 - DNA, 16 bp, G. gallus
ttattgatgacttgga

SEQ ID NO: 541256 - DNA, 16 bp, G. gallus
ttattgctattattat

SEQ ID NO: 541257 - DNA, 16 bp, G. gallus
ttattgttgttgctgt

SEQ ID NO: 541258 - DNA, 16 bp, G. gallus
ttatttccatggaaac

SEQ ID NO: 541259 - DNA, 16 bp, G. gallus
ttatttttaaaaagca

SEQ ID NO: 541260 - DNA, 16 bp, G. gallus
ttatttttaaaaggaa

SEQ ID NO: 541261 - DNA, 16 bp, G. gallus
ttatttttttccccag

SEQ ID NO: 541262 - DNA, 16 bp, G. gallus
ttatttttttcctgag

SEQ ID NO: 541263 - DNA, 16 bp, G. gallus
ttcaaaagaaaatatt

SEQ ID NO: 541264 - DNA, 16 bp, G. gallus
ttcaaagaggaaaaaa

SEQ ID NO: 541265 - DNA, 16 bp, G. gallus
ttcaacacaacatcca

SEQ ID NO: 541266 - DNA, 16 bp, G. gallus
ttcaacctctactacc

SEQ ID NO: 541267 - DNA, 16 bp, G. gallus
ttcaacctctactgct

SEQ ID NO: 541268 - DNA, 16 bp, G. gallus
ttcaacctgagcaatt

SEQ ID NO: 541269 - DNA, 16 bp, G. gallus
ttcaactctttgaaag

SEQ ID NO: 541270 - DNA, 16 bp, G. gallus
ttcaagaaatgtggag

SEQ ID NO: 541271 - DNA, 16 bp, G. gallus
ttcaaggatcatcaag

SEQ ID NO: 541272 - DNA, 16 bp, G. gallus
ttcaaggggaaaaaaa

SEQ ID NO: 541273 - DNA, 16 bp, G. gallus
ttcacagaagaaaaaa

SEQ ID NO: 541274 - DNA, 16 bp, G. gallus
ttcacattgctgttgc

SEQ ID NO: 541275 - DNA, 16 bp, G. gallus
ttcaccagactgccat

SEQ ID NO: 541276 - DNA, 16 bp, G. gallus
ttcacccagaaggtgg

SEQ ID NO: 541277 - DNA, 16 bp, G. gallus
ttcacctgattgccat

SEQ ID NO: 541278 - DNA, 16 bp, G. gallus
ttcagaaacaaacaaa

SEQ ID NO: 541279 - DNA, 16 bp, G. gallus
ttcagaaactttctct

SEQ ID NO: 541280 - DNA, 16 bp, G. gallus
ttcagaaaggaaaaaa

SEQ ID NO: 541281 - DNA, 16 bp, G. gallus
ttcagagcagcagctg

SEQ ID NO: 541282 - DNA, 16 bp, G. gallus
ttcagagcagccttca

SEQ ID NO: 541283 - DNA, 16 bp, G. gallus
ttcagagggatggaga

SEQ ID NO: 541284 - DNA, 16 bp, G. gallus
ttcagcaaggccaagt

SEQ ID NO: 541285 - DNA, 16 bp, G. gallus
ttcagcaagtgtcaat

SEQ ID NO: 541286 - DNA, 16 bp, G. gallus
ttcagccagctgtcaa

SEQ ID NO: 541287 - DNA, 16 bp, G. gallus
ttcagcctagagaaga

SEQ ID NO: 541288 - DNA, 16 bp, G. gallus
ttcagcctctgctgcc

SEQ ID NO: 541289 - DNA, 16 bp, G. gallus
ttcagcctgaagaaaa

SEQ ID NO: 541290 - DNA, 16 bp, G. gallus
ttcagcctgcagaaga

SEQ ID NO: 541291 - DNA, 16 bp, G. gallus
ttcagcctggagaaca

SEQ ID NO: 541292 - DNA, 16 bp, G. gallus
ttcagctgcaggaggt

SEQ ID NO: 541293 - DNA, 16 bp, G. gallus
ttcagctgggacagag

SEQ ID NO: 541294 - DNA, 16 bp, G. gallus
ttcaggaaaagaaaaa

SEQ ID NO: 541295 - DNA, 16 bp, G. gallus
ttcaggaaagaaaaaa

SEQ ID NO: 541296 - DNA, 16 bp, G. gallus
ttcaggaagaaaaaaa

SEQ ID NO: 541297 - DNA, 16 bp, G. gallus
ttcaggcagttataga

SEQ ID NO: 541298 - DNA, 23 bp, G. gallus
ttcaggctggacgttaggaaata

SEQ ID NO: 541299 - DNA, 16 bp, G. gallus
ttcagggatggtgact

SEQ ID NO: 541300 - DNA, 16 bp, G. gallus
ttcagtatctttattg

SEQ ID NO: 541301 - DNA, 16 bp, G. gallus
ttcagtatggagaaga

SEQ ID NO: 541302 - DNA, 16 bp, G. gallus
ttcagtctggagaaaa

SEQ ID NO: 541303 - DNA, 16 bp, G. gallus
ttcagtctggaggagg

SEQ ID NO: 541304 - DNA, 16 bp, G. gallus
ttcagtggatgaagaa

SEQ ID NO: 541305 - DNA, 16 bp, G. gallus
ttcagttccatctgtg

SEQ ID NO: 541306 - DNA, 16 bp, G. gallus
ttcagttggaagagac

SEQ ID NO: 541307 - DNA, 16 bp, G. gallus
ttcagtttaaaaaaaa

SEQ ID NO: 541308 - DNA, 16 bp, G. gallus
ttcatcaatgcttgct

SEQ ID NO: 541309 - DNA, 16 bp, G. gallus
ttcatcagtgacatca

SEQ ID NO: 541310 - DNA, 16 bp, G. gallus
ttcatcatcatcatca

SEQ ID NO: 541311 - DNA, 16 bp, G. gallus
ttcatcctggagaaga

SEQ ID NO: 541312 - DNA, 16 bp, G. gallus
ttcatctcagaaagag

SEQ ID NO: 541313 - DNA, 16 bp, G. gallus
ttcattaaaaagaaaa

SEQ ID NO: 541314 - DNA, 16 bp, G. gallus
ttcattaaggttggaa

SEQ ID NO: 541315 - DNA, 16 bp, G. gallus
ttcattctggagaaga

SEQ ID NO: 541316 - DNA, 16 bp, G. gallus
ttcattgcagccttcc

SEQ ID NO: 541317 - DNA, 18 bp, G. gallus
ttccaacccaaaccattc

SEQ ID NO: 541318 - DNA, 16 bp, G. gallus
ttccaacccaagccat

SEQ ID NO: 541319 - DNA, 16 bp, G. gallus
ttccaaccttgatgat

SEQ ID NO: 541320 - DNA, 16 bp, G. gallus
ttccaactcaaaagat

SEQ ID NO: 541321 - DNA, 16 bp, G. gallus
ttccaactccctgctg

SEQ ID NO: 541322 - DNA, 16 bp, G. gallus
ttccaacttgggatat

SEQ ID NO: 541323 - DNA, 16 bp, G. gallus
ttccaagagctccaca

SEQ ID NO: 541324 - DNA, 16 bp, G. gallus
ttccaaggaaaaaaaa

SEQ ID NO: 541325 - DNA, 16 bp, G. gallus
ttccactggaaaaaaa

SEQ ID NO: 541326 - DNA, 16 bp, G. gallus
ttccagagatggggca

SEQ ID NO: 541327 - DNA, 16 bp, G. gallus
ttccagatgtggcctc

SEQ ID NO: 541328 - DNA, 16 bp, G. gallus
ttccagcgtctcacca

SEQ ID NO: 541329 - DNA, 16 bp, G. gallus
ttccagctccttcagc

SEQ ID NO: 541330 - DNA, 16 bp, G. gallus
ttccaggaaaaaaaaa

SEQ ID NO: 541331 - DNA, 16 bp, G. gallus
ttccaggaggatctgc

SEQ ID NO: 541332 - DNA, 16 bp, G. gallus
ttccagggaggggaca

SEQ ID NO: 541333 - DNA, 16 bp, G. gallus
ttccagggcctcacca

SEQ ID NO: 541334 - DNA, 16 bp, G. gallus
ttccagtgcatcacca

SEQ ID NO: 541335 - DNA, 16 bp, G. gallus
ttccagtgctttgtca

SEQ ID NO: 541336 - DNA, 16 bp, G. gallus
ttccagttaaaaaaaa

SEQ ID NO: 541337 - DNA, 16 bp, G. gallus
ttccatggaaagtaca

SEQ ID NO: 541338 - DNA, 16 bp, G. gallus
ttcccaggagcagagc

SEQ ID NO: 541339 - DNA, 16 bp, G. gallus
ttccctcaacctttcc

SEQ ID NO: 541340 - DNA, 16 bp, G. gallus
ttccctcagccacttc

SEQ ID NO: 541341 - DNA, 16 bp, G. gallus
ttccctccttcaattt

SEQ ID NO: 541342 - DNA, 16 bp, G. gallus
ttccctctcatcctat

SEQ ID NO: 541343 - DNA, 16 bp, G. gallus
ttccctcttttagttt

SEQ ID NO: 541344 - DNA, 16 bp, G. gallus
ttcccttttgtcctat

SEQ ID NO: 541345 - DNA, 16 bp, G. gallus
ttcctcaggggtcagt

SEQ ID NO: 541346 - DNA, 16 bp, G. gallus
ttcctccatgaagaaa

SEQ ID NO: 541347 - DNA, 16 bp, G. gallus
ttcctccatgcagaag

SEQ ID NO: 541348 - DNA, 16 bp, G. gallus
ttcctctcagaaggga

SEQ ID NO: 541349 - DNA, 16 bp, G. gallus
ttcctctggaaaaaaa

SEQ ID NO: 541350 - DNA, 16 bp, G. gallus
ttcctgaaggcattca

SEQ ID NO: 541351 - DNA, 16 bp, G. gallus
ttcctgatatccaacc

SEQ ID NO: 541352 - DNA, 16 bp, G. gallus
ttcctgcctcctctgc

SEQ ID NO: 541353 - DNA, 16 bp, G. gallus
ttcctgctgctgctgc

SEQ ID NO: 541354 - DNA, 16 bp, G. gallus
ttcctggagaaaaaaa

SEQ ID NO: 541355 - DNA, 16 bp, G. gallus
ttcctgtgctccagtt

SEQ ID NO: 541356 - DNA, 16 bp, G. gallus
ttccttatgtccaatc

SEQ ID NO: 541357 - DNA, 16 bp, G. gallus
ttccttcgccttctta

SEQ ID NO: 541358 - DNA, 17 bp, G. gallus
ttccttctgctgtatca

SEQ ID NO: 541359 - DNA, 16 bp, G. gallus
ttccttgacctgctgg

SEQ ID NO: 541360 - DNA, 16 bp, G. gallus
ttcctttaaaagaaaa

SEQ ID NO: 541361 - DNA, 16 bp, G. gallus
ttcctttccattccat

SEQ ID NO: 541362 - DNA, 16 bp, G. gallus
ttccttttctgtccta

SEQ ID NO: 541363 - DNA, 16 bp, G. gallus
ttctacaggtacattg

SEQ ID NO: 541364 - DNA, 16 bp, G. gallus
ttctatgattctatgg

SEQ ID NO: 541365 - DNA, 16 bp, G. gallus
ttctcaaattccttta

SEQ ID NO: 541366 - DNA, 16 bp, G. gallus
ttctcagctagaaaac

SEQ ID NO: 541367 - DNA, 16 bp, G. gallus
ttctcagtggtgccca

SEQ ID NO: 541368 - DNA, 16 bp, G. gallus
ttctcagttcaagaaa

SEQ ID NO: 541369 - DNA, 16 bp, G. gallus
ttctcatgctgccctg

SEQ ID NO: 541370 - DNA, 16 bp, G. gallus
ttctccaagcccttca

SEQ ID NO: 541371 - DNA, 16 bp, G. gallus
ttctccaagctcttca

SEQ ID NO: 541372 - DNA, 16 bp, G. gallus
ttctccagagtgaaca

SEQ ID NO: 541373 - DNA, 16 bp, G. gallus
ttctccaggctgagca

SEQ ID NO: 541374 - DNA, 16 bp, G. gallus
ttctccatgctaaaca

SEQ ID NO: 541375 - DNA, 16 bp, G. gallus
ttctcctctccaagct

SEQ ID NO: 541376 - DNA, 16 bp, G. gallus
ttctcctctccaggct

SEQ ID NO: 541377 - DNA, 17 bp, G. gallus
ttctcctggagaaactg

SEQ ID NO: 541378 - DNA, 16 bp, G. gallus
ttctcctggagaagct

SEQ ID NO: 541379 - DNA, 16 bp, G. gallus
ttctcctggctgaaca

SEQ ID NO: 541380 - DNA, 16 bp, G. gallus
ttctccttctctggag

SEQ ID NO: 541381 - DNA, 16 bp, G. gallus
ttctctgaaagagtgg

SEQ ID NO: 541382 - DNA, 24 bp, G. gallus
ttctctgaaagggtggtcaggcac

SEQ ID NO: 541383 - DNA, 16 bp, G. gallus
ttctctgcccagcctg

SEQ ID NO: 541384 - DNA, 16 bp, G. gallus
ttctctggacgtgctc

SEQ ID NO: 541385 - DNA, 16 bp, G. gallus
ttctgaaaacaaaaca

SEQ ID NO: 541386 - DNA, 16 bp, G. gallus
ttctgaagaaaaaaat

SEQ ID NO: 541387 - DNA, 16 bp, G. gallus
ttctgatgaaatttta

SEQ ID NO: 541388 - DNA, 16 bp, G. gallus
ttctgatgcaagccag

SEQ ID NO: 541389 - DNA, 16 bp, G. gallus
ttctgatggatgaaaa

SEQ ID NO: 541390 - DNA, 16 bp, G. gallus
ttctgctgctgctttt

SEQ ID NO: 541391 - DNA, 16 bp, G. gallus
ttctggagaagaaatt

SEQ ID NO: 541392 - DNA, 16 bp, G. gallus
ttctggaggcatggat

SEQ ID NO: 541393 - DNA, 16 bp, G. gallus
ttctggtggacaacag

SEQ ID NO: 541394 - DNA, 16 bp, G. gallus
ttctgtctggaggaca

SEQ ID NO: 541395 - DNA, 16 bp, G. gallus
ttctgtgatgctgtga

SEQ ID NO: 541396 - DNA, 16 bp, G. gallus
ttctgtgattctaaac

SEQ ID NO: 541397 - DNA, 16 bp, G. gallus
ttctgtgattctacga

SEQ ID NO: 541398 - DNA, 16 bp, G. gallus
ttctgtgattctgtaa

SEQ ID NO: 541399 - DNA, 16 bp, G. gallus
ttctgtgattctgtga

SEQ ID NO: 541400 - DNA, 16 bp, G. gallus
ttctgttctgttctat

SEQ ID NO: 541401 - DNA, 16 bp, G. gallus
ttcttaatctcacacc

SEQ ID NO: 541402 - DNA, 16 bp, G. gallus
ttcttacagtgaggga

SEQ ID NO: 541403 - DNA, 16 bp, G. gallus
ttcttcacagaaaggg

SEQ ID NO: 541404 - DNA, 16 bp, G. gallus
ttcttcagaaaagaaa

SEQ ID NO: 541405 - DNA, 16 bp, G. gallus
ttcttcagaagaaaaa

SEQ ID NO: 541406 - DNA, 16 bp, G. gallus
ttcttcagtctggaga

SEQ ID NO: 541407 - DNA, 16 bp, G. gallus
ttcttccacaggaggt

SEQ ID NO: 541408 - DNA, 16 bp, G. gallus
ttcttcccagaaagag

SEQ ID NO: 541409 - DNA, 16 bp, G. gallus
ttcttcctcatgttca

SEQ ID NO: 541410 - DNA, 16 bp, G. gallus
ttcttctcaggaagag

SEQ ID NO: 541411 - DNA, 16 bp, G. gallus
ttcttctctggaagag

SEQ ID NO: 541412 - DNA, 16 bp, G. gallus
ttcttctgcatgtttg

SEQ ID NO: 541413 - DNA, 16 bp, G. gallus
ttcttgtattcccaca

SEQ ID NO: 541414 - DNA, 16 bp, G. gallus
ttcttgtgttggaggc

SEQ ID NO: 541415 - DNA, 16 bp, G. gallus
ttctttaagaaaaaaa

SEQ ID NO: 541416 - DNA, 16 bp, G. gallus
ttctttcctgtgaggg

SEQ ID NO: 541417 - DNA, 16 bp, G. gallus
ttctttcttcttctag

SEQ ID NO: 541418 - DNA, 16 bp, G. gallus
ttctttttaagaaaaa

SEQ ID NO: 541419 - DNA, 16 bp, G. gallus
ttctttttctttgaaa

SEQ ID NO: 541420 - DNA, 16 bp, G. gallus
ttctttttttaaagaa

SEQ ID NO: 541421 - DNA, 16 bp, G. gallus
ttgaaaaacagcattt

SEQ ID NO: 541422 - DNA, 16 bp, G. gallus
ttgaaaaggacaacaa

SEQ ID NO: 541423 - DNA, 16 bp, G. gallus
ttgaaaatgaccacaa

SEQ ID NO: 541424 - DNA, 16 bp, G. gallus
ttgaaaattcacaggt

SEQ ID NO: 541425 - DNA, 16 bp, G. gallus
ttgaaactcaatgatc

SEQ ID NO: 541426 - DNA, 16 bp, G. gallus
ttgaacaccttcagag

SEQ ID NO: 541427 - DNA, 16 bp, G. gallus
ttgaaccttcccacca

SEQ ID NO: 541428 - DNA, 16 bp, G. gallus
ttgaaccttcctgaca

SEQ ID NO: 541429 - DNA, 16 bp, G. gallus
ttgaagccatttcctc

SEQ ID NO: 541430 - DNA, 16 bp, G. gallus
ttgaaggtcccttcca

SEQ ID NO: 541431 - DNA, 16 bp, G. gallus
ttgaatgcctccaggt

SEQ ID NO: 541432 - DNA, 16 bp, G. gallus
ttgaatgtcttcaggg

SEQ ID NO: 541433 - DNA, 16 bp, G. gallus
ttgacctgctggtcat

SEQ ID NO: 541434 - DNA, 16 bp, G. gallus
ttgagaaatcctttgt

SEQ ID NO: 541435 - DNA, 16 bp, G. gallus
ttgagaagtgggccca

SEQ ID NO: 541436 - DNA, 16 bp, G. gallus
ttgagtcagctctcct

SEQ ID NO: 541437 - DNA, 16 bp, G. gallus
ttgagttggaaaggac

SEQ ID NO: 541438 - DNA, 16 bp, G. gallus
ttgagttggaagggac

SEQ ID NO: 541439 - DNA, 16 bp, G. gallus
ttgatgaagatgttaa

SEQ ID NO: 541440 - DNA, 16 bp, G. gallus
ttgatgcagcccagaa

SEQ ID NO: 541441 - DNA, 16 bp, G. gallus
ttgatgctcagctgaa

SEQ ID NO: 541442 - DNA, 16 bp, G. gallus
ttgcaaccacttccat

SEQ ID NO: 541443 - DNA, 16 bp, G. gallus
ttgcaattaaaaaaaa

SEQ ID NO: 541444 - DNA, 16 bp, G. gallus
ttgcagaaaaaaataa

SEQ ID NO: 541445 - DNA, 16 bp, G. gallus
ttgcagagaaaacagg

SEQ ID NO: 541446 - DNA, 16 bp, G. gallus
ttgcagagacagaagg

SEQ ID NO: 541447 - DNA, 16 bp, G. gallus
ttgcagcagcagcagc

SEQ ID NO: 541448 - DNA, 16 bp, G. gallus
ttgcagtgtgacagat

SEQ ID NO: 541449 - DNA, 16 bp, G. gallus
ttgccagcaggagcag

SEQ ID NO: 541450 - DNA, 16 bp, G. gallus
ttgcccagagatgctg

SEQ ID NO: 541451 - DNA, 16 bp, G. gallus
ttgcccagggcctgat

SEQ ID NO: 541452 - DNA, 16 bp, G. gallus
ttgcctacaaagatgt

SEQ ID NO: 541453 - DNA, 16 bp, G. gallus
ttgccttggcccattg

SEQ ID NO: 541454 - DNA, 16 bp, G. gallus
ttgctcaaagccctgt

SEQ ID NO: 541455 - DNA, 16 bp, G. gallus
ttgctgctgctgctgc

SEQ ID NO: 541456 - DNA, 16 bp, G. gallus
ttgcttcatctgcact

SEQ ID NO: 541457 - DNA, 16 bp, G. gallus
ttggaaaagaccttca

SEQ ID NO: 541458 - DNA, 16 bp, G. gallus
ttggaaaggatcttta

SEQ ID NO: 541459 - DNA, 16 bp, G. gallus
ttggaacaggctgccc

SEQ ID NO: 541460 - DNA, 16 bp, G. gallus
ttggaactgaatgatc

SEQ ID NO: 541461 - DNA, 16 bp, G. gallus
ttggaagagaccttca

SEQ ID NO: 541462 - DNA, 16 bp, G. gallus
ttggaaggaacctctg

SEQ ID NO: 541463 - DNA, 16 bp, G. gallus
ttggaagggacctaca

SEQ ID NO: 541464 - DNA, 16 bp, G. gallus
ttggaagggacttctg

SEQ ID NO: 541465 - DNA, 16 bp, G. gallus
ttggaatgtaagataa

SEQ ID NO: 541466 - DNA, 16 bp, G. gallus
ttggacaagatgacct

SEQ ID NO: 541467 - DNA, 16 bp, G. gallus
ttggaccagatggcct

SEQ ID NO: 541468 - DNA, 16 bp, G. gallus
ttggactacatgatct

SEQ ID NO: 541469 - DNA, 16 bp, G. gallus
ttggactagatgatca

SEQ ID NO: 541470 - DNA, 16 bp, G. gallus
ttggactagatgatct

SEQ ID NO: 541471 - DNA, 16 bp, G. gallus
ttggactggatgatgt

SEQ ID NO: 541472 - DNA, 16 bp, G. gallus
ttggacttgatctctt

SEQ ID NO: 541473 - DNA, 16 bp, G. gallus
ttggacttgatgatcc

SEQ ID NO: 541474 - DNA, 16 bp, G. gallus
ttggagaacatgccct

SEQ ID NO: 541475 - DNA, 16 bp, G. gallus
ttggagaagaaattct

SEQ ID NO: 541476 - DNA, 16 bp, G. gallus
ttggagaagagaaagc

SEQ ID NO: 541477 - DNA, 16 bp, G. gallus
ttggagagagagagag

SEQ ID NO: 541478 - DNA, 16 bp, G. gallus
ttggagcagctggagc

SEQ ID NO: 541479 - DNA, 16 bp, G. gallus
ttggagtactgcatcc

SEQ ID NO: 541480 - DNA, 16 bp, G. gallus
ttggagttcttttcca

SEQ ID NO: 541481 - DNA, 16 bp, G. gallus
ttggatatcaggagga

SEQ ID NO: 541482 - DNA, 16 bp, G. gallus
ttggatatgaggaaga

SEQ ID NO: 541483 - DNA, 16 bp, G. gallus
ttggatgggtccctgg

SEQ ID NO: 541484 - DNA, 16 bp, G. gallus
ttggattggaagggac

SEQ ID NO: 541485 - DNA, 16 bp, G. gallus
ttggatttggtgatct

SEQ ID NO: 541486 - DNA, 16 bp, G. gallus
ttggcagtggaagcaa

SEQ ID NO: 541487 - DNA, 16 bp, G. gallus
ttggccaccagggcac

SEQ ID NO: 541488 - DNA, 16 bp, G. gallus
ttggcctcttctcctg

SEQ ID NO: 541489 - DNA, 16 bp, G. gallus
ttggccttctgggttg

SEQ ID NO: 541490 - DNA, 16 bp, G. gallus
ttggccttgttgaatc

SEQ ID NO: 541491 - DNA, 16 bp, G. gallus
ttggctgcatccagcc

SEQ ID NO: 541492 - DNA, 16 bp, G. gallus
ttggcttttctaattt

SEQ ID NO: 541493 - DNA, 16 bp, G. gallus
ttgggatggaagggac

SEQ ID NO: 541494 - DNA, 16 bp, G. gallus
ttgggctggaagggac

SEQ ID NO: 541495 - DNA, 16 bp, G. gallus
ttggggggaaaaaaaa

SEQ ID NO: 541496 - DNA, 16 bp, G. gallus
ttgggttggaagggac

SEQ ID NO: 541497 - DNA, 16 bp, G. gallus
ttgggttggaaggggc

SEQ ID NO: 541498 - DNA, 16 bp, G. gallus
ttgggttggaatggac

SEQ ID NO: 541499 - DNA, 16 bp, G. gallus
ttggtcccagcactga

SEQ ID NO: 541500 - DNA, 16 bp, G. gallus
ttggtgggaaggttca

SEQ ID NO: 541501 - DNA, 16 bp, G. gallus
ttggtttggaagggac

SEQ ID NO: 541502 - DNA, 16 bp, G. gallus
ttgtacagagccaagg

SEQ ID NO: 541503 - DNA, 16 bp, G. gallus
ttgtagaatcatagaa

SEQ ID NO: 541504 - DNA, 16 bp, G. gallus
ttgtagtttccatgaa

SEQ ID NO: 541505 - DNA, 16 bp, G. gallus
ttgtatgggaactgct

SEQ ID NO: 541506 - DNA, 16 bp, G. gallus
ttgtcagactgcccct

SEQ ID NO: 541507 - DNA, 16 bp, G. gallus
ttgtcaggacctactg

SEQ ID NO: 541508 - DNA, 16 bp, G. gallus
ttgtcctggcactggg

SEQ ID NO: 541509 - DNA, 16 bp, G. gallus
ttgtcctgtcacaaca

SEQ ID NO: 541510 - DNA, 16 bp, G. gallus
ttgtcctgtcactgca

SEQ ID NO: 541511 - DNA, 16 bp, G. gallus
ttgtctaccaggaccc

SEQ ID NO: 541512 - DNA, 16 bp, G. gallus
ttgtcttgggctgcat

SEQ ID NO: 541513 - DNA, 16 bp, G. gallus
ttgtgagccaacataa

SEQ ID NO: 541514 - DNA, 16 bp, G. gallus
ttgtgcaaagtgtttg

SEQ ID NO: 541515 - DNA, 16 bp, G. gallus
ttgtgcatcacttgtt

SEQ ID NO: 541516 - DNA, 16 bp, G. gallus
ttgtgcctgggaagat

SEQ ID NO: 541517 - DNA, 16 bp, G. gallus
ttgtgctccagaccca

SEQ ID NO: 541518 - DNA, 16 bp, G. gallus
ttgtggatgcctcctc

SEQ ID NO: 541519 - DNA, 16 bp, G. gallus
ttgtggccttccagta

SEQ ID NO: 541520 - DNA, 16 bp, G. gallus
ttgtggccttcctctg

SEQ ID NO: 541521 - DNA, 16 bp, G. gallus
ttgtggggaaaaaaaa

SEQ ID NO: 541522 - DNA, 16 bp, G. gallus
ttgtgggttccttcca

SEQ ID NO: 541523 - DNA, 16 bp, G. gallus
ttgtgttctttgtatc

SEQ ID NO: 541524 - DNA, 16 bp, G. gallus
ttgttcactgctggtg

SEQ ID NO: 541525 - DNA, 16 bp, G. gallus
ttgttcatcactggca

SEQ ID NO: 541526 - DNA, 16 bp, G. gallus
ttgttcccatcttcca

SEQ ID NO: 541527 - DNA, 16 bp, G. gallus
ttgttgaatctcatcc

SEQ ID NO: 541528 - DNA, 16 bp, G. gallus
ttgttgccttctgcaa

SEQ ID NO: 541529 - DNA, 16 bp, G. gallus
ttgtttttttaaaaca

SEQ ID NO: 541530 - DNA, 16 bp, G. gallus
tttaaaaaagcaaaca

SEQ ID NO: 541531 - DNA, 16 bp, G. gallus
tttaaaaacaaagcaa

SEQ ID NO: 541532 - DNA, 16 bp, G. gallus
tttaaaagcaaagcaa

SEQ ID NO: 541533 - DNA, 16 bp, G. gallus
tttaaactaaaggagg

SEQ ID NO: 541534 - DNA, 16 bp, G. gallus
tttaaagaaaagcaaa

SEQ ID NO: 541535 - DNA, 16 bp, G. gallus
tttaaatactggaaag

SEQ ID NO: 541536 - DNA, 16 bp, G. gallus
tttacagaaatatttt

SEQ ID NO: 541537 - DNA, 16 bp, G. gallus
tttacatctgccttta

SEQ ID NO: 541538 - DNA, 16 bp, G. gallus
tttactcagcacctgg

SEQ ID NO: 541539 - DNA, 16 bp, G. gallus
tttagagacaaggatg

SEQ ID NO: 541540 - DNA, 16 bp, G. gallus
tttagatgctgtactg

SEQ ID NO: 541541 - DNA, 16 bp, G. gallus
tttagcagaaaaaaaa

SEQ ID NO: 541542 - DNA, 16 bp, G. gallus
tttaggtcccttccaa

SEQ ID NO: 541543 - DNA, 17 bp, G. gallus
tttaggttggatgttag

SEQ ID NO: 541544 - DNA, 16 bp, G. gallus
tttataaatatctgaa

SEQ ID NO: 541545 - DNA, 16 bp, G. gallus
tttataactactttgt

SEQ ID NO: 541546 - DNA, 16 bp, G. gallus
tttatcttggagaaga

SEQ ID NO: 541547 - DNA, 16 bp, G. gallus
tttatgattccatgat

SEQ ID NO: 541548 - DNA, 16 bp, G. gallus
tttattaccatggaaa

SEQ ID NO: 541549 - DNA, 16 bp, G. gallus
tttatttccagggaaa

SEQ ID NO: 541550 - DNA, 16 bp, G. gallus
tttatttccatggaaa

SEQ ID NO: 541551 - DNA, 16 bp, G. gallus
tttatttgcatggaaa

SEQ ID NO: 541552 - DNA, 16 bp, G. gallus
tttattttaaaaccat

SEQ ID NO: 541553 - DNA, 16 bp, G. gallus
tttattttctttccag

SEQ ID NO: 541554 - DNA, 16 bp, G. gallus
tttcaaaaaggaaaaa

SEQ ID NO: 541555 - DNA, 16 bp, G. gallus
tttcaaagaaaataaa

SEQ ID NO: 541556 - DNA, 16 bp, G. gallus
tttcaaatgaaaagag

SEQ ID NO: 541557 - DNA, 23 bp, G. gallus
tttcaaccccctgctatgtgcag

SEQ ID NO: 541558 - DNA, 16 bp, G. gallus
tttcaagaaaagaaaa

SEQ ID NO: 541559 - DNA, 16 bp, G. gallus
tttcaagaaagggaga

SEQ ID NO: 541560 - DNA, 16 bp, G. gallus
tttcaagccatgactt

SEQ ID NO: 541561 - DNA, 16 bp, G. gallus
tttcacagaatcacag

SEQ ID NO: 541562 - DNA, 16 bp, G. gallus
tttcacaggaaaaaaa

SEQ ID NO: 541563 - DNA, 16 bp, G. gallus
tttcagaaaaaaacaa

SEQ ID NO: 541564 - DNA, 16 bp, G. gallus
tttcagaaaagaaaat

SEQ ID NO: 541565 - DNA, 16 bp, G. gallus
tttcagagaagaaaaa

SEQ ID NO: 541566 - DNA, 16 bp, G. gallus
tttcagatactctctc

SEQ ID NO: 541567 - DNA, 16 bp, G. gallus
tttcagcagcagtgac

SEQ ID NO: 541568 - DNA, 16 bp, G. gallus
tttcagcagtggcagc

SEQ ID NO: 541569 - DNA, 16 bp, G. gallus
tttcagctacaaaaca

SEQ ID NO: 541570 - DNA, 16 bp, G. gallus
tttcagtatctgaagg

SEQ ID NO: 541571 - DNA, 16 bp, G. gallus
tttcagtggtctgtgg

SEQ ID NO: 541572 - DNA, 16 bp, G. gallus
tttcatcagtgatgaa

SEQ ID NO: 541573 - DNA, 16 bp, G. gallus
tttcatctgaaaaaaa

SEQ ID NO: 541574 - DNA, 16 bp, G. gallus
tttcattaaaaagaaa

SEQ ID NO: 541575 - DNA, 16 bp, G. gallus
tttcattaaaagaaaa

SEQ ID NO: 541576 - DNA, 16 bp, G. gallus
tttcattttgttgctg

SEQ ID NO: 541577 - DNA, 16 bp, G. gallus
tttccaaccttaatga

SEQ ID NO: 541578 - DNA, 16 bp, G. gallus
tttccaaccttagtaa

SEQ ID NO: 541579 - DNA, 16 bp, G. gallus
tttccaagctaaacaa

SEQ ID NO: 541580 - DNA, 16 bp, G. gallus
tttccacagaaataaa

SEQ ID NO: 541581 - DNA, 16 bp, G. gallus
tttccaggctgaagag

SEQ ID NO: 541582 - DNA, 16 bp, G. gallus
tttccatggaaaaaaa

SEQ ID NO: 541583 - DNA, 16 bp, G. gallus
tttccatggaaataaa

SEQ ID NO: 541584 - DNA, 16 bp, G. gallus
tttccatggaaatgaa

SEQ ID NO: 541585 - DNA, 16 bp, G. gallus
tttccatggaaattaa

SEQ ID NO: 541586 - DNA, 16 bp, G. gallus
tttcccatccaccttt

SEQ ID NO: 541587 - DNA, 16 bp, G. gallus
tttccccttgtcctgc

SEQ ID NO: 541588 - DNA, 16 bp, G. gallus
tttcccttcttgaaaa

SEQ ID NO: 541589 - DNA, 16 bp, G. gallus
tttcctcatggaggaa

SEQ ID NO: 541590 - DNA, 16 bp, G. gallus
tttcctggaacctgga

SEQ ID NO: 541591 - DNA, 16 bp, G. gallus
tttccttaaagaaaaa

SEQ ID NO: 541592 - DNA, 16 bp, G. gallus
tttccttgccttgcct

SEQ ID NO: 541593 - DNA, 16 bp, G. gallus
tttcctttaaaaaaaa

SEQ ID NO: 541594 - DNA, 16 bp, G. gallus
tttctaaaaagaaaaa

SEQ ID NO: 541595 - DNA, 16 bp, G. gallus
tttctccaaactgtta

SEQ ID NO: 541596 - DNA, 16 bp, G. gallus
tttctccctttcttga

SEQ ID NO: 541597 - DNA, 16 bp, G. gallus
tttctcctttaaaaaa

SEQ ID NO: 541598 - DNA, 16 bp, G. gallus
tttctctctctcaaaa

SEQ ID NO: 541599 - DNA, 20 bp, G. gallus
tttctgacaacagattcctc

SEQ ID NO: 541600 - DNA, 16 bp, G. gallus
tttctgagaagaaact

SEQ ID NO: 541601 - DNA, 16 bp, G. gallus
tttctgagaataaatt

SEQ ID NO: 541602 - DNA, 16 bp, G. gallus
tttctgattaaaaaaa

SEQ ID NO: 541603 - DNA, 16 bp, G. gallus
tttctgccatctgatc

SEQ ID NO: 541604 - DNA, 16 bp, G. gallus
tttctgctgcccttct

SEQ ID NO: 541605 - DNA, 16 bp, G. gallus
tttctgctgctgctgc

SEQ ID NO: 541606 - DNA, 16 bp, G. gallus
tttctggggggaaaaa

SEQ ID NO: 541607 - DNA, 16 bp, G. gallus
tttctgtgaagaaatt

SEQ ID NO: 541608 - DNA, 16 bp, G. gallus
tttctgtggaaataaa

SEQ ID NO: 541609 - DNA, 16 bp, G. gallus
tttcttaaaaaagaaa

SEQ ID NO: 541610 - DNA, 16 bp, G. gallus
tttcttcttaacatct

SEQ ID NO: 541611 - DNA, 16 bp, G. gallus
tttcttggacacctcc

SEQ ID NO: 541612 - DNA, 16 bp, G. gallus
tttctttctctttcag

SEQ ID NO: 541613 - DNA, 16 bp, G. gallus
tttctttgaaaaaaaa

SEQ ID NO: 541614 - DNA, 16 bp, G. gallus
tttctttgcttttaaa

SEQ ID NO: 541615 - DNA, 16 bp, G. gallus
tttctttgggaaaaaa

SEQ ID NO: 541616 - DNA, 16 bp, G. gallus
tttctttgtgtttgca

SEQ ID NO: 541617 - DNA, 16 bp, G. gallus
tttcttttccaaaata

SEQ ID NO: 541618 - DNA, 16 bp, G. gallus
tttctttttcctgaaa

SEQ ID NO: 541619 - DNA, 16 bp, G. gallus
tttcttttttaaacag

SEQ ID NO: 541620 - DNA, 16 bp, G. gallus
tttcttttttaaatga

SEQ ID NO: 541621 - DNA, 16 bp, G. gallus
tttgaaaaacaaacaa

SEQ ID NO: 541622 - DNA, 16 bp, G. gallus
tttgaagccatttccc

SEQ ID NO: 541623 - DNA, 16 bp, G. gallus
tttgaagttcttcctt

SEQ ID NO: 541624 - DNA, 16 bp, G. gallus
tttgacactgtctcct

SEQ ID NO: 541625 - DNA, 16 bp, G. gallus
tttgagcttgaaacca

SEQ ID NO: 541626 - DNA, 16 bp, G. gallus
tttgaggagaaaaaaa

SEQ ID NO: 541627 - DNA, 16 bp, G. gallus
tttgagggtgacagag

SEQ ID NO: 541628 - DNA, 16 bp, G. gallus
tttgagttggaagaga

SEQ ID NO: 541629 - DNA, 16 bp, G. gallus
tttgagttggaaggga

SEQ ID NO: 541630 - DNA, 16 bp, G. gallus
tttgatagagtaaatt

SEQ ID NO: 541631 - DNA, 16 bp, G. gallus
tttgcagcgaggaaga

SEQ ID NO: 541632 - DNA, 16 bp, G. gallus
tttgcctcagtcttca

SEQ ID NO: 541633 - DNA, 16 bp, G. gallus
tttgctctatcagtgt

SEQ ID NO: 541634 - DNA, 16 bp, G. gallus
tttgctgaacttcatg

SEQ ID NO: 541635 - DNA, 16 bp, G. gallus
tttgctgcagccaaag

SEQ ID NO: 541636 - DNA, 16 bp, G. gallus
tttgcttgcttgcttg

SEQ ID NO: 541637 - DNA, 16 bp, G. gallus
tttgcttttctttaaa

SEQ ID NO: 541638 - DNA, 16 bp, G. gallus
tttggagaagaaattt

SEQ ID NO: 541639 - DNA, 16 bp, G. gallus
tttggagaaggaaaaa

SEQ ID NO: 541640 - DNA, 16 bp, G. gallus
tttggagaataaattt

SEQ ID NO: 541641 - DNA, 16 bp, G. gallus
tttggagagaaggatg

SEQ ID NO: 541642 - DNA, 16 bp, G. gallus
tttggagcagctggag

SEQ ID NO: 541643 - DNA, 16 bp, G. gallus
tttgggagaaaaacaa

SEQ ID NO: 541644 - DNA, 16 bp, G. gallus
tttgggcagctgtgcc

SEQ ID NO: 541645 - DNA, 16 bp, G. gallus
tttgggcccctcacta

SEQ ID NO: 541646 - DNA, 16 bp, G. gallus
tttgggggaaaaaaat

SEQ ID NO: 541647 - DNA, 16 bp, G. gallus
tttgggttggaaggga

SEQ ID NO: 541648 - DNA, 16 bp, G. gallus
tttggtggaaaaaaaa

SEQ ID NO: 541649 - DNA, 16 bp, G. gallus
tttgtagaatcataga

SEQ ID NO: 541650 - DNA, 17 bp, G. gallus
tttgtagctgagaattt

SEQ ID NO: 541651 - DNA, 16 bp, G. gallus
tttgtagctgaggatt

SEQ ID NO: 541652 - DNA, 16 bp, G. gallus
tttgtctgaagggaca

SEQ ID NO: 541653 - DNA, 16 bp, G. gallus
tttgtgaagaaaaaaa

SEQ ID NO: 541654 - DNA, 16 bp, G. gallus
tttgtgcccactgcct

SEQ ID NO: 541655 - DNA, 16 bp, G. gallus
tttgtggatgacacca

SEQ ID NO: 541656 - DNA, 16 bp, G. gallus
tttgtggcctttctct

SEQ ID NO: 541657 - DNA, 16 bp, G. gallus
tttgtgtgtgtgtgca

SEQ ID NO: 541658 - DNA, 16 bp, G. gallus
tttgttagagcaaatt

SEQ ID NO: 541659 - DNA, 16 bp, G. gallus
tttgttgctgagaatt

SEQ ID NO: 541660 - DNA, 16 bp, G. gallus
tttgtttgtttcaaaa

SEQ ID NO: 541661 - DNA, 16 bp, G. gallus
tttgttttaaaacaaa

SEQ ID NO: 541662 - DNA, 16 bp, G. gallus
tttgttttgtttccaa

SEQ ID NO: 541663 - DNA, 16 bp, G. gallus
tttgtttttaaaacaa

SEQ ID NO: 541664 - DNA, 16 bp, G. gallus
tttgtttttaaatgag

SEQ ID NO: 541665 - DNA, 16 bp, G. gallus
tttgtttttttccaaa

SEQ ID NO: 541666 - DNA, 16 bp, G. gallus
ttttaaaaaaatctgt

SEQ ID NO: 541667 - DNA, 16 bp, G. gallus
ttttaaaaaatgcttt

SEQ ID NO: 541668 - DNA, 16 bp, G. gallus
ttttaaaaacaaaacc

SEQ ID NO: 541669 - DNA, 16 bp, G. gallus
ttttaaaaacagtttt

SEQ ID NO: 541670 - DNA, 16 bp, G. gallus
ttttaaaaagcagttt

SEQ ID NO: 541671 - DNA, 16 bp, G. gallus
ttttaaaaatgagttt

SEQ ID NO: 541672 - DNA, 16 bp, G. gallus
ttttaaaacaacaaca

SEQ ID NO: 541673 - DNA, 16 bp, G. gallus
ttttaaaatgtcattt

SEQ ID NO: 541674 - DNA, 16 bp, G. gallus
ttttaaagaacatttt

SEQ ID NO: 541675 - DNA, 16 bp, G. gallus
ttttaaaggaaaaaga

SEQ ID NO: 541676 - DNA, 16 bp, G. gallus
ttttaaagggaaaaaa

SEQ ID NO: 541677 - DNA, 16 bp, G. gallus
ttttaaattggaagag

SEQ ID NO: 541678 - DNA, 16 bp, G. gallus
ttttaaggggaaaaaa

SEQ ID NO: 541679 - DNA, 16 bp, G. gallus
ttttaatgcaccccag

SEQ ID NO: 541680 - DNA, 16 bp, G. gallus
ttttaatgcatatttt

SEQ ID NO: 541681 - DNA, 16 bp, G. gallus
ttttacacagtctgat

SEQ ID NO: 541682 - DNA, 16 bp, G. gallus
ttttagtggaaaaaaa

SEQ ID NO: 541683 - DNA, 16 bp, G. gallus
ttttatttggaaaaaa

SEQ ID NO: 541684 - DNA, 16 bp, G. gallus
ttttattttcaaaaca

SEQ ID NO: 541685 - DNA, 16 bp, G. gallus
ttttcaaaagaaaaaa

SEQ ID NO: 541686 - DNA, 16 bp, G. gallus
ttttcaaagaaaagaa

SEQ ID NO: 541687 - DNA, 16 bp, G. gallus
ttttcaaaggaaaaaa

SEQ ID NO: 541688 - DNA, 16 bp, G. gallus
ttttcaaatatcatca

SEQ ID NO: 541689 - DNA, 16 bp, G. gallus
ttttcaaggatgaagc

SEQ ID NO: 541690 - DNA, 16 bp, G. gallus
ttttcaccagtgataa

SEQ ID NO: 541691 - DNA, 16 bp, G. gallus
ttttcatccaccagaa

SEQ ID NO: 541692 - DNA, 16 bp, G. gallus
ttttcatggaaataaa

SEQ ID NO: 541693 - DNA, 16 bp, G. gallus
ttttcatttaaaacaa

SEQ ID NO: 541694 - DNA, 16 bp, G. gallus
ttttccaaagaaaaaa

SEQ ID NO: 541695 - DNA, 16 bp, G. gallus
ttttccaagcccttca

SEQ ID NO: 541696 - DNA, 16 bp, G. gallus
ttttccacatgaagga

SEQ ID NO: 541697 - DNA, 16 bp, G. gallus
ttttccaggaaaaaaa

SEQ ID NO: 541698 - DNA, 16 bp, G. gallus
ttttccattaaaaaaa

SEQ ID NO: 541699 - DNA, 16 bp, G. gallus
ttttccccaaactaaa

SEQ ID NO: 541700 - DNA, 16 bp, G. gallus
ttttccgcatggagga

SEQ ID NO: 541701 - DNA, 16 bp, G. gallus
ttttctaggaaaaaaa

SEQ ID NO: 541702 - DNA, 16 bp, G. gallus
ttttctctgaaaaaaa

SEQ ID NO: 541703 - DNA, 16 bp, G. gallus
ttttctgaaaaagaaa

SEQ ID NO: 541704 - DNA, 16 bp, G. gallus
ttttctgcatggagga

SEQ ID NO: 541705 - DNA, 16 bp, G. gallus
ttttctgtaaaaaaaa

SEQ ID NO: 541706 - DNA, 16 bp, G. gallus
ttttctgtaaagaagt

SEQ ID NO: 541707 - DNA, 16 bp, G. gallus
ttttctgtatggagga

SEQ ID NO: 541708 - DNA, 16 bp, G. gallus
ttttcttcccagattt

SEQ ID NO: 541709 - DNA, 16 bp, G. gallus
ttttcttttaatgaaa

SEQ ID NO: 541710 - DNA, 16 bp, G. gallus
ttttctttttaaagga

SEQ ID NO: 541711 - DNA, 16 bp, G. gallus
ttttgaaaaaggaaaa

SEQ ID NO: 541712 - DNA, 16 bp, G. gallus
ttttgaactggagagc

SEQ ID NO: 541713 - DNA, 16 bp, G. gallus
ttttgaagggaaaaaa

SEQ ID NO: 541714 - DNA, 16 bp, G. gallus
ttttgcatggaggaat

SEQ ID NO: 541715 - DNA, 16 bp, G. gallus
ttttgcctgttggaaa

SEQ ID NO: 541716 - DNA, 16 bp, G. gallus
ttttgctttttaaaat

SEQ ID NO: 541717 - DNA, 16 bp, G. gallus
ttttggagcagccctt

SEQ ID NO: 541718 - DNA, 16 bp, G. gallus
ttttggaggggaaaaa

SEQ ID NO: 541719 - DNA, 16 bp, G. gallus
ttttgtcagacttccc

SEQ ID NO: 541720 - DNA, 16 bp, G. gallus
ttttgtggggaaaaaa

SEQ ID NO: 541721 - DNA, 18 bp, G. gallus
ttttgtgtggacttatct

SEQ ID NO: 541722 - DNA, 16 bp, G. gallus
ttttgttgctgtgcga

SEQ ID NO: 541723 - DNA, 16 bp, G. gallus
ttttgttgttgttcaa

SEQ ID NO: 541724 - DNA, 16 bp, G. gallus
ttttgtttccagttct

SEQ ID NO: 541725 - DNA, 16 bp, G. gallus
ttttgtttctgtgtga

SEQ ID NO: 541726 - DNA, 16 bp, G. gallus
ttttgtttttaaacat

SEQ ID NO: 541727 - DNA, 16 bp, G. gallus
ttttgttttttaaaca

SEQ ID NO: 541728 - DNA, 16 bp, G. gallus
tttttaaaaacagaaa

SEQ ID NO: 541729 - DNA, 16 bp, G. gallus
tttttaaaaagcattt

SEQ ID NO: 541730 - DNA, 16 bp, G. gallus
tttttaaaacagaaaa

SEQ ID NO: 541731 - DNA, 16 bp, G. gallus
tttttaaaactgtttt

SEQ ID NO: 541732 - DNA, 16 bp, G. gallus
tttttcaacctgagca

SEQ ID NO: 541733 - DNA, 16 bp, G. gallus
tttttcattttgaaat

SEQ ID NO: 541734 - DNA, 16 bp, G. gallus
tttttccttttcaaaa

SEQ ID NO: 541735 - DNA, 16 bp, G. gallus
tttttctcagaaagag

SEQ ID NO: 541736 - DNA, 16 bp, G. gallus
tttttctcttttgaaa

SEQ ID NO: 541737 - DNA, 16 bp, G. gallus
tttttcttcaagaaaa

SEQ ID NO: 541738 - DNA, 16 bp, G. gallus
tttttctttctgtaaa

SEQ ID NO: 541739 - DNA, 16 bp, G. gallus
tttttcttttaaaaag

SEQ ID NO: 541740 - DNA, 16 bp, G. gallus
tttttcttttaaagaa

SEQ ID NO: 541741 - DNA, 16 bp, G. gallus
tttttctttttggaaa

SEQ ID NO: 541742 - DNA, 16 bp, G. gallus
tttttgagttgaatgt

SEQ ID NO: 541743 - DNA, 16 bp, G. gallus
ttttttaaaatgcttt

SEQ ID NO: 541744 - DNA, 16 bp, G. gallus
ttttttaaagaagaaa

SEQ ID NO: 541745 - DNA, 16 bp, G. gallus
ttttttaaagcatttt

SEQ ID NO: 541746 - DNA, 16 bp, G. gallus
ttttttaaatcagaaa

SEQ ID NO: 541747 - DNA, 16 bp, G. gallus
ttttttccccccacta

SEQ ID NO: 541748 - DNA, 16 bp, G. gallus
ttttttccccttaaat

SEQ ID NO: 541749 - DNA, 16 bp, G. gallus
ttttttcctctcaaaa

SEQ ID NO: 541750 - DNA, 16 bp, G. gallus
ttttttcctgaagttt

SEQ ID NO: 541751 - DNA, 16 bp, G. gallus
ttttttcctttcagaa

SEQ ID NO: 541752 - DNA, 16 bp, G. gallus
ttttttctcctcaaaa

SEQ ID NO: 541753 - DNA, 16 bp, G. gallus
ttttttctttcagaaa

SEQ ID NO: 541754 - DNA, 16 bp, G. gallus
ttttttcttttggaaa

SEQ ID NO: 541755 - DNA, 16 bp, G. gallus
ttttttgctgttcaca

SEQ ID NO: 541756 - DNA, 16 bp, G. gallus
tttttttaaacagaag

SEQ ID NO: 541757 - DNA, 16 bp, G. gallus
tttttttaaagagaaa

SEQ ID NO: 541758 - DNA, 16 bp, G. gallus
tttttttaaagcaaag

SEQ ID NO: 541759 - DNA, 16 bp, G. gallus
tttttttaacaaaaca

SEQ ID NO: 541760 - DNA, 16 bp, G. gallus
tttttttaatagcaat

SEQ ID NO: 541761 - DNA, 16 bp, G. gallus
tttttttaattgcaaa

SEQ ID NO: 541762 - DNA, 16 bp, G. gallus
tttttttactcagagg

SEQ ID NO: 541763 - DNA, 16 bp, G. gallus
tttttttccacatgaa

SEQ ID NO: 541764 - DNA, 16 bp, G. gallus
tttttttccactgaaa

SEQ ID NO: 541765 - DNA, 16 bp, G. gallus
tttttttccagaaaaa

SEQ ID NO: 541766 - DNA, 16 bp, G. gallus
tttttttccagaagaa

SEQ ID NO: 541767 - DNA, 16 bp, G. gallus
tttttttccagttcaa

SEQ ID NO: 541768 - DNA, 16 bp, G. gallus
tttttttccatggaaa

SEQ ID NO: 541769 - DNA, 16 bp, G. gallus
tttttttcccccacaa

SEQ ID NO: 541770 - DNA, 16 bp, G. gallus
tttttttcccctgaag

SEQ ID NO: 541771 - DNA, 16 bp, G. gallus
tttttttcccctggaa

SEQ ID NO: 541772 - DNA, 16 bp, G. gallus
tttttttccctctgaa

SEQ ID NO: 541773 - DNA, 16 bp, G. gallus
tttttttcctagagaa

SEQ ID NO: 541774 - DNA, 16 bp, G. gallus
tttttttcctcaagaa

SEQ ID NO: 541775 - DNA, 16 bp, G. gallus
tttttttcctccccaa

SEQ ID NO: 541776 - DNA, 16 bp, G. gallus
tttttttcctctgaag

SEQ ID NO: 541777 - DNA, 16 bp, G. gallus
tttttttcctgaagtg

SEQ ID NO: 541778 - DNA, 16 bp, G. gallus
tttttttcctgtaaaa

SEQ ID NO: 541779 - DNA, 16 bp, G. gallus
tttttttcctgtaaat

SEQ ID NO: 541780 - DNA, 16 bp, G. gallus
tttttttccttaaaca

SEQ ID NO: 541781 - DNA, 16 bp, G. gallus
tttttttccttctgga

SEQ ID NO: 541782 - DNA, 16 bp, G. gallus
tttttttcctttggaa

SEQ ID NO: 541783 - DNA, 16 bp, G. gallus
tttttttcttcagaat

SEQ ID NO: 541784 - DNA, 16 bp, G. gallus
tttttttcttctgaaa

SEQ ID NO: 541785 - DNA, 16 bp, G. gallus
tttttttctttgaaaa

SEQ ID NO: 541786 - DNA, 16 bp, G. gallus
ttttttttaaacagat

SEQ ID NO: 541787 - DNA, 16 bp, G. gallus
ttttttttaaagcata

SEQ ID NO: 541788 - DNA, 16 bp, G. gallus
ttttttttaaagctgt

SEQ ID NO: 541789 - DNA, 16 bp, G. gallus
ttttttttaataactg

SEQ ID NO: 541790 - DNA, 16 bp, G. gallus
ttttttttaatacaga

SEQ ID NO: 541791 - DNA, 16 bp, G. gallus
ttttttttaatcagtg

SEQ ID NO: 541792 - DNA, 16 bp, G. gallus
ttttttttaatgaaca

SEQ ID NO: 541793 - DNA, 16 bp, G. gallus
ttttttttaatgaact

SEQ ID NO: 541794 - DNA, 16 bp, G. gallus
ttttttttaatgctaa

SEQ ID NO: 541795 - DNA, 16 bp, G. gallus
ttttttttaatggcaa

SEQ ID NO: 541796 - DNA, 16 bp, G. gallus
ttttttttccaagaaa

SEQ ID NO: 541797 - DNA, 16 bp, G. gallus
ttttttttccaccaga

SEQ ID NO: 541798 - DNA, 16 bp, G. gallus
ttttttttccagtatg

SEQ ID NO: 541799 - DNA, 16 bp, G. gallus
ttttttttccccaagg

SEQ ID NO: 541800 - DNA, 16 bp, G. gallus
ttttttttccccaatg

SEQ ID NO: 541801 - DNA, 16 bp, G. gallus
ttttttttccccataa

SEQ ID NO: 541802 - DNA, 16 bp, G. gallus
ttttttttcccccagt

SEQ ID NO: 541803 - DNA, 16 bp, G. gallus
ttttttttccctcaga

SEQ ID NO: 541804 - DNA, 16 bp, G. gallus
ttttttttcctctgac

SEQ ID NO: 541805 - DNA, 16 bp, G. gallus
ttttttttcctgcaaa

SEQ ID NO: 541806 - DNA, 16 bp, G. gallus
ttttttttctcctaag

SEQ ID NO: 541807 - DNA, 16 bp, G. gallus
ttttttttctctccag

SEQ ID NO: 541808 - DNA, 16 bp, G. gallus
ttttttttctgaaaaa

SEQ ID NO: 541809 - DNA, 16 bp, G. gallus
ttttttttcttaaaga

SEQ ID NO: 541810 - DNA, 16 bp, G. gallus
ttttttttcttcagca

SEQ ID NO: 541811 - DNA, 16 bp, G. gallus
tttttttttaaacatg

SEQ ID NO: 541812 - DNA, 16 bp, G. gallus
tttttttttaaagctg

SEQ ID NO: 541813 - DNA, 16 bp, G. gallus
tttttttttaactgcc

SEQ ID NO: 541814 - DNA, 16 bp, G. gallus
tttttttttaatcaga

SEQ ID NO: 541815 - DNA, 16 bp, G. gallus
tttttttttcaagaag

SEQ ID NO: 541816 - DNA, 16 bp, G. gallus
tttttttttcaagcaa

SEQ ID NO: 541817 - DNA, 16 bp, G. gallus
tttttttttcagaagt

SEQ ID NO: 541818 - DNA, 16 bp, G. gallus
tttttttttccaatga

SEQ ID NO: 541819 - DNA, 16 bp, G. gallus
tttttttttcccagag

SEQ ID NO: 541820 - DNA, 16 bp, G. gallus
tttttttttccccaga

SEQ ID NO: 541821 - DNA, 16 bp, G. gallus
tttttttttccccatg

SEQ ID NO: 541822 - DNA, 16 bp, G. gallus
tttttttttccctgca

SEQ ID NO: 541823 - DNA, 16 bp, G. gallus
tttttttttcctgaaa

SEQ ID NO: 541824 - DNA, 16 bp, G. gallus
tttttttttcctgcag

SEQ ID NO: 541825 - DNA, 16 bp, G. gallus
tttttttttctgcagc

SEQ ID NO: 541826 - DNA, 16 bp, G. gallus
tttttttttgcaaaca

SEQ ID NO: 541827 - DNA, 16 bp, G. gallus
tttttttttggtacag

SEQ ID NO: 541828 - DNA, 16 bp, G. gallus
tttttttttgtcaaaa

SEQ ID NO: 541829 - DNA, 16 bp, G. gallus
ttttttttttccagca

SEQ ID NO: 541830 - DNA, 16 bp, G. gallus
ttttttttttcccagc

SEQ ID NO: 541831 - DNA, 16 bp, G. gallus
ttttttttttgccagg

SEQ ID NO: 541832 - DNA, 16 bp, G. gallus
ttttttttttggcaag

SEQ ID NO: 541833 - DNA, 14 bp, D. melanogaster
aaaaaaaaaccttg

SEQ ID NO: 541834 - DNA, 14 bp, D. melanogaster
aaaaaaaaacgctg

SEQ ID NO: 541835 - DNA, 14 bp, D. melanogaster
aaaaaaaaacgctt

SEQ ID NO: 541836 - DNA, 14 bp, D. melanogaster
aaaaaaaaacgttg

SEQ ID NO: 541837 - DNA, 14 bp, D. melanogaster
aaaaaaaaacgttt

SEQ ID NO: 541838 - DNA, 14 bp, D. melanogaster
aaaaaaaaactctg

SEQ ID NO: 541839 - DNA, 14 bp, D. melanogaster
aaaaaaaaactttg

SEQ ID NO: 541840 - DNA, 14 bp, D. melanogaster
aaaaaaaaatgtct

SEQ ID NO: 541841 - DNA, 14 bp, D. melanogaster
aaaaaaaacatttg

SEQ ID NO: 541842 - DNA, 13 bp, D. melanogaster
aaaaaaaacgttg

SEQ ID NO: 541843 - DNA, 14 bp, D. melanogaster
aaaaaaaacgttga

SEQ ID NO: 541844 - DNA, 13 bp, D. melanogaster
aaaaaaaactccg

SEQ ID NO: 541845 - DNA, 13 bp, D. melanogaster
aaaaaaaactgcg

SEQ ID NO: 541846 - DNA, 13 bp, D. melanogaster
aaaaaaaactgct

SEQ ID NO: 541847 - DNA, 13 bp, D. melanogaster
aaaaaaaactggg

SEQ ID NO: 541848 - DNA, 14 bp, D. melanogaster
aaaaaaaactgtta

SEQ ID NO: 541849 - DNA, 13 bp, D. melanogaster
aaaaaaaacttgt

SEQ ID NO: 541850 - DNA, 13 bp, D. melanogaster
aaaaaaaactttg

SEQ ID NO: 541851 - DNA, 14 bp, D. melanogaster
aaaaaaaactttga

SEQ ID NO: 541852 - DNA, 14 bp, D. melanogaster
aaaaaaaagatttc

SEQ ID NO: 541853 - DNA, 13 bp, D. melanogaster
aaaaaaaagctgg

SEQ ID NO: 541854 - DNA, 13 bp, D. melanogaster
aaaaaaaagcttt

SEQ ID NO: 541855 - DNA, 13 bp, D. melanogaster
aaaaaaaaggctg

SEQ ID NO: 541856 - DNA, 13 bp, D. melanogaster
aaaaaaaagtcct

SEQ ID NO: 541857 - DNA, 13 bp, D. melanogaster
aaaaaaaagtgcg

SEQ ID NO: 541858 - DNA, 13 bp, D. melanogaster
aaaaaaaagttct

SEQ ID NO: 541859 - DNA, 13 bp, D. melanogaster
aaaaaaaagttgc

SEQ ID NO: 541860 - DNA, 14 bp, D. melanogaster
aaaaaaaagttgca

SEQ ID NO: 541861 - DNA, 14 bp, D. melanogaster
aaaaaaaagtttac

SEQ ID NO: 541862 - DNA, 13 bp, D. melanogaster
aaaaaaaagtttc

SEQ ID NO: 541863 - DNA, 13 bp, D. melanogaster
aaaaaaaatctgc

SEQ ID NO: 541864 - DNA, 14 bp, D. melanogaster
aaaaaaaatgcact

SEQ ID NO: 541865 - DNA, 14 bp, D. melanogaster
aaaaaaaatgcagt

SEQ ID NO: 541866 - DNA, 14 bp, D. melanogaster
aaaaaaaatgtact

SEQ ID NO: 541867 - DNA, 13 bp, D. melanogaster
aaaaaaaatgtct

SEQ ID NO: 541868 - DNA, 13 bp, D. melanogaster
aaaaaaaatgttc

SEQ ID NO: 541869 - DNA, 14 bp, D. melanogaster
aaaaaaaattgcat

SEQ ID NO: 541870 - DNA, 13 bp, D. melanogaster
aaaaaaaattgcc

SEQ ID NO: 541871 - DNA, 14 bp, D. melanogaster
aaaaaaaattgcca

SEQ ID NO: 541872 - DNA, 13 bp, D. melanogaster
aaaaaaaattgct

SEQ ID NO: 541873 - DNA, 13 bp, D. melanogaster
aaaaaaaatttgc

SEQ ID NO: 541874 - DNA, 13 bp, D. melanogaster
aaaaaaacagctc

SEQ ID NO: 541875 - DNA, 13 bp, D. melanogaster
aaaaaaacagctg

SEQ ID NO: 541876 - DNA, 13 bp, D. melanogaster
aaaaaaacagtcg

SEQ ID NO: 541877 - DNA, 13 bp, D. melanogaster
aaaaaaacagtgg

SEQ ID NO: 541878 - DNA, 13 bp, D. melanogaster
aaaaaaacatttg

SEQ ID NO: 541879 - DNA, 14 bp, D. melanogaster
aaaaaaacccattt

SEQ ID NO: 541880 - DNA, 13 bp, D. melanogaster
aaaaaaacccctt

SEQ ID NO: 541881 - DNA, 13 bp, D. melanogaster
aaaaaaaccgttt

SEQ ID NO: 541882 - DNA, 13 bp, D. melanogaster
aaaaaaacctttg

SEQ ID NO: 541883 - DNA, 13 bp, D. melanogaster
aaaaaaacctttt

SEQ ID NO: 541884 - DNA, 14 bp, D. melanogaster
aaaaaaaccttttt

SEQ ID NO: 541885 - DNA, 14 bp, D. melanogaster
aaaaaaacgaattt

SEQ ID NO: 541886 - DNA, 13 bp, D. melanogaster
aaaaaaacggatt

SEQ ID NO: 541887 - DNA, 13 bp, D. melanogaster
aaaaaaacgtgga

SEQ ID NO: 541888 - DNA, 13 bp, D. melanogaster
aaaaaaacgtggc

SEQ ID NO: 541889 - DNA, 13 bp, D. melanogaster
aaaaaaacgttgc

SEQ ID NO: 541890 - DNA, 14 bp, D. melanogaster
aaaaaaacgttttt

SEQ ID NO: 541891 - DNA, 13 bp, D. melanogaster
aaaaaaactgagg

SEQ ID NO: 541892 - DNA, 13 bp, D. melanogaster
aaaaaaactgccg

SEQ ID NO: 541893 - DNA, 13 bp, D. melanogaster
aaaaaaactggct

SEQ ID NO: 541894 - DNA, 13 bp, D. melanogaster
aaaaaaacttgtt

SEQ ID NO: 541895 - DNA, 13 bp, D. melanogaster
aaaaaaactttcg

SEQ ID NO: 541896 - DNA, 13 bp, D. melanogaster
aaaaaaacttttg

SEQ ID NO: 541897 - DNA, 14 bp, D. melanogaster
aaaaaaacttttga

SEQ ID NO: 541898 - DNA, 13 bp, D. melanogaster
aaaaaaagaggct

SEQ ID NO: 541899 - DNA, 13 bp, D. melanogaster
aaaaaaagagtgc

SEQ ID NO: 541900 - DNA, 14 bp, D. melanogaster
aaaaaaagagtgca

SEQ ID NO: 541901 - DNA, 13 bp, D. melanogaster
aaaaaaagattgc

SEQ ID NO: 541902 - DNA, 13 bp, D. melanogaster
aaaaaaagctgag

SEQ ID NO: 541903 - DNA, 13 bp, D. melanogaster
aaaaaaagctgtg

SEQ ID NO: 541904 - DNA, 13 bp, D. melanogaster
aaaaaaagcttat

SEQ ID NO: 541905 - DNA, 13 bp, D. melanogaster
aaaaaaaggcatc

SEQ ID NO: 541906 - DNA, 13 bp, D. melanogaster
aaaaaaaggcatt

SEQ ID NO: 541907 - DNA, 13 bp, D. melanogaster
aaaaaaaggcggc

SEQ ID NO: 541908 - DNA, 13 bp, D. melanogaster
aaaaaaagggcat

SEQ ID NO: 541909 - DNA, 13 bp, D. melanogaster
aaaaaaaggggtt

SEQ ID NO: 541910 - DNA, 14 bp, D. melanogaster
aaaaaaaggggttt

SEQ ID NO: 541911 - DNA, 13 bp, D. melanogaster
aaaaaaagggttt

SEQ ID NO: 541912 - DNA, 13 bp, D. melanogaster
aaaaaaaggtttt

SEQ ID NO: 541913 - DNA, 13 bp, D. melanogaster
aaaaaaagtactt

SEQ ID NO: 541914 - DNA, 14 bp, D. melanogaster
aaaaaaagtatctt

SEQ ID NO: 541915 - DNA, 13 bp, D. melanogaster
aaaaaaagtattc

SEQ ID NO: 541916 - DNA, 13 bp, D. melanogaster
aaaaaaagtcttt

SEQ ID NO: 541917 - DNA, 13 bp, D. melanogaster
aaaaaaagtgcac

SEQ ID NO: 541918 - DNA, 13 bp, D. melanogaster
aaaaaaagtgcag

SEQ ID NO: 541919 - DNA, 13 bp, D. melanogaster
aaaaaaagtgttc

SEQ ID NO: 541920 - DNA, 13 bp, D. melanogaster
aaaaaaagtgttt

SEQ ID NO: 541921 - DNA, 13 bp, D. melanogaster
aaaaaaagttgca

SEQ ID NO: 541922 - DNA, 13 bp, D. melanogaster
aaaaaaagttggc

SEQ ID NO: 541923 - DNA, 13 bp, D. melanogaster
aaaaaaagttgtt

SEQ ID NO: 541924 - DNA, 13 bp, D. melanogaster
aaaaaaagtttac

SEQ ID NO: 541925 - DNA, 14 bp, D. melanogaster
aaaaaaataatcgg

SEQ ID NO: 541926 - DNA, 13 bp, D. melanogaster
aaaaaaatagctt

SEQ ID NO: 541927 - DNA, 13 bp, D. melanogaster
aaaaaaatagttc

SEQ ID NO: 541928 - DNA, 13 bp, D. melanogaster
aaaaaaatattgc

SEQ ID NO: 541929 - DNA, 14 bp, D. melanogaster
aaaaaaatatttcg

SEQ ID NO: 541930 - DNA, 13 bp, D. melanogaster
aaaaaaatcagtc

SEQ ID NO: 541931 - DNA, 13 bp, D. melanogaster
aaaaaaatcagtt

SEQ ID NO: 541932 - DNA, 14 bp, D. melanogaster
aaaaaaatcgaatt

SEQ ID NO: 541933 - DNA, 13 bp, D. melanogaster
aaaaaaatcgagg

SEQ ID NO: 541934 - DNA, 13 bp, D. melanogaster
aaaaaaatcgtat

SEQ ID NO: 541935 - DNA, 13 bp, D. melanogaster
aaaaaaatcgttg

SEQ ID NO: 541936 - DNA, 14 bp, D. melanogaster
aaaaaaatctttga

SEQ ID NO: 541937 - DNA, 13 bp, D. melanogaster
aaaaaaatgcagc

SEQ ID NO: 541938 - DNA, 13 bp, D. melanogaster
aaaaaaatgccat

SEQ ID NO: 541939 - DNA, 13 bp, D. melanogaster
aaaaaaatggcag

SEQ ID NO: 541940 - DNA, 13 bp, D. melanogaster
aaaaaaatggcat

SEQ ID NO: 541941 - DNA, 13 bp, D. melanogaster
aaaaaaatgtctc

SEQ ID NO: 541942 - DNA, 13 bp, D. melanogaster
aaaaaaatgtgca

SEQ ID NO: 541943 - DNA, 13 bp, D. melanogaster
aaaaaaatgttgt

SEQ ID NO: 541944 - DNA, 13 bp, D. melanogaster
aaaaaaattactg

SEQ ID NO: 541945 - DNA, 13 bp, D. melanogaster
aaaaaaattctga

SEQ ID NO: 541946 - DNA, 13 bp, D. melanogaster
aaaaaaattgcat

SEQ ID NO: 541947 - DNA, 14 bp, D. melanogaster
aaaaaaattgcatt

SEQ ID NO: 541948 - DNA, 13 bp, D. melanogaster
aaaaaaattgctt

SEQ ID NO: 541949 - DNA, 13 bp, D. melanogaster
aaaaaaattggct

SEQ ID NO: 541950 - DNA, 13 bp, D. melanogaster
aaaaaaattgggc

SEQ ID NO: 541951 - DNA, 13 bp, D. melanogaster
aaaaaaattggtg

SEQ ID NO: 541952 - DNA, 14 bp, D. melanogaster
aaaaaaattgtaca

SEQ ID NO: 541953 - DNA, 13 bp, D. melanogaster
aaaaaaattgttg

SEQ ID NO: 541954 - DNA, 13 bp, D. melanogaster
aaaaaaatttgcc

SEQ ID NO: 541955 - DNA, 13 bp, D. melanogaster
aaaaaacaagttg

SEQ ID NO: 541956 - DNA, 13 bp, D. melanogaster
aaaaaacaagttt

SEQ ID NO: 541957 - DNA, 13 bp, D. melanogaster
aaaaaacactcga

SEQ ID NO: 541958 - DNA, 13 bp, D. melanogaster
aaaaaacactttt

SEQ ID NO: 541959 - DNA, 13 bp, D. melanogaster
aaaaaacagctga

SEQ ID NO: 541960 - DNA, 14 bp, D. melanogaster
aaaaaacagctgat

SEQ ID NO: 541961 - DNA, 13 bp, D. melanogaster
aaaaaacagtatg

SEQ ID NO: 541962 - DNA, 13 bp, D. melanogaster
aaaaaacatcgat

SEQ ID NO: 541963 - DNA, 13 bp, D. melanogaster
aaaaaacatgatt

SEQ ID NO: 541964 - DNA, 13 bp, D. melanogaster
aaaaaacattttc

SEQ ID NO: 541965 - DNA, 13 bp, D. melanogaster
aaaaaaccaatgc

SEQ ID NO: 541966 - DNA, 13 bp, D. melanogaster
aaaaaaccaattg

SEQ ID NO: 541967 - DNA, 13 bp, D. melanogaster
aaaaaaccatttt

SEQ ID NO: 541968 - DNA, 14 bp, D. melanogaster
aaaaaacccttaat

SEQ ID NO: 541969 - DNA, 13 bp, D. melanogaster
aaaaaacccttta

SEQ ID NO: 541970 - DNA, 14 bp, D. melanogaster
aaaaaaccctttat

SEQ ID NO: 541971 - DNA, 13 bp, D. melanogaster
aaaaaaccgaatg

SEQ ID NO: 541972 - DNA, 13 bp, D. melanogaster
aaaaaacctttga

SEQ ID NO: 541973 - DNA, 13 bp, D. melanogaster
aaaaaacgaattg

SEQ ID NO: 541974 - DNA, 13 bp, D. melanogaster
aaaaaacgcaatt

SEQ ID NO: 541975 - DNA, 13 bp, D. melanogaster
aaaaaacgccagc

SEQ ID NO: 541976 - DNA, 13 bp, D. melanogaster
aaaaaacggtggt

SEQ ID NO: 541977 - DNA, 13 bp, D. melanogaster
aaaaaacgtagca

SEQ ID NO: 541978 - DNA, 13 bp, D. melanogaster
aaaaaacgttgaa

SEQ ID NO: 541979 - DNA, 13 bp, D. melanogaster
aaaaaacgttttc

SEQ ID NO: 541980 - DNA, 13 bp, D. melanogaster
aaaaaacgttttt

SEQ ID NO: 541981 - DNA, 13 bp, D. melanogaster
aaaaaactaattg

SEQ ID NO: 541982 - DNA, 14 bp, D. melanogaster
aaaaaactaattgg

SEQ ID NO: 541983 - DNA, 14 bp, D. melanogaster
aaaaaactaattgt

SEQ ID NO: 541984 - DNA, 13 bp, D. melanogaster
aaaaaactatttc

SEQ ID NO: 541985 - DNA, 13 bp, D. melanogaster
aaaaaactgaagt

SEQ ID NO: 541986 - DNA, 13 bp, D. melanogaster
aaaaaactgatta

SEQ ID NO: 541987 - DNA, 13 bp, D. melanogaster
aaaaaactgattt

SEQ ID NO: 541988 - DNA, 13 bp, D. melanogaster
aaaaaactgcaac

SEQ ID NO: 541989 - DNA, 13 bp, D. melanogaster
aaaaaactgcaca

SEQ ID NO: 541990 - DNA, 13 bp, D. melanogaster
aaaaaactgcata

SEQ ID NO: 541991 - DNA, 13 bp, D. melanogaster
aaaaaactggcaa

SEQ ID NO: 541992 - DNA, 13 bp, D. melanogaster
aaaaaactggttt

SEQ ID NO: 541993 - DNA, 14 bp, D. melanogaster
aaaaaactgtaaca

SEQ ID NO: 541994 - DNA, 13 bp, D. melanogaster
aaaaaactgttct

SEQ ID NO: 541995 - DNA, 13 bp, D. melanogaster
aaaaaactgttgc

SEQ ID NO: 541996 - DNA, 13 bp, D. melanogaster
aaaaaacttgaat

SEQ ID NO: 541997 - DNA, 13 bp, D. melanogaster
aaaaaactttcac

SEQ ID NO: 541998 - DNA, 13 bp, D. melanogaster
aaaaaactttctt

SEQ ID NO: 541999 - DNA, 13 bp, D. melanogaster
aaaaaactttgaa

SEQ ID NO: 542000 - DNA, 13 bp, D. melanogaster
aaaaaactttgcc

SEQ ID NO: 542001 - DNA, 13 bp, D. melanogaster
aaaaaacttttca

SEQ ID NO: 542002 - DNA, 13 bp, D. melanogaster
aaaaaactttttg

SEQ ID NO: 542003 - DNA, 14 bp, D. melanogaster
aaaaaactttttgc

SEQ ID NO: 542004 - DNA, 13 bp, D. melanogaster
aaaaaagaacctt

SEQ ID NO: 542005 - DNA, 13 bp, D. melanogaster
aaaaaagaacttt

SEQ ID NO: 542006 - DNA, 13 bp, D. melanogaster
aaaaaagaagctg

SEQ ID NO: 542007 - DNA, 13 bp, D. melanogaster
aaaaaagaagctt

SEQ ID NO: 542008 - DNA, 13 bp, D. melanogaster
aaaaaagaatctg

SEQ ID NO: 542009 - DNA, 14 bp, D. melanogaster
aaaaaagaatctgt

SEQ ID NO: 542010 - DNA, 13 bp, D. melanogaster
aaaaaagaatttc

SEQ ID NO: 542011 - DNA, 13 bp, D. melanogaster
aaaaaagagcatt

SEQ ID NO: 542012 - DNA, 14 bp, D. melanogaster
aaaaaagagtgcaa

SEQ ID NO: 542013 - DNA, 13 bp, D. melanogaster
aaaaaagatgcca

SEQ ID NO: 542014 - DNA, 13 bp, D. melanogaster
aaaaaagattcag

SEQ ID NO: 542015 - DNA, 13 bp, D. melanogaster
aaaaaagcatttg

SEQ ID NO: 542016 - DNA, 13 bp, D. melanogaster
aaaaaagcatttt

SEQ ID NO: 542017 - DNA, 13 bp, D. melanogaster
aaaaaagccaact

SEQ ID NO: 542018 - DNA, 13 bp, D. melanogaster
aaaaaagccaagt

SEQ ID NO: 542019 - DNA, 13 bp, D. melanogaster
aaaaaagcgaact

SEQ ID NO: 542020 - DNA, 13 bp, D. melanogaster
aaaaaagcgttaa

SEQ ID NO: 542021 - DNA, 13 bp, D. melanogaster
aaaaaagctttaa

SEQ ID NO: 542022 - DNA, 13 bp, D. melanogaster
aaaaaaggaagct

SEQ ID NO: 542023 - DNA, 14 bp, D. melanogaster
aaaaaaggaagcta

SEQ ID NO: 542024 - DNA, 13 bp, D. melanogaster
aaaaaaggagttg

SEQ ID NO: 542025 - DNA, 13 bp, D. melanogaster
aaaaaaggattca

SEQ ID NO: 542026 - DNA, 13 bp, D. melanogaster
aaaaaaggatttt

SEQ ID NO: 542027 - DNA, 13 bp, D. melanogaster
aaaaaaggcattt

SEQ ID NO: 542028 - DNA, 13 bp, D. melanogaster
aaaaaaggctcaa

SEQ ID NO: 542029 - DNA, 13 bp, D. melanogaster
aaaaaaggctgaa

SEQ ID NO: 542030 - DNA, 13 bp, D. melanogaster
aaaaaaggcttca

SEQ ID NO: 542031 - DNA, 13 bp, D. melanogaster
aaaaaagggttga

SEQ ID NO: 542032 - DNA, 13 bp, D. melanogaster
aaaaaagggtttt

SEQ ID NO: 542033 - DNA, 13 bp, D. melanogaster
aaaaaaggtagca

SEQ ID NO: 542034 - DNA, 13 bp, D. melanogaster
aaaaaaggtggca

SEQ ID NO: 542035 - DNA, 13 bp, D. melanogaster
aaaaaaggttaca

SEQ ID NO: 542036 - DNA, 13 bp, D. melanogaster
aaaaaaggttcaa

SEQ ID NO: 542037 - DNA, 13 bp, D. melanogaster
aaaaaaggttgtc

SEQ ID NO: 542038 - DNA, 13 bp, D. melanogaster
aaaaaaggtttat

SEQ ID NO: 542039 - DNA, 13 bp, D. melanogaster
aaaaaagtactta

SEQ ID NO: 542040 - DNA, 13 bp, D. melanogaster
aaaaaagtacttt

SEQ ID NO: 542041 - DNA, 13 bp, D. melanogaster
aaaaaagtatctc

SEQ ID NO: 542042 - DNA, 13 bp, D. melanogaster
aaaaaagtatctt

SEQ ID NO: 542043 - DNA, 13 bp, D. melanogaster
aaaaaagtatgac

SEQ ID NO: 542044 - DNA, 13 bp, D. melanogaster
aaaaaagtcgaga

SEQ ID NO: 542045 - DNA, 13 bp, D. melanogaster
aaaaaagtgaagc

SEQ ID NO: 542046 - DNA, 13 bp, D. melanogaster
aaaaaagtgattt

SEQ ID NO: 542047 - DNA, 13 bp, D. melanogaster
aaaaaagtgcaac

SEQ ID NO: 542048 - DNA, 14 bp, D. melanogaster
aaaaaagtgcaaca

SEQ ID NO: 542049 - DNA, 13 bp, D. melanogaster
aaaaaagtgcaag

SEQ ID NO: 542050 - DNA, 13 bp, D. melanogaster
aaaaaagtgcagt

SEQ ID NO: 542051 - DNA, 13 bp, D. melanogaster
aaaaaagtgccac

SEQ ID NO: 542052 - DNA, 14 bp, D. melanogaster
aaaaaagtgccacc

SEQ ID NO: 542053 - DNA, 13 bp, D. melanogaster
aaaaaagtgctaa

SEQ ID NO: 542054 - DNA, 13 bp, D. melanogaster
aaaaaagtgctgg

SEQ ID NO: 542055 - DNA, 14 bp, D. melanogaster
aaaaaagtggcaaa

SEQ ID NO: 542056 - DNA, 13 bp, D. melanogaster
aaaaaagtggcca

SEQ ID NO: 542057 - DNA, 13 bp, D. melanogaster
aaaaaagtgggcg

SEQ ID NO: 542058 - DNA, 13 bp, D. melanogaster
aaaaaagtgtagc

SEQ ID NO: 542059 - DNA, 14 bp, D. melanogaster
aaaaaagtgtattt

SEQ ID NO: 542060 - DNA, 13 bp, D. melanogaster
aaaaaagtgtgca

SEQ ID NO: 542061 - DNA, 13 bp, D. melanogaster
aaaaaagtgtgct

SEQ ID NO: 542062 - DNA, 13 bp, D. melanogaster
aaaaaagtgtgga

SEQ ID NO: 542063 - DNA, 13 bp, D. melanogaster
aaaaaagtgttta

SEQ ID NO: 542064 - DNA, 13 bp, D. melanogaster
aaaaaagttcatt

SEQ ID NO: 542065 - DNA, 13 bp, D. melanogaster
aaaaaagttcgaa

SEQ ID NO: 542066 - DNA, 13 bp, D. melanogaster
aaaaaagttcgtt

SEQ ID NO: 542067 - DNA, 13 bp, D. melanogaster
aaaaaagttctta

SEQ ID NO: 542068 - DNA, 13 bp, D. melanogaster
aaaaaagttgcct

SEQ ID NO: 542069 - DNA, 13 bp, D. melanogaster
aaaaaagttggca

SEQ ID NO: 542070 - DNA, 13 bp, D. melanogaster
aaaaaagtttaac

SEQ ID NO: 542071 - DNA, 13 bp, D. melanogaster
aaaaaagtttaca

SEQ ID NO: 542072 - DNA, 13 bp, D. melanogaster
aaaaaagtttcaa

SEQ ID NO: 542073 - DNA, 14 bp, D. melanogaster
aaaaaagtttcaaa

SEQ ID NO: 542074 - DNA, 13 bp, D. melanogaster
aaaaaagtttcag

SEQ ID NO: 542075 - DNA, 13 bp, D. melanogaster
aaaaaagtttcgc

SEQ ID NO: 542076 - DNA, 13 bp, D. melanogaster
aaaaaagtttgcc

SEQ ID NO: 542077 - DNA, 13 bp, D. melanogaster
aaaaaagtttgtt

SEQ ID NO: 542078 - DNA, 13 bp, D. melanogaster
aaaaaagttttcc

SEQ ID NO: 542079 - DNA, 13 bp, D. melanogaster
aaaaaagtttttg

SEQ ID NO: 542080 - DNA, 13 bp, D. melanogaster
aaaaaataatcgg

SEQ ID NO: 542081 - DNA, 14 bp, D. melanogaster
aaaaaatacatttg

SEQ ID NO: 542082 - DNA, 13 bp, D. melanogaster
aaaaaatacgtat

SEQ ID NO: 542083 - DNA, 13 bp, D. melanogaster
aaaaaatactgca

SEQ ID NO: 542084 - DNA, 13 bp, D. melanogaster
aaaaaatactttg

SEQ ID NO: 542085 - DNA, 14 bp, D. melanogaster
aaaaaatagaattc

SEQ ID NO: 542086 - DNA, 13 bp, D. melanogaster
aaaaaataggctt

SEQ ID NO: 542087 - DNA, 14 bp, D. melanogaster
aaaaaataggcttc

SEQ ID NO: 542088 - DNA, 13 bp, D. melanogaster
aaaaaatagttca

SEQ ID NO: 542089 - DNA, 13 bp, D. melanogaster
aaaaaatatcgtt

SEQ ID NO: 542090 - DNA, 13 bp, D. melanogaster
aaaaaatatgcca

SEQ ID NO: 542091 - DNA, 14 bp, D. melanogaster
aaaaaatatgccaa

SEQ ID NO: 542092 - DNA, 13 bp, D. melanogaster
aaaaaatatgtac

SEQ ID NO: 542093 - DNA, 13 bp, D. melanogaster
aaaaaatatgttg

SEQ ID NO: 542094 - DNA, 13 bp, D. melanogaster
aaaaaatattgca

SEQ ID NO: 542095 - DNA, 13 bp, D. melanogaster
aaaaaatatttcc

SEQ ID NO: 542096 - DNA, 14 bp, D. melanogaster
aaaaaatatttcgc

SEQ ID NO: 542097 - DNA, 14 bp, D. melanogaster
aaaaaatatttgcc

SEQ ID NO: 542098 - DNA, 14 bp, D. melanogaster
aaaaaatattttgg

SEQ ID NO: 542099 - DNA, 13 bp, D. melanogaster
aaaaaatcaattg

SEQ ID NO: 542100 - DNA, 13 bp, D. melanogaster
aaaaaatcatctt

SEQ ID NO: 542101 - DNA, 14 bp, D. melanogaster
aaaaaatcatcttt

SEQ ID NO: 542102 - DNA, 13 bp, D. melanogaster
aaaaaatccagtt

SEQ ID NO: 542103 - DNA, 13 bp, D. melanogaster
aaaaaatccgttc

SEQ ID NO: 542104 - DNA, 13 bp, D. melanogaster
aaaaaatcgaatt

SEQ ID NO: 542105 - DNA, 13 bp, D. melanogaster
aaaaaatcgtggc

SEQ ID NO: 542106 - DNA, 27 bp, D. melanogaster
aaaaaatcgtgtgccaaaaaatcgtat

SEQ ID NO: 542107 - DNA, 13 bp, D. melanogaster
aaaaaatctgact

SEQ ID NO: 542108 - DNA, 13 bp, D. melanogaster
aaaaaatctgttg

SEQ ID NO: 542109 - DNA, 13 bp, D. melanogaster
aaaaaatctgttt

SEQ ID NO: 542110 - DNA, 13 bp, D. melanogaster
aaaaaatcttgaa

SEQ ID NO: 542111 - DNA, 13 bp, D. melanogaster
aaaaaatcttgtt

SEQ ID NO: 542112 - DNA, 13 bp, D. melanogaster
aaaaaatctttca

SEQ ID NO: 542113 - DNA, 13 bp, D. melanogaster
aaaaaatctttga

SEQ ID NO: 542114 - DNA, 13 bp, D. melanogaster
aaaaaatgaactg

SEQ ID NO: 542115 - DNA, 13 bp, D. melanogaster
aaaaaatgagttt

SEQ ID NO: 542116 - DNA, 13 bp, D. melanogaster
aaaaaatgcactt

SEQ ID NO: 542117 - DNA, 13 bp, D. melanogaster
aaaaaatgcagtg

SEQ ID NO: 542118 - DNA, 13 bp, D. melanogaster
aaaaaatgcattt

SEQ ID NO: 542119 - DNA, 13 bp, D. melanogaster
aaaaaatgctact

SEQ ID NO: 542120 - DNA, 13 bp, D. melanogaster
aaaaaatgctcat

SEQ ID NO: 542121 - DNA, 13 bp, D. melanogaster
aaaaaatggcaag

SEQ ID NO: 542122 - DNA, 13 bp, D. melanogaster
aaaaaatggcaga

SEQ ID NO: 542123 - DNA, 13 bp, D. melanogaster
aaaaaatggcatt

SEQ ID NO: 542124 - DNA, 13 bp, D. melanogaster
aaaaaatggccaa

SEQ ID NO: 542125 - DNA, 13 bp, D. melanogaster
aaaaaatggcgaa

SEQ ID NO: 542126 - DNA, 13 bp, D. melanogaster
aaaaaatgggatt

SEQ ID NO: 542127 - DNA, 13 bp, D. melanogaster
aaaaaatgggcga

SEQ ID NO: 542128 - DNA, 13 bp, D. melanogaster
aaaaaatgggtta

SEQ ID NO: 542129 - DNA, 14 bp, D. melanogaster
aaaaaatggtcaaa

SEQ ID NO: 542130 - DNA, 13 bp, D. melanogaster
aaaaaatgtacat

SEQ ID NO: 542131 - DNA, 14 bp, D. melanogaster
aaaaaatgtacatt

SEQ ID NO: 542132 - DNA, 14 bp, D. melanogaster
aaaaaatgtatgtt

SEQ ID NO: 542133 - DNA, 13 bp, D. melanogaster
aaaaaatgtcaca

SEQ ID NO: 542134 - DNA, 13 bp, D. melanogaster
aaaaaatgtcctt

SEQ ID NO: 542135 - DNA, 13 bp, D. melanogaster
aaaaaatgtcgaa

SEQ ID NO: 542136 - DNA, 13 bp, D. melanogaster
aaaaaatgtctta

SEQ ID NO: 542137 - DNA, 13 bp, D. melanogaster
aaaaaatgtggtt

SEQ ID NO: 542138 - DNA, 13 bp, D. melanogaster
aaaaaatgtgtct

SEQ ID NO: 542139 - DNA, 13 bp, D. melanogaster
aaaaaatgtgtgc

SEQ ID NO: 542140 - DNA, 13 bp, D. melanogaster
aaaaaatgtgtgt

SEQ ID NO: 542141 - DNA, 13 bp, D. melanogaster
aaaaaatgtgttt

SEQ ID NO: 542142 - DNA, 13 bp, D. melanogaster
aaaaaatgttcaa

SEQ ID NO: 542143 - DNA, 14 bp, D. melanogaster
aaaaaatgttcaaa

SEQ ID NO: 542144 - DNA, 13 bp, D. melanogaster
aaaaaatgttcca

SEQ ID NO: 542145 - DNA, 13 bp, D. melanogaster
aaaaaatgttctt

SEQ ID NO: 542146 - DNA, 13 bp, D. melanogaster
aaaaaatgttgtt

SEQ ID NO: 542147 - DNA, 13 bp, D. melanogaster
aaaaaatgtttac

SEQ ID NO: 542148 - DNA, 14 bp, D. melanogaster
aaaaaatgtttcaa

SEQ ID NO: 542149 - DNA, 13 bp, D. melanogaster
aaaaaatgtttct

SEQ ID NO: 542150 - DNA, 13 bp, D. melanogaster
aaaaaatgtttga

SEQ ID NO: 542151 - DNA, 14 bp, D. melanogaster
aaaaaatgtttgct

SEQ ID NO: 542152 - DNA, 13 bp, D. melanogaster
aaaaaatgtttgt

SEQ ID NO: 542153 - DNA, 14 bp, D. melanogaster
aaaaaatgtttgta

SEQ ID NO: 542154 - DNA, 14 bp, D. melanogaster
aaaaaatgtttgtt

SEQ ID NO: 542155 - DNA, 13 bp, D. melanogaster
aaaaaatgttttc

SEQ ID NO: 542156 - DNA, 13 bp, D. melanogaster
aaaaaattacagc

SEQ ID NO: 542157 - DNA, 13 bp, D. melanogaster
aaaaaattagttg

SEQ ID NO: 542158 - DNA, 14 bp, D. melanogaster
aaaaaattatgcaa

SEQ ID NO: 542159 - DNA, 13 bp, D. melanogaster
aaaaaattcagtt

SEQ ID NO: 542160 - DNA, 13 bp, D. melanogaster
aaaaaattcgcat

SEQ ID NO: 542161 - DNA, 14 bp, D. melanogaster
aaaaaattgcaaat

SEQ ID NO: 542162 - DNA, 13 bp, D. melanogaster
aaaaaattgcact

SEQ ID NO: 542163 - DNA, 13 bp, D. melanogaster
aaaaaattgcata

SEQ ID NO: 542164 - DNA, 14 bp, D. melanogaster
aaaaaattgcataa

SEQ ID NO: 542165 - DNA, 13 bp, D. melanogaster
aaaaaattgcatt

SEQ ID NO: 542166 - DNA, 13 bp, D. melanogaster
aaaaaattgccaa

SEQ ID NO: 542167 - DNA, 14 bp, D. melanogaster
aaaaaattgccaaa

SEQ ID NO: 542168 - DNA, 13 bp, D. melanogaster
aaaaaattgctgc

SEQ ID NO: 542169 - DNA, 14 bp, D. melanogaster
aaaaaattgctgct

SEQ ID NO: 542170 - DNA, 13 bp, D. melanogaster
aaaaaattggatt

SEQ ID NO: 542171 - DNA, 13 bp, D. melanogaster
aaaaaattggttt

SEQ ID NO: 542172 - DNA, 13 bp, D. melanogaster
aaaaaattgtaca

SEQ ID NO: 542173 - DNA, 13 bp, D. melanogaster
aaaaaattgtcag

SEQ ID NO: 542174 - DNA, 13 bp, D. melanogaster
aaaaaattgtgca

SEQ ID NO: 542175 - DNA, 13 bp, D. melanogaster
aaaaaattgtgga

SEQ ID NO: 542176 - DNA, 14 bp, D. melanogaster
aaaaaattgtgtgc

SEQ ID NO: 542177 - DNA, 13 bp, D. melanogaster
aaaaaattgtgtt

SEQ ID NO: 542178 - DNA, 13 bp, D. melanogaster
aaaaaatttcact

SEQ ID NO: 542179 - DNA, 13 bp, D. melanogaster
aaaaaatttccac

SEQ ID NO: 542180 - DNA, 14 bp, D. melanogaster
aaaaaatttcccaa

SEQ ID NO: 542181 - DNA, 13 bp, D. melanogaster
aaaaaatttcggt

SEQ ID NO: 542182 - DNA, 13 bp, D. melanogaster
aaaaaatttggca

SEQ ID NO: 542183 - DNA, 13 bp, D. melanogaster
aaaaaatttggtt

SEQ ID NO: 542184 - DNA, 13 bp, D. melanogaster
aaaaaatttgtgt

SEQ ID NO: 542185 - DNA, 13 bp, D. melanogaster
aaaaaattttcag

SEQ ID NO: 542186 - DNA, 13 bp, D. melanogaster
aaaaacaaactgc

SEQ ID NO: 542187 - DNA, 14 bp, D. melanogaster
aaaaacaaactgca

SEQ ID NO: 542188 - DNA, 13 bp, D. melanogaster
aaaaacaaagctg

SEQ ID NO: 542189 - DNA, 13 bp, D. melanogaster
aaaaacaaagtgt

SEQ ID NO: 542190 - DNA, 13 bp, D. melanogaster
aaaaacaaatggt

SEQ ID NO: 542191 - DNA, 14 bp, D. melanogaster
aaaaacaaatgttt

SEQ ID NO: 542192 - DNA, 13 bp, D. melanogaster
aaaaacaaattgt

SEQ ID NO: 542193 - DNA, 13 bp, D. melanogaster
aaaaacaaatttg

SEQ ID NO: 542194 - DNA, 14 bp, D. melanogaster
aaaaacaaatttga

SEQ ID NO: 542195 - DNA, 14 bp, D. melanogaster
aaaaacaacaactg

SEQ ID NO: 542196 - DNA, 13 bp, D. melanogaster
aaaaacaacttga

SEQ ID NO: 542197 - DNA, 13 bp, D. melanogaster
aaaaacaacttgc

SEQ ID NO: 542198 - DNA, 13 bp, D. melanogaster
aaaaacaagctat

SEQ ID NO: 542199 - DNA, 13 bp, D. melanogaster
aaaaacaagtgtt

SEQ ID NO: 542200 - DNA, 13 bp, D. melanogaster
aaaaacaagttct

SEQ ID NO: 542201 - DNA, 13 bp, D. melanogaster
aaaaacaagtttt

SEQ ID NO: 542202 - DNA, 14 bp, D. melanogaster
aaaaacaatgcaat

SEQ ID NO: 542203 - DNA, 13 bp, D. melanogaster
aaaaacaatggca

SEQ ID NO: 542204 - DNA, 14 bp, D. melanogaster
aaaaacaatggcaa

SEQ ID NO: 542205 - DNA, 13 bp, D. melanogaster
aaaaacaatgttg

SEQ ID NO: 542206 - DNA, 14 bp, D. melanogaster
aaaaacaattgaat

SEQ ID NO: 542207 - DNA, 13 bp, D. melanogaster
aaaaacaattgca

SEQ ID NO: 542208 - DNA, 13 bp, D. melanogaster
aaaaacaattgtt

SEQ ID NO: 542209 - DNA, 13 bp, D. melanogaster
aaaaacaatttcg

SEQ ID NO: 542210 - DNA, 13 bp, D. melanogaster
aaaaacaattttc

SEQ ID NO: 542211 - DNA, 14 bp, D. melanogaster
aaaaacacaaatgt

SEQ ID NO: 542212 - DNA, 13 bp, D. melanogaster
aaaaacacaattg

SEQ ID NO: 542213 - DNA, 14 bp, D. melanogaster
aaaaacacacattt

SEQ ID NO: 542214 - DNA, 13 bp, D. melanogaster
aaaaacacatgat

SEQ ID NO: 542215 - DNA, 13 bp, D. melanogaster
aaaaacacatttg

SEQ ID NO: 542216 - DNA, 13 bp, D. melanogaster
aaaaacacatttt

SEQ ID NO: 542217 - DNA, 13 bp, D. melanogaster
aaaaacaccgttt

SEQ ID NO: 542218 - DNA, 13 bp, D. melanogaster
aaaaacacctttt

SEQ ID NO: 542219 - DNA, 13 bp, D. melanogaster
aaaaacactcgca

SEQ ID NO: 542220 - DNA, 13 bp, D. melanogaster
aaaaacacttaag

SEQ ID NO: 542221 - DNA, 13 bp, D. melanogaster
aaaaacacttgaa

SEQ ID NO: 542222 - DNA, 13 bp, D. melanogaster
aaaaacacttgtg

SEQ ID NO: 542223 - DNA, 13 bp, D. melanogaster
aaaaacactttat

SEQ ID NO: 542224 - DNA, 13 bp, D. melanogaster
aaaaacactttgc

SEQ ID NO: 542225 - DNA, 13 bp, D. melanogaster
aaaaacactttgg

SEQ ID NO: 542226 - DNA, 13 bp, D. melanogaster
aaaaacactttgt

SEQ ID NO: 542227 - DNA, 13 bp, D. melanogaster
aaaaacagaagct

SEQ ID NO: 542228 - DNA, 13 bp, D. melanogaster
aaaaacagcaatt

SEQ ID NO: 542229 - DNA, 13 bp, D. melanogaster
aaaaacagcagct

SEQ ID NO: 542230 - DNA, 13 bp, D. melanogaster
aaaaacagctgac

SEQ ID NO: 542231 - DNA, 13 bp, D. melanogaster
aaaaacagctgag

SEQ ID NO: 542232 - DNA, 13 bp, D. melanogaster
aaaaacagctgat

SEQ ID NO: 542233 - DNA, 13 bp, D. melanogaster
aaaaacagctttc

SEQ ID NO: 542234 - DNA, 13 bp, D. melanogaster
aaaaacagctttt

SEQ ID NO: 542235 - DNA, 13 bp, D. melanogaster
aaaaacaggcagc

SEQ ID NO: 542236 - DNA, 13 bp, D. melanogaster
aaaaacaggtgag

SEQ ID NO: 542237 - DNA, 13 bp, D. melanogaster
aaaaacagtagcc

SEQ ID NO: 542238 - DNA, 14 bp, D. melanogaster
aaaaacagtcgcaa

SEQ ID NO: 542239 - DNA, 13 bp, D. melanogaster
aaaaacagttgaa

SEQ ID NO: 542240 - DNA, 13 bp, D. melanogaster
aaaaacagttgca

SEQ ID NO: 542241 - DNA, 13 bp, D. melanogaster
aaaaacagtttaa

SEQ ID NO: 542242 - DNA, 13 bp, D. melanogaster
aaaaacagtttta

SEQ ID NO: 542243 - DNA, 13 bp, D. melanogaster
aaaaacagttttt

SEQ ID NO: 542244 - DNA, 14 bp, D. melanogaster
aaaaacagttttta

SEQ ID NO: 542245 - DNA, 13 bp, D. melanogaster
aaaaacataattg

SEQ ID NO: 542246 - DNA, 13 bp, D. melanogaster
aaaaacatactgc

SEQ ID NO: 542247 - DNA, 13 bp, D. melanogaster
aaaaacatattga

SEQ ID NO: 542248 - DNA, 13 bp, D. melanogaster
aaaaacatcagca

SEQ ID NO: 542249 - DNA, 13 bp, D. melanogaster
aaaaacatcatcg

SEQ ID NO: 542250 - DNA, 14 bp, D. melanogaster
aaaaacatcatcgt

SEQ ID NO: 542251 - DNA, 13 bp, D. melanogaster
aaaaacatcgacg

SEQ ID NO: 542252 - DNA, 13 bp, D. melanogaster
aaaaacatcgata

SEQ ID NO: 542253 - DNA, 13 bp, D. melanogaster
aaaaacatcgtaa

SEQ ID NO: 542254 - DNA, 13 bp, D. melanogaster
aaaaacatgtaat

SEQ ID NO: 542255 - DNA, 14 bp, D. melanogaster
aaaaacatgtaatt

SEQ ID NO: 542256 - DNA, 13 bp, D. melanogaster
aaaaacatgtgaa

SEQ ID NO: 542257 - DNA, 13 bp, D. melanogaster
aaaaacattaagc

SEQ ID NO: 542258 - DNA, 13 bp, D. melanogaster
aaaaacattcatt

SEQ ID NO: 542259 - DNA, 14 bp, D. melanogaster
aaaaacattcgaaa

SEQ ID NO: 542260 - DNA, 14 bp, D. melanogaster
aaaaacattgaaat

SEQ ID NO: 542261 - DNA, 13 bp, D. melanogaster
aaaaacattgaag

SEQ ID NO: 542262 - DNA, 13 bp, D. melanogaster
aaaaacattgcca

SEQ ID NO: 542263 - DNA, 13 bp, D. melanogaster
aaaaacattgtaa

SEQ ID NO: 542264 - DNA, 13 bp, D. melanogaster
aaaaacatttcct

SEQ ID NO: 542265 - DNA, 13 bp, D. melanogaster
aaaaacatttctt

SEQ ID NO: 542266 - DNA, 13 bp, D. melanogaster
aaaaacatttgaa

SEQ ID NO: 542267 - DNA, 13 bp, D. melanogaster
aaaaacatttgcc

SEQ ID NO: 542268 - DNA, 14 bp, D. melanogaster
aaaaacatttgttt

SEQ ID NO: 542269 - DNA, 13 bp, D. melanogaster
aaaaacattttct

SEQ ID NO: 542270 - DNA, 13 bp, D. melanogaster
aaaaacattttgg

SEQ ID NO: 542271 - DNA, 14 bp, D. melanogaster
aaaaacattttggc

SEQ ID NO: 542272 - DNA, 14 bp, D. melanogaster
aaaaacattttgtt

SEQ ID NO: 542273 - DNA, 13 bp, D. melanogaster
aaaaaccaaatgg

SEQ ID NO: 542274 - DNA, 13 bp, D. melanogaster
aaaaaccaaatgt

SEQ ID NO: 542275 - DNA, 13 bp, D. melanogaster
aaaaaccaagtga

SEQ ID NO: 542276 - DNA, 13 bp, D. melanogaster
aaaaaccaagtta

SEQ ID NO: 542277 - DNA, 13 bp, D. melanogaster
aaaaaccaatctt

SEQ ID NO: 542278 - DNA, 13 bp, D. melanogaster
aaaaaccaatgca

SEQ ID NO: 542279 - DNA, 13 bp, D. melanogaster
aaaaaccaatttt

SEQ ID NO: 542280 - DNA, 13 bp, D. melanogaster
aaaaaccagaatg

SEQ ID NO: 542281 - DNA, 13 bp, D. melanogaster
aaaaaccaggaat

SEQ ID NO: 542282 - DNA, 13 bp, D. melanogaster
aaaaaccatattt

SEQ ID NO: 542283 - DNA, 13 bp, D. melanogaster
aaaaaccatttcc

SEQ ID NO: 542284 - DNA, 13 bp, D. melanogaster
aaaaaccattttc

SEQ ID NO: 542285 - DNA, 13 bp, D. melanogaster
aaaaacccaactt

SEQ ID NO: 542286 - DNA, 13 bp, D. melanogaster
aaaaacccaattt

SEQ ID NO: 542287 - DNA, 13 bp, D. melanogaster
aaaaacccatttt

SEQ ID NO: 542288 - DNA, 13 bp, D. melanogaster
aaaaaccccattt

SEQ ID NO: 542289 - DNA, 13 bp, D. melanogaster
aaaaacccctttt

SEQ ID NO: 542290 - DNA, 13 bp, D. melanogaster
aaaaacccgagag

SEQ ID NO: 542291 - DNA, 13 bp, D. melanogaster
aaaaaccctttat

SEQ ID NO: 542292 - DNA, 13 bp, D. melanogaster
aaaaaccctttgc

SEQ ID NO: 542293 - DNA, 13 bp, D. melanogaster
aaaaaccgaaact

SEQ ID NO: 542294 - DNA, 13 bp, D. melanogaster
aaaaaccgaaatg

SEQ ID NO: 542295 - DNA, 13 bp, D. melanogaster
aaaaaccgaatgc

SEQ ID NO: 542296 - DNA, 13 bp, D. melanogaster
aaaaaccgattat

SEQ ID NO: 542297 - DNA, 13 bp, D. melanogaster
aaaaacctattta

SEQ ID NO: 542298 - DNA, 13 bp, D. melanogaster
aaaaaccttggcc

SEQ ID NO: 542299 - DNA, 13 bp, D. melanogaster
aaaaacctttaac

SEQ ID NO: 542300 - DNA, 14 bp, D. melanogaster
aaaaacctttaaca

SEQ ID NO: 542301 - DNA, 13 bp, D. melanogaster
aaaaacctttaat

SEQ ID NO: 542302 - DNA, 13 bp, D. melanogaster
aaaaaccttttaa

SEQ ID NO: 542303 - DNA, 13 bp, D. melanogaster
aaaaaccttttgc

SEQ ID NO: 542304 - DNA, 13 bp, D. melanogaster
aaaaacctttttt

SEQ ID NO: 542305 - DNA, 13 bp, D. melanogaster
aaaaacgaactga

SEQ ID NO: 542306 - DNA, 13 bp, D. melanogaster
aaaaacgaagtat

SEQ ID NO: 542307 - DNA, 13 bp, D. melanogaster
aaaaacgaagtgc

SEQ ID NO: 542308 - DNA, 13 bp, D. melanogaster
aaaaacgaattat

SEQ ID NO: 542309 - DNA, 13 bp, D. melanogaster
aaaaacgaattca

SEQ ID NO: 542310 - DNA, 13 bp, D. melanogaster
aaaaacgaatttc

SEQ ID NO: 542311 - DNA, 13 bp, D. melanogaster
aaaaacgagtttt

SEQ ID NO: 542312 - DNA, 13 bp, D. melanogaster
aaaaacgatggaa

SEQ ID NO: 542313 - DNA, 13 bp, D. melanogaster
aaaaacgatttta

SEQ ID NO: 542314 - DNA, 13 bp, D. melanogaster
aaaaacgattttg

SEQ ID NO: 542315 - DNA, 13 bp, D. melanogaster
aaaaacgattttt

SEQ ID NO: 542316 - DNA, 14 bp, D. melanogaster
aaaaacgcaatatt

SEQ ID NO: 542317 - DNA, 13 bp, D. melanogaster
aaaaacgcaattt

SEQ ID NO: 542318 - DNA, 13 bp, D. melanogaster
aaaaacgcacata

SEQ ID NO: 542319 - DNA, 14 bp, D. melanogaster
aaaaacgcataaat

SEQ ID NO: 542320 - DNA, 14 bp, D. melanogaster
aaaaacgcattaaa

SEQ ID NO: 542321 - DNA, 13 bp, D. melanogaster
aaaaacgcattga

SEQ ID NO: 542322 - DNA, 14 bp, D. melanogaster
aaaaacgcattgat

SEQ ID NO: 542323 - DNA, 13 bp, D. melanogaster
aaaaacgcgccag

SEQ ID NO: 542324 - DNA, 13 bp, D. melanogaster
aaaaacgcgcgcg

SEQ ID NO: 542325 - DNA, 13 bp, D. melanogaster
aaaaacgctgcaa

SEQ ID NO: 542326 - DNA, 13 bp, D. melanogaster
aaaaacgctttaa

SEQ ID NO: 542327 - DNA, 13 bp, D. melanogaster
aaaaacggaaagt

SEQ ID NO: 542328 - DNA, 13 bp, D. melanogaster
aaaaacggaatta

SEQ ID NO: 542329 - DNA, 13 bp, D. melanogaster
aaaaacggatttt

SEQ ID NO: 542330 - DNA, 13 bp, D. melanogaster
aaaaacggcagca

SEQ ID NO: 542331 - DNA, 13 bp, D. melanogaster
aaaaacgggtttt

SEQ ID NO: 542332 - DNA, 13 bp, D. melanogaster
aaaaacggtggta

SEQ ID NO: 542333 - DNA, 13 bp, D. melanogaster
aaaaacgtaattg

SEQ ID NO: 542334 - DNA, 13 bp, D. melanogaster
aaaaacgtaattt

SEQ ID NO: 542335 - DNA, 13 bp, D. melanogaster
aaaaacgtatttg

SEQ ID NO: 542336 - DNA, 13 bp, D. melanogaster
aaaaacgtatttt

SEQ ID NO: 542337 - DNA, 13 bp, D. melanogaster
aaaaacgtgatgt

SEQ ID NO: 542338 - DNA, 14 bp, D. melanogaster
aaaaacgtgcaaaa

SEQ ID NO: 542339 - DNA, 13 bp, D. melanogaster
aaaaacgtggaaa

SEQ ID NO: 542340 - DNA, 14 bp, D. melanogaster
aaaaacgtggaagg

SEQ ID NO: 542341 - DNA, 13 bp, D. melanogaster
aaaaacgttaata

SEQ ID NO: 542342 - DNA, 13 bp, D. melanogaster
aaaaacgtttgaa

SEQ ID NO: 542343 - DNA, 13 bp, D. melanogaster
aaaaacgttttaa

SEQ ID NO: 542344 - DNA, 13 bp, D. melanogaster
aaaaacgttttca

SEQ ID NO: 542345 - DNA, 13 bp, D. melanogaster
aaaaacgtttttc

SEQ ID NO: 542346 - DNA, 13 bp, D. melanogaster
aaaaactaaagtt

SEQ ID NO: 542347 - DNA, 13 bp, D. melanogaster
aaaaactaagcca

SEQ ID NO: 542348 - DNA, 13 bp, D. melanogaster
aaaaactaatcga

SEQ ID NO: 542349 - DNA, 13 bp, D. melanogaster
aaaaactaattgg

SEQ ID NO: 542350 - DNA, 13 bp, D. melanogaster
aaaaactacaagc

SEQ ID NO: 542351 - DNA, 14 bp, D. melanogaster
aaaaactacaagct

SEQ ID NO: 542352 - DNA, 13 bp, D. melanogaster
aaaaactacactt

SEQ ID NO: 542353 - DNA, 13 bp, D. melanogaster
aaaaactacgaat

SEQ ID NO: 542354 - DNA, 13 bp, D. melanogaster
aaaaactactttt

SEQ ID NO: 542355 - DNA, 13 bp, D. melanogaster
aaaaactagaagg

SEQ ID NO: 542356 - DNA, 13 bp, D. melanogaster
aaaaactatcgca

SEQ ID NO: 542357 - DNA, 13 bp, D. melanogaster
aaaaactatgcca

SEQ ID NO: 542358 - DNA, 13 bp, D. melanogaster
aaaaactatgcta

SEQ ID NO: 542359 - DNA, 13 bp, D. melanogaster
aaaaactatgtat

SEQ ID NO: 542360 - DNA, 13 bp, D. melanogaster
aaaaactattcca

SEQ ID NO: 542361 - DNA, 13 bp, D. melanogaster
aaaaactatttgt

SEQ ID NO: 542362 - DNA, 13 bp, D. melanogaster
aaaaactattttc

SEQ ID NO: 542363 - DNA, 13 bp, D. melanogaster
aaaaactattttg

SEQ ID NO: 542364 - DNA, 13 bp, D. melanogaster
aaaaactcaattt

SEQ ID NO: 542365 - DNA, 13 bp, D. melanogaster
aaaaactcatttc

SEQ ID NO: 542366 - DNA, 13 bp, D. melanogaster
aaaaactcgcaca

SEQ ID NO: 542367 - DNA, 13 bp, D. melanogaster
aaaaactcgttta

SEQ ID NO: 542368 - DNA, 13 bp, D. melanogaster
aaaaactctttaa

SEQ ID NO: 542369 - DNA, 13 bp, D. melanogaster
aaaaactctttga

SEQ ID NO: 542370 - DNA, 13 bp, D. melanogaster
aaaaactgaaagt

SEQ ID NO: 542371 - DNA, 13 bp, D. melanogaster
aaaaactgaaatg

SEQ ID NO: 542372 - DNA, 14 bp, D. melanogaster
aaaaactgaaattt

SEQ ID NO: 542373 - DNA, 13 bp, D. melanogaster
aaaaactgaagat

SEQ ID NO: 542374 - DNA, 13 bp, D. melanogaster
aaaaactgaagct

SEQ ID NO: 542375 - DNA, 13 bp, D. melanogaster
aaaaactgaatat

SEQ ID NO: 542376 - DNA, 13 bp, D. melanogaster
aaaaactgaatgg

SEQ ID NO: 542377 - DNA, 13 bp, D. melanogaster
aaaaactgaattt

SEQ ID NO: 542378 - DNA, 15 bp, D. melanogaster
aaaaactgattattt

SEQ ID NO: 542379 - DNA, 13 bp, D. melanogaster
aaaaactgatttt

SEQ ID NO: 542380 - DNA, 13 bp, D. melanogaster
aaaaactgcaagt

SEQ ID NO: 542381 - DNA, 13 bp, D. melanogaster
aaaaactgcaata

SEQ ID NO: 542382 - DNA, 13 bp, D. melanogaster
aaaaactgcaatt

SEQ ID NO: 542383 - DNA, 13 bp, D. melanogaster
aaaaactgcacaa

SEQ ID NO: 542384 - DNA, 13 bp, D. melanogaster
aaaaactgcactt

SEQ ID NO: 542385 - DNA, 13 bp, D. melanogaster
aaaaactgcagct

SEQ ID NO: 542386 - DNA, 13 bp, D. melanogaster
aaaaactgcataa

SEQ ID NO: 542387 - DNA, 13 bp, D. melanogaster
aaaaactgcatat

SEQ ID NO: 542388 - DNA, 14 bp, D. melanogaster
aaaaactgccaaaa

SEQ ID NO: 542389 - DNA, 13 bp, D. melanogaster
aaaaactgccaac

SEQ ID NO: 542390 - DNA, 13 bp, D. melanogaster
aaaaactgccacg

SEQ ID NO: 542391 - DNA, 13 bp, D. melanogaster
aaaaactggaaat

SEQ ID NO: 542392 - DNA, 14 bp, D. melanogaster
aaaaactggacgtg

SEQ ID NO: 542393 - DNA, 13 bp, D. melanogaster
aaaaactggcaaa

SEQ ID NO: 542394 - DNA, 13 bp, D. melanogaster
aaaaactggtaaa

SEQ ID NO: 542395 - DNA, 13 bp, D. melanogaster
aaaaactgtattt

SEQ ID NO: 542396 - DNA, 13 bp, D. melanogaster
aaaaactgtcaaa

SEQ ID NO: 542397 - DNA, 13 bp, D. melanogaster
aaaaactgtcaac

SEQ ID NO: 542398 - DNA, 13 bp, D. melanogaster
aaaaactgtcatt

SEQ ID NO: 542399 - DNA, 13 bp, D. melanogaster
aaaaactgtgcca

SEQ ID NO: 542400 - DNA, 13 bp, D. melanogaster
aaaaactgtggaa

SEQ ID NO: 542401 - DNA, 13 bp, D. melanogaster
aaaaactgttcaa

SEQ ID NO: 542402 - DNA, 13 bp, D. melanogaster
aaaaactgttgaa

SEQ ID NO: 542403 - DNA, 13 bp, D. melanogaster
aaaaactgttgcc

SEQ ID NO: 542404 - DNA, 13 bp, D. melanogaster
aaaaactgtttaa

SEQ ID NO: 542405 - DNA, 13 bp, D. melanogaster
aaaaactgtttac

SEQ ID NO: 542406 - DNA, 13 bp, D. melanogaster
aaaaactgttttt

SEQ ID NO: 542407 - DNA, 13 bp, D. melanogaster
aaaaacttaaagc

SEQ ID NO: 542408 - DNA, 14 bp, D. melanogaster
aaaaacttaagcga

SEQ ID NO: 542409 - DNA, 13 bp, D. melanogaster
aaaaacttaagct

SEQ ID NO: 542410 - DNA, 13 bp, D. melanogaster
aaaaacttcaaag

SEQ ID NO: 542411 - DNA, 13 bp, D. melanogaster
aaaaacttcaact

SEQ ID NO: 542412 - DNA, 13 bp, D. melanogaster
aaaaacttcagtg

SEQ ID NO: 542413 - DNA, 13 bp, D. melanogaster
aaaaacttcatct

SEQ ID NO: 542414 - DNA, 13 bp, D. melanogaster
aaaaacttcatga

SEQ ID NO: 542415 - DNA, 13 bp, D. melanogaster
aaaaacttgaaac

SEQ ID NO: 542416 - DNA, 13 bp, D. melanogaster
aaaaacttgaaag

SEQ ID NO: 542417 - DNA, 13 bp, D. melanogaster
aaaaacttgaaat

SEQ ID NO: 542418 - DNA, 13 bp, D. melanogaster
aaaaacttgaagt

SEQ ID NO: 542419 - DNA, 13 bp, D. melanogaster
aaaaacttgactt

SEQ ID NO: 542420 - DNA, 13 bp, D. melanogaster
aaaaacttgcaca

SEQ ID NO: 542421 - DNA, 13 bp, D. melanogaster
aaaaacttggcaa

SEQ ID NO: 542422 - DNA, 14 bp, D. melanogaster
aaaaacttggcgaa

SEQ ID NO: 542423 - DNA, 13 bp, D. melanogaster
aaaaacttgtaaa

SEQ ID NO: 542424 - DNA, 13 bp, D. melanogaster
aaaaacttgtcca

SEQ ID NO: 542425 - DNA, 13 bp, D. melanogaster
aaaaacttgttta

SEQ ID NO: 542426 - DNA, 13 bp, D. melanogaster
aaaaactttaagt

SEQ ID NO: 542427 - DNA, 13 bp, D. melanogaster
aaaaactttagtt

SEQ ID NO: 542428 - DNA, 13 bp, D. melanogaster
aaaaactttatag

SEQ ID NO: 542429 - DNA, 13 bp, D. melanogaster
aaaaactttcacc

SEQ ID NO: 542430 - DNA, 13 bp, D. melanogaster
aaaaactttcact

SEQ ID NO: 542431 - DNA, 13 bp, D. melanogaster
aaaaactttccaa

SEQ ID NO: 542432 - DNA, 13 bp, D. melanogaster
aaaaactttcgat

SEQ ID NO: 542433 - DNA, 13 bp, D. melanogaster
aaaaactttcgca

SEQ ID NO: 542434 - DNA, 13 bp, D. melanogaster
aaaaactttctgc

SEQ ID NO: 542435 - DNA, 14 bp, D. melanogaster
aaaaactttgaaaa

SEQ ID NO: 542436 - DNA, 13 bp, D. melanogaster
aaaaactttgatt

SEQ ID NO: 542437 - DNA, 13 bp, D. melanogaster
aaaaactttgcaa

SEQ ID NO: 542438 - DNA, 13 bp, D. melanogaster
aaaaactttgcat

SEQ ID NO: 542439 - DNA, 13 bp, D. melanogaster
aaaaactttgcca

SEQ ID NO: 542440 - DNA, 14 bp, D. melanogaster
aaaaactttgccaa

SEQ ID NO: 542441 - DNA, 13 bp, D. melanogaster
aaaaactttggat

SEQ ID NO: 542442 - DNA, 14 bp, D. melanogaster
aaaaactttggcca

SEQ ID NO: 542443 - DNA, 13 bp, D. melanogaster
aaaaactttggcg

SEQ ID NO: 542444 - DNA, 13 bp, D. melanogaster
aaaaacttttaca

SEQ ID NO: 542445 - DNA, 14 bp, D. melanogaster
aaaaacttttcaat

SEQ ID NO: 542446 - DNA, 13 bp, D. melanogaster
aaaaacttttctt

SEQ ID NO: 542447 - DNA, 14 bp, D. melanogaster
aaaaacttttgcaa

SEQ ID NO: 542448 - DNA, 13 bp, D. melanogaster
aaaaacttttgcc

SEQ ID NO: 542449 - DNA, 13 bp, D. melanogaster
aaaaacttttggc

SEQ ID NO: 542450 - DNA, 13 bp, D. melanogaster
aaaaacttttgta

SEQ ID NO: 542451 - DNA, 13 bp, D. melanogaster
aaaaactttttca

SEQ ID NO: 542452 - DNA, 14 bp, D. melanogaster
aaaaactttttcaa

SEQ ID NO: 542453 - DNA, 13 bp, D. melanogaster
aaaaactttttcc

SEQ ID NO: 542454 - DNA, 13 bp, D. melanogaster
aaaaactttttgc

SEQ ID NO: 542455 - DNA, 13 bp, D. melanogaster
aaaaactttttgg

SEQ ID NO: 542456 - DNA, 14 bp, D. melanogaster
aaaaagaaaacttt

SEQ ID NO: 542457 - DNA, 13 bp, D. melanogaster
aaaaagaaatcgt

SEQ ID NO: 542458 - DNA, 13 bp, D. melanogaster
aaaaagaaatctt

SEQ ID NO: 542459 - DNA, 13 bp, D. melanogaster
aaaaagaaatgct

SEQ ID NO: 542460 - DNA, 13 bp, D. melanogaster
aaaaagaaattgc

SEQ ID NO: 542461 - DNA, 14 bp, D. melanogaster
aaaaagaaattgcc

SEQ ID NO: 542462 - DNA, 13 bp, D. melanogaster
aaaaagaacattt

SEQ ID NO: 542463 - DNA, 13 bp, D. melanogaster
aaaaagaacttgg

SEQ ID NO: 542464 - DNA, 13 bp, D. melanogaster
aaaaagaactttt

SEQ ID NO: 542465 - DNA, 13 bp, D. melanogaster
aaaaagaagcggc

SEQ ID NO: 542466 - DNA, 14 bp, D. melanogaster
aaaaagaagctata

SEQ ID NO: 542467 - DNA, 13 bp, D. melanogaster
aaaaagaagtgct

SEQ ID NO: 542468 - DNA, 13 bp, D. melanogaster
aaaaagaagtttt

SEQ ID NO: 542469 - DNA, 13 bp, D. melanogaster
aaaaagaatgtcg

SEQ ID NO: 542470 - DNA, 13 bp, D. melanogaster
aaaaagaattctt

SEQ ID NO: 542471 - DNA, 13 bp, D. melanogaster
aaaaagaattttc

SEQ ID NO: 542472 - DNA, 13 bp, D. melanogaster
aaaaagacaattc

SEQ ID NO: 542473 - DNA, 15 bp, D. melanogaster
aaaaagacaattcgt

SEQ ID NO: 542474 - DNA, 13 bp, D. melanogaster
aaaaagacattgt

SEQ ID NO: 542475 - DNA, 13 bp, D. melanogaster
aaaaagacatttt

SEQ ID NO: 542476 - DNA, 13 bp, D. melanogaster
aaaaagagattca

SEQ ID NO: 542477 - DNA, 13 bp, D. melanogaster
aaaaagagatttg

SEQ ID NO: 542478 - DNA, 13 bp, D. melanogaster
aaaaagagatttt

SEQ ID NO: 542479 - DNA, 13 bp, D. melanogaster
aaaaagagtaagc

SEQ ID NO: 542480 - DNA, 14 bp, D. melanogaster
aaaaagagtaagcc

SEQ ID NO: 542481 - DNA, 13 bp, D. melanogaster
aaaaagagtgcaa

SEQ ID NO: 542482 - DNA, 13 bp, D. melanogaster
aaaaagagtggta

SEQ ID NO: 542483 - DNA, 13 bp, D. melanogaster
aaaaagagttctt

SEQ ID NO: 542484 - DNA, 13 bp, D. melanogaster
aaaaagagttttg

SEQ ID NO: 542485 - DNA, 14 bp, D. melanogaster
aaaaagatacattt

SEQ ID NO: 542486 - DNA, 13 bp, D. melanogaster
aaaaagatggcga

SEQ ID NO: 542487 - DNA, 14 bp, D. melanogaster
aaaaagatggcgat

SEQ ID NO: 542488 - DNA, 13 bp, D. melanogaster
aaaaagattcaga

SEQ ID NO: 542489 - DNA, 13 bp, D. melanogaster
aaaaagatttcaa

SEQ ID NO: 542490 - DNA, 13 bp, D. melanogaster
aaaaagatttcca

SEQ ID NO: 542491 - DNA, 13 bp, D. melanogaster
aaaaagatttcta

SEQ ID NO: 542492 - DNA, 13 bp, D. melanogaster
aaaaagcaaatgc

SEQ ID NO: 542493 - DNA, 13 bp, D. melanogaster
aaaaagcaaatgg

SEQ ID NO: 542494 - DNA, 13 bp, D. melanogaster
aaaaagcaatgga

SEQ ID NO: 542495 - DNA, 14 bp, D. melanogaster
aaaaagcaatggag

SEQ ID NO: 542496 - DNA, 13 bp, D. melanogaster
aaaaagcaatttg

SEQ ID NO: 542497 - DNA, 13 bp, D. melanogaster
aaaaagcagcagc

SEQ ID NO: 542498 - DNA, 14 bp, D. melanogaster
aaaaagcagcagca

SEQ ID NO: 542499 - DNA, 13 bp, D. melanogaster
aaaaagcagccac

SEQ ID NO: 542500 - DNA, 13 bp, D. melanogaster
aaaaagcagcgag

SEQ ID NO: 542501 - DNA, 13 bp, D. melanogaster
aaaaagcagtcga

SEQ ID NO: 542502 - DNA, 13 bp, D. melanogaster
aaaaagcattaat

SEQ ID NO: 542503 - DNA, 13 bp, D. melanogaster
aaaaagcattcat

SEQ ID NO: 542504 - DNA, 14 bp, D. melanogaster
aaaaagcattcata

SEQ ID NO: 542505 - DNA, 13 bp, D. melanogaster
aaaaagcattcga

SEQ ID NO: 542506 - DNA, 13 bp, D. melanogaster
aaaaagcattgaa

SEQ ID NO: 542507 - DNA, 14 bp, D. melanogaster
aaaaagcatttaaa

SEQ ID NO: 542508 - DNA, 13 bp, D. melanogaster
aaaaagcatttac

SEQ ID NO: 542509 - DNA, 13 bp, D. melanogaster
aaaaagcatttca

SEQ ID NO: 542510 - DNA, 13 bp, D. melanogaster
aaaaagcattttt

SEQ ID NO: 542511 - DNA, 13 bp, D. melanogaster
aaaaagccaactt

SEQ ID NO: 542512 - DNA, 13 bp, D. melanogaster
aaaaagccaagtt

SEQ ID NO: 542513 - DNA, 13 bp, D. melanogaster
aaaaagccagcag

SEQ ID NO: 542514 - DNA, 13 bp, D. melanogaster
aaaaagccgaaat

SEQ ID NO: 542515 - DNA, 13 bp, D. melanogaster
aaaaagcgaaatt

SEQ ID NO: 542516 - DNA, 14 bp, D. melanogaster
aaaaagcgaaattt

SEQ ID NO: 542517 - DNA, 13 bp, D. melanogaster
aaaaagcgaatga

SEQ ID NO: 542518 - DNA, 13 bp, D. melanogaster
aaaaagcgaggca

SEQ ID NO: 542519 - DNA, 13 bp, D. melanogaster
aaaaagcgatcat

SEQ ID NO: 542520 - DNA, 13 bp, D. melanogaster
aaaaagcgcccaa

SEQ ID NO: 542521 - DNA, 13 bp, D. melanogaster
aaaaagcggcaat

SEQ ID NO: 542522 - DNA, 13 bp, D. melanogaster
aaaaagcggtcat

SEQ ID NO: 542523 - DNA, 13 bp, D. melanogaster
aaaaagctaaagc

SEQ ID NO: 542524 - DNA, 13 bp, D. melanogaster
aaaaagctaaatt

SEQ ID NO: 542525 - DNA, 13 bp, D. melanogaster
aaaaagctaacta

SEQ ID NO: 542526 - DNA, 13 bp, D. melanogaster
aaaaagctcataa

SEQ ID NO: 542527 - DNA, 13 bp, D. melanogaster
aaaaagctgaaat

SEQ ID NO: 542528 - DNA, 13 bp, D. melanogaster
aaaaagctgatct

SEQ ID NO: 542529 - DNA, 13 bp, D. melanogaster
aaaaagctgcaaa

SEQ ID NO: 542530 - DNA, 13 bp, D. melanogaster
aaaaagctggaaa

SEQ ID NO: 542531 - DNA, 13 bp, D. melanogaster
aaaaagctggcaa

SEQ ID NO: 542532 - DNA, 13 bp, D. melanogaster
aaaaagctgggtc

SEQ ID NO: 542533 - DNA, 13 bp, D. melanogaster
aaaaagcttattt

SEQ ID NO: 542534 - DNA, 14 bp, D. melanogaster
aaaaagctttaaaa

SEQ ID NO: 542535 - DNA, 13 bp, D. melanogaster
aaaaagctttgct

SEQ ID NO: 542536 - DNA, 13 bp, D. melanogaster
aaaaagcttttcc

SEQ ID NO: 542537 - DNA, 14 bp, D. melanogaster
aaaaaggaaaatgc

SEQ ID NO: 542538 - DNA, 13 bp, D. melanogaster
aaaaaggaaactg

SEQ ID NO: 542539 - DNA, 14 bp, D. melanogaster
aaaaaggaaactga

SEQ ID NO: 542540 - DNA, 13 bp, D. melanogaster
aaaaaggaaactt

SEQ ID NO: 542541 - DNA, 13 bp, D. melanogaster
aaaaaggaaatcc

SEQ ID NO: 542542 - DNA, 13 bp, D. melanogaster
aaaaaggaaatgc

SEQ ID NO: 542543 - DNA, 13 bp, D. melanogaster
aaaaaggaaattc

SEQ ID NO: 542544 - DNA, 13 bp, D. melanogaster
aaaaaggaatttt

SEQ ID NO: 542545 - DNA, 13 bp, D. melanogaster
aaaaaggacaatt

SEQ ID NO: 542546 - DNA, 13 bp, D. melanogaster
aaaaaggacattc

SEQ ID NO: 542547 - DNA, 13 bp, D. melanogaster
aaaaaggacattt

SEQ ID NO: 542548 - DNA, 13 bp, D. melanogaster
aaaaaggagcaat

SEQ ID NO: 542549 - DNA, 13 bp, D. melanogaster
aaaaaggatatac

SEQ ID NO: 542550 - DNA, 13 bp, D. melanogaster
aaaaaggatatgc

SEQ ID NO: 542551 - DNA, 13 bp, D. melanogaster
aaaaaggatgcga

SEQ ID NO: 542552 - DNA, 13 bp, D. melanogaster
aaaaaggattcaa

SEQ ID NO: 542553 - DNA, 13 bp, D. melanogaster
aaaaaggatttcc

SEQ ID NO: 542554 - DNA, 13 bp, D. melanogaster
aaaaaggatttgc

SEQ ID NO: 542555 - DNA, 13 bp, D. melanogaster
aaaaaggattttc

SEQ ID NO: 542556 - DNA, 13 bp, D. melanogaster
aaaaaggcaagcc

SEQ ID NO: 542557 - DNA, 13 bp, D. melanogaster
aaaaaggcaattt

SEQ ID NO: 542558 - DNA, 13 bp, D. melanogaster
aaaaaggcagcag

SEQ ID NO: 542559 - DNA, 13 bp, D. melanogaster
aaaaaggcagcca

SEQ ID NO: 542560 - DNA, 13 bp, D. melanogaster
aaaaaggcgaaat

SEQ ID NO: 542561 - DNA, 13 bp, D. melanogaster
aaaaaggcgctgc

SEQ ID NO: 542562 - DNA, 13 bp, D. melanogaster
aaaaaggcttaaa

SEQ ID NO: 542563 - DNA, 13 bp, D. melanogaster
aaaaaggctttaa

SEQ ID NO: 542564 - DNA, 14 bp, D. melanogaster
aaaaagggaaaact

SEQ ID NO: 542565 - DNA, 14 bp, D. melanogaster
aaaaagggaaattt

SEQ ID NO: 542566 - DNA, 13 bp, D. melanogaster
aaaaagggcaaat

SEQ ID NO: 542567 - DNA, 13 bp, D. melanogaster
aaaaagggcaatc

SEQ ID NO: 542568 - DNA, 13 bp, D. melanogaster
aaaaagggcagca

SEQ ID NO: 542569 - DNA, 13 bp, D. melanogaster
aaaaaggggttcg

SEQ ID NO: 542570 - DNA, 14 bp, D. melanogaster
aaaaaggggttcgg

SEQ ID NO: 542571 - DNA, 13 bp, D. melanogaster
aaaaagggttaag

SEQ ID NO: 542572 - DNA, 13 bp, D. melanogaster
aaaaagggttcaa

SEQ ID NO: 542573 - DNA, 13 bp, D. melanogaster
aaaaagggttttt

SEQ ID NO: 542574 - DNA, 13 bp, D. melanogaster
aaaaaggtaattt

SEQ ID NO: 542575 - DNA, 13 bp, D. melanogaster
aaaaaggtattta

SEQ ID NO: 542576 - DNA, 13 bp, D. melanogaster
aaaaaggtgttaa

SEQ ID NO: 542577 - DNA, 13 bp, D. melanogaster
aaaaaggtgttga

SEQ ID NO: 542578 - DNA, 13 bp, D. melanogaster
aaaaaggtgtttt

SEQ ID NO: 542579 - DNA, 13 bp, D. melanogaster
aaaaaggtttgaa

SEQ ID NO: 542580 - DNA, 13 bp, D. melanogaster
aaaaaggtttgcc

SEQ ID NO: 542581 - DNA, 13 bp, D. melanogaster
aaaaaggttttaa

SEQ ID NO: 542582 - DNA, 13 bp, D. melanogaster
aaaaaggttttat

SEQ ID NO: 542583 - DNA, 13 bp, D. melanogaster
aaaaaggttttct

SEQ ID NO: 542584 - DNA, 14 bp, D. melanogaster
aaaaaggtttttaa

SEQ ID NO: 542585 - DNA, 13 bp, D. melanogaster
aaaaaggtttttc

SEQ ID NO: 542586 - DNA, 13 bp, D. melanogaster
aaaaaggtttttt

SEQ ID NO: 542587 - DNA, 13 bp, D. melanogaster
aaaaagtaaatgc

SEQ ID NO: 542588 - DNA, 13 bp, D. melanogaster
aaaaagtacacat

SEQ ID NO: 542589 - DNA, 13 bp, D. melanogaster
aaaaagtacactt

SEQ ID NO: 542590 - DNA, 13 bp, D. melanogaster
aaaaagtacattt

SEQ ID NO: 542591 - DNA, 13 bp, D. melanogaster
aaaaagtactttt

SEQ ID NO: 542592 - DNA, 13 bp, D. melanogaster
aaaaagtaggcaa

SEQ ID NO: 542593 - DNA, 13 bp, D. melanogaster
aaaaagtagtttt

SEQ ID NO: 542594 - DNA, 13 bp, D. melanogaster
aaaaagtatctta

SEQ ID NO: 542595 - DNA, 13 bp, D. melanogaster
aaaaagtatgcaa

SEQ ID NO: 542596 - DNA, 14 bp, D. melanogaster
aaaaagtatgcaaa

SEQ ID NO: 542597 - DNA, 14 bp, D. melanogaster
aaaaagtatttcaa

SEQ ID NO: 542598 - DNA, 13 bp, D. melanogaster
aaaaagtatttcg

SEQ ID NO: 542599 - DNA, 13 bp, D. melanogaster
aaaaagtcaaatg

SEQ ID NO: 542600 - DNA, 13 bp, D. melanogaster
aaaaagtcaagcc

SEQ ID NO: 542601 - DNA, 13 bp, D. melanogaster
aaaaagtcaatat

SEQ ID NO: 542602 - DNA, 13 bp, D. melanogaster
aaaaagtcatttt

SEQ ID NO: 542603 - DNA, 13 bp, D. melanogaster
aaaaagtccatga

SEQ ID NO: 542604 - DNA, 13 bp, D. melanogaster
aaaaagtcgacca

SEQ ID NO: 542605 - DNA, 13 bp, D. melanogaster
aaaaagtcgagaa

SEQ ID NO: 542606 - DNA, 13 bp, D. melanogaster
aaaaagtcgattc

SEQ ID NO: 542607 - DNA, 13 bp, D. melanogaster
aaaaagtgaaact

SEQ ID NO: 542608 - DNA, 13 bp, D. melanogaster
aaaaagtgaaagc

SEQ ID NO: 542609 - DNA, 13 bp, D. melanogaster
aaaaagtgaagca

SEQ ID NO: 542610 - DNA, 13 bp, D. melanogaster
aaaaagtgaatac

SEQ ID NO: 542611 - DNA, 13 bp, D. melanogaster
aaaaagtgaatgt

SEQ ID NO: 542612 - DNA, 13 bp, D. melanogaster
aaaaagtgaattg

SEQ ID NO: 542613 - DNA, 13 bp, D. melanogaster
aaaaagtgcaaat

SEQ ID NO: 542614 - DNA, 13 bp, D. melanogaster
aaaaagtgcaaca

SEQ ID NO: 542615 - DNA, 14 bp, D. melanogaster
aaaaagtgcaagtg

SEQ ID NO: 542616 - DNA, 13 bp, D. melanogaster
aaaaagtgcaata

SEQ ID NO: 542617 - DNA, 13 bp, D. melanogaster
aaaaagtgcaatc

SEQ ID NO: 542618 - DNA, 13 bp, D. melanogaster
aaaaagtgcaatg

SEQ ID NO: 542619 - DNA, 13 bp, D. melanogaster
aaaaagtgcacaa

SEQ ID NO: 542620 - DNA, 13 bp, D. melanogaster
aaaaagtgcacac

SEQ ID NO: 542621 - DNA, 13 bp, D. melanogaster
aaaaagtgcactg

SEQ ID NO: 542622 - DNA, 13 bp, D. melanogaster
aaaaagtgcagag

SEQ ID NO: 542623 - DNA, 13 bp, D. melanogaster
aaaaagtgcagca

SEQ ID NO: 542624 - DNA, 13 bp, D. melanogaster
aaaaagtgcataa

SEQ ID NO: 542625 - DNA, 13 bp, D. melanogaster
aaaaagtgcattg

SEQ ID NO: 542626 - DNA, 13 bp, D. melanogaster
aaaaagtgccacc

SEQ ID NO: 542627 - DNA, 13 bp, D. melanogaster
aaaaagtgccagc

SEQ ID NO: 542628 - DNA, 13 bp, D. melanogaster
aaaaagtgcgcaa

SEQ ID NO: 542629 - DNA, 13 bp, D. melanogaster
aaaaagtgctgca

SEQ ID NO: 542630 - DNA, 13 bp, D. melanogaster
aaaaagtggcaaa

SEQ ID NO: 542631 - DNA, 13 bp, D. melanogaster
aaaaagtggcagc

SEQ ID NO: 542632 - DNA, 13 bp, D. melanogaster
aaaaagtggccaa

SEQ ID NO: 542633 - DNA, 13 bp, D. melanogaster
aaaaagtggctgc

SEQ ID NO: 542634 - DNA, 14 bp, D. melanogaster
aaaaagtggctgca

SEQ ID NO: 542635 - DNA, 14 bp, D. melanogaster
aaaaagtgggcaaa

SEQ ID NO: 542636 - DNA, 13 bp, D. melanogaster
aaaaagtgggcgg

SEQ ID NO: 542637 - DNA, 13 bp, D. melanogaster
aaaaagtgggcgt

SEQ ID NO: 542638 - DNA, 13 bp, D. melanogaster
aaaaagtggtctt

SEQ ID NO: 542639 - DNA, 13 bp, D. melanogaster
aaaaagtgtaatt

SEQ ID NO: 542640 - DNA, 13 bp, D. melanogaster
aaaaagtgtacat

SEQ ID NO: 542641 - DNA, 13 bp, D. melanogaster
aaaaagtgtagca

SEQ ID NO: 542642 - DNA, 13 bp, D. melanogaster
aaaaagtgtattt

SEQ ID NO: 542643 - DNA, 14 bp, D. melanogaster
aaaaagtgtcaaaa

SEQ ID NO: 542644 - DNA, 13 bp, D. melanogaster
aaaaagtgtcaga

SEQ ID NO: 542645 - DNA, 13 bp, D. melanogaster
aaaaagtgtgttt

SEQ ID NO: 542646 - DNA, 13 bp, D. melanogaster
aaaaagtgttaag

SEQ ID NO: 542647 - DNA, 13 bp, D. melanogaster
aaaaagtgttaat

SEQ ID NO: 542648 - DNA, 13 bp, D. melanogaster
aaaaagtgttcaa

SEQ ID NO: 542649 - DNA, 14 bp, D. melanogaster
aaaaagtgttgcat

SEQ ID NO: 542650 - DNA, 13 bp, D. melanogaster
aaaaagtgtttgc

SEQ ID NO: 542651 - DNA, 14 bp, D. melanogaster
aaaaagtgttttaa

SEQ ID NO: 542652 - DNA, 13 bp, D. melanogaster
aaaaagtgttttg

SEQ ID NO: 542653 - DNA, 14 bp, D. melanogaster
aaaaagtgttttgg

SEQ ID NO: 542654 - DNA, 13 bp, D. melanogaster
aaaaagttaagtt

SEQ ID NO: 542655 - DNA, 13 bp, D. melanogaster
aaaaagttataca

SEQ ID NO: 542656 - DNA, 13 bp, D. melanogaster
aaaaagttatcaa

SEQ ID NO: 542657 - DNA, 13 bp, D. melanogaster
aaaaagttatgag

SEQ ID NO: 542658 - DNA, 13 bp, D. melanogaster
aaaaagttattca

SEQ ID NO: 542659 - DNA, 13 bp, D. melanogaster
aaaaagttattcc

SEQ ID NO: 542660 - DNA, 13 bp, D. melanogaster
aaaaagttcaaca

SEQ ID NO: 542661 - DNA, 13 bp, D. melanogaster
aaaaagttccaaa

SEQ ID NO: 542662 - DNA, 13 bp, D. melanogaster
aaaaagttcgaaa

SEQ ID NO: 542663 - DNA, 14 bp, D. melanogaster
aaaaagttcgaaaa

SEQ ID NO: 542664 - DNA, 13 bp, D. melanogaster
aaaaagttcttat

SEQ ID NO: 542665 - DNA, 13 bp, D. melanogaster
aaaaagttgaaac

SEQ ID NO: 542666 - DNA, 13 bp, D. melanogaster
aaaaagttgaaca

SEQ ID NO: 542667 - DNA, 13 bp, D. melanogaster
aaaaagttgaatg

SEQ ID NO: 542668 - DNA, 13 bp, D. melanogaster
aaaaagttgaatt

SEQ ID NO: 542669 - DNA, 13 bp, D. melanogaster
aaaaagttgacaa

SEQ ID NO: 542670 - DNA, 14 bp, D. melanogaster
aaaaagttgacaaa

SEQ ID NO: 542671 - DNA, 13 bp, D. melanogaster
aaaaagttgattt

SEQ ID NO: 542672 - DNA, 13 bp, D. melanogaster
aaaaagttgcaaa

SEQ ID NO: 542673 - DNA, 13 bp, D. melanogaster
aaaaagttgcagc

SEQ ID NO: 542674 - DNA, 13 bp, D. melanogaster
aaaaagttgccaa

SEQ ID NO: 542675 - DNA, 13 bp, D. melanogaster
aaaaagttgtgga

SEQ ID NO: 542676 - DNA, 13 bp, D. melanogaster
aaaaagttgttaa

SEQ ID NO: 542677 - DNA, 13 bp, D. melanogaster
aaaaagttgttat

SEQ ID NO: 542678 - DNA, 13 bp, D. melanogaster
aaaaagttgttga

SEQ ID NO: 542679 - DNA, 13 bp, D. melanogaster
aaaaagttgtttg

SEQ ID NO: 542680 - DNA, 13 bp, D. melanogaster
aaaaagtttaaca

SEQ ID NO: 542681 - DNA, 14 bp, D. melanogaster
aaaaagtttacaaa

SEQ ID NO: 542682 - DNA, 13 bp, D. melanogaster
aaaaagtttactt

SEQ ID NO: 542683 - DNA, 13 bp, D. melanogaster
aaaaagtttagtt

SEQ ID NO: 542684 - DNA, 13 bp, D. melanogaster
aaaaagtttatca

SEQ ID NO: 542685 - DNA, 13 bp, D. melanogaster
aaaaagtttcaaa

SEQ ID NO: 542686 - DNA, 13 bp, D. melanogaster
aaaaagtttccat

SEQ ID NO: 542687 - DNA, 13 bp, D. melanogaster
aaaaagtttcgca

SEQ ID NO: 542688 - DNA, 13 bp, D. melanogaster
aaaaagtttcgct

SEQ ID NO: 542689 - DNA, 13 bp, D. melanogaster
aaaaagtttgaag

SEQ ID NO: 542690 - DNA, 13 bp, D. melanogaster
aaaaagtttgcaa

SEQ ID NO: 542691 - DNA, 13 bp, D. melanogaster
aaaaagtttgcca

SEQ ID NO: 542692 - DNA, 13 bp, D. melanogaster
aaaaagtttgcga

SEQ ID NO: 542693 - DNA, 13 bp, D. melanogaster
aaaaagtttggaa

SEQ ID NO: 542694 - DNA, 13 bp, D. melanogaster
aaaaagtttgttg

SEQ ID NO: 542695 - DNA, 13 bp, D. melanogaster
aaaaagttttgaa

SEQ ID NO: 542696 - DNA, 13 bp, D. melanogaster
aaaaagttttgca

SEQ ID NO: 542697 - DNA, 13 bp, D. melanogaster
aaaaagttttgcc

SEQ ID NO: 542698 - DNA, 14 bp, D. melanogaster
aaaaagttttgttt

SEQ ID NO: 542699 - DNA, 14 bp, D. melanogaster
aaaaagttttttgc

SEQ ID NO: 542700 - DNA, 13 bp, D. melanogaster
aaaaataaactgg

SEQ ID NO: 542701 - DNA, 13 bp, D. melanogaster
aaaaataaatcgc

SEQ ID NO: 542702 - DNA, 13 bp, D. melanogaster
aaaaataaatgct

SEQ ID NO: 542703 - DNA, 13 bp, D. melanogaster
aaaaataacattg

SEQ ID NO: 542704 - DNA, 13 bp, D. melanogaster
aaaaataacgtta

SEQ ID NO: 542705 - DNA, 14 bp, D. melanogaster
aaaaataactgttt

SEQ ID NO: 542706 - DNA, 13 bp, D. melanogaster
aaaaataacttga

SEQ ID NO: 542707 - DNA, 13 bp, D. melanogaster
aaaaataagtttc

SEQ ID NO: 542708 - DNA, 14 bp, D. melanogaster
aaaaataataatgc

SEQ ID NO: 542709 - DNA, 14 bp, D. melanogaster
aaaaataatacgta

SEQ ID NO: 542710 - DNA, 13 bp, D. melanogaster
aaaaataatgcat

SEQ ID NO: 542711 - DNA, 14 bp, D. melanogaster
aaaaataatgcatt

SEQ ID NO: 542712 - DNA, 14 bp, D. melanogaster
aaaaataatgccaa

SEQ ID NO: 542713 - DNA, 14 bp, D. melanogaster
aaaaataattaagc

SEQ ID NO: 542714 - DNA, 13 bp, D. melanogaster
aaaaataattggt

SEQ ID NO: 542715 - DNA, 13 bp, D. melanogaster
aaaaatacaagtt

SEQ ID NO: 542716 - DNA, 14 bp, D. melanogaster
aaaaatacaatttg

SEQ ID NO: 542717 - DNA, 13 bp, D. melanogaster
aaaaatacacttt

SEQ ID NO: 542718 - DNA, 13 bp, D. melanogaster
aaaaatacagatt

SEQ ID NO: 542719 - DNA, 13 bp, D. melanogaster
aaaaatacagttt

SEQ ID NO: 542720 - DNA, 13 bp, D. melanogaster
aaaaatacatttg

SEQ ID NO: 542721 - DNA, 13 bp, D. melanogaster
aaaaataccattt

SEQ ID NO: 542722 - DNA, 13 bp, D. melanogaster
aaaaatacgattt

SEQ ID NO: 542723 - DNA, 13 bp, D. melanogaster
aaaaatacgcatt

SEQ ID NO: 542724 - DNA, 13 bp, D. melanogaster
aaaaatacttgtt

SEQ ID NO: 542725 - DNA, 14 bp, D. melanogaster
aaaaatacttgtta

SEQ ID NO: 542726 - DNA, 13 bp, D. melanogaster
aaaaatactttca

SEQ ID NO: 542727 - DNA, 13 bp, D. melanogaster
aaaaatagaattc

SEQ ID NO: 542728 - DNA, 14 bp, D. melanogaster
aaaaatagaattcc

SEQ ID NO: 542729 - DNA, 13 bp, D. melanogaster
aaaaatagagttt

SEQ ID NO: 542730 - DNA, 13 bp, D. melanogaster
aaaaatagcaatt

SEQ ID NO: 542731 - DNA, 13 bp, D. melanogaster
aaaaatagcagca

SEQ ID NO: 542732 - DNA, 13 bp, D. melanogaster
aaaaatagcatca

SEQ ID NO: 542733 - DNA, 13 bp, D. melanogaster
aaaaatagcattt

SEQ ID NO: 542734 - DNA, 13 bp, D. melanogaster
aaaaatagccaag

SEQ ID NO: 542735 - DNA, 13 bp, D. melanogaster
aaaaatagcccca

SEQ ID NO: 542736 - DNA, 13 bp, D. melanogaster
aaaaatagcttaa

SEQ ID NO: 542737 - DNA, 13 bp, D. melanogaster
aaaaatagttttg

SEQ ID NO: 542738 - DNA, 13 bp, D. melanogaster
aaaaatatacagt

SEQ ID NO: 542739 - DNA, 13 bp, D. melanogaster
aaaaatatacctt

SEQ ID NO: 542740 - DNA, 13 bp, D. melanogaster
aaaaatatacgat

SEQ ID NO: 542741 - DNA, 13 bp, D. melanogaster
aaaaatatatagc

SEQ ID NO: 542742 - DNA, 13 bp, D. melanogaster
aaaaatatatctc

SEQ ID NO: 542743 - DNA, 13 bp, D. melanogaster
aaaaatatatgca

SEQ ID NO: 542744 - DNA, 14 bp, D. melanogaster
aaaaatatatgtgt

SEQ ID NO: 542745 - DNA, 13 bp, D. melanogaster
aaaaatatcaagt

SEQ ID NO: 542746 - DNA, 13 bp, D. melanogaster
aaaaatatccact

SEQ ID NO: 542747 - DNA, 13 bp, D. melanogaster
aaaaatatccttt

SEQ ID NO: 542748 - DNA, 13 bp, D. melanogaster
aaaaatatcgata

SEQ ID NO: 542749 - DNA, 13 bp, D. melanogaster
aaaaatatcgcaa

SEQ ID NO: 542750 - DNA, 13 bp, D. melanogaster
aaaaatatcgcta

SEQ ID NO: 542751 - DNA, 14 bp, D. melanogaster
aaaaatatctgaat

SEQ ID NO: 542752 - DNA, 15 bp, D. melanogaster
aaaaatatctgaatg

SEQ ID NO: 542753 - DNA, 13 bp, D. melanogaster
aaaaatatcttgt

SEQ ID NO: 542754 - DNA, 14 bp, D. melanogaster
aaaaatatgcaaat

SEQ ID NO: 542755 - DNA, 13 bp, D. melanogaster
aaaaatatgcatt

SEQ ID NO: 542756 - DNA, 13 bp, D. melanogaster
aaaaatatgccac

SEQ ID NO: 542757 - DNA, 14 bp, D. melanogaster
aaaaatatgctaaa

SEQ ID NO: 542758 - DNA, 13 bp, D. melanogaster
aaaaatatggcaa

SEQ ID NO: 542759 - DNA, 14 bp, D. melanogaster
aaaaatatggcaaa

SEQ ID NO: 542760 - DNA, 13 bp, D. melanogaster
aaaaatatggcca

SEQ ID NO: 542761 - DNA, 13 bp, D. melanogaster
aaaaatatgtact

SEQ ID NO: 542762 - DNA, 14 bp, D. melanogaster
aaaaatatgtcaaa

SEQ ID NO: 542763 - DNA, 13 bp, D. melanogaster
aaaaatatgtgca

SEQ ID NO: 542764 - DNA, 13 bp, D. melanogaster
aaaaatatgttca

SEQ ID NO: 542765 - DNA, 14 bp, D. melanogaster
aaaaatatgttcaa

SEQ ID NO: 542766 - DNA, 13 bp, D. melanogaster
aaaaatattcatg

SEQ ID NO: 542767 - DNA, 13 bp, D. melanogaster
aaaaatattccca

SEQ ID NO: 542768 - DNA, 13 bp, D. melanogaster
aaaaatattcggt

SEQ ID NO: 542769 - DNA, 13 bp, D. melanogaster
aaaaatattcttc

SEQ ID NO: 542770 - DNA, 14 bp, D. melanogaster
aaaaatattgcaaa

SEQ ID NO: 542771 - DNA, 13 bp, D. melanogaster
aaaaatattggca

SEQ ID NO: 542772 - DNA, 14 bp, D. melanogaster
aaaaatattgtcca

SEQ ID NO: 542773 - DNA, 13 bp, D. melanogaster
aaaaatattgtgc

SEQ ID NO: 542774 - DNA, 13 bp, D. melanogaster
aaaaatatttacc

SEQ ID NO: 542775 - DNA, 14 bp, D. melanogaster
aaaaatatttcact

SEQ ID NO: 542776 - DNA, 13 bp, D. melanogaster
aaaaatatttcag

SEQ ID NO: 542777 - DNA, 14 bp, D. melanogaster
aaaaatatttcctt

SEQ ID NO: 542778 - DNA, 14 bp, D. melanogaster
aaaaatatttcgct

SEQ ID NO: 542779 - DNA, 13 bp, D. melanogaster
aaaaatatttgca

SEQ ID NO: 542780 - DNA, 13 bp, D. melanogaster
aaaaatatttgcc

SEQ ID NO: 542781 - DNA, 14 bp, D. melanogaster
aaaaatatttgcca

SEQ ID NO: 542782 - DNA, 13 bp, D. melanogaster
aaaaatatttgtg

SEQ ID NO: 542783 - DNA, 14 bp, D. melanogaster
aaaaatatttgtgt

SEQ ID NO: 542784 - DNA, 14 bp, D. melanogaster
aaaaatcaaagagc

SEQ ID NO: 542785 - DNA, 13 bp, D. melanogaster
aaaaatcaaattg

SEQ ID NO: 542786 - DNA, 13 bp, D. melanogaster
aaaaatcaacagc

SEQ ID NO: 542787 - DNA, 13 bp, D. melanogaster
aaaaatcaacgtt

SEQ ID NO: 542788 - DNA, 13 bp, D. melanogaster
aaaaatcaacttg

SEQ ID NO: 542789 - DNA, 13 bp, D. melanogaster
aaaaatcaagtat

SEQ ID NO: 542790 - DNA, 13 bp, D. melanogaster
aaaaatcaagtca

SEQ ID NO: 542791 - DNA, 13 bp, D. melanogaster
aaaaatcaagttt

SEQ ID NO: 542792 - DNA, 13 bp, D. melanogaster
aaaaatcaattgt

SEQ ID NO: 542793 - DNA, 14 bp, D. melanogaster
aaaaatcaattttg

SEQ ID NO: 542794 - DNA, 13 bp, D. melanogaster
aaaaatcacagca

SEQ ID NO: 542795 - DNA, 13 bp, D. melanogaster
aaaaatcactttt

SEQ ID NO: 542796 - DNA, 13 bp, D. melanogaster
aaaaatcagatat

SEQ ID NO: 542797 - DNA, 13 bp, D. melanogaster
aaaaatcagccaa

SEQ ID NO: 542798 - DNA, 13 bp, D. melanogaster
aaaaatcaggcaa

SEQ ID NO: 542799 - DNA, 13 bp, D. melanogaster
aaaaatcagggaa

SEQ ID NO: 542800 - DNA, 14 bp, D. melanogaster
aaaaatcagggaaa

SEQ ID NO: 542801 - DNA, 13 bp, D. melanogaster
aaaaatcagtttt

SEQ ID NO: 542802 - DNA, 13 bp, D. melanogaster
aaaaatcatagca

SEQ ID NO: 542803 - DNA, 13 bp, D. melanogaster
aaaaatcatatag

SEQ ID NO: 542804 - DNA, 13 bp, D. melanogaster
aaaaatcatgatg

SEQ ID NO: 542805 - DNA, 13 bp, D. melanogaster
aaaaatcatgcaa

SEQ ID NO: 542806 - DNA, 13 bp, D. melanogaster
aaaaatcattcga

SEQ ID NO: 542807 - DNA, 13 bp, D. melanogaster
aaaaatcattgaa

SEQ ID NO: 542808 - DNA, 14 bp, D. melanogaster
aaaaatcattgaaa

SEQ ID NO: 542809 - DNA, 13 bp, D. melanogaster
aaaaatcatttcc

SEQ ID NO: 542810 - DNA, 13 bp, D. melanogaster
aaaaatcatttgg

SEQ ID NO: 542811 - DNA, 13 bp, D. melanogaster
aaaaatcattttc

SEQ ID NO: 542812 - DNA, 13 bp, D. melanogaster
aaaaatcattttg

SEQ ID NO: 542813 - DNA, 13 bp, D. melanogaster
aaaaatccaagtg

SEQ ID NO: 542814 - DNA, 13 bp, D. melanogaster
aaaaatccaagtt

SEQ ID NO: 542815 - DNA, 13 bp, D. melanogaster
aaaaatccagcaa

SEQ ID NO: 542816 - DNA, 13 bp, D. melanogaster
aaaaatccatgaa

SEQ ID NO: 542817 - DNA, 13 bp, D. melanogaster
aaaaatccattca

SEQ ID NO: 542818 - DNA, 13 bp, D. melanogaster
aaaaatccattga

SEQ ID NO: 542819 - DNA, 13 bp, D. melanogaster
aaaaatccattta

SEQ ID NO: 542820 - DNA, 13 bp, D. melanogaster
aaaaatccatttg

SEQ ID NO: 542821 - DNA, 13 bp, D. melanogaster
aaaaatccatttt

SEQ ID NO: 542822 - DNA, 13 bp, D. melanogaster
aaaaatcccagac

SEQ ID NO: 542823 - DNA, 13 bp, D. melanogaster
aaaaatccctcaa

SEQ ID NO: 542824 - DNA, 13 bp, D. melanogaster
aaaaatccgtctg

SEQ ID NO: 542825 - DNA, 13 bp, D. melanogaster
aaaaatccgtttt

SEQ ID NO: 542826 - DNA, 13 bp, D. melanogaster
aaaaatccttttt

SEQ ID NO: 542827 - DNA, 13 bp, D. melanogaster
aaaaatcgaaact

SEQ ID NO: 542828 - DNA, 13 bp, D. melanogaster
aaaaatcgaaagt

SEQ ID NO: 542829 - DNA, 14 bp, D. melanogaster
aaaaatcgaaatcg

SEQ ID NO: 542830 - DNA, 13 bp, D. melanogaster
aaaaatcgaaatg

SEQ ID NO: 542831 - DNA, 13 bp, D. melanogaster
aaaaatcgaaatt

SEQ ID NO: 542832 - DNA, 13 bp, D. melanogaster
aaaaatcgaatgg

SEQ ID NO: 542833 - DNA, 13 bp, D. melanogaster
aaaaatcgaatta

SEQ ID NO: 542834 - DNA, 13 bp, D. melanogaster
aaaaatcgaattt

SEQ ID NO: 542835 - DNA, 14 bp, D. melanogaster
aaaaatcgaatttt

SEQ ID NO: 542836 - DNA, 13 bp, D. melanogaster
aaaaatcgagcaa

SEQ ID NO: 542837 - DNA, 13 bp, D. melanogaster
aaaaatcgatgtt

SEQ ID NO: 542838 - DNA, 13 bp, D. melanogaster
aaaaatcgattga

SEQ ID NO: 542839 - DNA, 14 bp, D. melanogaster
aaaaatcgattgaa

SEQ ID NO: 542840 - DNA, 13 bp, D. melanogaster
aaaaatcgatttc

SEQ ID NO: 542841 - DNA, 13 bp, D. melanogaster
aaaaatcgcaaat

SEQ ID NO: 542842 - DNA, 13 bp, D. melanogaster
aaaaatcgcacaa

SEQ ID NO: 542843 - DNA, 13 bp, D. melanogaster
aaaaatcgcagca

SEQ ID NO: 542844 - DNA, 13 bp, D. melanogaster
aaaaatcgcgaaa

SEQ ID NO: 542845 - DNA, 13 bp, D. melanogaster
aaaaatcgctggc

SEQ ID NO: 542846 - DNA, 13 bp, D. melanogaster
aaaaatcgctttt

SEQ ID NO: 542847 - DNA, 13 bp, D. melanogaster
aaaaatcggaaat

SEQ ID NO: 542848 - DNA, 14 bp, D. melanogaster
aaaaatcgtataaa

SEQ ID NO: 542849 - DNA, 13 bp, D. melanogaster
aaaaatcgtatat

SEQ ID NO: 542850 - DNA, 13 bp, D. melanogaster
aaaaatcgtatta

SEQ ID NO: 542851 - DNA, 14 bp, D. melanogaster
aaaaatcgtggcca

SEQ ID NO: 542852 - DNA, 13 bp, D. melanogaster
aaaaatcgtttga

SEQ ID NO: 542853 - DNA, 13 bp, D. melanogaster
aaaaatcgtttta

SEQ ID NO: 542854 - DNA, 14 bp, D. melanogaster
aaaaatcgttttaa

SEQ ID NO: 542855 - DNA, 13 bp, D. melanogaster
aaaaatctaattg

SEQ ID NO: 542856 - DNA, 13 bp, D. melanogaster
aaaaatctcatta

SEQ ID NO: 542857 - DNA, 13 bp, D. melanogaster
aaaaatctgaaag

SEQ ID NO: 542858 - DNA, 13 bp, D. melanogaster
aaaaatctgactg

SEQ ID NO: 542859 - DNA, 13 bp, D. melanogaster
aaaaatctgattt

SEQ ID NO: 542860 - DNA, 13 bp, D. melanogaster
aaaaatctgcata

SEQ ID NO: 542861 - DNA, 13 bp, D. melanogaster
aaaaatctgctga

SEQ ID NO: 542862 - DNA, 13 bp, D. melanogaster
aaaaatctggaaa

SEQ ID NO: 542863 - DNA, 13 bp, D. melanogaster
aaaaatctgttag

SEQ ID NO: 542864 - DNA, 13 bp, D. melanogaster
aaaaatcttaact

SEQ ID NO: 542865 - DNA, 13 bp, D. melanogaster
aaaaatcttgaaa

SEQ ID NO: 542866 - DNA, 14 bp, D. melanogaster
aaaaatcttgaaaa

SEQ ID NO: 542867 - DNA, 13 bp, D. melanogaster
aaaaatctttcaa

SEQ ID NO: 542868 - DNA, 13 bp, D. melanogaster
aaaaatctttgaa

SEQ ID NO: 542869 - DNA, 14 bp, D. melanogaster
aaaaatctttgaac

SEQ ID NO: 542870 - DNA, 13 bp, D. melanogaster
aaaaatgaaatct

SEQ ID NO: 542871 - DNA, 13 bp, D. melanogaster
aaaaatgaaatgc

SEQ ID NO: 542872 - DNA, 13 bp, D. melanogaster
aaaaatgaaattc

SEQ ID NO: 542873 - DNA, 13 bp, D. melanogaster
aaaaatgaattca

SEQ ID NO: 542874 - DNA, 13 bp, D. melanogaster
aaaaatgaattgt

SEQ ID NO: 542875 - DNA, 14 bp, D. melanogaster
aaaaatgaattttg

SEQ ID NO: 542876 - DNA, 13 bp, D. melanogaster
aaaaatgaccaca

SEQ ID NO: 542877 - DNA, 13 bp, D. melanogaster
aaaaatgacgaag

SEQ ID NO: 542878 - DNA, 13 bp, D. melanogaster
aaaaatgactggt

SEQ ID NO: 542879 - DNA, 13 bp, D. melanogaster
aaaaatgacttta

SEQ ID NO: 542880 - DNA, 14 bp, D. melanogaster
aaaaatgactttat

SEQ ID NO: 542881 - DNA, 13 bp, D. melanogaster
aaaaatgagcaat

SEQ ID NO: 542882 - DNA, 13 bp, D. melanogaster
aaaaatgagcagc

SEQ ID NO: 542883 - DNA, 13 bp, D. melanogaster
aaaaatgaggctg

SEQ ID NO: 542884 - DNA, 13 bp, D. melanogaster
aaaaatgagtcaa

SEQ ID NO: 542885 - DNA, 13 bp, D. melanogaster
aaaaatgagtttt

SEQ ID NO: 542886 - DNA, 13 bp, D. melanogaster
aaaaatgatacag

SEQ ID NO: 542887 - DNA, 13 bp, D. melanogaster
aaaaatgataggg

SEQ ID NO: 542888 - DNA, 13 bp, D. melanogaster
aaaaatgatcata

SEQ ID NO: 542889 - DNA, 13 bp, D. melanogaster
aaaaatgatgatg

SEQ ID NO: 542890 - DNA, 14 bp, D. melanogaster
aaaaatgatgatgt

SEQ ID NO: 542891 - DNA, 13 bp, D. melanogaster
aaaaatgatggca

SEQ ID NO: 542892 - DNA, 14 bp, D. melanogaster
aaaaatgatggcat

SEQ ID NO: 542893 - DNA, 13 bp, D. melanogaster
aaaaatgattgca

SEQ ID NO: 542894 - DNA, 13 bp, D. melanogaster
aaaaatgatttca

SEQ ID NO: 542895 - DNA, 14 bp, D. melanogaster
aaaaatgatttgat

SEQ ID NO: 542896 - DNA, 13 bp, D. melanogaster
aaaaatgattttc

SEQ ID NO: 542897 - DNA, 14 bp, D. melanogaster
aaaaatgcaaaatt

SEQ ID NO: 542898 - DNA, 13 bp, D. melanogaster
aaaaatgcaaatc

SEQ ID NO: 542899 - DNA, 13 bp, D. melanogaster
aaaaatgcaaatg

SEQ ID NO: 542900 - DNA, 13 bp, D. melanogaster
aaaaatgcaaatt

SEQ ID NO: 542901 - DNA, 14 bp, D. melanogaster
aaaaatgcaaattt

SEQ ID NO: 542902 - DNA, 13 bp, D. melanogaster
aaaaatgcaacac

SEQ ID NO: 542903 - DNA, 13 bp, D. melanogaster
aaaaatgcaacag

SEQ ID NO: 542904 - DNA, 13 bp, D. melanogaster
aaaaatgcaaccg

SEQ ID NO: 542905 - DNA, 13 bp, D. melanogaster
aaaaatgcaagca

SEQ ID NO: 542906 - DNA, 13 bp, D. melanogaster
aaaaatgcaatat

SEQ ID NO: 542907 - DNA, 14 bp, D. melanogaster
aaaaatgcaatatt

SEQ ID NO: 542908 - DNA, 13 bp, D. melanogaster
aaaaatgcaatca

SEQ ID NO: 542909 - DNA, 13 bp, D. melanogaster
aaaaatgcaatta

SEQ ID NO: 542910 - DNA, 13 bp, D. melanogaster
aaaaatgcaattt

SEQ ID NO: 542911 - DNA, 13 bp, D. melanogaster
aaaaatgcacagc

SEQ ID NO: 542912 - DNA, 13 bp, D. melanogaster
aaaaatgcaccca

SEQ ID NO: 542913 - DNA, 14 bp, D. melanogaster
aaaaatgcagaaat

SEQ ID NO: 542914 - DNA, 13 bp, D. melanogaster
aaaaatgcagcaa

SEQ ID NO: 542915 - DNA, 14 bp, D. melanogaster
aaaaatgcagcaaa

SEQ ID NO: 542916 - DNA, 13 bp, D. melanogaster
aaaaatgcagcca

SEQ ID NO: 542917 - DNA, 14 bp, D. melanogaster
aaaaatgcagctaa

SEQ ID NO: 542918 - DNA, 13 bp, D. melanogaster
aaaaatgcagtaa

SEQ ID NO: 542919 - DNA, 14 bp, D. melanogaster
aaaaatgcataatt

SEQ ID NO: 542920 - DNA, 13 bp, D. melanogaster
aaaaatgcataca

SEQ ID NO: 542921 - DNA, 13 bp, D. melanogaster
aaaaatgcatact

SEQ ID NO: 542922 - DNA, 13 bp, D. melanogaster
aaaaatgcatgaa

SEQ ID NO: 542923 - DNA, 13 bp, D. melanogaster
aaaaatgcattaa

SEQ ID NO: 542924 - DNA, 14 bp, D. melanogaster
aaaaatgcattaaa

SEQ ID NO: 542925 - DNA, 13 bp, D. melanogaster
aaaaatgcattca

SEQ ID NO: 542926 - DNA, 13 bp, D. melanogaster
aaaaatgcattgt

SEQ ID NO: 542927 - DNA, 14 bp, D. melanogaster
aaaaatgcatttaa

SEQ ID NO: 542928 - DNA, 13 bp, D. melanogaster
aaaaatgcatttt

SEQ ID NO: 542929 - DNA, 14 bp, D. melanogaster
aaaaatgccaaata

SEQ ID NO: 542930 - DNA, 14 bp, D. melanogaster
aaaaatgccaacaa

SEQ ID NO: 542931 - DNA, 13 bp, D. melanogaster
aaaaatgccaatt

SEQ ID NO: 542932 - DNA, 13 bp, D. melanogaster
aaaaatgccacaa

SEQ ID NO: 542933 - DNA, 13 bp, D. melanogaster
aaaaatgccacag

SEQ ID NO: 542934 - DNA, 13 bp, D. melanogaster
aaaaatgccacct

SEQ ID NO: 542935 - DNA, 13 bp, D. melanogaster
aaaaatgccagaa

SEQ ID NO: 542936 - DNA, 13 bp, D. melanogaster
aaaaatgccagag

SEQ ID NO: 542937 - DNA, 13 bp, D. melanogaster
aaaaatgccattt

SEQ ID NO: 542938 - DNA, 13 bp, D. melanogaster
aaaaatgcctttg

SEQ ID NO: 542939 - DNA, 13 bp, D. melanogaster
aaaaatgcgagaa

SEQ ID NO: 542940 - DNA, 13 bp, D. melanogaster
aaaaatgcgagca

SEQ ID NO: 542941 - DNA, 13 bp, D. melanogaster
aaaaatgcgcagc

SEQ ID NO: 542942 - DNA, 13 bp, D. melanogaster
aaaaatgcgcatt

SEQ ID NO: 542943 - DNA, 13 bp, D. melanogaster
aaaaatgcgcttg

SEQ ID NO: 542944 - DNA, 13 bp, D. melanogaster
aaaaatgctaatg

SEQ ID NO: 542945 - DNA, 13 bp, D. melanogaster
aaaaatgctatta

SEQ ID NO: 542946 - DNA, 13 bp, D. melanogaster
aaaaatgctcaaa

SEQ ID NO: 542947 - DNA, 13 bp, D. melanogaster
aaaaatgctgata

SEQ ID NO: 542948 - DNA, 13 bp, D. melanogaster
aaaaatgctgatt

SEQ ID NO: 542949 - DNA, 13 bp, D. melanogaster
aaaaatgctgctg

SEQ ID NO: 542950 - DNA, 13 bp, D. melanogaster
aaaaatgcttaaa

SEQ ID NO: 542951 - DNA, 14 bp, D. melanogaster
aaaaatgcttaaat

SEQ ID NO: 542952 - DNA, 13 bp, D. melanogaster
aaaaatgcttata

SEQ ID NO: 542953 - DNA, 13 bp, D. melanogaster
aaaaatgcttgaa

SEQ ID NO: 542954 - DNA, 13 bp, D. melanogaster
aaaaatgctttaa

SEQ ID NO: 542955 - DNA, 13 bp, D. melanogaster
aaaaatgctttta

SEQ ID NO: 542956 - DNA, 13 bp, D. melanogaster
aaaaatgcttttt

SEQ ID NO: 542957 - DNA, 13 bp, D. melanogaster
aaaaatggaaacg

SEQ ID NO: 542958 - DNA, 14 bp, D. melanogaster
aaaaatggaagaac

SEQ ID NO: 542959 - DNA, 13 bp, D. melanogaster
aaaaatggacaag

SEQ ID NO: 542960 - DNA, 15 bp, D. melanogaster
aaaaatggattcaat

SEQ ID NO: 542961 - DNA, 14 bp, D. melanogaster
aaaaatggatttta

SEQ ID NO: 542962 - DNA, 14 bp, D. melanogaster
aaaaatggcaaaac

SEQ ID NO: 542963 - DNA, 13 bp, D. melanogaster
aaaaatggcaaag

SEQ ID NO: 542964 - DNA, 13 bp, D. melanogaster
aaaaatggcaaat

SEQ ID NO: 542965 - DNA, 14 bp, D. melanogaster
aaaaatggcaacaa

SEQ ID NO: 542966 - DNA, 13 bp, D. melanogaster
aaaaatggcaaga

SEQ ID NO: 542967 - DNA, 13 bp, D. melanogaster
aaaaatggcagaa

SEQ ID NO: 542968 - DNA, 13 bp, D. melanogaster
aaaaatggcataa

SEQ ID NO: 542969 - DNA, 13 bp, D. melanogaster
aaaaatggccaaa

SEQ ID NO: 542970 - DNA, 14 bp, D. melanogaster
aaaaatggccaaaa

SEQ ID NO: 542971 - DNA, 13 bp, D. melanogaster
aaaaatggcgtct

SEQ ID NO: 542972 - DNA, 13 bp, D. melanogaster
aaaaatggctaaa

SEQ ID NO: 542973 - DNA, 13 bp, D. melanogaster
aaaaatggctcaa

SEQ ID NO: 542974 - DNA, 13 bp, D. melanogaster
aaaaatggctttt

SEQ ID NO: 542975 - DNA, 13 bp, D. melanogaster
aaaaatgggattt

SEQ ID NO: 542976 - DNA, 14 bp, D. melanogaster
aaaaatgggcaaaa

SEQ ID NO: 542977 - DNA, 13 bp, D. melanogaster
aaaaatgggtttt

SEQ ID NO: 542978 - DNA, 13 bp, D. melanogaster
aaaaatggtcaaa

SEQ ID NO: 542979 - DNA, 13 bp, D. melanogaster
aaaaatggtcaca

SEQ ID NO: 542980 - DNA, 14 bp, D. melanogaster
aaaaatggtgaaat

SEQ ID NO: 542981 - DNA, 13 bp, D. melanogaster
aaaaatggtgcaa

SEQ ID NO: 542982 - DNA, 13 bp, D. melanogaster
aaaaatggttatt

SEQ ID NO: 542983 - DNA, 13 bp, D. melanogaster
aaaaatggttcaa

SEQ ID NO: 542984 - DNA, 13 bp, D. melanogaster
aaaaatggttttc

SEQ ID NO: 542985 - DNA, 13 bp, D. melanogaster
aaaaatgtaaatc

SEQ ID NO: 542986 - DNA, 13 bp, D. melanogaster
aaaaatgtaatgt

SEQ ID NO: 542987 - DNA, 14 bp, D. melanogaster
aaaaatgtaatttc

SEQ ID NO: 542988 - DNA, 13 bp, D. melanogaster
aaaaatgtacaac

SEQ ID NO: 542989 - DNA, 13 bp, D. melanogaster
aaaaatgtactat

SEQ ID NO: 542990 - DNA, 13 bp, D. melanogaster
aaaaatgtagaca

SEQ ID NO: 542991 - DNA, 13 bp, D. melanogaster
aaaaatgtagtta

SEQ ID NO: 542992 - DNA, 13 bp, D. melanogaster
aaaaatgtataca

SEQ ID NO: 542993 - DNA, 13 bp, D. melanogaster
aaaaatgtatatg

SEQ ID NO: 542994 - DNA, 14 bp, D. melanogaster
aaaaatgtatgcaa

SEQ ID NO: 542995 - DNA, 14 bp, D. melanogaster
aaaaatgtattcat

SEQ ID NO: 542996 - DNA, 13 bp, D. melanogaster
aaaaatgtattga

SEQ ID NO: 542997 - DNA, 13 bp, D. melanogaster
aaaaatgtatttc

SEQ ID NO: 542998 - DNA, 14 bp, D. melanogaster
aaaaatgtcaaaat

SEQ ID NO: 542999 - DNA, 13 bp, D. melanogaster
aaaaatgtcaaag

SEQ ID NO: 543000 - DNA, 13 bp, D. melanogaster
aaaaatgtcaata

SEQ ID NO: 543001 - DNA, 13 bp, D. melanogaster
aaaaatgtcacaa

SEQ ID NO: 543002 - DNA, 14 bp, D. melanogaster
aaaaatgtcacaac

SEQ ID NO: 543003 - DNA, 13 bp, D. melanogaster
aaaaatgtcacac

SEQ ID NO: 543004 - DNA, 13 bp, D. melanogaster
aaaaatgtcactg

SEQ ID NO: 543005 - DNA, 13 bp, D. melanogaster
aaaaatgtcgttt

SEQ ID NO: 543006 - DNA, 14 bp, D. melanogaster
aaaaatgtctaaaa

SEQ ID NO: 543007 - DNA, 13 bp, D. melanogaster
aaaaatgtcttct

SEQ ID NO: 543008 - DNA, 13 bp, D. melanogaster
aaaaatgtctttt

SEQ ID NO: 543009 - DNA, 13 bp, D. melanogaster
aaaaatgtgaatt

SEQ ID NO: 543010 - DNA, 13 bp, D. melanogaster
aaaaatgtgatat

SEQ ID NO: 543011 - DNA, 14 bp, D. melanogaster
aaaaatgtgcaaaa

SEQ ID NO: 543012 - DNA, 13 bp, D. melanogaster
aaaaatgtgcaat

SEQ ID NO: 543013 - DNA, 13 bp, D. melanogaster
aaaaatgtgcaca

SEQ ID NO: 543014 - DNA, 13 bp, D. melanogaster
aaaaatgtgctaa

SEQ ID NO: 543015 - DNA, 13 bp, D. melanogaster
aaaaatgtgggcg

SEQ ID NO: 543016 - DNA, 13 bp, D. melanogaster
aaaaatgtggtcg

SEQ ID NO: 543017 - DNA, 13 bp, D. melanogaster
aaaaatgtggttt

SEQ ID NO: 543018 - DNA, 13 bp, D. melanogaster
aaaaatgtgtaca

SEQ ID NO: 543019 - DNA, 13 bp, D. melanogaster
aaaaatgtgtata

SEQ ID NO: 543020 - DNA, 14 bp, D. melanogaster
aaaaatgtgtattt

SEQ ID NO: 543021 - DNA, 13 bp, D. melanogaster
aaaaatgtgtgaa

SEQ ID NO: 543022 - DNA, 14 bp, D. melanogaster
aaaaatgtgtgaaa

SEQ ID NO: 543023 - DNA, 13 bp, D. melanogaster
aaaaatgtgtgct

SEQ ID NO: 543024 - DNA, 13 bp, D. melanogaster
aaaaatgtgtgta

SEQ ID NO: 543025 - DNA, 13 bp, D. melanogaster
aaaaatgtgtgtt

SEQ ID NO: 543026 - DNA, 13 bp, D. melanogaster
aaaaatgtgttct

SEQ ID NO: 543027 - DNA, 13 bp, D. melanogaster
aaaaatgtgttga

SEQ ID NO: 543028 - DNA, 14 bp, D. melanogaster
aaaaatgtgttgat

SEQ ID NO: 543029 - DNA, 13 bp, D. melanogaster
aaaaatgtgtttt

SEQ ID NO: 543030 - DNA, 13 bp, D. melanogaster
aaaaatgttaatg

SEQ ID NO: 543031 - DNA, 13 bp, D. melanogaster
aaaaatgttacaa

SEQ ID NO: 543032 - DNA, 13 bp, D. melanogaster
aaaaatgttatgt

SEQ ID NO: 543033 - DNA, 13 bp, D. melanogaster
aaaaatgttattg

SEQ ID NO: 543034 - DNA, 13 bp, D. melanogaster
aaaaatgttcaaa

SEQ ID NO: 543035 - DNA, 14 bp, D. melanogaster
aaaaatgttcaaaa

SEQ ID NO: 543036 - DNA, 13 bp, D. melanogaster
aaaaatgttcatt

SEQ ID NO: 543037 - DNA, 13 bp, D. melanogaster
aaaaatgttccaa

SEQ ID NO: 543038 - DNA, 13 bp, D. melanogaster
aaaaatgttcgca

SEQ ID NO: 543039 - DNA, 13 bp, D. melanogaster
aaaaatgttgatt

SEQ ID NO: 543040 - DNA, 13 bp, D. melanogaster
aaaaatgttgcac

SEQ ID NO: 543041 - DNA, 14 bp, D. melanogaster
aaaaatgttgcata

SEQ ID NO: 543042 - DNA, 13 bp, D. melanogaster
aaaaatgttgcca

SEQ ID NO: 543043 - DNA, 14 bp, D. melanogaster
aaaaatgttgccaa

SEQ ID NO: 543044 - DNA, 13 bp, D. melanogaster
aaaaatgttggca

SEQ ID NO: 543045 - DNA, 13 bp, D. melanogaster
aaaaatgttgggc

SEQ ID NO: 543046 - DNA, 13 bp, D. melanogaster
aaaaatgttgtaa

SEQ ID NO: 543047 - DNA, 13 bp, D. melanogaster
aaaaatgttgtat

SEQ ID NO: 543048 - DNA, 14 bp, D. melanogaster
aaaaatgttgttaa

SEQ ID NO: 543049 - DNA, 13 bp, D. melanogaster
aaaaatgtttaag

SEQ ID NO: 543050 - DNA, 13 bp, D. melanogaster
aaaaatgtttaca

SEQ ID NO: 543051 - DNA, 13 bp, D. melanogaster
aaaaatgtttact

SEQ ID NO: 543052 - DNA, 13 bp, D. melanogaster
aaaaatgtttatg

SEQ ID NO: 543053 - DNA, 14 bp, D. melanogaster
aaaaatgtttattg

SEQ ID NO: 543054 - DNA, 13 bp, D. melanogaster
aaaaatgtttcat

SEQ ID NO: 543055 - DNA, 14 bp, D. melanogaster
aaaaatgtttcatt

SEQ ID NO: 543056 - DNA, 13 bp, D. melanogaster
aaaaatgtttcca

SEQ ID NO: 543057 - DNA, 14 bp, D. melanogaster
aaaaatgtttgaat

SEQ ID NO: 543058 - DNA, 13 bp, D. melanogaster
aaaaatgtttgca

SEQ ID NO: 543059 - DNA, 14 bp, D. melanogaster
aaaaatgtttgcat

SEQ ID NO: 543060 - DNA, 14 bp, D. melanogaster
aaaaatgtttgcca

SEQ ID NO: 543061 - DNA, 13 bp, D. melanogaster
aaaaatgtttgct

SEQ ID NO: 543062 - DNA, 13 bp, D. melanogaster
aaaaatgtttggg

SEQ ID NO: 543063 - DNA, 13 bp, D. melanogaster
aaaaatgtttgta

SEQ ID NO: 543064 - DNA, 14 bp, D. melanogaster
aaaaatgtttgtat

SEQ ID NO: 543065 - DNA, 13 bp, D. melanogaster
aaaaatgtttgtt

SEQ ID NO: 543066 - DNA, 14 bp, D. melanogaster
aaaaatgtttgttg

SEQ ID NO: 543067 - DNA, 14 bp, D. melanogaster
aaaaatgtttgttt

SEQ ID NO: 543068 - DNA, 14 bp, D. melanogaster
aaaaatgttttaag

SEQ ID NO: 543069 - DNA, 14 bp, D. melanogaster
aaaaatgttttcaa

SEQ ID NO: 543070 - DNA, 14 bp, D. melanogaster
aaaaatgttttcct

SEQ ID NO: 543071 - DNA, 14 bp, D. melanogaster
aaaaatgttttgat

SEQ ID NO: 543072 - DNA, 14 bp, D. melanogaster
aaaaatgttttgca

SEQ ID NO: 543073 - DNA, 14 bp, D. melanogaster
aaaaatgttttgtt

SEQ ID NO: 543074 - DNA, 13 bp, D. melanogaster
aaaaattaacagc

SEQ ID NO: 543075 - DNA, 13 bp, D. melanogaster
aaaaattaacatg

SEQ ID NO: 543076 - DNA, 13 bp, D. melanogaster
aaaaattaacttg

SEQ ID NO: 543077 - DNA, 13 bp, D. melanogaster
aaaaattaagcga

SEQ ID NO: 543078 - DNA, 13 bp, D. melanogaster
aaaaattaccatt

SEQ ID NO: 543079 - DNA, 13 bp, D. melanogaster
aaaaattactcat

SEQ ID NO: 543080 - DNA, 13 bp, D. melanogaster
aaaaattagcaat

SEQ ID NO: 543081 - DNA, 13 bp, D. melanogaster
aaaaattagcaca

SEQ ID NO: 543082 - DNA, 13 bp, D. melanogaster
aaaaattagcatt

SEQ ID NO: 543083 - DNA, 13 bp, D. melanogaster
aaaaattatacag

SEQ ID NO: 543084 - DNA, 13 bp, D. melanogaster
aaaaattatcagt

SEQ ID NO: 543085 - DNA, 13 bp, D. melanogaster
aaaaattatgcaa

SEQ ID NO: 543086 - DNA, 13 bp, D. melanogaster
aaaaattatgcat

SEQ ID NO: 543087 - DNA, 14 bp, D. melanogaster
aaaaattattagct

SEQ ID NO: 543088 - DNA, 13 bp, D. melanogaster
aaaaattattggg

SEQ ID NO: 543089 - DNA, 13 bp, D. melanogaster
aaaaattcaatgg

SEQ ID NO: 543090 - DNA, 13 bp, D. melanogaster
aaaaattcactta

SEQ ID NO: 543091 - DNA, 13 bp, D. melanogaster
aaaaattcagcaa

SEQ ID NO: 543092 - DNA, 13 bp, D. melanogaster
aaaaattcagtta

SEQ ID NO: 543093 - DNA, 13 bp, D. melanogaster
aaaaattcatcca

SEQ ID NO: 543094 - DNA, 13 bp, D. melanogaster
aaaaattccaatt

SEQ ID NO: 543095 - DNA, 14 bp, D. melanogaster
aaaaattccaattt

SEQ ID NO: 543096 - DNA, 13 bp, D. melanogaster
aaaaattccatta

SEQ ID NO: 543097 - DNA, 13 bp, D. melanogaster
aaaaattcccttt

SEQ ID NO: 543098 - DNA, 13 bp, D. melanogaster
aaaaattccgttt

SEQ ID NO: 543099 - DNA, 13 bp, D. melanogaster
aaaaattcgaata

SEQ ID NO: 543100 - DNA, 13 bp, D. melanogaster
aaaaattcgaatt

SEQ ID NO: 543101 - DNA, 13 bp, D. melanogaster
aaaaattcgatta

SEQ ID NO: 543102 - DNA, 13 bp, D. melanogaster
aaaaattcgattt

SEQ ID NO: 543103 - DNA, 14 bp, D. melanogaster
aaaaattcgatttt

SEQ ID NO: 543104 - DNA, 13 bp, D. melanogaster
aaaaattcgcaaa

SEQ ID NO: 543105 - DNA, 14 bp, D. melanogaster
aaaaattcgcaaaa

SEQ ID NO: 543106 - DNA, 13 bp, D. melanogaster
aaaaattcggaaa

SEQ ID NO: 543107 - DNA, 13 bp, D. melanogaster
aaaaattcgtata

SEQ ID NO: 543108 - DNA, 14 bp, D. melanogaster
aaaaattcgtataa

SEQ ID NO: 543109 - DNA, 15 bp, D. melanogaster
aaaaattcgttgaaa

SEQ ID NO: 543110 - DNA, 13 bp, D. melanogaster
aaaaattctacag

SEQ ID NO: 543111 - DNA, 13 bp, D. melanogaster
aaaaattctacat

SEQ ID NO: 543112 - DNA, 13 bp, D. melanogaster
aaaaattctctac

SEQ ID NO: 543113 - DNA, 13 bp, D. melanogaster
aaaaattctgttt

SEQ ID NO: 543114 - DNA, 13 bp, D. melanogaster
aaaaattctttgg

SEQ ID NO: 543115 - DNA, 14 bp, D. melanogaster
aaaaattgaaaact

SEQ ID NO: 543116 - DNA, 13 bp, D. melanogaster
aaaaattgaaagc

SEQ ID NO: 543117 - DNA, 13 bp, D. melanogaster
aaaaattgaagtg

SEQ ID NO: 543118 - DNA, 13 bp, D. melanogaster
aaaaattgaatgc

SEQ ID NO: 543119 - DNA, 14 bp, D. melanogaster
aaaaattgagcaaa

SEQ ID NO: 543120 - DNA, 13 bp, D. melanogaster
aaaaattgatcaa

SEQ ID NO: 543121 - DNA, 13 bp, D. melanogaster
aaaaattgcaaat

SEQ ID NO: 543122 - DNA, 13 bp, D. melanogaster
aaaaattgcaaca

SEQ ID NO: 543123 - DNA, 13 bp, D. melanogaster
aaaaattgcactt

SEQ ID NO: 543124 - DNA, 13 bp, D. melanogaster
aaaaattgcagtt

SEQ ID NO: 543125 - DNA, 13 bp, D. melanogaster
aaaaattgcataa

SEQ ID NO: 543126 - DNA, 13 bp, D. melanogaster
aaaaattgccaca

SEQ ID NO: 543127 - DNA, 13 bp, D. melanogaster
aaaaattgcgaaa

SEQ ID NO: 543128 - DNA, 14 bp, D. melanogaster
aaaaattgcgaaaa

SEQ ID NO: 543129 - DNA, 19 bp, D. melanogaster
aaaaattgcgtttaattaa

SEQ ID NO: 543130 - DNA, 13 bp, D. melanogaster
aaaaattgctaaa

SEQ ID NO: 543131 - DNA, 13 bp, D. melanogaster
aaaaattgctgaa

SEQ ID NO: 543132 - DNA, 13 bp, D. melanogaster
aaaaattgctgct

SEQ ID NO: 543133 - DNA, 14 bp, D. melanogaster
aaaaattgcttaaa

SEQ ID NO: 543134 - DNA, 13 bp, D. melanogaster
aaaaattgctttt

SEQ ID NO: 543135 - DNA, 13 bp, D. melanogaster
aaaaattggaatt

SEQ ID NO: 543136 - DNA, 13 bp, D. melanogaster
aaaaattggcaaa

SEQ ID NO: 543137 - DNA, 14 bp, D. melanogaster
aaaaattggcaaaa

SEQ ID NO: 543138 - DNA, 13 bp, D. melanogaster
aaaaattggcatt

SEQ ID NO: 543139 - DNA, 14 bp, D. melanogaster
aaaaattggccaaa

SEQ ID NO: 543140 - DNA, 13 bp, D. melanogaster
aaaaattggctgc

SEQ ID NO: 543141 - DNA, 13 bp, D. melanogaster
aaaaattggtttt

SEQ ID NO: 543142 - DNA, 14 bp, D. melanogaster
aaaaattgtaaaac

SEQ ID NO: 543143 - DNA, 13 bp, D. melanogaster
aaaaattgtacaa

SEQ ID NO: 543144 - DNA, 14 bp, D. melanogaster
aaaaattgtacaat

SEQ ID NO: 543145 - DNA, 13 bp, D. melanogaster
aaaaattgtatgt

SEQ ID NO: 543146 - DNA, 13 bp, D. melanogaster
aaaaattgtattc

SEQ ID NO: 543147 - DNA, 13 bp, D. melanogaster
aaaaattgtcaaa

SEQ ID NO: 543148 - DNA, 13 bp, D. melanogaster
aaaaattgtcaac

SEQ ID NO: 543149 - DNA, 13 bp, D. melanogaster
aaaaattgtcata

SEQ ID NO: 543150 - DNA, 13 bp, D. melanogaster
aaaaattgtgcaa

SEQ ID NO: 543151 - DNA, 14 bp, D. melanogaster
aaaaattgtggaaa

SEQ ID NO: 543152 - DNA, 13 bp, D. melanogaster
aaaaattgtgtgc

SEQ ID NO: 543153 - DNA, 13 bp, D. melanogaster
aaaaattgtgttt

SEQ ID NO: 543154 - DNA, 14 bp, D. melanogaster
aaaaattgttcaaa

SEQ ID NO: 543155 - DNA, 13 bp, D. melanogaster
aaaaattgttgca

SEQ ID NO: 543156 - DNA, 13 bp, D. melanogaster
aaaaattgttgga

SEQ ID NO: 543157 - DNA, 14 bp, D. melanogaster
aaaaattgttggat

SEQ ID NO: 543158 - DNA, 13 bp, D. melanogaster
aaaaattgttgtg

SEQ ID NO: 543159 - DNA, 13 bp, D. melanogaster
aaaaattgtttac

SEQ ID NO: 543160 - DNA, 13 bp, D. melanogaster
aaaaattgtttct

SEQ ID NO: 543161 - DNA, 13 bp, D. melanogaster
aaaaattgtttgt

SEQ ID NO: 543162 - DNA, 14 bp, D. melanogaster
aaaaattgtttttc

SEQ ID NO: 543163 - DNA, 14 bp, D. melanogaster
aaaaatttaagcca

SEQ ID NO: 543164 - DNA, 13 bp, D. melanogaster
aaaaatttacaag

SEQ ID NO: 543165 - DNA, 13 bp, D. melanogaster
aaaaatttatgca

SEQ ID NO: 543166 - DNA, 13 bp, D. melanogaster
aaaaatttcacca

SEQ ID NO: 543167 - DNA, 13 bp, D. melanogaster
aaaaatttcactt

SEQ ID NO: 543168 - DNA, 13 bp, D. melanogaster
aaaaatttcccaa

SEQ ID NO: 543169 - DNA, 13 bp, D. melanogaster
aaaaatttcgaaa

SEQ ID NO: 543170 - DNA, 13 bp, D. melanogaster
aaaaatttcgttt

SEQ ID NO: 543171 - DNA, 13 bp, D. melanogaster
aaaaatttgacaa

SEQ ID NO: 543172 - DNA, 14 bp, D. melanogaster
aaaaatttgacaaa

SEQ ID NO: 543173 - DNA, 13 bp, D. melanogaster
aaaaatttgagca

SEQ ID NO: 543174 - DNA, 13 bp, D. melanogaster
aaaaatttgagtt

SEQ ID NO: 543175 - DNA, 14 bp, D. melanogaster
aaaaatttgagttt

SEQ ID NO: 543176 - DNA, 13 bp, D. melanogaster
aaaaatttgcaat

SEQ ID NO: 543177 - DNA, 13 bp, D. melanogaster
aaaaatttgcaca

SEQ ID NO: 543178 - DNA, 13 bp, D. melanogaster
aaaaatttgcata

SEQ ID NO: 543179 - DNA, 13 bp, D. melanogaster
aaaaatttgcatt

SEQ ID NO: 543180 - DNA, 13 bp, D. melanogaster
aaaaatttgccaa

SEQ ID NO: 543181 - DNA, 13 bp, D. melanogaster
aaaaatttgccat

SEQ ID NO: 543182 - DNA, 13 bp, D. melanogaster
aaaaatttgccta

SEQ ID NO: 543183 - DNA, 13 bp, D. melanogaster
aaaaatttgcgaa

SEQ ID NO: 543184 - DNA, 14 bp, D. melanogaster
aaaaatttgcgaaa

SEQ ID NO: 543185 - DNA, 13 bp, D. melanogaster
aaaaatttgctgc

SEQ ID NO: 543186 - DNA, 13 bp, D. melanogaster
aaaaatttgcttt

SEQ ID NO: 543187 - DNA, 14 bp, D. melanogaster
aaaaatttgcttta

SEQ ID NO: 543188 - DNA, 13 bp, D. melanogaster
aaaaatttggcat

SEQ ID NO: 543189 - DNA, 14 bp, D. melanogaster
aaaaatttggcatc

SEQ ID NO: 543190 - DNA, 13 bp, D. melanogaster
aaaaatttgtagt

SEQ ID NO: 543191 - DNA, 14 bp, D. melanogaster
aaaaatttgtagta

SEQ ID NO: 543192 - DNA, 13 bp, D. melanogaster
aaaaatttgtatg

SEQ ID NO: 543193 - DNA, 13 bp, D. melanogaster
aaaaatttgttca

SEQ ID NO: 543194 - DNA, 13 bp, D. melanogaster
aaaaatttgtttg

SEQ ID NO: 543195 - DNA, 14 bp, D. melanogaster
aaaaatttgtttgc

SEQ ID NO: 543196 - DNA, 14 bp, D. melanogaster
aaaaatttgttttg

SEQ ID NO: 543197 - DNA, 13 bp, D. melanogaster
aaaaattttccca

SEQ ID NO: 543198 - DNA, 14 bp, D. melanogaster
aaaacaaaaacttg

SEQ ID NO: 543199 - DNA, 13 bp, D. melanogaster
aaaacaaaacgtc

SEQ ID NO: 543200 - DNA, 13 bp, D. melanogaster
aaaacaaaacgtg

SEQ ID NO: 543201 - DNA, 13 bp, D. melanogaster
aaaacaaaactgt

SEQ ID NO: 543202 - DNA, 13 bp, D. melanogaster
aaaacaaaagctg

SEQ ID NO: 543203 - DNA, 14 bp, D. melanogaster
aaaacaaaagctta

SEQ ID NO: 543204 - DNA, 13 bp, D. melanogaster
aaaacaaaagtcg

SEQ ID NO: 543205 - DNA, 13 bp, D. melanogaster
aaaacaaaagttt

SEQ ID NO: 543206 - DNA, 13 bp, D. melanogaster
aaaacaaaatgct

SEQ ID NO: 543207 - DNA, 13 bp, D. melanogaster
aaaacaaaattgt

SEQ ID NO: 543208 - DNA, 14 bp, D. melanogaster
aaaacaaacaagtg

SEQ ID NO: 543209 - DNA, 14 bp, D. melanogaster
aaaacaaacatctg

SEQ ID NO: 543210 - DNA, 13 bp, D. melanogaster
aaaacaaacattg

SEQ ID NO: 543211 - DNA, 13 bp, D. melanogaster
aaaacaaacgttt

SEQ ID NO: 543212 - DNA, 13 bp, D. melanogaster
aaaacaaactgca

SEQ ID NO: 543213 - DNA, 14 bp, D. melanogaster
aaaacaaactgcaa

SEQ ID NO: 543214 - DNA, 13 bp, D. melanogaster
aaaacaaactgga

SEQ ID NO: 543215 - DNA, 13 bp, D. melanogaster
aaaacaaactggc

SEQ ID NO: 543216 - DNA, 14 bp, D. melanogaster
aaaacaaactggct

SEQ ID NO: 543217 - DNA, 13 bp, D. melanogaster
aaaacaaacttgc

SEQ ID NO: 543218 - DNA, 13 bp, D. melanogaster
aaaacaaactttt

SEQ ID NO: 543219 - DNA, 14 bp, D. melanogaster
aaaacaaagcaatt

SEQ ID NO: 543220 - DNA, 13 bp, D. melanogaster
aaaacaaagccat

SEQ ID NO: 543221 - DNA, 13 bp, D. melanogaster
aaaacaaagtgca

SEQ ID NO: 543222 - DNA, 13 bp, D. melanogaster
aaaacaaagtgtt

SEQ ID NO: 543223 - DNA, 13 bp, D. melanogaster
aaaacaaagttta

SEQ ID NO: 543224 - DNA, 13 bp, D. melanogaster
aaaacaaagtttg

SEQ ID NO: 543225 - DNA, 14 bp, D. melanogaster
aaaacaaataattg

SEQ ID NO: 543226 - DNA, 14 bp, D. melanogaster
aaaacaaatatgta

SEQ ID NO: 543227 - DNA, 13 bp, D. melanogaster
aaaacaaatattg

SEQ ID NO: 543228 - DNA, 14 bp, D. melanogaster
aaaacaaatcgaat

SEQ ID NO: 543229 - DNA, 13 bp, D. melanogaster
aaaacaaatcgca

SEQ ID NO: 543230 - DNA, 13 bp, D. melanogaster
aaaacaaatgcat

SEQ ID NO: 543231 - DNA, 13 bp, D. melanogaster
aaaacaaatgcca

SEQ ID NO: 543232 - DNA, 13 bp, D. melanogaster
aaaacaaatgtca

SEQ ID NO: 543233 - DNA, 13 bp, D. melanogaster
aaaacaaatgtga

SEQ ID NO: 543234 - DNA, 13 bp, D. melanogaster
aaaacaaatgtgt

SEQ ID NO: 543235 - DNA, 14 bp, D. melanogaster
aaaacaaatgtttt

SEQ ID NO: 543236 - DNA, 13 bp, D. melanogaster
aaaacaaattacg

SEQ ID NO: 543237 - DNA, 13 bp, D. melanogaster
aaaacaaattcct

SEQ ID NO: 543238 - DNA, 13 bp, D. melanogaster
aaaacaaattgat

SEQ ID NO: 543239 - DNA, 13 bp, D. melanogaster
aaaacaaattgcg

SEQ ID NO: 543240 - DNA, 13 bp, D. melanogaster
aaaacaaattgta

SEQ ID NO: 543241 - DNA, 13 bp, D. melanogaster
aaaacaaattgtg

SEQ ID NO: 543242 - DNA, 14 bp, D. melanogaster
aaaacaaatttatg

SEQ ID NO: 543243 - DNA, 14 bp, D. melanogaster
aaaacaaatttcca

SEQ ID NO: 543244 - DNA, 13 bp, D. melanogaster
aaaacaaatttga

SEQ ID NO: 543245 - DNA, 14 bp, D. melanogaster
aaaacaaatttgtt

SEQ ID NO: 543246 - DNA, 13 bp, D. melanogaster
aaaacaaattttc

SEQ ID NO: 543247 - DNA, 13 bp, D. melanogaster
aaaacaaattttg

SEQ ID NO: 543248 - DNA, 14 bp, D. melanogaster
aaaacaacaactgc

SEQ ID NO: 543249 - DNA, 13 bp, D. melanogaster
aaaacaacaagct

SEQ ID NO: 543250 - DNA, 13 bp, D. melanogaster
aaaacaacacttt

SEQ ID NO: 543251 - DNA, 13 bp, D. melanogaster
aaaacaacagatg

SEQ ID NO: 543252 - DNA, 13 bp, D. melanogaster
aaaacaacatttg

SEQ ID NO: 543253 - DNA, 13 bp, D. melanogaster
aaaacaacatttt

SEQ ID NO: 543254 - DNA, 13 bp, D. melanogaster
aaaacaaccattt

SEQ ID NO: 543255 - DNA, 13 bp, D. melanogaster
aaaacaaccgatt

SEQ ID NO: 543256 - DNA, 13 bp, D. melanogaster
aaaacaacgaatt

SEQ ID NO: 543257 - DNA, 13 bp, D. melanogaster
aaaacaactattt

SEQ ID NO: 543258 - DNA, 13 bp, D. melanogaster
aaaacaactgcaa

SEQ ID NO: 543259 - DNA, 14 bp, D. melanogaster
aaaacaactgcaaa

SEQ ID NO: 543260 - DNA, 13 bp, D. melanogaster
aaaacaactggaa

SEQ ID NO: 543261 - DNA, 13 bp, D. melanogaster
aaaacaacttgaa

SEQ ID NO: 543262 - DNA, 13 bp, D. melanogaster
aaaacaacttttg

SEQ ID NO: 543263 - DNA, 13 bp, D. melanogaster
aaaacaagaattt

SEQ ID NO: 543264 - DNA, 13 bp, D. melanogaster
aaaacaagcaatt

SEQ ID NO: 543265 - DNA, 13 bp, D. melanogaster
aaaacaagcacct

SEQ ID NO: 543266 - DNA, 13 bp, D. melanogaster
aaaacaagcattt

SEQ ID NO: 543267 - DNA, 13 bp, D. melanogaster
aaaacaagcgaat

SEQ ID NO: 543268 - DNA, 13 bp, D. melanogaster
aaaacaagctaga

SEQ ID NO: 543269 - DNA, 13 bp, D. melanogaster
aaaacaagctgaa

SEQ ID NO: 543270 - DNA, 13 bp, D. melanogaster
aaaacaagtcatg

SEQ ID NO: 543271 - DNA, 13 bp, D. melanogaster
aaaacaagtggcg

SEQ ID NO: 543272 - DNA, 13 bp, D. melanogaster
aaaacaagttcaa

SEQ ID NO: 543273 - DNA, 14 bp, D. melanogaster
aaaacaagttcaaa

SEQ ID NO: 543274 - DNA, 13 bp, D. melanogaster
aaaacaagttgaa

SEQ ID NO: 543275 - DNA, 13 bp, D. melanogaster
aaaacaagttggc

SEQ ID NO: 543276 - DNA, 13 bp, D. melanogaster
aaaacaagtttaa

SEQ ID NO: 543277 - DNA, 13 bp, D. melanogaster
aaaacaagttttt

SEQ ID NO: 543278 - DNA, 14 bp, D. melanogaster
aaaacaataaattg

SEQ ID NO: 543279 - DNA, 13 bp, D. melanogaster
aaaacaataatgt

SEQ ID NO: 543280 - DNA, 13 bp, D. melanogaster
aaaacaatatgca

SEQ ID NO: 543281 - DNA, 13 bp, D. melanogaster
aaaacaatatgtt

SEQ ID NO: 543282 - DNA, 14 bp, D. melanogaster
aaaacaatatttgt

SEQ ID NO: 543283 - DNA, 13 bp, D. melanogaster
aaaacaatcagca

SEQ ID NO: 543284 - DNA, 13 bp, D. melanogaster
aaaacaatcattt

SEQ ID NO: 543285 - DNA, 13 bp, D. melanogaster
aaaacaatccatc

SEQ ID NO: 543286 - DNA, 13 bp, D. melanogaster
aaaacaatcgcag

SEQ ID NO: 543287 - DNA, 14 bp, D. melanogaster
aaaacaatgaaatg

SEQ ID NO: 543288 - DNA, 14 bp, D. melanogaster
aaaacaatgaaatt

SEQ ID NO: 543289 - DNA, 13 bp, D. melanogaster
aaaacaatgagca

SEQ ID NO: 543290 - DNA, 14 bp, D. melanogaster
aaaacaatgcaaat

SEQ ID NO: 543291 - DNA, 13 bp, D. melanogaster
aaaacaatgcaat

SEQ ID NO: 543292 - DNA, 13 bp, D. melanogaster
aaaacaatgccaa

SEQ ID NO: 543293 - DNA, 13 bp, D. melanogaster
aaaacaatgcttt

SEQ ID NO: 543294 - DNA, 13 bp, D. melanogaster
aaaacaatggcag

SEQ ID NO: 543295 - DNA, 13 bp, D. melanogaster
aaaacaatgtcaa

SEQ ID NO: 543296 - DNA, 13 bp, D. melanogaster
aaaacaatgttaa

SEQ ID NO: 543297 - DNA, 13 bp, D. melanogaster
aaaacaatgtttt

SEQ ID NO: 543298 - DNA, 13 bp, D. melanogaster
aaaacaattaagc

SEQ ID NO: 543299 - DNA, 13 bp, D. melanogaster
aaaacaattacag

SEQ ID NO: 543300 - DNA, 13 bp, D. melanogaster
aaaacaattagca

SEQ ID NO: 543301 - DNA, 13 bp, D. melanogaster
aaaacaattatgt

SEQ ID NO: 543302 - DNA, 13 bp, D. melanogaster
aaaacaattgcaa

SEQ ID NO: 543303 - DNA, 14 bp, D. melanogaster
aaaacaattgcaaa

SEQ ID NO: 543304 - DNA, 13 bp, D. melanogaster
aaaacaattgcat

SEQ ID NO: 543305 - DNA, 14 bp, D. melanogaster
aaaacaattgcatt

SEQ ID NO: 543306 - DNA, 14 bp, D. melanogaster
aaaacaattggaaa

SEQ ID NO: 543307 - DNA, 13 bp, D. melanogaster
aaaacaattgtca

SEQ ID NO: 543308 - DNA, 13 bp, D. melanogaster
aaaacaattgtta

SEQ ID NO: 543309 - DNA, 13 bp, D. melanogaster
aaaacaattgttt

SEQ ID NO: 543310 - DNA, 14 bp, D. melanogaster
aaaacaattgtttt

SEQ ID NO: 543311 - DNA, 13 bp, D. melanogaster
aaaacaatttcat

SEQ ID NO: 543312 - DNA, 13 bp, D. melanogaster
aaaacaatttcca

SEQ ID NO: 543313 - DNA, 13 bp, D. melanogaster
aaaacaatttctg

SEQ ID NO: 543314 - DNA, 14 bp, D. melanogaster
aaaacaatttgaat

SEQ ID NO: 543315 - DNA, 13 bp, D. melanogaster
aaaacaatttgat

SEQ ID NO: 543316 - DNA, 13 bp, D. melanogaster
aaaacaatttgca

SEQ ID NO: 543317 - DNA, 14 bp, D. melanogaster
aaaacaatttgcaa

SEQ ID NO: 543318 - DNA, 13 bp, D. melanogaster
aaaacaatttgcc

SEQ ID NO: 543319 - DNA, 13 bp, D. melanogaster
aaaacaatttgtt

SEQ ID NO: 543320 - DNA, 13 bp, D. melanogaster
aaaacaattttca

SEQ ID NO: 543321 - DNA, 13 bp, D. melanogaster
aaaacaattttgt

SEQ ID NO: 543322 - DNA, 14 bp, D. melanogaster
aaaacaattttgtt

SEQ ID NO: 543323 - DNA, 13 bp, D. melanogaster
aaaacacaaatcg

SEQ ID NO: 543324 - DNA, 13 bp, D. melanogaster
aaaacacacagat

SEQ ID NO: 543325 - DNA, 13 bp, D. melanogaster
aaaacacacattt

SEQ ID NO: 543326 - DNA, 14 bp, D. melanogaster
aaaacacacatttt

SEQ ID NO: 543327 - DNA, 13 bp, D. melanogaster
aaaacacactttt

SEQ ID NO: 543328 - DNA, 13 bp, D. melanogaster
aaaacacatatgt

SEQ ID NO: 543329 - DNA, 13 bp, D. melanogaster
aaaacacatgcaa

SEQ ID NO: 543330 - DNA, 13 bp, D. melanogaster
aaaacacattatt

SEQ ID NO: 543331 - DNA, 14 bp, D. melanogaster
aaaacacattattg

SEQ ID NO: 543332 - DNA, 13 bp, D. melanogaster
aaaacacatttcc

SEQ ID NO: 543333 - DNA, 13 bp, D. melanogaster
aaaacaccaaatg

SEQ ID NO: 543334 - DNA, 13 bp, D. melanogaster
aaaacaccgaaat

SEQ ID NO: 543335 - DNA, 13 bp, D. melanogaster
aaaacaccttttt

SEQ ID NO: 543336 - DNA, 13 bp, D. melanogaster
aaaacacgaaatg

SEQ ID NO: 543337 - DNA, 13 bp, D. melanogaster
aaaacacgatcaa

SEQ ID NO: 543338 - DNA, 13 bp, D. melanogaster
aaaacactaatgt

SEQ ID NO: 543339 - DNA, 13 bp, D. melanogaster
aaaacactatttt

SEQ ID NO: 543340 - DNA, 13 bp, D. melanogaster
aaaacactcgaaa

SEQ ID NO: 543341 - DNA, 13 bp, D. melanogaster
aaaacactggcaa

SEQ ID NO: 543342 - DNA, 13 bp, D. melanogaster
aaaacactgggaa

SEQ ID NO: 543343 - DNA, 13 bp, D. melanogaster
aaaacacttaatt

SEQ ID NO: 543344 - DNA, 14 bp, D. melanogaster
aaaacacttgaaaa

SEQ ID NO: 543345 - DNA, 13 bp, D. melanogaster
aaaacacttgaca

SEQ ID NO: 543346 - DNA, 13 bp, D. melanogaster
aaaacacttgcaa

SEQ ID NO: 543347 - DNA, 13 bp, D. melanogaster
aaaacactttatt

SEQ ID NO: 543348 - DNA, 13 bp, D. melanogaster
aaaacactttccc

SEQ ID NO: 543349 - DNA, 13 bp, D. melanogaster
aaaacactttggc

SEQ ID NO: 543350 - DNA, 13 bp, D. melanogaster
aaaacacttttta

SEQ ID NO: 543351 - DNA, 14 bp, D. melanogaster
aaaacactttttaa

SEQ ID NO: 543352 - DNA, 13 bp, D. melanogaster
aaaacactttttg

SEQ ID NO: 543353 - DNA, 13 bp, D. melanogaster
aaaacagaaatgt

SEQ ID NO: 543354 - DNA, 14 bp, D. melanogaster
aaaacagaaattat

SEQ ID NO: 543355 - DNA, 13 bp, D. melanogaster
aaaacagatcaac

SEQ ID NO: 543356 - DNA, 14 bp, D. melanogaster
aaaacagcaacaat

SEQ ID NO: 543357 - DNA, 13 bp, D. melanogaster
aaaacagcagcca

SEQ ID NO: 543358 - DNA, 13 bp, D. melanogaster
aaaacagcagcga

SEQ ID NO: 543359 - DNA, 13 bp, D. melanogaster
aaaacagcaggca

SEQ ID NO: 543360 - DNA, 13 bp, D. melanogaster
aaaacagctgata

SEQ ID NO: 543361 - DNA, 13 bp, D. melanogaster
aaaacagctgttg

SEQ ID NO: 543362 - DNA, 13 bp, D. melanogaster
aaaacagctttat

SEQ ID NO: 543363 - DNA, 14 bp, D. melanogaster
aaaacagctttata

SEQ ID NO: 543364 - DNA, 13 bp, D. melanogaster
aaaacaggaaatg

SEQ ID NO: 543365 - DNA, 14 bp, D. melanogaster
aaaacaggaagtaa

SEQ ID NO: 543366 - DNA, 13 bp, D. melanogaster
aaaacaggcgtaa

SEQ ID NO: 543367 - DNA, 14 bp, D. melanogaster
aaaacagtactgga

SEQ ID NO: 543368 - DNA, 13 bp, D. melanogaster
aaaacagtattta

SEQ ID NO: 543369 - DNA, 13 bp, D. melanogaster
aaaacagtcgcaa

SEQ ID NO: 543370 - DNA, 13 bp, D. melanogaster
aaaacagtgcaaa

SEQ ID NO: 543371 - DNA, 13 bp, D. melanogaster
aaaacagtgcaga

SEQ ID NO: 543372 - DNA, 14 bp, D. melanogaster
aaaacagtgcagaa

SEQ ID NO: 543373 - DNA, 13 bp, D. melanogaster
aaaacagtgcctt

SEQ ID NO: 543374 - DNA, 13 bp, D. melanogaster
aaaacagtggaaa

SEQ ID NO: 543375 - DNA, 13 bp, D. melanogaster
aaaacagttattt

SEQ ID NO: 543376 - DNA, 13 bp, D. melanogaster
aaaacagttcctg

SEQ ID NO: 543377 - DNA, 13 bp, D. melanogaster
aaaacagttgaaa

SEQ ID NO: 543378 - DNA, 14 bp, D. melanogaster
aaaacagttgcaaa

SEQ ID NO: 543379 - DNA, 13 bp, D. melanogaster
aaaacagtttata

SEQ ID NO: 543380 - DNA, 13 bp, D. melanogaster
aaaacagtttcaa

SEQ ID NO: 543381 - DNA, 13 bp, D. melanogaster
aaaacagtttgca

SEQ ID NO: 543382 - DNA, 13 bp, D. melanogaster
aaaacagttttaa

SEQ ID NO: 543383 - DNA, 13 bp, D. melanogaster
aaaacagttttga

SEQ ID NO: 543384 - DNA, 13 bp, D. melanogaster
aaaacagttttta

SEQ ID NO: 543385 - DNA, 13 bp, D. melanogaster
aaaacagtttttt

SEQ ID NO: 543386 - DNA, 13 bp, D. melanogaster
aaaacataactga

SEQ ID NO: 543387 - DNA, 13 bp, D. melanogaster
aaaacataacttt

SEQ ID NO: 543388 - DNA, 13 bp, D. melanogaster
aaaacataatggc

SEQ ID NO: 543389 - DNA, 13 bp, D. melanogaster
aaaacatacatag

SEQ ID NO: 543390 - DNA, 14 bp, D. melanogaster
aaaacatacatttt

SEQ ID NO: 543391 - DNA, 13 bp, D. melanogaster
aaaacatactgca

SEQ ID NO: 543392 - DNA, 13 bp, D. melanogaster
aaaacatagttta

SEQ ID NO: 543393 - DNA, 13 bp, D. melanogaster
aaaacatagtttt

SEQ ID NO: 543394 - DNA, 13 bp, D. melanogaster
aaaacatatactt

SEQ ID NO: 543395 - DNA, 13 bp, D. melanogaster
aaaacatatatgt

SEQ ID NO: 543396 - DNA, 14 bp, D. melanogaster
aaaacatatatgta

SEQ ID NO: 543397 - DNA, 13 bp, D. melanogaster
aaaacatatattc

SEQ ID NO: 543398 - DNA, 13 bp, D. melanogaster
aaaacatattgaa

SEQ ID NO: 543399 - DNA, 13 bp, D. melanogaster
aaaacatattgca

SEQ ID NO: 543400 - DNA, 14 bp, D. melanogaster
aaaacatattgtaa

SEQ ID NO: 543401 - DNA, 13 bp, D. melanogaster
aaaacatatttca

SEQ ID NO: 543402 - DNA, 14 bp, D. melanogaster
aaaacatatttgaa

SEQ ID NO: 543403 - DNA, 13 bp, D. melanogaster
aaaacatatttgc

SEQ ID NO: 543404 - DNA, 13 bp, D. melanogaster
aaaacatattttc

SEQ ID NO: 543405 - DNA, 13 bp, D. melanogaster
aaaacatcaattt

SEQ ID NO: 543406 - DNA, 13 bp, D. melanogaster
aaaacatcatttt

SEQ ID NO: 543407 - DNA, 13 bp, D. melanogaster
aaaacatccactt

SEQ ID NO: 543408 - DNA, 13 bp, D. melanogaster
aaaacatcgaaat

SEQ ID NO: 543409 - DNA, 13 bp, D. melanogaster
aaaacatcgattt

SEQ ID NO: 543410 - DNA, 13 bp, D. melanogaster
aaaacatctttaa

SEQ ID NO: 543411 - DNA, 14 bp, D. melanogaster
aaaacatgaaaatg

SEQ ID NO: 543412 - DNA, 13 bp, D. melanogaster
aaaacatgaaatt

SEQ ID NO: 543413 - DNA, 13 bp, D. melanogaster
aaaacatgaatat

SEQ ID NO: 543414 - DNA, 13 bp, D. melanogaster
aaaacatgatggc

SEQ ID NO: 543415 - DNA, 13 bp, D. melanogaster
aaaacatgattaa

SEQ ID NO: 543416 - DNA, 13 bp, D. melanogaster
aaaacatgcaaat

SEQ ID NO: 543417 - DNA, 13 bp, D. melanogaster
aaaacatgcaaca

SEQ ID NO: 543418 - DNA, 13 bp, D. melanogaster
aaaacatgcaatt

SEQ ID NO: 543419 - DNA, 13 bp, D. melanogaster
aaaacatgccaaa

SEQ ID NO: 543420 - DNA, 13 bp, D. melanogaster
aaaacatgcgaaa

SEQ ID NO: 543421 - DNA, 13 bp, D. melanogaster
aaaacatggaacc

SEQ ID NO: 543422 - DNA, 13 bp, D. melanogaster
aaaacatggcaaa

SEQ ID NO: 543423 - DNA, 13 bp, D. melanogaster
aaaacatggccaa

SEQ ID NO: 543424 - DNA, 13 bp, D. melanogaster
aaaacatgtaatt

SEQ ID NO: 543425 - DNA, 13 bp, D. melanogaster
aaaacatgtgtaa

SEQ ID NO: 543426 - DNA, 13 bp, D. melanogaster
aaaacatgttaaa

SEQ ID NO: 543427 - DNA, 13 bp, D. melanogaster
aaaacatgtttga

SEQ ID NO: 543428 - DNA, 13 bp, D. melanogaster
aaaacattaaatg

SEQ ID NO: 543429 - DNA, 13 bp, D. melanogaster
aaaacattaagat

SEQ ID NO: 543430 - DNA, 13 bp, D. melanogaster
aaaacattaagct

SEQ ID NO: 543431 - DNA, 13 bp, D. melanogaster
aaaacattcagaa

SEQ ID NO: 543432 - DNA, 13 bp, D. melanogaster
aaaacattcgaaa

SEQ ID NO: 543433 - DNA, 13 bp, D. melanogaster
aaaacattctgaa

SEQ ID NO: 543434 - DNA, 13 bp, D. melanogaster
aaaacattcttaa

SEQ ID NO: 543435 - DNA, 14 bp, D. melanogaster
aaaacattgaaaat

SEQ ID NO: 543436 - DNA, 13 bp, D. melanogaster
aaaacattgaaat

SEQ ID NO: 543437 - DNA, 13 bp, D. melanogaster
aaaacattgaata

SEQ ID NO: 543438 - DNA, 13 bp, D. melanogaster
aaaacattgccaa

SEQ ID NO: 543439 - DNA, 13 bp, D. melanogaster
aaaacattgctaa

SEQ ID NO: 543440 - DNA, 13 bp, D. melanogaster
aaaacattgtttt

SEQ ID NO: 543441 - DNA, 13 bp, D. melanogaster
aaaacatttaaag

SEQ ID NO: 543442 - DNA, 13 bp, D. melanogaster
aaaacatttaact

SEQ ID NO: 543443 - DNA, 13 bp, D. melanogaster
aaaacatttaaga

SEQ ID NO: 543444 - DNA, 13 bp, D. melanogaster
aaaacatttaagc

SEQ ID NO: 543445 - DNA, 13 bp, D. melanogaster
aaaacatttaagt

SEQ ID NO: 543446 - DNA, 13 bp, D. melanogaster
aaaacatttacac

SEQ ID NO: 543447 - DNA, 13 bp, D. melanogaster
aaaacatttacta

SEQ ID NO: 543448 - DNA, 13 bp, D. melanogaster
aaaacatttatgt

SEQ ID NO: 543449 - DNA, 14 bp, D. melanogaster
aaaacatttcaatt

SEQ ID NO: 543450 - DNA, 13 bp, D. melanogaster
aaaacatttcact

SEQ ID NO: 543451 - DNA, 14 bp, D. melanogaster
aaaacatttcattt

SEQ ID NO: 543452 - DNA, 13 bp, D. melanogaster
aaaacatttcctt

SEQ ID NO: 543453 - DNA, 13 bp, D. melanogaster
aaaacatttctaa

SEQ ID NO: 543454 - DNA, 13 bp, D. melanogaster
aaaacatttctat

SEQ ID NO: 543455 - DNA, 13 bp, D. melanogaster
aaaacatttgaaa

SEQ ID NO: 543456 - DNA, 14 bp, D. melanogaster
aaaacatttgaaaa

SEQ ID NO: 543457 - DNA, 14 bp, D. melanogaster
aaaacatttgaaat

SEQ ID NO: 543458 - DNA, 13 bp, D. melanogaster
aaaacatttgatt

SEQ ID NO: 543459 - DNA, 14 bp, D. melanogaster
aaaacatttgattt

SEQ ID NO: 543460 - DNA, 13 bp, D. melanogaster
aaaacatttgcaa

SEQ ID NO: 543461 - DNA, 14 bp, D. melanogaster
aaaacatttgcaat

SEQ ID NO: 543462 - DNA, 14 bp, D. melanogaster
aaaacatttgcatt

SEQ ID NO: 543463 - DNA, 13 bp, D. melanogaster
aaaacatttggca

SEQ ID NO: 543464 - DNA, 13 bp, D. melanogaster
aaaacatttgtta

SEQ ID NO: 543465 - DNA, 14 bp, D. melanogaster
aaaacatttgtttt

SEQ ID NO: 543466 - DNA, 13 bp, D. melanogaster
aaaacattttagt

SEQ ID NO: 543467 - DNA, 13 bp, D. melanogaster
aaaacattttcaa

SEQ ID NO: 543468 - DNA, 14 bp, D. melanogaster
aaaacattttcaca

SEQ ID NO: 543469 - DNA, 14 bp, D. melanogaster
aaaacattttcatt

SEQ ID NO: 543470 - DNA, 14 bp, D. melanogaster
aaaacattttgaac

SEQ ID NO: 543471 - DNA, 13 bp, D. melanogaster
aaaacattttgca

SEQ ID NO: 543472 - DNA, 13 bp, D. melanogaster
aaaacattttgga

SEQ ID NO: 543473 - DNA, 13 bp, D. melanogaster
aaaacattttgta

SEQ ID NO: 543474 - DNA, 14 bp, D. melanogaster
aaaacattttgtaa

SEQ ID NO: 543475 - DNA, 14 bp, D. melanogaster
aaaacattttgttt

SEQ ID NO: 543476 - DNA, 13 bp, D. melanogaster
aaaacatttttag

SEQ ID NO: 543477 - DNA, 13 bp, D. melanogaster
aaaacatttttca

SEQ ID NO: 543478 - DNA, 13 bp, D. melanogaster
aaaacatttttgc

SEQ ID NO: 543479 - DNA, 13 bp, D. melanogaster
aaaaccaaaagtc

SEQ ID NO: 543480 - DNA, 13 bp, D. melanogaster
aaaaccaaaagtt

SEQ ID NO: 543481 - DNA, 14 bp, D. melanogaster
aaaaccaaaatgga

SEQ ID NO: 543482 - DNA, 13 bp, D. melanogaster
aaaaccaaaatgt

SEQ ID NO: 543483 - DNA, 14 bp, D. melanogaster
aaaaccaaagaagt

SEQ ID NO: 543484 - DNA, 13 bp, D. melanogaster
aaaaccaaagttt

SEQ ID NO: 543485 - DNA, 13 bp, D. melanogaster
aaaaccaaatcag

SEQ ID NO: 543486 - DNA, 13 bp, D. melanogaster
aaaaccaaatcga

SEQ ID NO: 543487 - DNA, 14 bp, D. melanogaster
aaaaccaaatgaat

SEQ ID NO: 543488 - DNA, 13 bp, D. melanogaster
aaaaccaaatgca

SEQ ID NO: 543489 - DNA, 14 bp, D. melanogaster
aaaaccaaatgcaa

SEQ ID NO: 543490 - DNA, 13 bp, D. melanogaster
aaaaccaaatggg

SEQ ID NO: 543491 - DNA, 13 bp, D. melanogaster
aaaaccaaattcg

SEQ ID NO: 543492 - DNA, 13 bp, D. melanogaster
aaaaccaaattga

SEQ ID NO: 543493 - DNA, 13 bp, D. melanogaster
aaaaccaaattgt

SEQ ID NO: 543494 - DNA, 13 bp, D. melanogaster
aaaaccaaatttg

SEQ ID NO: 543495 - DNA, 13 bp, D. melanogaster
aaaaccaacaatg

SEQ ID NO: 543496 - DNA, 13 bp, D. melanogaster
aaaaccaagctaa

SEQ ID NO: 543497 - DNA, 13 bp, D. melanogaster
aaaaccaagtaca

SEQ ID NO: 543498 - DNA, 13 bp, D. melanogaster
aaaaccaagtcaa

SEQ ID NO: 543499 - DNA, 13 bp, D. melanogaster
aaaaccaagtgaa

SEQ ID NO: 543500 - DNA, 15 bp, D. melanogaster
aaaaccaagttatta

SEQ ID NO: 543501 - DNA, 13 bp, D. melanogaster
aaaaccaatcgaa

SEQ ID NO: 543502 - DNA, 13 bp, D. melanogaster
aaaaccaatcgat

SEQ ID NO: 543503 - DNA, 13 bp, D. melanogaster
aaaaccaatgcaa

SEQ ID NO: 543504 - DNA, 13 bp, D. melanogaster
aaaaccaattgaa

SEQ ID NO: 543505 - DNA, 14 bp, D. melanogaster
aaaaccaattgaaa

SEQ ID NO: 543506 - DNA, 13 bp, D. melanogaster
aaaaccaatttca

SEQ ID NO: 543507 - DNA, 13 bp, D. melanogaster
aaaaccaattttt

SEQ ID NO: 543508 - DNA, 13 bp, D. melanogaster
aaaaccacattta

SEQ ID NO: 543509 - DNA, 13 bp, D. melanogaster
aaaaccactgaaa

SEQ ID NO: 543510 - DNA, 13 bp, D. melanogaster
aaaaccacttgaa

SEQ ID NO: 543511 - DNA, 13 bp, D. melanogaster
aaaaccagaaatt

SEQ ID NO: 543512 - DNA, 13 bp, D. melanogaster
aaaaccagaatga

SEQ ID NO: 543513 - DNA, 13 bp, D. melanogaster
aaaaccagaattt

SEQ ID NO: 543514 - DNA, 13 bp, D. melanogaster
aaaaccagttaaa

SEQ ID NO: 543515 - DNA, 13 bp, D. melanogaster
aaaaccagttttc

SEQ ID NO: 543516 - DNA, 13 bp, D. melanogaster
aaaaccatattat

SEQ ID NO: 543517 - DNA, 13 bp, D. melanogaster
aaaaccatattgg

SEQ ID NO: 543518 - DNA, 13 bp, D. melanogaster
aaaaccatattta

SEQ ID NO: 543519 - DNA, 13 bp, D. melanogaster
aaaaccatatttt

SEQ ID NO: 543520 - DNA, 13 bp, D. melanogaster
aaaaccatgaaac

SEQ ID NO: 543521 - DNA, 13 bp, D. melanogaster
aaaaccatggaaa

SEQ ID NO: 543522 - DNA, 13 bp, D. melanogaster
aaaaccattaatt

SEQ ID NO: 543523 - DNA, 13 bp, D. melanogaster
aaaaccattatta

SEQ ID NO: 543524 - DNA, 13 bp, D. melanogaster
aaaaccattcatt

SEQ ID NO: 543525 - DNA, 13 bp, D. melanogaster
aaaaccattgaaa

SEQ ID NO: 543526 - DNA, 14 bp, D. melanogaster
aaaaccatttaatt

SEQ ID NO: 543527 - DNA, 13 bp, D. melanogaster
aaaaccatttatt

SEQ ID NO: 543528 - DNA, 14 bp, D. melanogaster
aaaaccatttattt

SEQ ID NO: 543529 - DNA, 13 bp, D. melanogaster
aaaaccatttgca

SEQ ID NO: 543530 - DNA, 13 bp, D. melanogaster
aaaaccattttat

SEQ ID NO: 543531 - DNA, 13 bp, D. melanogaster
aaaaccattttga

SEQ ID NO: 543532 - DNA, 13 bp, D. melanogaster
aaaaccattttta

SEQ ID NO: 543533 - DNA, 13 bp, D. melanogaster
aaaacccaatggt

SEQ ID NO: 543534 - DNA, 13 bp, D. melanogaster
aaaacccaattta

SEQ ID NO: 543535 - DNA, 13 bp, D. melanogaster
aaaacccatatta

SEQ ID NO: 543536 - DNA, 13 bp, D. melanogaster
aaaacccatgaaa

SEQ ID NO: 543537 - DNA, 13 bp, D. melanogaster
aaaacccattcaa

SEQ ID NO: 543538 - DNA, 13 bp, D. melanogaster
aaaacccattgaa

SEQ ID NO: 543539 - DNA, 13 bp, D. melanogaster
aaaacccatttaa

SEQ ID NO: 543540 - DNA, 14 bp, D. melanogaster
aaaacccatttaaa

SEQ ID NO: 543541 - DNA, 13 bp, D. melanogaster
aaaacccatttca

SEQ ID NO: 543542 - DNA, 13 bp, D. melanogaster
aaaacccatttta

SEQ ID NO: 543543 - DNA, 13 bp, D. melanogaster
aaaaccccattaa

SEQ ID NO: 543544 - DNA, 13 bp, D. melanogaster
aaaaccccattta

SEQ ID NO: 543545 - DNA, 13 bp, D. melanogaster
aaaaccccatttt

SEQ ID NO: 543546 - DNA, 13 bp, D. melanogaster
aaaacccctttaa

SEQ ID NO: 543547 - DNA, 13 bp, D. melanogaster
aaaacccgaaaat

SEQ ID NO: 543548 - DNA, 13 bp, D. melanogaster
aaaaccctttaaa

SEQ ID NO: 543549 - DNA, 13 bp, D. melanogaster
aaaacccttttca

SEQ ID NO: 543550 - DNA, 13 bp, D. melanogaster
aaaacccttttcc

SEQ ID NO: 543551 - DNA, 14 bp, D. melanogaster
aaaaccgaaaaact

SEQ ID NO: 543552 - DNA, 14 bp, D. melanogaster
aaaaccgaaaactg

SEQ ID NO: 543553 - DNA, 13 bp, D. melanogaster
aaaaccgaaaagt

SEQ ID NO: 543554 - DNA, 13 bp, D. melanogaster
aaaaccgaaactc

SEQ ID NO: 543555 - DNA, 14 bp, D. melanogaster
aaaaccgaaactga

SEQ ID NO: 543556 - DNA, 13 bp, D. melanogaster
aaaaccgaaagcc

SEQ ID NO: 543557 - DNA, 13 bp, D. melanogaster
aaaaccgaaatca

SEQ ID NO: 543558 - DNA, 13 bp, D. melanogaster
aaaaccgaaattg

SEQ ID NO: 543559 - DNA, 13 bp, D. melanogaster
aaaaccgaacaat

SEQ ID NO: 543560 - DNA, 13 bp, D. melanogaster
aaaaccgaaccga

SEQ ID NO: 543561 - DNA, 13 bp, D. melanogaster
aaaaccgaactga

SEQ ID NO: 543562 - DNA, 13 bp, D. melanogaster
aaaaccgaagcca

SEQ ID NO: 543563 - DNA, 13 bp, D. melanogaster
aaaaccgaagccg

SEQ ID NO: 543564 - DNA, 13 bp, D. melanogaster
aaaaccgaatcga

SEQ ID NO: 543565 - DNA, 13 bp, D. melanogaster
aaaaccgaatgca

SEQ ID NO: 543566 - DNA, 13 bp, D. melanogaster
aaaaccgaattaa

SEQ ID NO: 543567 - DNA, 13 bp, D. melanogaster
aaaaccgaatttc

SEQ ID NO: 543568 - DNA, 13 bp, D. melanogaster
aaaaccgagaaat

SEQ ID NO: 543569 - DNA, 13 bp, D. melanogaster
aaaaccgcaaaat

SEQ ID NO: 543570 - DNA, 13 bp, D. melanogaster
aaaaccgcaaatg

SEQ ID NO: 543571 - DNA, 13 bp, D. melanogaster
aaaaccgcagcaa

SEQ ID NO: 543572 - DNA, 13 bp, D. melanogaster
aaaaccgttggac

SEQ ID NO: 543573 - DNA, 13 bp, D. melanogaster
aaaaccgttttta

SEQ ID NO: 543574 - DNA, 13 bp, D. melanogaster
aaaacctaatcct

SEQ ID NO: 543575 - DNA, 14 bp, D. melanogaster
aaaacctaccgaaa

SEQ ID NO: 543576 - DNA, 13 bp, D. melanogaster
aaaacctatttaa

SEQ ID NO: 543577 - DNA, 13 bp, D. melanogaster
aaaacctcactga

SEQ ID NO: 543578 - DNA, 13 bp, D. melanogaster
aaaacctcagcaa

SEQ ID NO: 543579 - DNA, 13 bp, D. melanogaster
aaaacctggccaa

SEQ ID NO: 543580 - DNA, 13 bp, D. melanogaster
aaaaccttcaaat

SEQ ID NO: 543581 - DNA, 13 bp, D. melanogaster
aaaaccttcgact

SEQ ID NO: 543582 - DNA, 13 bp, D. melanogaster
aaaaccttggcca

SEQ ID NO: 543583 - DNA, 13 bp, D. melanogaster
aaaacctttaaca

SEQ ID NO: 543584 - DNA, 13 bp, D. melanogaster
aaaacctttaatt

SEQ ID NO: 543585 - DNA, 13 bp, D. melanogaster
aaaaccttttaat

SEQ ID NO: 543586 - DNA, 13 bp, D. melanogaster
aaaaccttttcat

SEQ ID NO: 543587 - DNA, 13 bp, D. melanogaster
aaaaccttttgca

SEQ ID NO: 543588 - DNA, 13 bp, D. melanogaster
aaaacctttttaa

SEQ ID NO: 543589 - DNA, 13 bp, D. melanogaster
aaaaccttttttc

SEQ ID NO: 543590 - DNA, 13 bp, D. melanogaster
aaaaccttttttt

SEQ ID NO: 543591 - DNA, 14 bp, D. melanogaster
aaaacgaaaacatt

SEQ ID NO: 543592 - DNA, 14 bp, D. melanogaster
aaaacgaaaacgat

SEQ ID NO: 543593 - DNA, 14 bp, D. melanogaster
aaaacgaaaacgta

SEQ ID NO: 543594 - DNA, 13 bp, D. melanogaster
aaaacgaaaactg

SEQ ID NO: 543595 - DNA, 13 bp, D. melanogaster
aaaacgaaaactt

SEQ ID NO: 543596 - DNA, 13 bp, D. melanogaster
aaaacgaaaagtg

SEQ ID NO: 543597 - DNA, 14 bp, D. melanogaster
aaaacgaaaatatt

SEQ ID NO: 543598 - DNA, 13 bp, D. melanogaster
aaaacgaaaatgt

SEQ ID NO: 543599 - DNA, 13 bp, D. melanogaster
aaaacgaaaattg

SEQ ID NO: 543600 - DNA, 13 bp, D. melanogaster
aaaacgaaaattt

SEQ ID NO: 543601 - DNA, 13 bp, D. melanogaster
aaaacgaaacatt

SEQ ID NO: 543602 - DNA, 13 bp, D. melanogaster
aaaacgaaacggg

SEQ ID NO: 543603 - DNA, 13 bp, D. melanogaster
aaaacgaaactgt

SEQ ID NO: 543604 - DNA, 14 bp, D. melanogaster
aaaacgaaagactt

SEQ ID NO: 543605 - DNA, 13 bp, D. melanogaster
aaaacgaaatacg

SEQ ID NO: 543606 - DNA, 13 bp, D. melanogaster
aaaacgaaatatt

SEQ ID NO: 543607 - DNA, 14 bp, D. melanogaster
aaaacgaaatattt

SEQ ID NO: 543608 - DNA, 13 bp, D. melanogaster
aaaacgaaatcag

SEQ ID NO: 543609 - DNA, 13 bp, D. melanogaster
aaaacgaaatcca

SEQ ID NO: 543610 - DNA, 13 bp, D. melanogaster
aaaacgaaatcga

SEQ ID NO: 543611 - DNA, 13 bp, D. melanogaster
aaaacgaaatgcg

SEQ ID NO: 543612 - DNA, 13 bp, D. melanogaster
aaaacgaaatgga

SEQ ID NO: 543613 - DNA, 14 bp, D. melanogaster
aaaacgaaatggaa

SEQ ID NO: 543614 - DNA, 13 bp, D. melanogaster
aaaacgaaatggc

SEQ ID NO: 543615 - DNA, 13 bp, D. melanogaster
aaaacgaaattca

SEQ ID NO: 543616 - DNA, 13 bp, D. melanogaster
aaaacgaaattcc

SEQ ID NO: 543617 - DNA, 14 bp, D. melanogaster
aaaacgaaatttaa

SEQ ID NO: 543618 - DNA, 13 bp, D. melanogaster
aaaacgaaatttg

SEQ ID NO: 543619 - DNA, 13 bp, D. melanogaster
aaaacgaaatttt

SEQ ID NO: 543620 - DNA, 13 bp, D. melanogaster
aaaacgaacaatt

SEQ ID NO: 543621 - DNA, 13 bp, D. melanogaster
aaaacgaacatac

SEQ ID NO: 543622 - DNA, 13 bp, D. melanogaster
aaaacgaacgaat

SEQ ID NO: 543623 - DNA, 13 bp, D. melanogaster
aaaacgaagagtt

SEQ ID NO: 543624 - DNA, 13 bp, D. melanogaster
aaaacgaagtata

SEQ ID NO: 543625 - DNA, 13 bp, D. melanogaster
aaaacgaagtcaa

SEQ ID NO: 543626 - DNA, 13 bp, D. melanogaster
aaaacgaatattt

SEQ ID NO: 543627 - DNA, 13 bp, D. melanogaster
aaaacgaatcgaa

SEQ ID NO: 543628 - DNA, 14 bp, D. melanogaster
aaaacgaatcgaaa

SEQ ID NO: 543629 - DNA, 13 bp, D. melanogaster
aaaacgaatgcaa

SEQ ID NO: 543630 - DNA, 13 bp, D. melanogaster
aaaacgaattatt

SEQ ID NO: 543631 - DNA, 13 bp, D. melanogaster
aaaacgaattgaa

SEQ ID NO: 543632 - DNA, 13 bp, D. melanogaster
aaaacgaatttat

SEQ ID NO: 543633 - DNA, 13 bp, D. melanogaster
aaaacgaattttc

SEQ ID NO: 543634 - DNA, 14 bp, D. melanogaster
aaaacgacaacagt

SEQ ID NO: 543635 - DNA, 13 bp, D. melanogaster
aaaacgacgacga

SEQ ID NO: 543636 - DNA, 13 bp, D. melanogaster
aaaacgagaaatt

SEQ ID NO: 543637 - DNA, 13 bp, D. melanogaster
aaaacgaggttca

SEQ ID NO: 543638 - DNA, 13 bp, D. melanogaster
aaaacgagtgaaa

SEQ ID NO: 543639 - DNA, 13 bp, D. melanogaster
aaaacgagtttgt

SEQ ID NO: 543640 - DNA, 13 bp, D. melanogaster
aaaacgagttttc

SEQ ID NO: 543641 - DNA, 13 bp, D. melanogaster
aaaacgatctcaa

SEQ ID NO: 543642 - DNA, 13 bp, D. melanogaster
aaaacgatggaaa

SEQ ID NO: 543643 - DNA, 14 bp, D. melanogaster
aaaacgatggaaaa

SEQ ID NO: 543644 - DNA, 13 bp, D. melanogaster
aaaacgatgtcaa

SEQ ID NO: 543645 - DNA, 13 bp, D. melanogaster
aaaacgattcaaa

SEQ ID NO: 543646 - DNA, 13 bp, D. melanogaster
aaaacgatttcaa

SEQ ID NO: 543647 - DNA, 13 bp, D. melanogaster
aaaacgatttcca

SEQ ID NO: 543648 - DNA, 13 bp, D. melanogaster
aaaacgatttcga

SEQ ID NO: 543649 - DNA, 13 bp, D. melanogaster
aaaacgatttgaa

SEQ ID NO: 543650 - DNA, 13 bp, D. melanogaster
aaaacgattttcc

SEQ ID NO: 543651 - DNA, 13 bp, D. melanogaster
aaaacgcaaaact

SEQ ID NO: 543652 - DNA, 13 bp, D. melanogaster
aaaacgcaaatga

SEQ ID NO: 543653 - DNA, 13 bp, D. melanogaster
aaaacgcaatatt

SEQ ID NO: 543654 - DNA, 13 bp, D. melanogaster
aaaacgcaatgca

SEQ ID NO: 543655 - DNA, 13 bp, D. melanogaster
aaaacgcaattaa

SEQ ID NO: 543656 - DNA, 13 bp, D. melanogaster
aaaacgcagcagc

SEQ ID NO: 543657 - DNA, 13 bp, D. melanogaster
aaaacgcagccaa

SEQ ID NO: 543658 - DNA, 13 bp, D. melanogaster
aaaacgcagctaa

SEQ ID NO: 543659 - DNA, 13 bp, D. melanogaster
aaaacgcataaat

SEQ ID NO: 543660 - DNA, 13 bp, D. melanogaster
aaaacgcatgcaa

SEQ ID NO: 543661 - DNA, 13 bp, D. melanogaster
aaaacgcattcga

SEQ ID NO: 543662 - DNA, 13 bp, D. melanogaster
aaaacgcattgaa

SEQ ID NO: 543663 - DNA, 13 bp, D. melanogaster
aaaacgcatttaa

SEQ ID NO: 543664 - DNA, 13 bp, D. melanogaster
aaaacgcatttat

SEQ ID NO: 543665 - DNA, 13 bp, D. melanogaster
aaaacgcattttc

SEQ ID NO: 543666 - DNA, 13 bp, D. melanogaster
aaaacgcattttt

SEQ ID NO: 543667 - DNA, 13 bp, D. melanogaster
aaaacgcgcacaa

SEQ ID NO: 543668 - DNA, 13 bp, D. melanogaster
aaaacgctggaag

SEQ ID NO: 543669 - DNA, 13 bp, D. melanogaster
aaaacgcttgttt

SEQ ID NO: 543670 - DNA, 14 bp, D. melanogaster
aaaacgctttaaaa

SEQ ID NO: 543671 - DNA, 13 bp, D. melanogaster
aaaacgctttaat

SEQ ID NO: 543672 - DNA, 13 bp, D. melanogaster
aaaacgcttttca

SEQ ID NO: 543673 - DNA, 13 bp, D. melanogaster
aaaacggaaaatc

SEQ ID NO: 543674 - DNA, 13 bp, D. melanogaster
aaaacggaaaatg

SEQ ID NO: 543675 - DNA, 13 bp, D. melanogaster
aaaacggaaaatt

SEQ ID NO: 543676 - DNA, 13 bp, D. melanogaster
aaaacggaaacgg

SEQ ID NO: 543677 - DNA, 14 bp, D. melanogaster
aaaacggaaatgaa

SEQ ID NO: 543678 - DNA, 13 bp, D. melanogaster
aaaacggaatgaa

SEQ ID NO: 543679 - DNA, 13 bp, D. melanogaster
aaaacggaatttt

SEQ ID NO: 543680 - DNA, 13 bp, D. melanogaster
aaaacggagcata

SEQ ID NO: 543681 - DNA, 14 bp, D. melanogaster
aaaacggaggacga

SEQ ID NO: 543682 - DNA, 13 bp, D. melanogaster
aaaacggcaaaat

SEQ ID NO: 543683 - DNA, 13 bp, D. melanogaster
aaaacggcagcca

SEQ ID NO: 543684 - DNA, 13 bp, D. melanogaster
aaaacggcataaa

SEQ ID NO: 543685 - DNA, 16 bp, D. melanogaster
aaaacggcccttttca

SEQ ID NO: 543686 - DNA, 13 bp, D. melanogaster
aaaacggggtagc

SEQ ID NO: 543687 - DNA, 13 bp, D. melanogaster
aaaacggtggaaa

SEQ ID NO: 543688 - DNA, 13 bp, D. melanogaster
aaaacgtaacgaa

SEQ ID NO: 543689 - DNA, 13 bp, D. melanogaster
aaaacgtaatatt

SEQ ID NO: 543690 - DNA, 14 bp, D. melanogaster
aaaacgtacaagaa

SEQ ID NO: 543691 - DNA, 13 bp, D. melanogaster
aaaacgtagcaaa

SEQ ID NO: 543692 - DNA, 13 bp, D. melanogaster
aaaacgtataaat

SEQ ID NO: 543693 - DNA, 13 bp, D. melanogaster
aaaacgtattaaa

SEQ ID NO: 543694 - DNA, 13 bp, D. melanogaster
aaaacgtattatt

SEQ ID NO: 543695 - DNA, 13 bp, D. melanogaster
aaaacgtatttaa

SEQ ID NO: 543696 - DNA, 13 bp, D. melanogaster
aaaacgtatttat

SEQ ID NO: 543697 - DNA, 13 bp, D. melanogaster
aaaacgtattttt

SEQ ID NO: 543698 - DNA, 13 bp, D. melanogaster
aaaacgtgaaaat

SEQ ID NO: 543699 - DNA, 13 bp, D. melanogaster
aaaacgtgcaaaa

SEQ ID NO: 543700 - DNA, 14 bp, D. melanogaster
aaaacgtgcaaaaa

SEQ ID NO: 543701 - DNA, 13 bp, D. melanogaster
aaaacgtggaaaa

SEQ ID NO: 543702 - DNA, 13 bp, D. melanogaster
aaaacgtgttcaa

SEQ ID NO: 543703 - DNA, 13 bp, D. melanogaster
aaaacgtgttttt

SEQ ID NO: 543704 - DNA, 13 bp, D. melanogaster
aaaacgttaaaat

SEQ ID NO: 543705 - DNA, 13 bp, D. melanogaster
aaaacgttagcaa

SEQ ID NO: 543706 - DNA, 13 bp, D. melanogaster
aaaacgttgaaaa

SEQ ID NO: 543707 - DNA, 13 bp, D. melanogaster
aaaacgttgctca

SEQ ID NO: 543708 - DNA, 13 bp, D. melanogaster
aaaacgtttcatt

SEQ ID NO: 543709 - DNA, 13 bp, D. melanogaster
aaaacgtttgcca

SEQ ID NO: 543710 - DNA, 13 bp, D. melanogaster
aaaacgtttgccc

SEQ ID NO: 543711 - DNA, 13 bp, D. melanogaster
aaaacgttttaaa

SEQ ID NO: 543712 - DNA, 13 bp, D. melanogaster
aaaacgttttatt

SEQ ID NO: 543713 - DNA, 13 bp, D. melanogaster
aaaacgttttcaa

SEQ ID NO: 543714 - DNA, 14 bp, D. melanogaster
aaaactaaaactga

SEQ ID NO: 543715 - DNA, 13 bp, D. melanogaster
aaaactaaaagct

SEQ ID NO: 543716 - DNA, 13 bp, D. melanogaster
aaaactaaaaggc

SEQ ID NO: 543717 - DNA, 13 bp, D. melanogaster
aaaactaaaattg

SEQ ID NO: 543718 - DNA, 13 bp, D. melanogaster
aaaactaaactga

SEQ ID NO: 543719 - DNA, 13 bp, D. melanogaster
aaaactaaattgt

SEQ ID NO: 543720 - DNA, 13 bp, D. melanogaster
aaaactaaatttg

SEQ ID NO: 543721 - DNA, 13 bp, D. melanogaster
aaaactaacattt

SEQ ID NO: 543722 - DNA, 13 bp, D. melanogaster
aaaactaactttt

SEQ ID NO: 543723 - DNA, 13 bp, D. melanogaster
aaaactaagaagg

SEQ ID NO: 543724 - DNA, 13 bp, D. melanogaster
aaaactaagctga

SEQ ID NO: 543725 - DNA, 14 bp, D. melanogaster
aaaactaagctgaa

SEQ ID NO: 543726 - DNA, 13 bp, D. melanogaster
aaaactaataatg

SEQ ID NO: 543727 - DNA, 13 bp, D. melanogaster
aaaactaatgttt

SEQ ID NO: 543728 - DNA, 13 bp, D. melanogaster
aaaactaattgtt

SEQ ID NO: 543729 - DNA, 14 bp, D. melanogaster
aaaactaatttgaa

SEQ ID NO: 543730 - DNA, 13 bp, D. melanogaster
aaaactaatttgt

SEQ ID NO: 543731 - DNA, 13 bp, D. melanogaster
aaaactacagatc

SEQ ID NO: 543732 - DNA, 13 bp, D. melanogaster
aaaactaccctaa

SEQ ID NO: 543733 - DNA, 13 bp, D. melanogaster
aaaactactctca

SEQ ID NO: 543734 - DNA, 13 bp, D. melanogaster
aaaactagaacta

SEQ ID NO: 543735 - DNA, 13 bp, D. melanogaster
aaaactagaattt

SEQ ID NO: 543736 - DNA, 13 bp, D. melanogaster
aaaactagactaa

SEQ ID NO: 543737 - DNA, 13 bp, D. melanogaster
aaaactagttaaa

SEQ ID NO: 543738 - DNA, 13 bp, D. melanogaster
aaaactagtttta

SEQ ID NO: 543739 - DNA, 13 bp, D. melanogaster
aaaactagttttc

SEQ ID NO: 543740 - DNA, 13 bp, D. melanogaster
aaaactagttttt

SEQ ID NO: 543741 - DNA, 14 bp, D. melanogaster
aaaactataaaatg

SEQ ID NO: 543742 - DNA, 13 bp, D. melanogaster
aaaactatatatg

SEQ ID NO: 543743 - DNA, 13 bp, D. melanogaster
aaaactatcgaaa

SEQ ID NO: 543744 - DNA, 13 bp, D. melanogaster
aaaactatcgcat

SEQ ID NO: 543745 - DNA, 13 bp, D. melanogaster
aaaactatgaaac

SEQ ID NO: 543746 - DNA, 13 bp, D. melanogaster
aaaactatgagtc

SEQ ID NO: 543747 - DNA, 14 bp, D. melanogaster
aaaactatgagtca

SEQ ID NO: 543748 - DNA, 14 bp, D. melanogaster
aaaactatgcaaaa

SEQ ID NO: 543749 - DNA, 13 bp, D. melanogaster
aaaactatgcgaa

SEQ ID NO: 543750 - DNA, 13 bp, D. melanogaster
aaaactatgtaaa

SEQ ID NO: 543751 - DNA, 13 bp, D. melanogaster
aaaactatgtaca

SEQ ID NO: 543752 - DNA, 13 bp, D. melanogaster
aaaactattccag

SEQ ID NO: 543753 - DNA, 14 bp, D. melanogaster
aaaactattccagt

SEQ ID NO: 543754 - DNA, 13 bp, D. melanogaster
aaaactattgaaa

SEQ ID NO: 543755 - DNA, 13 bp, D. melanogaster
aaaactattggtt

SEQ ID NO: 543756 - DNA, 13 bp, D. melanogaster
aaaactattgtaa

SEQ ID NO: 543757 - DNA, 14 bp, D. melanogaster
aaaactatttattg

SEQ ID NO: 543758 - DNA, 13 bp, D. melanogaster
aaaactatttcaa

SEQ ID NO: 543759 - DNA, 13 bp, D. melanogaster
aaaactatttgca

SEQ ID NO: 543760 - DNA, 13 bp, D. melanogaster
aaaactatttgcc

SEQ ID NO: 543761 - DNA, 13 bp, D. melanogaster
aaaactattttac

SEQ ID NO: 543762 - DNA, 13 bp, D. melanogaster
aaaactattttca

SEQ ID NO: 543763 - DNA, 13 bp, D. melanogaster
aaaactatttttg

SEQ ID NO: 543764 - DNA, 13 bp, D. melanogaster
aaaactcaaactt

SEQ ID NO: 543765 - DNA, 13 bp, D. melanogaster
aaaactcaaattt

SEQ ID NO: 543766 - DNA, 14 bp, D. melanogaster
aaaactcaacgaga

SEQ ID NO: 543767 - DNA, 13 bp, D. melanogaster
aaaactcaatatt

SEQ ID NO: 543768 - DNA, 13 bp, D. melanogaster
aaaactcaatttg

SEQ ID NO: 543769 - DNA, 13 bp, D. melanogaster
aaaactcaatttt

SEQ ID NO: 543770 - DNA, 14 bp, D. melanogaster
aaaactcaattttc

SEQ ID NO: 543771 - DNA, 13 bp, D. melanogaster
aaaactcactcaa

SEQ ID NO: 543772 - DNA, 13 bp, D. melanogaster
aaaactcagacgc

SEQ ID NO: 543773 - DNA, 13 bp, D. melanogaster
aaaactcagtttt

SEQ ID NO: 543774 - DNA, 13 bp, D. melanogaster
aaaactcatcatt

SEQ ID NO: 543775 - DNA, 13 bp, D. melanogaster
aaaactcatttca

SEQ ID NO: 543776 - DNA, 13 bp, D. melanogaster
aaaactcatttgt

SEQ ID NO: 543777 - DNA, 13 bp, D. melanogaster
aaaactccaactc

SEQ ID NO: 543778 - DNA, 13 bp, D. melanogaster
aaaactccattta

SEQ ID NO: 543779 - DNA, 13 bp, D. melanogaster
aaaactcccaagt

SEQ ID NO: 543780 - DNA, 13 bp, D. melanogaster
aaaactcgaaaac

SEQ ID NO: 543781 - DNA, 13 bp, D. melanogaster
aaaactcgaaaat

SEQ ID NO: 543782 - DNA, 13 bp, D. melanogaster
aaaactcggaaaa

SEQ ID NO: 543783 - DNA, 13 bp, D. melanogaster
aaaactcgtattt

SEQ ID NO: 543784 - DNA, 13 bp, D. melanogaster
aaaactcgtttaa

SEQ ID NO: 543785 - DNA, 13 bp, D. melanogaster
aaaactctttaaa

SEQ ID NO: 543786 - DNA, 13 bp, D. melanogaster
aaaactctttatt

SEQ ID NO: 543787 - DNA, 13 bp, D. melanogaster
aaaactcttttaa

SEQ ID NO: 543788 - DNA, 14 bp, D. melanogaster
aaaactgaaaaact

SEQ ID NO: 543789 - DNA, 14 bp, D. melanogaster
aaaactgaaaaatc

SEQ ID NO: 543790 - DNA, 14 bp, D. melanogaster
aaaactgaaaacag

SEQ ID NO: 543791 - DNA, 14 bp, D. melanogaster
aaaactgaaaacca

SEQ ID NO: 543792 - DNA, 13 bp, D. melanogaster
aaaactgaaaact

SEQ ID NO: 543793 - DNA, 14 bp, D. melanogaster
aaaactgaaaacta

SEQ ID NO: 543794 - DNA, 14 bp, D. melanogaster
aaaactgaaaactg

SEQ ID NO: 543795 - DNA, 13 bp, D. melanogaster
aaaactgaaaagc

SEQ ID NO: 543796 - DNA, 14 bp, D. melanogaster
aaaactgaaaatat

SEQ ID NO: 543797 - DNA, 13 bp, D. melanogaster
aaaactgaaaatt

SEQ ID NO: 543798 - DNA, 13 bp, D. melanogaster
aaaactgaaacat

SEQ ID NO: 543799 - DNA, 13 bp, D. melanogaster
aaaactgaaacga

SEQ ID NO: 543800 - DNA, 13 bp, D. melanogaster
aaaactgaaacta

SEQ ID NO: 543801 - DNA, 13 bp, D. melanogaster
aaaactgaaactg

SEQ ID NO: 543802 - DNA, 14 bp, D. melanogaster
aaaactgaaactga

SEQ ID NO: 543803 - DNA, 13 bp, D. melanogaster
aaaactgaaagca

SEQ ID NO: 543804 - DNA, 13 bp, D. melanogaster
aaaactgaaagct

SEQ ID NO: 543805 - DNA, 14 bp, D. melanogaster
aaaactgaaatatt

SEQ ID NO: 543806 - DNA, 13 bp, D. melanogaster
aaaactgaaatca

SEQ ID NO: 543807 - DNA, 13 bp, D. melanogaster
aaaactgaaatta

SEQ ID NO: 543808 - DNA, 13 bp, D. melanogaster
aaaactgaaattg

SEQ ID NO: 543809 - DNA, 13 bp, D. melanogaster
aaaactgaagcaa

SEQ ID NO: 543810 - DNA, 13 bp, D. melanogaster
aaaactgaagcta

SEQ ID NO: 543811 - DNA, 13 bp, D. melanogaster
aaaactgaatatg

SEQ ID NO: 543812 - DNA, 13 bp, D. melanogaster
aaaactgaatgaa

SEQ ID NO: 543813 - DNA, 13 bp, D. melanogaster
aaaactgaattaa

SEQ ID NO: 543814 - DNA, 14 bp, D. melanogaster
aaaactgaattaaa

SEQ ID NO: 543815 - DNA, 14 bp, D. melanogaster
aaaactgaattgaa

SEQ ID NO: 543816 - DNA, 13 bp, D. melanogaster
aaaactgaatttt

SEQ ID NO: 543817 - DNA, 13 bp, D. melanogaster
aaaactgacattt

SEQ ID NO: 543818 - DNA, 13 bp, D. melanogaster
aaaactgagaact

SEQ ID NO: 543819 - DNA, 14 bp, D. melanogaster
aaaactgaggaaaa

SEQ ID NO: 543820 - DNA, 13 bp, D. melanogaster
aaaactgagtttt

SEQ ID NO: 543821 - DNA, 13 bp, D. melanogaster
aaaactgattaaa

SEQ ID NO: 543822 - DNA, 14 bp, D. melanogaster
aaaactgattaaaa

SEQ ID NO: 543823 - DNA, 13 bp, D. melanogaster
aaaactgattaat

SEQ ID NO: 543824 - DNA, 13 bp, D. melanogaster
aaaactgatttca

SEQ ID NO: 543825 - DNA, 13 bp, D. melanogaster
aaaactgatttcg

SEQ ID NO: 543826 - DNA, 13 bp, D. melanogaster
aaaactgatttta

SEQ ID NO: 543827 - DNA, 14 bp, D. melanogaster
aaaactgattttat

SEQ ID NO: 543828 - DNA, 13 bp, D. melanogaster
aaaactgattttt

SEQ ID NO: 543829 - DNA, 14 bp, D. melanogaster
aaaactgatttttt

SEQ ID NO: 543830 - DNA, 13 bp, D. melanogaster
aaaactgcaaaag

SEQ ID NO: 543831 - DNA, 13 bp, D. melanogaster
aaaactgcaactg

SEQ ID NO: 543832 - DNA, 13 bp, D. melanogaster
aaaactgcaagtg

SEQ ID NO: 543833 - DNA, 13 bp, D. melanogaster
aaaactgcacaaa

SEQ ID NO: 543834 - DNA, 13 bp, D. melanogaster
aaaactgcacaca

SEQ ID NO: 543835 - DNA, 13 bp, D. melanogaster
aaaactgcactgc

SEQ ID NO: 543836 - DNA, 13 bp, D. melanogaster
aaaactgcacttt

SEQ ID NO: 543837 - DNA, 13 bp, D. melanogaster
aaaactgcagcag

SEQ ID NO: 543838 - DNA, 13 bp, D. melanogaster
aaaactgcagcca

SEQ ID NO: 543839 - DNA, 13 bp, D. melanogaster
aaaactgcagcgc

SEQ ID NO: 543840 - DNA, 14 bp, D. melanogaster
aaaactgcagcgca

SEQ ID NO: 543841 - DNA, 13 bp, D. melanogaster
aaaactgcagttt

SEQ ID NO: 543842 - DNA, 13 bp, D. melanogaster
aaaactgcataaa

SEQ ID NO: 543843 - DNA, 13 bp, D. melanogaster
aaaactgcatatt

SEQ ID NO: 543844 - DNA, 13 bp, D. melanogaster
aaaactgcattca

SEQ ID NO: 543845 - DNA, 13 bp, D. melanogaster
aaaactgcattta

SEQ ID NO: 543846 - DNA, 14 bp, D. melanogaster
aaaactgcatttac

SEQ ID NO: 543847 - DNA, 13 bp, D. melanogaster
aaaactgcatttc

SEQ ID NO: 543848 - DNA, 13 bp, D. melanogaster
aaaactgccaaaa

SEQ ID NO: 543849 - DNA, 13 bp, D. melanogaster
aaaactgccaacg

SEQ ID NO: 543850 - DNA, 13 bp, D. melanogaster
aaaactgccaact

SEQ ID NO: 543851 - DNA, 13 bp, D. melanogaster
aaaactgcgccac

SEQ ID NO: 543852 - DNA, 13 bp, D. melanogaster
aaaactgctaaaa

SEQ ID NO: 543853 - DNA, 13 bp, D. melanogaster
aaaactgctgaaa

SEQ ID NO: 543854 - DNA, 13 bp, D. melanogaster
aaaactggaaata

SEQ ID NO: 543855 - DNA, 13 bp, D. melanogaster
aaaactggaactg

SEQ ID NO: 543856 - DNA, 13 bp, D. melanogaster
aaaactggacgtg

SEQ ID NO: 543857 - DNA, 13 bp, D. melanogaster
aaaactggagaaa

SEQ ID NO: 543858 - DNA, 13 bp, D. melanogaster
aaaactggagcaa

SEQ ID NO: 543859 - DNA, 14 bp, D. melanogaster
aaaactggaggagg

SEQ ID NO: 543860 - DNA, 13 bp, D. melanogaster
aaaactggatttt

SEQ ID NO: 543861 - DNA, 13 bp, D. melanogaster
aaaactggcaaaa

SEQ ID NO: 543862 - DNA, 14 bp, D. melanogaster
aaaactggcaactg

SEQ ID NO: 543863 - DNA, 13 bp, D. melanogaster
aaaactgggaaat

SEQ ID NO: 543864 - DNA, 13 bp, D. melanogaster
aaaactgggcaaa

SEQ ID NO: 543865 - DNA, 13 bp, D. melanogaster
aaaactggttgct

SEQ ID NO: 543866 - DNA, 13 bp, D. melanogaster
aaaactggttttc

SEQ ID NO: 543867 - DNA, 13 bp, D. melanogaster
aaaactgtaatta

SEQ ID NO: 543868 - DNA, 13 bp, D. melanogaster
aaaactgtcaaaa

SEQ ID NO: 543869 - DNA, 13 bp, D. melanogaster
aaaactgtcaaca

SEQ ID NO: 543870 - DNA, 14 bp, D. melanogaster
aaaactgtgaaaaa

SEQ ID NO: 543871 - DNA, 13 bp, D. melanogaster
aaaactgtgaaat

SEQ ID NO: 543872 - DNA, 13 bp, D. melanogaster
aaaactgtgagaa

SEQ ID NO: 543873 - DNA, 13 bp, D. melanogaster
aaaactgtgcaaa

SEQ ID NO: 543874 - DNA, 13 bp, D. melanogaster
aaaactgtgccaa

SEQ ID NO: 543875 - DNA, 13 bp, D. melanogaster
aaaactgtggaaa

SEQ ID NO: 543876 - DNA, 13 bp, D. melanogaster
aaaactgtgtaaa

SEQ ID NO: 543877 - DNA, 13 bp, D. melanogaster
aaaactgtgtttt

SEQ ID NO: 543878 - DNA, 13 bp, D. melanogaster
aaaactgttaaaa

SEQ ID NO: 543879 - DNA, 14 bp, D. melanogaster
aaaactgttaaaaa

SEQ ID NO: 543880 - DNA, 13 bp, D. melanogaster
aaaactgttaaat

SEQ ID NO: 543881 - DNA, 13 bp, D. melanogaster
aaaactgttaatt

SEQ ID NO: 543882 - DNA, 13 bp, D. melanogaster
aaaactgttatta

SEQ ID NO: 543883 - DNA, 13 bp, D. melanogaster
aaaactgttcaaa

SEQ ID NO: 543884 - DNA, 13 bp, D. melanogaster
aaaactgttcgaa

SEQ ID NO: 543885 - DNA, 14 bp, D. melanogaster
aaaactgttgaaaa

SEQ ID NO: 543886 - DNA, 13 bp, D. melanogaster
aaaactgttgaca

SEQ ID NO: 543887 - DNA, 13 bp, D. melanogaster
aaaactgttgcaa

SEQ ID NO: 543888 - DNA, 13 bp, D. melanogaster
aaaactgttgtaa

SEQ ID NO: 543889 - DNA, 13 bp, D. melanogaster
aaaactgtttact

SEQ ID NO: 543890 - DNA, 13 bp, D. melanogaster
aaaactgtttatt

SEQ ID NO: 543891 - DNA, 13 bp, D. melanogaster
aaaactgtttcaa

SEQ ID NO: 543892 - DNA, 13 bp, D. melanogaster
aaaactgtttcgg

SEQ ID NO: 543893 - DNA, 14 bp, D. melanogaster
aaaactgtttcgga

SEQ ID NO: 543894 - DNA, 13 bp, D. melanogaster
aaaactgtttgaa

SEQ ID NO: 543895 - DNA, 13 bp, D. melanogaster
aaaactgttttat

SEQ ID NO: 543896 - DNA, 13 bp, D. melanogaster
aaaactgttttca

SEQ ID NO: 543897 - DNA, 13 bp, D. melanogaster
aaaactgtttttc

SEQ ID NO: 543898 - DNA, 14 bp, D. melanogaster
aaaactgtttttcg

SEQ ID NO: 543899 - DNA, 13 bp, D. melanogaster
aaaacttaaagtc

SEQ ID NO: 543900 - DNA, 13 bp, D. melanogaster
aaaacttaaagtt

SEQ ID NO: 543901 - DNA, 13 bp, D. melanogaster
aaaacttaacgaa

SEQ ID NO: 543902 - DNA, 13 bp, D. melanogaster
aaaacttaactga

SEQ ID NO: 543903 - DNA, 13 bp, D. melanogaster
aaaacttaacttt

SEQ ID NO: 543904 - DNA, 13 bp, D. melanogaster
aaaacttaagatt

SEQ ID NO: 543905 - DNA, 13 bp, D. melanogaster
aaaacttaagcat

SEQ ID NO: 543906 - DNA, 13 bp, D. melanogaster
aaaacttaagcga

SEQ ID NO: 543907 - DNA, 13 bp, D. melanogaster
aaaacttaaggct

SEQ ID NO: 543908 - DNA, 13 bp, D. melanogaster
aaaacttaaggtt

SEQ ID NO: 543909 - DNA, 14 bp, D. melanogaster
aaaacttaatgaaa

SEQ ID NO: 543910 - DNA, 13 bp, D. melanogaster
aaaacttaatgct

SEQ ID NO: 543911 - DNA, 13 bp, D. melanogaster
aaaacttaattca

SEQ ID NO: 543912 - DNA, 13 bp, D. melanogaster
aaaacttaatttc

SEQ ID NO: 543913 - DNA, 13 bp, D. melanogaster
aaaacttattcaa

SEQ ID NO: 543914 - DNA, 13 bp, D. melanogaster
aaaacttattttc

SEQ ID NO: 543915 - DNA, 13 bp, D. melanogaster
aaaacttcaaagt

SEQ ID NO: 543916 - DNA, 13 bp, D. melanogaster
aaaacttcacatc

SEQ ID NO: 543917 - DNA, 13 bp, D. melanogaster
aaaacttcagcct

SEQ ID NO: 543918 - DNA, 13 bp, D. melanogaster
aaaacttcagggg

SEQ ID NO: 543919 - DNA, 13 bp, D. melanogaster
aaaacttcagttt

SEQ ID NO: 543920 - DNA, 13 bp, D. melanogaster
aaaacttcttaaa

SEQ ID NO: 543921 - DNA, 13 bp, D. melanogaster
aaaacttcttgaa

SEQ ID NO: 543922 - DNA, 14 bp, D. melanogaster
aaaacttcttgaag

SEQ ID NO: 543923 - DNA, 13 bp, D. melanogaster
aaaacttcttgtt

SEQ ID NO: 543924 - DNA, 13 bp, D. melanogaster
aaaacttctttaa

SEQ ID NO: 543925 - DNA, 13 bp, D. melanogaster
aaaacttgaaaac

SEQ ID NO: 543926 - DNA, 14 bp, D. melanogaster
aaaacttgaaaact

SEQ ID NO: 543927 - DNA, 13 bp, D. melanogaster
aaaacttgaaatt

SEQ ID NO: 543928 - DNA, 13 bp, D. melanogaster
aaaacttgaatat

SEQ ID NO: 543929 - DNA, 13 bp, D. melanogaster
aaaacttgaattc

SEQ ID NO: 543930 - DNA, 13 bp, D. melanogaster
aaaacttgaattt

SEQ ID NO: 543931 - DNA, 13 bp, D. melanogaster
aaaacttgagcaa

SEQ ID NO: 543932 - DNA, 13 bp, D. melanogaster
aaaacttgcaaaa

SEQ ID NO: 543933 - DNA, 13 bp, D. melanogaster
aaaacttgccaaa

SEQ ID NO: 543934 - DNA, 13 bp, D. melanogaster
aaaacttgccagg

SEQ ID NO: 543935 - DNA, 13 bp, D. melanogaster
aaaacttggaaaa

SEQ ID NO: 543936 - DNA, 13 bp, D. melanogaster
aaaacttggcaaa

SEQ ID NO: 543937 - DNA, 13 bp, D. melanogaster
aaaacttggccag

SEQ ID NO: 543938 - DNA, 13 bp, D. melanogaster
aaaacttggctaa

SEQ ID NO: 543939 - DNA, 13 bp, D. melanogaster
aaaacttgtaaaa

SEQ ID NO: 543940 - DNA, 13 bp, D. melanogaster
aaaacttgtattt

SEQ ID NO: 543941 - DNA, 13 bp, D. melanogaster
aaaacttgtgcat

SEQ ID NO: 543942 - DNA, 13 bp, D. melanogaster
aaaacttgttatt

SEQ ID NO: 543943 - DNA, 13 bp, D. melanogaster
aaaacttgttcaa

SEQ ID NO: 543944 - DNA, 13 bp, D. melanogaster
aaaacttgttggc

SEQ ID NO: 543945 - DNA, 13 bp, D. melanogaster
aaaacttgtttgc

SEQ ID NO: 543946 - DNA, 14 bp, D. melanogaster
aaaacttgtttttc

SEQ ID NO: 543947 - DNA, 13 bp, D. melanogaster
aaaactttaaaag

SEQ ID NO: 543948 - DNA, 13 bp, D. melanogaster
aaaactttaaact

SEQ ID NO: 543949 - DNA, 13 bp, D. melanogaster
aaaactttaaaga

SEQ ID NO: 543950 - DNA, 13 bp, D. melanogaster
aaaactttaaatg

SEQ ID NO: 543951 - DNA, 13 bp, D. melanogaster
aaaactttaattc

SEQ ID NO: 543952 - DNA, 13 bp, D. melanogaster
aaaactttaattg

SEQ ID NO: 543953 - DNA, 13 bp, D. melanogaster
aaaactttaccaa

SEQ ID NO: 543954 - DNA, 14 bp, D. melanogaster
aaaactttagtatt

SEQ ID NO: 543955 - DNA, 13 bp, D. melanogaster
aaaactttagttt

SEQ ID NO: 543956 - DNA, 13 bp, D. melanogaster
aaaactttatcaa

SEQ ID NO: 543957 - DNA, 13 bp, D. melanogaster
aaaactttcaagt

SEQ ID NO: 543958 - DNA, 13 bp, D. melanogaster
aaaactttcaatt

SEQ ID NO: 543959 - DNA, 13 bp, D. melanogaster
aaaactttcattt

SEQ ID NO: 543960 - DNA, 14 bp, D. melanogaster
aaaactttcatttt

SEQ ID NO: 543961 - DNA, 13 bp, D. melanogaster
aaaactttccaat

SEQ ID NO: 543962 - DNA, 14 bp, D. melanogaster
aaaactttccaata

SEQ ID NO: 543963 - DNA, 13 bp, D. melanogaster
aaaactttccatg

SEQ ID NO: 543964 - DNA, 13 bp, D. melanogaster
aaaactttcgaaa

SEQ ID NO: 543965 - DNA, 13 bp, D. melanogaster
aaaactttcgcat

SEQ ID NO: 543966 - DNA, 13 bp, D. melanogaster
aaaactttcgttt

SEQ ID NO: 543967 - DNA, 13 bp, D. melanogaster
aaaactttctaaa

SEQ ID NO: 543968 - DNA, 13 bp, D. melanogaster
aaaactttctgcc

SEQ ID NO: 543969 - DNA, 13 bp, D. melanogaster
aaaactttctgtg

SEQ ID NO: 543970 - DNA, 14 bp, D. melanogaster
aaaactttgaaaat

SEQ ID NO: 543971 - DNA, 13 bp, D. melanogaster
aaaactttgaact

SEQ ID NO: 543972 - DNA, 13 bp, D. melanogaster
aaaactttgacaa

SEQ ID NO: 543973 - DNA, 13 bp, D. melanogaster
aaaactttgacca

SEQ ID NO: 543974 - DNA, 13 bp, D. melanogaster
aaaactttgataa

SEQ ID NO: 543975 - DNA, 13 bp, D. melanogaster
aaaactttgatat

SEQ ID NO: 543976 - DNA, 13 bp, D. melanogaster
aaaactttgattt

SEQ ID NO: 543977 - DNA, 13 bp, D. melanogaster
aaaactttgcaac

SEQ ID NO: 543978 - DNA, 13 bp, D. melanogaster
aaaactttgcaca

SEQ ID NO: 543979 - DNA, 13 bp, D. melanogaster
aaaactttgccac

SEQ ID NO: 543980 - DNA, 13 bp, D. melanogaster
aaaactttgccga

SEQ ID NO: 543981 - DNA, 13 bp, D. melanogaster
aaaactttgcctt

SEQ ID NO: 543982 - DNA, 13 bp, D. melanogaster
aaaactttgcttt

SEQ ID NO: 543983 - DNA, 14 bp, D. melanogaster
aaaactttggataa

SEQ ID NO: 543984 - DNA, 13 bp, D. melanogaster
aaaactttggcaa

SEQ ID NO: 543985 - DNA, 13 bp, D. melanogaster
aaaactttggcca

SEQ ID NO: 543986 - DNA, 14 bp, D. melanogaster
aaaactttggccaa

SEQ ID NO: 543987 - DNA, 13 bp, D. melanogaster
aaaactttgtcat

SEQ ID NO: 543988 - DNA, 13 bp, D. melanogaster
aaaactttgtgca

SEQ ID NO: 543989 - DNA, 13 bp, D. melanogaster
aaaactttgttaa

SEQ ID NO: 543990 - DNA, 13 bp, D. melanogaster
aaaactttgttca

SEQ ID NO: 543991 - DNA, 15 bp, D. melanogaster
aaaactttgttcacc

SEQ ID NO: 543992 - DNA, 13 bp, D. melanogaster
aaaactttgttta

SEQ ID NO: 543993 - DNA, 13 bp, D. melanogaster
aaaacttttaaac

SEQ ID NO: 543994 - DNA, 13 bp, D. melanogaster
aaaacttttacca

SEQ ID NO: 543995 - DNA, 13 bp, D. melanogaster
aaaacttttagaa

SEQ ID NO: 543996 - DNA, 14 bp, D. melanogaster
aaaacttttcaatt

SEQ ID NO: 543997 - DNA, 13 bp, D. melanogaster
aaaacttttcact

SEQ ID NO: 543998 - DNA, 13 bp, D. melanogaster
aaaacttttccac

SEQ ID NO: 543999 - DNA, 13 bp, D. melanogaster
aaaacttttccca

SEQ ID NO: 544000 - DNA, 13 bp, D. melanogaster
aaaacttttcccc

SEQ ID NO: 544001 - DNA, 13 bp, D. melanogaster
aaaacttttccga

SEQ ID NO: 544002 - DNA, 13 bp, D. melanogaster
aaaacttttccgc

SEQ ID NO: 544003 - DNA, 13 bp, D. melanogaster
aaaacttttcgcc

SEQ ID NO: 544004 - DNA, 14 bp, D. melanogaster
aaaacttttctaat

SEQ ID NO: 544005 - DNA, 13 bp, D. melanogaster
aaaacttttcttc

SEQ ID NO: 544006 - DNA, 13 bp, D. melanogaster
aaaacttttcttt

SEQ ID NO: 544007 - DNA, 13 bp, D. melanogaster
aaaacttttgaaa

SEQ ID NO: 544008 - DNA, 13 bp, D. melanogaster
aaaacttttgatt

SEQ ID NO: 544009 - DNA, 13 bp, D. melanogaster
aaaacttttgcaa

SEQ ID NO: 544010 - DNA, 14 bp, D. melanogaster
aaaacttttgcaat

SEQ ID NO: 544011 - DNA, 13 bp, D. melanogaster
aaaacttttgcac

SEQ ID NO: 544012 - DNA, 13 bp, D. melanogaster
aaaacttttgcat

SEQ ID NO: 544013 - DNA, 13 bp, D. melanogaster
aaaacttttgcca

SEQ ID NO: 544014 - DNA, 14 bp, D. melanogaster
aaaacttttgccaa

SEQ ID NO: 544015 - DNA, 13 bp, D. melanogaster
aaaacttttggca

SEQ ID NO: 544016 - DNA, 13 bp, D. melanogaster
aaaacttttggcc

SEQ ID NO: 544017 - DNA, 13 bp, D. melanogaster
aaaacttttggct

SEQ ID NO: 544018 - DNA, 13 bp, D. melanogaster
aaaacttttggta

SEQ ID NO: 544019 - DNA, 13 bp, D. melanogaster
aaaacttttgtaa

SEQ ID NO: 544020 - DNA, 13 bp, D. melanogaster
aaaactttttaca

SEQ ID NO: 544021 - DNA, 13 bp, D. melanogaster
aaaactttttagc

SEQ ID NO: 544022 - DNA, 13 bp, D. melanogaster
aaaactttttcaa

SEQ ID NO: 544023 - DNA, 13 bp, D. melanogaster
aaaactttttcat

SEQ ID NO: 544024 - DNA, 13 bp, D. melanogaster
aaaactttttcca

SEQ ID NO: 544025 - DNA, 13 bp, D. melanogaster
aaaactttttgaa

SEQ ID NO: 544026 - DNA, 13 bp, D. melanogaster
aaaactttttgca

SEQ ID NO: 544027 - DNA, 14 bp, D. melanogaster
aaaactttttgcat

SEQ ID NO: 544028 - DNA, 13 bp, D. melanogaster
aaaactttttgcc

SEQ ID NO: 544029 - DNA, 14 bp, D. melanogaster
aaaactttttgccc

SEQ ID NO: 544030 - DNA, 14 bp, D. melanogaster
aaaactttttgttt

SEQ ID NO: 544031 - DNA, 13 bp, D. melanogaster
aaaagaaaacgct

SEQ ID NO: 544032 - DNA, 13 bp, D. melanogaster
aaaagaaaacgtt

SEQ ID NO: 544033 - DNA, 14 bp, D. melanogaster
aaaagaaaactatt

SEQ ID NO: 544034 - DNA, 13 bp, D. melanogaster
aaaagaaaactct

SEQ ID NO: 544035 - DNA, 13 bp, D. melanogaster
aaaagaaaactgc

SEQ ID NO: 544036 - DNA, 13 bp, D. melanogaster
aaaagaaaacttg

SEQ ID NO: 544037 - DNA, 13 bp, D. melanogaster
aaaagaaaacttt

SEQ ID NO: 544038 - DNA, 14 bp, D. melanogaster
aaaagaaaactttt

SEQ ID NO: 544039 - DNA, 13 bp, D. melanogaster
aaaagaaaagtcg

SEQ ID NO: 544040 - DNA, 13 bp, D. melanogaster
aaaagaaaatccc

SEQ ID NO: 544041 - DNA, 13 bp, D. melanogaster
aaaagaaaatctc

SEQ ID NO: 544042 - DNA, 13 bp, D. melanogaster
aaaagaaaatgct

SEQ ID NO: 544043 - DNA, 13 bp, D. melanogaster
aaaagaaaatggc

SEQ ID NO: 544044 - DNA, 14 bp, D. melanogaster
aaaagaaaatggca

SEQ ID NO: 544045 - DNA, 13 bp, D. melanogaster
aaaagaaaattct

SEQ ID NO: 544046 - DNA, 13 bp, D. melanogaster
aaaagaaaattgc

SEQ ID NO: 544047 - DNA, 13 bp, D. melanogaster
aaaagaaaatttc

SEQ ID NO: 544048 - DNA, 14 bp, D. melanogaster
aaaagaaacaattt

SEQ ID NO: 544049 - DNA, 13 bp, D. melanogaster
aaaagaaacattt

SEQ ID NO: 544050 - DNA, 13 bp, D. melanogaster
aaaagaaaccatt

SEQ ID NO: 544051 - DNA, 13 bp, D. melanogaster
aaaagaaaccttt

SEQ ID NO: 544052 - DNA, 13 bp, D. melanogaster
aaaagaaactttt

SEQ ID NO: 544053 - DNA, 13 bp, D. melanogaster
aaaagaaagcttt

SEQ ID NO: 544054 - DNA, 13 bp, D. melanogaster
aaaagaaagtttt

SEQ ID NO: 544055 - DNA, 14 bp, D. melanogaster
aaaagaaagttttt

SEQ ID NO: 544056 - DNA, 14 bp, D. melanogaster
aaaagaaatcaatt

SEQ ID NO: 544057 - DNA, 13 bp, D. melanogaster
aaaagaaatccca

SEQ ID NO: 544058 - DNA, 13 bp, D. melanogaster
aaaagaaatcgca

SEQ ID NO: 544059 - DNA, 13 bp, D. melanogaster
aaaagaaatcgtt

SEQ ID NO: 544060 - DNA, 13 bp, D. melanogaster
aaaagaaatgcat

SEQ ID NO: 544061 - DNA, 13 bp, D. melanogaster
aaaagaaatgcca

SEQ ID NO: 544062 - DNA, 13 bp, D. melanogaster
aaaagaaatgttt

SEQ ID NO: 544063 - DNA, 13 bp, D. melanogaster
aaaagaaatttgt

SEQ ID NO: 544064 - DNA, 13 bp, D. melanogaster
aaaagaactgaat

SEQ ID NO: 544065 - DNA, 13 bp, D. melanogaster
aaaagaactgcta

SEQ ID NO: 544066 - DNA, 13 bp, D. melanogaster
aaaagaactttaa

SEQ ID NO: 544067 - DNA, 13 bp, D. melanogaster
aaaagaactttgg

SEQ ID NO: 544068 - DNA, 14 bp, D. melanogaster
aaaagaactttggc

SEQ ID NO: 544069 - DNA, 13 bp, D. melanogaster
aaaagaacttttt

SEQ ID NO: 544070 - DNA, 13 bp, D. melanogaster
aaaagaagacatt

SEQ ID NO: 544071 - DNA, 13 bp, D. melanogaster
aaaagaagactca

SEQ ID NO: 544072 - DNA, 14 bp, D. melanogaster
aaaagaagaggatc

SEQ ID NO: 544073 - DNA, 13 bp, D. melanogaster
aaaagaagattct

SEQ ID NO: 544074 - DNA, 13 bp, D. melanogaster
aaaagaagcaatg

SEQ ID NO: 544075 - DNA, 13 bp, D. melanogaster
aaaagaagctata

SEQ ID NO: 544076 - DNA, 13 bp, D. melanogaster
aaaagaagctgaa

SEQ ID NO: 544077 - DNA, 13 bp, D. melanogaster
aaaagaagtgctg

SEQ ID NO: 544078 - DNA, 13 bp, D. melanogaster
aaaagaatatgct

SEQ ID NO: 544079 - DNA, 13 bp, D. melanogaster
aaaagaatctttt

SEQ ID NO: 544080 - DNA, 15 bp, D. melanogaster
aaaagaatcttttat

SEQ ID NO: 544081 - DNA, 13 bp, D. melanogaster
aaaagaatgtcaa

SEQ ID NO: 544082 - DNA, 13 bp, D. melanogaster
aaaagaattcaat

SEQ ID NO: 544083 - DNA, 13 bp, D. melanogaster
aaaagaattcatt

SEQ ID NO: 544084 - DNA, 13 bp, D. melanogaster
aaaagaattcgaa

SEQ ID NO: 544085 - DNA, 13 bp, D. melanogaster
aaaagaatttcaa

SEQ ID NO: 544086 - DNA, 13 bp, D. melanogaster
aaaagaatttcat

SEQ ID NO: 544087 - DNA, 13 bp, D. melanogaster
aaaagaatttcca

SEQ ID NO: 544088 - DNA, 13 bp, D. melanogaster
aaaagaatttgat

SEQ ID NO: 544089 - DNA, 13 bp, D. melanogaster
aaaagaattttga

SEQ ID NO: 544090 - DNA, 14 bp, D. melanogaster
aaaagacaatacac

SEQ ID NO: 544091 - DNA, 13 bp, D. melanogaster
aaaagacaatttt

SEQ ID NO: 544092 - DNA, 13 bp, D. melanogaster
aaaagacattgtt

SEQ ID NO: 544093 - DNA, 13 bp, D. melanogaster
aaaagacatttta

SEQ ID NO: 544094 - DNA, 13 bp, D. melanogaster
aaaagacttttta

SEQ ID NO: 544095 - DNA, 13 bp, D. melanogaster
aaaagagaaagct

SEQ ID NO: 544096 - DNA, 13 bp, D. melanogaster
aaaagagcaccga

SEQ ID NO: 544097 - DNA, 13 bp, D. melanogaster
aaaagagcagcag

SEQ ID NO: 544098 - DNA, 13 bp, D. melanogaster
aaaagagcgttga

SEQ ID NO: 544099 - DNA, 13 bp, D. melanogaster
aaaagagcttaaa

SEQ ID NO: 544100 - DNA, 13 bp, D. melanogaster
aaaagaggcggca

SEQ ID NO: 544101 - DNA, 13 bp, D. melanogaster
aaaagagtatttt

SEQ ID NO: 544102 - DNA, 13 bp, D. melanogaster
aaaagagtcaaca

SEQ ID NO: 544103 - DNA, 13 bp, D. melanogaster
aaaagagtgcaaa

SEQ ID NO: 544104 - DNA, 13 bp, D. melanogaster
aaaagagtgcaag

SEQ ID NO: 544105 - DNA, 13 bp, D. melanogaster
aaaagagttaatt

SEQ ID NO: 544106 - DNA, 13 bp, D. melanogaster
aaaagagttagat

SEQ ID NO: 544107 - DNA, 13 bp, D. melanogaster
aaaagagttcgaa

SEQ ID NO: 544108 - DNA, 13 bp, D. melanogaster
aaaagagttctta

SEQ ID NO: 544109 - DNA, 13 bp, D. melanogaster
aaaagagttgaca

SEQ ID NO: 544110 - DNA, 13 bp, D. melanogaster
aaaagagttttta

SEQ ID NO: 544111 - DNA, 13 bp, D. melanogaster
aaaagatacaact

SEQ ID NO: 544112 - DNA, 14 bp, D. melanogaster
aaaagatacagata

SEQ ID NO: 544113 - DNA, 13 bp, D. melanogaster
aaaagatacatat

SEQ ID NO: 544114 - DNA, 13 bp, D. melanogaster
aaaagatacattt

SEQ ID NO: 544115 - DNA, 14 bp, D. melanogaster
aaaagatacattta

SEQ ID NO: 544116 - DNA, 13 bp, D. melanogaster
aaaagatactttt

SEQ ID NO: 544117 - DNA, 13 bp, D. melanogaster
aaaagatatgtat

SEQ ID NO: 544118 - DNA, 13 bp, D. melanogaster
aaaagatattctt

SEQ ID NO: 544119 - DNA, 13 bp, D. melanogaster
aaaagatatttac

SEQ ID NO: 544120 - DNA, 14 bp, D. melanogaster
aaaagatatttttg

SEQ ID NO: 544121 - DNA, 14 bp, D. melanogaster
aaaagatcaaaatg

SEQ ID NO: 544122 - DNA, 13 bp, D. melanogaster
aaaagatcactta

SEQ ID NO: 544123 - DNA, 13 bp, D. melanogaster
aaaagatgatgag

SEQ ID NO: 544124 - DNA, 13 bp, D. melanogaster
aaaagatgcccga

SEQ ID NO: 544125 - DNA, 13 bp, D. melanogaster
aaaagatgtaccg

SEQ ID NO: 544126 - DNA, 13 bp, D. melanogaster
aaaagatgtatat

SEQ ID NO: 544127 - DNA, 13 bp, D. melanogaster
aaaagatgtccaa

SEQ ID NO: 544128 - DNA, 13 bp, D. melanogaster
aaaagatgtctga

SEQ ID NO: 544129 - DNA, 14 bp, D. melanogaster
aaaagattaatgag

SEQ ID NO: 544130 - DNA, 13 bp, D. melanogaster
aaaagattattga

SEQ ID NO: 544131 - DNA, 13 bp, D. melanogaster
aaaagattcaaat

SEQ ID NO: 544132 - DNA, 13 bp, D. melanogaster
aaaagattcagat

SEQ ID NO: 544133 - DNA, 13 bp, D. melanogaster
aaaagattccaaa

SEQ ID NO: 544134 - DNA, 13 bp, D. melanogaster
aaaagattgttaa

SEQ ID NO: 544135 - DNA, 13 bp, D. melanogaster
aaaagatttcaat

SEQ ID NO: 544136 - DNA, 13 bp, D. melanogaster
aaaagattttcat

SEQ ID NO: 544137 - DNA, 13 bp, D. melanogaster
aaaagattttccc

SEQ ID NO: 544138 - DNA, 14 bp, D. melanogaster
aaaagattttccca

SEQ ID NO: 544139 - DNA, 13 bp, D. melanogaster
aaaagattttgtt

SEQ ID NO: 544140 - DNA, 13 bp, D. melanogaster
aaaagatttttgc

SEQ ID NO: 544141 - DNA, 14 bp, D. melanogaster
aaaagcaaaaagtt

SEQ ID NO: 544142 - DNA, 13 bp, D. melanogaster
aaaagcaaaactt

SEQ ID NO: 544143 - DNA, 14 bp, D. melanogaster
aaaagcaaaagcat

SEQ ID NO: 544144 - DNA, 13 bp, D. melanogaster
aaaagcaaaagct

SEQ ID NO: 544145 - DNA, 14 bp, D. melanogaster
aaaagcaaaagtca

SEQ ID NO: 544146 - DNA, 13 bp, D. melanogaster
aaaagcaaaagtt

SEQ ID NO: 544147 - DNA, 14 bp, D. melanogaster
aaaagcaaaatatt

SEQ ID NO: 544148 - DNA, 13 bp, D. melanogaster
aaaagcaaaatcg

SEQ ID NO: 544149 - DNA, 13 bp, D. melanogaster
aaaagcaaaattt

SEQ ID NO: 544150 - DNA, 13 bp, D. melanogaster
aaaagcaaacagt

SEQ ID NO: 544151 - DNA, 13 bp, D. melanogaster
aaaagcaaacatt

SEQ ID NO: 544152 - DNA, 13 bp, D. melanogaster
aaaagcaaactca

SEQ ID NO: 544153 - DNA, 14 bp, D. melanogaster
aaaagcaaagcaat

SEQ ID NO: 544154 - DNA, 13 bp, D. melanogaster
aaaagcaaagcgc

SEQ ID NO: 544155 - DNA, 13 bp, D. melanogaster
aaaagcaaagtga

SEQ ID NO: 544156 - DNA, 14 bp, D. melanogaster
aaaagcaaatattt

SEQ ID NO: 544157 - DNA, 13 bp, D. melanogaster
aaaagcaaatgga

SEQ ID NO: 544158 - DNA, 14 bp, D. melanogaster
aaaagcaaatggaa

SEQ ID NO: 544159 - DNA, 13 bp, D. melanogaster
aaaagcaaatgtc

SEQ ID NO: 544160 - DNA, 13 bp, D. melanogaster
aaaagcaaattat

SEQ ID NO: 544161 - DNA, 13 bp, D. melanogaster
aaaagcaaattca

SEQ ID NO: 544162 - DNA, 13 bp, D. melanogaster
aaaagcaaatttc

SEQ ID NO: 544163 - DNA, 13 bp, D. melanogaster
aaaagcaacaatg

SEQ ID NO: 544164 - DNA, 14 bp, D. melanogaster
aaaagcaacaatta

SEQ ID NO: 544165 - DNA, 14 bp, D. melanogaster
aaaagcaacagcag

SEQ ID NO: 544166 - DNA, 13 bp, D. melanogaster
aaaagcaacatca

SEQ ID NO: 544167 - DNA, 13 bp, D. melanogaster
aaaagcaacatta

SEQ ID NO: 544168 - DNA, 13 bp, D. melanogaster
aaaagcaactgaa

SEQ ID NO: 544169 - DNA, 13 bp, D. melanogaster
aaaagcaactgca

SEQ ID NO: 544170 - DNA, 13 bp, D. melanogaster
aaaagcaagcaat

SEQ ID NO: 544171 - DNA, 13 bp, D. melanogaster
aaaagcaagtgaa

SEQ ID NO: 544172 - DNA, 13 bp, D. melanogaster
aaaagcaagtggc

SEQ ID NO: 544173 - DNA, 13 bp, D. melanogaster
aaaagcaatatat

SEQ ID NO: 544174 - DNA, 13 bp, D. melanogaster
aaaagcaatattt

SEQ ID NO: 544175 - DNA, 13 bp, D. melanogaster
aaaagcaatcagt

SEQ ID NO: 544176 - DNA, 13 bp, D. melanogaster
aaaagcaatctca

SEQ ID NO: 544177 - DNA, 13 bp, D. melanogaster
aaaagcaatgaca

SEQ ID NO: 544178 - DNA, 13 bp, D. melanogaster
aaaagcaatggaa

SEQ ID NO: 544179 - DNA, 13 bp, D. melanogaster
aaaagcaatggca

SEQ ID NO: 544180 - DNA, 13 bp, D. melanogaster
aaaagcaattaat

SEQ ID NO: 544181 - DNA, 13 bp, D. melanogaster
aaaagcaattata

SEQ ID NO: 544182 - DNA, 13 bp, D. melanogaster
aaaagcaattatt

SEQ ID NO: 544183 - DNA, 13 bp, D. melanogaster
aaaagcaattcca

SEQ ID NO: 544184 - DNA, 13 bp, D. melanogaster
aaaagcaattgaa

SEQ ID NO: 544185 - DNA, 13 bp, D. melanogaster
aaaagcaatttga

SEQ ID NO: 544186 - DNA, 13 bp, D. melanogaster
aaaagcaatttta

SEQ ID NO: 544187 - DNA, 13 bp, D. melanogaster
aaaagcaattttc

SEQ ID NO: 544188 - DNA, 13 bp, D. melanogaster
aaaagcacatgct

SEQ ID NO: 544189 - DNA, 13 bp, D. melanogaster
aaaagcactgaaa

SEQ ID NO: 544190 - DNA, 13 bp, D. melanogaster
aaaagcacttcaa

SEQ ID NO: 544191 - DNA, 14 bp, D. melanogaster
aaaagcagcagcaa

SEQ ID NO: 544192 - DNA, 13 bp, D. melanogaster
aaaagcagcagcc

SEQ ID NO: 544193 - DNA, 13 bp, D. melanogaster
aaaagcagccaca

SEQ ID NO: 544194 - DNA, 13 bp, D. melanogaster
aaaagcagcgcag

SEQ ID NO: 544195 - DNA, 13 bp, D. melanogaster
aaaagcagcggaa

SEQ ID NO: 544196 - DNA, 13 bp, D. melanogaster
aaaagcagcggca

SEQ ID NO: 544197 - DNA, 13 bp, D. melanogaster
aaaagcagcgggg

SEQ ID NO: 544198 - DNA, 13 bp, D. melanogaster
aaaagcagctaaa

SEQ ID NO: 544199 - DNA, 13 bp, D. melanogaster
aaaagcagcttaa

SEQ ID NO: 544200 - DNA, 14 bp, D. melanogaster
aaaagcaggaaaat

SEQ ID NO: 544201 - DNA, 13 bp, D. melanogaster
aaaagcaggcaac

SEQ ID NO: 544202 - DNA, 13 bp, D. melanogaster
aaaagcaggcagc

SEQ ID NO: 544203 - DNA, 13 bp, D. melanogaster
aaaagcaggcgaa

SEQ ID NO: 544204 - DNA, 13 bp, D. melanogaster
aaaagcagtgaaa

SEQ ID NO: 544205 - DNA, 13 bp, D. melanogaster
aaaagcagttaaa

SEQ ID NO: 544206 - DNA, 13 bp, D. melanogaster
aaaagcatacata

SEQ ID NO: 544207 - DNA, 13 bp, D. melanogaster
aaaagcatattta

SEQ ID NO: 544208 - DNA, 13 bp, D. melanogaster
aaaagcatatttc

SEQ ID NO: 544209 - DNA, 13 bp, D. melanogaster
aaaagcatatttt

SEQ ID NO: 544210 - DNA, 13 bp, D. melanogaster
aaaagcatcaaat

SEQ ID NO: 544211 - DNA, 13 bp, D. melanogaster
aaaagcatcaaca

SEQ ID NO: 544212 - DNA, 13 bp, D. melanogaster
aaaagcatgcaaa

SEQ ID NO: 544213 - DNA, 13 bp, D. melanogaster
aaaagcatgccaa

SEQ ID NO: 544214 - DNA, 13 bp, D. melanogaster
aaaagcattaata

SEQ ID NO: 544215 - DNA, 13 bp, D. melanogaster
aaaagcattaatt

SEQ ID NO: 544216 - DNA, 13 bp, D. melanogaster
aaaagcattcaaa

SEQ ID NO: 544217 - DNA, 13 bp, D. melanogaster
aaaagcattcagc

SEQ ID NO: 544218 - DNA, 13 bp, D. melanogaster
aaaagcattcgaa

SEQ ID NO: 544219 - DNA, 13 bp, D. melanogaster
aaaagcattgaga

SEQ ID NO: 544220 - DNA, 13 bp, D. melanogaster
aaaagcatttaaa

SEQ ID NO: 544221 - DNA, 14 bp, D. melanogaster
aaaagcatttaaaa

SEQ ID NO: 544222 - DNA, 13 bp, D. melanogaster
aaaagcatttgca

SEQ ID NO: 544223 - DNA, 13 bp, D. melanogaster
aaaagcatttgcc

SEQ ID NO: 544224 - DNA, 13 bp, D. melanogaster
aaaagcatttgga

SEQ ID NO: 544225 - DNA, 13 bp, D. melanogaster
aaaagcatttggc

SEQ ID NO: 544226 - DNA, 13 bp, D. melanogaster
aaaagcatttgta

SEQ ID NO: 544227 - DNA, 13 bp, D. melanogaster
aaaagcatttgtt

SEQ ID NO: 544228 - DNA, 13 bp, D. melanogaster
aaaagcattttaa

SEQ ID NO: 544229 - DNA, 14 bp, D. melanogaster
aaaagcattttaaa

SEQ ID NO: 544230 - DNA, 13 bp, D. melanogaster
aaaagcattttca

SEQ ID NO: 544231 - DNA, 13 bp, D. melanogaster
aaaagcatttttc

SEQ ID NO: 544232 - DNA, 13 bp, D. melanogaster
aaaagcatttttg

SEQ ID NO: 544233 - DNA, 14 bp, D. melanogaster
aaaagccaaaaagt

SEQ ID NO: 544234 - DNA, 13 bp, D. melanogaster
aaaagccaaaact

SEQ ID NO: 544235 - DNA, 13 bp, D. melanogaster
aaaagccaaaagt

SEQ ID NO: 544236 - DNA, 13 bp, D. melanogaster
aaaagccaaaatg

SEQ ID NO: 544237 - DNA, 13 bp, D. melanogaster
aaaagccaaaggc

SEQ ID NO: 544238 - DNA, 14 bp, D. melanogaster
aaaagccaaaggca

SEQ ID NO: 544239 - DNA, 13 bp, D. melanogaster
aaaagccaaagtt

SEQ ID NO: 544240 - DNA, 13 bp, D. melanogaster
aaaagccaaatgc

SEQ ID NO: 544241 - DNA, 13 bp, D. melanogaster
aaaagccaacagc

SEQ ID NO: 544242 - DNA, 13 bp, D. melanogaster
aaaagccaaccga

SEQ ID NO: 544243 - DNA, 13 bp, D. melanogaster
aaaagccaactaa

SEQ ID NO: 544244 - DNA, 13 bp, D. melanogaster
aaaagccaagagc

SEQ ID NO: 544245 - DNA, 13 bp, D. melanogaster
aaaagccaagctg

SEQ ID NO: 544246 - DNA, 13 bp, D. melanogaster
aaaagccaagtgg

SEQ ID NO: 544247 - DNA, 13 bp, D. melanogaster
aaaagccaatgaa

SEQ ID NO: 544248 - DNA, 13 bp, D. melanogaster
aaaagccaattaa

SEQ ID NO: 544249 - DNA, 13 bp, D. melanogaster
aaaagccaattta

SEQ ID NO: 544250 - DNA, 13 bp, D. melanogaster
aaaagccaccgaa

SEQ ID NO: 544251 - DNA, 13 bp, D. melanogaster
aaaagccagagag

SEQ ID NO: 544252 - DNA, 13 bp, D. melanogaster
aaaagccagccaa

SEQ ID NO: 544253 - DNA, 13 bp, D. melanogaster
aaaagccagcgac

SEQ ID NO: 544254 - DNA, 13 bp, D. melanogaster
aaaagccagcgag

SEQ ID NO: 544255 - DNA, 13 bp, D. melanogaster
aaaagccagtcaa

SEQ ID NO: 544256 - DNA, 13 bp, D. melanogaster
aaaagccataagc

SEQ ID NO: 544257 - DNA, 13 bp, D. melanogaster
aaaagccatataa

SEQ ID NO: 544258 - DNA, 13 bp, D. melanogaster
aaaagccatcaaa

SEQ ID NO: 544259 - DNA, 13 bp, D. melanogaster
aaaagccatcgaa

SEQ ID NO: 544260 - DNA, 14 bp, D. melanogaster
aaaagccattaaaa

SEQ ID NO: 544261 - DNA, 13 bp, D. melanogaster
aaaagccattaat

SEQ ID NO: 544262 - DNA, 13 bp, D. melanogaster
aaaagccattgaa

SEQ ID NO: 544263 - DNA, 13 bp, D. melanogaster
aaaagcccataaa

SEQ ID NO: 544264 - DNA, 13 bp, D. melanogaster
aaaagcccattaa

SEQ ID NO: 544265 - DNA, 13 bp, D. melanogaster
aaaagccgaaaat

SEQ ID NO: 544266 - DNA, 13 bp, D. melanogaster
aaaagccgcaaat

SEQ ID NO: 544267 - DNA, 13 bp, D. melanogaster
aaaagccgcacaa

SEQ ID NO: 544268 - DNA, 13 bp, D. melanogaster
aaaagccgcatac

SEQ ID NO: 544269 - DNA, 13 bp, D. melanogaster
aaaagccggaatg

SEQ ID NO: 544270 - DNA, 15 bp, D. melanogaster
aaaagccggaatgca

SEQ ID NO: 544271 - DNA, 13 bp, D. melanogaster
aaaagcctgaaaa

SEQ ID NO: 544272 - DNA, 13 bp, D. melanogaster
aaaagcctggcca

SEQ ID NO: 544273 - DNA, 13 bp, D. melanogaster
aaaagccttaaaa

SEQ ID NO: 544274 - DNA, 13 bp, D. melanogaster
aaaagccttatat

SEQ ID NO: 544275 - DNA, 13 bp, D. melanogaster
aaaagcctttcaa

SEQ ID NO: 544276 - DNA, 13 bp, D. melanogaster
aaaagccttttaa

SEQ ID NO: 544277 - DNA, 13 bp, D. melanogaster
aaaagcgaaaagt

SEQ ID NO: 544278 - DNA, 13 bp, D. melanogaster
aaaagcgaaaatg

SEQ ID NO: 544279 - DNA, 13 bp, D. melanogaster
aaaagcgaaactt

SEQ ID NO: 544280 - DNA, 13 bp, D. melanogaster
aaaagcgaaatat

SEQ ID NO: 544281 - DNA, 14 bp, D. melanogaster
aaaagcgaaatatt

SEQ ID NO: 544282 - DNA, 14 bp, D. melanogaster
aaaagcgaaatgaa

SEQ ID NO: 544283 - DNA, 13 bp, D. melanogaster
aaaagcgaaatta

SEQ ID NO: 544284 - DNA, 13 bp, D. melanogaster
aaaagcgaagcag

SEQ ID NO: 544285 - DNA, 13 bp, D. melanogaster
aaaagcgaatatt

SEQ ID NO: 544286 - DNA, 13 bp, D. melanogaster
aaaagcgaatgaa

SEQ ID NO: 544287 - DNA, 14 bp, D. melanogaster
aaaagcgaatgaaa

SEQ ID NO: 544288 - DNA, 13 bp, D. melanogaster
aaaagcgaatgca

SEQ ID NO: 544289 - DNA, 13 bp, D. melanogaster
aaaagcgagccaa

SEQ ID NO: 544290 - DNA, 13 bp, D. melanogaster
aaaagcgagctaa

SEQ ID NO: 544291 - DNA, 13 bp, D. melanogaster
aaaagcgaggcaa

SEQ ID NO: 544292 - DNA, 13 bp, D. melanogaster
aaaagcgaggcca

SEQ ID NO: 544293 - DNA, 14 bp, D. melanogaster
aaaagcgaggccaa

SEQ ID NO: 544294 - DNA, 13 bp, D. melanogaster
aaaagcgagtgga

SEQ ID NO: 544295 - DNA, 13 bp, D. melanogaster
aaaagcgatctga

SEQ ID NO: 544296 - DNA, 13 bp, D. melanogaster
aaaagcgatgaaa

SEQ ID NO: 544297 - DNA, 13 bp, D. melanogaster
aaaagcgatggaa

SEQ ID NO: 544298 - DNA, 13 bp, D. melanogaster
aaaagcgattaaa

SEQ ID NO: 544299 - DNA, 13 bp, D. melanogaster
aaaagcgatttaa

SEQ ID NO: 544300 - DNA, 13 bp, D. melanogaster
aaaagcgattttc

SEQ ID NO: 544301 - DNA, 13 bp, D. melanogaster
aaaagcgattttt

SEQ ID NO: 544302 - DNA, 13 bp, D. melanogaster
aaaagcgcaaaat

SEQ ID NO: 544303 - DNA, 13 bp, D. melanogaster
aaaagcgcaaata

SEQ ID NO: 544304 - DNA, 13 bp, D. melanogaster
aaaagcgcaattt

SEQ ID NO: 544305 - DNA, 13 bp, D. melanogaster
aaaagcgcacaca

SEQ ID NO: 544306 - DNA, 13 bp, D. melanogaster
aaaagcgcataaa

SEQ ID NO: 544307 - DNA, 13 bp, D. melanogaster
aaaagcgccgagc

SEQ ID NO: 544308 - DNA, 13 bp, D. melanogaster
aaaagcgcgccaa

SEQ ID NO: 544309 - DNA, 13 bp, D. melanogaster
aaaagcgctgaaa

SEQ ID NO: 544310 - DNA, 13 bp, D. melanogaster
aaaagcgcttaaa

SEQ ID NO: 544311 - DNA, 14 bp, D. melanogaster
aaaagcggaaaact

SEQ ID NO: 544312 - DNA, 13 bp, D. melanogaster
aaaagcggaaatg

SEQ ID NO: 544313 - DNA, 13 bp, D. melanogaster
aaaagcggaaatt

SEQ ID NO: 544314 - DNA, 13 bp, D. melanogaster
aaaagcggaagca

SEQ ID NO: 544315 - DNA, 13 bp, D. melanogaster
aaaagcggaagtg

SEQ ID NO: 544316 - DNA, 13 bp, D. melanogaster
aaaagcggcaaat

SEQ ID NO: 544317 - DNA, 13 bp, D. melanogaster
aaaagcggcaaca

SEQ ID NO: 544318 - DNA, 13 bp, D. melanogaster
aaaagcggcagaa

SEQ ID NO: 544319 - DNA, 13 bp, D. melanogaster
aaaagcggcagca

SEQ ID NO: 544320 - DNA, 13 bp, D. melanogaster
aaaagcggcgaaa

SEQ ID NO: 544321 - DNA, 13 bp, D. melanogaster
aaaagcggcggaa

SEQ ID NO: 544322 - DNA, 13 bp, D. melanogaster
aaaagcggcggca

SEQ ID NO: 544323 - DNA, 13 bp, D. melanogaster
aaaagcgggcgaa

SEQ ID NO: 544324 - DNA, 14 bp, D. melanogaster
aaaagcggtggaaa

SEQ ID NO: 544325 - DNA, 13 bp, D. melanogaster
aaaagcgtaaata

SEQ ID NO: 544326 - DNA, 13 bp, D. melanogaster
aaaagcgtattta

SEQ ID NO: 544327 - DNA, 13 bp, D. melanogaster
aaaagcgtgaaaa

SEQ ID NO: 544328 - DNA, 13 bp, D. melanogaster
aaaagcgtggaaa

SEQ ID NO: 544329 - DNA, 13 bp, D. melanogaster
aaaagcgtgtaaa

SEQ ID NO: 544330 - DNA, 13 bp, D. melanogaster
aaaagcgttgaaa

SEQ ID NO: 544331 - DNA, 13 bp, D. melanogaster
aaaagcgttggaa

SEQ ID NO: 544332 - DNA, 13 bp, D. melanogaster
aaaagcgtttaaa

SEQ ID NO: 544333 - DNA, 13 bp, D. melanogaster
aaaagcgtttaat

SEQ ID NO: 544334 - DNA, 13 bp, D. melanogaster
aaaagcgttttaa

SEQ ID NO: 544335 - DNA, 13 bp, D. melanogaster
aaaagctaaaagt

SEQ ID NO: 544336 - DNA, 13 bp, D. melanogaster
aaaagctaaaatg

SEQ ID NO: 544337 - DNA, 13 bp, D. melanogaster
aaaagctaaatta

SEQ ID NO: 544338 - DNA, 13 bp, D. melanogaster
aaaagctaactat

SEQ ID NO: 544339 - DNA, 13 bp, D. melanogaster
aaaagctagaagg

SEQ ID NO: 544340 - DNA, 13 bp, D. melanogaster
aaaagctagcaaa

SEQ ID NO: 544341 - DNA, 14 bp, D. melanogaster
aaaagctatatttg

SEQ ID NO: 544342 - DNA, 13 bp, D. melanogaster
aaaagctatgaaa

SEQ ID NO: 544343 - DNA, 13 bp, D. melanogaster
aaaagctcataaa

SEQ ID NO: 544344 - DNA, 13 bp, D. melanogaster
aaaagctcattaa

SEQ ID NO: 544345 - DNA, 13 bp, D. melanogaster
aaaagctctggat

SEQ ID NO: 544346 - DNA, 14 bp, D. melanogaster
aaaagctgaaaaac

SEQ ID NO: 544347 - DNA, 13 bp, D. melanogaster
aaaagctgaaaac

SEQ ID NO: 544348 - DNA, 13 bp, D. melanogaster
aaaagctgaaaag

SEQ ID NO: 544349 - DNA, 14 bp, D. melanogaster
aaaagctgaaaagc

SEQ ID NO: 544350 - DNA, 13 bp, D. melanogaster
aaaagctgaaaat

SEQ ID NO: 544351 - DNA, 13 bp, D. melanogaster
aaaagctgaaaga

SEQ ID NO: 544352 - DNA, 13 bp, D. melanogaster
aaaagctgaaagc

SEQ ID NO: 544353 - DNA, 13 bp, D. melanogaster
aaaagctgaaagt

SEQ ID NO: 544354 - DNA, 13 bp, D. melanogaster
aaaagctgaaatc

SEQ ID NO: 544355 - DNA, 13 bp, D. melanogaster
aaaagctgaaatg

SEQ ID NO: 544356 - DNA, 13 bp, D. melanogaster
aaaagctgaagaa

SEQ ID NO: 544357 - DNA, 13 bp, D. melanogaster
aaaagctgaccac

SEQ ID NO: 544358 - DNA, 14 bp, D. melanogaster
aaaagctgagaaaa

SEQ ID NO: 544359 - DNA, 13 bp, D. melanogaster
aaaagctgagcaa

SEQ ID NO: 544360 - DNA, 13 bp, D. melanogaster
aaaagctgatgaa

SEQ ID NO: 544361 - DNA, 13 bp, D. melanogaster
aaaagctgcacaa

SEQ ID NO: 544362 - DNA, 13 bp, D. melanogaster
aaaagctgccagc

SEQ ID NO: 544363 - DNA, 13 bp, D. melanogaster
aaaagctgcgaaa

SEQ ID NO: 544364 - DNA, 13 bp, D. melanogaster
aaaagctggaaaa

SEQ ID NO: 544365 - DNA, 14 bp, D. melanogaster
aaaagctggaaaaa

SEQ ID NO: 544366 - DNA, 14 bp, D. melanogaster
aaaagctggaaaag

SEQ ID NO: 544367 - DNA, 13 bp, D. melanogaster
aaaagctggcaaa

SEQ ID NO: 544368 - DNA, 13 bp, D. melanogaster
aaaagctggccaa

SEQ ID NO: 544369 - DNA, 13 bp, D. melanogaster
aaaagctgggaaa

SEQ ID NO: 544370 - DNA, 13 bp, D. melanogaster
aaaagctgtaaaa

SEQ ID NO: 544371 - DNA, 14 bp, D. melanogaster
aaaagctgtaaaaa

SEQ ID NO: 544372 - DNA, 13 bp, D. melanogaster
aaaagctgtcaaa

SEQ ID NO: 544373 - DNA, 13 bp, D. melanogaster
aaaagcttagaaa

SEQ ID NO: 544374 - DNA, 13 bp, D. melanogaster
aaaagcttataaa

SEQ ID NO: 544375 - DNA, 13 bp, D. melanogaster
aaaagcttcaaaa

SEQ ID NO: 544376 - DNA, 13 bp, D. melanogaster
aaaagcttcaaat

SEQ ID NO: 544377 - DNA, 13 bp, D. melanogaster
aaaagcttcaatt

SEQ ID NO: 544378 - DNA, 13 bp, D. melanogaster
aaaagcttctggc

SEQ ID NO: 544379 - DNA, 13 bp, D. melanogaster
aaaagcttgaaaa

SEQ ID NO: 544380 - DNA, 13 bp, D. melanogaster
aaaagctttaaaa

SEQ ID NO: 544381 - DNA, 13 bp, D. melanogaster
aaaagctttaatt

SEQ ID NO: 544382 - DNA, 13 bp, D. melanogaster
aaaagctttattt

SEQ ID NO: 544383 - DNA, 13 bp, D. melanogaster
aaaagctttcaaa

SEQ ID NO: 544384 - DNA, 13 bp, D. melanogaster
aaaagctttcaat

SEQ ID NO: 544385 - DNA, 13 bp, D. melanogaster
aaaagctttgcca

SEQ ID NO: 544386 - DNA, 13 bp, D. melanogaster
aaaagctttggca

SEQ ID NO: 544387 - DNA, 13 bp, D. melanogaster
aaaagcttttaag

SEQ ID NO: 544388 - DNA, 13 bp, D. melanogaster
aaaagcttttaga

SEQ ID NO: 544389 - DNA, 13 bp, D. melanogaster
aaaagcttttagt

SEQ ID NO: 544390 - DNA, 13 bp, D. melanogaster
aaaagcttttatt

SEQ ID NO: 544391 - DNA, 14 bp, D. melanogaster
aaaagcttttattt

SEQ ID NO: 544392 - DNA, 13 bp, D. melanogaster
aaaagcttttcaa

SEQ ID NO: 544393 - DNA, 13 bp, D. melanogaster
aaaagcttttctt

SEQ ID NO: 544394 - DNA, 13 bp, D. melanogaster
aaaagcttttgct

SEQ ID NO: 544395 - DNA, 13 bp, D. melanogaster
aaaagcttttggg

SEQ ID NO: 544396 - DNA, 13 bp, D. melanogaster
aaaagctttttaa

SEQ ID NO: 544397 - DNA, 13 bp, D. melanogaster
aaaagcttttttc

SEQ ID NO: 544398 - DNA, 13 bp, D. melanogaster
aaaaggaaaacct

SEQ ID NO: 544399 - DNA, 13 bp, D. melanogaster
aaaaggaaaagct

SEQ ID NO: 544400 - DNA, 14 bp, D. melanogaster
aaaaggaaaagttt

SEQ ID NO: 544401 - DNA, 14 bp, D. melanogaster
aaaaggaaaatgca

SEQ ID NO: 544402 - DNA, 13 bp, D. melanogaster
aaaaggaaaccat

SEQ ID NO: 544403 - DNA, 13 bp, D. melanogaster
aaaaggaaactga

SEQ ID NO: 544404 - DNA, 14 bp, D. melanogaster
aaaaggaaactgaa

SEQ ID NO: 544405 - DNA, 13 bp, D. melanogaster
aaaaggaaacttt

SEQ ID NO: 544406 - DNA, 13 bp, D. melanogaster
aaaaggaaatgca

SEQ ID NO: 544407 - DNA, 14 bp, D. melanogaster
aaaaggaaatgcaa

SEQ ID NO: 544408 - DNA, 13 bp, D. melanogaster
aaaaggaaattgt

SEQ ID NO: 544409 - DNA, 13 bp, D. melanogaster
aaaaggaaatttt

SEQ ID NO: 544410 - DNA, 13 bp, D. melanogaster
aaaaggaactgat

SEQ ID NO: 544411 - DNA, 14 bp, D. melanogaster
aaaaggaagcgttt

SEQ ID NO: 544412 - DNA, 13 bp, D. melanogaster
aaaaggaagctaa

SEQ ID NO: 544413 - DNA, 13 bp, D. melanogaster
aaaaggaagtctt

SEQ ID NO: 544414 - DNA, 13 bp, D. melanogaster
aaaaggaagtgca

SEQ ID NO: 544415 - DNA, 13 bp, D. melanogaster
aaaaggaagtttt

SEQ ID NO: 544416 - DNA, 13 bp, D. melanogaster
aaaaggaatttta

SEQ ID NO: 544417 - DNA, 13 bp, D. melanogaster
aaaaggaattttt

SEQ ID NO: 544418 - DNA, 13 bp, D. melanogaster
aaaaggacaaatt

SEQ ID NO: 544419 - DNA, 13 bp, D. melanogaster
aaaaggacattaa

SEQ ID NO: 544420 - DNA, 13 bp, D. melanogaster
aaaaggacatttt

SEQ ID NO: 544421 - DNA, 13 bp, D. melanogaster
aaaaggaccacca

SEQ ID NO: 544422 - DNA, 13 bp, D. melanogaster
aaaaggacctttt

SEQ ID NO: 544423 - DNA, 14 bp, D. melanogaster
aaaaggagaagcca

SEQ ID NO: 544424 - DNA, 13 bp, D. melanogaster
aaaaggagaatcg

SEQ ID NO: 544425 - DNA, 13 bp, D. melanogaster
aaaaggagatcag

SEQ ID NO: 544426 - DNA, 13 bp, D. melanogaster
aaaaggagccaca

SEQ ID NO: 544427 - DNA, 13 bp, D. melanogaster
aaaaggagcgcac

SEQ ID NO: 544428 - DNA, 13 bp, D. melanogaster
aaaaggagctgga

SEQ ID NO: 544429 - DNA, 13 bp, D. melanogaster
aaaaggaggatcc

SEQ ID NO: 544430 - DNA, 13 bp, D. melanogaster
aaaaggaggcgtg

SEQ ID NO: 544431 - DNA, 13 bp, D. melanogaster
aaaaggataacat

SEQ ID NO: 544432 - DNA, 13 bp, D. melanogaster
aaaaggatataca

SEQ ID NO: 544433 - DNA, 13 bp, D. melanogaster
aaaaggatatgca

SEQ ID NO: 544434 - DNA, 13 bp, D. melanogaster
aaaaggatatttt

SEQ ID NO: 544435 - DNA, 13 bp, D. melanogaster
aaaaggatccagg

SEQ ID NO: 544436 - DNA, 13 bp, D. melanogaster
aaaaggatccgaa

SEQ ID NO: 544437 - DNA, 13 bp, D. melanogaster
aaaaggatgtaat

SEQ ID NO: 544438 - DNA, 13 bp, D. melanogaster
aaaaggattattt

SEQ ID NO: 544439 - DNA, 13 bp, D. melanogaster
aaaaggatttatt

SEQ ID NO: 544440 - DNA, 14 bp, D. melanogaster
aaaaggatttattt

SEQ ID NO: 544441 - DNA, 13 bp, D. melanogaster
aaaaggatttgca

SEQ ID NO: 544442 - DNA, 13 bp, D. melanogaster
aaaaggattttaa

SEQ ID NO: 544443 - DNA, 13 bp, D. melanogaster
aaaaggattttat

SEQ ID NO: 544444 - DNA, 13 bp, D. melanogaster
aaaaggattttca

SEQ ID NO: 544445 - DNA, 13 bp, D. melanogaster
aaaaggattttct

SEQ ID NO: 544446 - DNA, 13 bp, D. melanogaster
aaaaggattttgt

SEQ ID NO: 544447 - DNA, 13 bp, D. melanogaster
aaaaggatttttt

SEQ ID NO: 544448 - DNA, 13 bp, D. melanogaster
aaaaggcaaaact

SEQ ID NO: 544449 - DNA, 13 bp, D. melanogaster
aaaaggcaaacgg

SEQ ID NO: 544450 - DNA, 13 bp, D. melanogaster
aaaaggcaaatca

SEQ ID NO: 544451 - DNA, 13 bp, D. melanogaster
aaaaggcaacgca

SEQ ID NO: 544452 - DNA, 13 bp, D. melanogaster
aaaaggcaacttt

SEQ ID NO: 544453 - DNA, 13 bp, D. melanogaster
aaaaggcaatcaa

SEQ ID NO: 544454 - DNA, 14 bp, D. melanogaster
aaaaggcaattaaa

SEQ ID NO: 544455 - DNA, 13 bp, D. melanogaster
aaaaggcagaaat

SEQ ID NO: 544456 - DNA, 13 bp, D. melanogaster
aaaaggcagagcg

SEQ ID NO: 544457 - DNA, 13 bp, D. melanogaster
aaaaggcagcaac

SEQ ID NO: 544458 - DNA, 13 bp, D. melanogaster
aaaaggcagcaag

SEQ ID NO: 544459 - DNA, 13 bp, D. melanogaster
aaaaggcagcaca

SEQ ID NO: 544460 - DNA, 13 bp, D. melanogaster
aaaaggcagcaga

SEQ ID NO: 544461 - DNA, 13 bp, D. melanogaster
aaaaggcagcagg

SEQ ID NO: 544462 - DNA, 13 bp, D. melanogaster
aaaaggcagccgc

SEQ ID NO: 544463 - DNA, 13 bp, D. melanogaster
aaaaggcagctgg

SEQ ID NO: 544464 - DNA, 13 bp, D. melanogaster
aaaaggcaggcca

SEQ ID NO: 544465 - DNA, 13 bp, D. melanogaster
aaaaggcagtttt

SEQ ID NO: 544466 - DNA, 13 bp, D. melanogaster
aaaaggcatcaaa

SEQ ID NO: 544467 - DNA, 13 bp, D. melanogaster
aaaaggcattaaa

SEQ ID NO: 544468 - DNA, 14 bp, D. melanogaster
aaaaggcattaaaa

SEQ ID NO: 544469 - DNA, 14 bp, D. melanogaster
aaaaggcctttgaa

SEQ ID NO: 544470 - DNA, 13 bp, D. melanogaster
aaaaggcgaaaat

SEQ ID NO: 544471 - DNA, 13 bp, D. melanogaster
aaaaggcgactaa

SEQ ID NO: 544472 - DNA, 13 bp, D. melanogaster
aaaaggcggcaaa

SEQ ID NO: 544473 - DNA, 13 bp, D. melanogaster
aaaaggctccacc

SEQ ID NO: 544474 - DNA, 13 bp, D. melanogaster
aaaaggctcggaa

SEQ ID NO: 544475 - DNA, 13 bp, D. melanogaster
aaaaggctgaaaa

SEQ ID NO: 544476 - DNA, 14 bp, D. melanogaster
aaaaggctgaaaaa

SEQ ID NO: 544477 - DNA, 13 bp, D. melanogaster
aaaaggcttaaaa

SEQ ID NO: 544478 - DNA, 13 bp, D. melanogaster
aaaaggcttcaac

SEQ ID NO: 544479 - DNA, 13 bp, D. melanogaster
aaaaggcttttaa

SEQ ID NO: 544480 - DNA, 13 bp, D. melanogaster
aaaagggaaaatc

SEQ ID NO: 544481 - DNA, 13 bp, D. melanogaster
aaaagggaaagtt

SEQ ID NO: 544482 - DNA, 13 bp, D. melanogaster
aaaagggaaattt

SEQ ID NO: 544483 - DNA, 14 bp, D. melanogaster
aaaagggaattaat

SEQ ID NO: 544484 - DNA, 13 bp, D. melanogaster
aaaagggaatttt

SEQ ID NO: 544485 - DNA, 13 bp, D. melanogaster
aaaagggatttaa

SEQ ID NO: 544486 - DNA, 13 bp, D. melanogaster
aaaagggatttta

SEQ ID NO: 544487 - DNA, 14 bp, D. melanogaster
aaaagggattttac

SEQ ID NO: 544488 - DNA, 13 bp, D. melanogaster
aaaagggcttaaa

SEQ ID NO: 544489 - DNA, 13 bp, D. melanogaster
aaaagggctttaa

SEQ ID NO: 544490 - DNA, 13 bp, D. melanogaster
aaaaggggcaatt

SEQ ID NO: 544491 - DNA, 13 bp, D. melanogaster
aaaaggggccaaa

SEQ ID NO: 544492 - DNA, 14 bp, D. melanogaster
aaaagggggcggtg

SEQ ID NO: 544493 - DNA, 13 bp, D. melanogaster
aaaaggggttttc

SEQ ID NO: 544494 - DNA, 13 bp, D. melanogaster
aaaaggggttttt

SEQ ID NO: 544495 - DNA, 13 bp, D. melanogaster
aaaagggtataca

SEQ ID NO: 544496 - DNA, 13 bp, D. melanogaster
aaaagggtatatt

SEQ ID NO: 544497 - DNA, 13 bp, D. melanogaster
aaaagggtatttc

SEQ ID NO: 544498 - DNA, 13 bp, D. melanogaster
aaaagggttgcca

SEQ ID NO: 544499 - DNA, 13 bp, D. melanogaster
aaaagggtttcca

SEQ ID NO: 544500 - DNA, 13 bp, D. melanogaster
aaaagggttttta

SEQ ID NO: 544501 - DNA, 13 bp, D. melanogaster
aaaaggtatacta

SEQ ID NO: 544502 - DNA, 13 bp, D. melanogaster
aaaaggtatttaa

SEQ ID NO: 544503 - DNA, 13 bp, D. melanogaster
aaaaggtatttgt

SEQ ID NO: 544504 - DNA, 13 bp, D. melanogaster
aaaaggtcaaagg

SEQ ID NO: 544505 - DNA, 13 bp, D. melanogaster
aaaaggtcacaat

SEQ ID NO: 544506 - DNA, 13 bp, D. melanogaster
aaaaggtcataac

SEQ ID NO: 544507 - DNA, 13 bp, D. melanogaster
aaaaggtgaatta

SEQ ID NO: 544508 - DNA, 13 bp, D. melanogaster
aaaaggtgcaaaa

SEQ ID NO: 544509 - DNA, 13 bp, D. melanogaster
aaaaggtggcaaa

SEQ ID NO: 544510 - DNA, 13 bp, D. melanogaster
aaaaggtggcctg

SEQ ID NO: 544511 - DNA, 13 bp, D. melanogaster
aaaaggtgggcaa

SEQ ID NO: 544512 - DNA, 13 bp, D. melanogaster
aaaaggtgttcca

SEQ ID NO: 544513 - DNA, 13 bp, D. melanogaster
aaaaggtgttgaa

SEQ ID NO: 544514 - DNA, 13 bp, D. melanogaster
aaaaggttaaatt

SEQ ID NO: 544515 - DNA, 13 bp, D. melanogaster
aaaaggttaacaa

SEQ ID NO: 544516 - DNA, 13 bp, D. melanogaster
aaaaggttatacc

SEQ ID NO: 544517 - DNA, 13 bp, D. melanogaster
aaaaggttattta

SEQ ID NO: 544518 - DNA, 13 bp, D. melanogaster
aaaaggttcaaaa

SEQ ID NO: 544519 - DNA, 13 bp, D. melanogaster
aaaaggttgagat

SEQ ID NO: 544520 - DNA, 13 bp, D. melanogaster
aaaaggtttattt

SEQ ID NO: 544521 - DNA, 13 bp, D. melanogaster
aaaaggtttctat

SEQ ID NO: 544522 - DNA, 13 bp, D. melanogaster
aaaaggttttaat

SEQ ID NO: 544523 - DNA, 13 bp, D. melanogaster
aaaaggttttatt

SEQ ID NO: 544524 - DNA, 13 bp, D. melanogaster
aaaaggttttctt

SEQ ID NO: 544525 - DNA, 13 bp, D. melanogaster
aaaaggttttgaa

SEQ ID NO: 544526 - DNA, 13 bp, D. melanogaster
aaaaggttttttt

SEQ ID NO: 544527 - DNA, 13 bp, D. melanogaster
aaaagtaaaactt

SEQ ID NO: 544528 - DNA, 14 bp, D. melanogaster
aaaagtaaacagca

SEQ ID NO: 544529 - DNA, 13 bp, D. melanogaster
aaaagtaaactta

SEQ ID NO: 544530 - DNA, 14 bp, D. melanogaster
aaaagtaaacttaa

SEQ ID NO: 544531 - DNA, 13 bp, D. melanogaster
aaaagtaaacttg

SEQ ID NO: 544532 - DNA, 13 bp, D. melanogaster
aaaagtaaacttt

SEQ ID NO: 544533 - DNA, 13 bp, D. melanogaster
aaaagtaaagcac

SEQ ID NO: 544534 - DNA, 13 bp, D. melanogaster
aaaagtaaagcat

SEQ ID NO: 544535 - DNA, 13 bp, D. melanogaster
aaaagtaaatgtt

SEQ ID NO: 544536 - DNA, 13 bp, D. melanogaster
aaaagtaaattca

SEQ ID NO: 544537 - DNA, 13 bp, D. melanogaster
aaaagtaaattgt

SEQ ID NO: 544538 - DNA, 13 bp, D. melanogaster
aaaagtaacccaa

SEQ ID NO: 544539 - DNA, 13 bp, D. melanogaster
aaaagtaatagca

SEQ ID NO: 544540 - DNA, 13 bp, D. melanogaster
aaaagtaatcaat

SEQ ID NO: 544541 - DNA, 13 bp, D. melanogaster
aaaagtaatcata

SEQ ID NO: 544542 - DNA, 13 bp, D. melanogaster
aaaagtaatgcca

SEQ ID NO: 544543 - DNA, 13 bp, D. melanogaster
aaaagtaatttca

SEQ ID NO: 544544 - DNA, 13 bp, D. melanogaster
aaaagtaatttcg

SEQ ID NO: 544545 - DNA, 13 bp, D. melanogaster
aaaagtaatttgc

SEQ ID NO: 544546 - DNA, 13 bp, D. melanogaster
aaaagtacaattt

SEQ ID NO: 544547 - DNA, 13 bp, D. melanogaster
aaaagtacacaca

SEQ ID NO: 544548 - DNA, 13 bp, D. melanogaster
aaaagtacataag

SEQ ID NO: 544549 - DNA, 13 bp, D. melanogaster
aaaagtacatatt

SEQ ID NO: 544550 - DNA, 13 bp, D. melanogaster
aaaagtacattaa

SEQ ID NO: 544551 - DNA, 13 bp, D. melanogaster
aaaagtactgaaa

SEQ ID NO: 544552 - DNA, 13 bp, D. melanogaster
aaaagtacttaaa

SEQ ID NO: 544553 - DNA, 13 bp, D. melanogaster
aaaagtagagcag

SEQ ID NO: 544554 - DNA, 13 bp, D. melanogaster
aaaagtagctaaa

SEQ ID NO: 544555 - DNA, 13 bp, D. melanogaster
aaaagtaggcaac

SEQ ID NO: 544556 - DNA, 14 bp, D. melanogaster
aaaagtaggcaaca

SEQ ID NO: 544557 - DNA, 13 bp, D. melanogaster
aaaagtaggcaat

SEQ ID NO: 544558 - DNA, 14 bp, D. melanogaster
aaaagtaggcaata

SEQ ID NO: 544559 - DNA, 13 bp, D. melanogaster
aaaagtagtcaaa

SEQ ID NO: 544560 - DNA, 13 bp, D. melanogaster
aaaagtataatca

SEQ ID NO: 544561 - DNA, 13 bp, D. melanogaster
aaaagtatagttt

SEQ ID NO: 544562 - DNA, 13 bp, D. melanogaster
aaaagtatataca

SEQ ID NO: 544563 - DNA, 14 bp, D. melanogaster
aaaagtatatacaa

SEQ ID NO: 544564 - DNA, 13 bp, D. melanogaster
aaaagtatccgaa

SEQ ID NO: 544565 - DNA, 14 bp, D. melanogaster
aaaagtatccgaaa

SEQ ID NO: 544566 - DNA, 13 bp, D. melanogaster
aaaagtatcctgg

SEQ ID NO: 544567 - DNA, 13 bp, D. melanogaster
aaaagtatctaaa

SEQ ID NO: 544568 - DNA, 13 bp, D. melanogaster
aaaagtatctcaa

SEQ ID NO: 544569 - DNA, 13 bp, D. melanogaster
aaaagtatctgaa

SEQ ID NO: 544570 - DNA, 14 bp, D. melanogaster
aaaagtatctgaag

SEQ ID NO: 544571 - DNA, 13 bp, D. melanogaster
aaaagtatcttta

SEQ ID NO: 544572 - DNA, 14 bp, D. melanogaster
aaaagtatctttaa

SEQ ID NO: 544573 - DNA, 13 bp, D. melanogaster
aaaagtatgaaac

SEQ ID NO: 544574 - DNA, 14 bp, D. melanogaster
aaaagtatgcaaag

SEQ ID NO: 544575 - DNA, 13 bp, D. melanogaster
aaaagtatgccaa

SEQ ID NO: 544576 - DNA, 13 bp, D. melanogaster
aaaagtatgccac

SEQ ID NO: 544577 - DNA, 14 bp, D. melanogaster
aaaagtatgccaca

SEQ ID NO: 544578 - DNA, 13 bp, D. melanogaster
aaaagtatgccat

SEQ ID NO: 544579 - DNA, 13 bp, D. melanogaster
aaaagtatgctac

SEQ ID NO: 544580 - DNA, 14 bp, D. melanogaster
aaaagtatgctaca

SEQ ID NO: 544581 - DNA, 13 bp, D. melanogaster
aaaagtatgcttt

SEQ ID NO: 544582 - DNA, 14 bp, D. melanogaster
aaaagtatgcttta

SEQ ID NO: 544583 - DNA, 13 bp, D. melanogaster
aaaagtatgtaca

SEQ ID NO: 544584 - DNA, 13 bp, D. melanogaster
aaaagtattaaac

SEQ ID NO: 544585 - DNA, 13 bp, D. melanogaster
aaaagtattacaa

SEQ ID NO: 544586 - DNA, 13 bp, D. melanogaster
aaaagtattcaaa

SEQ ID NO: 544587 - DNA, 13 bp, D. melanogaster
aaaagtattcaat

SEQ ID NO: 544588 - DNA, 13 bp, D. melanogaster
aaaagtattgcaa

SEQ ID NO: 544589 - DNA, 13 bp, D. melanogaster
aaaagtattgttt

SEQ ID NO: 544590 - DNA, 14 bp, D. melanogaster
aaaagtatttaaca

SEQ ID NO: 544591 - DNA, 13 bp, D. melanogaster
aaaagtatttaag

SEQ ID NO: 544592 - DNA, 13 bp, D. melanogaster
aaaagtatttaca

SEQ ID NO: 544593 - DNA, 13 bp, D. melanogaster
aaaagtatttaga

SEQ ID NO: 544594 - DNA, 13 bp, D. melanogaster
aaaagtatttcaa

SEQ ID NO: 544595 - DNA, 14 bp, D. melanogaster
aaaagtatttcaaa

SEQ ID NO: 544596 - DNA, 13 bp, D. melanogaster
aaaagtatttgca

SEQ ID NO: 544597 - DNA, 13 bp, D. melanogaster
aaaagtatttgta

SEQ ID NO: 544598 - DNA, 13 bp, D. melanogaster
aaaagtattttcc

SEQ ID NO: 544599 - DNA, 13 bp, D. melanogaster
aaaagtattttgt

SEQ ID NO: 544600 - DNA, 13 bp, D. melanogaster
aaaagtatttttg

SEQ ID NO: 544601 - DNA, 14 bp, D. melanogaster
aaaagtatttttgt

SEQ ID NO: 544602 - DNA, 13 bp, D. melanogaster
aaaagtcaaaagc

SEQ ID NO: 544603 - DNA, 13 bp, D. melanogaster
aaaagtcaaaagt

SEQ ID NO: 544604 - DNA, 13 bp, D. melanogaster
aaaagtcaaaatg

SEQ ID NO: 544605 - DNA, 13 bp, D. melanogaster
aaaagtcaaagtt

SEQ ID NO: 544606 - DNA, 13 bp, D. melanogaster
aaaagtcaaatat

SEQ ID NO: 544607 - DNA, 13 bp, D. melanogaster
aaaagtcaaatca

SEQ ID NO: 544608 - DNA, 13 bp, D. melanogaster
aaaagtcaaatga

SEQ ID NO: 544609 - DNA, 13 bp, D. melanogaster
aaaagtcaaatgt

SEQ ID NO: 544610 - DNA, 13 bp, D. melanogaster
aaaagtcaaattg

SEQ ID NO: 544611 - DNA, 13 bp, D. melanogaster
aaaagtcaaattt

SEQ ID NO: 544612 - DNA, 13 bp, D. melanogaster
aaaagtcaacaga

SEQ ID NO: 544613 - DNA, 13 bp, D. melanogaster
aaaagtcaacttt

SEQ ID NO: 544614 - DNA, 13 bp, D. melanogaster
aaaagtcaagccc

SEQ ID NO: 544615 - DNA, 13 bp, D. melanogaster
aaaagtcaaggaa

SEQ ID NO: 544616 - DNA, 13 bp, D. melanogaster
aaaagtcaatgaa

SEQ ID NO: 544617 - DNA, 13 bp, D. melanogaster
aaaagtcaattaa

SEQ ID NO: 544618 - DNA, 14 bp, D. melanogaster
aaaagtcaattaaa

SEQ ID NO: 544619 - DNA, 13 bp, D. melanogaster
aaaagtcaattat

SEQ ID NO: 544620 - DNA, 13 bp, D. melanogaster
aaaagtcaattta

SEQ ID NO: 544621 - DNA, 13 bp, D. melanogaster
aaaagtcaatttt

SEQ ID NO: 544622 - DNA, 13 bp, D. melanogaster
aaaagtcacaaac

SEQ ID NO: 544623 - DNA, 13 bp, D. melanogaster
aaaagtcacgttt

SEQ ID NO: 544624 - DNA, 13 bp, D. melanogaster
aaaagtcagcaaa

SEQ ID NO: 544625 - DNA, 13 bp, D. melanogaster
aaaagtcagcgaa

SEQ ID NO: 544626 - DNA, 13 bp, D. melanogaster
aaaagtcataaag

SEQ ID NO: 544627 - DNA, 13 bp, D. melanogaster
aaaagtcataaat

SEQ ID NO: 544628 - DNA, 13 bp, D. melanogaster
aaaagtcatatca

SEQ ID NO: 544629 - DNA, 13 bp, D. melanogaster
aaaagtcatattt

SEQ ID NO: 544630 - DNA, 13 bp, D. melanogaster
aaaagtcattaaa

SEQ ID NO: 544631 - DNA, 13 bp, D. melanogaster
aaaagtcattcaa

SEQ ID NO: 544632 - DNA, 13 bp, D. melanogaster
aaaagtcatttaa

SEQ ID NO: 544633 - DNA, 13 bp, D. melanogaster
aaaagtccaaata

SEQ ID NO: 544634 - DNA, 13 bp, D. melanogaster
aaaagtccaacaa

SEQ ID NO: 544635 - DNA, 13 bp, D. melanogaster
aaaagtccatcga

SEQ ID NO: 544636 - DNA, 13 bp, D. melanogaster
aaaagtccgtctg

SEQ ID NO: 544637 - DNA, 13 bp, D. melanogaster
aaaagtcgaaaag

SEQ ID NO: 544638 - DNA, 13 bp, D. melanogaster
aaaagtcgaaaca

SEQ ID NO: 544639 - DNA, 15 bp, D. melanogaster
aaaagtcgaccatag

SEQ ID NO: 544640 - DNA, 13 bp, D. melanogaster
aaaagtcgaggaa

SEQ ID NO: 544641 - DNA, 14 bp, D. melanogaster
aaaagtcggaaaat

SEQ ID NO: 544642 - DNA, 13 bp, D. melanogaster
aaaagtcgggaaa

SEQ ID NO: 544643 - DNA, 13 bp, D. melanogaster
aaaagtcgtaaaa

SEQ ID NO: 544644 - DNA, 13 bp, D. melanogaster
aaaagtctgaaaa

SEQ ID NO: 544645 - DNA, 13 bp, D. melanogaster
aaaagtctttgaa

SEQ ID NO: 544646 - DNA, 13 bp, D. melanogaster
aaaagtgaaaacg

SEQ ID NO: 544647 - DNA, 14 bp, D. melanogaster
aaaagtgaaaagca

SEQ ID NO: 544648 - DNA, 13 bp, D. melanogaster
aaaagtgaaaatc

SEQ ID NO: 544649 - DNA, 14 bp, D. melanogaster
aaaagtgaaaattc

SEQ ID NO: 544650 - DNA, 13 bp, D. melanogaster
aaaagtgaaacag

SEQ ID NO: 544651 - DNA, 13 bp, D. melanogaster
aaaagtgaaacca

SEQ ID NO: 544652 - DNA, 13 bp, D. melanogaster
aaaagtgaaagtg

SEQ ID NO: 544653 - DNA, 13 bp, D. melanogaster
aaaagtgaaagtt

SEQ ID NO: 544654 - DNA, 13 bp, D. melanogaster
aaaagtgaaatca

SEQ ID NO: 544655 - DNA, 13 bp, D. melanogaster
aaaagtgaaatgt

SEQ ID NO: 544656 - DNA, 13 bp, D. melanogaster
aaaagtgaaattc

SEQ ID NO: 544657 - DNA, 13 bp, D. melanogaster
aaaagtgaaattt

SEQ ID NO: 544658 - DNA, 14 bp, D. melanogaster
aaaagtgaaatttc

SEQ ID NO: 544659 - DNA, 14 bp, D. melanogaster
aaaagtgaaatttt

SEQ ID NO: 544660 - DNA, 13 bp, D. melanogaster
aaaagtgaacttt

SEQ ID NO: 544661 - DNA, 14 bp, D. melanogaster
aaaagtgaatacgt

SEQ ID NO: 544662 - DNA, 13 bp, D. melanogaster
aaaagtgaatatt

SEQ ID NO: 544663 - DNA, 13 bp, D. melanogaster
aaaagtgaatggg

SEQ ID NO: 544664 - DNA, 13 bp, D. melanogaster
aaaagtgaattat

SEQ ID NO: 544665 - DNA, 13 bp, D. melanogaster
aaaagtgaattga

SEQ ID NO: 544666 - DNA, 13 bp, D. melanogaster
aaaagtgaatttt

SEQ ID NO: 544667 - DNA, 13 bp, D. melanogaster
aaaagtgacaatt

SEQ ID NO: 544668 - DNA, 13 bp, D. melanogaster
aaaagtgagtggg

SEQ ID NO: 544669 - DNA, 13 bp, D. melanogaster
aaaagtgatattt

SEQ ID NO: 544670 - DNA, 14 bp, D. melanogaster
aaaagtgcaaaatc

SEQ ID NO: 544671 - DNA, 14 bp, D. melanogaster
aaaagtgcaaacaa

SEQ ID NO: 544672 - DNA, 13 bp, D. melanogaster
aaaagtgcaaaga

SEQ ID NO: 544673 - DNA, 14 bp, D. melanogaster
aaaagtgcaaatag

SEQ ID NO: 544674 - DNA, 14 bp, D. melanogaster
aaaagtgcaacaaa

SEQ ID NO: 544675 - DNA, 13 bp, D. melanogaster
aaaagtgcaacat

SEQ ID NO: 544676 - DNA, 13 bp, D. melanogaster
aaaagtgcaacca

SEQ ID NO: 544677 - DNA, 13 bp, D. melanogaster
aaaagtgcaagtg

SEQ ID NO: 544678 - DNA, 13 bp, D. melanogaster
aaaagtgcaagtt

SEQ ID NO: 544679 - DNA, 14 bp, D. melanogaster
aaaagtgcaataaa

SEQ ID NO: 544680 - DNA, 13 bp, D. melanogaster
aaaagtgcaatat

SEQ ID NO: 544681 - DNA, 13 bp, D. melanogaster
aaaagtgcaatca

SEQ ID NO: 544682 - DNA, 13 bp, D. melanogaster
aaaagtgcaatta

SEQ ID NO: 544683 - DNA, 13 bp, D. melanogaster
aaaagtgcaattt

SEQ ID NO: 544684 - DNA, 13 bp, D. melanogaster
aaaagtgcacatt

SEQ ID NO: 544685 - DNA, 13 bp, D. melanogaster
aaaagtgcactta

SEQ ID NO: 544686 - DNA, 13 bp, D. melanogaster
aaaagtgcacttt

SEQ ID NO: 544687 - DNA, 14 bp, D. melanogaster
aaaagtgcagaaaa

SEQ ID NO: 544688 - DNA, 13 bp, D. melanogaster
aaaagtgcagcag

SEQ ID NO: 544689 - DNA, 13 bp, D. melanogaster
aaaagtgcagcat

SEQ ID NO: 544690 - DNA, 13 bp, D. melanogaster
aaaagtgcagcca

SEQ ID NO: 544691 - DNA, 13 bp, D. melanogaster
aaaagtgcaggaa

SEQ ID NO: 544692 - DNA, 13 bp, D. melanogaster
aaaagtgcataaa

SEQ ID NO: 544693 - DNA, 13 bp, D. melanogaster
aaaagtgcataac

SEQ ID NO: 544694 - DNA, 13 bp, D. melanogaster
aaaagtgcatatt

SEQ ID NO: 544695 - DNA, 14 bp, D. melanogaster
aaaagtgcattaaa

SEQ ID NO: 544696 - DNA, 13 bp, D. melanogaster
aaaagtgcattca

SEQ ID NO: 544697 - DNA, 13 bp, D. melanogaster
aaaagtgcattta

SEQ ID NO: 544698 - DNA, 13 bp, D. melanogaster
aaaagtgccaaaa

SEQ ID NO: 544699 - DNA, 13 bp, D. melanogaster
aaaagtgccaaag

SEQ ID NO: 544700 - DNA, 13 bp, D. melanogaster
aaaagtgccaagt

SEQ ID NO: 544701 - DNA, 13 bp, D. melanogaster
aaaagtgccacaa

SEQ ID NO: 544702 - DNA, 13 bp, D. melanogaster
aaaagtgcccaaa

SEQ ID NO: 544703 - DNA, 13 bp, D. melanogaster
aaaagtgcctgaa

SEQ ID NO: 544704 - DNA, 14 bp, D. melanogaster
aaaagtgcctgaaa

SEQ ID NO: 544705 - DNA, 13 bp, D. melanogaster
aaaagtgcctgca

SEQ ID NO: 544706 - DNA, 13 bp, D. melanogaster
aaaagtgcgccaa

SEQ ID NO: 544707 - DNA, 14 bp, D. melanogaster
aaaagtgcggaaaa

SEQ ID NO: 544708 - DNA, 13 bp, D. melanogaster
aaaagtgcgttgt

SEQ ID NO: 544709 - DNA, 13 bp, D. melanogaster
aaaagtgctaaaa

SEQ ID NO: 544710 - DNA, 14 bp, D. melanogaster
aaaagtgctaaaac

SEQ ID NO: 544711 - DNA, 13 bp, D. melanogaster
aaaagtgctcaaa

SEQ ID NO: 544712 - DNA, 13 bp, D. melanogaster
aaaagtgctgaaa

SEQ ID NO: 544713 - DNA, 13 bp, D. melanogaster
aaaagtgctgcca

SEQ ID NO: 544714 - DNA, 13 bp, D. melanogaster
aaaagtgcttaaa

SEQ ID NO: 544715 - DNA, 14 bp, D. melanogaster
aaaagtgcttaaaa

SEQ ID NO: 544716 - DNA, 13 bp, D. melanogaster
aaaagtgctttaa

SEQ ID NO: 544717 - DNA, 14 bp, D. melanogaster
aaaagtggaaaaac

SEQ ID NO: 544718 - DNA, 13 bp, D. melanogaster
aaaagtggaaact

SEQ ID NO: 544719 - DNA, 14 bp, D. melanogaster
aaaagtggaaagtg

SEQ ID NO: 544720 - DNA, 13 bp, D. melanogaster
aaaagtggaaatt

SEQ ID NO: 544721 - DNA, 13 bp, D. melanogaster
aaaagtggaagtg

SEQ ID NO: 544722 - DNA, 13 bp, D. melanogaster
aaaagtggacaaa

SEQ ID NO: 544723 - DNA, 13 bp, D. melanogaster
aaaagtggatttt

SEQ ID NO: 544724 - DNA, 13 bp, D. melanogaster
aaaagtggcaaaa

SEQ ID NO: 544725 - DNA, 13 bp, D. melanogaster
aaaagtggcacaa

SEQ ID NO: 544726 - DNA, 13 bp, D. melanogaster
aaaagtggcagca

SEQ ID NO: 544727 - DNA, 13 bp, D. melanogaster
aaaagtggcattt

SEQ ID NO: 544728 - DNA, 14 bp, D. melanogaster
aaaagtggccaaaa

SEQ ID NO: 544729 - DNA, 13 bp, D. melanogaster
aaaagtggccaag

SEQ ID NO: 544730 - DNA, 13 bp, D. melanogaster
aaaagtgggaaat

SEQ ID NO: 544731 - DNA, 13 bp, D. melanogaster
aaaagtgggcgga

SEQ ID NO: 544732 - DNA, 13 bp, D. melanogaster
aaaagtgggcggc

SEQ ID NO: 544733 - DNA, 13 bp, D. melanogaster
aaaagtgggcgtg

SEQ ID NO: 544734 - DNA, 14 bp, D. melanogaster
aaaagtgggcgtgg

SEQ ID NO: 544735 - DNA, 13 bp, D. melanogaster
aaaagtgggtgtg

SEQ ID NO: 544736 - DNA, 13 bp, D. melanogaster
aaaagtgtaacaa

SEQ ID NO: 544737 - DNA, 13 bp, D. melanogaster
aaaagtgtacaaa

SEQ ID NO: 544738 - DNA, 13 bp, D. melanogaster
aaaagtgtacata

SEQ ID NO: 544739 - DNA, 13 bp, D. melanogaster
aaaagtgtatcca

SEQ ID NO: 544740 - DNA, 13 bp, D. melanogaster
aaaagtgtatttc

SEQ ID NO: 544741 - DNA, 13 bp, D. melanogaster
aaaagtgtatttt

SEQ ID NO: 544742 - DNA, 13 bp, D. melanogaster
aaaagtgtcaaaa

SEQ ID NO: 544743 - DNA, 14 bp, D. melanogaster
aaaagtgtcaaaaa

SEQ ID NO: 544744 - DNA, 13 bp, D. melanogaster
aaaagtgtcaagt

SEQ ID NO: 544745 - DNA, 13 bp, D. melanogaster
aaaagtgtcataa

SEQ ID NO: 544746 - DNA, 13 bp, D. melanogaster
aaaagtgtgcaaa

SEQ ID NO: 544747 - DNA, 14 bp, D. melanogaster
aaaagtgtgcaaaa

SEQ ID NO: 544748 - DNA, 13 bp, D. melanogaster
aaaagtgtgcaac

SEQ ID NO: 544749 - DNA, 13 bp, D. melanogaster
aaaagtgtgccaa

SEQ ID NO: 544750 - DNA, 13 bp, D. melanogaster
aaaagtgtggaaa

SEQ ID NO: 544751 - DNA, 13 bp, D. melanogaster
aaaagtgtgggca

SEQ ID NO: 544752 - DNA, 13 bp, D. melanogaster
aaaagtgtgtaaa

SEQ ID NO: 544753 - DNA, 13 bp, D. melanogaster
aaaagtgtgtaca

SEQ ID NO: 544754 - DNA, 13 bp, D. melanogaster
aaaagtgtgtata

SEQ ID NO: 544755 - DNA, 13 bp, D. melanogaster
aaaagtgtgtggg

SEQ ID NO: 544756 - DNA, 13 bp, D. melanogaster
aaaagtgtgtgtt

SEQ ID NO: 544757 - DNA, 13 bp, D. melanogaster
aaaagtgttatta

SEQ ID NO: 544758 - DNA, 13 bp, D. melanogaster
aaaagtgttattt

SEQ ID NO: 544759 - DNA, 14 bp, D. melanogaster
aaaagtgttatttg

SEQ ID NO: 544760 - DNA, 14 bp, D. melanogaster
aaaagtgttgaaaa

SEQ ID NO: 544761 - DNA, 13 bp, D. melanogaster
aaaagtgttgcaa

SEQ ID NO: 544762 - DNA, 13 bp, D. melanogaster
aaaagtgttgcat

SEQ ID NO: 544763 - DNA, 13 bp, D. melanogaster
aaaagtgttgcca

SEQ ID NO: 544764 - DNA, 13 bp, D. melanogaster
aaaagtgtttaaa

SEQ ID NO: 544765 - DNA, 13 bp, D. melanogaster
aaaagtgtttaat

SEQ ID NO: 544766 - DNA, 14 bp, D. melanogaster
aaaagtgtttattt

SEQ ID NO: 544767 - DNA, 13 bp, D. melanogaster
aaaagtgtttcaa

SEQ ID NO: 544768 - DNA, 13 bp, D. melanogaster
aaaagtgtttgct

SEQ ID NO: 544769 - DNA, 13 bp, D. melanogaster
aaaagtgttttaa

SEQ ID NO: 544770 - DNA, 14 bp, D. melanogaster
aaaagtgttttaaa

SEQ ID NO: 544771 - DNA, 13 bp, D. melanogaster
aaaagtgttttta

SEQ ID NO: 544772 - DNA, 13 bp, D. melanogaster
aaaagttaaacat

SEQ ID NO: 544773 - DNA, 13 bp, D. melanogaster
aaaagttaaagtt

SEQ ID NO: 544774 - DNA, 13 bp, D. melanogaster
aaaagttaacaac

SEQ ID NO: 544775 - DNA, 14 bp, D. melanogaster
aaaagttaagcaaa

SEQ ID NO: 544776 - DNA, 13 bp, D. melanogaster
aaaagttaagtga

SEQ ID NO: 544777 - DNA, 13 bp, D. melanogaster
aaaagttaagtta

SEQ ID NO: 544778 - DNA, 13 bp, D. melanogaster
aaaagttaatagg

SEQ ID NO: 544779 - DNA, 13 bp, D. melanogaster
aaaagttaatcaa

SEQ ID NO: 544780 - DNA, 13 bp, D. melanogaster
aaaagttactggg

SEQ ID NO: 544781 - DNA, 13 bp, D. melanogaster
aaaagttagccaa

SEQ ID NO: 544782 - DNA, 13 bp, D. melanogaster
aaaagttagttat

SEQ ID NO: 544783 - DNA, 13 bp, D. melanogaster
aaaagttataacc

SEQ ID NO: 544784 - DNA, 13 bp, D. melanogaster
aaaagttatgcaa

SEQ ID NO: 544785 - DNA, 13 bp, D. melanogaster
aaaagttcaaaat

SEQ ID NO: 544786 - DNA, 13 bp, D. melanogaster
aaaagttcaaaca

SEQ ID NO: 544787 - DNA, 14 bp, D. melanogaster
aaaagttcaaagtt

SEQ ID NO: 544788 - DNA, 13 bp, D. melanogaster
aaaagttcaaatt

SEQ ID NO: 544789 - DNA, 13 bp, D. melanogaster
aaaagttcaacaa

SEQ ID NO: 544790 - DNA, 14 bp, D. melanogaster
aaaagttcaacatt

SEQ ID NO: 544791 - DNA, 13 bp, D. melanogaster
aaaagttcaagtt

SEQ ID NO: 544792 - DNA, 13 bp, D. melanogaster
aaaagttcaataa

SEQ ID NO: 544793 - DNA, 13 bp, D. melanogaster
aaaagttcagaaa

SEQ ID NO: 544794 - DNA, 13 bp, D. melanogaster
aaaagttcagttt

SEQ ID NO: 544795 - DNA, 13 bp, D. melanogaster
aaaagttcataaa

SEQ ID NO: 544796 - DNA, 13 bp, D. melanogaster
aaaagttccattt

SEQ ID NO: 544797 - DNA, 13 bp, D. melanogaster
aaaagttcccaaa

SEQ ID NO: 544798 - DNA, 13 bp, D. melanogaster
aaaagttccttaa

SEQ ID NO: 544799 - DNA, 13 bp, D. melanogaster
aaaagttcgaaaa

SEQ ID NO: 544800 - DNA, 13 bp, D. melanogaster
aaaagttcgattt

SEQ ID NO: 544801 - DNA, 13 bp, D. melanogaster
aaaagttcgttta

SEQ ID NO: 544802 - DNA, 13 bp, D. melanogaster
aaaagttctcaaa

SEQ ID NO: 544803 - DNA, 13 bp, D. melanogaster
aaaagttctcttt

SEQ ID NO: 544804 - DNA, 13 bp, D. melanogaster
aaaagttcttaaa

SEQ ID NO: 544805 - DNA, 14 bp, D. melanogaster
aaaagttgaaaagt

SEQ ID NO: 544806 - DNA, 13 bp, D. melanogaster
aaaagttgaacaa

SEQ ID NO: 544807 - DNA, 14 bp, D. melanogaster
aaaagttgaacaaa

SEQ ID NO: 544808 - DNA, 13 bp, D. melanogaster
aaaagttgaagga

SEQ ID NO: 544809 - DNA, 13 bp, D. melanogaster
aaaagttgaatta

SEQ ID NO: 544810 - DNA, 13 bp, D. melanogaster
aaaagttgaattt

SEQ ID NO: 544811 - DNA, 13 bp, D. melanogaster
aaaagttgacaaa

SEQ ID NO: 544812 - DNA, 13 bp, D. melanogaster
aaaagttgacttt

SEQ ID NO: 544813 - DNA, 13 bp, D. melanogaster
aaaagttgagatt

SEQ ID NO: 544814 - DNA, 13 bp, D. melanogaster
aaaagttgattaa

SEQ ID NO: 544815 - DNA, 13 bp, D. melanogaster
aaaagttgcaaaa

SEQ ID NO: 544816 - DNA, 13 bp, D. melanogaster
aaaagttgcaaag

SEQ ID NO: 544817 - DNA, 13 bp, D. melanogaster
aaaagttgcaact

SEQ ID NO: 544818 - DNA, 13 bp, D. melanogaster
aaaagttgcaaga

SEQ ID NO: 544819 - DNA, 13 bp, D. melanogaster
aaaagttgcataa

SEQ ID NO: 544820 - DNA, 13 bp, D. melanogaster
aaaagttgcatat

SEQ ID NO: 544821 - DNA, 13 bp, D. melanogaster
aaaagttgccaca

SEQ ID NO: 544822 - DNA, 13 bp, D. melanogaster
aaaagttgcccaa

SEQ ID NO: 544823 - DNA, 13 bp, D. melanogaster
aaaagttgctgaa

SEQ ID NO: 544824 - DNA, 13 bp, D. melanogaster
aaaagttgcttaa

SEQ ID NO: 544825 - DNA, 13 bp, D. melanogaster
aaaagttggcaaa

SEQ ID NO: 544826 - DNA, 13 bp, D. melanogaster
aaaagttggcatt

SEQ ID NO: 544827 - DNA, 13 bp, D. melanogaster
aaaagttggcttt

SEQ ID NO: 544828 - DNA, 13 bp, D. melanogaster
aaaagttgggcaa

SEQ ID NO: 544829 - DNA, 13 bp, D. melanogaster
aaaagttggttaa

SEQ ID NO: 544830 - DNA, 13 bp, D. melanogaster
aaaagttgtaatt

SEQ ID NO: 544831 - DNA, 14 bp, D. melanogaster
aaaagttgtacgta

SEQ ID NO: 544832 - DNA, 13 bp, D. melanogaster
aaaagttgtataa

SEQ ID NO: 544833 - DNA, 13 bp, D. melanogaster
aaaagttgtatat

SEQ ID NO: 544834 - DNA, 13 bp, D. melanogaster
aaaagttgtatta

SEQ ID NO: 544835 - DNA, 13 bp, D. melanogaster
aaaagttgtattt

SEQ ID NO: 544836 - DNA, 13 bp, D. melanogaster
aaaagttgtcaaa

SEQ ID NO: 544837 - DNA, 13 bp, D. melanogaster
aaaagttgtcaac

SEQ ID NO: 544838 - DNA, 13 bp, D. melanogaster
aaaagttgtgaaa

SEQ ID NO: 544839 - DNA, 13 bp, D. melanogaster
aaaagttgtgcaa

SEQ ID NO: 544840 - DNA, 13 bp, D. melanogaster
aaaagttgtggca

SEQ ID NO: 544841 - DNA, 13 bp, D. melanogaster
aaaagttgttaaa

SEQ ID NO: 544842 - DNA, 13 bp, D. melanogaster
aaaagttgttaac

SEQ ID NO: 544843 - DNA, 13 bp, D. melanogaster
aaaagttgttatt

SEQ ID NO: 544844 - DNA, 13 bp, D. melanogaster
aaaagttgttcaa

SEQ ID NO: 544845 - DNA, 13 bp, D. melanogaster
aaaagttgttgca

SEQ ID NO: 544846 - DNA, 13 bp, D. melanogaster
aaaagttgtttgt

SEQ ID NO: 544847 - DNA, 13 bp, D. melanogaster
aaaagtttaaagc

SEQ ID NO: 544848 - DNA, 13 bp, D. melanogaster
aaaagtttaaatg

SEQ ID NO: 544849 - DNA, 13 bp, D. melanogaster
aaaagtttaagca

SEQ ID NO: 544850 - DNA, 14 bp, D. melanogaster
aaaagtttaagttt

SEQ ID NO: 544851 - DNA, 13 bp, D. melanogaster
aaaagtttaatga

SEQ ID NO: 544852 - DNA, 13 bp, D. melanogaster
aaaagtttacaaa

SEQ ID NO: 544853 - DNA, 14 bp, D. melanogaster
aaaagtttacaatt

SEQ ID NO: 544854 - DNA, 13 bp, D. melanogaster
aaaagtttacact

SEQ ID NO: 544855 - DNA, 14 bp, D. melanogaster
aaaagtttacactt

SEQ ID NO: 544856 - DNA, 13 bp, D. melanogaster
aaaagtttacata

SEQ ID NO: 544857 - DNA, 13 bp, D. melanogaster
aaaagtttaccaa

SEQ ID NO: 544858 - DNA, 13 bp, D. melanogaster
aaaagtttagttt

SEQ ID NO: 544859 - DNA, 13 bp, D. melanogaster
aaaagtttattac

SEQ ID NO: 544860 - DNA, 13 bp, D. melanogaster
aaaagtttattga

SEQ ID NO: 544861 - DNA, 13 bp, D. melanogaster
aaaagtttcaaaa

SEQ ID NO: 544862 - DNA, 13 bp, D. melanogaster
aaaagtttcaatt

SEQ ID NO: 544863 - DNA, 13 bp, D. melanogaster
aaaagtttcagca

SEQ ID NO: 544864 - DNA, 13 bp, D. melanogaster
aaaagtttcattg

SEQ ID NO: 544865 - DNA, 14 bp, D. melanogaster
aaaagtttcatttt

SEQ ID NO: 544866 - DNA, 13 bp, D. melanogaster
aaaagtttccaaa

SEQ ID NO: 544867 - DNA, 13 bp, D. melanogaster
aaaagtttccatt

SEQ ID NO: 544868 - DNA, 13 bp, D. melanogaster
aaaagtttcctaa

SEQ ID NO: 544869 - DNA, 14 bp, D. melanogaster
aaaagtttcctttt

SEQ ID NO: 544870 - DNA, 13 bp, D. melanogaster
aaaagtttcgaaa

SEQ ID NO: 544871 - DNA, 13 bp, D. melanogaster
aaaagtttcgaat

SEQ ID NO: 544872 - DNA, 13 bp, D. melanogaster
aaaagtttcgatt

SEQ ID NO: 544873 - DNA, 13 bp, D. melanogaster
aaaagtttcgcaa

SEQ ID NO: 544874 - DNA, 13 bp, D. melanogaster
aaaagtttcggct

SEQ ID NO: 544875 - DNA, 13 bp, D. melanogaster
aaaagtttcgttt

SEQ ID NO: 544876 - DNA, 13 bp, D. melanogaster
aaaagtttcttat

SEQ ID NO: 544877 - DNA, 13 bp, D. melanogaster
aaaagtttgaaca

SEQ ID NO: 544878 - DNA, 13 bp, D. melanogaster
aaaagtttgaacg

SEQ ID NO: 544879 - DNA, 13 bp, D. melanogaster
aaaagtttgatta

SEQ ID NO: 544880 - DNA, 13 bp, D. melanogaster
aaaagtttgcaaa

SEQ ID NO: 544881 - DNA, 14 bp, D. melanogaster
aaaagtttgcaaac

SEQ ID NO: 544882 - DNA, 14 bp, D. melanogaster
aaaagtttgcaatt

SEQ ID NO: 544883 - DNA, 13 bp, D. melanogaster
aaaagtttgcaca

SEQ ID NO: 544884 - DNA, 13 bp, D. melanogaster
aaaagtttgccaa

SEQ ID NO: 544885 - DNA, 13 bp, D. melanogaster
aaaagtttgccac

SEQ ID NO: 544886 - DNA, 13 bp, D. melanogaster
aaaagtttgccat

SEQ ID NO: 544887 - DNA, 13 bp, D. melanogaster
aaaagtttgccca

SEQ ID NO: 544888 - DNA, 13 bp, D. melanogaster
aaaagtttgccct

SEQ ID NO: 544889 - DNA, 13 bp, D. melanogaster
aaaagtttgccgc

SEQ ID NO: 544890 - DNA, 13 bp, D. melanogaster
aaaagtttgctaa

SEQ ID NO: 544891 - DNA, 13 bp, D. melanogaster
aaaagtttgctgc

SEQ ID NO: 544892 - DNA, 13 bp, D. melanogaster
aaaagtttggcaa

SEQ ID NO: 544893 - DNA, 13 bp, D. melanogaster
aaaagtttggcca

SEQ ID NO: 544894 - DNA, 13 bp, D. melanogaster
aaaagtttggcgt

SEQ ID NO: 544895 - DNA, 13 bp, D. melanogaster
aaaagtttggctt

SEQ ID NO: 544896 - DNA, 13 bp, D. melanogaster
aaaagtttgggaa

SEQ ID NO: 544897 - DNA, 13 bp, D. melanogaster
aaaagtttggtaa

SEQ ID NO: 544898 - DNA, 13 bp, D. melanogaster
aaaagtttgtaaa

SEQ ID NO: 544899 - DNA, 13 bp, D. melanogaster
aaaagtttgtgaa

SEQ ID NO: 544900 - DNA, 13 bp, D. melanogaster
aaaagtttgtttt

SEQ ID NO: 544901 - DNA, 13 bp, D. melanogaster
aaaagttttacaa

SEQ ID NO: 544902 - DNA, 13 bp, D. melanogaster
aaaagttttcaca

SEQ ID NO: 544903 - DNA, 13 bp, D. melanogaster
aaaagttttcatt

SEQ ID NO: 544904 - DNA, 14 bp, D. melanogaster
aaaagttttcattt

SEQ ID NO: 544905 - DNA, 13 bp, D. melanogaster
aaaagttttccac

SEQ ID NO: 544906 - DNA, 14 bp, D. melanogaster
aaaagttttccatt

SEQ ID NO: 544907 - DNA, 13 bp, D. melanogaster
aaaagttttccct

SEQ ID NO: 544908 - DNA, 14 bp, D. melanogaster
aaaagttttccctt

SEQ ID NO: 544909 - DNA, 13 bp, D. melanogaster
aaaagttttcctt

SEQ ID NO: 544910 - DNA, 13 bp, D. melanogaster
aaaagttttcgcc

SEQ ID NO: 544911 - DNA, 13 bp, D. melanogaster
aaaagttttcgct

SEQ ID NO: 544912 - DNA, 13 bp, D. melanogaster
aaaagttttcggt

SEQ ID NO: 544913 - DNA, 14 bp, D. melanogaster
aaaagttttctcag

SEQ ID NO: 544914 - DNA, 13 bp, D. melanogaster
aaaagttttctgt

SEQ ID NO: 544915 - DNA, 13 bp, D. melanogaster
aaaagttttgaaa

SEQ ID NO: 544916 - DNA, 14 bp, D. melanogaster
aaaagttttgaaat

SEQ ID NO: 544917 - DNA, 13 bp, D. melanogaster
aaaagttttgatt

SEQ ID NO: 544918 - DNA, 13 bp, D. melanogaster
aaaagttttgcaa

SEQ ID NO: 544919 - DNA, 13 bp, D. melanogaster
aaaagttttgccc

SEQ ID NO: 544920 - DNA, 13 bp, D. melanogaster
aaaagttttgcgt

SEQ ID NO: 544921 - DNA, 13 bp, D. melanogaster
aaaagttttggca

SEQ ID NO: 544922 - DNA, 13 bp, D. melanogaster
aaaagttttggga

SEQ ID NO: 544923 - DNA, 13 bp, D. melanogaster
aaaagttttgggg

SEQ ID NO: 544924 - DNA, 13 bp, D. melanogaster
aaaagttttgtgg

SEQ ID NO: 544925 - DNA, 13 bp, D. melanogaster
aaaagtttttaag

SEQ ID NO: 544926 - DNA, 13 bp, D. melanogaster
aaaagtttttaca

SEQ ID NO: 544927 - DNA, 13 bp, D. melanogaster
aaaagtttttcat

SEQ ID NO: 544928 - DNA, 13 bp, D. melanogaster
aaaagtttttcca

SEQ ID NO: 544929 - DNA, 13 bp, D. melanogaster
aaaagtttttgtc

SEQ ID NO: 544930 - DNA, 13 bp, D. melanogaster
aaaagtttttgtt

SEQ ID NO: 544931 - DNA, 13 bp, D. melanogaster
aaaagttttttcc

SEQ ID NO: 544932 - DNA, 14 bp, D. melanogaster
aaaagtttttttct

SEQ ID NO: 544933 - DNA, 14 bp, D. melanogaster
aaaataaaaacgct

SEQ ID NO: 544934 - DNA, 14 bp, D. melanogaster
aaaataaaaactgt

SEQ ID NO: 544935 - DNA, 13 bp, D. melanogaster
aaaataaaactgt

SEQ ID NO: 544936 - DNA, 13 bp, D. melanogaster
aaaataaaagctt

SEQ ID NO: 544937 - DNA, 13 bp, D. melanogaster
aaaataaaagggc

SEQ ID NO: 544938 - DNA, 13 bp, D. melanogaster
aaaataaaagtgc

SEQ ID NO: 544939 - DNA, 13 bp, D. melanogaster
aaaataaaatctg

SEQ ID NO: 544940 - DNA, 13 bp, D. melanogaster
aaaataaacgatt

SEQ ID NO: 544941 - DNA, 13 bp, D. melanogaster
aaaataaacgcag

SEQ ID NO: 544942 - DNA, 13 bp, D. melanogaster
aaaataaacgttt

SEQ ID NO: 544943 - DNA, 13 bp, D. melanogaster
aaaataaactatg

SEQ ID NO: 544944 - DNA, 13 bp, D. melanogaster
aaaataaactctt

SEQ ID NO: 544945 - DNA, 13 bp, D. melanogaster
aaaataaactgca

SEQ ID NO: 544946 - DNA, 13 bp, D. melanogaster
aaaataaactgta

SEQ ID NO: 544947 - DNA, 13 bp, D. melanogaster
aaaataaagcgag

SEQ ID NO: 544948 - DNA, 13 bp, D. melanogaster
aaaataaagctga

SEQ ID NO: 544949 - DNA, 13 bp, D. melanogaster
aaaataaagctgc

SEQ ID NO: 544950 - DNA, 13 bp, D. melanogaster
aaaataaaggcca

SEQ ID NO: 544951 - DNA, 13 bp, D. melanogaster
aaaataaagggtt

SEQ ID NO: 544952 - DNA, 13 bp, D. melanogaster
aaaataaagtact

SEQ ID NO: 544953 - DNA, 13 bp, D. melanogaster
aaaataaagtgca

SEQ ID NO: 544954 - DNA, 13 bp, D. melanogaster
aaaataaagtttc

SEQ ID NO: 544955 - DNA, 13 bp, D. melanogaster
aaaataaatagct

SEQ ID NO: 544956 - DNA, 13 bp, D. melanogaster
aaaataaatcgca

SEQ ID NO: 544957 - DNA, 13 bp, D. melanogaster
aaaataaatgagc

SEQ ID NO: 544958 - DNA, 14 bp, D. melanogaster
aaaataaatgccaa

SEQ ID NO: 544959 - DNA, 13 bp, D. melanogaster
aaaataaatgctg

SEQ ID NO: 544960 - DNA, 13 bp, D. melanogaster
aaaataaatgtgt

SEQ ID NO: 544961 - DNA, 13 bp, D. melanogaster
aaaataaattctg

SEQ ID NO: 544962 - DNA, 13 bp, D. melanogaster
aaaataaattgca

SEQ ID NO: 544963 - DNA, 13 bp, D. melanogaster
aaaataaattgct

SEQ ID NO: 544964 - DNA, 13 bp, D. melanogaster
aaaataaattgtg

SEQ ID NO: 544965 - DNA, 13 bp, D. melanogaster
aaaataaatttcc

SEQ ID NO: 544966 - DNA, 13 bp, D. melanogaster
aaaataaccccag

SEQ ID NO: 544967 - DNA, 13 bp, D. melanogaster
aaaataacgattt

SEQ ID NO: 544968 - DNA, 13 bp, D. melanogaster
aaaataacggtta

SEQ ID NO: 544969 - DNA, 13 bp, D. melanogaster
aaaataacgttaa

SEQ ID NO: 544970 - DNA, 14 bp, D. melanogaster
aaaataacgttaaa

SEQ ID NO: 544971 - DNA, 13 bp, D. melanogaster
aaaataagatttc

SEQ ID NO: 544972 - DNA, 13 bp, D. melanogaster
aaaataagcaact

SEQ ID NO: 544973 - DNA, 13 bp, D. melanogaster
aaaataagcagca

SEQ ID NO: 544974 - DNA, 13 bp, D. melanogaster
aaaataagccaag

SEQ ID NO: 544975 - DNA, 13 bp, D. melanogaster
aaaataagctgaa

SEQ ID NO: 544976 - DNA, 13 bp, D. melanogaster
aaaataagctgca

SEQ ID NO: 544977 - DNA, 13 bp, D. melanogaster
aaaataagtgttt

SEQ ID NO: 544978 - DNA, 13 bp, D. melanogaster
aaaataagtttct

SEQ ID NO: 544979 - DNA, 13 bp, D. melanogaster
aaaataatacgac

SEQ ID NO: 544980 - DNA, 14 bp, D. melanogaster
aaaataatacgact

SEQ ID NO: 544981 - DNA, 13 bp, D. melanogaster
aaaataatagcac

SEQ ID NO: 544982 - DNA, 14 bp, D. melanogaster
aaaataatagcact

SEQ ID NO: 544983 - DNA, 13 bp, D. melanogaster
aaaataatcaagc

SEQ ID NO: 544984 - DNA, 13 bp, D. melanogaster
aaaataatcaagt

SEQ ID NO: 544985 - DNA, 14 bp, D. melanogaster
aaaataatcagttt

SEQ ID NO: 544986 - DNA, 13 bp, D. melanogaster
aaaataatcgaat

SEQ ID NO: 544987 - DNA, 13 bp, D. melanogaster
aaaataatcgtaa

SEQ ID NO: 544988 - DNA, 13 bp, D. melanogaster
aaaataatgaagc

SEQ ID NO: 544989 - DNA, 14 bp, D. melanogaster
aaaataatgaatcc

SEQ ID NO: 544990 - DNA, 13 bp, D. melanogaster
aaaataatgactt

SEQ ID NO: 544991 - DNA, 13 bp, D. melanogaster
aaaataatgcaga

SEQ ID NO: 544992 - DNA, 13 bp, D. melanogaster
aaaataatgccaa

SEQ ID NO: 544993 - DNA, 13 bp, D. melanogaster
aaaataatggcaa

SEQ ID NO: 544994 - DNA, 13 bp, D. melanogaster
aaaataatgtgga

SEQ ID NO: 544995 - DNA, 13 bp, D. melanogaster
aaaataatgttga

SEQ ID NO: 544996 - DNA, 14 bp, D. melanogaster
aaaataattaagca

SEQ ID NO: 544997 - DNA, 13 bp, D. melanogaster
aaaataattcaga

SEQ ID NO: 544998 - DNA, 14 bp, D. melanogaster
aaaataattcctta

SEQ ID NO: 544999 - DNA, 13 bp, D. melanogaster
aaaataattgaac

SEQ ID NO: 545000 - DNA, 13 bp, D. melanogaster
aaaataattgaca

SEQ ID NO: 545001 - DNA, 13 bp, D. melanogaster
aaaataattgcaa

SEQ ID NO: 545002 - DNA, 14 bp, D. melanogaster
aaaataattgcgaa

SEQ ID NO: 545003 - DNA, 13 bp, D. melanogaster
aaaataattgcta

SEQ ID NO: 545004 - DNA, 13 bp, D. melanogaster
aaaataattgtga

SEQ ID NO: 545005 - DNA, 13 bp, D. melanogaster
aaaataatttacg

SEQ ID NO: 545006 - DNA, 13 bp, D. melanogaster
aaaataatttcag

SEQ ID NO: 545007 - DNA, 13 bp, D. melanogaster
aaaataatttcgg

SEQ ID NO: 545008 - DNA, 13 bp, D. melanogaster
aaaataatttgca

SEQ ID NO: 545009 - DNA, 14 bp, D. melanogaster
aaaataatttgcat

SEQ ID NO: 545010 - DNA, 13 bp, D. melanogaster
aaaataatttgcg

SEQ ID NO: 545011 - DNA, 13 bp, D. melanogaster
aaaataattttcg

SEQ ID NO: 545012 - DNA, 14 bp, D. melanogaster
aaaataatttttgg

SEQ ID NO: 545013 - DNA, 13 bp, D. melanogaster
aaaatacaaagct

SEQ ID NO: 545014 - DNA, 14 bp, D. melanogaster
aaaatacaactttt

SEQ ID NO: 545015 - DNA, 13 bp, D. melanogaster
aaaatacaagtta

SEQ ID NO: 545016 - DNA, 13 bp, D. melanogaster
aaaatacaatcga

SEQ ID NO: 545017 - DNA, 13 bp, D. melanogaster
aaaatacaatgta

SEQ ID NO: 545018 - DNA, 13 bp, D. melanogaster
aaaatacaattcg

SEQ ID NO: 545019 - DNA, 13 bp, D. melanogaster
aaaatacaattga

SEQ ID NO: 545020 - DNA, 13 bp, D. melanogaster
aaaatacaattgt

SEQ ID NO: 545021 - DNA, 14 bp, D. melanogaster
aaaatacaatttct

SEQ ID NO: 545022 - DNA, 13 bp, D. melanogaster
aaaatacaatttg

SEQ ID NO: 545023 - DNA, 14 bp, D. melanogaster
aaaatacaattttc

SEQ ID NO: 545024 - DNA, 13 bp, D. melanogaster
aaaatacacactt

SEQ ID NO: 545025 - DNA, 13 bp, D. melanogaster
aaaatacacattt

SEQ ID NO: 545026 - DNA, 13 bp, D. melanogaster
aaaatacacgcga

SEQ ID NO: 545027 - DNA, 13 bp, D. melanogaster
aaaatacagaatt

SEQ ID NO: 545028 - DNA, 13 bp, D. melanogaster
aaaatacagatac

SEQ ID NO: 545029 - DNA, 13 bp, D. melanogaster
aaaatacagattc

SEQ ID NO: 545030 - DNA, 13 bp, D. melanogaster
aaaatacagcaat

SEQ ID NO: 545031 - DNA, 13 bp, D. melanogaster
aaaatacagctca

SEQ ID NO: 545032 - DNA, 14 bp, D. melanogaster
aaaatacagctcag

SEQ ID NO: 545033 - DNA, 13 bp, D. melanogaster
aaaatacataatg

SEQ ID NO: 545034 - DNA, 13 bp, D. melanogaster
aaaatacatgaat

SEQ ID NO: 545035 - DNA, 13 bp, D. melanogaster
aaaatacatgttt

SEQ ID NO: 545036 - DNA, 13 bp, D. melanogaster
aaaatacattcat

SEQ ID NO: 545037 - DNA, 13 bp, D. melanogaster
aaaatacatttct

SEQ ID NO: 545038 - DNA, 14 bp, D. melanogaster
aaaatacattttac

SEQ ID NO: 545039 - DNA, 13 bp, D. melanogaster
aaaataccaattg

SEQ ID NO: 545040 - DNA, 13 bp, D. melanogaster
aaaataccaattt

SEQ ID NO: 545041 - DNA, 13 bp, D. melanogaster
aaaatacccatct

SEQ ID NO: 545042 - DNA, 13 bp, D. melanogaster
aaaatacccatta

SEQ ID NO: 545043 - DNA, 13 bp, D. melanogaster
aaaatacccgaaa

SEQ ID NO: 545044 - DNA, 13 bp, D. melanogaster
aaaataccgaata

SEQ ID NO: 545045 - DNA, 13 bp, D. melanogaster
aaaatacctacat

SEQ ID NO: 545046 - DNA, 13 bp, D. melanogaster
aaaatacgaatac

SEQ ID NO: 545047 - DNA, 13 bp, D. melanogaster
aaaatacgaattt

SEQ ID NO: 545048 - DNA, 13 bp, D. melanogaster
aaaatacgattta

SEQ ID NO: 545049 - DNA, 13 bp, D. melanogaster
aaaatacgcaaat

SEQ ID NO: 545050 - DNA, 14 bp, D. melanogaster
aaaatacggaaaat

SEQ ID NO: 545051 - DNA, 13 bp, D. melanogaster
aaaatacgttaaa

SEQ ID NO: 545052 - DNA, 13 bp, D. melanogaster
aaaatacgttttt

SEQ ID NO: 545053 - DNA, 13 bp, D. melanogaster
aaaatactacatt

SEQ ID NO: 545054 - DNA, 13 bp, D. melanogaster
aaaatactcgaaa

SEQ ID NO: 545055 - DNA, 13 bp, D. melanogaster
aaaatactgatta

SEQ ID NO: 545056 - DNA, 14 bp, D. melanogaster
aaaatactgattat

SEQ ID NO: 545057 - DNA, 13 bp, D. melanogaster
aaaatactgctgt

SEQ ID NO: 545058 - DNA, 13 bp, D. melanogaster
aaaatacttaaag

SEQ ID NO: 545059 - DNA, 13 bp, D. melanogaster
aaaatacttgcaa

SEQ ID NO: 545060 - DNA, 13 bp, D. melanogaster
aaaatacttgtaa

SEQ ID NO: 545061 - DNA, 14 bp, D. melanogaster
aaaatacttgttat

SEQ ID NO: 545062 - DNA, 13 bp, D. melanogaster
aaaatactttcac

SEQ ID NO: 545063 - DNA, 13 bp, D. melanogaster
aaaatactttgat

SEQ ID NO: 545064 - DNA, 13 bp, D. melanogaster
aaaatactttgca

SEQ ID NO: 545065 - DNA, 13 bp, D. melanogaster
aaaatactttgta

SEQ ID NO: 545066 - DNA, 13 bp, D. melanogaster
aaaatactttgtt

SEQ ID NO: 545067 - DNA, 13 bp, D. melanogaster
aaaatacttttcg

SEQ ID NO: 545068 - DNA, 14 bp, D. melanogaster
aaaatagaactgaa

SEQ ID NO: 545069 - DNA, 13 bp, D. melanogaster
aaaatagattttc

SEQ ID NO: 545070 - DNA, 13 bp, D. melanogaster
aaaatagattttg

SEQ ID NO: 545071 - DNA, 13 bp, D. melanogaster
aaaatagcaaatg

SEQ ID NO: 545072 - DNA, 13 bp, D. melanogaster
aaaatagcaaatt

SEQ ID NO: 545073 - DNA, 13 bp, D. melanogaster
aaaatagcaagta

SEQ ID NO: 545074 - DNA, 13 bp, D. melanogaster
aaaatagcaatat

SEQ ID NO: 545075 - DNA, 14 bp, D. melanogaster
aaaatagcaattac

SEQ ID NO: 545076 - DNA, 13 bp, D. melanogaster
aaaatagcattta

SEQ ID NO: 545077 - DNA, 13 bp, D. melanogaster
aaaatagcatttc

SEQ ID NO: 545078 - DNA, 13 bp, D. melanogaster
aaaatagccaaat

SEQ ID NO: 545079 - DNA, 13 bp, D. melanogaster
aaaatagccgaaa

SEQ ID NO: 545080 - DNA, 13 bp, D. melanogaster
aaaatagctaaat

SEQ ID NO: 545081 - DNA, 13 bp, D. melanogaster
aaaatagctaata

SEQ ID NO: 545082 - DNA, 13 bp, D. melanogaster
aaaatagctgaaa

SEQ ID NO: 545083 - DNA, 14 bp, D. melanogaster
aaaatagctgaaat

SEQ ID NO: 545084 - DNA, 13 bp, D. melanogaster
aaaatagctggaa

SEQ ID NO: 545085 - DNA, 13 bp, D. melanogaster
aaaatagctttaa

SEQ ID NO: 545086 - DNA, 13 bp, D. melanogaster
aaaataggtattt

SEQ ID NO: 545087 - DNA, 13 bp, D. melanogaster
aaaataggtttta

SEQ ID NO: 545088 - DNA, 13 bp, D. melanogaster
aaaataggttttt

SEQ ID NO: 545089 - DNA, 13 bp, D. melanogaster
aaaatagtcaaat

SEQ ID NO: 545090 - DNA, 13 bp, D. melanogaster
aaaatagtgcaaa

SEQ ID NO: 545091 - DNA, 13 bp, D. melanogaster
aaaatagtgcaca

SEQ ID NO: 545092 - DNA, 14 bp, D. melanogaster
aaaatagttaggtg

SEQ ID NO: 545093 - DNA, 13 bp, D. melanogaster
aaaatagttcaaa

SEQ ID NO: 545094 - DNA, 13 bp, D. melanogaster
aaaatagttgaac

SEQ ID NO: 545095 - DNA, 14 bp, D. melanogaster
aaaatagttgaacc

SEQ ID NO: 545096 - DNA, 13 bp, D. melanogaster
aaaatagttgaat

SEQ ID NO: 545097 - DNA, 13 bp, D. melanogaster
aaaatagttggca

SEQ ID NO: 545098 - DNA, 13 bp, D. melanogaster
aaaatagttgtaa

SEQ ID NO: 545099 - DNA, 13 bp, D. melanogaster
aaaatagttgttt

SEQ ID NO: 545100 - DNA, 13 bp, D. melanogaster
aaaatagtttcca

SEQ ID NO: 545101 - DNA, 13 bp, D. melanogaster
aaaatagtttcta

SEQ ID NO: 545102 - DNA, 13 bp, D. melanogaster
aaaatagtttctt

SEQ ID NO: 545103 - DNA, 14 bp, D. melanogaster
aaaatagtttgtga

SEQ ID NO: 545104 - DNA, 13 bp, D. melanogaster
aaaatagtttgtt

SEQ ID NO: 545105 - DNA, 13 bp, D. melanogaster
aaaatagttttag

SEQ ID NO: 545106 - DNA, 14 bp, D. melanogaster
aaaatagttttcaa

SEQ ID NO: 545107 - DNA, 13 bp, D. melanogaster
aaaatagttttcc

SEQ ID NO: 545108 - DNA, 13 bp, D. melanogaster
aaaatagttttga

SEQ ID NO: 545109 - DNA, 13 bp, D. melanogaster
aaaatagttttgg

SEQ ID NO: 545110 - DNA, 14 bp, D. melanogaster
aaaatagtttttag

SEQ ID NO: 545111 - DNA, 14 bp, D. melanogaster
aaaatataaaacgt

SEQ ID NO: 545112 - DNA, 13 bp, D. melanogaster
aaaatataacgat

SEQ ID NO: 545113 - DNA, 14 bp, D. melanogaster
aaaatataacgatt

SEQ ID NO: 545114 - DNA, 14 bp, D. melanogaster
aaaatataagtaac

SEQ ID NO: 545115 - DNA, 13 bp, D. melanogaster
aaaatatacagat

SEQ ID NO: 545116 - DNA, 13 bp, D. melanogaster
aaaatatacgata

SEQ ID NO: 545117 - DNA, 13 bp, D. melanogaster
aaaatatagcata

SEQ ID NO: 545118 - DNA, 13 bp, D. melanogaster
aaaatatagcatt

SEQ ID NO: 545119 - DNA, 13 bp, D. melanogaster
aaaatatagtaca

SEQ ID NO: 545120 - DNA, 13 bp, D. melanogaster
aaaatatatacct

SEQ ID NO: 545121 - DNA, 14 bp, D. melanogaster
aaaatatatacgaa

SEQ ID NO: 545122 - DNA, 13 bp, D. melanogaster
aaaatatatagac

SEQ ID NO: 545123 - DNA, 14 bp, D. melanogaster
aaaatatatagaca

SEQ ID NO: 545124 - DNA, 13 bp, D. melanogaster
aaaatatatatcg

SEQ ID NO: 545125 - DNA, 14 bp, D. melanogaster
aaaatatatatgca

SEQ ID NO: 545126 - DNA, 13 bp, D. melanogaster
aaaatatatctgt

SEQ ID NO: 545127 - DNA, 13 bp, D. melanogaster
aaaatatatcttc

SEQ ID NO: 545128 - DNA, 14 bp, D. melanogaster
aaaatatatgcaaa

SEQ ID NO: 545129 - DNA, 13 bp, D. melanogaster
aaaatatatgcat

SEQ ID NO: 545130 - DNA, 14 bp, D. melanogaster
aaaatatatgcata

SEQ ID NO: 545131 - DNA, 13 bp, D. melanogaster
aaaatatatgcga

SEQ ID NO: 545132 - DNA, 13 bp, D. melanogaster
aaaatatatgctt

SEQ ID NO: 545133 - DNA, 13 bp, D. melanogaster
aaaatatatggca

SEQ ID NO: 545134 - DNA, 13 bp, D. melanogaster
aaaatatatggtt

SEQ ID NO: 545135 - DNA, 13 bp, D. melanogaster
aaaatatattgca

SEQ ID NO: 545136 - DNA, 14 bp, D. melanogaster
aaaatatattgcaa

SEQ ID NO: 545137 - DNA, 13 bp, D. melanogaster
aaaatatcaacag

SEQ ID NO: 545138 - DNA, 13 bp, D. melanogaster
aaaatatcaagtt

SEQ ID NO: 545139 - DNA, 13 bp, D. melanogaster
aaaatatcacagt

SEQ ID NO: 545140 - DNA, 14 bp, D. melanogaster
aaaatatcacagtc

SEQ ID NO: 545141 - DNA, 13 bp, D. melanogaster
aaaatatcagata

SEQ ID NO: 545142 - DNA, 13 bp, D. melanogaster
aaaatatcagcaa

SEQ ID NO: 545143 - DNA, 14 bp, D. melanogaster
aaaatatcatcgat

SEQ ID NO: 545144 - DNA, 13 bp, D. melanogaster
aaaatatcattca

SEQ ID NO: 545145 - DNA, 13 bp, D. melanogaster
aaaatatccattt

SEQ ID NO: 545146 - DNA, 13 bp, D. melanogaster
aaaatatcccatt

SEQ ID NO: 545147 - DNA, 13 bp, D. melanogaster
aaaatatcctata

SEQ ID NO: 545148 - DNA, 13 bp, D. melanogaster
aaaatatccttaa

SEQ ID NO: 545149 - DNA, 13 bp, D. melanogaster
aaaatatcgaaat

SEQ ID NO: 545150 - DNA, 13 bp, D. melanogaster
aaaatatcgaatt

SEQ ID NO: 545151 - DNA, 13 bp, D. melanogaster
aaaatatcgatat

SEQ ID NO: 545152 - DNA, 13 bp, D. melanogaster
aaaatatcgattt

SEQ ID NO: 545153 - DNA, 13 bp, D. melanogaster
aaaatatctaaga

SEQ ID NO: 545154 - DNA, 13 bp, D. melanogaster
aaaatatctagaa

SEQ ID NO: 545155 - DNA, 13 bp, D. melanogaster
aaaatatctcaat

SEQ ID NO: 545156 - DNA, 13 bp, D. melanogaster
aaaatatctgaat

SEQ ID NO: 545157 - DNA, 13 bp, D. melanogaster
aaaatatctgcaa

SEQ ID NO: 545158 - DNA, 13 bp, D. melanogaster
aaaatatctgcat

SEQ ID NO: 545159 - DNA, 13 bp, D. melanogaster
aaaatatcttaag

SEQ ID NO: 545160 - DNA, 14 bp, D. melanogaster
aaaatatgaaaact

SEQ ID NO: 545161 - DNA, 13 bp, D. melanogaster
aaaatatgaaact

SEQ ID NO: 545162 - DNA, 13 bp, D. melanogaster
aaaatatgagcca

SEQ ID NO: 545163 - DNA, 13 bp, D. melanogaster
aaaatatgataac

SEQ ID NO: 545164 - DNA, 14 bp, D. melanogaster
aaaatatgataact

SEQ ID NO: 545165 - DNA, 14 bp, D. melanogaster
aaaatatgattgat

SEQ ID NO: 545166 - DNA, 14 bp, D. melanogaster
aaaatatgcaaaag

SEQ ID NO: 545167 - DNA, 13 bp, D. melanogaster
aaaatatgcaaat

SEQ ID NO: 545168 - DNA, 14 bp, D. melanogaster
aaaatatgcaaata

SEQ ID NO: 545169 - DNA, 14 bp, D. melanogaster
aaaatatgcaacaa

SEQ ID NO: 545170 - DNA, 13 bp, D. melanogaster
aaaatatgcaata

SEQ ID NO: 545171 - DNA, 13 bp, D. melanogaster
aaaatatgcacaa

SEQ ID NO: 545172 - DNA, 14 bp, D. melanogaster
aaaatatgcacaaa

SEQ ID NO: 545173 - DNA, 13 bp, D. melanogaster
aaaatatgcagca

SEQ ID NO: 545174 - DNA, 13 bp, D. melanogaster
aaaatatgcataa

SEQ ID NO: 545175 - DNA, 14 bp, D. melanogaster
aaaatatgcataaa

SEQ ID NO: 545176 - DNA, 13 bp, D. melanogaster
aaaatatgcatgc

SEQ ID NO: 545177 - DNA, 13 bp, D. melanogaster
aaaatatgcatta

SEQ ID NO: 545178 - DNA, 13 bp, D. melanogaster
aaaatatgccaaa

SEQ ID NO: 545179 - DNA, 13 bp, D. melanogaster
aaaatatgccaag

SEQ ID NO: 545180 - DNA, 13 bp, D. melanogaster
aaaatatgccaca

SEQ ID NO: 545181 - DNA, 13 bp, D. melanogaster
aaaatatgcgaaa

SEQ ID NO: 545182 - DNA, 13 bp, D. melanogaster
aaaatatgcgaac

SEQ ID NO: 545183 - DNA, 13 bp, D. melanogaster
aaaatatgctaaa

SEQ ID NO: 545184 - DNA, 13 bp, D. melanogaster
aaaatatgcttaa

SEQ ID NO: 545185 - DNA, 13 bp, D. melanogaster
aaaatatggaaac

SEQ ID NO: 545186 - DNA, 13 bp, D. melanogaster
aaaatatggattt

SEQ ID NO: 545187 - DNA, 13 bp, D. melanogaster
aaaatatggcaca

SEQ ID NO: 545188 - DNA, 13 bp, D. melanogaster
aaaatatggcatt

SEQ ID NO: 545189 - DNA, 13 bp, D. melanogaster
aaaatatgggcca

SEQ ID NO: 545190 - DNA, 13 bp, D. melanogaster
aaaatatgggtta

SEQ ID NO: 545191 - DNA, 14 bp, D. melanogaster
aaaatatgtaaaca

SEQ ID NO: 545192 - DNA, 13 bp, D. melanogaster
aaaatatgtacaa

SEQ ID NO: 545193 - DNA, 14 bp, D. melanogaster
aaaatatgtacaaa

SEQ ID NO: 545194 - DNA, 13 bp, D. melanogaster
aaaatatgtatct

SEQ ID NO: 545195 - DNA, 14 bp, D. melanogaster
aaaatatgtatgta

SEQ ID NO: 545196 - DNA, 13 bp, D. melanogaster
aaaatatgtcaaa

SEQ ID NO: 545197 - DNA, 13 bp, D. melanogaster
aaaatatgtcaat

SEQ ID NO: 545198 - DNA, 13 bp, D. melanogaster
aaaatatgtcatt

SEQ ID NO: 545199 - DNA, 13 bp, D. melanogaster
aaaatatgtgatt

SEQ ID NO: 545200 - DNA, 13 bp, D. melanogaster
aaaatatgtgcaa

SEQ ID NO: 545201 - DNA, 13 bp, D. melanogaster
aaaatatgtgcat

SEQ ID NO: 545202 - DNA, 13 bp, D. melanogaster
aaaatatgtgtaa

SEQ ID NO: 545203 - DNA, 14 bp, D. melanogaster
aaaatatgttaaac

SEQ ID NO: 545204 - DNA, 13 bp, D. melanogaster
aaaatatgttact

SEQ ID NO: 545205 - DNA, 13 bp, D. melanogaster
aaaatatgttagt

SEQ ID NO: 545206 - DNA, 13 bp, D. melanogaster
aaaatatgttcga

SEQ ID NO: 545207 - DNA, 13 bp, D. melanogaster
aaaatatgttgca

SEQ ID NO: 545208 - DNA, 14 bp, D. melanogaster
aaaatatgtttaac

SEQ ID NO: 545209 - DNA, 13 bp, D. melanogaster
aaaatatgtttca

SEQ ID NO: 545210 - DNA, 13 bp, D. melanogaster
aaaatatgtttcg

SEQ ID NO: 545211 - DNA, 13 bp, D. melanogaster
aaaatatgtttgc

SEQ ID NO: 545212 - DNA, 13 bp, D. melanogaster
aaaatattaagca

SEQ ID NO: 545213 - DNA, 13 bp, D. melanogaster
aaaatattaccat

SEQ ID NO: 545214 - DNA, 13 bp, D. melanogaster
aaaatattacgaa

SEQ ID NO: 545215 - DNA, 14 bp, D. melanogaster
aaaatattacgaaa

SEQ ID NO: 545216 - DNA, 13 bp, D. melanogaster
aaaatattagcat

SEQ ID NO: 545217 - DNA, 13 bp, D. melanogaster
aaaatattagcca

SEQ ID NO: 545218 - DNA, 13 bp, D. melanogaster
aaaatattatgca

SEQ ID NO: 545219 - DNA, 14 bp, D. melanogaster
aaaatattatggta

SEQ ID NO: 545220 - DNA, 14 bp, D. melanogaster
aaaatattcaaatg

SEQ ID NO: 545221 - DNA, 13 bp, D. melanogaster
aaaatattcaatg

SEQ ID NO: 545222 - DNA, 13 bp, D. melanogaster
aaaatattcattc

SEQ ID NO: 545223 - DNA, 13 bp, D. melanogaster
aaaatattccaag

SEQ ID NO: 545224 - DNA, 13 bp, D. melanogaster
aaaatattccaca

SEQ ID NO: 545225 - DNA, 13 bp, D. melanogaster
aaaatattccata

SEQ ID NO: 545226 - DNA, 14 bp, D. melanogaster
aaaatattccattt

SEQ ID NO: 545227 - DNA, 13 bp, D. melanogaster
aaaatattcgaaa

SEQ ID NO: 545228 - DNA, 14 bp, D. melanogaster
aaaatattcgaaaa

SEQ ID NO: 545229 - DNA, 13 bp, D. melanogaster
aaaatattcgttt

SEQ ID NO: 545230 - DNA, 13 bp, D. melanogaster
aaaatattctctt

SEQ ID NO: 545231 - DNA, 13 bp, D. melanogaster
aaaatattgacaa

SEQ ID NO: 545232 - DNA, 13 bp, D. melanogaster
aaaatattgacag

SEQ ID NO: 545233 - DNA, 13 bp, D. melanogaster
aaaatattgcaaa

SEQ ID NO: 545234 - DNA, 14 bp, D. melanogaster
aaaatattgcaaaa

SEQ ID NO: 545235 - DNA, 13 bp, D. melanogaster
aaaatattgcaag

SEQ ID NO: 545236 - DNA, 13 bp, D. melanogaster
aaaatattgcaat

SEQ ID NO: 545237 - DNA, 13 bp, D. melanogaster
aaaatattgcagc

SEQ ID NO: 545238 - DNA, 13 bp, D. melanogaster
aaaatattgcatt

SEQ ID NO: 545239 - DNA, 14 bp, D. melanogaster
aaaatattgcattt

SEQ ID NO: 545240 - DNA, 13 bp, D. melanogaster
aaaatattgccaa

SEQ ID NO: 545241 - DNA, 13 bp, D. melanogaster
aaaatattgcgaa

SEQ ID NO: 545242 - DNA, 13 bp, D. melanogaster
aaaatattgcttt

SEQ ID NO: 545243 - DNA, 13 bp, D. melanogaster
aaaatattggtaa

SEQ ID NO: 545244 - DNA, 13 bp, D. melanogaster
aaaatattgtagc

SEQ ID NO: 545245 - DNA, 13 bp, D. melanogaster
aaaatattgtcaa

SEQ ID NO: 545246 - DNA, 13 bp, D. melanogaster
aaaatattgtcat

SEQ ID NO: 545247 - DNA, 13 bp, D. melanogaster
aaaatattgtgat

SEQ ID NO: 545248 - DNA, 13 bp, D. melanogaster
aaaatattgttct

SEQ ID NO: 545249 - DNA, 13 bp, D. melanogaster
aaaatatttatgg

SEQ ID NO: 545250 - DNA, 13 bp, D. melanogaster
aaaatatttcaac

SEQ ID NO: 545251 - DNA, 13 bp, D. melanogaster
aaaatatttcaca

SEQ ID NO: 545252 - DNA, 14 bp, D. melanogaster
aaaatatttcagtt

SEQ ID NO: 545253 - DNA, 13 bp, D. melanogaster
aaaatatttcctt

SEQ ID NO: 545254 - DNA, 13 bp, D. melanogaster
aaaatatttcgaa

SEQ ID NO: 545255 - DNA, 13 bp, D. melanogaster
aaaatatttcgct

SEQ ID NO: 545256 - DNA, 13 bp, D. melanogaster
aaaatatttctgc

SEQ ID NO: 545257 - DNA, 14 bp, D. melanogaster
aaaatatttgaaac

SEQ ID NO: 545258 - DNA, 14 bp, D. melanogaster
aaaatatttgacaa

SEQ ID NO: 545259 - DNA, 13 bp, D. melanogaster
aaaatatttgatc

SEQ ID NO: 545260 - DNA, 13 bp, D. melanogaster
aaaatatttgcac

SEQ ID NO: 545261 - DNA, 14 bp, D. melanogaster
aaaatatttgccaa

SEQ ID NO: 545262 - DNA, 13 bp, D. melanogaster
aaaatatttgcct

SEQ ID NO: 545263 - DNA, 14 bp, D. melanogaster
aaaatatttgcctt

SEQ ID NO: 545264 - DNA, 13 bp, D. melanogaster
aaaatatttgcga

SEQ ID NO: 545265 - DNA, 13 bp, D. melanogaster
aaaatatttgcta

SEQ ID NO: 545266 - DNA, 13 bp, D. melanogaster
aaaatatttgctt

SEQ ID NO: 545267 - DNA, 14 bp, D. melanogaster
aaaatatttgcttt

SEQ ID NO: 545268 - DNA, 13 bp, D. melanogaster
aaaatatttggct

SEQ ID NO: 545269 - DNA, 13 bp, D. melanogaster
aaaatatttggta

SEQ ID NO: 545270 - DNA, 13 bp, D. melanogaster
aaaatatttgtct

SEQ ID NO: 545271 - DNA, 13 bp, D. melanogaster
aaaatatttgtgc

SEQ ID NO: 545272 - DNA, 14 bp, D. melanogaster
aaaatatttgtgta

SEQ ID NO: 545273 - DNA, 14 bp, D. melanogaster
aaaatattttccaa

SEQ ID NO: 545274 - DNA, 14 bp, D. melanogaster
aaaatattttccca

SEQ ID NO: 545275 - DNA, 13 bp, D. melanogaster
aaaatattttcgc

SEQ ID NO: 545276 - DNA, 13 bp, D. melanogaster
aaaatattttgca

SEQ ID NO: 545277 - DNA, 14 bp, D. melanogaster
aaaatattttgcaa

SEQ ID NO: 545278 - DNA, 13 bp, D. melanogaster
aaaatattttgct

SEQ ID NO: 545279 - DNA, 14 bp, D. melanogaster
aaaatattttgctt

SEQ ID NO: 545280 - DNA, 14 bp, D. melanogaster
aaaatattttggct

SEQ ID NO: 545281 - DNA, 13 bp, D. melanogaster
aaaatattttgtg

SEQ ID NO: 545282 - DNA, 14 bp, D. melanogaster
aaaatatttttgca

SEQ ID NO: 545283 - DNA, 13 bp, D. melanogaster
aaaatcaaaagct

SEQ ID NO: 545284 - DNA, 15 bp, D. melanogaster
aaaatcaaaatggaa

SEQ ID NO: 545285 - DNA, 13 bp, D. melanogaster
aaaatcaaaatgt

SEQ ID NO: 545286 - DNA, 13 bp, D. melanogaster
aaaatcaaacgat

SEQ ID NO: 545287 - DNA, 13 bp, D. melanogaster
aaaatcaaactga

SEQ ID NO: 545288 - DNA, 13 bp, D. melanogaster
aaaatcaaagagc

SEQ ID NO: 545289 - DNA, 13 bp, D. melanogaster
aaaatcaaagcat

SEQ ID NO: 545290 - DNA, 13 bp, D. melanogaster
aaaatcaaagcca

SEQ ID NO: 545291 - DNA, 13 bp, D. melanogaster
aaaatcaaagtca

SEQ ID NO: 545292 - DNA, 13 bp, D. melanogaster
aaaatcaaatatg

SEQ ID NO: 545293 - DNA, 14 bp, D. melanogaster
aaaatcaaatcgat

SEQ ID NO: 545294 - DNA, 13 bp, D. melanogaster
aaaatcaaatgcc

SEQ ID NO: 545295 - DNA, 13 bp, D. melanogaster
aaaatcaaatgta

SEQ ID NO: 545296 - DNA, 13 bp, D. melanogaster
aaaatcaaattag

SEQ ID NO: 545297 - DNA, 13 bp, D. melanogaster
aaaatcaaattga

SEQ ID NO: 545298 - DNA, 13 bp, D. melanogaster
aaaatcaaattgt

SEQ ID NO: 545299 - DNA, 14 bp, D. melanogaster
aaaatcaaatttga

SEQ ID NO: 545300 - DNA, 14 bp, D. melanogaster
aaaatcaacaaatg

SEQ ID NO: 545301 - DNA, 13 bp, D. melanogaster
aaaatcaacaagc

SEQ ID NO: 545302 - DNA, 14 bp, D. melanogaster
aaaatcaacagcaa

SEQ ID NO: 545303 - DNA, 13 bp, D. melanogaster
aaaatcaactatt

SEQ ID NO: 545304 - DNA, 14 bp, D. melanogaster
aaaatcaactattg

SEQ ID NO: 545305 - DNA, 13 bp, D. melanogaster
aaaatcaactgaa

SEQ ID NO: 545306 - DNA, 13 bp, D. melanogaster
aaaatcaactgca

SEQ ID NO: 545307 - DNA, 13 bp, D. melanogaster
aaaatcaacttga

SEQ ID NO: 545308 - DNA, 13 bp, D. melanogaster
aaaatcaactttt

SEQ ID NO: 545309 - DNA, 13 bp, D. melanogaster
aaaatcaagagat

SEQ ID NO: 545310 - DNA, 13 bp, D. melanogaster
aaaatcaagattt

SEQ ID NO: 545311 - DNA, 13 bp, D. melanogaster
aaaatcaagcaga

SEQ ID NO: 545312 - DNA, 13 bp, D. melanogaster
aaaatcaagggaa

SEQ ID NO: 545313 - DNA, 13 bp, D. melanogaster
aaaatcaagtcaa

SEQ ID NO: 545314 - DNA, 14 bp, D. melanogaster
aaaatcaagtgaaa

SEQ ID NO: 545315 - DNA, 13 bp, D. melanogaster
aaaatcaagttga

SEQ ID NO: 545316 - DNA, 13 bp, D. melanogaster
aaaatcaagtttt

SEQ ID NO: 545317 - DNA, 13 bp, D. melanogaster
aaaatcaataagc

SEQ ID NO: 545318 - DNA, 13 bp, D. melanogaster
aaaatcaataagt

SEQ ID NO: 545319 - DNA, 13 bp, D. melanogaster
aaaatcaataatg

SEQ ID NO: 545320 - DNA, 13 bp, D. melanogaster
aaaatcaatacga

SEQ ID NO: 545321 - DNA, 13 bp, D. melanogaster
aaaatcaatactt

SEQ ID NO: 545322 - DNA, 13 bp, D. melanogaster
aaaatcaatcgaa

SEQ ID NO: 545323 - DNA, 14 bp, D. melanogaster
aaaatcaatcgaac

SEQ ID NO: 545324 - DNA, 14 bp, D. melanogaster
aaaatcaatgaaat

SEQ ID NO: 545325 - DNA, 13 bp, D. melanogaster
aaaatcaatgatt

SEQ ID NO: 545326 - DNA, 13 bp, D. melanogaster
aaaatcaatgcaa

SEQ ID NO: 545327 - DNA, 13 bp, D. melanogaster
aaaatcaatgcat

SEQ ID NO: 545328 - DNA, 13 bp, D. melanogaster
aaaatcaattact

SEQ ID NO: 545329 - DNA, 13 bp, D. melanogaster
aaaatcaattaga

SEQ ID NO: 545330 - DNA, 13 bp, D. melanogaster
aaaatcaattcgc

SEQ ID NO: 545331 - DNA, 14 bp, D. melanogaster
aaaatcaattctct

SEQ ID NO: 545332 - DNA, 14 bp, D. melanogaster
aaaatcaattgaaa

SEQ ID NO: 545333 - DNA, 14 bp, D. melanogaster
aaaatcaattgaat

SEQ ID NO: 545334 - DNA, 14 bp, D. melanogaster
aaaatcaattggaa

SEQ ID NO: 545335 - DNA, 13 bp, D. melanogaster
aaaatcaatttac

SEQ ID NO: 545336 - DNA, 13 bp, D. melanogaster
aaaatcaatttca

SEQ ID NO: 545337 - DNA, 13 bp, D. melanogaster
aaaatcaatttcc

SEQ ID NO: 545338 - DNA, 13 bp, D. melanogaster
aaaatcaatttcg

SEQ ID NO: 545339 - DNA, 14 bp, D. melanogaster
aaaatcaatttgaa

SEQ ID NO: 545340 - DNA, 14 bp, D. melanogaster
aaaatcaatttgca

SEQ ID NO: 545341 - DNA, 13 bp, D. melanogaster
aaaatcacacaga

SEQ ID NO: 545342 - DNA, 13 bp, D. melanogaster
aaaatcacatttt

SEQ ID NO: 545343 - DNA, 13 bp, D. melanogaster
aaaatcacttgca

SEQ ID NO: 545344 - DNA, 13 bp, D. melanogaster
aaaatcactttca

SEQ ID NO: 545345 - DNA, 13 bp, D. melanogaster
aaaatcacttttt

SEQ ID NO: 545346 - DNA, 13 bp, D. melanogaster
aaaatcagaaatt

SEQ ID NO: 545347 - DNA, 13 bp, D. melanogaster
aaaatcagaatca

SEQ ID NO: 545348 - DNA, 13 bp, D. melanogaster
aaaatcagaatta

SEQ ID NO: 545349 - DNA, 13 bp, D. melanogaster
aaaatcagagaga

SEQ ID NO: 545350 - DNA, 13 bp, D. melanogaster
aaaatcagcaaat

SEQ ID NO: 545351 - DNA, 13 bp, D. melanogaster
aaaatcagcaaca

SEQ ID NO: 545352 - DNA, 13 bp, D. melanogaster
aaaatcagcaagc

SEQ ID NO: 545353 - DNA, 13 bp, D. melanogaster
aaaatcagcaatc

SEQ ID NO: 545354 - DNA, 13 bp, D. melanogaster
aaaatcagcacaa

SEQ ID NO: 545355 - DNA, 13 bp, D. melanogaster
aaaatcagcagcc

SEQ ID NO: 545356 - DNA, 13 bp, D. melanogaster
aaaatcagcataa

SEQ ID NO: 545357 - DNA, 13 bp, D. melanogaster
aaaatcagcattt

SEQ ID NO: 545358 - DNA, 13 bp, D. melanogaster
aaaatcagcttaa

SEQ ID NO: 545359 - DNA, 13 bp, D. melanogaster
aaaatcagtggaa

SEQ ID NO: 545360 - DNA, 13 bp, D. melanogaster
aaaatcagttaaa

SEQ ID NO: 545361 - DNA, 13 bp, D. melanogaster
aaaatcagttgct

SEQ ID NO: 545362 - DNA, 14 bp, D. melanogaster
aaaatcagttgcta

SEQ ID NO: 545363 - DNA, 14 bp, D. melanogaster
aaaatcagtttaaa

SEQ ID NO: 545364 - DNA, 13 bp, D. melanogaster
aaaatcagtttct

SEQ ID NO: 545365 - DNA, 14 bp, D. melanogaster
aaaatcagtttctt

SEQ ID NO: 545366 - DNA, 13 bp, D. melanogaster
aaaatcagttttc

SEQ ID NO: 545367 - DNA, 13 bp, D. melanogaster
aaaatcataattg

SEQ ID NO: 545368 - DNA, 13 bp, D. melanogaster
aaaatcatagaat

SEQ ID NO: 545369 - DNA, 13 bp, D. melanogaster
aaaatcatagctt

SEQ ID NO: 545370 - DNA, 13 bp, D. melanogaster
aaaatcatatatg

SEQ ID NO: 545371 - DNA, 13 bp, D. melanogaster
aaaatcatatgtt

SEQ ID NO: 545372 - DNA, 13 bp, D. melanogaster
aaaatcatatttc

SEQ ID NO: 545373 - DNA, 13 bp, D. melanogaster
aaaatcatcagca

SEQ ID NO: 545374 - DNA, 13 bp, D. melanogaster
aaaatcatcattt

SEQ ID NO: 545375 - DNA, 13 bp, D. melanogaster
aaaatcatcttca

SEQ ID NO: 545376 - DNA, 13 bp, D. melanogaster
aaaatcattgaaa

SEQ ID NO: 545377 - DNA, 13 bp, D. melanogaster
aaaatcattgaca

SEQ ID NO: 545378 - DNA, 13 bp, D. melanogaster
aaaatcattgtta

SEQ ID NO: 545379 - DNA, 13 bp, D. melanogaster
aaaatcatttaag

SEQ ID NO: 545380 - DNA, 14 bp, D. melanogaster
aaaatcatttccaa

SEQ ID NO: 545381 - DNA, 13 bp, D. melanogaster
aaaatcatttcgc

SEQ ID NO: 545382 - DNA, 13 bp, D. melanogaster
aaaatcatttgca

SEQ ID NO: 545383 - DNA, 13 bp, D. melanogaster
aaaatcatttgcc

SEQ ID NO: 545384 - DNA, 14 bp, D. melanogaster
aaaatcattttcaa

SEQ ID NO: 545385 - DNA, 13 bp, D. melanogaster
aaaatcattttga

SEQ ID NO: 545386 - DNA, 13 bp, D. melanogaster
aaaatcattttgc

SEQ ID NO: 545387 - DNA, 13 bp, D. melanogaster
aaaatcatttttg

SEQ ID NO: 545388 - DNA, 13 bp, D. melanogaster
aaaatccaaaatg

SEQ ID NO: 545389 - DNA, 16 bp, D. melanogaster
aaaatccaaaggaaaa

SEQ ID NO: 545390 - DNA, 13 bp, D. melanogaster
aaaatccaaagtg

SEQ ID NO: 545391 - DNA, 13 bp, D. melanogaster
aaaatccaaatgc

SEQ ID NO: 545392 - DNA, 13 bp, D. melanogaster
aaaatccaaattg

SEQ ID NO: 545393 - DNA, 13 bp, D. melanogaster
aaaatccaaattt

SEQ ID NO: 545394 - DNA, 13 bp, D. melanogaster
aaaatccaacgaa

SEQ ID NO: 545395 - DNA, 13 bp, D. melanogaster
aaaatccaagcca

SEQ ID NO: 545396 - DNA, 14 bp, D. melanogaster
aaaatccaagttca

SEQ ID NO: 545397 - DNA, 14 bp, D. melanogaster
aaaatccaatactt

SEQ ID NO: 545398 - DNA, 15 bp, D. melanogaster
aaaatccaatacttt

SEQ ID NO: 545399 - DNA, 13 bp, D. melanogaster
aaaatccaatcca

SEQ ID NO: 545400 - DNA, 13 bp, D. melanogaster
aaaatccaattag

SEQ ID NO: 545401 - DNA, 13 bp, D. melanogaster
aaaatccacttaa

SEQ ID NO: 545402 - DNA, 13 bp, D. melanogaster
aaaatccagcaaa

SEQ ID NO: 545403 - DNA, 13 bp, D. melanogaster
aaaatccatattt

SEQ ID NO: 545404 - DNA, 13 bp, D. melanogaster
aaaatccattaat

SEQ ID NO: 545405 - DNA, 13 bp, D. melanogaster
aaaatccattgaa

SEQ ID NO: 545406 - DNA, 13 bp, D. melanogaster
aaaatccattgca

SEQ ID NO: 545407 - DNA, 13 bp, D. melanogaster
aaaatccatttaa

SEQ ID NO: 545408 - DNA, 13 bp, D. melanogaster
aaaatccatttcg

SEQ ID NO: 545409 - DNA, 13 bp, D. melanogaster
aaaatccatttga

SEQ ID NO: 545410 - DNA, 13 bp, D. melanogaster
aaaatccatttgc

SEQ ID NO: 545411 - DNA, 13 bp, D. melanogaster
aaaatccattttc

SEQ ID NO: 545412 - DNA, 13 bp, D. melanogaster
aaaatcccaaatg

SEQ ID NO: 545413 - DNA, 13 bp, D. melanogaster
aaaatcccttaaa

SEQ ID NO: 545414 - DNA, 14 bp, D. melanogaster
aaaatcccttttcc

SEQ ID NO: 545415 - DNA, 13 bp, D. melanogaster
aaaatccgaaaat

SEQ ID NO: 545416 - DNA, 13 bp, D. melanogaster
aaaatccgaaact

SEQ ID NO: 545417 - DNA, 13 bp, D. melanogaster
aaaatccgcaaaa

SEQ ID NO: 545418 - DNA, 13 bp, D. melanogaster
aaaatccggaaaa

SEQ ID NO: 545419 - DNA, 13 bp, D. melanogaster
aaaatccggagaa

SEQ ID NO: 545420 - DNA, 13 bp, D. melanogaster
aaaatccggcaaa

SEQ ID NO: 545421 - DNA, 13 bp, D. melanogaster
aaaatcctataag

SEQ ID NO: 545422 - DNA, 13 bp, D. melanogaster
aaaatcctgcgca

SEQ ID NO: 545423 - DNA, 13 bp, D. melanogaster
aaaatccttaaat

SEQ ID NO: 545424 - DNA, 13 bp, D. melanogaster
aaaatccttttgc

SEQ ID NO: 545425 - DNA, 14 bp, D. melanogaster
aaaatcgaaaaatc

SEQ ID NO: 545426 - DNA, 13 bp, D. melanogaster
aaaatcgaaaact

SEQ ID NO: 545427 - DNA, 13 bp, D. melanogaster
aaaatcgaaaatc

SEQ ID NO: 545428 - DNA, 14 bp, D. melanogaster
aaaatcgaaaatcg

SEQ ID NO: 545429 - DNA, 13 bp, D. melanogaster
aaaatcgaaaatg

SEQ ID NO: 545430 - DNA, 13 bp, D. melanogaster
aaaatcgaaaatt

SEQ ID NO: 545431 - DNA, 13 bp, D. melanogaster
aaaatcgaaacta

SEQ ID NO: 545432 - DNA, 13 bp, D. melanogaster
aaaatcgaaagca

SEQ ID NO: 545433 - DNA, 13 bp, D. melanogaster
aaaatcgaaagtg

SEQ ID NO: 545434 - DNA, 13 bp, D. melanogaster
aaaatcgaaatag

SEQ ID NO: 545435 - DNA, 13 bp, D. melanogaster
aaaatcgaaatat

SEQ ID NO: 545436 - DNA, 13 bp, D. melanogaster
aaaatcgaaatca

SEQ ID NO: 545437 - DNA, 14 bp, D. melanogaster
aaaatcgaaatcaa

SEQ ID NO: 545438 - DNA, 13 bp, D. melanogaster
aaaatcgaaatcg

SEQ ID NO: 545439 - DNA, 14 bp, D. melanogaster
aaaatcgaaatcga

SEQ ID NO: 545440 - DNA, 13 bp, D. melanogaster
aaaatcgaaattt

SEQ ID NO: 545441 - DNA, 13 bp, D. melanogaster
aaaatcgaagaat

SEQ ID NO: 545442 - DNA, 13 bp, D. melanogaster
aaaatcgaagcaa

SEQ ID NO: 545443 - DNA, 13 bp, D. melanogaster
aaaatcgaatcaa

SEQ ID NO: 545444 - DNA, 14 bp, D. melanogaster
aaaatcgaatcgaa

SEQ ID NO: 545445 - DNA, 14 bp, D. melanogaster
aaaatcgaatgaaa

SEQ ID NO: 545446 - DNA, 13 bp, D. melanogaster
aaaatcgaatggg

SEQ ID NO: 545447 - DNA, 13 bp, D. melanogaster
aaaatcgaattca

SEQ ID NO: 545448 - DNA, 13 bp, D. melanogaster
aaaatcgaattcg

SEQ ID NO: 545449 - DNA, 13 bp, D. melanogaster
aaaatcgaattct

SEQ ID NO: 545450 - DNA, 13 bp, D. melanogaster
aaaatcgaattga

SEQ ID NO: 545451 - DNA, 13 bp, D. melanogaster
aaaatcgaatttt

SEQ ID NO: 545452 - DNA, 14 bp, D. melanogaster
aaaatcgaattttt

SEQ ID NO: 545453 - DNA, 14 bp, D. melanogaster
aaaatcgactgact

SEQ ID NO: 545454 - DNA, 13 bp, D. melanogaster
aaaatcgagcaaa

SEQ ID NO: 545455 - DNA, 13 bp, D. melanogaster
aaaatcgagcaat

SEQ ID NO: 545456 - DNA, 13 bp, D. melanogaster
aaaatcgagccaa

SEQ ID NO: 545457 - DNA, 13 bp, D. melanogaster
aaaatcgagcgaa

SEQ ID NO: 545458 - DNA, 13 bp, D. melanogaster
aaaatcgaggaaa

SEQ ID NO: 545459 - DNA, 14 bp, D. melanogaster
aaaatcgaggaaaa

SEQ ID NO: 545460 - DNA, 13 bp, D. melanogaster
aaaatcgatcaaa

SEQ ID NO: 545461 - DNA, 13 bp, D. melanogaster
aaaatcgatcagg

SEQ ID NO: 545462 - DNA, 13 bp, D. melanogaster
aaaatcgatgaaa

SEQ ID NO: 545463 - DNA, 13 bp, D. melanogaster
aaaatcgatggca

SEQ ID NO: 545464 - DNA, 13 bp, D. melanogaster
aaaatcgattaaa

SEQ ID NO: 545465 - DNA, 14 bp, D. melanogaster
aaaatcgattgaac

SEQ ID NO: 545466 - DNA, 13 bp, D. melanogaster
aaaatcgattgct

SEQ ID NO: 545467 - DNA, 13 bp, D. melanogaster
aaaatcgattgtt

SEQ ID NO: 545468 - DNA, 13 bp, D. melanogaster
aaaatcgatttcg

SEQ ID NO: 545469 - DNA, 13 bp, D. melanogaster
aaaatcgatttgt

SEQ ID NO: 545470 - DNA, 13 bp, D. melanogaster
aaaatcgattttt

SEQ ID NO: 545471 - DNA, 13 bp, D. melanogaster
aaaatcgcaaaat

SEQ ID NO: 545472 - DNA, 13 bp, D. melanogaster
aaaatcgcaaaca

SEQ ID NO: 545473 - DNA, 13 bp, D. melanogaster
aaaatcgcaacaa

SEQ ID NO: 545474 - DNA, 14 bp, D. melanogaster
aaaatcgcacaaaa

SEQ ID NO: 545475 - DNA, 13 bp, D. melanogaster
aaaatcgcacaca

SEQ ID NO: 545476 - DNA, 13 bp, D. melanogaster
aaaatcgcataaa

SEQ ID NO: 545477 - DNA, 14 bp, D. melanogaster
aaaatcgcataaat

SEQ ID NO: 545478 - DNA, 13 bp, D. melanogaster
aaaatcgcattta

SEQ ID NO: 545479 - DNA, 13 bp, D. melanogaster
aaaatcgcatttg

SEQ ID NO: 545480 - DNA, 13 bp, D. melanogaster
aaaatcgccgctc

SEQ ID NO: 545481 - DNA, 13 bp, D. melanogaster
aaaatcgcgaaaa

SEQ ID NO: 545482 - DNA, 13 bp, D. melanogaster
aaaatcggaaaat

SEQ ID NO: 545483 - DNA, 14 bp, D. melanogaster
aaaatcggaaaatc

SEQ ID NO: 545484 - DNA, 13 bp, D. melanogaster
aaaatcggaaatt

SEQ ID NO: 545485 - DNA, 13 bp, D. melanogaster
aaaatcggagaaa

SEQ ID NO: 545486 - DNA, 13 bp, D. melanogaster
aaaatcggagaga

SEQ ID NO: 545487 - DNA, 14 bp, D. melanogaster
aaaatcggagagac

SEQ ID NO: 545488 - DNA, 13 bp, D. melanogaster
aaaatcggatatt

SEQ ID NO: 545489 - DNA, 13 bp, D. melanogaster
aaaatcggattgt

SEQ ID NO: 545490 - DNA, 13 bp, D. melanogaster
aaaatcgggaaag

SEQ ID NO: 545491 - DNA, 13 bp, D. melanogaster
aaaatcgggcaaa

SEQ ID NO: 545492 - DNA, 13 bp, D. melanogaster
aaaatcggggaaa

SEQ ID NO: 545493 - DNA, 13 bp, D. melanogaster
aaaatcgggggaa

SEQ ID NO: 545494 - DNA, 14 bp, D. melanogaster
aaaatcgggggaaa

SEQ ID NO: 545495 - DNA, 13 bp, D. melanogaster
aaaatcggggtcg

SEQ ID NO: 545496 - DNA, 13 bp, D. melanogaster
aaaatcggttgcg

SEQ ID NO: 545497 - DNA, 13 bp, D. melanogaster
aaaatcgtaaaat

SEQ ID NO: 545498 - DNA, 13 bp, D. melanogaster
aaaatcgtaaata

SEQ ID NO: 545499 - DNA, 13 bp, D. melanogaster
aaaatcgtaaatt

SEQ ID NO: 545500 - DNA, 13 bp, D. melanogaster
aaaatcgtacaaa

SEQ ID NO: 545501 - DNA, 13 bp, D. melanogaster
aaaatcgtataaa

SEQ ID NO: 545502 - DNA, 13 bp, D. melanogaster
aaaatcgtatata

SEQ ID NO: 545503 - DNA, 13 bp, D. melanogaster
aaaatcgtattaa

SEQ ID NO: 545504 - DNA, 13 bp, D. melanogaster
aaaatcgtatttt

SEQ ID NO: 545505 - DNA, 13 bp, D. melanogaster
aaaatcgtcaatc

SEQ ID NO: 545506 - DNA, 13 bp, D. melanogaster
aaaatcgtgaaat

SEQ ID NO: 545507 - DNA, 13 bp, D. melanogaster
aaaatcgtggaaa

SEQ ID NO: 545508 - DNA, 13 bp, D. melanogaster
aaaatcgtggcca

SEQ ID NO: 545509 - DNA, 13 bp, D. melanogaster
aaaatcgttcatt

SEQ ID NO: 545510 - DNA, 13 bp, D. melanogaster
aaaatcgttgttt

SEQ ID NO: 545511 - DNA, 13 bp, D. melanogaster
aaaatcgtttctt

SEQ ID NO: 545512 - DNA, 13 bp, D. melanogaster
aaaatcgttttaa

SEQ ID NO: 545513 - DNA, 13 bp, D. melanogaster
aaaatcgttttta

SEQ ID NO: 545514 - DNA, 13 bp, D. melanogaster
aaaatcgtttttc

SEQ ID NO: 545515 - DNA, 13 bp, D. melanogaster
aaaatcgtttttg

SEQ ID NO: 545516 - DNA, 13 bp, D. melanogaster
aaaatcgtttttt

SEQ ID NO: 545517 - DNA, 13 bp, D. melanogaster
aaaatctaaaagt

SEQ ID NO: 545518 - DNA, 13 bp, D. melanogaster
aaaatctaaatct

SEQ ID NO: 545519 - DNA, 14 bp, D. melanogaster
aaaatctaacattt

SEQ ID NO: 545520 - DNA, 13 bp, D. melanogaster
aaaatctaataga

SEQ ID NO: 545521 - DNA, 13 bp, D. melanogaster
aaaatctacgaaa

SEQ ID NO: 545522 - DNA, 13 bp, D. melanogaster
aaaatctagttaa

SEQ ID NO: 545523 - DNA, 13 bp, D. melanogaster
aaaatctatagaa

SEQ ID NO: 545524 - DNA, 13 bp, D. melanogaster
aaaatctatgaac

SEQ ID NO: 545525 - DNA, 13 bp, D. melanogaster
aaaatctatgcaa

SEQ ID NO: 545526 - DNA, 13 bp, D. melanogaster
aaaatctattttc

SEQ ID NO: 545527 - DNA, 13 bp, D. melanogaster
aaaatctcaaatt

SEQ ID NO: 545528 - DNA, 13 bp, D. melanogaster
aaaatctcaattt

SEQ ID NO: 545529 - DNA, 13 bp, D. melanogaster
aaaatctcagaaa

SEQ ID NO: 545530 - DNA, 13 bp, D. melanogaster
aaaatctcattaa

SEQ ID NO: 545531 - DNA, 13 bp, D. melanogaster
aaaatctcattat

SEQ ID NO: 545532 - DNA, 13 bp, D. melanogaster
aaaatctctgata

SEQ ID NO: 545533 - DNA, 13 bp, D. melanogaster
aaaatctctttta

SEQ ID NO: 545534 - DNA, 13 bp, D. melanogaster
aaaatctgaaaat

SEQ ID NO: 545535 - DNA, 13 bp, D. melanogaster
aaaatctgaaagc

SEQ ID NO: 545536 - DNA, 13 bp, D. melanogaster
aaaatctgacaaa

SEQ ID NO: 545537 - DNA, 13 bp, D. melanogaster
aaaatctgattaa

SEQ ID NO: 545538 - DNA, 13 bp, D. melanogaster
aaaatctgcaaaa

SEQ ID NO: 545539 - DNA, 13 bp, D. melanogaster
aaaatctgcaatt

SEQ ID NO: 545540 - DNA, 13 bp, D. melanogaster
aaaatctggaaac

SEQ ID NO: 545541 - DNA, 14 bp, D. melanogaster
aaaatctggaaact

SEQ ID NO: 545542 - DNA, 13 bp, D. melanogaster
aaaatctggaaat

SEQ ID NO: 545543 - DNA, 13 bp, D. melanogaster
aaaatctggcaaa

SEQ ID NO: 545544 - DNA, 13 bp, D. melanogaster
aaaatctgggaaa

SEQ ID NO: 545545 - DNA, 13 bp, D. melanogaster
aaaatctgtaaaa

SEQ ID NO: 545546 - DNA, 14 bp, D. melanogaster
aaaatctgtaaaat

SEQ ID NO: 545547 - DNA, 13 bp, D. melanogaster
aaaatctgtaaat

SEQ ID NO: 545548 - DNA, 13 bp, D. melanogaster
aaaatctgtacaa

SEQ ID NO: 545549 - DNA, 13 bp, D. melanogaster
aaaatctgtgaaa

SEQ ID NO: 545550 - DNA, 14 bp, D. melanogaster
aaaatctgtgcaca

SEQ ID NO: 545551 - DNA, 13 bp, D. melanogaster
aaaatctgttaaa

SEQ ID NO: 545552 - DNA, 14 bp, D. melanogaster
aaaatctgttagaa

SEQ ID NO: 545553 - DNA, 13 bp, D. melanogaster
aaaatctgtttat

SEQ ID NO: 545554 - DNA, 13 bp, D. melanogaster
aaaatctgttttt

SEQ ID NO: 545555 - DNA, 13 bp, D. melanogaster
aaaatcttaaaga

SEQ ID NO: 545556 - DNA, 13 bp, D. melanogaster
aaaatcttaacta

SEQ ID NO: 545557 - DNA, 13 bp, D. melanogaster
aaaatcttaagaa

SEQ ID NO: 545558 - DNA, 13 bp, D. melanogaster
aaaatcttaagtt

SEQ ID NO: 545559 - DNA, 14 bp, D. melanogaster
aaaatcttatagat

SEQ ID NO: 545560 - DNA, 13 bp, D. melanogaster
aaaatcttatcaa

SEQ ID NO: 545561 - DNA, 13 bp, D. melanogaster
aaaatcttatttg

SEQ ID NO: 545562 - DNA, 13 bp, D. melanogaster
aaaatcttcaatt

SEQ ID NO: 545563 - DNA, 13 bp, D. melanogaster
aaaatcttcctcc

SEQ ID NO: 545564 - DNA, 14 bp, D. melanogaster
aaaatcttcctcct

SEQ ID NO: 545565 - DNA, 13 bp, D. melanogaster
aaaatcttgaaaa

SEQ ID NO: 545566 - DNA, 14 bp, D. melanogaster
aaaatcttgaaaca

SEQ ID NO: 545567 - DNA, 13 bp, D. melanogaster
aaaatcttgataa

SEQ ID NO: 545568 - DNA, 13 bp, D. melanogaster
aaaatcttgtaaa

SEQ ID NO: 545569 - DNA, 13 bp, D. melanogaster
aaaatctttaact

SEQ ID NO: 545570 - DNA, 13 bp, D. melanogaster
aaaatctttaaga

SEQ ID NO: 545571 - DNA, 13 bp, D. melanogaster
aaaatctttacaa

SEQ ID NO: 545572 - DNA, 13 bp, D. melanogaster
aaaatctttactg

SEQ ID NO: 545573 - DNA, 13 bp, D. melanogaster
aaaatctttagaa

SEQ ID NO: 545574 - DNA, 13 bp, D. melanogaster
aaaatctttcaat

SEQ ID NO: 545575 - DNA, 13 bp, D. melanogaster
aaaatctttcgat

SEQ ID NO: 545576 - DNA, 13 bp, D. melanogaster
aaaatctttgaaa

SEQ ID NO: 545577 - DNA, 14 bp, D. melanogaster
aaaatctttgaaaa

SEQ ID NO: 545578 - DNA, 14 bp, D. melanogaster
aaaatctttgaaat

SEQ ID NO: 545579 - DNA, 13 bp, D. melanogaster
aaaatctttgatt

SEQ ID NO: 545580 - DNA, 13 bp, D. melanogaster
aaaatcttttaag

SEQ ID NO: 545581 - DNA, 14 bp, D. melanogaster
aaaatcttttcaaa

SEQ ID NO: 545582 - DNA, 13 bp, D. melanogaster
aaaatcttttctt

SEQ ID NO: 545583 - DNA, 13 bp, D. melanogaster
aaaatcttttgat

SEQ ID NO: 545584 - DNA, 13 bp, D. melanogaster
aaaatcttttttg

SEQ ID NO: 545585 - DNA, 14 bp, D. melanogaster
aaaatgaaaacttt

SEQ ID NO: 545586 - DNA, 13 bp, D. melanogaster
aaaatgaaaatcg

SEQ ID NO: 545587 - DNA, 13 bp, D. melanogaster
aaaatgaaaatct

SEQ ID NO: 545588 - DNA, 14 bp, D. melanogaster
aaaatgaaaatgca

SEQ ID NO: 545589 - DNA, 14 bp, D. melanogaster
aaaatgaaacaatt

SEQ ID NO: 545590 - DNA, 13 bp, D. melanogaster
aaaatgaaaccga

SEQ ID NO: 545591 - DNA, 14 bp, D. melanogaster
aaaatgaaactgaa

SEQ ID NO: 545592 - DNA, 13 bp, D. melanogaster
aaaatgaaactgt

SEQ ID NO: 545593 - DNA, 13 bp, D. melanogaster
aaaatgaaacttt

SEQ ID NO: 545594 - DNA, 14 bp, D. melanogaster
aaaatgaaactttt

SEQ ID NO: 545595 - DNA, 13 bp, D. melanogaster
aaaatgaaagctg

SEQ ID NO: 545596 - DNA, 13 bp, D. melanogaster
aaaatgaaatcag

SEQ ID NO: 545597 - DNA, 13 bp, D. melanogaster
aaaatgaaatcat

SEQ ID NO: 545598 - DNA, 13 bp, D. melanogaster
aaaatgaaatggg

SEQ ID NO: 545599 - DNA, 14 bp, D. melanogaster
aaaatgaaatgggt

SEQ ID NO: 545600 - DNA, 13 bp, D. melanogaster
aaaatgaaatgtg

SEQ ID NO: 545601 - DNA, 13 bp, D. melanogaster
aaaatgaaatgtt

SEQ ID NO: 545602 - DNA, 13 bp, D. melanogaster
aaaatgaaattgc

SEQ ID NO: 545603 - DNA, 14 bp, D. melanogaster
aaaatgaaattgtt

SEQ ID NO: 545604 - DNA, 13 bp, D. melanogaster
aaaatgaacaatt

SEQ ID NO: 545605 - DNA, 13 bp, D. melanogaster
aaaatgaacatga

SEQ ID NO: 545606 - DNA, 13 bp, D. melanogaster
aaaatgaacggaa

SEQ ID NO: 545607 - DNA, 13 bp, D. melanogaster
aaaatgaactgaa

SEQ ID NO: 545608 - DNA, 13 bp, D. melanogaster
aaaatgaacttaa

SEQ ID NO: 545609 - DNA, 13 bp, D. melanogaster
aaaatgaacttat

SEQ ID NO: 545610 - DNA, 13 bp, D. melanogaster
aaaatgaacttta

SEQ ID NO: 545611 - DNA, 13 bp, D. melanogaster
aaaatgaactttt

SEQ ID NO: 545612 - DNA, 13 bp, D. melanogaster
aaaatgaagccat

SEQ ID NO: 545613 - DNA, 13 bp, D. melanogaster
aaaatgaatatct

SEQ ID NO: 545614 - DNA, 13 bp, D. melanogaster
aaaatgaatatgt

SEQ ID NO: 545615 - DNA, 13 bp, D. melanogaster
aaaatgaatcatt

SEQ ID NO: 545616 - DNA, 13 bp, D. melanogaster
aaaatgaatggca

SEQ ID NO: 545617 - DNA, 13 bp, D. melanogaster
aaaatgaatgtat

SEQ ID NO: 545618 - DNA, 13 bp, D. melanogaster
aaaatgaatgtgt

SEQ ID NO: 545619 - DNA, 14 bp, D. melanogaster
aaaatgaattacaa

SEQ ID NO: 545620 - DNA, 13 bp, D. melanogaster
aaaatgaattcaa

SEQ ID NO: 545621 - DNA, 13 bp, D. melanogaster
aaaatgaattctt

SEQ ID NO: 545622 - DNA, 14 bp, D. melanogaster
aaaatgaattcttt

SEQ ID NO: 545623 - DNA, 14 bp, D. melanogaster
aaaatgacaaaatt

SEQ ID NO: 545624 - DNA, 13 bp, D. melanogaster
aaaatgacaaatt

SEQ ID NO: 545625 - DNA, 13 bp, D. melanogaster
aaaatgacaatga

SEQ ID NO: 545626 - DNA, 13 bp, D. melanogaster
aaaatgacagcaa

SEQ ID NO: 545627 - DNA, 13 bp, D. melanogaster
aaaatgacattaa

SEQ ID NO: 545628 - DNA, 13 bp, D. melanogaster
aaaatgacatttg

SEQ ID NO: 545629 - DNA, 13 bp, D. melanogaster
aaaatgaccaact

SEQ ID NO: 545630 - DNA, 14 bp, D. melanogaster
aaaatgaccaactg

SEQ ID NO: 545631 - DNA, 13 bp, D. melanogaster
aaaatgacctggt

SEQ ID NO: 545632 - DNA, 14 bp, D. melanogaster
aaaatgactcaaaa

SEQ ID NO: 545633 - DNA, 13 bp, D. melanogaster
aaaatgactgaaa

SEQ ID NO: 545634 - DNA, 13 bp, D. melanogaster
aaaatgactttat

SEQ ID NO: 545635 - DNA, 13 bp, D. melanogaster
aaaatgagaatgg

SEQ ID NO: 545636 - DNA, 13 bp, D. melanogaster
aaaatgagaattc

SEQ ID NO: 545637 - DNA, 13 bp, D. melanogaster
aaaatgagaattt

SEQ ID NO: 545638 - DNA, 13 bp, D. melanogaster
aaaatgaggctga

SEQ ID NO: 545639 - DNA, 13 bp, D. melanogaster
aaaatgagtggaa

SEQ ID NO: 545640 - DNA, 13 bp, D. melanogaster
aaaatgagttcaa

SEQ ID NO: 545641 - DNA, 13 bp, D. melanogaster
aaaatgagttgat

SEQ ID NO: 545642 - DNA, 13 bp, D. melanogaster
aaaatgagtttaa

SEQ ID NO: 545643 - DNA, 14 bp, D. melanogaster
aaaatgataagagt

SEQ ID NO: 545644 - DNA, 13 bp, D. melanogaster
aaaatgataagtt

SEQ ID NO: 545645 - DNA, 13 bp, D. melanogaster
aaaatgatataca

SEQ ID NO: 545646 - DNA, 13 bp, D. melanogaster
aaaatgatatatg

SEQ ID NO: 545647 - DNA, 13 bp, D. melanogaster
aaaatgatatttg

SEQ ID NO: 545648 - DNA, 14 bp, D. melanogaster
aaaatgatcataaa

SEQ ID NO: 545649 - DNA, 13 bp, D. melanogaster
aaaatgatcttaa

SEQ ID NO: 545650 - DNA, 13 bp, D. melanogaster
aaaatgatgatga

SEQ ID NO: 545651 - DNA, 13 bp, D. melanogaster
aaaatgatgatgg

SEQ ID NO: 545652 - DNA, 14 bp, D. melanogaster
aaaatgatggcata

SEQ ID NO: 545653 - DNA, 13 bp, D. melanogaster
aaaatgatgtcag

SEQ ID NO: 545654 - DNA, 13 bp, D. melanogaster
aaaatgatgtttt

SEQ ID NO: 545655 - DNA, 13 bp, D. melanogaster
aaaatgattatca

SEQ ID NO: 545656 - DNA, 13 bp, D. melanogaster
aaaatgattcata

SEQ ID NO: 545657 - DNA, 13 bp, D. melanogaster
aaaatgattggat

SEQ ID NO: 545658 - DNA, 13 bp, D. melanogaster
aaaatgatttaag

SEQ ID NO: 545659 - DNA, 14 bp, D. melanogaster
aaaatgatttatgg

SEQ ID NO: 545660 - DNA, 13 bp, D. melanogaster
aaaatgatttcaa

SEQ ID NO: 545661 - DNA, 13 bp, D. melanogaster
aaaatgatttcat

SEQ ID NO: 545662 - DNA, 13 bp, D. melanogaster
aaaatgatttctt

SEQ ID NO: 545663 - DNA, 13 bp, D. melanogaster
aaaatgattttct

SEQ ID NO: 545664 - DNA, 14 bp, D. melanogaster
aaaatgcaaaaatt

SEQ ID NO: 545665 - DNA, 13 bp, D. melanogaster
aaaatgcaaaacg

SEQ ID NO: 545666 - DNA, 13 bp, D. melanogaster
aaaatgcaaaact

SEQ ID NO: 545667 - DNA, 13 bp, D. melanogaster
aaaatgcaaaatg

SEQ ID NO: 545668 - DNA, 14 bp, D. melanogaster
aaaatgcaaaatga

SEQ ID NO: 545669 - DNA, 14 bp, D. melanogaster
aaaatgcaaaatgc

SEQ ID NO: 545670 - DNA, 14 bp, D. melanogaster
aaaatgcaaacaca

SEQ ID NO: 545671 - DNA, 13 bp, D. melanogaster
aaaatgcaaacat

SEQ ID NO: 545672 - DNA, 14 bp, D. melanogaster
aaaatgcaaacatt

SEQ ID NO: 545673 - DNA, 13 bp, D. melanogaster
aaaatgcaaacca

SEQ ID NO: 545674 - DNA, 13 bp, D. melanogaster
aaaatgcaaagta

SEQ ID NO: 545675 - DNA, 14 bp, D. melanogaster
aaaatgcaaataat

SEQ ID NO: 545676 - DNA, 14 bp, D. melanogaster
aaaatgcaaatcaa

SEQ ID NO: 545677 - DNA, 13 bp, D. melanogaster
aaaatgcaaatcg

SEQ ID NO: 545678 - DNA, 14 bp, D. melanogaster
aaaatgcaaatgag

SEQ ID NO: 545679 - DNA, 13 bp, D. melanogaster
aaaatgcaaatgc

SEQ ID NO: 545680 - DNA, 14 bp, D. melanogaster
aaaatgcaaatgca

SEQ ID NO: 545681 - DNA, 13 bp, D. melanogaster
aaaatgcaaatgg

SEQ ID NO: 545682 - DNA, 14 bp, D. melanogaster
aaaatgcaaatgga

SEQ ID NO: 545683 - DNA, 14 bp, D. melanogaster
aaaatgcaaattaa

SEQ ID NO: 545684 - DNA, 14 bp, D. melanogaster
aaaatgcaaattat

SEQ ID NO: 545685 - DNA, 13 bp, D. melanogaster
aaaatgcaaattt

SEQ ID NO: 545686 - DNA, 14 bp, D. melanogaster
aaaatgcaaatttc

SEQ ID NO: 545687 - DNA, 13 bp, D. melanogaster
aaaatgcaacaac

SEQ ID NO: 545688 - DNA, 13 bp, D. melanogaster
aaaatgcaacaat

SEQ ID NO: 545689 - DNA, 13 bp, D. melanogaster
aaaatgcaacagc

SEQ ID NO: 545690 - DNA, 14 bp, D. melanogaster
aaaatgcaacattt

SEQ ID NO: 545691 - DNA, 13 bp, D. melanogaster
aaaatgcaaccaa

SEQ ID NO: 545692 - DNA, 13 bp, D. melanogaster
aaaatgcaaccag

SEQ ID NO: 545693 - DNA, 13 bp, D. melanogaster
aaaatgcaagtgc

SEQ ID NO: 545694 - DNA, 14 bp, D. melanogaster
aaaatgcaataaat

SEQ ID NO: 545695 - DNA, 14 bp, D. melanogaster
aaaatgcaatattt

SEQ ID NO: 545696 - DNA, 13 bp, D. melanogaster
aaaatgcaatcaa

SEQ ID NO: 545697 - DNA, 14 bp, D. melanogaster
aaaatgcaatcaat

SEQ ID NO: 545698 - DNA, 13 bp, D. melanogaster
aaaatgcaatgca

SEQ ID NO: 545699 - DNA, 13 bp, D. melanogaster
aaaatgcaattaa

SEQ ID NO: 545700 - DNA, 14 bp, D. melanogaster
aaaatgcaattaca

SEQ ID NO: 545701 - DNA, 13 bp, D. melanogaster
aaaatgcaatttt

SEQ ID NO: 545702 - DNA, 14 bp, D. melanogaster
aaaatgcaatttta

SEQ ID NO: 545703 - DNA, 14 bp, D. melanogaster
aaaatgcacaaaat

SEQ ID NO: 545704 - DNA, 13 bp, D. melanogaster
aaaatgcacaagt

SEQ ID NO: 545705 - DNA, 14 bp, D. melanogaster
aaaatgcacacaaa

SEQ ID NO: 545706 - DNA, 13 bp, D. melanogaster
aaaatgcacagca

SEQ ID NO: 545707 - DNA, 13 bp, D. melanogaster
aaaatgcacccaa

SEQ ID NO: 545708 - DNA, 13 bp, D. melanogaster
aaaatgcactcaa

SEQ ID NO: 545709 - DNA, 13 bp, D. melanogaster
aaaatgcactttt

SEQ ID NO: 545710 - DNA, 13 bp, D. melanogaster
aaaatgcagaaag

SEQ ID NO: 545711 - DNA, 13 bp, D. melanogaster
aaaatgcagaaat

SEQ ID NO: 545712 - DNA, 13 bp, D. melanogaster
aaaatgcagaaca

SEQ ID NO: 545713 - DNA, 13 bp, D. melanogaster
aaaatgcagaagc

SEQ ID NO: 545714 - DNA, 13 bp, D. melanogaster
aaaatgcagacct

SEQ ID NO: 545715 - DNA, 13 bp, D. melanogaster
aaaatgcagactt

SEQ ID NO: 545716 - DNA, 13 bp, D. melanogaster
aaaatgcagcaaa

SEQ ID NO: 545717 - DNA, 14 bp, D. melanogaster
aaaatgcagcaaaa

SEQ ID NO: 545718 - DNA, 13 bp, D. melanogaster
aaaatgcagcaac

SEQ ID NO: 545719 - DNA, 13 bp, D. melanogaster
aaaatgcagcaga

SEQ ID NO: 545720 - DNA, 13 bp, D. melanogaster
aaaatgcagcagc

SEQ ID NO: 545721 - DNA, 14 bp, D. melanogaster
aaaatgcagcagca

SEQ ID NO: 545722 - DNA, 13 bp, D. melanogaster
aaaatgcagctaa

SEQ ID NO: 545723 - DNA, 13 bp, D. melanogaster
aaaatgcagctgg

SEQ ID NO: 545724 - DNA, 14 bp, D. melanogaster
aaaatgcaggaaaa

SEQ ID NO: 545725 - DNA, 13 bp, D. melanogaster
aaaatgcaggcca

SEQ ID NO: 545726 - DNA, 13 bp, D. melanogaster
aaaatgcagtaaa

SEQ ID NO: 545727 - DNA, 13 bp, D. melanogaster
aaaatgcagtcaa

SEQ ID NO: 545728 - DNA, 13 bp, D. melanogaster
aaaatgcagtggc

SEQ ID NO: 545729 - DNA, 13 bp, D. melanogaster
aaaatgcagttaa

SEQ ID NO: 545730 - DNA, 13 bp, D. melanogaster
aaaatgcagttgc

SEQ ID NO: 545731 - DNA, 13 bp, D. melanogaster
aaaatgcagtttc

SEQ ID NO: 545732 - DNA, 13 bp, D. melanogaster
aaaatgcataaat

SEQ ID NO: 545733 - DNA, 13 bp, D. melanogaster
aaaatgcataatt

SEQ ID NO: 545734 - DNA, 13 bp, D. melanogaster
aaaatgcatacat

SEQ ID NO: 545735 - DNA, 13 bp, D. melanogaster
aaaatgcatataa

SEQ ID NO: 545736 - DNA, 14 bp, D. melanogaster
aaaatgcatataaa

SEQ ID NO: 545737 - DNA, 13 bp, D. melanogaster
aaaatgcatatat

SEQ ID NO: 545738 - DNA, 13 bp, D. melanogaster
aaaatgcatattt

SEQ ID NO: 545739 - DNA, 14 bp, D. melanogaster
aaaatgcatattta

SEQ ID NO: 545740 - DNA, 13 bp, D. melanogaster
aaaatgcatcaaa

SEQ ID NO: 545741 - DNA, 13 bp, D. melanogaster
aaaatgcatcgaa

SEQ ID NO: 545742 - DNA, 13 bp, D. melanogaster
aaaatgcatgaat

SEQ ID NO: 545743 - DNA, 13 bp, D. melanogaster
aaaatgcatgcga

SEQ ID NO: 545744 - DNA, 13 bp, D. melanogaster
aaaatgcatgttt

SEQ ID NO: 545745 - DNA, 13 bp, D. melanogaster
aaaatgcattaaa

SEQ ID NO: 545746 - DNA, 14 bp, D. melanogaster
aaaatgcattcaaa

SEQ ID NO: 545747 - DNA, 14 bp, D. melanogaster
aaaatgcattgaaa

SEQ ID NO: 545748 - DNA, 14 bp, D. melanogaster
aaaatgcatttaaa

SEQ ID NO: 545749 - DNA, 13 bp, D. melanogaster
aaaatgcatttca

SEQ ID NO: 545750 - DNA, 13 bp, D. melanogaster
aaaatgcattttt

SEQ ID NO: 545751 - DNA, 14 bp, D. melanogaster
aaaatgcattttta

SEQ ID NO: 545752 - DNA, 14 bp, D. melanogaster
aaaatgcatttttg

SEQ ID NO: 545753 - DNA, 14 bp, D. melanogaster
aaaatgcatttttt

SEQ ID NO: 545754 - DNA, 14 bp, D. melanogaster
aaaatgccaaaaag

SEQ ID NO: 545755 - DNA, 14 bp, D. melanogaster
aaaatgccaaaaat

SEQ ID NO: 545756 - DNA, 13 bp, D. melanogaster
aaaatgccaaaag

SEQ ID NO: 545757 - DNA, 14 bp, D. melanogaster
aaaatgccaaacaa

SEQ ID NO: 545758 - DNA, 14 bp, D. melanogaster
aaaatgccaaatgc

SEQ ID NO: 545759 - DNA, 14 bp, D. melanogaster
aaaatgccaacaaa

SEQ ID NO: 545760 - DNA, 13 bp, D. melanogaster
aaaatgccaacag

SEQ ID NO: 545761 - DNA, 13 bp, D. melanogaster
aaaatgccaacta

SEQ ID NO: 545762 - DNA, 13 bp, D. melanogaster
aaaatgccaactt

SEQ ID NO: 545763 - DNA, 13 bp, D. melanogaster
aaaatgccaagaa

SEQ ID NO: 545764 - DNA, 13 bp, D. melanogaster
aaaatgccaataa

SEQ ID NO: 545765 - DNA, 14 bp, D. melanogaster
aaaatgccaatcaa

SEQ ID NO: 545766 - DNA, 13 bp, D. melanogaster
aaaatgccaatta

SEQ ID NO: 545767 - DNA, 13 bp, D. melanogaster
aaaatgccaattt

SEQ ID NO: 545768 - DNA, 14 bp, D. melanogaster
aaaatgccacaaat

SEQ ID NO: 545769 - DNA, 13 bp, D. melanogaster
aaaatgccacgaa

SEQ ID NO: 545770 - DNA, 13 bp, D. melanogaster
aaaatgccagaga

SEQ ID NO: 545771 - DNA, 13 bp, D. melanogaster
aaaatgccagcaa

SEQ ID NO: 545772 - DNA, 14 bp, D. melanogaster
aaaatgccagcaaa

SEQ ID NO: 545773 - DNA, 13 bp, D. melanogaster
aaaatgccagcag

SEQ ID NO: 545774 - DNA, 13 bp, D. melanogaster
aaaatgccagcga

SEQ ID NO: 545775 - DNA, 13 bp, D. melanogaster
aaaatgccaggaa

SEQ ID NO: 545776 - DNA, 13 bp, D. melanogaster
aaaatgccaggca

SEQ ID NO: 545777 - DNA, 13 bp, D. melanogaster
aaaatgccataaa

SEQ ID NO: 545778 - DNA, 13 bp, D. melanogaster
aaaatgccatcaa

SEQ ID NO: 545779 - DNA, 13 bp, D. melanogaster
aaaatgccatcga

SEQ ID NO: 545780 - DNA, 13 bp, D. melanogaster
aaaatgcccactg

SEQ ID NO: 545781 - DNA, 13 bp, D. melanogaster
aaaatgccccaag

SEQ ID NO: 545782 - DNA, 14 bp, D. melanogaster
aaaatgccccagcc

SEQ ID NO: 545783 - DNA, 13 bp, D. melanogaster
aaaatgccgaaaa

SEQ ID NO: 545784 - DNA, 13 bp, D. melanogaster
aaaatgccgagaa

SEQ ID NO: 545785 - DNA, 13 bp, D. melanogaster
aaaatgccgaggc

SEQ ID NO: 545786 - DNA, 13 bp, D. melanogaster
aaaatgccgcaaa

SEQ ID NO: 545787 - DNA, 13 bp, D. melanogaster
aaaatgcctggaa

SEQ ID NO: 545788 - DNA, 13 bp, D. melanogaster
aaaatgcctttaa

SEQ ID NO: 545789 - DNA, 14 bp, D. melanogaster
aaaatgcctttaaa

SEQ ID NO: 545790 - DNA, 13 bp, D. melanogaster
aaaatgccttttg

SEQ ID NO: 545791 - DNA, 13 bp, D. melanogaster
aaaatgcgaaaac

SEQ ID NO: 545792 - DNA, 13 bp, D. melanogaster
aaaatgcgaaaat

SEQ ID NO: 545793 - DNA, 14 bp, D. melanogaster
aaaatgcgaaaatc

SEQ ID NO: 545794 - DNA, 13 bp, D. melanogaster
aaaatgcgaaata

SEQ ID NO: 545795 - DNA, 13 bp, D. melanogaster
aaaatgcgaacaa

SEQ ID NO: 545796 - DNA, 13 bp, D. melanogaster
aaaatgcgaataa

SEQ ID NO: 545797 - DNA, 13 bp, D. melanogaster
aaaatgcgaatat

SEQ ID NO: 545798 - DNA, 13 bp, D. melanogaster
aaaatgcgaatga

SEQ ID NO: 545799 - DNA, 13 bp, D. melanogaster
aaaatgcgagaaa

SEQ ID NO: 545800 - DNA, 13 bp, D. melanogaster
aaaatgcgattta

SEQ ID NO: 545801 - DNA, 13 bp, D. melanogaster
aaaatgcgcaaaa

SEQ ID NO: 545802 - DNA, 13 bp, D. melanogaster
aaaatgcgccaaa

SEQ ID NO: 545803 - DNA, 13 bp, D. melanogaster
aaaatgcggaaaa

SEQ ID NO: 545804 - DNA, 13 bp, D. melanogaster
aaaatgcgtctga

SEQ ID NO: 545805 - DNA, 13 bp, D. melanogaster
aaaatgcgtttaa

SEQ ID NO: 545806 - DNA, 13 bp, D. melanogaster
aaaatgcgttttg

SEQ ID NO: 545807 - DNA, 13 bp, D. melanogaster
aaaatgcgttttt

SEQ ID NO: 545808 - DNA, 14 bp, D. melanogaster
aaaatgctaataaa

SEQ ID NO: 545809 - DNA, 13 bp, D. melanogaster
aaaatgctaatta

SEQ ID NO: 545810 - DNA, 13 bp, D. melanogaster
aaaatgctaattg

SEQ ID NO: 545811 - DNA, 13 bp, D. melanogaster
aaaatgctaattt

SEQ ID NO: 545812 - DNA, 14 bp, D. melanogaster
aaaatgctacaaaa

SEQ ID NO: 545813 - DNA, 13 bp, D. melanogaster
aaaatgctagaaa

SEQ ID NO: 545814 - DNA, 13 bp, D. melanogaster
aaaatgctatata

SEQ ID NO: 545815 - DNA, 13 bp, D. melanogaster
aaaatgctatgaa

SEQ ID NO: 545816 - DNA, 13 bp, D. melanogaster
aaaatgctattaa

SEQ ID NO: 545817 - DNA, 13 bp, D. melanogaster
aaaatgctcaaaa

SEQ ID NO: 545818 - DNA, 13 bp, D. melanogaster
aaaatgctcaaca

SEQ ID NO: 545819 - DNA, 13 bp, D. melanogaster
aaaatgctcaatc

SEQ ID NO: 545820 - DNA, 13 bp, D. melanogaster
aaaatgctcatat

SEQ ID NO: 545821 - DNA, 14 bp, D. melanogaster
aaaatgctcatata

SEQ ID NO: 545822 - DNA, 13 bp, D. melanogaster
aaaatgctcattt

SEQ ID NO: 545823 - DNA, 13 bp, D. melanogaster
aaaatgctcttaa

SEQ ID NO: 545824 - DNA, 13 bp, D. melanogaster
aaaatgctgaaat

SEQ ID NO: 545825 - DNA, 14 bp, D. melanogaster
aaaatgctgaaatt

SEQ ID NO: 545826 - DNA, 13 bp, D. melanogaster
aaaatgctgacca

SEQ ID NO: 545827 - DNA, 13 bp, D. melanogaster
aaaatgctgataa

SEQ ID NO: 545828 - DNA, 13 bp, D. melanogaster
aaaatgctgatta

SEQ ID NO: 545829 - DNA, 13 bp, D. melanogaster
aaaatgctgcaca

SEQ ID NO: 545830 - DNA, 13 bp, D. melanogaster
aaaatgctgccaa

SEQ ID NO: 545831 - DNA, 13 bp, D. melanogaster
aaaatgctgctgt

SEQ ID NO: 545832 - DNA, 14 bp, D. melanogaster
aaaatgctggaaaa

SEQ ID NO: 545833 - DNA, 13 bp, D. melanogaster
aaaatgctggcaa

SEQ ID NO: 545834 - DNA, 14 bp, D. melanogaster
aaaatgctggcaaa

SEQ ID NO: 545835 - DNA, 13 bp, D. melanogaster
aaaatgctggctg

SEQ ID NO: 545836 - DNA, 13 bp, D. melanogaster
aaaatgctgttga

SEQ ID NO: 545837 - DNA, 13 bp, D. melanogaster
aaaatgctgtttt

SEQ ID NO: 545838 - DNA, 13 bp, D. melanogaster
aaaatgcttaaaa

SEQ ID NO: 545839 - DNA, 14 bp, D. melanogaster
aaaatgcttaaaat

SEQ ID NO: 545840 - DNA, 13 bp, D. melanogaster
aaaatgcttaaat

SEQ ID NO: 545841 - DNA, 14 bp, D. melanogaster
aaaatgcttaaatt

SEQ ID NO: 545842 - DNA, 13 bp, D. melanogaster
aaaatgcttaagc

SEQ ID NO: 545843 - DNA, 13 bp, D. melanogaster
aaaatgcttaatt

SEQ ID NO: 545844 - DNA, 13 bp, D. melanogaster
aaaatgcttataa

SEQ ID NO: 545845 - DNA, 13 bp, D. melanogaster
aaaatgcttcaaa

SEQ ID NO: 545846 - DNA, 13 bp, D. melanogaster
aaaatgcttgaaa

SEQ ID NO: 545847 - DNA, 13 bp, D. melanogaster
aaaatgcttgttt

SEQ ID NO: 545848 - DNA, 14 bp, D. melanogaster
aaaatgctttaaaa

SEQ ID NO: 545849 - DNA, 13 bp, D. melanogaster
aaaatgctttaat

SEQ ID NO: 545850 - DNA, 13 bp, D. melanogaster
aaaatgcttttat

SEQ ID NO: 545851 - DNA, 13 bp, D. melanogaster
aaaatgcttttgg

SEQ ID NO: 545852 - DNA, 14 bp, D. melanogaster
aaaatggaaaaatc

SEQ ID NO: 545853 - DNA, 13 bp, D. melanogaster
aaaatggaaaacg

SEQ ID NO: 545854 - DNA, 13 bp, D. melanogaster
aaaatggaaaagc

SEQ ID NO: 545855 - DNA, 14 bp, D. melanogaster
aaaatggaaaatgc

SEQ ID NO: 545856 - DNA, 13 bp, D. melanogaster
aaaatggaaacag

SEQ ID NO: 545857 - DNA, 14 bp, D. melanogaster
aaaatggaaacttt

SEQ ID NO: 545858 - DNA, 13 bp, D. melanogaster
aaaatggaaagcc

SEQ ID NO: 545859 - DNA, 13 bp, D. melanogaster
aaaatggaaagcg

SEQ ID NO: 545860 - DNA, 13 bp, D. melanogaster
aaaatggaaagtg

SEQ ID NO: 545861 - DNA, 14 bp, D. melanogaster
aaaatggaaatcaa

SEQ ID NO: 545862 - DNA, 13 bp, D. melanogaster
aaaatggaaatct

SEQ ID NO: 545863 - DNA, 14 bp, D. melanogaster
aaaatggaaattca

SEQ ID NO: 545864 - DNA, 13 bp, D. melanogaster
aaaatggaagtgg

SEQ ID NO: 545865 - DNA, 13 bp, D. melanogaster
aaaatggaatagc

SEQ ID NO: 545866 - DNA, 13 bp, D. melanogaster
aaaatggaattga

SEQ ID NO: 545867 - DNA, 13 bp, D. melanogaster
aaaatggaatttt

SEQ ID NO: 545868 - DNA, 14 bp, D. melanogaster
aaaatggaattttt

SEQ ID NO: 545869 - DNA, 13 bp, D. melanogaster
aaaatggagcagc

SEQ ID NO: 545870 - DNA, 14 bp, D. melanogaster
aaaatggagttata

SEQ ID NO: 545871 - DNA, 13 bp, D. melanogaster
aaaatggatatgg

SEQ ID NO: 545872 - DNA, 13 bp, D. melanogaster
aaaatggatccat

SEQ ID NO: 545873 - DNA, 13 bp, D. melanogaster
aaaatggattcaa

SEQ ID NO: 545874 - DNA, 14 bp, D. melanogaster
aaaatggattcaat

SEQ ID NO: 545875 - DNA, 13 bp, D. melanogaster
aaaatggatttta

SEQ ID NO: 545876 - DNA, 14 bp, D. melanogaster
aaaatggattttaa

SEQ ID NO: 545877 - DNA, 13 bp, D. melanogaster
aaaatggattttt

SEQ ID NO: 545878 - DNA, 14 bp, D. melanogaster
aaaatggcaaaaat

SEQ ID NO: 545879 - DNA, 13 bp, D. melanogaster
aaaatggcaaaac

SEQ ID NO: 545880 - DNA, 14 bp, D. melanogaster
aaaatggcaaacaa

SEQ ID NO: 545881 - DNA, 13 bp, D. melanogaster
aaaatggcaaatg

SEQ ID NO: 545882 - DNA, 14 bp, D. melanogaster
aaaatggcaaatgg

SEQ ID NO: 545883 - DNA, 13 bp, D. melanogaster
aaaatggcaaatt

SEQ ID NO: 545884 - DNA, 13 bp, D. melanogaster
aaaatggcaacat

SEQ ID NO: 545885 - DNA, 13 bp, D. melanogaster
aaaatggcaactt

SEQ ID NO: 545886 - DNA, 13 bp, D. melanogaster
aaaatggcaagag

SEQ ID NO: 545887 - DNA, 13 bp, D. melanogaster
aaaatggcaagcg

SEQ ID NO: 545888 - DNA, 14 bp, D. melanogaster
aaaatggcaataaa

SEQ ID NO: 545889 - DNA, 14 bp, D. melanogaster
aaaatggcaattaa

SEQ ID NO: 545890 - DNA, 13 bp, D. melanogaster
aaaatggcaattg

SEQ ID NO: 545891 - DNA, 13 bp, D. melanogaster
aaaatggcacaca

SEQ ID NO: 545892 - DNA, 13 bp, D. melanogaster
aaaatggcagaag

SEQ ID NO: 545893 - DNA, 13 bp, D. melanogaster
aaaatggcagcaa

SEQ ID NO: 545894 - DNA, 13 bp, D. melanogaster
aaaatggcataat

SEQ ID NO: 545895 - DNA, 13 bp, D. melanogaster
aaaatggcatatt

SEQ ID NO: 545896 - DNA, 13 bp, D. melanogaster
aaaatggcattca

SEQ ID NO: 545897 - DNA, 14 bp, D. melanogaster
aaaatggcatttaa

SEQ ID NO: 545898 - DNA, 13 bp, D. melanogaster
aaaatggcatttt

SEQ ID NO: 545899 - DNA, 13 bp, D. melanogaster
aaaatggccaaaa

SEQ ID NO: 545900 - DNA, 14 bp, D. melanogaster
aaaatggccaaaaa

SEQ ID NO: 545901 - DNA, 13 bp, D. melanogaster
aaaatggccaacg

SEQ ID NO: 545902 - DNA, 13 bp, D. melanogaster
aaaatggccaagc

SEQ ID NO: 545903 - DNA, 13 bp, D. melanogaster
aaaatggccaatt

SEQ ID NO: 545904 - DNA, 13 bp, D. melanogaster
aaaatggccacaa

SEQ ID NO: 545905 - DNA, 13 bp, D. melanogaster
aaaatggccagga

SEQ ID NO: 545906 - DNA, 13 bp, D. melanogaster
aaaatggccataa

SEQ ID NO: 545907 - DNA, 14 bp, D. melanogaster
aaaatggcccaaaa

SEQ ID NO: 545908 - DNA, 13 bp, D. melanogaster
aaaatggccgcca

SEQ ID NO: 545909 - DNA, 13 bp, D. melanogaster
aaaatggcgaaaa

SEQ ID NO: 545910 - DNA, 14 bp, D. melanogaster
aaaatggcgaaaaa

SEQ ID NO: 545911 - DNA, 13 bp, D. melanogaster
aaaatggcgaaat

SEQ ID NO: 545912 - DNA, 13 bp, D. melanogaster
aaaatggcgatgg

SEQ ID NO: 545913 - DNA, 13 bp, D. melanogaster
aaaatggcggcca

SEQ ID NO: 545914 - DNA, 13 bp, D. melanogaster
aaaatggcgttaa

SEQ ID NO: 545915 - DNA, 14 bp, D. melanogaster
aaaatggctaaaaa

SEQ ID NO: 545916 - DNA, 13 bp, D. melanogaster
aaaatggctcaag

SEQ ID NO: 545917 - DNA, 14 bp, D. melanogaster
aaaatggctgaaaa

SEQ ID NO: 545918 - DNA, 13 bp, D. melanogaster
aaaatggctgcaa

SEQ ID NO: 545919 - DNA, 13 bp, D. melanogaster
aaaatggctggaa

SEQ ID NO: 545920 - DNA, 13 bp, D. melanogaster
aaaatggcttaaa

SEQ ID NO: 545921 - DNA, 13 bp, D. melanogaster
aaaatggcttaat

SEQ ID NO: 545922 - DNA, 13 bp, D. melanogaster
aaaatggctttgt

SEQ ID NO: 545923 - DNA, 13 bp, D. melanogaster
aaaatgggaaaac

SEQ ID NO: 545924 - DNA, 14 bp, D. melanogaster
aaaatgggaaaaca

SEQ ID NO: 545925 - DNA, 14 bp, D. melanogaster
aaaatgggaaaagc

SEQ ID NO: 545926 - DNA, 13 bp, D. melanogaster
aaaatgggaaacg

SEQ ID NO: 545927 - DNA, 13 bp, D. melanogaster
aaaatgggaattt

SEQ ID NO: 545928 - DNA, 13 bp, D. melanogaster
aaaatgggacaaa

SEQ ID NO: 545929 - DNA, 13 bp, D. melanogaster
aaaatgggacata

SEQ ID NO: 545930 - DNA, 14 bp, D. melanogaster
aaaatgggacataa

SEQ ID NO: 545931 - DNA, 13 bp, D. melanogaster
aaaatgggcaaaa

SEQ ID NO: 545932 - DNA, 13 bp, D. melanogaster
aaaatgggcaaac

SEQ ID NO: 545933 - DNA, 13 bp, D. melanogaster
aaaatgggcaaat

SEQ ID NO: 545934 - DNA, 13 bp, D. melanogaster
aaaatgggcggaa

SEQ ID NO: 545935 - DNA, 13 bp, D. melanogaster
aaaatgggtaatt

SEQ ID NO: 545936 - DNA, 14 bp, D. melanogaster
aaaatgggtaattg

SEQ ID NO: 545937 - DNA, 13 bp, D. melanogaster
aaaatgggtgaaa

SEQ ID NO: 545938 - DNA, 13 bp, D. melanogaster
aaaatgggttaat

SEQ ID NO: 545939 - DNA, 14 bp, D. melanogaster
aaaatggtaatgaa

SEQ ID NO: 545940 - DNA, 13 bp, D. melanogaster
aaaatggtaattc

SEQ ID NO: 545941 - DNA, 13 bp, D. melanogaster
aaaatggtaattt

SEQ ID NO: 545942 - DNA, 13 bp, D. melanogaster
aaaatggtatcaa

SEQ ID NO: 545943 - DNA, 13 bp, D. melanogaster
aaaatggtcaaaa

SEQ ID NO: 545944 - DNA, 14 bp, D. melanogaster
aaaatggtcaaaaa

SEQ ID NO: 545945 - DNA, 13 bp, D. melanogaster
aaaatggtgcaaa

SEQ ID NO: 545946 - DNA, 13 bp, D. melanogaster
aaaatggttaaat

SEQ ID NO: 545947 - DNA, 13 bp, D. melanogaster
aaaatggttaatt

SEQ ID NO: 545948 - DNA, 13 bp, D. melanogaster
aaaatggttataa

SEQ ID NO: 545949 - DNA, 13 bp, D. melanogaster
aaaatggttattt

SEQ ID NO: 545950 - DNA, 13 bp, D. melanogaster
aaaatggttcaaa

SEQ ID NO: 545951 - DNA, 13 bp, D. melanogaster
aaaatggttcggt

SEQ ID NO: 545952 - DNA, 13 bp, D. melanogaster
aaaatggttgaaa

SEQ ID NO: 545953 - DNA, 13 bp, D. melanogaster
aaaatggtttaat

SEQ ID NO: 545954 - DNA, 13 bp, D. melanogaster
aaaatggtttact

SEQ ID NO: 545955 - DNA, 14 bp, D. melanogaster
aaaatggtttgaaa

SEQ ID NO: 545956 - DNA, 13 bp, D. melanogaster
aaaatggttttat

SEQ ID NO: 545957 - DNA, 13 bp, D. melanogaster
aaaatggttttta

SEQ ID NO: 545958 - DNA, 14 bp, D. melanogaster
aaaatgtaaaactt

SEQ ID NO: 545959 - DNA, 14 bp, D. melanogaster
aaaatgtaaacaat

SEQ ID NO: 545960 - DNA, 13 bp, D. melanogaster
aaaatgtaaacag

SEQ ID NO: 545961 - DNA, 13 bp, D. melanogaster
aaaatgtaaactg

SEQ ID NO: 545962 - DNA, 14 bp, D. melanogaster
aaaatgtaaataca

SEQ ID NO: 545963 - DNA, 13 bp, D. melanogaster
aaaatgtaaatgt

SEQ ID NO: 545964 - DNA, 14 bp, D. melanogaster
aaaatgtaacaaat

SEQ ID NO: 545965 - DNA, 13 bp, D. melanogaster
aaaatgtaactaa

SEQ ID NO: 545966 - DNA, 13 bp, D. melanogaster
aaaatgtaatcaa

SEQ ID NO: 545967 - DNA, 14 bp, D. melanogaster
aaaatgtaatttca

SEQ ID NO: 545968 - DNA, 14 bp, D. melanogaster
aaaatgtacaaaat

SEQ ID NO: 545969 - DNA, 13 bp, D. melanogaster
aaaatgtacaaac

SEQ ID NO: 545970 - DNA, 13 bp, D. melanogaster
aaaatgtacaaag

SEQ ID NO: 545971 - DNA, 13 bp, D. melanogaster
aaaatgtacaaat

SEQ ID NO: 545972 - DNA, 14 bp, D. melanogaster
aaaatgtacaaatt

SEQ ID NO: 545973 - DNA, 13 bp, D. melanogaster
aaaatgtacaaga

SEQ ID NO: 545974 - DNA, 13 bp, D. melanogaster
aaaatgtacaatt

SEQ ID NO: 545975 - DNA, 14 bp, D. melanogaster
aaaatgtacacaaa

SEQ ID NO: 545976 - DNA, 13 bp, D. melanogaster
aaaatgtacacat

SEQ ID NO: 545977 - DNA, 13 bp, D. melanogaster
aaaatgtacactt

SEQ ID NO: 545978 - DNA, 13 bp, D. melanogaster
aaaatgtacattt

SEQ ID NO: 545979 - DNA, 14 bp, D. melanogaster
aaaatgtacgaaaa

SEQ ID NO: 545980 - DNA, 13 bp, D. melanogaster
aaaatgtactcaa

SEQ ID NO: 545981 - DNA, 13 bp, D. melanogaster
aaaatgtagcaat

SEQ ID NO: 545982 - DNA, 13 bp, D. melanogaster
aaaatgtagccaa

SEQ ID NO: 545983 - DNA, 13 bp, D. melanogaster
aaaatgtagttaa

SEQ ID NO: 545984 - DNA, 13 bp, D. melanogaster
aaaatgtagtttc

SEQ ID NO: 545985 - DNA, 13 bp, D. melanogaster
aaaatgtagtttt

SEQ ID NO: 545986 - DNA, 13 bp, D. melanogaster
aaaatgtataagc

SEQ ID NO: 545987 - DNA, 14 bp, D. melanogaster
aaaatgtatacaaa

SEQ ID NO: 545988 - DNA, 13 bp, D. melanogaster
aaaatgtatatgc

SEQ ID NO: 545989 - DNA, 13 bp, D. melanogaster
aaaatgtatcatc

SEQ ID NO: 545990 - DNA, 13 bp, D. melanogaster
aaaatgtatcatt

SEQ ID NO: 545991 - DNA, 13 bp, D. melanogaster
aaaatgtatctat

SEQ ID NO: 545992 - DNA, 13 bp, D. melanogaster
aaaatgtatctca

SEQ ID NO: 545993 - DNA, 13 bp, D. melanogaster
aaaatgtatctgt

SEQ ID NO: 545994 - DNA, 14 bp, D. melanogaster
aaaatgtatctgta

SEQ ID NO: 545995 - DNA, 13 bp, D. melanogaster
aaaatgtatcttc

SEQ ID NO: 545996 - DNA, 13 bp, D. melanogaster
aaaatgtatgcaa

SEQ ID NO: 545997 - DNA, 14 bp, D. melanogaster
aaaatgtatgcaaa

SEQ ID NO: 545998 - DNA, 13 bp, D. melanogaster
aaaatgtatgcat

SEQ ID NO: 545999 - DNA, 13 bp, D. melanogaster
aaaatgtatgcta

SEQ ID NO: 546000 - DNA, 13 bp, D. melanogaster
aaaatgtatgctt

SEQ ID NO: 546001 - DNA, 13 bp, D. melanogaster
aaaatgtatggca

SEQ ID NO: 546002 - DNA, 13 bp, D. melanogaster
aaaatgtatgtat

SEQ ID NO: 546003 - DNA, 13 bp, D. melanogaster
aaaatgtattact

SEQ ID NO: 546004 - DNA, 14 bp, D. melanogaster
aaaatgtattcaaa

SEQ ID NO: 546005 - DNA, 13 bp, D. melanogaster
aaaatgtattcat

SEQ ID NO: 546006 - DNA, 14 bp, D. melanogaster
aaaatgtattcata

SEQ ID NO: 546007 - DNA, 13 bp, D. melanogaster
aaaatgtattgta

SEQ ID NO: 546008 - DNA, 13 bp, D. melanogaster
aaaatgtattgtt

SEQ ID NO: 546009 - DNA, 13 bp, D. melanogaster
aaaatgtatttca

SEQ ID NO: 546010 - DNA, 14 bp, D. melanogaster
aaaatgtatttcat

SEQ ID NO: 546011 - DNA, 13 bp, D. melanogaster
aaaatgtatttcc

SEQ ID NO: 546012 - DNA, 13 bp, D. melanogaster
aaaatgtattttg

SEQ ID NO: 546013 - DNA, 14 bp, D. melanogaster
aaaatgtattttga

SEQ ID NO: 546014 - DNA, 14 bp, D. melanogaster
aaaatgtcaaaaag

SEQ ID NO: 546015 - DNA, 14 bp, D. melanogaster
aaaatgtcaaaaat

SEQ ID NO: 546016 - DNA, 13 bp, D. melanogaster
aaaatgtcaaaat

SEQ ID NO: 546017 - DNA, 13 bp, D. melanogaster
aaaatgtcaaacg

SEQ ID NO: 546018 - DNA, 13 bp, D. melanogaster
aaaatgtcaaaga

SEQ ID NO: 546019 - DNA, 13 bp, D. melanogaster
aaaatgtcaaatt

SEQ ID NO: 546020 - DNA, 13 bp, D. melanogaster
aaaatgtcaacaa

SEQ ID NO: 546021 - DNA, 14 bp, D. melanogaster
aaaatgtcaacaag

SEQ ID NO: 546022 - DNA, 13 bp, D. melanogaster
aaaatgtcaattt

SEQ ID NO: 546023 - DNA, 13 bp, D. melanogaster
aaaatgtcacaaa

SEQ ID NO: 546024 - DNA, 13 bp, D. melanogaster
aaaatgtcacata

SEQ ID NO: 546025 - DNA, 13 bp, D. melanogaster
aaaatgtcacatt

SEQ ID NO: 546026 - DNA, 13 bp, D. melanogaster
aaaatgtcagcga

SEQ ID NO: 546027 - DNA, 13 bp, D. melanogaster
aaaatgtcatatt

SEQ ID NO: 546028 - DNA, 13 bp, D. melanogaster
aaaatgtcatcaa

SEQ ID NO: 546029 - DNA, 13 bp, D. melanogaster
aaaatgtcattaa

SEQ ID NO: 546030 - DNA, 14 bp, D. melanogaster
aaaatgtcattaaa

SEQ ID NO: 546031 - DNA, 13 bp, D. melanogaster
aaaatgtcattgc

SEQ ID NO: 546032 - DNA, 13 bp, D. melanogaster
aaaatgtcatttt

SEQ ID NO: 546033 - DNA, 13 bp, D. melanogaster
aaaatgtccaaca

SEQ ID NO: 546034 - DNA, 13 bp, D. melanogaster
aaaatgtccttgc

SEQ ID NO: 546035 - DNA, 13 bp, D. melanogaster
aaaatgtcctttg

SEQ ID NO: 546036 - DNA, 13 bp, D. melanogaster
aaaatgtcgaaat

SEQ ID NO: 546037 - DNA, 13 bp, D. melanogaster
aaaatgtctaatt

SEQ ID NO: 546038 - DNA, 13 bp, D. melanogaster
aaaatgtctattt

SEQ ID NO: 546039 - DNA, 13 bp, D. melanogaster
aaaatgtcttcaa

SEQ ID NO: 546040 - DNA, 13 bp, D. melanogaster
aaaatgtgaaaac

SEQ ID NO: 546041 - DNA, 14 bp, D. melanogaster
aaaatgtgaaaatg

SEQ ID NO: 546042 - DNA, 13 bp, D. melanogaster
aaaatgtgaaaca

SEQ ID NO: 546043 - DNA, 14 bp, D. melanogaster
aaaatgtgaaacat

SEQ ID NO: 546044 - DNA, 13 bp, D. melanogaster
aaaatgtgaaagc

SEQ ID NO: 546045 - DNA, 13 bp, D. melanogaster
aaaatgtgaaatt

SEQ ID NO: 546046 - DNA, 13 bp, D. melanogaster
aaaatgtgaacaa

SEQ ID NO: 546047 - DNA, 13 bp, D. melanogaster
aaaatgtgaatgt

SEQ ID NO: 546048 - DNA, 13 bp, D. melanogaster
aaaatgtgaattt

SEQ ID NO: 546049 - DNA, 13 bp, D. melanogaster
aaaatgtgattga

SEQ ID NO: 546050 - DNA, 13 bp, D. melanogaster
aaaatgtgcaaaa

SEQ ID NO: 546051 - DNA, 13 bp, D. melanogaster
aaaatgtgcaaca

SEQ ID NO: 546052 - DNA, 13 bp, D. melanogaster
aaaatgtgcaact

SEQ ID NO: 546053 - DNA, 13 bp, D. melanogaster
aaaatgtgcaatt

SEQ ID NO: 546054 - DNA, 13 bp, D. melanogaster
aaaatgtgcacaa

SEQ ID NO: 546055 - DNA, 13 bp, D. melanogaster
aaaatgtgcacat

SEQ ID NO: 546056 - DNA, 14 bp, D. melanogaster
aaaatgtgcataaa

SEQ ID NO: 546057 - DNA, 13 bp, D. melanogaster
aaaatgtgccaaa

SEQ ID NO: 546058 - DNA, 13 bp, D. melanogaster
aaaatgtgccaag

SEQ ID NO: 546059 - DNA, 13 bp, D. melanogaster
aaaatgtgcgaaa

SEQ ID NO: 546060 - DNA, 13 bp, D. melanogaster
aaaatgtgctgca

SEQ ID NO: 546061 - DNA, 13 bp, D. melanogaster
aaaatgtgcttaa

SEQ ID NO: 546062 - DNA, 13 bp, D. melanogaster
aaaatgtgcttta

SEQ ID NO: 546063 - DNA, 13 bp, D. melanogaster
aaaatgtgctttc

SEQ ID NO: 546064 - DNA, 13 bp, D. melanogaster
aaaatgtggaaat

SEQ ID NO: 546065 - DNA, 13 bp, D. melanogaster
aaaatgtggagca

SEQ ID NO: 546066 - DNA, 14 bp, D. melanogaster
aaaatgtggagcag

SEQ ID NO: 546067 - DNA, 13 bp, D. melanogaster
aaaatgtggcaaa

SEQ ID NO: 546068 - DNA, 13 bp, D. melanogaster
aaaatgtggcaag

SEQ ID NO: 546069 - DNA, 13 bp, D. melanogaster
aaaatgtggcaca

SEQ ID NO: 546070 - DNA, 13 bp, D. melanogaster
aaaatgtggcagg

SEQ ID NO: 546071 - DNA, 13 bp, D. melanogaster
aaaatgtggccaa

SEQ ID NO: 546072 - DNA, 13 bp, D. melanogaster
aaaatgtgggaaa

SEQ ID NO: 546073 - DNA, 14 bp, D. melanogaster
aaaatgtggggaaa

SEQ ID NO: 546074 - DNA, 13 bp, D. melanogaster
aaaatgtgggtgg

SEQ ID NO: 546075 - DNA, 14 bp, D. melanogaster
aaaatgtgtaaaga

SEQ ID NO: 546076 - DNA, 13 bp, D. melanogaster
aaaatgtgtaaat

SEQ ID NO: 546077 - DNA, 13 bp, D. melanogaster
aaaatgtgtaata

SEQ ID NO: 546078 - DNA, 14 bp, D. melanogaster
aaaatgtgtacaaa

SEQ ID NO: 546079 - DNA, 13 bp, D. melanogaster
aaaatgtgtagaa

SEQ ID NO: 546080 - DNA, 13 bp, D. melanogaster
aaaatgtgtattt

SEQ ID NO: 546081 - DNA, 13 bp, D. melanogaster
aaaatgtgtcaaa

SEQ ID NO: 546082 - DNA, 14 bp, D. melanogaster
aaaatgtgtcaaaa

SEQ ID NO: 546083 - DNA, 13 bp, D. melanogaster
aaaatgtgtcttt

SEQ ID NO: 546084 - DNA, 13 bp, D. melanogaster
aaaatgtgtgaaa

SEQ ID NO: 546085 - DNA, 14 bp, D. melanogaster
aaaatgtgtgaaaa

SEQ ID NO: 546086 - DNA, 13 bp, D. melanogaster
aaaatgtgtgatt

SEQ ID NO: 546087 - DNA, 13 bp, D. melanogaster
aaaatgtgtggaa

SEQ ID NO: 546088 - DNA, 13 bp, D. melanogaster
aaaatgtgtggca

SEQ ID NO: 546089 - DNA, 13 bp, D. melanogaster
aaaatgtgtgtaa

SEQ ID NO: 546090 - DNA, 13 bp, D. melanogaster
aaaatgtgttaaa

SEQ ID NO: 546091 - DNA, 14 bp, D. melanogaster
aaaatgtgttaaat

SEQ ID NO: 546092 - DNA, 13 bp, D. melanogaster
aaaatgtgttaag

SEQ ID NO: 546093 - DNA, 13 bp, D. melanogaster
aaaatgtgttaat

SEQ ID NO: 546094 - DNA, 13 bp, D. melanogaster
aaaatgtgttcac

SEQ ID NO: 546095 - DNA, 13 bp, D. melanogaster
aaaatgtgttgaa

SEQ ID NO: 546096 - DNA, 13 bp, D. melanogaster
aaaatgtgtttaa

SEQ ID NO: 546097 - DNA, 13 bp, D. melanogaster
aaaatgtgtttac

SEQ ID NO: 546098 - DNA, 13 bp, D. melanogaster
aaaatgtgtttat

SEQ ID NO: 546099 - DNA, 14 bp, D. melanogaster
aaaatgtgtttata

SEQ ID NO: 546100 - DNA, 14 bp, D. melanogaster
aaaatgtgtttatt

SEQ ID NO: 546101 - DNA, 13 bp, D. melanogaster
aaaatgttaaaac

SEQ ID NO: 546102 - DNA, 14 bp, D. melanogaster
aaaatgttaaacaa

SEQ ID NO: 546103 - DNA, 13 bp, D. melanogaster
aaaatgttaaagc

SEQ ID NO: 546104 - DNA, 13 bp, D. melanogaster
aaaatgttaaatc

SEQ ID NO: 546105 - DNA, 13 bp, D. melanogaster
aaaatgttaaatg

SEQ ID NO: 546106 - DNA, 13 bp, D. melanogaster
aaaatgttaacaa

SEQ ID NO: 546107 - DNA, 13 bp, D. melanogaster
aaaatgttaagtg

SEQ ID NO: 546108 - DNA, 13 bp, D. melanogaster
aaaatgttaatgt

SEQ ID NO: 546109 - DNA, 13 bp, D. melanogaster
aaaatgttaattg

SEQ ID NO: 546110 - DNA, 13 bp, D. melanogaster
aaaatgttacttt

SEQ ID NO: 546111 - DNA, 13 bp, D. melanogaster
aaaatgttagcta

SEQ ID NO: 546112 - DNA, 13 bp, D. melanogaster
aaaatgttagtat

SEQ ID NO: 546113 - DNA, 13 bp, D. melanogaster
aaaatgttataca

SEQ ID NO: 546114 - DNA, 13 bp, D. melanogaster
aaaatgttatcaa

SEQ ID NO: 546115 - DNA, 13 bp, D. melanogaster
aaaatgttatcga

SEQ ID NO: 546116 - DNA, 13 bp, D. melanogaster
aaaatgttatcta

SEQ ID NO: 546117 - DNA, 13 bp, D. melanogaster
aaaatgttatgca

SEQ ID NO: 546118 - DNA, 13 bp, D. melanogaster
aaaatgttatgta

SEQ ID NO: 546119 - DNA, 14 bp, D. melanogaster
aaaatgttcaacaa

SEQ ID NO: 546120 - DNA, 13 bp, D. melanogaster
aaaatgttcaact

SEQ ID NO: 546121 - DNA, 13 bp, D. melanogaster
aaaatgttcaata

SEQ ID NO: 546122 - DNA, 13 bp, D. melanogaster
aaaatgttcaatt

SEQ ID NO: 546123 - DNA, 14 bp, D. melanogaster
aaaatgttcaatta

SEQ ID NO: 546124 - DNA, 13 bp, D. melanogaster
aaaatgttcactt

SEQ ID NO: 546125 - DNA, 13 bp, D. melanogaster
aaaatgttcataa

SEQ ID NO: 546126 - DNA, 13 bp, D. melanogaster
aaaatgttcatca

SEQ ID NO: 546127 - DNA, 13 bp, D. melanogaster
aaaatgttcattg

SEQ ID NO: 546128 - DNA, 13 bp, D. melanogaster
aaaatgttcattt

SEQ ID NO: 546129 - DNA, 14 bp, D. melanogaster
aaaatgttcatttt

SEQ ID NO: 546130 - DNA, 13 bp, D. melanogaster
aaaatgttccaat

SEQ ID NO: 546131 - DNA, 13 bp, D. melanogaster
aaaatgttccatt

SEQ ID NO: 546132 - DNA, 13 bp, D. melanogaster
aaaatgttccttt

SEQ ID NO: 546133 - DNA, 13 bp, D. melanogaster
aaaatgttcgatt

SEQ ID NO: 546134 - DNA, 13 bp, D. melanogaster
aaaatgttctaaa

SEQ ID NO: 546135 - DNA, 13 bp, D. melanogaster
aaaatgttctcat

SEQ ID NO: 546136 - DNA, 13 bp, D. melanogaster
aaaatgttcttaa

SEQ ID NO: 546137 - DNA, 13 bp, D. melanogaster
aaaatgttcttat

SEQ ID NO: 546138 - DNA, 13 bp, D. melanogaster
aaaatgttcttgt

SEQ ID NO: 546139 - DNA, 13 bp, D. melanogaster
aaaatgttgaaac

SEQ ID NO: 546140 - DNA, 13 bp, D. melanogaster
aaaatgttgaaat

SEQ ID NO: 546141 - DNA, 13 bp, D. melanogaster
aaaatgttgaata

SEQ ID NO: 546142 - DNA, 13 bp, D. melanogaster
aaaatgttgaatg

SEQ ID NO: 546143 - DNA, 13 bp, D. melanogaster
aaaatgttgacaa

SEQ ID NO: 546144 - DNA, 13 bp, D. melanogaster
aaaatgttgagca

SEQ ID NO: 546145 - DNA, 13 bp, D. melanogaster
aaaatgttgagct

SEQ ID NO: 546146 - DNA, 13 bp, D. melanogaster
aaaatgttgattt

SEQ ID NO: 546147 - DNA, 14 bp, D. melanogaster
aaaatgttgattta

SEQ ID NO: 546148 - DNA, 13 bp, D. melanogaster
aaaatgttgcaaa

SEQ ID NO: 546149 - DNA, 14 bp, D. melanogaster
aaaatgttgcaaaa

SEQ ID NO: 546150 - DNA, 13 bp, D. melanogaster
aaaatgttgcaag

SEQ ID NO: 546151 - DNA, 13 bp, D. melanogaster
aaaatgttgcaca

SEQ ID NO: 546152 - DNA, 14 bp, D. melanogaster
aaaatgttgcacaa

SEQ ID NO: 546153 - DNA, 13 bp, D. melanogaster
aaaatgttgcata

SEQ ID NO: 546154 - DNA, 13 bp, D. melanogaster
aaaatgttgccaa

SEQ ID NO: 546155 - DNA, 14 bp, D. melanogaster
aaaatgttgccaaa

SEQ ID NO: 546156 - DNA, 14 bp, D. melanogaster
aaaatgttgccaac

SEQ ID NO: 546157 - DNA, 13 bp, D. melanogaster
aaaatgttgccac

SEQ ID NO: 546158 - DNA, 13 bp, D. melanogaster
aaaatgttgccca

SEQ ID NO: 546159 - DNA, 13 bp, D. melanogaster
aaaatgttgcgcc

SEQ ID NO: 546160 - DNA, 13 bp, D. melanogaster
aaaatgttgctat

SEQ ID NO: 546161 - DNA, 13 bp, D. melanogaster
aaaatgttgctca

SEQ ID NO: 546162 - DNA, 13 bp, D. melanogaster
aaaatgttggaaa

SEQ ID NO: 546163 - DNA, 14 bp, D. melanogaster
aaaatgttgggaaa

SEQ ID NO: 546164 - DNA, 13 bp, D. melanogaster
aaaatgttgtaaa

SEQ ID NO: 546165 - DNA, 14 bp, D. melanogaster
aaaatgttgtatat

SEQ ID NO: 546166 - DNA, 13 bp, D. melanogaster
aaaatgttgtatt

SEQ ID NO: 546167 - DNA, 14 bp, D. melanogaster
aaaatgttgtattt

SEQ ID NO: 546168 - DNA, 13 bp, D. melanogaster
aaaatgttgtgat

SEQ ID NO: 546169 - DNA, 13 bp, D. melanogaster
aaaatgttgttat

SEQ ID NO: 546170 - DNA, 14 bp, D. melanogaster
aaaatgttgtttat

SEQ ID NO: 546171 - DNA, 13 bp, D. melanogaster
aaaatgtttaaac

SEQ ID NO: 546172 - DNA, 13 bp, D. melanogaster
aaaatgtttaact

SEQ ID NO: 546173 - DNA, 13 bp, D. melanogaster
aaaatgtttaagc

SEQ ID NO: 546174 - DNA, 13 bp, D. melanogaster
aaaatgtttaatg

SEQ ID NO: 546175 - DNA, 13 bp, D. melanogaster
aaaatgtttacct

SEQ ID NO: 546176 - DNA, 13 bp, D. melanogaster
aaaatgtttagca

SEQ ID NO: 546177 - DNA, 13 bp, D. melanogaster
aaaatgtttcaaa

SEQ ID NO: 546178 - DNA, 14 bp, D. melanogaster
aaaatgtttcaaaa

SEQ ID NO: 546179 - DNA, 13 bp, D. melanogaster
aaaatgtttcaat

SEQ ID NO: 546180 - DNA, 14 bp, D. melanogaster
aaaatgtttcaatt

SEQ ID NO: 546181 - DNA, 13 bp, D. melanogaster
aaaatgtttcatt

SEQ ID NO: 546182 - DNA, 14 bp, D. melanogaster
aaaatgtttcattt

SEQ ID NO: 546183 - DNA, 13 bp, D. melanogaster
aaaatgtttccaa

SEQ ID NO: 546184 - DNA, 13 bp, D. melanogaster
aaaatgtttcctt

SEQ ID NO: 546185 - DNA, 13 bp, D. melanogaster
aaaatgtttcgat

SEQ ID NO: 546186 - DNA, 13 bp, D. melanogaster
aaaatgtttctat

SEQ ID NO: 546187 - DNA, 13 bp, D. melanogaster
aaaatgtttcttt

SEQ ID NO: 546188 - DNA, 14 bp, D. melanogaster
aaaatgtttcttta

SEQ ID NO: 546189 - DNA, 13 bp, D. melanogaster
aaaatgtttgcaa

SEQ ID NO: 546190 - DNA, 13 bp, D. melanogaster
aaaatgtttgcac

SEQ ID NO: 546191 - DNA, 13 bp, D. melanogaster
aaaatgtttgcat

SEQ ID NO: 546192 - DNA, 14 bp, D. melanogaster
aaaatgtttgcatt

SEQ ID NO: 546193 - DNA, 13 bp, D. melanogaster
aaaatgtttgcca

SEQ ID NO: 546194 - DNA, 14 bp, D. melanogaster
aaaatgtttgccaa

SEQ ID NO: 546195 - DNA, 13 bp, D. melanogaster
aaaatgtttgccc

SEQ ID NO: 546196 - DNA, 14 bp, D. melanogaster
aaaatgtttgcccc

SEQ ID NO: 546197 - DNA, 13 bp, D. melanogaster
aaaatgtttgcgg

SEQ ID NO: 546198 - DNA, 13 bp, D. melanogaster
aaaatgtttgctt

SEQ ID NO: 546199 - DNA, 13 bp, D. melanogaster
aaaatgtttggat

SEQ ID NO: 546200 - DNA, 13 bp, D. melanogaster
aaaatgtttggca

SEQ ID NO: 546201 - DNA, 13 bp, D. melanogaster
aaaatgtttgtaa

SEQ ID NO: 546202 - DNA, 13 bp, D. melanogaster
aaaatgtttgtat

SEQ ID NO: 546203 - DNA, 13 bp, D. melanogaster
aaaatgtttgtta

SEQ ID NO: 546204 - DNA, 13 bp, D. melanogaster
aaaatgttttcaa

SEQ ID NO: 546205 - DNA, 14 bp, D. melanogaster
aaaatgttttcaaa

SEQ ID NO: 546206 - DNA, 13 bp, D. melanogaster
aaaatgttttcca

SEQ ID NO: 546207 - DNA, 14 bp, D. melanogaster
aaaatgttttccaa

SEQ ID NO: 546208 - DNA, 14 bp, D. melanogaster
aaaatgttttcctt

SEQ ID NO: 546209 - DNA, 13 bp, D. melanogaster
aaaatgttttcgt

SEQ ID NO: 546210 - DNA, 13 bp, D. melanogaster
aaaatgttttgag

SEQ ID NO: 546211 - DNA, 13 bp, D. melanogaster
aaaatgttttgat

SEQ ID NO: 546212 - DNA, 13 bp, D. melanogaster
aaaatgttttgca

SEQ ID NO: 546213 - DNA, 14 bp, D. melanogaster
aaaatgttttgcat

SEQ ID NO: 546214 - DNA, 13 bp, D. melanogaster
aaaatgttttggc

SEQ ID NO: 546215 - DNA, 13 bp, D. melanogaster
aaaatgttttgta

SEQ ID NO: 546216 - DNA, 14 bp, D. melanogaster
aaaatgttttgtaa

SEQ ID NO: 546217 - DNA, 14 bp, D. melanogaster
aaaatgttttgtat

SEQ ID NO: 546218 - DNA, 13 bp, D. melanogaster
aaaatgttttgtt

SEQ ID NO: 546219 - DNA, 13 bp, D. melanogaster
aaaatgtttttca

SEQ ID NO: 546220 - DNA, 14 bp, D. melanogaster
aaaatgtttttcaa

SEQ ID NO: 546221 - DNA, 13 bp, D. melanogaster
aaaatgtttttga

SEQ ID NO: 546222 - DNA, 13 bp, D. melanogaster
aaaatgtttttgt

SEQ ID NO: 546223 - DNA, 13 bp, D. melanogaster
aaaatgttttttg

SEQ ID NO: 546224 - DNA, 14 bp, D. melanogaster
aaaattaaaagcca

SEQ ID NO: 546225 - DNA, 14 bp, D. melanogaster
aaaattaaaatacg

SEQ ID NO: 546226 - DNA, 13 bp, D. melanogaster
aaaattaaacagc

SEQ ID NO: 546227 - DNA, 13 bp, D. melanogaster
aaaattaaacctt

SEQ ID NO: 546228 - DNA, 13 bp, D. melanogaster
aaaattaaacgat

SEQ ID NO: 546229 - DNA, 13 bp, D. melanogaster
aaaattaaacgtt

SEQ ID NO: 546230 - DNA, 13 bp, D. melanogaster
aaaattaaaggtt

SEQ ID NO: 546231 - DNA, 13 bp, D. melanogaster
aaaattaaagtca

SEQ ID NO: 546232 - DNA, 14 bp, D. melanogaster
aaaattaaatgcaa

SEQ ID NO: 546233 - DNA, 13 bp, D. melanogaster
aaaattaaatggc

SEQ ID NO: 546234 - DNA, 14 bp, D. melanogaster
aaaattaaccagaa

SEQ ID NO: 546235 - DNA, 13 bp, D. melanogaster
aaaattaagcaat

SEQ ID NO: 546236 - DNA, 13 bp, D. melanogaster
aaaattaagctta

SEQ ID NO: 546237 - DNA, 13 bp, D. melanogaster
aaaattaagggcg

SEQ ID NO: 546238 - DNA, 14 bp, D. melanogaster
aaaattaagggcga

SEQ ID NO: 546239 - DNA, 13 bp, D. melanogaster
aaaattaagggtt

SEQ ID NO: 546240 - DNA, 13 bp, D. melanogaster
aaaattaagtttg

SEQ ID NO: 546241 - DNA, 13 bp, D. melanogaster
aaaattaatcgaa

SEQ ID NO: 546242 - DNA, 13 bp, D. melanogaster
aaaattaatctca

SEQ ID NO: 546243 - DNA, 13 bp, D. melanogaster
aaaattaattgct

SEQ ID NO: 546244 - DNA, 13 bp, D. melanogaster
aaaattaatttcc

SEQ ID NO: 546245 - DNA, 13 bp, D. melanogaster
aaaattacctaca

SEQ ID NO: 546246 - DNA, 13 bp, D. melanogaster
aaaattacctttt

SEQ ID NO: 546247 - DNA, 13 bp, D. melanogaster
aaaattacgtata

SEQ ID NO: 546248 - DNA, 13 bp, D. melanogaster
aaaattactagag

SEQ ID NO: 546249 - DNA, 13 bp, D. melanogaster
aaaattactcaat

SEQ ID NO: 546250 - DNA, 13 bp, D. melanogaster
aaaattactgttt

SEQ ID NO: 546251 - DNA, 13 bp, D. melanogaster
aaaattacttcaa

SEQ ID NO: 546252 - DNA, 13 bp, D. melanogaster
aaaattagagcaa

SEQ ID NO: 546253 - DNA, 13 bp, D. melanogaster
aaaattagcacaa

SEQ ID NO: 546254 - DNA, 14 bp, D. melanogaster
aaaattagcatttt

SEQ ID NO: 546255 - DNA, 13 bp, D. melanogaster
aaaattagccaat

SEQ ID NO: 546256 - DNA, 14 bp, D. melanogaster
aaaattagccaatt

SEQ ID NO: 546257 - DNA, 13 bp, D. melanogaster
aaaattagcgatt

SEQ ID NO: 546258 - DNA, 13 bp, D. melanogaster
aaaattagctaaa

SEQ ID NO: 546259 - DNA, 13 bp, D. melanogaster
aaaattagctgaa

SEQ ID NO: 546260 - DNA, 13 bp, D. melanogaster
aaaattagtaaca

SEQ ID NO: 546261 - DNA, 13 bp, D. melanogaster
aaaattagtcaaa

SEQ ID NO: 546262 - DNA, 13 bp, D. melanogaster
aaaattagtgcga

SEQ ID NO: 546263 - DNA, 13 bp, D. melanogaster
aaaattagttaag

SEQ ID NO: 546264 - DNA, 13 bp, D. melanogaster
aaaattagttcaa

SEQ ID NO: 546265 - DNA, 13 bp, D. melanogaster
aaaattagtttag

SEQ ID NO: 546266 - DNA, 13 bp, D. melanogaster
aaaattataagtg

SEQ ID NO: 546267 - DNA, 13 bp, D. melanogaster
aaaattatacact

SEQ ID NO: 546268 - DNA, 13 bp, D. melanogaster
aaaattatagcaa

SEQ ID NO: 546269 - DNA, 13 bp, D. melanogaster
aaaattatagtga

SEQ ID NO: 546270 - DNA, 13 bp, D. melanogaster
aaaattatattcc

SEQ ID NO: 546271 - DNA, 14 bp, D. melanogaster
aaaattatattcct

SEQ ID NO: 546272 - DNA, 13 bp, D. melanogaster
aaaattatcaaga

SEQ ID NO: 546273 - DNA, 13 bp, D. melanogaster
aaaattatcagaa

SEQ ID NO: 546274 - DNA, 13 bp, D. melanogaster
aaaattatcagtt

SEQ ID NO: 546275 - DNA, 13 bp, D. melanogaster
aaaattatcgaaa

SEQ ID NO: 546276 - DNA, 13 bp, D. melanogaster
aaaattatgaagc

SEQ ID NO: 546277 - DNA, 13 bp, D. melanogaster
aaaattatgaatg

SEQ ID NO: 546278 - DNA, 14 bp, D. melanogaster
aaaattatgacaaa

SEQ ID NO: 546279 - DNA, 13 bp, D. melanogaster
aaaattatgacag

SEQ ID NO: 546280 - DNA, 13 bp, D. melanogaster
aaaattatgatga

SEQ ID NO: 546281 - DNA, 13 bp, D. melanogaster
aaaattatgcaag

SEQ ID NO: 546282 - DNA, 13 bp, D. melanogaster
aaaattatgcaca

SEQ ID NO: 546283 - DNA, 13 bp, D. melanogaster
aaaattatgccac

SEQ ID NO: 546284 - DNA, 13 bp, D. melanogaster
aaaattatgcgca

SEQ ID NO: 546285 - DNA, 13 bp, D. melanogaster
aaaattatgctta

SEQ ID NO: 546286 - DNA, 13 bp, D. melanogaster
aaaattatggaga

SEQ ID NO: 546287 - DNA, 13 bp, D. melanogaster
aaaattatgtgtt

SEQ ID NO: 546288 - DNA, 13 bp, D. melanogaster
aaaattatgttga

SEQ ID NO: 546289 - DNA, 13 bp, D. melanogaster
aaaattatgttgc

SEQ ID NO: 546290 - DNA, 13 bp, D. melanogaster
aaaattattagct

SEQ ID NO: 546291 - DNA, 14 bp, D. melanogaster
aaaattattagctg

SEQ ID NO: 546292 - DNA, 13 bp, D. melanogaster
aaaattattccaa

SEQ ID NO: 546293 - DNA, 13 bp, D. melanogaster
aaaattattcgaa

SEQ ID NO: 546294 - DNA, 13 bp, D. melanogaster
aaaattattgaca

SEQ ID NO: 546295 - DNA, 13 bp, D. melanogaster
aaaattattgtca

SEQ ID NO: 546296 - DNA, 13 bp, D. melanogaster
aaaattattgttg

SEQ ID NO: 546297 - DNA, 13 bp, D. melanogaster
aaaattatttgcg

SEQ ID NO: 546298 - DNA, 14 bp, D. melanogaster
aaaattatttgttg

SEQ ID NO: 546299 - DNA, 13 bp, D. melanogaster
aaaattcaaaatg

SEQ ID NO: 546300 - DNA, 14 bp, D. melanogaster
aaaattcaaatgaa

SEQ ID NO: 546301 - DNA, 13 bp, D. melanogaster
aaaattcaactta

SEQ ID NO: 546302 - DNA, 13 bp, D. melanogaster
aaaattcaacttt

SEQ ID NO: 546303 - DNA, 13 bp, D. melanogaster
aaaattcaagatt

SEQ ID NO: 546304 - DNA, 14 bp, D. melanogaster
aaaattcaagcagg

SEQ ID NO: 546305 - DNA, 13 bp, D. melanogaster
aaaattcaagtgg

SEQ ID NO: 546306 - DNA, 13 bp, D. melanogaster
aaaattcaatcag

SEQ ID NO: 546307 - DNA, 13 bp, D. melanogaster
aaaattcaatcat

SEQ ID NO: 546308 - DNA, 13 bp, D. melanogaster
aaaattcaatgaa

SEQ ID NO: 546309 - DNA, 13 bp, D. melanogaster
aaaattcaattca

SEQ ID NO: 546310 - DNA, 14 bp, D. melanogaster
aaaattcaattcaa

SEQ ID NO: 546311 - DNA, 13 bp, D. melanogaster
aaaattcaattga

SEQ ID NO: 546312 - DNA, 13 bp, D. melanogaster
aaaattcaattgc

SEQ ID NO: 546313 - DNA, 13 bp, D. melanogaster
aaaattcaattgt

SEQ ID NO: 546314 - DNA, 13 bp, D. melanogaster
aaaattcaatttg

SEQ ID NO: 546315 - DNA, 13 bp, D. melanogaster
aaaattcacttca

SEQ ID NO: 546316 - DNA, 13 bp, D. melanogaster
aaaattcactttt

SEQ ID NO: 546317 - DNA, 13 bp, D. melanogaster
aaaattcagattt

SEQ ID NO: 546318 - DNA, 13 bp, D. melanogaster
aaaattcagcaaa

SEQ ID NO: 546319 - DNA, 13 bp, D. melanogaster
aaaattcagcaga

SEQ ID NO: 546320 - DNA, 13 bp, D. melanogaster
aaaattcagctaa

SEQ ID NO: 546321 - DNA, 13 bp, D. melanogaster
aaaattcaggaaa

SEQ ID NO: 546322 - DNA, 13 bp, D. melanogaster
aaaattcatattc

SEQ ID NO: 546323 - DNA, 13 bp, D. melanogaster
aaaattcatcaat

SEQ ID NO: 546324 - DNA, 14 bp, D. melanogaster
aaaattcatgaaaa

SEQ ID NO: 546325 - DNA, 13 bp, D. melanogaster
aaaattcattaca

SEQ ID NO: 546326 - DNA, 13 bp, D. melanogaster
aaaattcattgaa

SEQ ID NO: 546327 - DNA, 13 bp, D. melanogaster
aaaattcatttgg

SEQ ID NO: 546328 - DNA, 13 bp, D. melanogaster
aaaattccaaact

SEQ ID NO: 546329 - DNA, 13 bp, D. melanogaster
aaaattccaaatt

SEQ ID NO: 546330 - DNA, 14 bp, D. melanogaster
aaaattccaaattt

SEQ ID NO: 546331 - DNA, 13 bp, D. melanogaster
aaaattccaatat

SEQ ID NO: 546332 - DNA, 14 bp, D. melanogaster
aaaattccaatgca

SEQ ID NO: 546333 - DNA, 13 bp, D. melanogaster
aaaattccaattt

SEQ ID NO: 546334 - DNA, 13 bp, D. melanogaster
aaaattccatatt

SEQ ID NO: 546335 - DNA, 13 bp, D. melanogaster
aaaattccatcaa

SEQ ID NO: 546336 - DNA, 13 bp, D. melanogaster
aaaattccattaa

SEQ ID NO: 546337 - DNA, 13 bp, D. melanogaster
aaaattccattac

SEQ ID NO: 546338 - DNA, 13 bp, D. melanogaster
aaaattccattga

SEQ ID NO: 546339 - DNA, 13 bp, D. melanogaster
aaaattccattgg

SEQ ID NO: 546340 - DNA, 13 bp, D. melanogaster
aaaattccattta

SEQ ID NO: 546341 - DNA, 13 bp, D. melanogaster
aaaattcccaaat

SEQ ID NO: 546342 - DNA, 13 bp, D. melanogaster
aaaattccggaaa

SEQ ID NO: 546343 - DNA, 13 bp, D. melanogaster
aaaattcctcaaa

SEQ ID NO: 546344 - DNA, 13 bp, D. melanogaster
aaaattcctttgt

SEQ ID NO: 546345 - DNA, 15 bp, D. melanogaster
aaaattcctttgtct

SEQ ID NO: 546346 - DNA, 13 bp, D. melanogaster
aaaattccttttt

SEQ ID NO: 546347 - DNA, 14 bp, D. melanogaster
aaaattcgaaaatt

SEQ ID NO: 546348 - DNA, 13 bp, D. melanogaster
aaaattcgaaact

SEQ ID NO: 546349 - DNA, 13 bp, D. melanogaster
aaaattcgaaaga

SEQ ID NO: 546350 - DNA, 13 bp, D. melanogaster
aaaattcgaaata

SEQ ID NO: 546351 - DNA, 13 bp, D. melanogaster
aaaattcgaagaa

SEQ ID NO: 546352 - DNA, 13 bp, D. melanogaster
aaaattcgaattc

SEQ ID NO: 546353 - DNA, 14 bp, D. melanogaster
aaaattcgagagag

SEQ ID NO: 546354 - DNA, 13 bp, D. melanogaster
aaaattcgataaa

SEQ ID NO: 546355 - DNA, 14 bp, D. melanogaster
aaaattcgatattt

SEQ ID NO: 546356 - DNA, 13 bp, D. melanogaster
aaaattcgatttt

SEQ ID NO: 546357 - DNA, 13 bp, D. melanogaster
aaaattcgcaaaa

SEQ ID NO: 546358 - DNA, 13 bp, D. melanogaster
aaaattcgcaatt

SEQ ID NO: 546359 - DNA, 13 bp, D. melanogaster
aaaattcgcacaa

SEQ ID NO: 546360 - DNA, 13 bp, D. melanogaster
aaaattcgcataa

SEQ ID NO: 546361 - DNA, 13 bp, D. melanogaster
aaaattcgcattt

SEQ ID NO: 546362 - DNA, 13 bp, D. melanogaster
aaaattcgctttt

SEQ ID NO: 546363 - DNA, 13 bp, D. melanogaster
aaaattcggaaaa

SEQ ID NO: 546364 - DNA, 13 bp, D. melanogaster
aaaattcggaaat

SEQ ID NO: 546365 - DNA, 13 bp, D. melanogaster
aaaattcgtataa

SEQ ID NO: 546366 - DNA, 13 bp, D. melanogaster
aaaattcgttttc

SEQ ID NO: 546367 - DNA, 13 bp, D. melanogaster
aaaattctagaaa

SEQ ID NO: 546368 - DNA, 13 bp, D. melanogaster
aaaattctatatc

SEQ ID NO: 546369 - DNA, 14 bp, D. melanogaster
aaaattctatatca

SEQ ID NO: 546370 - DNA, 14 bp, D. melanogaster
aaaattctatattg

SEQ ID NO: 546371 - DNA, 13 bp, D. melanogaster
aaaattctcgaaa

SEQ ID NO: 546372 - DNA, 13 bp, D. melanogaster
aaaattctctttt

SEQ ID NO: 546373 - DNA, 13 bp, D. melanogaster
aaaattctgaaat

SEQ ID NO: 546374 - DNA, 14 bp, D. melanogaster
aaaattctgatatt

SEQ ID NO: 546375 - DNA, 13 bp, D. melanogaster
aaaattctggaaa

SEQ ID NO: 546376 - DNA, 13 bp, D. melanogaster
aaaattcttcaaa

SEQ ID NO: 546377 - DNA, 13 bp, D. melanogaster
aaaattcttcaat

SEQ ID NO: 546378 - DNA, 13 bp, D. melanogaster
aaaattcttcaga

SEQ ID NO: 546379 - DNA, 13 bp, D. melanogaster
aaaattcttgaaa

SEQ ID NO: 546380 - DNA, 13 bp, D. melanogaster
aaaattcttgttt

SEQ ID NO: 546381 - DNA, 14 bp, D. melanogaster
aaaattcttgtttt

SEQ ID NO: 546382 - DNA, 13 bp, D. melanogaster
aaaattctttacc

SEQ ID NO: 546383 - DNA, 13 bp, D. melanogaster
aaaattctttatc

SEQ ID NO: 546384 - DNA, 13 bp, D. melanogaster
aaaattctttcaa

SEQ ID NO: 546385 - DNA, 13 bp, D. melanogaster
aaaattcttttgt

SEQ ID NO: 546386 - DNA, 14 bp, D. melanogaster
aaaattgaaaaatc

SEQ ID NO: 546387 - DNA, 13 bp, D. melanogaster
aaaattgaaaact

SEQ ID NO: 546388 - DNA, 14 bp, D. melanogaster
aaaattgaaaattc

SEQ ID NO: 546389 - DNA, 13 bp, D. melanogaster
aaaattgaaacca

SEQ ID NO: 546390 - DNA, 13 bp, D. melanogaster
aaaattgaaactg

SEQ ID NO: 546391 - DNA, 13 bp, D. melanogaster
aaaattgaaactt

SEQ ID NO: 546392 - DNA, 13 bp, D. melanogaster
aaaattgaaagca

SEQ ID NO: 546393 - DNA, 14 bp, D. melanogaster
aaaattgaaatgga

SEQ ID NO: 546394 - DNA, 14 bp, D. melanogaster
aaaattgaaattca

SEQ ID NO: 546395 - DNA, 13 bp, D. melanogaster
aaaattgaaattg

SEQ ID NO: 546396 - DNA, 13 bp, D. melanogaster
aaaattgaacaac

SEQ ID NO: 546397 - DNA, 13 bp, D. melanogaster
aaaattgaactaa

SEQ ID NO: 546398 - DNA, 13 bp, D. melanogaster
aaaattgaacttt

SEQ ID NO: 546399 - DNA, 13 bp, D. melanogaster
aaaattgaagttg

SEQ ID NO: 546400 - DNA, 13 bp, D. melanogaster
aaaattgaataca

SEQ ID NO: 546401 - DNA, 13 bp, D. melanogaster
aaaattgaatcaa

SEQ ID NO: 546402 - DNA, 13 bp, D. melanogaster
aaaattgacattt

SEQ ID NO: 546403 - DNA, 13 bp, D. melanogaster
aaaattgactttt

SEQ ID NO: 546404 - DNA, 13 bp, D. melanogaster
aaaattgagatta

SEQ ID NO: 546405 - DNA, 13 bp, D. melanogaster
aaaattgagcaaa

SEQ ID NO: 546406 - DNA, 13 bp, D. melanogaster
aaaattgagcaat

SEQ ID NO: 546407 - DNA, 13 bp, D. melanogaster
aaaattgagtttt

SEQ ID NO: 546408 - DNA, 14 bp, D. melanogaster
aaaattgagttttg

SEQ ID NO: 546409 - DNA, 14 bp, D. melanogaster
aaaattgagttttt

SEQ ID NO: 546410 - DNA, 13 bp, D. melanogaster
aaaattgatcaca

SEQ ID NO: 546411 - DNA, 13 bp, D. melanogaster
aaaattgatgatg

SEQ ID NO: 546412 - DNA, 13 bp, D. melanogaster
aaaattgattgca

SEQ ID NO: 546413 - DNA, 13 bp, D. melanogaster
aaaattgatttcg

SEQ ID NO: 546414 - DNA, 13 bp, D. melanogaster
aaaattgatttga

SEQ ID NO: 546415 - DNA, 14 bp, D. melanogaster
aaaattgatttgtt

SEQ ID NO: 546416 - DNA, 13 bp, D. melanogaster
aaaattgattttc

SEQ ID NO: 546417 - DNA, 13 bp, D. melanogaster
aaaattgcaaaag

SEQ ID NO: 546418 - DNA, 14 bp, D. melanogaster
aaaattgcaaaatt

SEQ ID NO: 546419 - DNA, 14 bp, D. melanogaster
aaaattgcaataaa

SEQ ID NO: 546420 - DNA, 13 bp, D. melanogaster
aaaattgcaatat

SEQ ID NO: 546421 - DNA, 14 bp, D. melanogaster
aaaattgcaatatt

SEQ ID NO: 546422 - DNA, 13 bp, D. melanogaster
aaaattgcaattt

SEQ ID NO: 546423 - DNA, 14 bp, D. melanogaster
aaaattgcaatttt

SEQ ID NO: 546424 - DNA, 13 bp, D. melanogaster
aaaattgcacaaa

SEQ ID NO: 546425 - DNA, 13 bp, D. melanogaster
aaaattgcacaat

SEQ ID NO: 546426 - DNA, 13 bp, D. melanogaster
aaaattgcagaaa

SEQ ID NO: 546427 - DNA, 13 bp, D. melanogaster
aaaattgcatatt

SEQ ID NO: 546428 - DNA, 14 bp, D. melanogaster
aaaattgcatattt

SEQ ID NO: 546429 - DNA, 13 bp, D. melanogaster
aaaattgcatcaa

SEQ ID NO: 546430 - DNA, 13 bp, D. melanogaster
aaaattgcattag

SEQ ID NO: 546431 - DNA, 13 bp, D. melanogaster
aaaattgcattta

SEQ ID NO: 546432 - DNA, 13 bp, D. melanogaster
aaaattgcatttc

SEQ ID NO: 546433 - DNA, 13 bp, D. melanogaster
aaaattgcatttg

SEQ ID NO: 546434 - DNA, 14 bp, D. melanogaster
aaaattgcatttga

SEQ ID NO: 546435 - DNA, 13 bp, D. melanogaster
aaaattgcatttt

SEQ ID NO: 546436 - DNA, 14 bp, D. melanogaster
aaaattgcattttt

SEQ ID NO: 546437 - DNA, 13 bp, D. melanogaster
aaaattgccaaaa

SEQ ID NO: 546438 - DNA, 14 bp, D. melanogaster
aaaattgccaaaaa

SEQ ID NO: 546439 - DNA, 14 bp, D. melanogaster
aaaattgccaaaat

SEQ ID NO: 546440 - DNA, 13 bp, D. melanogaster
aaaattgccaact

SEQ ID NO: 546441 - DNA, 13 bp, D. melanogaster
aaaattgccaagt

SEQ ID NO: 546442 - DNA, 13 bp, D. melanogaster
aaaattgcccaaa

SEQ ID NO: 546443 - DNA, 13 bp, D. melanogaster
aaaattgcccagc

SEQ ID NO: 546444 - DNA, 13 bp, D. melanogaster
aaaattgccgaaa

SEQ ID NO: 546445 - DNA, 13 bp, D. melanogaster
aaaattgcgaaaa

SEQ ID NO: 546446 - DNA, 13 bp, D. melanogaster
aaaattgcgcaaa

SEQ ID NO: 546447 - DNA, 13 bp, D. melanogaster
aaaattgcggaaa

SEQ ID NO: 546448 - DNA, 13 bp, D. melanogaster
aaaattgctaaaa

SEQ ID NO: 546449 - DNA, 13 bp, D. melanogaster
aaaattgctataa

SEQ ID NO: 546450 - DNA, 13 bp, D. melanogaster
aaaattgctattt

SEQ ID NO: 546451 - DNA, 13 bp, D. melanogaster
aaaattgcttaaa

SEQ ID NO: 546452 - DNA, 13 bp, D. melanogaster
aaaattgcttcaa

SEQ ID NO: 546453 - DNA, 13 bp, D. melanogaster
aaaattgctttaa

SEQ ID NO: 546454 - DNA, 13 bp, D. melanogaster
aaaattgctttca

SEQ ID NO: 546455 - DNA, 13 bp, D. melanogaster
aaaattgctttga

SEQ ID NO: 546456 - DNA, 13 bp, D. melanogaster
aaaattggaaagt

SEQ ID NO: 546457 - DNA, 13 bp, D. melanogaster
aaaattggaattt

SEQ ID NO: 546458 - DNA, 13 bp, D. melanogaster
aaaattggacaaa

SEQ ID NO: 546459 - DNA, 14 bp, D. melanogaster
aaaattggcaaaaa

SEQ ID NO: 546460 - DNA, 13 bp, D. melanogaster
aaaattggcaaac

SEQ ID NO: 546461 - DNA, 13 bp, D. melanogaster
aaaattggcaaag

SEQ ID NO: 546462 - DNA, 13 bp, D. melanogaster
aaaattggcaaat

SEQ ID NO: 546463 - DNA, 13 bp, D. melanogaster
aaaattggcaact

SEQ ID NO: 546464 - DNA, 13 bp, D. melanogaster
aaaattggcaatg

SEQ ID NO: 546465 - DNA, 13 bp, D. melanogaster
aaaattggcaatt

SEQ ID NO: 546466 - DNA, 13 bp, D. melanogaster
aaaattggccaaa

SEQ ID NO: 546467 - DNA, 14 bp, D. melanogaster
aaaattggccaaaa

SEQ ID NO: 546468 - DNA, 13 bp, D. melanogaster
aaaattggcgaaa

SEQ ID NO: 546469 - DNA, 13 bp, D. melanogaster
aaaattggcttaa

SEQ ID NO: 546470 - DNA, 13 bp, D. melanogaster
aaaattgggtcaa

SEQ ID NO: 546471 - DNA, 13 bp, D. melanogaster
aaaattggtaaat

SEQ ID NO: 546472 - DNA, 13 bp, D. melanogaster
aaaattggtattt

SEQ ID NO: 546473 - DNA, 13 bp, D. melanogaster
aaaattggtcaaa

SEQ ID NO: 546474 - DNA, 14 bp, D. melanogaster
aaaattggtcaaaa

SEQ ID NO: 546475 - DNA, 15 bp, D. melanogaster
aaaattggtggaggc

SEQ ID NO: 546476 - DNA, 13 bp, D. melanogaster
aaaattgtaaaac

SEQ ID NO: 546477 - DNA, 13 bp, D. melanogaster
aaaattgtaacaa

SEQ ID NO: 546478 - DNA, 13 bp, D. melanogaster
aaaattgtaagca

SEQ ID NO: 546479 - DNA, 13 bp, D. melanogaster
aaaattgtaattc

SEQ ID NO: 546480 - DNA, 13 bp, D. melanogaster
aaaattgtacaaa

SEQ ID NO: 546481 - DNA, 14 bp, D. melanogaster
aaaattgtacaaat

SEQ ID NO: 546482 - DNA, 13 bp, D. melanogaster
aaaattgtacata

SEQ ID NO: 546483 - DNA, 13 bp, D. melanogaster
aaaattgtacttt

SEQ ID NO: 546484 - DNA, 13 bp, D. melanogaster
aaaattgtagttt

SEQ ID NO: 546485 - DNA, 13 bp, D. melanogaster
aaaattgtattga

SEQ ID NO: 546486 - DNA, 13 bp, D. melanogaster
aaaattgtcaaaa

SEQ ID NO: 546487 - DNA, 14 bp, D. melanogaster
aaaattgtcaaaat

SEQ ID NO: 546488 - DNA, 13 bp, D. melanogaster
aaaattgtcaaca

SEQ ID NO: 546489 - DNA, 13 bp, D. melanogaster
aaaattgtcaatt

SEQ ID NO: 546490 - DNA, 13 bp, D. melanogaster
aaaattgtcactt

SEQ ID NO: 546491 - DNA, 14 bp, D. melanogaster
aaaattgtcataaa

SEQ ID NO: 546492 - DNA, 13 bp, D. melanogaster
aaaattgtcattt

SEQ ID NO: 546493 - DNA, 13 bp, D. melanogaster
aaaattgtccaaa

SEQ ID NO: 546494 - DNA, 13 bp, D. melanogaster
aaaattgtgaaag

SEQ ID NO: 546495 - DNA, 13 bp, D. melanogaster
aaaattgtgaata

SEQ ID NO: 546496 - DNA, 14 bp, D. melanogaster
aaaattgtgcaaaa

SEQ ID NO: 546497 - DNA, 13 bp, D. melanogaster
aaaattgtgcaga

SEQ ID NO: 546498 - DNA, 13 bp, D. melanogaster
aaaattgtgccaa

SEQ ID NO: 546499 - DNA, 13 bp, D. melanogaster
aaaattgtgcttt

SEQ ID NO: 546500 - DNA, 13 bp, D. melanogaster
aaaattgtggaaa

SEQ ID NO: 546501 - DNA, 14 bp, D. melanogaster
aaaattgtggaaaa

SEQ ID NO: 546502 - DNA, 13 bp, D. melanogaster
aaaattgtgggcg

SEQ ID NO: 546503 - DNA, 14 bp, D. melanogaster
aaaattgtgggcgt

SEQ ID NO: 546504 - DNA, 13 bp, D. melanogaster
aaaattgtgtaaa

SEQ ID NO: 546505 - DNA, 13 bp, D. melanogaster
aaaattgtgtaat

SEQ ID NO: 546506 - DNA, 13 bp, D. melanogaster
aaaattgtgtata

SEQ ID NO: 546507 - DNA, 13 bp, D. melanogaster
aaaattgtgtatt

SEQ ID NO: 546508 - DNA, 13 bp, D. melanogaster
aaaattgtgtcaa

SEQ ID NO: 546509 - DNA, 13 bp, D. melanogaster
aaaattgtgtgca

SEQ ID NO: 546510 - DNA, 13 bp, D. melanogaster
aaaattgtgtgtt

SEQ ID NO: 546511 - DNA, 13 bp, D. melanogaster
aaaattgttcaaa

SEQ ID NO: 546512 - DNA, 14 bp, D. melanogaster
aaaattgttcaaaa

SEQ ID NO: 546513 - DNA, 14 bp, D. melanogaster
aaaattgttcaatt

SEQ ID NO: 546514 - DNA, 13 bp, D. melanogaster
aaaattgttcata

SEQ ID NO: 546515 - DNA, 14 bp, D. melanogaster
aaaattgttccaaa

SEQ ID NO: 546516 - DNA, 13 bp, D. melanogaster
aaaattgttctaa

SEQ ID NO: 546517 - DNA, 13 bp, D. melanogaster
aaaattgttgaac

SEQ ID NO: 546518 - DNA, 13 bp, D. melanogaster
aaaattgttgcat

SEQ ID NO: 546519 - DNA, 14 bp, D. melanogaster
aaaattgttgccaa

SEQ ID NO: 546520 - DNA, 13 bp, D. melanogaster
aaaattgttgctc

SEQ ID NO: 546521 - DNA, 13 bp, D. melanogaster
aaaattgttggaa

SEQ ID NO: 546522 - DNA, 13 bp, D. melanogaster
aaaattgttgttg

SEQ ID NO: 546523 - DNA, 13 bp, D. melanogaster
aaaattgttgttt

SEQ ID NO: 546524 - DNA, 15 bp, D. melanogaster
aaaattgtttaagtg

SEQ ID NO: 546525 - DNA, 13 bp, D. melanogaster
aaaattgtttaga

SEQ ID NO: 546526 - DNA, 13 bp, D. melanogaster
aaaattgtttatg

SEQ ID NO: 546527 - DNA, 14 bp, D. melanogaster
aaaattgtttcaaa

SEQ ID NO: 546528 - DNA, 13 bp, D. melanogaster
aaaattgtttcga

SEQ ID NO: 546529 - DNA, 13 bp, D. melanogaster
aaaattgtttcgc

SEQ ID NO: 546530 - DNA, 14 bp, D. melanogaster
aaaattgtttcttt

SEQ ID NO: 546531 - DNA, 13 bp, D. melanogaster
aaaattgtttgat

SEQ ID NO: 546532 - DNA, 13 bp, D. melanogaster
aaaattgtttgca

SEQ ID NO: 546533 - DNA, 14 bp, D. melanogaster
aaaattgtttgtaa

SEQ ID NO: 546534 - DNA, 13 bp, D. melanogaster
aaaattgtttgtt

SEQ ID NO: 546535 - DNA, 14 bp, D. melanogaster
aaaattgtttgtta

SEQ ID NO: 546536 - DNA, 14 bp, D. melanogaster
aaaattgttttcaa

SEQ ID NO: 546537 - DNA, 13 bp, D. melanogaster
aaaattgttttga

SEQ ID NO: 546538 - DNA, 13 bp, D. melanogaster
aaaattgttttgc

SEQ ID NO: 546539 - DNA, 13 bp, D. melanogaster
aaaatttaacttc

SEQ ID NO: 546540 - DNA, 13 bp, D. melanogaster
aaaatttaacttg

SEQ ID NO: 546541 - DNA, 13 bp, D. melanogaster
aaaatttaagcca

SEQ ID NO: 546542 - DNA, 13 bp, D. melanogaster
aaaatttaagtgt

SEQ ID NO: 546543 - DNA, 13 bp, D. melanogaster
aaaatttaatgag

SEQ ID NO: 546544 - DNA, 13 bp, D. melanogaster
aaaatttaatgca

SEQ ID NO: 546545 - DNA, 13 bp, D. melanogaster
aaaatttacaaga

SEQ ID NO: 546546 - DNA, 13 bp, D. melanogaster
aaaatttacaatg

SEQ ID NO: 546547 - DNA, 13 bp, D. melanogaster
aaaatttacgaag

SEQ ID NO: 546548 - DNA, 13 bp, D. melanogaster
aaaatttatgatg

SEQ ID NO: 546549 - DNA, 13 bp, D. melanogaster
aaaatttatgcaa

SEQ ID NO: 546550 - DNA, 13 bp, D. melanogaster
aaaatttattggc

SEQ ID NO: 546551 - DNA, 13 bp, D. melanogaster
aaaatttcaacag

SEQ ID NO: 546552 - DNA, 13 bp, D. melanogaster
aaaatttcaagtg

SEQ ID NO: 546553 - DNA, 13 bp, D. melanogaster
aaaatttcaccca

SEQ ID NO: 546554 - DNA, 13 bp, D. melanogaster
aaaatttcagcaa

SEQ ID NO: 546555 - DNA, 13 bp, D. melanogaster
aaaatttcaggaa

SEQ ID NO: 546556 - DNA, 13 bp, D. melanogaster
aaaatttcagttt

SEQ ID NO: 546557 - DNA, 13 bp, D. melanogaster
aaaatttccaaat

SEQ ID NO: 546558 - DNA, 13 bp, D. melanogaster
aaaatttccaaca

SEQ ID NO: 546559 - DNA, 13 bp, D. melanogaster
aaaatttccaatc

SEQ ID NO: 546560 - DNA, 13 bp, D. melanogaster
aaaatttccaatt

SEQ ID NO: 546561 - DNA, 13 bp, D. melanogaster
aaaatttccactt

SEQ ID NO: 546562 - DNA, 13 bp, D. melanogaster
aaaatttcccaaa

SEQ ID NO: 546563 - DNA, 13 bp, D. melanogaster
aaaatttcccaat

SEQ ID NO: 546564 - DNA, 13 bp, D. melanogaster
aaaatttcccagc

SEQ ID NO: 546565 - DNA, 13 bp, D. melanogaster
aaaatttcccatt

SEQ ID NO: 546566 - DNA, 13 bp, D. melanogaster
aaaatttcgaaaa

SEQ ID NO: 546567 - DNA, 14 bp, D. melanogaster
aaaatttcgaaaaa

SEQ ID NO: 546568 - DNA, 13 bp, D. melanogaster
aaaatttcgaaat

SEQ ID NO: 546569 - DNA, 13 bp, D. melanogaster
aaaatttcgattt

SEQ ID NO: 546570 - DNA, 13 bp, D. melanogaster
aaaatttcgcaaa

SEQ ID NO: 546571 - DNA, 13 bp, D. melanogaster
aaaatttcggaaa

SEQ ID NO: 546572 - DNA, 13 bp, D. melanogaster
aaaatttcggtct

SEQ ID NO: 546573 - DNA, 13 bp, D. melanogaster
aaaatttctaaag

SEQ ID NO: 546574 - DNA, 13 bp, D. melanogaster
aaaatttctcaaa

SEQ ID NO: 546575 - DNA, 13 bp, D. melanogaster
aaaatttctcatt

SEQ ID NO: 546576 - DNA, 13 bp, D. melanogaster
aaaatttctgaaa

SEQ ID NO: 546577 - DNA, 14 bp, D. melanogaster
aaaatttcttcagt

SEQ ID NO: 546578 - DNA, 14 bp, D. melanogaster
aaaatttctttcaa

SEQ ID NO: 546579 - DNA, 13 bp, D. melanogaster
aaaatttctttct

SEQ ID NO: 546580 - DNA, 13 bp, D. melanogaster
aaaatttgaacaa

SEQ ID NO: 546581 - DNA, 13 bp, D. melanogaster
aaaatttgaatga

SEQ ID NO: 546582 - DNA, 13 bp, D. melanogaster
aaaatttgacaaa

SEQ ID NO: 546583 - DNA, 13 bp, D. melanogaster
aaaatttgacatt

SEQ ID NO: 546584 - DNA, 13 bp, D. melanogaster
aaaatttgacttt

SEQ ID NO: 546585 - DNA, 13 bp, D. melanogaster
aaaatttgatatg

SEQ ID NO: 546586 - DNA, 13 bp, D. melanogaster
aaaatttgcaaaa

SEQ ID NO: 546587 - DNA, 14 bp, D. melanogaster
aaaatttgcaaaaa

SEQ ID NO: 546588 - DNA, 14 bp, D. melanogaster
aaaatttgcaaaat

SEQ ID NO: 546589 - DNA, 13 bp, D. melanogaster
aaaatttgcaatt

SEQ ID NO: 546590 - DNA, 13 bp, D. melanogaster
aaaatttgcattt

SEQ ID NO: 546591 - DNA, 14 bp, D. melanogaster
aaaatttgcattta

SEQ ID NO: 546592 - DNA, 13 bp, D. melanogaster
aaaatttgccagc

SEQ ID NO: 546593 - DNA, 13 bp, D. melanogaster
aaaatttgcgaaa

SEQ ID NO: 546594 - DNA, 13 bp, D. melanogaster
aaaatttgcttat

SEQ ID NO: 546595 - DNA, 14 bp, D. melanogaster
aaaatttggaaatt

SEQ ID NO: 546596 - DNA, 13 bp, D. melanogaster
aaaatttggattt

SEQ ID NO: 546597 - DNA, 14 bp, D. melanogaster
aaaatttggccaaa

SEQ ID NO: 546598 - DNA, 13 bp, D. melanogaster
aaaatttggtatt

SEQ ID NO: 546599 - DNA, 13 bp, D. melanogaster
aaaatttgtaaac

SEQ ID NO: 546600 - DNA, 13 bp, D. melanogaster
aaaatttgtagta

SEQ ID NO: 546601 - DNA, 14 bp, D. melanogaster
aaaatttgtagtag

SEQ ID NO: 546602 - DNA, 14 bp, D. melanogaster
aaaatttgtcaaaa

SEQ ID NO: 546603 - DNA, 13 bp, D. melanogaster
aaaatttgtcaat

SEQ ID NO: 546604 - DNA, 13 bp, D. melanogaster
aaaatttgtgagt

SEQ ID NO: 546605 - DNA, 13 bp, D. melanogaster
aaaatttgtgcaa

SEQ ID NO: 546606 - DNA, 13 bp, D. melanogaster
aaaatttgttcat

SEQ ID NO: 546607 - DNA, 13 bp, D. melanogaster
aaaatttgttgat

SEQ ID NO: 546608 - DNA, 13 bp, D. melanogaster
aaaatttgttgca

SEQ ID NO: 546609 - DNA, 13 bp, D. melanogaster
aaaatttgttgcc

SEQ ID NO: 546610 - DNA, 13 bp, D. melanogaster
aaaatttgttgtc

SEQ ID NO: 546611 - DNA, 13 bp, D. melanogaster
aaaatttgtttac

SEQ ID NO: 546612 - DNA, 13 bp, D. melanogaster
aaaatttgtttag

SEQ ID NO: 546613 - DNA, 13 bp, D. melanogaster
aaaatttgtttct

SEQ ID NO: 546614 - DNA, 13 bp, D. melanogaster
aaaatttgtttgg

SEQ ID NO: 546615 - DNA, 14 bp, D. melanogaster
aaaatttgttttct

SEQ ID NO: 546616 - DNA, 13 bp, D. melanogaster
aaaattttaagag

SEQ ID NO: 546617 - DNA, 13 bp, D. melanogaster
aaaattttacgat

SEQ ID NO: 546618 - DNA, 13 bp, D. melanogaster
aaaattttagatc

SEQ ID NO: 546619 - DNA, 14 bp, D. melanogaster
aaaattttagatca

SEQ ID NO: 546620 - DNA, 13 bp, D. melanogaster
aaaattttatgcg

SEQ ID NO: 546621 - DNA, 13 bp, D. melanogaster
aaaattttattgc

SEQ ID NO: 546622 - DNA, 13 bp, D. melanogaster
aaaattttcactg

SEQ ID NO: 546623 - DNA, 13 bp, D. melanogaster
aaaattttccact

SEQ ID NO: 546624 - DNA, 13 bp, D. melanogaster
aaaattttccaga

SEQ ID NO: 546625 - DNA, 14 bp, D. melanogaster
aaaattttccattt

SEQ ID NO: 546626 - DNA, 13 bp, D. melanogaster
aaaattttcgctt

SEQ ID NO: 546627 - DNA, 13 bp, D. melanogaster
aaaattttcggtt

SEQ ID NO: 546628 - DNA, 13 bp, D. melanogaster
aaaattttcgttt

SEQ ID NO: 546629 - DNA, 14 bp, D. melanogaster
aaaattttcgttta

SEQ ID NO: 546630 - DNA, 14 bp, D. melanogaster
aaaattttgctaaa

SEQ ID NO: 546631 - DNA, 13 bp, D. melanogaster
aaaattttggaaa

SEQ ID NO: 546632 - DNA, 13 bp, D. melanogaster
aaaattttggaat

SEQ ID NO: 546633 - DNA, 14 bp, D. melanogaster
aaaattttgttttc

SEQ ID NO: 546634 - DNA, 14 bp, D. melanogaster
aaaatttttagctg

SEQ ID NO: 546635 - DNA, 13 bp, D. melanogaster
aaaatttttcaca

SEQ ID NO: 546636 - DNA, 14 bp, D. melanogaster
aaaatttttcctga

SEQ ID NO: 546637 - DNA, 13 bp, D. melanogaster
aaaatttttgaga

SEQ ID NO: 546638 - DNA, 13 bp, D. melanogaster
aaaatttttgcaa

SEQ ID NO: 546639 - DNA, 13 bp, D. melanogaster
aaaatttttgctg

SEQ ID NO: 546640 - DNA, 13 bp, D. melanogaster
aaaatttttggaa

SEQ ID NO: 546641 - DNA, 13 bp, D. melanogaster
aaaatttttgtgc

SEQ ID NO: 546642 - DNA, 14 bp, D. melanogaster
aaacaaaaacagtt

SEQ ID NO: 546643 - DNA, 13 bp, D. melanogaster
aaacaaaaacctg

SEQ ID NO: 546644 - DNA, 13 bp, D. melanogaster
aaacaaaaacgtg

SEQ ID NO: 546645 - DNA, 14 bp, D. melanogaster
aaacaaaaactcag

SEQ ID NO: 546646 - DNA, 13 bp, D. melanogaster
aaacaaaaagctt

SEQ ID NO: 546647 - DNA, 13 bp, D. melanogaster
aaacaaaaagtgc

SEQ ID NO: 546648 - DNA, 13 bp, D. melanogaster
aaacaaaaagtgg

SEQ ID NO: 546649 - DNA, 14 bp, D. melanogaster
aaacaaaaagtttt

SEQ ID NO: 546650 - DNA, 14 bp, D. melanogaster
aaacaaaaatattg

SEQ ID NO: 546651 - DNA, 13 bp, D. melanogaster
aaacaaaaatctg

SEQ ID NO: 546652 - DNA, 13 bp, D. melanogaster
aaacaaaaatggt

SEQ ID NO: 546653 - DNA, 14 bp, D. melanogaster
aaacaaaaatgtat

SEQ ID NO: 546654 - DNA, 13 bp, D. melanogaster
aaacaaaaatgtt

SEQ ID NO: 546655 - DNA, 14 bp, D. melanogaster
aaacaaaaatgtta

SEQ ID NO: 546656 - DNA, 13 bp, D. melanogaster
aaacaaaaattgt

SEQ ID NO: 546657 - DNA, 14 bp, D. melanogaster
aaacaaaaattgtg

SEQ ID NO: 546658 - DNA, 14 bp, D. melanogaster
aaacaaaacacttt

SEQ ID NO: 546659 - DNA, 14 bp, D. melanogaster
aaacaaaaccgaat

SEQ ID NO: 546660 - DNA, 13 bp, D. melanogaster
aaacaaaaccgat

SEQ ID NO: 546661 - DNA, 13 bp, D. melanogaster
aaacaaaactcga

SEQ ID NO: 546662 - DNA, 13 bp, D. melanogaster
aaacaaaactgca

SEQ ID NO: 546663 - DNA, 13 bp, D. melanogaster
aaacaaaactttc

SEQ ID NO: 546664 - DNA, 13 bp, D. melanogaster
aaacaaaactttt

SEQ ID NO: 546665 - DNA, 13 bp, D. melanogaster
aaacaaaagactt

SEQ ID NO: 546666 - DNA, 13 bp, D. melanogaster
aaacaaaagattt

SEQ ID NO: 546667 - DNA, 14 bp, D. melanogaster
aaacaaaagcaatt

SEQ ID NO: 546668 - DNA, 13 bp, D. melanogaster
aaacaaaagcatt

SEQ ID NO: 546669 - DNA, 13 bp, D. melanogaster
aaacaaaagcgct

SEQ ID NO: 546670 - DNA, 13 bp, D. melanogaster
aaacaaaagcgtt

SEQ ID NO: 546671 - DNA, 13 bp, D. melanogaster
aaacaaaagctgg

SEQ ID NO: 546672 - DNA, 14 bp, D. melanogaster
aaacaaaaggcagc

SEQ ID NO: 546673 - DNA, 13 bp, D. melanogaster
aaacaaaaggcat

SEQ ID NO: 546674 - DNA, 13 bp, D. melanogaster
aaacaaaaggtga

SEQ ID NO: 546675 - DNA, 13 bp, D. melanogaster
aaacaaaagtatc

SEQ ID NO: 546676 - DNA, 13 bp, D. melanogaster
aaacaaaagtcca

SEQ ID NO: 546677 - DNA, 13 bp, D. melanogaster
aaacaaaagtcgc

SEQ ID NO: 546678 - DNA, 13 bp, D. melanogaster
aaacaaaagtgct

SEQ ID NO: 546679 - DNA, 13 bp, D. melanogaster
aaacaaaagtgga

SEQ ID NO: 546680 - DNA, 13 bp, D. melanogaster
aaacaaaagtggc

SEQ ID NO: 546681 - DNA, 13 bp, D. melanogaster
aaacaaaagtgtt

SEQ ID NO: 546682 - DNA, 13 bp, D. melanogaster
aaacaaaagtttt

SEQ ID NO: 546683 - DNA, 13 bp, D. melanogaster
aaacaaaatattg

SEQ ID NO: 546684 - DNA, 13 bp, D. melanogaster
aaacaaaatcagc

SEQ ID NO: 546685 - DNA, 13 bp, D. melanogaster
aaacaaaatcgag

SEQ ID NO: 546686 - DNA, 14 bp, D. melanogaster
aaacaaaatgaatt

SEQ ID NO: 546687 - DNA, 14 bp, D. melanogaster
aaacaaaatgccaa

SEQ ID NO: 546688 - DNA, 13 bp, D. melanogaster
aaacaaaatgccc

SEQ ID NO: 546689 - DNA, 13 bp, D. melanogaster
aaacaaaatgcgt

SEQ ID NO: 546690 - DNA, 13 bp, D. melanogaster
aaacaaaatggcg

SEQ ID NO: 546691 - DNA, 13 bp, D. melanogaster
aaacaaaatgtat

SEQ ID NO: 546692 - DNA, 13 bp, D. melanogaster
aaacaaaatgtgg

SEQ ID NO: 546693 - DNA, 13 bp, D. melanogaster
aaacaaaatgtgt

SEQ ID NO: 546694 - DNA, 13 bp, D. melanogaster
aaacaaaatgtta

SEQ ID NO: 546695 - DNA, 13 bp, D. melanogaster
aaacaaaattctg

SEQ ID NO: 546696 - DNA, 13 bp, D. melanogaster
aaacaaaattctt

SEQ ID NO: 546697 - DNA, 14 bp, D. melanogaster
aaacaaaattgaag

SEQ ID NO: 546698 - DNA, 13 bp, D. melanogaster
aaacaaaattgat

SEQ ID NO: 546699 - DNA, 13 bp, D. melanogaster
aaacaaaattgct

SEQ ID NO: 546700 - DNA, 13 bp, D. melanogaster
aaacaaaattgtt

SEQ ID NO: 546701 - DNA, 13 bp, D. melanogaster
aaacaaaatttga

SEQ ID NO: 546702 - DNA, 13 bp, D. melanogaster
aaacaaaatttgt

SEQ ID NO: 546703 - DNA, 13 bp, D. melanogaster
aaacaaaattttc

SEQ ID NO: 546704 - DNA, 14 bp, D. melanogaster
aaacaaacaaagct

SEQ ID NO: 546705 - DNA, 14 bp, D. melanogaster
aaacaaacaaattg

SEQ ID NO: 546706 - DNA, 13 bp, D. melanogaster
aaacaaacaagtg

SEQ ID NO: 546707 - DNA, 14 bp, D. melanogaster
aaacaaacaagtga

SEQ ID NO: 546708 - DNA, 13 bp, D. melanogaster
aaacaaacaagtt

SEQ ID NO: 546709 - DNA, 14 bp, D. melanogaster
aaacaaacaatttc

SEQ ID NO: 546710 - DNA, 14 bp, D. melanogaster
aaacaaacaatttg

SEQ ID NO: 546711 - DNA, 14 bp, D. melanogaster
aaacaaacacattt

SEQ ID NO: 546712 - DNA, 13 bp, D. melanogaster
aaacaaacagcat

SEQ ID NO: 546713 - DNA, 13 bp, D. melanogaster
aaacaaacagctg

SEQ ID NO: 546714 - DNA, 13 bp, D. melanogaster
aaacaaacagttg

SEQ ID NO: 546715 - DNA, 13 bp, D. melanogaster
aaacaaacagttt

SEQ ID NO: 546716 - DNA, 13 bp, D. melanogaster
aaacaaacatgcc

SEQ ID NO: 546717 - DNA, 13 bp, D. melanogaster
aaacaaacatttt

SEQ ID NO: 546718 - DNA, 14 bp, D. melanogaster
aaacaaacattttg

SEQ ID NO: 546719 - DNA, 13 bp, D. melanogaster
aaacaaacgattt

SEQ ID NO: 546720 - DNA, 13 bp, D. melanogaster
aaacaaacgcata

SEQ ID NO: 546721 - DNA, 13 bp, D. melanogaster
aaacaaacggggt

SEQ ID NO: 546722 - DNA, 13 bp, D. melanogaster
aaacaaactaatg

SEQ ID NO: 546723 - DNA, 13 bp, D. melanogaster
aaacaaactagtt

SEQ ID NO: 546724 - DNA, 13 bp, D. melanogaster
aaacaaactattt

SEQ ID NO: 546725 - DNA, 13 bp, D. melanogaster
aaacaaactcatt

SEQ ID NO: 546726 - DNA, 13 bp, D. melanogaster
aaacaaactgaat

SEQ ID NO: 546727 - DNA, 13 bp, D. melanogaster
aaacaaactgcag

SEQ ID NO: 546728 - DNA, 13 bp, D. melanogaster
aaacaaactggca

SEQ ID NO: 546729 - DNA, 13 bp, D. melanogaster
aaacaaactggct

SEQ ID NO: 546730 - DNA, 13 bp, D. melanogaster
aaacaaactggtt

SEQ ID NO: 546731 - DNA, 13 bp, D. melanogaster
aaacaaactttat

SEQ ID NO: 546732 - DNA, 13 bp, D. melanogaster
aaacaaactttct

SEQ ID NO: 546733 - DNA, 14 bp, D. melanogaster
aaacaaactttttt

SEQ ID NO: 546734 - DNA, 13 bp, D. melanogaster
aaacaaagacttt

SEQ ID NO: 546735 - DNA, 13 bp, D. melanogaster
aaacaaagatttt

SEQ ID NO: 546736 - DNA, 13 bp, D. melanogaster
aaacaaagcaatc

SEQ ID NO: 546737 - DNA, 14 bp, D. melanogaster
aaacaaagccaaat

SEQ ID NO: 546738 - DNA, 13 bp, D. melanogaster
aaacaaagccagc

SEQ ID NO: 546739 - DNA, 13 bp, D. melanogaster
aaacaaagcctac

SEQ ID NO: 546740 - DNA, 13 bp, D. melanogaster
aaacaaagcgaat

SEQ ID NO: 546741 - DNA, 13 bp, D. melanogaster
aaacaaagctaat

SEQ ID NO: 546742 - DNA, 13 bp, D. melanogaster
aaacaaagctgaa

SEQ ID NO: 546743 - DNA, 14 bp, D. melanogaster
aaacaaaggcaaat

SEQ ID NO: 546744 - DNA, 13 bp, D. melanogaster
aaacaaagtatat

SEQ ID NO: 546745 - DNA, 13 bp, D. melanogaster
aaacaaagtcaag

SEQ ID NO: 546746 - DNA, 13 bp, D. melanogaster
aaacaaagtgaat

SEQ ID NO: 546747 - DNA, 13 bp, D. melanogaster
aaacaaagtgttt

SEQ ID NO: 546748 - DNA, 13 bp, D. melanogaster
aaacaaagttaat

SEQ ID NO: 546749 - DNA, 13 bp, D. melanogaster
aaacaaagttctt

SEQ ID NO: 546750 - DNA, 13 bp, D. melanogaster
aaacaaagtttaa

SEQ ID NO: 546751 - DNA, 13 bp, D. melanogaster
aaacaaagtttat

SEQ ID NO: 546752 - DNA, 13 bp, D. melanogaster
aaacaaagtttgc

SEQ ID NO: 546753 - DNA, 13 bp, D. melanogaster
aaacaaagttttt

SEQ ID NO: 546754 - DNA, 14 bp, D. melanogaster
aaacaaataaatgc

SEQ ID NO: 546755 - DNA, 13 bp, D. melanogaster
aaacaaatacgag

SEQ ID NO: 546756 - DNA, 13 bp, D. melanogaster
aaacaaatagttt

SEQ ID NO: 546757 - DNA, 13 bp, D. melanogaster
aaacaaatatcga

SEQ ID NO: 546758 - DNA, 13 bp, D. melanogaster
aaacaaatatgta

SEQ ID NO: 546759 - DNA, 14 bp, D. melanogaster
aaacaaatatttga

SEQ ID NO: 546760 - DNA, 14 bp, D. melanogaster
aaacaaatatttgt

SEQ ID NO: 546761 - DNA, 14 bp, D. melanogaster
aaacaaatcaaatg

SEQ ID NO: 546762 - DNA, 13 bp, D. melanogaster
aaacaaatcaagt

SEQ ID NO: 546763 - DNA, 13 bp, D. melanogaster
aaacaaatcatcg

SEQ ID NO: 546764 - DNA, 13 bp, D. melanogaster
aaacaaatcattt

SEQ ID NO: 546765 - DNA, 14 bp, D. melanogaster
aaacaaatcatttg

SEQ ID NO: 546766 - DNA, 13 bp, D. melanogaster
aaacaaatcgagc

SEQ ID NO: 546767 - DNA, 13 bp, D. melanogaster
aaacaaatcgatg

SEQ ID NO: 546768 - DNA, 13 bp, D. melanogaster
aaacaaatcgatt

SEQ ID NO: 546769 - DNA, 13 bp, D. melanogaster
aaacaaatcgctt

SEQ ID NO: 546770 - DNA, 13 bp, D. melanogaster
aaacaaatcggaa

SEQ ID NO: 546771 - DNA, 13 bp, D. melanogaster
aaacaaatctatt

SEQ ID NO: 546772 - DNA, 14 bp, D. melanogaster
aaacaaatgaaatg

SEQ ID NO: 546773 - DNA, 13 bp, D. melanogaster
aaacaaatgaagg

SEQ ID NO: 546774 - DNA, 13 bp, D. melanogaster
aaacaaatgaatg

SEQ ID NO: 546775 - DNA, 13 bp, D. melanogaster
aaacaaatgaatt

SEQ ID NO: 546776 - DNA, 13 bp, D. melanogaster
aaacaaatgatgt

SEQ ID NO: 546777 - DNA, 13 bp, D. melanogaster
aaacaaatgcaat

SEQ ID NO: 546778 - DNA, 14 bp, D. melanogaster
aaacaaatgcaatt

SEQ ID NO: 546779 - DNA, 13 bp, D. melanogaster
aaacaaatgcaga

SEQ ID NO: 546780 - DNA, 13 bp, D. melanogaster
aaacaaatgcatt

SEQ ID NO: 546781 - DNA, 13 bp, D. melanogaster
aaacaaatgccaa

SEQ ID NO: 546782 - DNA, 14 bp, D. melanogaster
aaacaaatgccaaa

SEQ ID NO: 546783 - DNA, 13 bp, D. melanogaster
aaacaaatgccat

SEQ ID NO: 546784 - DNA, 13 bp, D. melanogaster
aaacaaatgcgaa

SEQ ID NO: 546785 - DNA, 14 bp, D. melanogaster
aaacaaatgcgaaa

SEQ ID NO: 546786 - DNA, 13 bp, D. melanogaster
aaacaaatgcgat

SEQ ID NO: 546787 - DNA, 13 bp, D. melanogaster
aaacaaatgctaa

SEQ ID NO: 546788 - DNA, 13 bp, D. melanogaster
aaacaaatgctgc

SEQ ID NO: 546789 - DNA, 13 bp, D. melanogaster
aaacaaatgcttt

SEQ ID NO: 546790 - DNA, 14 bp, D. melanogaster
aaacaaatggaaat

SEQ ID NO: 546791 - DNA, 13 bp, D. melanogaster
aaacaaatggcaa

SEQ ID NO: 546792 - DNA, 14 bp, D. melanogaster
aaacaaatggcaaa

SEQ ID NO: 546793 - DNA, 13 bp, D. melanogaster
aaacaaatgtact

SEQ ID NO: 546794 - DNA, 13 bp, D. melanogaster
aaacaaatgtgaa

SEQ ID NO: 546795 - DNA, 13 bp, D. melanogaster
aaacaaatgtgta

SEQ ID NO: 546796 - DNA, 13 bp, D. melanogaster
aaacaaatgttgc

SEQ ID NO: 546797 - DNA, 13 bp, D. melanogaster
aaacaaatgttgt

SEQ ID NO: 546798 - DNA, 13 bp, D. melanogaster
aaacaaatgtttg

SEQ ID NO: 546799 - DNA, 13 bp, D. melanogaster
aaacaaatgtttt

SEQ ID NO: 546800 - DNA, 14 bp, D. melanogaster
aaacaaatgttttt

SEQ ID NO: 546801 - DNA, 13 bp, D. melanogaster
aaacaaattacga

SEQ ID NO: 546802 - DNA, 13 bp, D. melanogaster
aaacaaattactt

SEQ ID NO: 546803 - DNA, 14 bp, D. melanogaster
aaacaaattacttt

SEQ ID NO: 546804 - DNA, 13 bp, D. melanogaster
aaacaaattagca

SEQ ID NO: 546805 - DNA, 13 bp, D. melanogaster
aaacaaattagtt

SEQ ID NO: 546806 - DNA, 14 bp, D. melanogaster
aaacaaattagttt

SEQ ID NO: 546807 - DNA, 13 bp, D. melanogaster
aaacaaattatgt

SEQ ID NO: 546808 - DNA, 13 bp, D. melanogaster
aaacaaattcaag

SEQ ID NO: 546809 - DNA, 13 bp, D. melanogaster
aaacaaattcgaa

SEQ ID NO: 546810 - DNA, 14 bp, D. melanogaster
aaacaaattcgaaa

SEQ ID NO: 546811 - DNA, 13 bp, D. melanogaster
aaacaaattcgca

SEQ ID NO: 546812 - DNA, 14 bp, D. melanogaster
aaacaaattgaaat

SEQ ID NO: 546813 - DNA, 14 bp, D. melanogaster
aaacaaattgaatt

SEQ ID NO: 546814 - DNA, 13 bp, D. melanogaster
aaacaaattgaga

SEQ ID NO: 546815 - DNA, 13 bp, D. melanogaster
aaacaaattgatt

SEQ ID NO: 546816 - DNA, 13 bp, D. melanogaster
aaacaaattgcac

SEQ ID NO: 546817 - DNA, 13 bp, D. melanogaster
aaacaaattgcag

SEQ ID NO: 546818 - DNA, 14 bp, D. melanogaster
aaacaaattgcaga

SEQ ID NO: 546819 - DNA, 13 bp, D. melanogaster
aaacaaattgcca

SEQ ID NO: 546820 - DNA, 13 bp, D. melanogaster
aaacaaattgccc

SEQ ID NO: 546821 - DNA, 13 bp, D. melanogaster
aaacaaattgcta

SEQ ID NO: 546822 - DNA, 13 bp, D. melanogaster
aaacaaattggaa

SEQ ID NO: 546823 - DNA, 14 bp, D. melanogaster
aaacaaattggaaa

SEQ ID NO: 546824 - DNA, 13 bp, D. melanogaster
aaacaaattggct

SEQ ID NO: 546825 - DNA, 13 bp, D. melanogaster
aaacaaattgtaa

SEQ ID NO: 546826 - DNA, 13 bp, D. melanogaster
aaacaaattgtat

SEQ ID NO: 546827 - DNA, 13 bp, D. melanogaster
aaacaaattgtta

SEQ ID NO: 546828 - DNA, 14 bp, D. melanogaster
aaacaaattgttaa

SEQ ID NO: 546829 - DNA, 13 bp, D. melanogaster
aaacaaattgttc

SEQ ID NO: 546830 - DNA, 13 bp, D. melanogaster
aaacaaattgttg

SEQ ID NO: 546831 - DNA, 13 bp, D. melanogaster
aaacaaattgttt

SEQ ID NO: 546832 - DNA, 13 bp, D. melanogaster
aaacaaatttagt

SEQ ID NO: 546833 - DNA, 13 bp, D. melanogaster
aaacaaatttcag

SEQ ID NO: 546834 - DNA, 14 bp, D. melanogaster
aaacaaatttcaga

SEQ ID NO: 546835 - DNA, 14 bp, D. melanogaster
aaacaaatttcatt

SEQ ID NO: 546836 - DNA, 13 bp, D. melanogaster
aaacaaatttccg

SEQ ID NO: 546837 - DNA, 14 bp, D. melanogaster
aaacaaatttcttt

SEQ ID NO: 546838 - DNA, 14 bp, D. melanogaster
aaacaaatttgatt

SEQ ID NO: 546839 - DNA, 13 bp, D. melanogaster
aaacaaatttggc

SEQ ID NO: 546840 - DNA, 13 bp, D. melanogaster
aaacaaatttgta

SEQ ID NO: 546841 - DNA, 13 bp, D. melanogaster
aaacaaatttgtg

SEQ ID NO: 546842 - DNA, 13 bp, D. melanogaster
aaacaaatttgtt

SEQ ID NO: 546843 - DNA, 14 bp, D. melanogaster
aaacaacaaaatcg

SEQ ID NO: 546844 - DNA, 13 bp, D. melanogaster
aaacaacaaactg

SEQ ID NO: 546845 - DNA, 14 bp, D. melanogaster
aaacaacaaatagt

SEQ ID NO: 546846 - DNA, 13 bp, D. melanogaster
aaacaacaaattg

SEQ ID NO: 546847 - DNA, 14 bp, D. melanogaster
aaacaacaacagct

SEQ ID NO: 546848 - DNA, 13 bp, D. melanogaster
aaacaacaacatg

SEQ ID NO: 546849 - DNA, 14 bp, D. melanogaster
aaacaacaacattg

SEQ ID NO: 546850 - DNA, 13 bp, D. melanogaster
aaacaacaactgc

SEQ ID NO: 546851 - DNA, 13 bp, D. melanogaster
aaacaacaacttt

SEQ ID NO: 546852 - DNA, 13 bp, D. melanogaster
aaacaacaagtgc

SEQ ID NO: 546853 - DNA, 13 bp, D. melanogaster
aaacaacaagttg

SEQ ID NO: 546854 - DNA, 13 bp, D. melanogaster
aaacaacaatagc

SEQ ID NO: 546855 - DNA, 13 bp, D. melanogaster
aaacaacaatatg

SEQ ID NO: 546856 - DNA, 13 bp, D. melanogaster
aaacaacaatgac

SEQ ID NO: 546857 - DNA, 13 bp, D. melanogaster
aaacaacaatggc

SEQ ID NO: 546858 - DNA, 13 bp, D. melanogaster
aaacaacaattag

SEQ ID NO: 546859 - DNA, 13 bp, D. melanogaster
aaacaacacactt

SEQ ID NO: 546860 - DNA, 13 bp, D. melanogaster
aaacaacacagct

SEQ ID NO: 546861 - DNA, 13 bp, D. melanogaster
aaacaacactact

SEQ ID NO: 546862 - DNA, 13 bp, D. melanogaster
aaacaacatattc

SEQ ID NO: 546863 - DNA, 13 bp, D. melanogaster
aaacaacattgaa

SEQ ID NO: 546864 - DNA, 13 bp, D. melanogaster
aaacaacatttca

SEQ ID NO: 546865 - DNA, 13 bp, D. melanogaster
aaacaacatttta

SEQ ID NO: 546866 - DNA, 13 bp, D. melanogaster
aaacaacattttc

SEQ ID NO: 546867 - DNA, 13 bp, D. melanogaster
aaacaaccgattt

SEQ ID NO: 546868 - DNA, 13 bp, D. melanogaster
aaacaacgatata

SEQ ID NO: 546869 - DNA, 13 bp, D. melanogaster
aaacaacggcagc

SEQ ID NO: 546870 - DNA, 13 bp, D. melanogaster
aaacaactaattg

SEQ ID NO: 546871 - DNA, 13 bp, D. melanogaster
aaacaactacagc

SEQ ID NO: 546872 - DNA, 13 bp, D. melanogaster
aaacaactgaaag

SEQ ID NO: 546873 - DNA, 13 bp, D. melanogaster
aaacaactgattt

SEQ ID NO: 546874 - DNA, 13 bp, D. melanogaster
aaacaactgcaca

SEQ ID NO: 546875 - DNA, 13 bp, D. melanogaster
aaacaacttgaat

SEQ ID NO: 546876 - DNA, 13 bp, D. melanogaster
aaacaacttgatt

SEQ ID NO: 546877 - DNA, 13 bp, D. melanogaster
aaacaactttcac

SEQ ID NO: 546878 - DNA, 13 bp, D. melanogaster
aaacaacttttac

SEQ ID NO: 546879 - DNA, 14 bp, D. melanogaster
aaacaagaaactgc

SEQ ID NO: 546880 - DNA, 13 bp, D. melanogaster
aaacaagaaactt

SEQ ID NO: 546881 - DNA, 13 bp, D. melanogaster
aaacaagaaattt

SEQ ID NO: 546882 - DNA, 14 bp, D. melanogaster
aaacaagaaatttg

SEQ ID NO: 546883 - DNA, 13 bp, D. melanogaster
aaacaagaattta

SEQ ID NO: 546884 - DNA, 13 bp, D. melanogaster
aaacaagaatttt

SEQ ID NO: 546885 - DNA, 14 bp, D. melanogaster
aaacaagaattttt

SEQ ID NO: 546886 - DNA, 13 bp, D. melanogaster
aaacaagagtcac

SEQ ID NO: 546887 - DNA, 13 bp, D. melanogaster
aaacaagattttg

SEQ ID NO: 546888 - DNA, 13 bp, D. melanogaster
aaacaagcagcag

SEQ ID NO: 546889 - DNA, 13 bp, D. melanogaster
aaacaagcatttt

SEQ ID NO: 546890 - DNA, 13 bp, D. melanogaster
aaacaagccagca

SEQ ID NO: 546891 - DNA, 13 bp, D. melanogaster
aaacaagccataa

SEQ ID NO: 546892 - DNA, 13 bp, D. melanogaster
aaacaagcgaaat

SEQ ID NO: 546893 - DNA, 13 bp, D. melanogaster
aaacaagcggcaa

SEQ ID NO: 546894 - DNA, 13 bp, D. melanogaster
aaacaagcgtttt

SEQ ID NO: 546895 - DNA, 13 bp, D. melanogaster
aaacaagctgaaa

SEQ ID NO: 546896 - DNA, 14 bp, D. melanogaster
aaacaagctgaaaa

SEQ ID NO: 546897 - DNA, 13 bp, D. melanogaster
aaacaagctgcaa

SEQ ID NO: 546898 - DNA, 13 bp, D. melanogaster
aaacaaggaaagt

SEQ ID NO: 546899 - DNA, 13 bp, D. melanogaster
aaacaaggaaatt

SEQ ID NO: 546900 - DNA, 13 bp, D. melanogaster
aaacaaggcagca

SEQ ID NO: 546901 - DNA, 13 bp, D. melanogaster
aaacaagggaaat

SEQ ID NO: 546902 - DNA, 13 bp, D. melanogaster
aaacaaggtgact

SEQ ID NO: 546903 - DNA, 13 bp, D. melanogaster
aaacaagtaattt

SEQ ID NO: 546904 - DNA, 13 bp, D. melanogaster
aaacaagtatttt

SEQ ID NO: 546905 - DNA, 13 bp, D. melanogaster
aaacaagtgaaac

SEQ ID NO: 546906 - DNA, 14 bp, D. melanogaster
aaacaagtgaaact

SEQ ID NO: 546907 - DNA, 13 bp, D. melanogaster
aaacaagtgaaat

SEQ ID NO: 546908 - DNA, 13 bp, D. melanogaster
aaacaagtggcaa

SEQ ID NO: 546909 - DNA, 13 bp, D. melanogaster
aaacaagttgaaa

SEQ ID NO: 546910 - DNA, 13 bp, D. melanogaster
aaacaagttgaat

SEQ ID NO: 546911 - DNA, 13 bp, D. melanogaster
aaacaagttgcaa

SEQ ID NO: 546912 - DNA, 13 bp, D. melanogaster
aaacaagttggcc

SEQ ID NO: 546913 - DNA, 13 bp, D. melanogaster
aaacaagtttaaa

SEQ ID NO: 546914 - DNA, 13 bp, D. melanogaster
aaacaagtttata

SEQ ID NO: 546915 - DNA, 13 bp, D. melanogaster
aaacaagtttgca

SEQ ID NO: 546916 - DNA, 13 bp, D. melanogaster
aaacaagtttgcc

SEQ ID NO: 546917 - DNA, 13 bp, D. melanogaster
aaacaagtttgtt

SEQ ID NO: 546918 - DNA, 13 bp, D. melanogaster
aaacaagttttcg

SEQ ID NO: 546919 - DNA, 13 bp, D. melanogaster
aaacaagtttttt

SEQ ID NO: 546920 - DNA, 14 bp, D. melanogaster
aaacaagttttttt

SEQ ID NO: 546921 - DNA, 13 bp, D. melanogaster
aaacaataaacgt

SEQ ID NO: 546922 - DNA, 13 bp, D. melanogaster
aaacaataaagtg

SEQ ID NO: 546923 - DNA, 13 bp, D. melanogaster
aaacaataaatgc

SEQ ID NO: 546924 - DNA, 13 bp, D. melanogaster
aaacaataacagc

SEQ ID NO: 546925 - DNA, 13 bp, D. melanogaster
aaacaataagcca

SEQ ID NO: 546926 - DNA, 13 bp, D. melanogaster
aaacaataaggca

SEQ ID NO: 546927 - DNA, 14 bp, D. melanogaster
aaacaataaggcag

SEQ ID NO: 546928 - DNA, 13 bp, D. melanogaster
aaacaataatttc

SEQ ID NO: 546929 - DNA, 13 bp, D. melanogaster
aaacaatacattt

SEQ ID NO: 546930 - DNA, 13 bp, D. melanogaster
aaacaatagatat

SEQ ID NO: 546931 - DNA, 13 bp, D. melanogaster
aaacaatagattt

SEQ ID NO: 546932 - DNA, 13 bp, D. melanogaster
aaacaatagcaac

SEQ ID NO: 546933 - DNA, 13 bp, D. melanogaster
aaacaatatatgt

SEQ ID NO: 546934 - DNA, 13 bp, D. melanogaster
aaacaatatgcaa

SEQ ID NO: 546935 - DNA, 13 bp, D. melanogaster
aaacaatatggca

SEQ ID NO: 546936 - DNA, 13 bp, D. melanogaster
aaacaatattgaa

SEQ ID NO: 546937 - DNA, 13 bp, D. melanogaster
aaacaatatttct

SEQ ID NO: 546938 - DNA, 13 bp, D. melanogaster
aaacaatcaaatg

SEQ ID NO: 546939 - DNA, 13 bp, D. melanogaster
aaacaatcaacag

SEQ ID NO: 546940 - DNA, 13 bp, D. melanogaster
aaacaatccagtt

SEQ ID NO: 546941 - DNA, 13 bp, D. melanogaster
aaacaatccatca

SEQ ID NO: 546942 - DNA, 13 bp, D. melanogaster
aaacaatcgattt

SEQ ID NO: 546943 - DNA, 13 bp, D. melanogaster
aaacaatcgtaaa

SEQ ID NO: 546944 - DNA, 13 bp, D. melanogaster
aaacaatcttttt

SEQ ID NO: 546945 - DNA, 14 bp, D. melanogaster
aaacaatgaaaatt

SEQ ID NO: 546946 - DNA, 13 bp, D. melanogaster
aaacaatgacaat

SEQ ID NO: 546947 - DNA, 13 bp, D. melanogaster
aaacaatgacagc

SEQ ID NO: 546948 - DNA, 13 bp, D. melanogaster
aaacaatgcacaa

SEQ ID NO: 546949 - DNA, 13 bp, D. melanogaster
aaacaatgcattt

SEQ ID NO: 546950 - DNA, 13 bp, D. melanogaster
aaacaatgccaac

SEQ ID NO: 546951 - DNA, 13 bp, D. melanogaster
aaacaatgccaat

SEQ ID NO: 546952 - DNA, 13 bp, D. melanogaster
aaacaatgcgaaa

SEQ ID NO: 546953 - DNA, 13 bp, D. melanogaster
aaacaatgcgaat

SEQ ID NO: 546954 - DNA, 13 bp, D. melanogaster
aaacaatgcgatt

SEQ ID NO: 546955 - DNA, 13 bp, D. melanogaster
aaacaatggaaag

SEQ ID NO: 546956 - DNA, 13 bp, D. melanogaster
aaacaatggaaat

SEQ ID NO: 546957 - DNA, 13 bp, D. melanogaster
aaacaatggcaac

SEQ ID NO: 546958 - DNA, 13 bp, D. melanogaster
aaacaatggcaat

SEQ ID NO: 546959 - DNA, 13 bp, D. melanogaster
aaacaatggcagc

SEQ ID NO: 546960 - DNA, 13 bp, D. melanogaster
aaacaatggccaa

SEQ ID NO: 546961 - DNA, 13 bp, D. melanogaster
aaacaatggccag

SEQ ID NO: 546962 - DNA, 13 bp, D. melanogaster
aaacaatggctaa

SEQ ID NO: 546963 - DNA, 13 bp, D. melanogaster
aaacaatgtcaaa

SEQ ID NO: 546964 - DNA, 13 bp, D. melanogaster
aaacaatgtgaaa

SEQ ID NO: 546965 - DNA, 13 bp, D. melanogaster
aaacaatgtggaa

SEQ ID NO: 546966 - DNA, 13 bp, D. melanogaster
aaacaatgttttt

SEQ ID NO: 546967 - DNA, 13 bp, D. melanogaster
aaacaattaaatg

SEQ ID NO: 546968 - DNA, 14 bp, D. melanogaster
aaacaattaaattg

SEQ ID NO: 546969 - DNA, 13 bp, D. melanogaster
aaacaattaatga

SEQ ID NO: 546970 - DNA, 13 bp, D. melanogaster
aaacaattaattg

SEQ ID NO: 546971 - DNA, 13 bp, D. melanogaster
aaacaattagctt

SEQ ID NO: 546972 - DNA, 13 bp, D. melanogaster
aaacaattagttt

SEQ ID NO: 546973 - DNA, 13 bp, D. melanogaster
aaacaattattca

SEQ ID NO: 546974 - DNA, 13 bp, D. melanogaster
aaacaattatttg

SEQ ID NO: 546975 - DNA, 13 bp, D. melanogaster
aaacaattcaatt

SEQ ID NO: 546976 - DNA, 14 bp, D. melanogaster
aaacaattcaattt

SEQ ID NO: 546977 - DNA, 13 bp, D. melanogaster
aaacaattcattt

SEQ ID NO: 546978 - DNA, 13 bp, D. melanogaster
aaacaattcccaa

SEQ ID NO: 546979 - DNA, 13 bp, D. melanogaster
aaacaattcgaat

SEQ ID NO: 546980 - DNA, 13 bp, D. melanogaster
aaacaattcgatt

SEQ ID NO: 546981 - DNA, 13 bp, D. melanogaster
aaacaattcttaa

SEQ ID NO: 546982 - DNA, 14 bp, D. melanogaster
aaacaattgaaaag

SEQ ID NO: 546983 - DNA, 13 bp, D. melanogaster
aaacaattgaaat

SEQ ID NO: 546984 - DNA, 13 bp, D. melanogaster
aaacaattgaatg

SEQ ID NO: 546985 - DNA, 13 bp, D. melanogaster
aaacaattgcaaa

SEQ ID NO: 546986 - DNA, 13 bp, D. melanogaster
aaacaattgcaat

SEQ ID NO: 546987 - DNA, 13 bp, D. melanogaster
aaacaattgccaa

SEQ ID NO: 546988 - DNA, 13 bp, D. melanogaster
aaacaattgcgaa

SEQ ID NO: 546989 - DNA, 13 bp, D. melanogaster
aaacaattggcaa

SEQ ID NO: 546990 - DNA, 13 bp, D. melanogaster
aaacaattggcca

SEQ ID NO: 546991 - DNA, 13 bp, D. melanogaster
aaacaattgtcaa

SEQ ID NO: 546992 - DNA, 13 bp, D. melanogaster
aaacaattgtgtt

SEQ ID NO: 546993 - DNA, 13 bp, D. melanogaster
aaacaattgttaa

SEQ ID NO: 546994 - DNA, 13 bp, D. melanogaster
aaacaattgttta

SEQ ID NO: 546995 - DNA, 13 bp, D. melanogaster
aaacaattgtttg

SEQ ID NO: 546996 - DNA, 13 bp, D. melanogaster
aaacaattgtttt

SEQ ID NO: 546997 - DNA, 14 bp, D. melanogaster
aaacaattgttttt

SEQ ID NO: 546998 - DNA, 13 bp, D. melanogaster
aaacaatttaagc

SEQ ID NO: 546999 - DNA, 14 bp, D. melanogaster
aaacaatttaattg

SEQ ID NO: 547000 - DNA, 13 bp, D. melanogaster
aaacaatttacca

SEQ ID NO: 547001 - DNA, 13 bp, D. melanogaster
aaacaatttacgc

SEQ ID NO: 547002 - DNA, 14 bp, D. melanogaster
aaacaatttcaatt

SEQ ID NO: 547003 - DNA, 13 bp, D. melanogaster
aaacaatttcata

SEQ ID NO: 547004 - DNA, 13 bp, D. melanogaster
aaacaatttccac

SEQ ID NO: 547005 - DNA, 13 bp, D. melanogaster
aaacaatttccat

SEQ ID NO: 547006 - DNA, 13 bp, D. melanogaster
aaacaatttctaa

SEQ ID NO: 547007 - DNA, 13 bp, D. melanogaster
aaacaatttgaaa

SEQ ID NO: 547008 - DNA, 14 bp, D. melanogaster
aaacaatttgaaat

SEQ ID NO: 547009 - DNA, 13 bp, D. melanogaster
aaacaatttgaag

SEQ ID NO: 547010 - DNA, 13 bp, D. melanogaster
aaacaatttgaat

SEQ ID NO: 547011 - DNA, 14 bp, D. melanogaster
aaacaatttgaata

SEQ ID NO: 547012 - DNA, 13 bp, D. melanogaster
aaacaatttgatt

SEQ ID NO: 547013 - DNA, 13 bp, D. melanogaster
aaacaatttgcaa

SEQ ID NO: 547014 - DNA, 14 bp, D. melanogaster
aaacaatttgcaaa

SEQ ID NO: 547015 - DNA, 13 bp, D. melanogaster
aaacaatttgcac

SEQ ID NO: 547016 - DNA, 13 bp, D. melanogaster
aaacaatttgcag

SEQ ID NO: 547017 - DNA, 14 bp, D. melanogaster
aaacaatttgcatt

SEQ ID NO: 547018 - DNA, 13 bp, D. melanogaster
aaacaatttgcca

SEQ ID NO: 547019 - DNA, 13 bp, D. melanogaster
aaacaatttgcgc

SEQ ID NO: 547020 - DNA, 13 bp, D. melanogaster
aaacaatttgtaa

SEQ ID NO: 547021 - DNA, 13 bp, D. melanogaster
aaacaatttgtag

SEQ ID NO: 547022 - DNA, 13 bp, D. melanogaster
aaacaatttgtat

SEQ ID NO: 547023 - DNA, 13 bp, D. melanogaster
aaacaatttgttg

SEQ ID NO: 547024 - DNA, 13 bp, D. melanogaster
aaacaatttgttt

SEQ ID NO: 547025 - DNA, 14 bp, D. melanogaster
aaacaattttaagg

SEQ ID NO: 547026 - DNA, 14 bp, D. melanogaster
aaacaattttaatg

SEQ ID NO: 547027 - DNA, 13 bp, D. melanogaster
aaacaattttacg

SEQ ID NO: 547028 - DNA, 14 bp, D. melanogaster
aaacaattttatag

SEQ ID NO: 547029 - DNA, 14 bp, D. melanogaster
aaacaattttcaat

SEQ ID NO: 547030 - DNA, 14 bp, D. melanogaster
aaacaattttccaa

SEQ ID NO: 547031 - DNA, 13 bp, D. melanogaster
aaacaattttccc

SEQ ID NO: 547032 - DNA, 13 bp, D. melanogaster
aaacaattttcct

SEQ ID NO: 547033 - DNA, 13 bp, D. melanogaster
aaacaattttgtg

SEQ ID NO: 547034 - DNA, 13 bp, D. melanogaster
aaacaatttttag

SEQ ID NO: 547035 - DNA, 13 bp, D. melanogaster
aaacaatttttgg

SEQ ID NO: 547036 - DNA, 13 bp, D. melanogaster
aaacaattttttg

SEQ ID NO: 547037 - DNA, 13 bp, D. melanogaster
aaacacaaaattg

SEQ ID NO: 547038 - DNA, 13 bp, D. melanogaster
aaacacaaagtgt

SEQ ID NO: 547039 - DNA, 14 bp, D. melanogaster
aaacacaaatatgt

SEQ ID NO: 547040 - DNA, 13 bp, D. melanogaster
aaacacaaatgca

SEQ ID NO: 547041 - DNA, 13 bp, D. melanogaster
aaacacaaatgga

SEQ ID NO: 547042 - DNA, 13 bp, D. melanogaster
aaacacaaatgtt

SEQ ID NO: 547043 - DNA, 13 bp, D. melanogaster
aaacacaaattgc

SEQ ID NO: 547044 - DNA, 13 bp, D. melanogaster
aaacacaaatttg

SEQ ID NO: 547045 - DNA, 13 bp, D. melanogaster
aaacacaaatttt

SEQ ID NO: 547046 - DNA, 13 bp, D. melanogaster
aaacacaacaatg

SEQ ID NO: 547047 - DNA, 13 bp, D. melanogaster
aaacacaagtgcc

SEQ ID NO: 547048 - DNA, 13 bp, D. melanogaster
aaacacaagtgtt

SEQ ID NO: 547049 - DNA, 14 bp, D. melanogaster
aaacacaagtgttt

SEQ ID NO: 547050 - DNA, 13 bp, D. melanogaster
aaacacaatgcca

SEQ ID NO: 547051 - DNA, 13 bp, D. melanogaster
aaacacaatggca

SEQ ID NO: 547052 - DNA, 13 bp, D. melanogaster
aaacacaattatt

SEQ ID NO: 547053 - DNA, 13 bp, D. melanogaster
aaacacaattggg

SEQ ID NO: 547054 - DNA, 13 bp, D. melanogaster
aaacacaattgta

SEQ ID NO: 547055 - DNA, 13 bp, D. melanogaster
aaacacaatttga

SEQ ID NO: 547056 - DNA, 13 bp, D. melanogaster
aaacacaattttc

SEQ ID NO: 547057 - DNA, 14 bp, D. melanogaster
aaacacacacatgc

SEQ ID NO: 547058 - DNA, 13 bp, D. melanogaster
aaacacacacttt

SEQ ID NO: 547059 - DNA, 13 bp, D. melanogaster
aaacacacagata

SEQ ID NO: 547060 - DNA, 13 bp, D. melanogaster
aaacacacaggca

SEQ ID NO: 547061 - DNA, 13 bp, D. melanogaster
aaacacacagtat

SEQ ID NO: 547062 - DNA, 14 bp, D. melanogaster
aaacacacataagc

SEQ ID NO: 547063 - DNA, 13 bp, D. melanogaster
aaacacacataga

SEQ ID NO: 547064 - DNA, 16 bp, D. melanogaster
aaacacacatatatat

SEQ ID NO: 547065 - DNA, 13 bp, D. melanogaster
aaacacacatatg

SEQ ID NO: 547066 - DNA, 13 bp, D. melanogaster
aaacacacatatt

SEQ ID NO: 547067 - DNA, 13 bp, D. melanogaster
aaacacacatgca

SEQ ID NO: 547068 - DNA, 13 bp, D. melanogaster
aaacacacatttt

SEQ ID NO: 547069 - DNA, 13 bp, D. melanogaster
aaacacacgaaat

SEQ ID NO: 547070 - DNA, 13 bp, D. melanogaster
aaacacactcgca

SEQ ID NO: 547071 - DNA, 13 bp, D. melanogaster
aaacacactgaaa

SEQ ID NO: 547072 - DNA, 13 bp, D. melanogaster
aaacacactttca

SEQ ID NO: 547073 - DNA, 13 bp, D. melanogaster
aaacacagacgca

SEQ ID NO: 547074 - DNA, 13 bp, D. melanogaster
aaacacagataca

SEQ ID NO: 547075 - DNA, 13 bp, D. melanogaster
aaacacagcagca

SEQ ID NO: 547076 - DNA, 13 bp, D. melanogaster
aaacacaggcaca

SEQ ID NO: 547077 - DNA, 14 bp, D. melanogaster
aaacacatacatat

SEQ ID NO: 547078 - DNA, 13 bp, D. melanogaster
aaacacatatttt

SEQ ID NO: 547079 - DNA, 13 bp, D. melanogaster
aaacacatgatta

SEQ ID NO: 547080 - DNA, 13 bp, D. melanogaster
aaacacatgcaca

SEQ ID NO: 547081 - DNA, 13 bp, D. melanogaster
aaacacattcata

SEQ ID NO: 547082 - DNA, 13 bp, D. melanogaster
aaacacattcatt

SEQ ID NO: 547083 - DNA, 13 bp, D. melanogaster
aaacacattcgaa

SEQ ID NO: 547084 - DNA, 13 bp, D. melanogaster
aaacacattcgca

SEQ ID NO: 547085 - DNA, 14 bp, D. melanogaster
aaacacatttcatt

SEQ ID NO: 547086 - DNA, 13 bp, D. melanogaster
aaacacatttgtc

SEQ ID NO: 547087 - DNA, 13 bp, D. melanogaster
aaacacatttgtg

SEQ ID NO: 547088 - DNA, 13 bp, D. melanogaster
aaacacatttgtt

SEQ ID NO: 547089 - DNA, 13 bp, D. melanogaster
aaacacattttaa

SEQ ID NO: 547090 - DNA, 13 bp, D. melanogaster
aaacacattttat

SEQ ID NO: 547091 - DNA, 14 bp, D. melanogaster
aaacacattttatt

SEQ ID NO: 547092 - DNA, 13 bp, D. melanogaster
aaacacattttgc

SEQ ID NO: 547093 - DNA, 13 bp, D. melanogaster
aaacaccatttaa

SEQ ID NO: 547094 - DNA, 14 bp, D. melanogaster
aaacaccatttaac

SEQ ID NO: 547095 - DNA, 14 bp, D. melanogaster
aaacacccatgtgt

SEQ ID NO: 547096 - DNA, 13 bp, D. melanogaster
aaacaccgccgtt

SEQ ID NO: 547097 - DNA, 13 bp, D. melanogaster
aaacacctttttt

SEQ ID NO: 547098 - DNA, 13 bp, D. melanogaster
aaacacgaaaatg

SEQ ID NO: 547099 - DNA, 13 bp, D. melanogaster
aaacacgaaattt

SEQ ID NO: 547100 - DNA, 13 bp, D. melanogaster
aaacacgcacgca

SEQ ID NO: 547101 - DNA, 13 bp, D. melanogaster
aaacacgcataaa

SEQ ID NO: 547102 - DNA, 13 bp, D. melanogaster
aaacactatttaa

SEQ ID NO: 547103 - DNA, 13 bp, D. melanogaster
aaacactcgaaaa

SEQ ID NO: 547104 - DNA, 13 bp, D. melanogaster
aaacactcgaaat

SEQ ID NO: 547105 - DNA, 13 bp, D. melanogaster
aaacactgaaaat

SEQ ID NO: 547106 - DNA, 13 bp, D. melanogaster
aaacactgagaaa

SEQ ID NO: 547107 - DNA, 14 bp, D. melanogaster
aaacacttaaatcc

SEQ ID NO: 547108 - DNA, 13 bp, D. melanogaster
aaacacttcactt

SEQ ID NO: 547109 - DNA, 13 bp, D. melanogaster
aaacacttgaaat

SEQ ID NO: 547110 - DNA, 13 bp, D. melanogaster
aaacacttggaaa

SEQ ID NO: 547111 - DNA, 14 bp, D. melanogaster
aaacacttgtgttt

SEQ ID NO: 547112 - DNA, 13 bp, D. melanogaster
aaacactttcaat

SEQ ID NO: 547113 - DNA, 13 bp, D. melanogaster
aaacactttccct

SEQ ID NO: 547114 - DNA, 13 bp, D. melanogaster
aaacactttgaaa

SEQ ID NO: 547115 - DNA, 13 bp, D. melanogaster
aaacactttgcca

SEQ ID NO: 547116 - DNA, 13 bp, D. melanogaster
aaacacttttaat

SEQ ID NO: 547117 - DNA, 13 bp, D. melanogaster
aaacacttttact

SEQ ID NO: 547118 - DNA, 14 bp, D. melanogaster
aaacacttttactg

SEQ ID NO: 547119 - DNA, 13 bp, D. melanogaster
aaacacttttcaa

SEQ ID NO: 547120 - DNA, 13 bp, D. melanogaster
aaacacttttcat

SEQ ID NO: 547121 - DNA, 13 bp, D. melanogaster
aaacacttttcca

SEQ ID NO: 547122 - DNA, 13 bp, D. melanogaster
aaacacttttcga

SEQ ID NO: 547123 - DNA, 13 bp, D. melanogaster
aaacacttttctt

SEQ ID NO: 547124 - DNA, 13 bp, D. melanogaster
aaacactttttaa

SEQ ID NO: 547125 - DNA, 14 bp, D. melanogaster
aaacactttttgaa

SEQ ID NO: 547126 - DNA, 13 bp, D. melanogaster
aaacagaaaactg

SEQ ID NO: 547127 - DNA, 13 bp, D. melanogaster
aaacagaaaattc

SEQ ID NO: 547128 - DNA, 14 bp, D. melanogaster
aaacagaaaattct

SEQ ID NO: 547129 - DNA, 16 bp, D. melanogaster
aaacagaaacaggcag

SEQ ID NO: 547130 - DNA, 13 bp, D. melanogaster
aaacagaaaccat

SEQ ID NO: 547131 - DNA, 13 bp, D. melanogaster
aaacagaaacttt

SEQ ID NO: 547132 - DNA, 13 bp, D. melanogaster
aaacagaaatatt

SEQ ID NO: 547133 - DNA, 14 bp, D. melanogaster
aaacagaaatattt

SEQ ID NO: 547134 - DNA, 14 bp, D. melanogaster
aaacagaaatcgaa

SEQ ID NO: 547135 - DNA, 13 bp, D. melanogaster
aaacagaaatgca

SEQ ID NO: 547136 - DNA, 13 bp, D. melanogaster
aaacagaaatgga

SEQ ID NO: 547137 - DNA, 13 bp, D. melanogaster
aaacagaaatgtg

SEQ ID NO: 547138 - DNA, 13 bp, D. melanogaster
aaacagaaattat

SEQ ID NO: 547139 - DNA, 13 bp, D. melanogaster
aaacagaaattga

SEQ ID NO: 547140 - DNA, 13 bp, D. melanogaster
aaacagaaattgc

SEQ ID NO: 547141 - DNA, 13 bp, D. melanogaster
aaacagaacatag

SEQ ID NO: 547142 - DNA, 13 bp, D. melanogaster
aaacagaactgaa

SEQ ID NO: 547143 - DNA, 13 bp, D. melanogaster
aaacagaactttt

SEQ ID NO: 547144 - DNA, 13 bp, D. melanogaster
aaacagaagcaat

SEQ ID NO: 547145 - DNA, 14 bp, D. melanogaster
aaacagaagcagac

SEQ ID NO: 547146 - DNA, 13 bp, D. melanogaster
aaacagaataatt

SEQ ID NO: 547147 - DNA, 14 bp, D. melanogaster
aaacagaattaatg

SEQ ID NO: 547148 - DNA, 13 bp, D. melanogaster
aaacagaattttc

SEQ ID NO: 547149 - DNA, 13 bp, D. melanogaster
aaacagacgcaca

SEQ ID NO: 547150 - DNA, 13 bp, D. melanogaster
aaacagaggacga

SEQ ID NO: 547151 - DNA, 13 bp, D. melanogaster
aaacagaggcact

SEQ ID NO: 547152 - DNA, 13 bp, D. melanogaster
aaacagaggtaat

SEQ ID NO: 547153 - DNA, 13 bp, D. melanogaster
aaacagatatata

SEQ ID NO: 547154 - DNA, 13 bp, D. melanogaster
aaacagatcaaca

SEQ ID NO: 547155 - DNA, 13 bp, D. melanogaster
aaacagatgtcat

SEQ ID NO: 547156 - DNA, 13 bp, D. melanogaster
aaacagatttaaa

SEQ ID NO: 547157 - DNA, 13 bp, D. melanogaster
aaacagcaaaagt

SEQ ID NO: 547158 - DNA, 13 bp, D. melanogaster
aaacagcaaactg

SEQ ID NO: 547159 - DNA, 13 bp, D. melanogaster
aaacagcaaatca

SEQ ID NO: 547160 - DNA, 14 bp, D. melanogaster
aaacagcaacaata

SEQ ID NO: 547161 - DNA, 13 bp, D. melanogaster
aaacagcaacagc

SEQ ID NO: 547162 - DNA, 13 bp, D. melanogaster
aaacagcaactaa

SEQ ID NO: 547163 - DNA, 13 bp, D. melanogaster
aaacagcaactgc

SEQ ID NO: 547164 - DNA, 14 bp, D. melanogaster
aaacagcaactgca

SEQ ID NO: 547165 - DNA, 13 bp, D. melanogaster
aaacagcaagtgc

SEQ ID NO: 547166 - DNA, 13 bp, D. melanogaster
aaacagcaataat

SEQ ID NO: 547167 - DNA, 13 bp, D. melanogaster
aaacagcaatcaa

SEQ ID NO: 547168 - DNA, 13 bp, D. melanogaster
aaacagcaatttt

SEQ ID NO: 547169 - DNA, 13 bp, D. melanogaster
aaacagcagagca

SEQ ID NO: 547170 - DNA, 13 bp, D. melanogaster
aaacagcagcaac

SEQ ID NO: 547171 - DNA, 13 bp, D. melanogaster
aaacagcagcaca

SEQ ID NO: 547172 - DNA, 13 bp, D. melanogaster
aaacagcagcaga

SEQ ID NO: 547173 - DNA, 15 bp, D. melanogaster
aaacagcagcagcag

SEQ ID NO: 547174 - DNA, 13 bp, D. melanogaster
aaacagcagccaa

SEQ ID NO: 547175 - DNA, 13 bp, D. melanogaster
aaacagcagccac

SEQ ID NO: 547176 - DNA, 13 bp, D. melanogaster
aaacagcagccca

SEQ ID NO: 547177 - DNA, 13 bp, D. melanogaster
aaacagcagcgaa

SEQ ID NO: 547178 - DNA, 13 bp, D. melanogaster
aaacagcagcgga

SEQ ID NO: 547179 - DNA, 14 bp, D. melanogaster
aaacagcagctaca

SEQ ID NO: 547180 - DNA, 13 bp, D. melanogaster
aaacagcagctgc

SEQ ID NO: 547181 - DNA, 13 bp, D. melanogaster
aaacagcagctgt

SEQ ID NO: 547182 - DNA, 13 bp, D. melanogaster
aaacagcagttaa

SEQ ID NO: 547183 - DNA, 13 bp, D. melanogaster
aaacagcatttaa

SEQ ID NO: 547184 - DNA, 13 bp, D. melanogaster
aaacagcatttgc

SEQ ID NO: 547185 - DNA, 13 bp, D. melanogaster
aaacagcatttta

SEQ ID NO: 547186 - DNA, 13 bp, D. melanogaster
aaacagccaaaat

SEQ ID NO: 547187 - DNA, 13 bp, D. melanogaster
aaacagcgacaac

SEQ ID NO: 547188 - DNA, 13 bp, D. melanogaster
aaacagcgaggaa

SEQ ID NO: 547189 - DNA, 13 bp, D. melanogaster
aaacagctgaaaa

SEQ ID NO: 547190 - DNA, 13 bp, D. melanogaster
aaacagctgattg

SEQ ID NO: 547191 - DNA, 13 bp, D. melanogaster
aaacagctgccaa

SEQ ID NO: 547192 - DNA, 13 bp, D. melanogaster
aaacagctggaaa

SEQ ID NO: 547193 - DNA, 13 bp, D. melanogaster
aaacagctgttcg

SEQ ID NO: 547194 - DNA, 13 bp, D. melanogaster
aaacagctgttgt

SEQ ID NO: 547195 - DNA, 13 bp, D. melanogaster
aaacagctgtttg

SEQ ID NO: 547196 - DNA, 13 bp, D. melanogaster
aaacagctttaaa

SEQ ID NO: 547197 - DNA, 13 bp, D. melanogaster
aaacagctttcaa

SEQ ID NO: 547198 - DNA, 13 bp, D. melanogaster
aaacagctttgaa

SEQ ID NO: 547199 - DNA, 13 bp, D. melanogaster
aaacaggaaaact

SEQ ID NO: 547200 - DNA, 13 bp, D. melanogaster
aaacaggaaaatg

SEQ ID NO: 547201 - DNA, 13 bp, D. melanogaster
aaacaggaaaatt

SEQ ID NO: 547202 - DNA, 14 bp, D. melanogaster
aaacaggaaaattc

SEQ ID NO: 547203 - DNA, 13 bp, D. melanogaster
aaacaggacgaag

SEQ ID NO: 547204 - DNA, 13 bp, D. melanogaster
aaacaggagcagc

SEQ ID NO: 547205 - DNA, 14 bp, D. melanogaster
aaacaggagcagca

SEQ ID NO: 547206 - DNA, 13 bp, D. melanogaster
aaacaggagcagg

SEQ ID NO: 547207 - DNA, 14 bp, D. melanogaster
aaacaggagcagga

SEQ ID NO: 547208 - DNA, 13 bp, D. melanogaster
aaacaggcaaata

SEQ ID NO: 547209 - DNA, 13 bp, D. melanogaster
aaacaggcagcag

SEQ ID NO: 547210 - DNA, 13 bp, D. melanogaster
aaacaggcaggct

SEQ ID NO: 547211 - DNA, 13 bp, D. melanogaster
aaacaggctgctc

SEQ ID NO: 547212 - DNA, 13 bp, D. melanogaster
aaacagggaaaat

SEQ ID NO: 547213 - DNA, 13 bp, D. melanogaster
aaacagggaaatg

SEQ ID NO: 547214 - DNA, 13 bp, D. melanogaster
aaacaggtgatcc

SEQ ID NO: 547215 - DNA, 13 bp, D. melanogaster
aaacagtataaat

SEQ ID NO: 547216 - DNA, 13 bp, D. melanogaster
aaacagtatgttt

SEQ ID NO: 547217 - DNA, 13 bp, D. melanogaster
aaacagtcaaatg

SEQ ID NO: 547218 - DNA, 13 bp, D. melanogaster
aaacagtggaaaa

SEQ ID NO: 547219 - DNA, 13 bp, D. melanogaster
aaacagtgtcaaa

SEQ ID NO: 547220 - DNA, 14 bp, D. melanogaster
aaacagtgtcaaat

SEQ ID NO: 547221 - DNA, 13 bp, D. melanogaster
aaacagtgtcctt

SEQ ID NO: 547222 - DNA, 13 bp, D. melanogaster
aaacagtgtttgt

SEQ ID NO: 547223 - DNA, 13 bp, D. melanogaster
aaacagttaaaag

SEQ ID NO: 547224 - DNA, 13 bp, D. melanogaster
aaacagttaacaa

SEQ ID NO: 547225 - DNA, 13 bp, D. melanogaster
aaacagttatttt

SEQ ID NO: 547226 - DNA, 13 bp, D. melanogaster
aaacagttcctgc

SEQ ID NO: 547227 - DNA, 13 bp, D. melanogaster
aaacagttcttca

SEQ ID NO: 547228 - DNA, 13 bp, D. melanogaster
aaacagttgaaaa

SEQ ID NO: 547229 - DNA, 13 bp, D. melanogaster
aaacagttgcaaa

SEQ ID NO: 547230 - DNA, 13 bp, D. melanogaster
aaacagttgcaca

SEQ ID NO: 547231 - DNA, 13 bp, D. melanogaster
aaacagttgctga

SEQ ID NO: 547232 - DNA, 13 bp, D. melanogaster
aaacagttggaaa

SEQ ID NO: 547233 - DNA, 13 bp, D. melanogaster
aaacagttggcaa

SEQ ID NO: 547234 - DNA, 13 bp, D. melanogaster
aaacagttggcca

SEQ ID NO: 547235 - DNA, 14 bp, D. melanogaster
aaacagttgttatt

SEQ ID NO: 547236 - DNA, 13 bp, D. melanogaster
aaacagtttaaaa

SEQ ID NO: 547237 - DNA, 13 bp, D. melanogaster
aaacagtttaaat

SEQ ID NO: 547238 - DNA, 13 bp, D. melanogaster
aaacagtttaatt

SEQ ID NO: 547239 - DNA, 13 bp, D. melanogaster
aaacagtttattt

SEQ ID NO: 547240 - DNA, 13 bp, D. melanogaster
aaacagtttcagt

SEQ ID NO: 547241 - DNA, 14 bp, D. melanogaster
aaacagtttcagta

SEQ ID NO: 547242 - DNA, 13 bp, D. melanogaster
aaacagtttcttg

SEQ ID NO: 547243 - DNA, 13 bp, D. melanogaster
aaacagtttgttt

SEQ ID NO: 547244 - DNA, 13 bp, D. melanogaster
aaacagttttaaa

SEQ ID NO: 547245 - DNA, 13 bp, D. melanogaster
aaacagttttcaa

SEQ ID NO: 547246 - DNA, 14 bp, D. melanogaster
aaacagttttgaaa

SEQ ID NO: 547247 - DNA, 13 bp, D. melanogaster
aaacagttttgca

SEQ ID NO: 547248 - DNA, 13 bp, D. melanogaster
aaacataaacttg

SEQ ID NO: 547249 - DNA, 13 bp, D. melanogaster
aaacataaatcag

SEQ ID NO: 547250 - DNA, 13 bp, D. melanogaster
aaacataaatgca

SEQ ID NO: 547251 - DNA, 13 bp, D. melanogaster
aaacataagttta

SEQ ID NO: 547252 - DNA, 13 bp, D. melanogaster
aaacataagtttt

SEQ ID NO: 547253 - DNA, 13 bp, D. melanogaster
aaacataattatg

SEQ ID NO: 547254 - DNA, 13 bp, D. melanogaster
aaacataatttgt

SEQ ID NO: 547255 - DNA, 13 bp, D. melanogaster
aaacatacaattt

SEQ ID NO: 547256 - DNA, 13 bp, D. melanogaster
aaacatacacaga

SEQ ID NO: 547257 - DNA, 13 bp, D. melanogaster
aaacatacatttt

SEQ ID NO: 547258 - DNA, 13 bp, D. melanogaster
aaacatactcact

SEQ ID NO: 547259 - DNA, 13 bp, D. melanogaster
aaacatactgcaa

SEQ ID NO: 547260 - DNA, 13 bp, D. melanogaster
aaacatactgttt

SEQ ID NO: 547261 - DNA, 13 bp, D. melanogaster
aaacatagataca

SEQ ID NO: 547262 - DNA, 13 bp, D. melanogaster
aaacatagatata

SEQ ID NO: 547263 - DNA, 14 bp, D. melanogaster
aaacatagcaacaa

SEQ ID NO: 547264 - DNA, 13 bp, D. melanogaster
aaacatatagtat

SEQ ID NO: 547265 - DNA, 13 bp, D. melanogaster
aaacatatatatg

SEQ ID NO: 547266 - DNA, 13 bp, D. melanogaster
aaacatatatgaa

SEQ ID NO: 547267 - DNA, 13 bp, D. melanogaster
aaacatatatgta

SEQ ID NO: 547268 - DNA, 14 bp, D. melanogaster
aaacatatatgtac

SEQ ID NO: 547269 - DNA, 14 bp, D. melanogaster
aaacatatatgtat

SEQ ID NO: 547270 - DNA, 13 bp, D. melanogaster
aaacatatatgtg

SEQ ID NO: 547271 - DNA, 13 bp, D. melanogaster
aaacatatgaata

SEQ ID NO: 547272 - DNA, 13 bp, D. melanogaster
aaacatatgcaaa

SEQ ID NO: 547273 - DNA, 13 bp, D. melanogaster
aaacatatgtata

SEQ ID NO: 547274 - DNA, 13 bp, D. melanogaster
aaacatatgtatg

SEQ ID NO: 547275 - DNA, 13 bp, D. melanogaster
aaacatatgtatt

SEQ ID NO: 547276 - DNA, 13 bp, D. melanogaster
aaacatatgtttt

SEQ ID NO: 547277 - DNA, 13 bp, D. melanogaster
aaacatattctat

SEQ ID NO: 547278 - DNA, 13 bp, D. melanogaster
aaacatattctca

SEQ ID NO: 547279 - DNA, 13 bp, D. melanogaster
aaacatattcttt

SEQ ID NO: 547280 - DNA, 13 bp, D. melanogaster
aaacatattgaaa

SEQ ID NO: 547281 - DNA, 14 bp, D. melanogaster
aaacatattgaaaa

SEQ ID NO: 547282 - DNA, 13 bp, D. melanogaster
aaacatattgcaa

SEQ ID NO: 547283 - DNA, 13 bp, D. melanogaster
aaacatattgtaa

SEQ ID NO: 547284 - DNA, 15 bp, D. melanogaster
aaacatattgtaaga

SEQ ID NO: 547285 - DNA, 13 bp, D. melanogaster
aaacatatttaag

SEQ ID NO: 547286 - DNA, 14 bp, D. melanogaster
aaacatatttacac

SEQ ID NO: 547287 - DNA, 13 bp, D. melanogaster
aaacatatttaga

SEQ ID NO: 547288 - DNA, 13 bp, D. melanogaster
aaacatatttatg

SEQ ID NO: 547289 - DNA, 13 bp, D. melanogaster
aaacatatttcaa

SEQ ID NO: 547290 - DNA, 13 bp, D. melanogaster
aaacatatttcat

SEQ ID NO: 547291 - DNA, 14 bp, D. melanogaster
aaacatatttcatt

SEQ ID NO: 547292 - DNA, 13 bp, D. melanogaster
aaacatatttcca

SEQ ID NO: 547293 - DNA, 13 bp, D. melanogaster
aaacatatttgaa

SEQ ID NO: 547294 - DNA, 13 bp, D. melanogaster
aaacatatttgca

SEQ ID NO: 547295 - DNA, 13 bp, D. melanogaster
aaacatattttca

SEQ ID NO: 547296 - DNA, 13 bp, D. melanogaster
aaacatattttcg

SEQ ID NO: 547297 - DNA, 14 bp, D. melanogaster
aaacatattttgta

SEQ ID NO: 547298 - DNA, 13 bp, D. melanogaster
aaacatcaatttg

SEQ ID NO: 547299 - DNA, 13 bp, D. melanogaster
aaacatcagcaaa

SEQ ID NO: 547300 - DNA, 13 bp, D. melanogaster
aaacatcagcagt

SEQ ID NO: 547301 - DNA, 13 bp, D. melanogaster
aaacatccaaaga

SEQ ID NO: 547302 - DNA, 13 bp, D. melanogaster
aaacatccaatta

SEQ ID NO: 547303 - DNA, 13 bp, D. melanogaster
aaacatccacttg

SEQ ID NO: 547304 - DNA, 13 bp, D. melanogaster
aaacatccgcagc

SEQ ID NO: 547305 - DNA, 13 bp, D. melanogaster
aaacatcctaaag

SEQ ID NO: 547306 - DNA, 13 bp, D. melanogaster
aaacatcgacgga

SEQ ID NO: 547307 - DNA, 13 bp, D. melanogaster
aaacatcgatgtt

SEQ ID NO: 547308 - DNA, 14 bp, D. melanogaster
aaacatcgatgttt

SEQ ID NO: 547309 - DNA, 13 bp, D. melanogaster
aaacatctcatta

SEQ ID NO: 547310 - DNA, 13 bp, D. melanogaster
aaacatcttaaac

SEQ ID NO: 547311 - DNA, 13 bp, D. melanogaster
aaacatcttaaat

SEQ ID NO: 547312 - DNA, 13 bp, D. melanogaster
aaacatctttaaa

SEQ ID NO: 547313 - DNA, 13 bp, D. melanogaster
aaacatgaaattt

SEQ ID NO: 547314 - DNA, 13 bp, D. melanogaster
aaacatgaatttt

SEQ ID NO: 547315 - DNA, 13 bp, D. melanogaster
aaacatgattttt

SEQ ID NO: 547316 - DNA, 13 bp, D. melanogaster
aaacatgcaacaa

SEQ ID NO: 547317 - DNA, 13 bp, D. melanogaster
aaacatgcacaca

SEQ ID NO: 547318 - DNA, 13 bp, D. melanogaster
aaacatggccaga

SEQ ID NO: 547319 - DNA, 13 bp, D. melanogaster
aaacatggcgaaa

SEQ ID NO: 547320 - DNA, 13 bp, D. melanogaster
aaacatggtcaag

SEQ ID NO: 547321 - DNA, 13 bp, D. melanogaster
aaacatgtaaata

SEQ ID NO: 547322 - DNA, 13 bp, D. melanogaster
aaacatgtattta

SEQ ID NO: 547323 - DNA, 13 bp, D. melanogaster
aaacatgtgtaaa

SEQ ID NO: 547324 - DNA, 13 bp, D. melanogaster
aaacatgttccta

SEQ ID NO: 547325 - DNA, 13 bp, D. melanogaster
aaacatgttgcaa

SEQ ID NO: 547326 - DNA, 13 bp, D. melanogaster
aaacatgtttaaa

SEQ ID NO: 547327 - DNA, 13 bp, D. melanogaster
aaacatgttttaa

SEQ ID NO: 547328 - DNA, 13 bp, D. melanogaster
aaacatgttttat

SEQ ID NO: 547329 - DNA, 13 bp, D. melanogaster
aaacatgttttga

SEQ ID NO: 547330 - DNA, 13 bp, D. melanogaster
aaacatgtttttc

SEQ ID NO: 547331 - DNA, 13 bp, D. melanogaster
aaacatgtttttg

SEQ ID NO: 547332 - DNA, 13 bp, D. melanogaster
aaacattaaaagg

SEQ ID NO: 547333 - DNA, 13 bp, D. melanogaster
aaacattaaactt

SEQ ID NO: 547334 - DNA, 13 bp, D. melanogaster
aaacattaaatga

SEQ ID NO: 547335 - DNA, 13 bp, D. melanogaster
aaacattaaattg

SEQ ID NO: 547336 - DNA, 13 bp, D. melanogaster
aaacattaacatc

SEQ ID NO: 547337 - DNA, 13 bp, D. melanogaster
aaacattaatttc

SEQ ID NO: 547338 - DNA, 13 bp, D. melanogaster
aaacattacttgt

SEQ ID NO: 547339 - DNA, 13 bp, D. melanogaster
aaacattagaaat

SEQ ID NO: 547340 - DNA, 13 bp, D. melanogaster
aaacattatgcaa

SEQ ID NO: 547341 - DNA, 13 bp, D. melanogaster
aaacattcaaagt

SEQ ID NO: 547342 - DNA, 13 bp, D. melanogaster
aaacattcataca

SEQ ID NO: 547343 - DNA, 13 bp, D. melanogaster
aaacattcccaaa

SEQ ID NO: 547344 - DNA, 13 bp, D. melanogaster
aaacattcgattt

SEQ ID NO: 547345 - DNA, 13 bp, D. melanogaster
aaacattcgcatt

SEQ ID NO: 547346 - DNA, 13 bp, D. melanogaster
aaacattctaaat

SEQ ID NO: 547347 - DNA, 13 bp, D. melanogaster
aaacattgaaaac

SEQ ID NO: 547348 - DNA, 13 bp, D. melanogaster
aaacattgaaatc

SEQ ID NO: 547349 - DNA, 13 bp, D. melanogaster
aaacattgaaatt

SEQ ID NO: 547350 - DNA, 13 bp, D. melanogaster
aaacattgaataa

SEQ ID NO: 547351 - DNA, 13 bp, D. melanogaster
aaacattgacatt

SEQ ID NO: 547352 - DNA, 13 bp, D. melanogaster
aaacattgagaaa

SEQ ID NO: 547353 - DNA, 13 bp, D. melanogaster
aaacattgatatt

SEQ ID NO: 547354 - DNA, 13 bp, D. melanogaster
aaacattgcaatt

SEQ ID NO: 547355 - DNA, 13 bp, D. melanogaster
aaacattggaaaa

SEQ ID NO: 547356 - DNA, 13 bp, D. melanogaster
aaacattggcaaa

SEQ ID NO: 547357 - DNA, 13 bp, D. melanogaster
aaacattggccaa

SEQ ID NO: 547358 - DNA, 13 bp, D. melanogaster
aaacattgtagac

SEQ ID NO: 547359 - DNA, 13 bp, D. melanogaster
aaacatttaaaag

SEQ ID NO: 547360 - DNA, 13 bp, D. melanogaster
aaacatttaaact

SEQ ID NO: 547361 - DNA, 13 bp, D. melanogaster
aaacatttaaatg

SEQ ID NO: 547362 - DNA, 14 bp, D. melanogaster
aaacatttaaatgt

SEQ ID NO: 547363 - DNA, 13 bp, D. melanogaster
aaacatttaacga

SEQ ID NO: 547364 - DNA, 13 bp, D. melanogaster
aaacatttaactg

SEQ ID NO: 547365 - DNA, 13 bp, D. melanogaster
aaacatttaagtt

SEQ ID NO: 547366 - DNA, 14 bp, D. melanogaster
aaacatttaagttt

SEQ ID NO: 547367 - DNA, 13 bp, D. melanogaster
aaacatttacaat

SEQ ID NO: 547368 - DNA, 14 bp, D. melanogaster
aaacatttacatat

SEQ ID NO: 547369 - DNA, 14 bp, D. melanogaster
aaacatttacattt

SEQ ID NO: 547370 - DNA, 13 bp, D. melanogaster
aaacatttacttt

SEQ ID NO: 547371 - DNA, 13 bp, D. melanogaster
aaacatttagcat

SEQ ID NO: 547372 - DNA, 13 bp, D. melanogaster
aaacatttagtat

SEQ ID NO: 547373 - DNA, 13 bp, D. melanogaster
aaacatttatctt

SEQ ID NO: 547374 - DNA, 13 bp, D. melanogaster
aaacatttattca

SEQ ID NO: 547375 - DNA, 13 bp, D. melanogaster
aaacatttattgc

SEQ ID NO: 547376 - DNA, 13 bp, D. melanogaster
aaacatttcaaat

SEQ ID NO: 547377 - DNA, 13 bp, D. melanogaster
aaacatttcaatg

SEQ ID NO: 547378 - DNA, 13 bp, D. melanogaster
aaacatttcaatt

SEQ ID NO: 547379 - DNA, 13 bp, D. melanogaster
aaacatttcacaa

SEQ ID NO: 547380 - DNA, 13 bp, D. melanogaster
aaacatttcactg

SEQ ID NO: 547381 - DNA, 14 bp, D. melanogaster
aaacatttcactgt

SEQ ID NO: 547382 - DNA, 13 bp, D. melanogaster
aaacatttcataa

SEQ ID NO: 547383 - DNA, 13 bp, D. melanogaster
aaacatttcattt

SEQ ID NO: 547384 - DNA, 13 bp, D. melanogaster
aaacatttccaaa

SEQ ID NO: 547385 - DNA, 13 bp, D. melanogaster
aaacatttccaat

SEQ ID NO: 547386 - DNA, 13 bp, D. melanogaster
aaacatttccatt

SEQ ID NO: 547387 - DNA, 13 bp, D. melanogaster
aaacatttcgagt

SEQ ID NO: 547388 - DNA, 13 bp, D. melanogaster
aaacatttcgcat

SEQ ID NO: 547389 - DNA, 13 bp, D. melanogaster
aaacatttcgttt

SEQ ID NO: 547390 - DNA, 13 bp, D. melanogaster
aaacatttctatt

SEQ ID NO: 547391 - DNA, 13 bp, D. melanogaster
aaacatttcttag

SEQ ID NO: 547392 - DNA, 13 bp, D. melanogaster
aaacatttgaaac

SEQ ID NO: 547393 - DNA, 13 bp, D. melanogaster
aaacatttgaatt

SEQ ID NO: 547394 - DNA, 14 bp, D. melanogaster
aaacatttgaattt

SEQ ID NO: 547395 - DNA, 13 bp, D. melanogaster
aaacatttgagag

SEQ ID NO: 547396 - DNA, 13 bp, D. melanogaster
aaacatttgattt

SEQ ID NO: 547397 - DNA, 13 bp, D. melanogaster
aaacatttgcaat

SEQ ID NO: 547398 - DNA, 13 bp, D. melanogaster
aaacatttgcaca

SEQ ID NO: 547399 - DNA, 13 bp, D. melanogaster
aaacatttgcagc

SEQ ID NO: 547400 - DNA, 13 bp, D. melanogaster
aaacatttgcata

SEQ ID NO: 547401 - DNA, 14 bp, D. melanogaster
aaacatttgcataa

SEQ ID NO: 547402 - DNA, 13 bp, D. melanogaster
aaacatttgcatt

SEQ ID NO: 547403 - DNA, 14 bp, D. melanogaster
aaacatttgcattt

SEQ ID NO: 547404 - DNA, 13 bp, D. melanogaster
aaacatttgccaa

SEQ ID NO: 547405 - DNA, 14 bp, D. melanogaster
aaacatttgccaaa

SEQ ID NO: 547406 - DNA, 13 bp, D. melanogaster
aaacatttgccac

SEQ ID NO: 547407 - DNA, 13 bp, D. melanogaster
aaacatttgcctt

SEQ ID NO: 547408 - DNA, 13 bp, D. melanogaster
aaacatttgcgca

SEQ ID NO: 547409 - DNA, 13 bp, D. melanogaster
aaacatttgctta

SEQ ID NO: 547410 - DNA, 13 bp, D. melanogaster
aaacatttgcttt

SEQ ID NO: 547411 - DNA, 13 bp, D. melanogaster
aaacatttggcaa

SEQ ID NO: 547412 - DNA, 13 bp, D. melanogaster
aaacatttggcca

SEQ ID NO: 547413 - DNA, 13 bp, D. melanogaster
aaacatttggttt

SEQ ID NO: 547414 - DNA, 13 bp, D. melanogaster
aaacatttgtgca

SEQ ID NO: 547415 - DNA, 13 bp, D. melanogaster
aaacatttgtgtt

SEQ ID NO: 547416 - DNA, 14 bp, D. melanogaster
aaacatttgttaaa

SEQ ID NO: 547417 - DNA, 13 bp, D. melanogaster
aaacatttgttca

SEQ ID NO: 547418 - DNA, 13 bp, D. melanogaster
aaacatttgttga

SEQ ID NO: 547419 - DNA, 13 bp, D. melanogaster
aaacatttgttgt

SEQ ID NO: 547420 - DNA, 13 bp, D. melanogaster
aaacatttgttta

SEQ ID NO: 547421 - DNA, 13 bp, D. melanogaster
aaacatttgtttt

SEQ ID NO: 547422 - DNA, 14 bp, D. melanogaster
aaacattttaaagt

SEQ ID NO: 547423 - DNA, 13 bp, D. melanogaster
aaacattttaaca

SEQ ID NO: 547424 - DNA, 13 bp, D. melanogaster
aaacattttaaga

SEQ ID NO: 547425 - DNA, 14 bp, D. melanogaster
aaacattttaattg

SEQ ID NO: 547426 - DNA, 13 bp, D. melanogaster
aaacattttacaa

SEQ ID NO: 547427 - DNA, 13 bp, D. melanogaster
aaacattttagtt

SEQ ID NO: 547428 - DNA, 13 bp, D. melanogaster
aaacattttattg

SEQ ID NO: 547429 - DNA, 13 bp, D. melanogaster
aaacattttcaat

SEQ ID NO: 547430 - DNA, 14 bp, D. melanogaster
aaacattttcaata

SEQ ID NO: 547431 - DNA, 14 bp, D. melanogaster
aaacattttccaaa

SEQ ID NO: 547432 - DNA, 13 bp, D. melanogaster
aaacattttccca

SEQ ID NO: 547433 - DNA, 13 bp, D. melanogaster
aaacattttcctg

SEQ ID NO: 547434 - DNA, 14 bp, D. melanogaster
aaacattttcgaaa

SEQ ID NO: 547435 - DNA, 13 bp, D. melanogaster
aaacattttcgcc

SEQ ID NO: 547436 - DNA, 13 bp, D. melanogaster
aaacattttcttg

SEQ ID NO: 547437 - DNA, 13 bp, D. melanogaster
aaacattttgaaa

SEQ ID NO: 547438 - DNA, 14 bp, D. melanogaster
aaacattttgaaaa

SEQ ID NO: 547439 - DNA, 13 bp, D. melanogaster
aaacattttgaat

SEQ ID NO: 547440 - DNA, 14 bp, D. melanogaster
aaacattttgaata

SEQ ID NO: 547441 - DNA, 14 bp, D. melanogaster
aaacattttgaatt

SEQ ID NO: 547442 - DNA, 13 bp, D. melanogaster
aaacattttgagg

SEQ ID NO: 547443 - DNA, 13 bp, D. melanogaster
aaacattttgagt

SEQ ID NO: 547444 - DNA, 13 bp, D. melanogaster
aaacattttgatt

SEQ ID NO: 547445 - DNA, 14 bp, D. melanogaster
aaacattttgatta

SEQ ID NO: 547446 - DNA, 13 bp, D. melanogaster
aaacattttgcca

SEQ ID NO: 547447 - DNA, 13 bp, D. melanogaster
aaacattttgcga

SEQ ID NO: 547448 - DNA, 13 bp, D. melanogaster
aaacattttgctt

SEQ ID NO: 547449 - DNA, 13 bp, D. melanogaster
aaacattttggca

SEQ ID NO: 547450 - DNA, 14 bp, D. melanogaster
aaacattttgtaaa

SEQ ID NO: 547451 - DNA, 13 bp, D. melanogaster
aaacattttgtat

SEQ ID NO: 547452 - DNA, 13 bp, D. melanogaster
aaacattttgttg

SEQ ID NO: 547453 - DNA, 13 bp, D. melanogaster
aaacattttgttt

SEQ ID NO: 547454 - DNA, 14 bp, D. melanogaster
aaacattttgtttt

SEQ ID NO: 547455 - DNA, 13 bp, D. melanogaster
aaacatttttaca

SEQ ID NO: 547456 - DNA, 14 bp, D. melanogaster
aaacatttttacag

SEQ ID NO: 547457 - DNA, 14 bp, D. melanogaster
aaacatttttcatt

SEQ ID NO: 547458 - DNA, 13 bp, D. melanogaster
aaacatttttctt

SEQ ID NO: 547459 - DNA, 13 bp, D. melanogaster
aaacatttttgaa

SEQ ID NO: 547460 - DNA, 14 bp, D. melanogaster
aaacatttttgaaa

SEQ ID NO: 547461 - DNA, 14 bp, D. melanogaster
aaacatttttgaat

SEQ ID NO: 547462 - DNA, 13 bp, D. melanogaster
aaacatttttgca

SEQ ID NO: 547463 - DNA, 14 bp, D. melanogaster
aaacatttttgcat

SEQ ID NO: 547464 - DNA, 14 bp, D. melanogaster
aaacatttttgtaa

SEQ ID NO: 547465 - DNA, 13 bp, D. melanogaster
aaacattttttct

SEQ ID NO: 547466 - DNA, 13 bp, D. melanogaster
aaacattttttgg

SEQ ID NO: 547467 - DNA, 14 bp, D. melanogaster
aaacattttttgtt

SEQ ID NO: 547468 - DNA, 13 bp, D. melanogaster
aaacatttttttg

SEQ ID NO: 547469 - DNA, 13 bp, D. melanogaster
aaaccaaaaactg

SEQ ID NO: 547470 - DNA, 13 bp, D. melanogaster
aaaccaaaaagtg

SEQ ID NO: 547471 - DNA, 13 bp, D. melanogaster
aaaccaaaactga

SEQ ID NO: 547472 - DNA, 14 bp, D. melanogaster
aaaccaaaactgaa

SEQ ID NO: 547473 - DNA, 13 bp, D. melanogaster
aaaccaaaagtca

SEQ ID NO: 547474 - DNA, 13 bp, D. melanogaster
aaaccaaaagttt

SEQ ID NO: 547475 - DNA, 13 bp, D. melanogaster
aaaccaaaatgta

SEQ ID NO: 547476 - DNA, 13 bp, D. melanogaster
aaaccaaaatgtg

SEQ ID NO: 547477 - DNA, 13 bp, D. melanogaster
aaaccaaacggag

SEQ ID NO: 547478 - DNA, 13 bp, D. melanogaster
aaaccaaactgaa

SEQ ID NO: 547479 - DNA, 14 bp, D. melanogaster
aaaccaaactgaac

SEQ ID NO: 547480 - DNA, 13 bp, D. melanogaster
aaaccaaactttt

SEQ ID NO: 547481 - DNA, 13 bp, D. melanogaster
aaaccaaagcaat

SEQ ID NO: 547482 - DNA, 13 bp, D. melanogaster
aaaccaaagccga

SEQ ID NO: 547483 - DNA, 13 bp, D. melanogaster
aaaccaaagtttt

SEQ ID NO: 547484 - DNA, 13 bp, D. melanogaster
aaaccaaatatgt

SEQ ID NO: 547485 - DNA, 14 bp, D. melanogaster
aaaccaaatcaaag

SEQ ID NO: 547486 - DNA, 13 bp, D. melanogaster
aaaccaaatcaga

SEQ ID NO: 547487 - DNA, 13 bp, D. melanogaster
aaaccaaatccga

SEQ ID NO: 547488 - DNA, 13 bp, D. melanogaster
aaaccaaatcgaa

SEQ ID NO: 547489 - DNA, 14 bp, D. melanogaster
aaaccaaatcgaaa

SEQ ID NO: 547490 - DNA, 13 bp, D. melanogaster
aaaccaaatcgat

SEQ ID NO: 547491 - DNA, 13 bp, D. melanogaster
aaaccaaatgaat

SEQ ID NO: 547492 - DNA, 14 bp, D. melanogaster
aaaccaaatgcaaa

SEQ ID NO: 547493 - DNA, 14 bp, D. melanogaster
aaaccaaatggaaa

SEQ ID NO: 547494 - DNA, 13 bp, D. melanogaster
aaaccaaattgaa

SEQ ID NO: 547495 - DNA, 13 bp, D. melanogaster
aaaccaaattgta

SEQ ID NO: 547496 - DNA, 13 bp, D. melanogaster
aaaccaaattgtt

SEQ ID NO: 547497 - DNA, 13 bp, D. melanogaster
aaaccaacaattt

SEQ ID NO: 547498 - DNA, 13 bp, D. melanogaster
aaaccaacccatt

SEQ ID NO: 547499 - DNA, 16 bp, D. melanogaster
aaaccaacccattttt

SEQ ID NO: 547500 - DNA, 13 bp, D. melanogaster
aaaccaactaatt

SEQ ID NO: 547501 - DNA, 13 bp, D. melanogaster
aaaccaactgaaa

SEQ ID NO: 547502 - DNA, 13 bp, D. melanogaster
aaaccaacttcaa

SEQ ID NO: 547503 - DNA, 13 bp, D. melanogaster
aaaccaagtcaaa

SEQ ID NO: 547504 - DNA, 13 bp, D. melanogaster
aaaccaataaagt

SEQ ID NO: 547505 - DNA, 13 bp, D. melanogaster
aaaccaatatatt

SEQ ID NO: 547506 - DNA, 14 bp, D. melanogaster
aaaccaatatggtt

SEQ ID NO: 547507 - DNA, 13 bp, D. melanogaster
aaaccaatccaat

SEQ ID NO: 547508 - DNA, 14 bp, D. melanogaster
aaaccaatccaatc

SEQ ID NO: 547509 - DNA, 13 bp, D. melanogaster
aaaccaatcgaaa

SEQ ID NO: 547510 - DNA, 13 bp, D. melanogaster
aaaccaatctgga

SEQ ID NO: 547511 - DNA, 13 bp, D. melanogaster
aaaccaatgccaa

SEQ ID NO: 547512 - DNA, 13 bp, D. melanogaster
aaaccaatggaaa

SEQ ID NO: 547513 - DNA, 13 bp, D. melanogaster
aaaccaatgtatg

SEQ ID NO: 547514 - DNA, 13 bp, D. melanogaster
aaaccaattaact

SEQ ID NO: 547515 - DNA, 13 bp, D. melanogaster
aaaccaattaagt

SEQ ID NO: 547516 - DNA, 13 bp, D. melanogaster
aaaccaattactt

SEQ ID NO: 547517 - DNA, 13 bp, D. melanogaster
aaaccaattcaat

SEQ ID NO: 547518 - DNA, 13 bp, D. melanogaster
aaaccaattcatt

SEQ ID NO: 547519 - DNA, 13 bp, D. melanogaster
aaaccaattcgaa

SEQ ID NO: 547520 - DNA, 13 bp, D. melanogaster
aaaccaattgaaa

SEQ ID NO: 547521 - DNA, 13 bp, D. melanogaster
aaaccaatttaag

SEQ ID NO: 547522 - DNA, 13 bp, D. melanogaster
aaaccaatttaat

SEQ ID NO: 547523 - DNA, 13 bp, D. melanogaster
aaaccaatttcaa

SEQ ID NO: 547524 - DNA, 14 bp, D. melanogaster
aaaccaatttcaat

SEQ ID NO: 547525 - DNA, 13 bp, D. melanogaster
aaaccaatttgaa

SEQ ID NO: 547526 - DNA, 13 bp, D. melanogaster
aaaccaatttgca

SEQ ID NO: 547527 - DNA, 13 bp, D. melanogaster
aaaccaatttgct

SEQ ID NO: 547528 - DNA, 13 bp, D. melanogaster
aaaccaatttgta

SEQ ID NO: 547529 - DNA, 13 bp, D. melanogaster
aaaccaattttga

SEQ ID NO: 547530 - DNA, 13 bp, D. melanogaster
aaaccaatttttg

SEQ ID NO: 547531 - DNA, 13 bp, D. melanogaster
aaaccacaaattt

SEQ ID NO: 547532 - DNA, 13 bp, D. melanogaster
aaaccacatattt

SEQ ID NO: 547533 - DNA, 13 bp, D. melanogaster
aaaccacattttt

SEQ ID NO: 547534 - DNA, 13 bp, D. melanogaster
aaaccactgattg

SEQ ID NO: 547535 - DNA, 13 bp, D. melanogaster
aaaccacttccga

SEQ ID NO: 547536 - DNA, 13 bp, D. melanogaster
aaaccacttggaa

SEQ ID NO: 547537 - DNA, 13 bp, D. melanogaster
aaaccagaaaatc

SEQ ID NO: 547538 - DNA, 13 bp, D. melanogaster
aaaccagaaatcg

SEQ ID NO: 547539 - DNA, 14 bp, D. melanogaster
aaaccagaaattca

SEQ ID NO: 547540 - DNA, 13 bp, D. melanogaster
aaaccagaaccag

SEQ ID NO: 547541 - DNA, 13 bp, D. melanogaster
aaaccagacactg

SEQ ID NO: 547542 - DNA, 13 bp, D. melanogaster
aaaccagaccaga

SEQ ID NO: 547543 - DNA, 13 bp, D. melanogaster
aaaccaggaaatt

SEQ ID NO: 547544 - DNA, 13 bp, D. melanogaster
aaaccagttgcca

SEQ ID NO: 547545 - DNA, 13 bp, D. melanogaster
aaaccagttttca

SEQ ID NO: 547546 - DNA, 13 bp, D. melanogaster
aaaccagttttcc

SEQ ID NO: 547547 - DNA, 13 bp, D. melanogaster
aaaccagttttga

SEQ ID NO: 547548 - DNA, 13 bp, D. melanogaster
aaaccataaaagt

SEQ ID NO: 547549 - DNA, 13 bp, D. melanogaster
aaaccataaagtt

SEQ ID NO: 547550 - DNA, 13 bp, D. melanogaster
aaaccataaattt

SEQ ID NO: 547551 - DNA, 13 bp, D. melanogaster
aaaccataactat

SEQ ID NO: 547552 - DNA, 13 bp, D. melanogaster
aaaccatagaaga

SEQ ID NO: 547553 - DNA, 13 bp, D. melanogaster
aaaccatatattt

SEQ ID NO: 547554 - DNA, 13 bp, D. melanogaster
aaaccatatcagc

SEQ ID NO: 547555 - DNA, 13 bp, D. melanogaster
aaaccatattttt

SEQ ID NO: 547556 - DNA, 13 bp, D. melanogaster
aaaccatcaacta

SEQ ID NO: 547557 - DNA, 13 bp, D. melanogaster
aaaccattaatta

SEQ ID NO: 547558 - DNA, 13 bp, D. melanogaster
aaaccattaattt

SEQ ID NO: 547559 - DNA, 13 bp, D. melanogaster
aaaccattgaaaa

SEQ ID NO: 547560 - DNA, 13 bp, D. melanogaster
aaaccattgaaat

SEQ ID NO: 547561 - DNA, 13 bp, D. melanogaster
aaaccatttaaat

SEQ ID NO: 547562 - DNA, 13 bp, D. melanogaster
aaaccatttaata

SEQ ID NO: 547563 - DNA, 13 bp, D. melanogaster
aaaccatttataa

SEQ ID NO: 547564 - DNA, 13 bp, D. melanogaster
aaaccatttatga

SEQ ID NO: 547565 - DNA, 13 bp, D. melanogaster
aaaccatttattt

SEQ ID NO: 547566 - DNA, 13 bp, D. melanogaster
aaaccatttcaaa

SEQ ID NO: 547567 - DNA, 13 bp, D. melanogaster
aaaccatttcaat

SEQ ID NO: 547568 - DNA, 13 bp, D. melanogaster
aaaccatttggaa

SEQ ID NO: 547569 - DNA, 13 bp, D. melanogaster
aaaccattttaaa

SEQ ID NO: 547570 - DNA, 13 bp, D. melanogaster
aaaccattttaat

SEQ ID NO: 547571 - DNA, 14 bp, D. melanogaster
aaaccattttaatt

SEQ ID NO: 547572 - DNA, 13 bp, D. melanogaster
aaaccattttatt

SEQ ID NO: 547573 - DNA, 13 bp, D. melanogaster
aaaccattttggc

SEQ ID NO: 547574 - DNA, 13 bp, D. melanogaster
aaaccatttttaa

SEQ ID NO: 547575 - DNA, 14 bp, D. melanogaster
aaaccatttttaaa

SEQ ID NO: 547576 - DNA, 13 bp, D. melanogaster
aaaccatttttcc

SEQ ID NO: 547577 - DNA, 13 bp, D. melanogaster
aaaccatttttta

SEQ ID NO: 547578 - DNA, 13 bp, D. melanogaster
aaaccattttttg

SEQ ID NO: 547579 - DNA, 13 bp, D. melanogaster
aaacccaaaactg

SEQ ID NO: 547580 - DNA, 13 bp, D. melanogaster
aaacccaaaatgg

SEQ ID NO: 547581 - DNA, 13 bp, D. melanogaster
aaacccaaagcga

SEQ ID NO: 547582 - DNA, 13 bp, D. melanogaster
aaacccaaatatt

SEQ ID NO: 547583 - DNA, 13 bp, D. melanogaster
aaacccaaatcgg

SEQ ID NO: 547584 - DNA, 14 bp, D. melanogaster
aaacccaaatcgga

SEQ ID NO: 547585 - DNA, 13 bp, D. melanogaster
aaacccaaatgaa

SEQ ID NO: 547586 - DNA, 13 bp, D. melanogaster
aaacccaaattat

SEQ ID NO: 547587 - DNA, 14 bp, D. melanogaster
aaacccaaattatt

SEQ ID NO: 547588 - DNA, 13 bp, D. melanogaster
aaacccaagccga

SEQ ID NO: 547589 - DNA, 13 bp, D. melanogaster
aaacccaatcgaa

SEQ ID NO: 547590 - DNA, 13 bp, D. melanogaster
aaacccaatgaaa

SEQ ID NO: 547591 - DNA, 13 bp, D. melanogaster
aaacccaatttgt

SEQ ID NO: 547592 - DNA, 13 bp, D. melanogaster
aaacccaattttc

SEQ ID NO: 547593 - DNA, 13 bp, D. melanogaster
aaacccatatata

SEQ ID NO: 547594 - DNA, 13 bp, D. melanogaster
aaacccatttaat

SEQ ID NO: 547595 - DNA, 13 bp, D. melanogaster
aaacccatttcat

SEQ ID NO: 547596 - DNA, 13 bp, D. melanogaster
aaacccatttcca

SEQ ID NO: 547597 - DNA, 13 bp, D. melanogaster
aaaccccagttca

SEQ ID NO: 547598 - DNA, 13 bp, D. melanogaster
aaaccccatttaa

SEQ ID NO: 547599 - DNA, 13 bp, D. melanogaster
aaaccccattttt

SEQ ID NO: 547600 - DNA, 13 bp, D. melanogaster
aaaccccttgaaa

SEQ ID NO: 547601 - DNA, 13 bp, D. melanogaster
aaaccctcaattt

SEQ ID NO: 547602 - DNA, 14 bp, D. melanogaster
aaaccctttttttt

SEQ ID NO: 547603 - DNA, 14 bp, D. melanogaster
aaaccgaaaaatca

SEQ ID NO: 547604 - DNA, 13 bp, D. melanogaster
aaaccgaaaaatt

SEQ ID NO: 547605 - DNA, 13 bp, D. melanogaster
aaaccgaaaaccg

SEQ ID NO: 547606 - DNA, 14 bp, D. melanogaster
aaaccgaaaactga

SEQ ID NO: 547607 - DNA, 13 bp, D. melanogaster
aaaccgaaaagta

SEQ ID NO: 547608 - DNA, 13 bp, D. melanogaster
aaaccgaaaatat

SEQ ID NO: 547609 - DNA, 13 bp, D. melanogaster
aaaccgaaaatca

SEQ ID NO: 547610 - DNA, 13 bp, D. melanogaster
aaaccgaaaatgg

SEQ ID NO: 547611 - DNA, 13 bp, D. melanogaster
aaaccgaaaattt

SEQ ID NO: 547612 - DNA, 13 bp, D. melanogaster
aaaccgaaaccag

SEQ ID NO: 547613 - DNA, 13 bp, D. melanogaster
aaaccgaaaccga

SEQ ID NO: 547614 - DNA, 14 bp, D. melanogaster
aaaccgaaaccgag

SEQ ID NO: 547615 - DNA, 13 bp, D. melanogaster
aaaccgaaacgca

SEQ ID NO: 547616 - DNA, 13 bp, D. melanogaster
aaaccgaaactga

SEQ ID NO: 547617 - DNA, 14 bp, D. melanogaster
aaaccgaaactgaa

SEQ ID NO: 547618 - DNA, 14 bp, D. melanogaster
aaaccgaaataaat

SEQ ID NO: 547619 - DNA, 13 bp, D. melanogaster
aaaccgaaataga

SEQ ID NO: 547620 - DNA, 14 bp, D. melanogaster
aaaccgaaatcgaa

SEQ ID NO: 547621 - DNA, 13 bp, D. melanogaster
aaaccgaaatgca

SEQ ID NO: 547622 - DNA, 13 bp, D. melanogaster
aaaccgaaatgga

SEQ ID NO: 547623 - DNA, 13 bp, D. melanogaster
aaaccgaaattaa

SEQ ID NO: 547624 - DNA, 13 bp, D. melanogaster
aaaccgaaattca

SEQ ID NO: 547625 - DNA, 13 bp, D. melanogaster
aaaccgaaattga

SEQ ID NO: 547626 - DNA, 14 bp, D. melanogaster
aaaccgaaattgaa

SEQ ID NO: 547627 - DNA, 13 bp, D. melanogaster
aaaccgaaattgt

SEQ ID NO: 547628 - DNA, 13 bp, D. melanogaster
aaaccgaaattta

SEQ ID NO: 547629 - DNA, 14 bp, D. melanogaster
aaaccgaaccgaac

SEQ ID NO: 547630 - DNA, 13 bp, D. melanogaster
aaaccgaactcaa

SEQ ID NO: 547631 - DNA, 13 bp, D. melanogaster
aaaccgaactgaa

SEQ ID NO: 547632 - DNA, 13 bp, D. melanogaster
aaaccgaagatat

SEQ ID NO: 547633 - DNA, 13 bp, D. melanogaster
aaaccgaagccaa

SEQ ID NO: 547634 - DNA, 13 bp, D. melanogaster
aaaccgaagcgaa

SEQ ID NO: 547635 - DNA, 13 bp, D. melanogaster
aaaccgaagtgaa

SEQ ID NO: 547636 - DNA, 13 bp, D. melanogaster
aaaccgaataaat

SEQ ID NO: 547637 - DNA, 13 bp, D. melanogaster
aaaccgaatcaaa

SEQ ID NO: 547638 - DNA, 13 bp, D. melanogaster
aaaccgaatccga

SEQ ID NO: 547639 - DNA, 14 bp, D. melanogaster
aaaccgaatccgaa

SEQ ID NO: 547640 - DNA, 13 bp, D. melanogaster
aaaccgaatcgaa

SEQ ID NO: 547641 - DNA, 13 bp, D. melanogaster
aaaccgaatgcaa

SEQ ID NO: 547642 - DNA, 13 bp, D. melanogaster
aaaccgaatttaa

SEQ ID NO: 547643 - DNA, 13 bp, D. melanogaster
aaaccgagctgaa

SEQ ID NO: 547644 - DNA, 14 bp, D. melanogaster
aaaccgatatgcta

SEQ ID NO: 547645 - DNA, 13 bp, D. melanogaster
aaaccgattaaaa

SEQ ID NO: 547646 - DNA, 13 bp, D. melanogaster
aaaccgcaaaatt

SEQ ID NO: 547647 - DNA, 14 bp, D. melanogaster
aaaccgcactgcaa

SEQ ID NO: 547648 - DNA, 13 bp, D. melanogaster
aaaccgcagcaaa

SEQ ID NO: 547649 - DNA, 14 bp, D. melanogaster
aaaccgccatcagc

SEQ ID NO: 547650 - DNA, 13 bp, D. melanogaster
aaaccggtaaatc

SEQ ID NO: 547651 - DNA, 14 bp, D. melanogaster
aaaccggtggcgtt

SEQ ID NO: 547652 - DNA, 13 bp, D. melanogaster
aaacctaaaagat

SEQ ID NO: 547653 - DNA, 13 bp, D. melanogaster
aaacctaatttat

SEQ ID NO: 547654 - DNA, 13 bp, D. melanogaster
aaacctatctgga

SEQ ID NO: 547655 - DNA, 13 bp, D. melanogaster
aaacctattttaa

SEQ ID NO: 547656 - DNA, 13 bp, D. melanogaster
aaacctccagcaa

SEQ ID NO: 547657 - DNA, 13 bp, D. melanogaster
aaacctgaaccca

SEQ ID NO: 547658 - DNA, 13 bp, D. melanogaster
aaacctgtttaaa

SEQ ID NO: 547659 - DNA, 13 bp, D. melanogaster
aaaccttaattaa

SEQ ID NO: 547660 - DNA, 13 bp, D. melanogaster
aaaccttattttt

SEQ ID NO: 547661 - DNA, 13 bp, D. melanogaster
aaacctttaacaa

SEQ ID NO: 547662 - DNA, 14 bp, D. melanogaster
aaacctttaacaaa

SEQ ID NO: 547663 - DNA, 13 bp, D. melanogaster
aaaccttttaaaa

SEQ ID NO: 547664 - DNA, 13 bp, D. melanogaster
aaaccttttattt

SEQ ID NO: 547665 - DNA, 13 bp, D. melanogaster
aaaccttttgaaa

SEQ ID NO: 547666 - DNA, 13 bp, D. melanogaster
aaacctttttaat

SEQ ID NO: 547667 - DNA, 13 bp, D. melanogaster
aaacctttttgtt

SEQ ID NO: 547668 - DNA, 13 bp, D. melanogaster
aaacgaaaaatgt

SEQ ID NO: 547669 - DNA, 13 bp, D. melanogaster
aaacgaaaaattc

SEQ ID NO: 547670 - DNA, 13 bp, D. melanogaster
aaacgaaaaattg

SEQ ID NO: 547671 - DNA, 13 bp, D. melanogaster
aaacgaaaaattt

SEQ ID NO: 547672 - DNA, 13 bp, D. melanogaster
aaacgaaaacatt

SEQ ID NO: 547673 - DNA, 13 bp, D. melanogaster
aaacgaaaacgat

SEQ ID NO: 547674 - DNA, 13 bp, D. melanogaster
aaacgaaaacgta

SEQ ID NO: 547675 - DNA, 14 bp, D. melanogaster
aaacgaaaactttt

SEQ ID NO: 547676 - DNA, 13 bp, D. melanogaster
aaacgaaaagtgt

SEQ ID NO: 547677 - DNA, 13 bp, D. melanogaster
aaacgaaaagtta

SEQ ID NO: 547678 - DNA, 13 bp, D. melanogaster
aaacgaaaagttt

SEQ ID NO: 547679 - DNA, 13 bp, D. melanogaster
aaacgaaaatatt

SEQ ID NO: 547680 - DNA, 13 bp, D. melanogaster
aaacgaaaatcga

SEQ ID NO: 547681 - DNA, 13 bp, D. melanogaster
aaacgaaaatgca

SEQ ID NO: 547682 - DNA, 13 bp, D. melanogaster
aaacgaaaatgga

SEQ ID NO: 547683 - DNA, 14 bp, D. melanogaster
aaacgaaaatggaa

SEQ ID NO: 547684 - DNA, 13 bp, D. melanogaster
aaacgaaaatgtt

SEQ ID NO: 547685 - DNA, 14 bp, D. melanogaster
aaacgaaaattatt

SEQ ID NO: 547686 - DNA, 13 bp, D. melanogaster
aaacgaaaattct

SEQ ID NO: 547687 - DNA, 13 bp, D. melanogaster
aaacgaaaatttt

SEQ ID NO: 547688 - DNA, 14 bp, D. melanogaster
aaacgaaaattttc

SEQ ID NO: 547689 - DNA, 13 bp, D. melanogaster
aaacgaaacattt

SEQ ID NO: 547690 - DNA, 13 bp, D. melanogaster
aaacgaaaccatt

SEQ ID NO: 547691 - DNA, 13 bp, D. melanogaster
aaacgaaacgaat

SEQ ID NO: 547692 - DNA, 13 bp, D. melanogaster
aaacgaaacgagc

SEQ ID NO: 547693 - DNA, 13 bp, D. melanogaster
aaacgaaacgata

SEQ ID NO: 547694 - DNA, 13 bp, D. melanogaster
aaacgaaacgggt

SEQ ID NO: 547695 - DNA, 13 bp, D. melanogaster
aaacgaaacgtaa

SEQ ID NO: 547696 - DNA, 13 bp, D. melanogaster
aaacgaaactaat

SEQ ID NO: 547697 - DNA, 13 bp, D. melanogaster
aaacgaaactgaa

SEQ ID NO: 547698 - DNA, 14 bp, D. melanogaster
aaacgaaactgaaa

SEQ ID NO: 547699 - DNA, 13 bp, D. melanogaster
aaacgaaactttt

SEQ ID NO: 547700 - DNA, 13 bp, D. melanogaster
aaacgaaagactc

SEQ ID NO: 547701 - DNA, 13 bp, D. melanogaster
aaacgaaagactt

SEQ ID NO: 547702 - DNA, 13 bp, D. melanogaster
aaacgaaaggatt

SEQ ID NO: 547703 - DNA, 13 bp, D. melanogaster
aaacgaaagtcaa

SEQ ID NO: 547704 - DNA, 13 bp, D. melanogaster
aaacgaaagtgct

SEQ ID NO: 547705 - DNA, 13 bp, D. melanogaster
aaacgaaagtgga

SEQ ID NO: 547706 - DNA, 13 bp, D. melanogaster
aaacgaaagtgtt

SEQ ID NO: 547707 - DNA, 13 bp, D. melanogaster
aaacgaaataatt

SEQ ID NO: 547708 - DNA, 13 bp, D. melanogaster
aaacgaaatcaat

SEQ ID NO: 547709 - DNA, 13 bp, D. melanogaster
aaacgaaatcatt

SEQ ID NO: 547710 - DNA, 13 bp, D. melanogaster
aaacgaaatcgaa

SEQ ID NO: 547711 - DNA, 14 bp, D. melanogaster
aaacgaaatcgaaa

SEQ ID NO: 547712 - DNA, 14 bp, D. melanogaster
aaacgaaatgaaac

SEQ ID NO: 547713 - DNA, 14 bp, D. melanogaster
aaacgaaatgaaag

SEQ ID NO: 547714 - DNA, 14 bp, D. melanogaster
aaacgaaatgaaat

SEQ ID NO: 547715 - DNA, 13 bp, D. melanogaster
aaacgaaatgatt

SEQ ID NO: 547716 - DNA, 13 bp, D. melanogaster
aaacgaaatgcaa

SEQ ID NO: 547717 - DNA, 13 bp, D. melanogaster
aaacgaaatgcat

SEQ ID NO: 547718 - DNA, 13 bp, D. melanogaster
aaacgaaatgcga

SEQ ID NO: 547719 - DNA, 13 bp, D. melanogaster
aaacgaaatgctc

SEQ ID NO: 547720 - DNA, 13 bp, D. melanogaster
aaacgaaatggaa

SEQ ID NO: 547721 - DNA, 14 bp, D. melanogaster
aaacgaaatggaat

SEQ ID NO: 547722 - DNA, 13 bp, D. melanogaster
aaacgaaatgtaa

SEQ ID NO: 547723 - DNA, 13 bp, D. melanogaster
aaacgaaattatt

SEQ ID NO: 547724 - DNA, 14 bp, D. melanogaster
aaacgaaattattt

SEQ ID NO: 547725 - DNA, 13 bp, D. melanogaster
aaacgaaattcaa

SEQ ID NO: 547726 - DNA, 13 bp, D. melanogaster
aaacgaaattcat

SEQ ID NO: 547727 - DNA, 13 bp, D. melanogaster
aaacgaaattgaa

SEQ ID NO: 547728 - DNA, 14 bp, D. melanogaster
aaacgaaattgaaa

SEQ ID NO: 547729 - DNA, 13 bp, D. melanogaster
aaacgaaattgat

SEQ ID NO: 547730 - DNA, 13 bp, D. melanogaster
aaacgaaattgtt

SEQ ID NO: 547731 - DNA, 13 bp, D. melanogaster
aaacgaaatttaa

SEQ ID NO: 547732 - DNA, 13 bp, D. melanogaster
aaacgaaattttt

SEQ ID NO: 547733 - DNA, 13 bp, D. melanogaster
aaacgaacatttt

SEQ ID NO: 547734 - DNA, 13 bp, D. melanogaster
aaacgaacgaacg

SEQ ID NO: 547735 - DNA, 14 bp, D. melanogaster
aaacgaacgaacga

SEQ ID NO: 547736 - DNA, 13 bp, D. melanogaster
aaacgaactgaaa

SEQ ID NO: 547737 - DNA, 13 bp, D. melanogaster
aaacgaacttcaa

SEQ ID NO: 547738 - DNA, 14 bp, D. melanogaster
aaacgaactttttt

SEQ ID NO: 547739 - DNA, 13 bp, D. melanogaster
aaacgaagtgaaa

SEQ ID NO: 547740 - DNA, 13 bp, D. melanogaster
aaacgaatcattt

SEQ ID NO: 547741 - DNA, 14 bp, D. melanogaster
aaacgaatcgaaaa

SEQ ID NO: 547742 - DNA, 14 bp, D. melanogaster
aaacgaatcgaaac

SEQ ID NO: 547743 - DNA, 13 bp, D. melanogaster
aaacgaatgctgc

SEQ ID NO: 547744 - DNA, 13 bp, D. melanogaster
aaacgaatggaaa

SEQ ID NO: 547745 - DNA, 13 bp, D. melanogaster
aaacgaattaaat

SEQ ID NO: 547746 - DNA, 13 bp, D. melanogaster
aaacgaattattt

SEQ ID NO: 547747 - DNA, 13 bp, D. melanogaster
aaacgaattcgaa

SEQ ID NO: 547748 - DNA, 13 bp, D. melanogaster
aaacgaattgaaa

SEQ ID NO: 547749 - DNA, 14 bp, D. melanogaster
aaacgaattgaaaa

SEQ ID NO: 547750 - DNA, 13 bp, D. melanogaster
aaacgaattgaat

SEQ ID NO: 547751 - DNA, 13 bp, D. melanogaster
aaacgaatttaat

SEQ ID NO: 547752 - DNA, 13 bp, D. melanogaster
aaacgaatttaca

SEQ ID NO: 547753 - DNA, 13 bp, D. melanogaster
aaacgaatttata

SEQ ID NO: 547754 - DNA, 13 bp, D. melanogaster
aaacgaatttgaa

SEQ ID NO: 547755 - DNA, 13 bp, D. melanogaster
aaacgaatttgtt

SEQ ID NO: 547756 - DNA, 13 bp, D. melanogaster
aaacgaattttaa

SEQ ID NO: 547757 - DNA, 13 bp, D. melanogaster
aaacgaatttttt

SEQ ID NO: 547758 - DNA, 13 bp, D. melanogaster
aaacgacaacgac

SEQ ID NO: 547759 - DNA, 13 bp, D. melanogaster
aaacgacattttt

SEQ ID NO: 547760 - DNA, 14 bp, D. melanogaster
aaacgacgaaaact

SEQ ID NO: 547761 - DNA, 13 bp, D. melanogaster
aaacgacgacgac

SEQ ID NO: 547762 - DNA, 13 bp, D. melanogaster
aaacgagaaattc

SEQ ID NO: 547763 - DNA, 13 bp, D. melanogaster
aaacgagaccttc

SEQ ID NO: 547764 - DNA, 13 bp, D. melanogaster
aaacgagagaaat

SEQ ID NO: 547765 - DNA, 13 bp, D. melanogaster
aaacgagctgaaa

SEQ ID NO: 547766 - DNA, 13 bp, D. melanogaster
aaacgagcttaaa

SEQ ID NO: 547767 - DNA, 13 bp, D. melanogaster
aaacgaggcgaaa

SEQ ID NO: 547768 - DNA, 13 bp, D. melanogaster
aaacgagtatata

SEQ ID NO: 547769 - DNA, 13 bp, D. melanogaster
aaacgagtgaaaa

SEQ ID NO: 547770 - DNA, 13 bp, D. melanogaster
aaacgagttggca

SEQ ID NO: 547771 - DNA, 14 bp, D. melanogaster
aaacgataaaaact

SEQ ID NO: 547772 - DNA, 13 bp, D. melanogaster
aaacgatacgaaa

SEQ ID NO: 547773 - DNA, 13 bp, D. melanogaster
aaacgatatgagc

SEQ ID NO: 547774 - DNA, 13 bp, D. melanogaster
aaacgatatttaa

SEQ ID NO: 547775 - DNA, 14 bp, D. melanogaster
aaacgatcagagca

SEQ ID NO: 547776 - DNA, 13 bp, D. melanogaster
aaacgatgacaaa

SEQ ID NO: 547777 - DNA, 13 bp, D. melanogaster
aaacgatgatgat

SEQ ID NO: 547778 - DNA, 13 bp, D. melanogaster
aaacgatggcaaa

SEQ ID NO: 547779 - DNA, 13 bp, D. melanogaster
aaacgatgttatt

SEQ ID NO: 547780 - DNA, 13 bp, D. melanogaster
aaacgattaaaat

SEQ ID NO: 547781 - DNA, 13 bp, D. melanogaster
aaacgattccagc

SEQ ID NO: 547782 - DNA, 13 bp, D. melanogaster
aaacgattcgaaa

SEQ ID NO: 547783 - DNA, 13 bp, D. melanogaster
aaacgattcgatt

SEQ ID NO: 547784 - DNA, 13 bp, D. melanogaster
aaacgatttaaga

SEQ ID NO: 547785 - DNA, 13 bp, D. melanogaster
aaacgatttaatt

SEQ ID NO: 547786 - DNA, 13 bp, D. melanogaster
aaacgatttcaaa

SEQ ID NO: 547787 - DNA, 13 bp, D. melanogaster
aaacgatttcaat

SEQ ID NO: 547788 - DNA, 13 bp, D. melanogaster
aaacgatttcatt

SEQ ID NO: 547789 - DNA, 13 bp, D. melanogaster
aaacgatttgttg

SEQ ID NO: 547790 - DNA, 13 bp, D. melanogaster
aaacgatttgttt

SEQ ID NO: 547791 - DNA, 13 bp, D. melanogaster
aaacgattttaat

SEQ ID NO: 547792 - DNA, 13 bp, D. melanogaster
aaacgattttatt

SEQ ID NO: 547793 - DNA, 13 bp, D. melanogaster
aaacgattttcaa

SEQ ID NO: 547794 - DNA, 13 bp, D. melanogaster
aaacgatttttaa

SEQ ID NO: 547795 - DNA, 13 bp, D. melanogaster
aaacgatttttat

SEQ ID NO: 547796 - DNA, 13 bp, D. melanogaster
aaacgatttttct

SEQ ID NO: 547797 - DNA, 13 bp, D. melanogaster
aaacgcaaacaat

SEQ ID NO: 547798 - DNA, 13 bp, D. melanogaster
aaacgcaaacgca

SEQ ID NO: 547799 - DNA, 13 bp, D. melanogaster
aaacgcaaatcaa

SEQ ID NO: 547800 - DNA, 13 bp, D. melanogaster
aaacgcaaatgaa

SEQ ID NO: 547801 - DNA, 13 bp, D. melanogaster
aaacgcaaattgt

SEQ ID NO: 547802 - DNA, 13 bp, D. melanogaster
aaacgcaacgcaa

SEQ ID NO: 547803 - DNA, 13 bp, D. melanogaster
aaacgcaatcaaa

SEQ ID NO: 547804 - DNA, 13 bp, D. melanogaster
aaacgcaatcaat

SEQ ID NO: 547805 - DNA, 13 bp, D. melanogaster
aaacgcaatgaaa

SEQ ID NO: 547806 - DNA, 13 bp, D. melanogaster
aaacgcaattaaa

SEQ ID NO: 547807 - DNA, 13 bp, D. melanogaster
aaacgcacacaag

SEQ ID NO: 547808 - DNA, 14 bp, D. melanogaster
aaacgcacacactc

SEQ ID NO: 547809 - DNA, 13 bp, D. melanogaster
aaacgcacacaga

SEQ ID NO: 547810 - DNA, 13 bp, D. melanogaster
aaacgcacacgaa

SEQ ID NO: 547811 - DNA, 13 bp, D. melanogaster
aaacgcacactgc

SEQ ID NO: 547812 - DNA, 14 bp, D. melanogaster
aaacgcacactgcc

SEQ ID NO: 547813 - DNA, 13 bp, D. melanogaster
aaacgcacatttt

SEQ ID NO: 547814 - DNA, 13 bp, D. melanogaster
aaacgcagacgaa

SEQ ID NO: 547815 - DNA, 13 bp, D. melanogaster
aaacgcagcacaa

SEQ ID NO: 547816 - DNA, 13 bp, D. melanogaster
aaacgcagccatc

SEQ ID NO: 547817 - DNA, 13 bp, D. melanogaster
aaacgcataaata

SEQ ID NO: 547818 - DNA, 13 bp, D. melanogaster
aaacgcattaaaa

SEQ ID NO: 547819 - DNA, 13 bp, D. melanogaster
aaacgcattcgaa

SEQ ID NO: 547820 - DNA, 13 bp, D. melanogaster
aaacgcatttcaa

SEQ ID NO: 547821 - DNA, 13 bp, D. melanogaster
aaacgcattttat

SEQ ID NO: 547822 - DNA, 13 bp, D. melanogaster
aaacgccaataaa

SEQ ID NO: 547823 - DNA, 13 bp, D. melanogaster
aaacgccaccggt

SEQ ID NO: 547824 - DNA, 13 bp, D. melanogaster
aaacgccagcaac

SEQ ID NO: 547825 - DNA, 14 bp, D. melanogaster
aaacgccagcaaca

SEQ ID NO: 547826 - DNA, 13 bp, D. melanogaster
aaacgccatttgc

SEQ ID NO: 547827 - DNA, 13 bp, D. melanogaster
aaacgcgaaattt

SEQ ID NO: 547828 - DNA, 13 bp, D. melanogaster
aaacgctgcaaaa

SEQ ID NO: 547829 - DNA, 13 bp, D. melanogaster
aaacgctgctggg

SEQ ID NO: 547830 - DNA, 13 bp, D. melanogaster
aaacgctggcaaa

SEQ ID NO: 547831 - DNA, 13 bp, D. melanogaster
aaacgcttccttc

SEQ ID NO: 547832 - DNA, 14 bp, D. melanogaster
aaacgcttccttct

SEQ ID NO: 547833 - DNA, 13 bp, D. melanogaster
aaacgcttccttt

SEQ ID NO: 547834 - DNA, 14 bp, D. melanogaster
aaacgcttcctttt

SEQ ID NO: 547835 - DNA, 13 bp, D. melanogaster
aaacgcttctttc

SEQ ID NO: 547836 - DNA, 13 bp, D. melanogaster
aaacgctttaaaa

SEQ ID NO: 547837 - DNA, 13 bp, D. melanogaster
aaacgcttttaaa

SEQ ID NO: 547838 - DNA, 13 bp, D. melanogaster
aaacgcttttaat

SEQ ID NO: 547839 - DNA, 13 bp, D. melanogaster
aaacgcttttcca

SEQ ID NO: 547840 - DNA, 14 bp, D. melanogaster
aaacggaaaaaatg

SEQ ID NO: 547841 - DNA, 13 bp, D. melanogaster
aaacggaaaacgg

SEQ ID NO: 547842 - DNA, 13 bp, D. melanogaster
aaacggaaaactg

SEQ ID NO: 547843 - DNA, 13 bp, D. melanogaster
aaacggaaaagcg

SEQ ID NO: 547844 - DNA, 14 bp, D. melanogaster
aaacggaaaagtat

SEQ ID NO: 547845 - DNA, 13 bp, D. melanogaster
aaacggaaaattc

SEQ ID NO: 547846 - DNA, 13 bp, D. melanogaster
aaacggaaaattg

SEQ ID NO: 547847 - DNA, 13 bp, D. melanogaster
aaacggaaacgca

SEQ ID NO: 547848 - DNA, 13 bp, D. melanogaster
aaacggaaacggc

SEQ ID NO: 547849 - DNA, 13 bp, D. melanogaster
aaacggaaagcga

SEQ ID NO: 547850 - DNA, 13 bp, D. melanogaster
aaacggaaatata

SEQ ID NO: 547851 - DNA, 13 bp, D. melanogaster
aaacggaaatatt

SEQ ID NO: 547852 - DNA, 13 bp, D. melanogaster
aaacggaaatgaa

SEQ ID NO: 547853 - DNA, 13 bp, D. melanogaster
aaacggaaatgcc

SEQ ID NO: 547854 - DNA, 13 bp, D. melanogaster
aaacggaaatgtt

SEQ ID NO: 547855 - DNA, 13 bp, D. melanogaster
aaacggaaattaa

SEQ ID NO: 547856 - DNA, 13 bp, D. melanogaster
aaacggaaattgc

SEQ ID NO: 547857 - DNA, 13 bp, D. melanogaster
aaacggaaattgt

SEQ ID NO: 547858 - DNA, 13 bp, D. melanogaster
aaacggaacggaa

SEQ ID NO: 547859 - DNA, 14 bp, D. melanogaster
aaacggaagcggaa

SEQ ID NO: 547860 - DNA, 15 bp, D. melanogaster
aaacggaagcggaaa

SEQ ID NO: 547861 - DNA, 13 bp, D. melanogaster
aaacggaagtgaa

SEQ ID NO: 547862 - DNA, 13 bp, D. melanogaster
aaacggaagtggc

SEQ ID NO: 547863 - DNA, 13 bp, D. melanogaster
aaacggaagtggg

SEQ ID NO: 547864 - DNA, 13 bp, D. melanogaster
aaacggaataatt

SEQ ID NO: 547865 - DNA, 13 bp, D. melanogaster
aaacggaatcgaa

SEQ ID NO: 547866 - DNA, 13 bp, D. melanogaster
aaacggaatgaaa

SEQ ID NO: 547867 - DNA, 13 bp, D. melanogaster
aaacggaatggaa

SEQ ID NO: 547868 - DNA, 13 bp, D. melanogaster
aaacggaattgaa

SEQ ID NO: 547869 - DNA, 13 bp, D. melanogaster
aaacggaatttaa

SEQ ID NO: 547870 - DNA, 13 bp, D. melanogaster
aaacggaatttat

SEQ ID NO: 547871 - DNA, 13 bp, D. melanogaster
aaacggaattttt

SEQ ID NO: 547872 - DNA, 14 bp, D. melanogaster
aaacggacagacgg

SEQ ID NO: 547873 - DNA, 13 bp, D. melanogaster
aaacggacatggc

SEQ ID NO: 547874 - DNA, 13 bp, D. melanogaster
aaacggagcatat

SEQ ID NO: 547875 - DNA, 14 bp, D. melanogaster
aaacggaggacgac

SEQ ID NO: 547876 - DNA, 13 bp, D. melanogaster
aaacggaggactc

SEQ ID NO: 547877 - DNA, 13 bp, D. melanogaster
aaacggaggcaaa

SEQ ID NO: 547878 - DNA, 13 bp, D. melanogaster
aaacggatataaa

SEQ ID NO: 547879 - DNA, 13 bp, D. melanogaster
aaacggatttagc

SEQ ID NO: 547880 - DNA, 13 bp, D. melanogaster
aaacggcaaacgg

SEQ ID NO: 547881 - DNA, 13 bp, D. melanogaster
aaacggcaaataa

SEQ ID NO: 547882 - DNA, 13 bp, D. melanogaster
aaacggcaaatga

SEQ ID NO: 547883 - DNA, 13 bp, D. melanogaster
aaacggcaaatgg

SEQ ID NO: 547884 - DNA, 13 bp, D. melanogaster
aaacggcagcagc

SEQ ID NO: 547885 - DNA, 13 bp, D. melanogaster
aaacggcggctaa

SEQ ID NO: 547886 - DNA, 13 bp, D. melanogaster
aaacggcgtccaa

SEQ ID NO: 547887 - DNA, 16 bp, D. melanogaster
aaacggctgttcgcct

SEQ ID NO: 547888 - DNA, 13 bp, D. melanogaster
aaacgggaaaaat

SEQ ID NO: 547889 - DNA, 13 bp, D. melanogaster
aaacgggaaatgg

SEQ ID NO: 547890 - DNA, 13 bp, D. melanogaster
aaacgggaaattg

SEQ ID NO: 547891 - DNA, 13 bp, D. melanogaster
aaacgggccaaaa

SEQ ID NO: 547892 - DNA, 13 bp, D. melanogaster
aaacggtggaaaa

SEQ ID NO: 547893 - DNA, 13 bp, D. melanogaster
aaacggtttcagt

SEQ ID NO: 547894 - DNA, 13 bp, D. melanogaster
aaacgtaaaaatc

SEQ ID NO: 547895 - DNA, 14 bp, D. melanogaster
aaacgtaaaaatca

SEQ ID NO: 547896 - DNA, 13 bp, D. melanogaster
aaacgtaaaattt

SEQ ID NO: 547897 - DNA, 13 bp, D. melanogaster
aaacgtaaacgta

SEQ ID NO: 547898 - DNA, 13 bp, D. melanogaster
aaacgtaaatttt

SEQ ID NO: 547899 - DNA, 13 bp, D. melanogaster
aaacgtaacgaaa

SEQ ID NO: 547900 - DNA, 13 bp, D. melanogaster
aaacgtaattttt

SEQ ID NO: 547901 - DNA, 13 bp, D. melanogaster
aaacgtacatata

SEQ ID NO: 547902 - DNA, 13 bp, D. melanogaster
aaacgtataaaat

SEQ ID NO: 547903 - DNA, 14 bp, D. melanogaster
aaacgtatagccca

SEQ ID NO: 547904 - DNA, 13 bp, D. melanogaster
aaacgtatatata

SEQ ID NO: 547905 - DNA, 13 bp, D. melanogaster
aaacgtattaaat

SEQ ID NO: 547906 - DNA, 13 bp, D. melanogaster
aaacgtatttaat

SEQ ID NO: 547907 - DNA, 14 bp, D. melanogaster
aaacgtatttaata

SEQ ID NO: 547908 - DNA, 13 bp, D. melanogaster
aaacgtattttaa

SEQ ID NO: 547909 - DNA, 13 bp, D. melanogaster
aaacgtcgagatc

SEQ ID NO: 547910 - DNA, 13 bp, D. melanogaster
aaacgtggccaaa

SEQ ID NO: 547911 - DNA, 13 bp, D. melanogaster
aaacgtggccaag

SEQ ID NO: 547912 - DNA, 13 bp, D. melanogaster
aaacgtgttcaaa

SEQ ID NO: 547913 - DNA, 13 bp, D. melanogaster
aaacgttaaaata

SEQ ID NO: 547914 - DNA, 13 bp, D. melanogaster
aaacgttaaataa

SEQ ID NO: 547915 - DNA, 13 bp, D. melanogaster
aaacgttagcaaa

SEQ ID NO: 547916 - DNA, 14 bp, D. melanogaster
aaacgttagcaaat

SEQ ID NO: 547917 - DNA, 13 bp, D. melanogaster
aaacgttatttat

SEQ ID NO: 547918 - DNA, 13 bp, D. melanogaster
aaacgttgaataa

SEQ ID NO: 547919 - DNA, 14 bp, D. melanogaster
aaacgttgaataaa

SEQ ID NO: 547920 - DNA, 13 bp, D. melanogaster
aaacgttgctcaa

SEQ ID NO: 547921 - DNA, 13 bp, D. melanogaster
aaacgttggaaaa

SEQ ID NO: 547922 - DNA, 13 bp, D. melanogaster
aaacgtttaaaaa

SEQ ID NO: 547923 - DNA, 13 bp, D. melanogaster
aaacgtttaattt

SEQ ID NO: 547924 - DNA, 13 bp, D. melanogaster
aaacgtttcaaaa

SEQ ID NO: 547925 - DNA, 13 bp, D. melanogaster
aaacgtttgttta

SEQ ID NO: 547926 - DNA, 13 bp, D. melanogaster
aaacgttttaaaa

SEQ ID NO: 547927 - DNA, 13 bp, D. melanogaster
aaacgttttaaag

SEQ ID NO: 547928 - DNA, 13 bp, D. melanogaster
aaacgttttaaat

SEQ ID NO: 547929 - DNA, 13 bp, D. melanogaster
aaacgttttattt

SEQ ID NO: 547930 - DNA, 13 bp, D. melanogaster
aaacgttttccat

SEQ ID NO: 547931 - DNA, 13 bp, D. melanogaster
aaacgttttcgaa

SEQ ID NO: 547932 - DNA, 13 bp, D. melanogaster
aaacgttttgcca

SEQ ID NO: 547933 - DNA, 13 bp, D. melanogaster
aaacgttttgtaa

SEQ ID NO: 547934 - DNA, 13 bp, D. melanogaster
aaacgtttttcaa

SEQ ID NO: 547935 - DNA, 13 bp, D. melanogaster
aaacgtttttcga

SEQ ID NO: 547936 - DNA, 13 bp, D. melanogaster
aaacgttttttaa

SEQ ID NO: 547937 - DNA, 14 bp, D. melanogaster
aaacgttttttaaa

SEQ ID NO: 547938 - DNA, 13 bp, D. melanogaster
aaacgttttttat

SEQ ID NO: 547939 - DNA, 13 bp, D. melanogaster
aaacgttttttgt

SEQ ID NO: 547940 - DNA, 14 bp, D. melanogaster
aaacgttttttgtt

SEQ ID NO: 547941 - DNA, 13 bp, D. melanogaster
aaactaaaaagtg

SEQ ID NO: 547942 - DNA, 13 bp, D. melanogaster
aaactaaaaatgt

SEQ ID NO: 547943 - DNA, 13 bp, D. melanogaster
aaactaaaacctt

SEQ ID NO: 547944 - DNA, 13 bp, D. melanogaster
aaactaaaactga

SEQ ID NO: 547945 - DNA, 14 bp, D. melanogaster
aaactaaaactgaa

SEQ ID NO: 547946 - DNA, 13 bp, D. melanogaster
aaactaaaacttt

SEQ ID NO: 547947 - DNA, 13 bp, D. melanogaster
aaactaaaagcga

SEQ ID NO: 547948 - DNA, 13 bp, D. melanogaster
aaactaaaagcta

SEQ ID NO: 547949 - DNA, 13 bp, D. melanogaster
aaactaaaagtgt

SEQ ID NO: 547950 - DNA, 13 bp, D. melanogaster
aaactaaaagttt

SEQ ID NO: 547951 - DNA, 13 bp, D. melanogaster
aaactaaaatatg

SEQ ID NO: 547952 - DNA, 13 bp, D. melanogaster
aaactaaaatgca

SEQ ID NO: 547953 - DNA, 13 bp, D. melanogaster
aaactaaaatgga

SEQ ID NO: 547954 - DNA, 13 bp, D. melanogaster
aaactaaaatgta

SEQ ID NO: 547955 - DNA, 13 bp, D. melanogaster
aaactaaaatgtt

SEQ ID NO: 547956 - DNA, 14 bp, D. melanogaster
aaactaaaattaag

SEQ ID NO: 547957 - DNA, 14 bp, D. melanogaster
aaactaaaattgaa

SEQ ID NO: 547958 - DNA, 13 bp, D. melanogaster
aaactaaaccgaa

SEQ ID NO: 547959 - DNA, 14 bp, D. melanogaster
aaactaaactaaag

SEQ ID NO: 547960 - DNA, 13 bp, D. melanogaster
aaactaaactaga

SEQ ID NO: 547961 - DNA, 13 bp, D. melanogaster
aaactaaactgaa

SEQ ID NO: 547962 - DNA, 13 bp, D. melanogaster
aaactaaagcaat

SEQ ID NO: 547963 - DNA, 14 bp, D. melanogaster
aaactaaagcaatt

SEQ ID NO: 547964 - DNA, 13 bp, D. melanogaster
aaactaaagcatt

SEQ ID NO: 547965 - DNA, 13 bp, D. melanogaster
aaactaaagctaa

SEQ ID NO: 547966 - DNA, 13 bp, D. melanogaster
aaactaaagttaa

SEQ ID NO: 547967 - DNA, 13 bp, D. melanogaster
aaactaaagtttt

SEQ ID NO: 547968 - DNA, 13 bp, D. melanogaster
aaactaaatagtt

SEQ ID NO: 547969 - DNA, 13 bp, D. melanogaster
aaactaaatattc

SEQ ID NO: 547970 - DNA, 13 bp, D. melanogaster
aaactaaatcttt

SEQ ID NO: 547971 - DNA, 13 bp, D. melanogaster
aaactaaatgcaa

SEQ ID NO: 547972 - DNA, 13 bp, D. melanogaster
aaactaaatgcat

SEQ ID NO: 547973 - DNA, 13 bp, D. melanogaster
aaactaaattgca

SEQ ID NO: 547974 - DNA, 13 bp, D. melanogaster
aaactaaattgta

SEQ ID NO: 547975 - DNA, 13 bp, D. melanogaster
aaactaaattgtt

SEQ ID NO: 547976 - DNA, 13 bp, D. melanogaster
aaactaaccgaaa

SEQ ID NO: 547977 - DNA, 13 bp, D. melanogaster
aaactaactaatt

SEQ ID NO: 547978 - DNA, 13 bp, D. melanogaster
aaactaactgaaa

SEQ ID NO: 547979 - DNA, 13 bp, D. melanogaster
aaactaactttaa

SEQ ID NO: 547980 - DNA, 13 bp, D. melanogaster
aaactaagaaatt

SEQ ID NO: 547981 - DNA, 13 bp, D. melanogaster
aaactaagccaaa

SEQ ID NO: 547982 - DNA, 13 bp, D. melanogaster
aaactaagctaaa

SEQ ID NO: 547983 - DNA, 13 bp, D. melanogaster
aaactaaggcaaa

SEQ ID NO: 547984 - DNA, 14 bp, D. melanogaster
aaactaatccgagt

SEQ ID NO: 547985 - DNA, 13 bp, D. melanogaster
aaactaatgacaa

SEQ ID NO: 547986 - DNA, 13 bp, D. melanogaster
aaactaatgattt

SEQ ID NO: 547987 - DNA, 13 bp, D. melanogaster
aaactaatgcaaa

SEQ ID NO: 547988 - DNA, 13 bp, D. melanogaster
aaactaatgcaat

SEQ ID NO: 547989 - DNA, 13 bp, D. melanogaster
aaactaattaact

SEQ ID NO: 547990 - DNA, 13 bp, D. melanogaster
aaactaattaagt

SEQ ID NO: 547991 - DNA, 13 bp, D. melanogaster
aaactaattagaa

SEQ ID NO: 547992 - DNA, 13 bp, D. melanogaster
aaactaattgaat

SEQ ID NO: 547993 - DNA, 14 bp, D. melanogaster
aaactaattgaatt

SEQ ID NO: 547994 - DNA, 13 bp, D. melanogaster
aaactaattgatt

SEQ ID NO: 547995 - DNA, 13 bp, D. melanogaster
aaactaattggtg

SEQ ID NO: 547996 - DNA, 13 bp, D. melanogaster
aaactaattgtat

SEQ ID NO: 547997 - DNA, 13 bp, D. melanogaster
aaactaattgttt

SEQ ID NO: 547998 - DNA, 13 bp, D. melanogaster
aaactaatttatg

SEQ ID NO: 547999 - DNA, 13 bp, D. melanogaster
aaactaatttcaa

SEQ ID NO: 548000 - DNA, 13 bp, D. melanogaster
aaactaatttcag

SEQ ID NO: 548001 - DNA, 13 bp, D. melanogaster
aaactaatttgaa

SEQ ID NO: 548002 - DNA, 13 bp, D. melanogaster
aaactaatttgat

SEQ ID NO: 548003 - DNA, 14 bp, D. melanogaster
aaactaatttgttt

SEQ ID NO: 548004 - DNA, 13 bp, D. melanogaster
aaactacaaactt

SEQ ID NO: 548005 - DNA, 13 bp, D. melanogaster
aaactacaagctg

SEQ ID NO: 548006 - DNA, 13 bp, D. melanogaster
aaactacacgttc

SEQ ID NO: 548007 - DNA, 13 bp, D. melanogaster
aaactacatacat

SEQ ID NO: 548008 - DNA, 13 bp, D. melanogaster
aaactacatccag

SEQ ID NO: 548009 - DNA, 13 bp, D. melanogaster
aaactacatttaa

SEQ ID NO: 548010 - DNA, 13 bp, D. melanogaster
aaactaccagggc

SEQ ID NO: 548011 - DNA, 14 bp, D. melanogaster
aaactacgaataac

SEQ ID NO: 548012 - DNA, 13 bp, D. melanogaster
aaactacgacaaa

SEQ ID NO: 548013 - DNA, 13 bp, D. melanogaster
aaactacgagaaa

SEQ ID NO: 548014 - DNA, 13 bp, D. melanogaster
aaactacgataaa

SEQ ID NO: 548015 - DNA, 13 bp, D. melanogaster
aaactacttgaaa

SEQ ID NO: 548016 - DNA, 13 bp, D. melanogaster
aaactactttaaa

SEQ ID NO: 548017 - DNA, 13 bp, D. melanogaster
aaactactttttt

SEQ ID NO: 548018 - DNA, 13 bp, D. melanogaster
aaactagaaagct

SEQ ID NO: 548019 - DNA, 13 bp, D. melanogaster
aaactagaactaa

SEQ ID NO: 548020 - DNA, 13 bp, D. melanogaster
aaactataaaatg

SEQ ID NO: 548021 - DNA, 13 bp, D. melanogaster
aaactataaagta

SEQ ID NO: 548022 - DNA, 13 bp, D. melanogaster
aaactataaagtt

SEQ ID NO: 548023 - DNA, 13 bp, D. melanogaster
aaactataactat

SEQ ID NO: 548024 - DNA, 13 bp, D. melanogaster
aaactatacaatt

SEQ ID NO: 548025 - DNA, 13 bp, D. melanogaster
aaactatagctaa

SEQ ID NO: 548026 - DNA, 14 bp, D. melanogaster
aaactatatatgta

SEQ ID NO: 548027 - DNA, 13 bp, D. melanogaster
aaactatatccaa

SEQ ID NO: 548028 - DNA, 13 bp, D. melanogaster
aaactatatgcaa

SEQ ID NO: 548029 - DNA, 13 bp, D. melanogaster
aaactatcaaatt

SEQ ID NO: 548030 - DNA, 13 bp, D. melanogaster
aaactatcaatat

SEQ ID NO: 548031 - DNA, 13 bp, D. melanogaster
aaactatcgataa

SEQ ID NO: 548032 - DNA, 13 bp, D. melanogaster
aaactatcttttt

SEQ ID NO: 548033 - DNA, 13 bp, D. melanogaster
aaactatgaaaat

SEQ ID NO: 548034 - DNA, 13 bp, D. melanogaster
aaactatgaatat

SEQ ID NO: 548035 - DNA, 13 bp, D. melanogaster
aaactatgcaaaa

SEQ ID NO: 548036 - DNA, 13 bp, D. melanogaster
aaactatgcaaca

SEQ ID NO: 548037 - DNA, 13 bp, D. melanogaster
aaactatggaaaa

SEQ ID NO: 548038 - DNA, 13 bp, D. melanogaster
aaactatggcaag

SEQ ID NO: 548039 - DNA, 13 bp, D. melanogaster
aaactattaaact

SEQ ID NO: 548040 - DNA, 13 bp, D. melanogaster
aaactattgaaaa

SEQ ID NO: 548041 - DNA, 14 bp, D. melanogaster
aaactattgaaaat

SEQ ID NO: 548042 - DNA, 13 bp, D. melanogaster
aaactattgcaaa

SEQ ID NO: 548043 - DNA, 13 bp, D. melanogaster
aaactatttaaag

SEQ ID NO: 548044 - DNA, 13 bp, D. melanogaster
aaactatttaatc

SEQ ID NO: 548045 - DNA, 13 bp, D. melanogaster
aaactatttattg

SEQ ID NO: 548046 - DNA, 13 bp, D. melanogaster
aaactatttctaa

SEQ ID NO: 548047 - DNA, 13 bp, D. melanogaster
aaactatttgaaa

SEQ ID NO: 548048 - DNA, 13 bp, D. melanogaster
aaactatttgcaa

SEQ ID NO: 548049 - DNA, 13 bp, D. melanogaster
aaactatttgcca

SEQ ID NO: 548050 - DNA, 13 bp, D. melanogaster
aaactatttgctt

SEQ ID NO: 548051 - DNA, 13 bp, D. melanogaster
aaactatttggaa

SEQ ID NO: 548052 - DNA, 13 bp, D. melanogaster
aaactatttgtaa

SEQ ID NO: 548053 - DNA, 13 bp, D. melanogaster
aaactatttgtat

SEQ ID NO: 548054 - DNA, 13 bp, D. melanogaster
aaactattttaag

SEQ ID NO: 548055 - DNA, 13 bp, D. melanogaster
aaactattttaca

SEQ ID NO: 548056 - DNA, 13 bp, D. melanogaster
aaactattttacc

SEQ ID NO: 548057 - DNA, 13 bp, D. melanogaster
aaactattttagt

SEQ ID NO: 548058 - DNA, 13 bp, D. melanogaster
aaactattttcct

SEQ ID NO: 548059 - DNA, 13 bp, D. melanogaster
aaactattttgaa

SEQ ID NO: 548060 - DNA, 13 bp, D. melanogaster
aaactattttgat

SEQ ID NO: 548061 - DNA, 13 bp, D. melanogaster
aaactattttgcc

SEQ ID NO: 548062 - DNA, 13 bp, D. melanogaster
aaactatttttct

SEQ ID NO: 548063 - DNA, 13 bp, D. melanogaster
aaactatttttgg

SEQ ID NO: 548064 - DNA, 14 bp, D. melanogaster
aaactatttttggc

SEQ ID NO: 548065 - DNA, 13 bp, D. melanogaster
aaactattttttc

SEQ ID NO: 548066 - DNA, 13 bp, D. melanogaster
aaactcaaaaatg

SEQ ID NO: 548067 - DNA, 13 bp, D. melanogaster
aaactcaaaactc

SEQ ID NO: 548068 - DNA, 14 bp, D. melanogaster
aaactcaaaatcga

SEQ ID NO: 548069 - DNA, 13 bp, D. melanogaster
aaactcaaaattt

SEQ ID NO: 548070 - DNA, 14 bp, D. melanogaster
aaactcaaacatat

SEQ ID NO: 548071 - DNA, 13 bp, D. melanogaster
aaactcaaagcca

SEQ ID NO: 548072 - DNA, 14 bp, D. melanogaster
aaactcaaattcaa

SEQ ID NO: 548073 - DNA, 13 bp, D. melanogaster
aaactcaaatttt

SEQ ID NO: 548074 - DNA, 14 bp, D. melanogaster
aaactcaaattttt

SEQ ID NO: 548075 - DNA, 13 bp, D. melanogaster
aaactcaacgaga

SEQ ID NO: 548076 - DNA, 13 bp, D. melanogaster
aaactcaactcga

SEQ ID NO: 548077 - DNA, 13 bp, D. melanogaster
aaactcaactgaa

SEQ ID NO: 548078 - DNA, 13 bp, D. melanogaster
aaactcaactttt

SEQ ID NO: 548079 - DNA, 13 bp, D. melanogaster
aaactcaagtggc

SEQ ID NO: 548080 - DNA, 13 bp, D. melanogaster
aaactcaatgaat

SEQ ID NO: 548081 - DNA, 13 bp, D. melanogaster
aaactcaattaga

SEQ ID NO: 548082 - DNA, 13 bp, D. melanogaster
aaactcaattgaa

SEQ ID NO: 548083 - DNA, 13 bp, D. melanogaster
aaactcaattgtt

SEQ ID NO: 548084 - DNA, 13 bp, D. melanogaster
aaactcaatttca

SEQ ID NO: 548085 - DNA, 13 bp, D. melanogaster
aaactcaatttgc

SEQ ID NO: 548086 - DNA, 13 bp, D. melanogaster
aaactcaattttc

SEQ ID NO: 548087 - DNA, 14 bp, D. melanogaster
aaactcaattttca

SEQ ID NO: 548088 - DNA, 13 bp, D. melanogaster
aaactcacatttg

SEQ ID NO: 548089 - DNA, 13 bp, D. melanogaster
aaactcacttttt

SEQ ID NO: 548090 - DNA, 13 bp, D. melanogaster
aaactcataaatc

SEQ ID NO: 548091 - DNA, 13 bp, D. melanogaster
aaactcataattt

SEQ ID NO: 548092 - DNA, 13 bp, D. melanogaster
aaactcatgaaaa

SEQ ID NO: 548093 - DNA, 13 bp, D. melanogaster
aaactcattcaaa

SEQ ID NO: 548094 - DNA, 14 bp, D. melanogaster
aaactcatttaaat

SEQ ID NO: 548095 - DNA, 13 bp, D. melanogaster
aaactcatttaat

SEQ ID NO: 548096 - DNA, 13 bp, D. melanogaster
aaactcatttaca

SEQ ID NO: 548097 - DNA, 13 bp, D. melanogaster
aaactcatttcgc

SEQ ID NO: 548098 - DNA, 13 bp, D. melanogaster
aaactcatttgtt

SEQ ID NO: 548099 - DNA, 13 bp, D. melanogaster
aaactcatttttt

SEQ ID NO: 548100 - DNA, 13 bp, D. melanogaster
aaactccagctcc

SEQ ID NO: 548101 - DNA, 14 bp, D. melanogaster
aaactccagctcct

SEQ ID NO: 548102 - DNA, 13 bp, D. melanogaster
aaactccagtcta

SEQ ID NO: 548103 - DNA, 13 bp, D. melanogaster
aaactccatttcc

SEQ ID NO: 548104 - DNA, 13 bp, D. melanogaster
aaactccccaaat

SEQ ID NO: 548105 - DNA, 13 bp, D. melanogaster
aaactccttgctg

SEQ ID NO: 548106 - DNA, 13 bp, D. melanogaster
aaactcgaaactc

SEQ ID NO: 548107 - DNA, 13 bp, D. melanogaster
aaactcgaaatta

SEQ ID NO: 548108 - DNA, 13 bp, D. melanogaster
aaactcgaactca

SEQ ID NO: 548109 - DNA, 13 bp, D. melanogaster
aaactcgatttaa

SEQ ID NO: 548110 - DNA, 13 bp, D. melanogaster
aaactcgcaacag

SEQ ID NO: 548111 - DNA, 13 bp, D. melanogaster
aaactcgcacaca

SEQ ID NO: 548112 - DNA, 13 bp, D. melanogaster
aaactcgtttaaa

SEQ ID NO: 548113 - DNA, 13 bp, D. melanogaster
aaactcgttttcc

SEQ ID NO: 548114 - DNA, 13 bp, D. melanogaster
aaactctacaagt

SEQ ID NO: 548115 - DNA, 13 bp, D. melanogaster
aaactctacacga

SEQ ID NO: 548116 - DNA, 13 bp, D. melanogaster
aaactctattttt

SEQ ID NO: 548117 - DNA, 13 bp, D. melanogaster
aaactctggcttt

SEQ ID NO: 548118 - DNA, 13 bp, D. melanogaster
aaactcttaaata

SEQ ID NO: 548119 - DNA, 13 bp, D. melanogaster
aaactcttattaa

SEQ ID NO: 548120 - DNA, 13 bp, D. melanogaster
aaactcttcagtt

SEQ ID NO: 548121 - DNA, 14 bp, D. melanogaster
aaactcttcagttg

SEQ ID NO: 548122 - DNA, 13 bp, D. melanogaster
aaactcttctcct

SEQ ID NO: 548123 - DNA, 13 bp, D. melanogaster
aaactcttcttca

SEQ ID NO: 548124 - DNA, 13 bp, D. melanogaster
aaactcttgaaaa

SEQ ID NO: 548125 - DNA, 13 bp, D. melanogaster
aaactcttttaat

SEQ ID NO: 548126 - DNA, 13 bp, D. melanogaster
aaactcttttatt

SEQ ID NO: 548127 - DNA, 13 bp, D. melanogaster
aaactcttttgtt

SEQ ID NO: 548128 - DNA, 14 bp, D. melanogaster
aaactgaaaaagag

SEQ ID NO: 548129 - DNA, 13 bp, D. melanogaster
aaactgaaaacag

SEQ ID NO: 548130 - DNA, 13 bp, D. melanogaster
aaactgaaaacgg

SEQ ID NO: 548131 - DNA, 13 bp, D. melanogaster
aaactgaaaagct

SEQ ID NO: 548132 - DNA, 13 bp, D. melanogaster
aaactgaaaagga

SEQ ID NO: 548133 - DNA, 14 bp, D. melanogaster
aaactgaaaataat

SEQ ID NO: 548134 - DNA, 13 bp, D. melanogaster
aaactgaaaatat

SEQ ID NO: 548135 - DNA, 14 bp, D. melanogaster
aaactgaaaatgaa

SEQ ID NO: 548136 - DNA, 13 bp, D. melanogaster
aaactgaaaatta

SEQ ID NO: 548137 - DNA, 13 bp, D. melanogaster
aaactgaaaattg

SEQ ID NO: 548138 - DNA, 13 bp, D. melanogaster
aaactgaaacaca

SEQ ID NO: 548139 - DNA, 13 bp, D. melanogaster
aaactgaaacaga

SEQ ID NO: 548140 - DNA, 13 bp, D. melanogaster
aaactgaaaccaa

SEQ ID NO: 548141 - DNA, 14 bp, D. melanogaster
aaactgaaaccgaa

SEQ ID NO: 548142 - DNA, 13 bp, D. melanogaster
aaactgaaacgaa

SEQ ID NO: 548143 - DNA, 13 bp, D. melanogaster
aaactgaaactaa

SEQ ID NO: 548144 - DNA, 14 bp, D. melanogaster
aaactgaaactaaa

SEQ ID NO: 548145 - DNA, 14 bp, D. melanogaster
aaactgaaactgag

SEQ ID NO: 548146 - DNA, 14 bp, D. melanogaster
aaactgaaactgat

SEQ ID NO: 548147 - DNA, 13 bp, D. melanogaster
aaactgaaactgc

SEQ ID NO: 548148 - DNA, 13 bp, D. melanogaster
aaactgaaactgg

SEQ ID NO: 548149 - DNA, 13 bp, D. melanogaster
aaactgaaactta

SEQ ID NO: 548150 - DNA, 14 bp, D. melanogaster
aaactgaaacttaa

SEQ ID NO: 548151 - DNA, 13 bp, D. melanogaster
aaactgaaataat

SEQ ID NO: 548152 - DNA, 13 bp, D. melanogaster
aaactgaaataca

SEQ ID NO: 548153 - DNA, 13 bp, D. melanogaster
aaactgaaatatg

SEQ ID NO: 548154 - DNA, 13 bp, D. melanogaster
aaactgaaatcaa

SEQ ID NO: 548155 - DNA, 13 bp, D. melanogaster
aaactgaaatcat

SEQ ID NO: 548156 - DNA, 14 bp, D. melanogaster
aaactgaaatcgaa

SEQ ID NO: 548157 - DNA, 13 bp, D. melanogaster
aaactgaaatgaa

SEQ ID NO: 548158 - DNA, 14 bp, D. melanogaster
aaactgaaatgaaa

SEQ ID NO: 548159 - DNA, 13 bp, D. melanogaster
aaactgaaatttt

SEQ ID NO: 548160 - DNA, 13 bp, D. melanogaster
aaactgaacagaa

SEQ ID NO: 548161 - DNA, 13 bp, D. melanogaster
aaactgaaccaaa

SEQ ID NO: 548162 - DNA, 13 bp, D. melanogaster
aaactgaaccgaa

SEQ ID NO: 548163 - DNA, 13 bp, D. melanogaster
aaactgaacggaa

SEQ ID NO: 548164 - DNA, 13 bp, D. melanogaster
aaactgaactaaa

SEQ ID NO: 548165 - DNA, 13 bp, D. melanogaster
aaactgaactgaa

SEQ ID NO: 548166 - DNA, 14 bp, D. melanogaster
aaactgaactgaaa

SEQ ID NO: 548167 - DNA, 14 bp, D. melanogaster
aaactgaactgaac

SEQ ID NO: 548168 - DNA, 13 bp, D. melanogaster
aaactgaagccaa

SEQ ID NO: 548169 - DNA, 13 bp, D. melanogaster
aaactgaagctat

SEQ ID NO: 548170 - DNA, 14 bp, D. melanogaster
aaactgaagctatg

SEQ ID NO: 548171 - DNA, 14 bp, D. melanogaster
aaactgaagctgaa

SEQ ID NO: 548172 - DNA, 13 bp, D. melanogaster
aaactgaaggaaa

SEQ ID NO: 548173 - DNA, 13 bp, D. melanogaster
aaactgaagtgtt

SEQ ID NO: 548174 - DNA, 13 bp, D. melanogaster
aaactgaataaat

SEQ ID NO: 548175 - DNA, 13 bp, D. melanogaster
aaactgaataatt

SEQ ID NO: 548176 - DNA, 13 bp, D. melanogaster
aaactgaatacca

SEQ ID NO: 548177 - DNA, 13 bp, D. melanogaster
aaactgaatatat

SEQ ID NO: 548178 - DNA, 13 bp, D. melanogaster
aaactgaatctga

SEQ ID NO: 548179 - DNA, 14 bp, D. melanogaster
aaactgaatctgaa

SEQ ID NO: 548180 - DNA, 13 bp, D. melanogaster
aaactgaatgaaa

SEQ ID NO: 548181 - DNA, 13 bp, D. melanogaster
aaactgaatgaat

SEQ ID NO: 548182 - DNA, 13 bp, D. melanogaster
aaactgaatgcga

SEQ ID NO: 548183 - DNA, 13 bp, D. melanogaster
aaactgaattgaa

SEQ ID NO: 548184 - DNA, 14 bp, D. melanogaster
aaactgaattgaat

SEQ ID NO: 548185 - DNA, 13 bp, D. melanogaster
aaactgacaaact

SEQ ID NO: 548186 - DNA, 13 bp, D. melanogaster
aaactgacaattt

SEQ ID NO: 548187 - DNA, 13 bp, D. melanogaster
aaactgacatttt

SEQ ID NO: 548188 - DNA, 13 bp, D. melanogaster
aaactgagaaact

SEQ ID NO: 548189 - DNA, 13 bp, D. melanogaster
aaactgaggaaaa

SEQ ID NO: 548190 - DNA, 13 bp, D. melanogaster
aaactgagtataa

SEQ ID NO: 548191 - DNA, 13 bp, D. melanogaster
aaactgataaata

SEQ ID NO: 548192 - DNA, 13 bp, D. melanogaster
aaactgattgaaa

SEQ ID NO: 548193 - DNA, 13 bp, D. melanogaster
aaactgatttaaa

SEQ ID NO: 548194 - DNA, 13 bp, D. melanogaster
aaactgattttaa

SEQ ID NO: 548195 - DNA, 14 bp, D. melanogaster
aaactgattttaaa

SEQ ID NO: 548196 - DNA, 13 bp, D. melanogaster
aaactgattttat

SEQ ID NO: 548197 - DNA, 13 bp, D. melanogaster
aaactgcaaaagt

SEQ ID NO: 548198 - DNA, 13 bp, D. melanogaster
aaactgcaaaatg

SEQ ID NO: 548199 - DNA, 13 bp, D. melanogaster
aaactgcaaaatt

SEQ ID NO: 548200 - DNA, 13 bp, D. melanogaster
aaactgcaaacaa

SEQ ID NO: 548201 - DNA, 13 bp, D. melanogaster
aaactgcaaacta

SEQ ID NO: 548202 - DNA, 13 bp, D. melanogaster
aaactgcaaactg

SEQ ID NO: 548203 - DNA, 13 bp, D. melanogaster
aaactgcaaattg

SEQ ID NO: 548204 - DNA, 13 bp, D. melanogaster
aaactgcaacaaa

SEQ ID NO: 548205 - DNA, 13 bp, D. melanogaster
aaactgcaacgca

SEQ ID NO: 548206 - DNA, 13 bp, D. melanogaster
aaactgcaacgcc

SEQ ID NO: 548207 - DNA, 13 bp, D. melanogaster
aaactgcaactgc

SEQ ID NO: 548208 - DNA, 14 bp, D. melanogaster
aaactgcaactgca

SEQ ID NO: 548209 - DNA, 13 bp, D. melanogaster
aaactgcaataaa

SEQ ID NO: 548210 - DNA, 13 bp, D. melanogaster
aaactgcaatcaa

SEQ ID NO: 548211 - DNA, 13 bp, D. melanogaster
aaactgcaattat

SEQ ID NO: 548212 - DNA, 13 bp, D. melanogaster
aaactgcaattca

SEQ ID NO: 548213 - DNA, 13 bp, D. melanogaster
aaactgcaatttg

SEQ ID NO: 548214 - DNA, 13 bp, D. melanogaster
aaactgcaatttt

SEQ ID NO: 548215 - DNA, 13 bp, D. melanogaster
aaactgcacaaaa

SEQ ID NO: 548216 - DNA, 13 bp, D. melanogaster
aaactgcacttaa

SEQ ID NO: 548217 - DNA, 13 bp, D. melanogaster
aaactgcacttga

SEQ ID NO: 548218 - DNA, 13 bp, D. melanogaster
aaactgcactttt

SEQ ID NO: 548219 - DNA, 13 bp, D. melanogaster
aaactgcagaaaa

SEQ ID NO: 548220 - DNA, 13 bp, D. melanogaster
aaactgcagcaaa

SEQ ID NO: 548221 - DNA, 13 bp, D. melanogaster
aaactgcagcagc

SEQ ID NO: 548222 - DNA, 13 bp, D. melanogaster
aaactgcagccaa

SEQ ID NO: 548223 - DNA, 13 bp, D. melanogaster
aaactgcagctgc

SEQ ID NO: 548224 - DNA, 13 bp, D. melanogaster
aaactgcagtcca

SEQ ID NO: 548225 - DNA, 14 bp, D. melanogaster
aaactgcataacaa

SEQ ID NO: 548226 - DNA, 13 bp, D. melanogaster
aaactgcatattt

SEQ ID NO: 548227 - DNA, 13 bp, D. melanogaster
aaactgcattagt

SEQ ID NO: 548228 - DNA, 14 bp, D. melanogaster
aaactgcatttaaa

SEQ ID NO: 548229 - DNA, 13 bp, D. melanogaster
aaactgccaaaaa

SEQ ID NO: 548230 - DNA, 13 bp, D. melanogaster
aaactgccccaaa

SEQ ID NO: 548231 - DNA, 13 bp, D. melanogaster
aaactgcgaaaaa

SEQ ID NO: 548232 - DNA, 13 bp, D. melanogaster
aaactgcgccaca

SEQ ID NO: 548233 - DNA, 14 bp, D. melanogaster
aaactgcgccacac

SEQ ID NO: 548234 - DNA, 13 bp, D. melanogaster
aaactgcgggaaa

SEQ ID NO: 548235 - DNA, 13 bp, D. melanogaster
aaactgctagcag

SEQ ID NO: 548236 - DNA, 14 bp, D. melanogaster
aaactgctagcaga

SEQ ID NO: 548237 - DNA, 13 bp, D. melanogaster
aaactgctgaaaa

SEQ ID NO: 548238 - DNA, 13 bp, D. melanogaster
aaactgctgacaa

SEQ ID NO: 548239 - DNA, 13 bp, D. melanogaster
aaactgctggcca

SEQ ID NO: 548240 - DNA, 13 bp, D. melanogaster
aaactggaaaaac

SEQ ID NO: 548241 - DNA, 13 bp, D. melanogaster
aaactggaaaaag

SEQ ID NO: 548242 - DNA, 13 bp, D. melanogaster
aaactggaaaacc

SEQ ID NO: 548243 - DNA, 13 bp, D. melanogaster
aaactggaaaatg

SEQ ID NO: 548244 - DNA, 13 bp, D. melanogaster
aaactggaaactg

SEQ ID NO: 548245 - DNA, 14 bp, D. melanogaster
aaactggaaactgg

SEQ ID NO: 548246 - DNA, 13 bp, D. melanogaster
aaactggaaatgc

SEQ ID NO: 548247 - DNA, 13 bp, D. melanogaster
aaactggaactta

SEQ ID NO: 548248 - DNA, 13 bp, D. melanogaster
aaactggacgtgg

SEQ ID NO: 548249 - DNA, 13 bp, D. melanogaster
aaactggagaaag

SEQ ID NO: 548250 - DNA, 13 bp, D. melanogaster
aaactggagcgcc

SEQ ID NO: 548251 - DNA, 13 bp, D. melanogaster
aaactggaggagg

SEQ ID NO: 548252 - DNA, 14 bp, D. melanogaster
aaactggaggaggc

SEQ ID NO: 548253 - DNA, 13 bp, D. melanogaster
aaactggataata

SEQ ID NO: 548254 - DNA, 13 bp, D. melanogaster
aaactggcaaaca

SEQ ID NO: 548255 - DNA, 13 bp, D. melanogaster
aaactggcaaact

SEQ ID NO: 548256 - DNA, 14 bp, D. melanogaster
aaactggcaaactg

SEQ ID NO: 548257 - DNA, 13 bp, D. melanogaster
aaactggcaaatg

SEQ ID NO: 548258 - DNA, 13 bp, D. melanogaster
aaactggcaactg

SEQ ID NO: 548259 - DNA, 13 bp, D. melanogaster
aaactggcagcca

SEQ ID NO: 548260 - DNA, 13 bp, D. melanogaster
aaactggcgaaaa

SEQ ID NO: 548261 - DNA, 13 bp, D. melanogaster
aaactgggaaaac

SEQ ID NO: 548262 - DNA, 13 bp, D. melanogaster
aaactggggaaaa

SEQ ID NO: 548263 - DNA, 13 bp, D. melanogaster
aaactgggtcaaa

SEQ ID NO: 548264 - DNA, 13 bp, D. melanogaster
aaactggtgtcct

SEQ ID NO: 548265 - DNA, 13 bp, D. melanogaster
aaactgtaagcca

SEQ ID NO: 548266 - DNA, 13 bp, D. melanogaster
aaactgtataaaa

SEQ ID NO: 548267 - DNA, 13 bp, D. melanogaster
aaactgtataatt

SEQ ID NO: 548268 - DNA, 13 bp, D. melanogaster
aaactgtatttaa

SEQ ID NO: 548269 - DNA, 13 bp, D. melanogaster
aaactgtatttat

SEQ ID NO: 548270 - DNA, 13 bp, D. melanogaster
aaactgtcaaaaa

SEQ ID NO: 548271 - DNA, 13 bp, D. melanogaster
aaactgtgaaaaa

SEQ ID NO: 548272 - DNA, 13 bp, D. melanogaster
aaactgtgaaaat

SEQ ID NO: 548273 - DNA, 13 bp, D. melanogaster
aaactgtgcaaat

SEQ ID NO: 548274 - DNA, 13 bp, D. melanogaster
aaactgtgccaag

SEQ ID NO: 548275 - DNA, 13 bp, D. melanogaster
aaactgtggaaat

SEQ ID NO: 548276 - DNA, 13 bp, D. melanogaster
aaactgtggcaaa

SEQ ID NO: 548277 - DNA, 13 bp, D. melanogaster
aaactgtgggaaa

SEQ ID NO: 548278 - DNA, 13 bp, D. melanogaster
aaactgtgtcaaa

SEQ ID NO: 548279 - DNA, 14 bp, D. melanogaster
aaactgtgttcaaa

SEQ ID NO: 548280 - DNA, 13 bp, D. melanogaster
aaactgttaaaca

SEQ ID NO: 548281 - DNA, 13 bp, D. melanogaster
aaactgttcgaaa

SEQ ID NO: 548282 - DNA, 13 bp, D. melanogaster
aaactgttgaaaa

SEQ ID NO: 548283 - DNA, 13 bp, D. melanogaster
aaactgttgccaa

SEQ ID NO: 548284 - DNA, 13 bp, D. melanogaster
aaactgttgtaaa

SEQ ID NO: 548285 - DNA, 14 bp, D. melanogaster
aaactgttgttaaa

SEQ ID NO: 548286 - DNA, 13 bp, D. melanogaster
aaactgtttgatt

SEQ ID NO: 548287 - DNA, 13 bp, D. melanogaster
aaactgtttgcca

SEQ ID NO: 548288 - DNA, 13 bp, D. melanogaster
aaactgtttgctg

SEQ ID NO: 548289 - DNA, 13 bp, D. melanogaster
aaactgttttaaa

SEQ ID NO: 548290 - DNA, 13 bp, D. melanogaster
aaactgttttaat

SEQ ID NO: 548291 - DNA, 13 bp, D. melanogaster
aaactgttttcaa

SEQ ID NO: 548292 - DNA, 13 bp, D. melanogaster
aaactgttttgca

SEQ ID NO: 548293 - DNA, 13 bp, D. melanogaster
aaactgtttttaa

SEQ ID NO: 548294 - DNA, 13 bp, D. melanogaster
aaactgtttttcg

SEQ ID NO: 548295 - DNA, 14 bp, D. melanogaster
aaactgtttttcga

SEQ ID NO: 548296 - DNA, 13 bp, D. melanogaster
aaactgtttttgt

SEQ ID NO: 548297 - DNA, 13 bp, D. melanogaster
aaacttaaaagca

SEQ ID NO: 548298 - DNA, 13 bp, D. melanogaster
aaacttaaaagcc

SEQ ID NO: 548299 - DNA, 14 bp, D. melanogaster
aaacttaaaatttg

SEQ ID NO: 548300 - DNA, 14 bp, D. melanogaster
aaacttaaacattt

SEQ ID NO: 548301 - DNA, 13 bp, D. melanogaster
aaacttaaacttt

SEQ ID NO: 548302 - DNA, 13 bp, D. melanogaster
aaacttaaagcaa

SEQ ID NO: 548303 - DNA, 13 bp, D. melanogaster
aaacttaaagctt

SEQ ID NO: 548304 - DNA, 13 bp, D. melanogaster
aaacttaaatact

SEQ ID NO: 548305 - DNA, 13 bp, D. melanogaster
aaacttaaatgtt

SEQ ID NO: 548306 - DNA, 14 bp, D. melanogaster
aaacttaaatgttt

SEQ ID NO: 548307 - DNA, 13 bp, D. melanogaster
aaacttaaattgc

SEQ ID NO: 548308 - DNA, 13 bp, D. melanogaster
aaacttaaccata

SEQ ID NO: 548309 - DNA, 13 bp, D. melanogaster
aaacttaacttaa

SEQ ID NO: 548310 - DNA, 13 bp, D. melanogaster
aaacttaagattt

SEQ ID NO: 548311 - DNA, 13 bp, D. melanogaster
aaacttaagtaaa

SEQ ID NO: 548312 - DNA, 13 bp, D. melanogaster
aaacttaatagaa

SEQ ID NO: 548313 - DNA, 13 bp, D. melanogaster
aaacttaatgaaa

SEQ ID NO: 548314 - DNA, 13 bp, D. melanogaster
aaacttaattagc

SEQ ID NO: 548315 - DNA, 13 bp, D. melanogaster
aaacttaattagt

SEQ ID NO: 548316 - DNA, 13 bp, D. melanogaster
aaacttaattgca

SEQ ID NO: 548317 - DNA, 13 bp, D. melanogaster
aaacttaattgct

SEQ ID NO: 548318 - DNA, 13 bp, D. melanogaster
aaacttaattgta

SEQ ID NO: 548319 - DNA, 13 bp, D. melanogaster
aaacttaatttca

SEQ ID NO: 548320 - DNA, 13 bp, D. melanogaster
aaacttacgctaa

SEQ ID NO: 548321 - DNA, 13 bp, D. melanogaster
aaacttagttaat

SEQ ID NO: 548322 - DNA, 13 bp, D. melanogaster
aaacttataaatg

SEQ ID NO: 548323 - DNA, 14 bp, D. melanogaster
aaacttatcagcaa

SEQ ID NO: 548324 - DNA, 13 bp, D. melanogaster
aaacttatcattt

SEQ ID NO: 548325 - DNA, 13 bp, D. melanogaster
aaacttatcgact

SEQ ID NO: 548326 - DNA, 13 bp, D. melanogaster
aaacttattcaaa

SEQ ID NO: 548327 - DNA, 13 bp, D. melanogaster
aaacttattgatt

SEQ ID NO: 548328 - DNA, 13 bp, D. melanogaster
aaacttattgttt

SEQ ID NO: 548329 - DNA, 13 bp, D. melanogaster
aaacttatttacc

SEQ ID NO: 548330 - DNA, 13 bp, D. melanogaster
aaacttatttact

SEQ ID NO: 548331 - DNA, 13 bp, D. melanogaster
aaacttatttcaa

SEQ ID NO: 548332 - DNA, 13 bp, D. melanogaster
aaacttatttctt

SEQ ID NO: 548333 - DNA, 13 bp, D. melanogaster
aaacttatttgtt

SEQ ID NO: 548334 - DNA, 13 bp, D. melanogaster
aaacttattttca

SEQ ID NO: 548335 - DNA, 13 bp, D. melanogaster
aaacttcaaaaag

SEQ ID NO: 548336 - DNA, 13 bp, D. melanogaster
aaacttcaaaagc

SEQ ID NO: 548337 - DNA, 13 bp, D. melanogaster
aaacttcaaactt

SEQ ID NO: 548338 - DNA, 13 bp, D. melanogaster
aaacttcaaatga

SEQ ID NO: 548339 - DNA, 13 bp, D. melanogaster
aaacttcaatttc

SEQ ID NO: 548340 - DNA, 13 bp, D. melanogaster
aaacttcagtttt

SEQ ID NO: 548341 - DNA, 13 bp, D. melanogaster
aaacttcattaat

SEQ ID NO: 548342 - DNA, 13 bp, D. melanogaster
aaacttgaaaact

SEQ ID NO: 548343 - DNA, 13 bp, D. melanogaster
aaacttgaaaatg

SEQ ID NO: 548344 - DNA, 13 bp, D. melanogaster
aaacttgaaactt

SEQ ID NO: 548345 - DNA, 13 bp, D. melanogaster
aaacttgaaatga

SEQ ID NO: 548346 - DNA, 13 bp, D. melanogaster
aaacttgaaattt

SEQ ID NO: 548347 - DNA, 13 bp, D. melanogaster
aaacttgaacaaa

SEQ ID NO: 548348 - DNA, 13 bp, D. melanogaster
aaacttgaacttg

SEQ ID NO: 548349 - DNA, 13 bp, D. melanogaster
aaacttgaagaaa

SEQ ID NO: 548350 - DNA, 13 bp, D. melanogaster
aaacttgaataga

SEQ ID NO: 548351 - DNA, 13 bp, D. melanogaster
aaacttgaatgca

SEQ ID NO: 548352 - DNA, 13 bp, D. melanogaster
aaacttgaattaa

SEQ ID NO: 548353 - DNA, 13 bp, D. melanogaster
aaacttgaattct

SEQ ID NO: 548354 - DNA, 13 bp, D. melanogaster
aaacttgaatttt

SEQ ID NO: 548355 - DNA, 13 bp, D. melanogaster
aaacttgacaata

SEQ ID NO: 548356 - DNA, 13 bp, D. melanogaster
aaacttgactatt

SEQ ID NO: 548357 - DNA, 14 bp, D. melanogaster
aaacttgagtacat

SEQ ID NO: 548358 - DNA, 13 bp, D. melanogaster
aaacttgataaat

SEQ ID NO: 548359 - DNA, 13 bp, D. melanogaster
aaacttgatattt

SEQ ID NO: 548360 - DNA, 13 bp, D. melanogaster
aaacttgatgaaa

SEQ ID NO: 548361 - DNA, 13 bp, D. melanogaster
aaacttgattttc

SEQ ID NO: 548362 - DNA, 13 bp, D. melanogaster
aaacttgcactgc

SEQ ID NO: 548363 - DNA, 13 bp, D. melanogaster
aaacttggaaatt

SEQ ID NO: 548364 - DNA, 14 bp, D. melanogaster
aaacttggccaaaa

SEQ ID NO: 548365 - DNA, 13 bp, D. melanogaster
aaacttggccaag

SEQ ID NO: 548366 - DNA, 13 bp, D. melanogaster
aaacttggccagc

SEQ ID NO: 548367 - DNA, 13 bp, D. melanogaster
aaacttggccagt

SEQ ID NO: 548368 - DNA, 13 bp, D. melanogaster
aaacttggcgaat

SEQ ID NO: 548369 - DNA, 13 bp, D. melanogaster
aaacttggctaaa

SEQ ID NO: 548370 - DNA, 13 bp, D. melanogaster
aaacttgggaaaa

SEQ ID NO: 548371 - DNA, 13 bp, D. melanogaster
aaacttggtaaaa

SEQ ID NO: 548372 - DNA, 13 bp, D. melanogaster
aaacttgtaatta

SEQ ID NO: 548373 - DNA, 13 bp, D. melanogaster
aaacttgtgaaat

SEQ ID NO: 548374 - DNA, 13 bp, D. melanogaster
aaacttgttcaaa

SEQ ID NO: 548375 - DNA, 13 bp, D. melanogaster
aaacttgtttgaa

SEQ ID NO: 548376 - DNA, 13 bp, D. melanogaster
aaacttgtttgca

SEQ ID NO: 548377 - DNA, 13 bp, D. melanogaster
aaacttgtttgct

SEQ ID NO: 548378 - DNA, 13 bp, D. melanogaster
aaacttgtttgtt

SEQ ID NO: 548379 - DNA, 13 bp, D. melanogaster
aaacttgttttca

SEQ ID NO: 548380 - DNA, 13 bp, D. melanogaster
aaactttaaactc

SEQ ID NO: 548381 - DNA, 13 bp, D. melanogaster
aaactttaaattg

SEQ ID NO: 548382 - DNA, 13 bp, D. melanogaster
aaactttaactaa

SEQ ID NO: 548383 - DNA, 13 bp, D. melanogaster
aaactttaagttt

SEQ ID NO: 548384 - DNA, 13 bp, D. melanogaster
aaactttaatcaa

SEQ ID NO: 548385 - DNA, 13 bp, D. melanogaster
aaactttaatgaa

SEQ ID NO: 548386 - DNA, 13 bp, D. melanogaster
aaactttaatggc

SEQ ID NO: 548387 - DNA, 14 bp, D. melanogaster
aaactttaattgaa

SEQ ID NO: 548388 - DNA, 13 bp, D. melanogaster
aaactttaattgg

SEQ ID NO: 548389 - DNA, 13 bp, D. melanogaster
aaactttaatttc

SEQ ID NO: 548390 - DNA, 13 bp, D. melanogaster
aaactttacaatt

SEQ ID NO: 548391 - DNA, 13 bp, D. melanogaster
aaactttaccaaa

SEQ ID NO: 548392 - DNA, 13 bp, D. melanogaster
aaactttagaaat

SEQ ID NO: 548393 - DNA, 13 bp, D. melanogaster
aaactttagcagt

SEQ ID NO: 548394 - DNA, 13 bp, D. melanogaster
aaactttatactt

SEQ ID NO: 548395 - DNA, 13 bp, D. melanogaster
aaactttatcaaa

SEQ ID NO: 548396 - DNA, 14 bp, D. melanogaster
aaactttatcaaat

SEQ ID NO: 548397 - DNA, 13 bp, D. melanogaster
aaactttatcagt

SEQ ID NO: 548398 - DNA, 13 bp, D. melanogaster
aaactttatcatt

SEQ ID NO: 548399 - DNA, 13 bp, D. melanogaster
aaactttatgaaa

SEQ ID NO: 548400 - DNA, 13 bp, D. melanogaster
aaactttattgca

SEQ ID NO: 548401 - DNA, 13 bp, D. melanogaster
aaactttcaaaga

SEQ ID NO: 548402 - DNA, 13 bp, D. melanogaster
aaactttcaaatg

SEQ ID NO: 548403 - DNA, 13 bp, D. melanogaster
aaactttcactgc

SEQ ID NO: 548404 - DNA, 13 bp, D. melanogaster
aaactttcacttg

SEQ ID NO: 548405 - DNA, 13 bp, D. melanogaster
aaactttcatttt

SEQ ID NO: 548406 - DNA, 13 bp, D. melanogaster
aaactttccaaaa

SEQ ID NO: 548407 - DNA, 13 bp, D. melanogaster
aaactttccaata

SEQ ID NO: 548408 - DNA, 13 bp, D. melanogaster
aaactttccaatt

SEQ ID NO: 548409 - DNA, 13 bp, D. melanogaster
aaactttccatgt

SEQ ID NO: 548410 - DNA, 13 bp, D. melanogaster
aaactttcgattg

SEQ ID NO: 548411 - DNA, 13 bp, D. melanogaster
aaactttcgattt

SEQ ID NO: 548412 - DNA, 13 bp, D. melanogaster
aaactttcgccaa

SEQ ID NO: 548413 - DNA, 13 bp, D. melanogaster
aaactttcgccag

SEQ ID NO: 548414 - DNA, 13 bp, D. melanogaster
aaactttctgcac

SEQ ID NO: 548415 - DNA, 13 bp, D. melanogaster
aaactttctgcca

SEQ ID NO: 548416 - DNA, 13 bp, D. melanogaster
aaactttctgtca

SEQ ID NO: 548417 - DNA, 14 bp, D. melanogaster
aaactttctgtcat

SEQ ID NO: 548418 - DNA, 13 bp, D. melanogaster
aaactttcttaaa

SEQ ID NO: 548419 - DNA, 13 bp, D. melanogaster
aaactttctttaa

SEQ ID NO: 548420 - DNA, 13 bp, D. melanogaster
aaactttgaaaat

SEQ ID NO: 548421 - DNA, 14 bp, D. melanogaster
aaactttgaacttt

SEQ ID NO: 548422 - DNA, 13 bp, D. melanogaster
aaactttgacaca

SEQ ID NO: 548423 - DNA, 13 bp, D. melanogaster
aaactttgacttt

SEQ ID NO: 548424 - DNA, 13 bp, D. melanogaster
aaactttgattta

SEQ ID NO: 548425 - DNA, 14 bp, D. melanogaster
aaactttgatttat

SEQ ID NO: 548426 - DNA, 13 bp, D. melanogaster
aaactttgcacaa

SEQ ID NO: 548427 - DNA, 13 bp, D. melanogaster
aaactttgcactt

SEQ ID NO: 548428 - DNA, 13 bp, D. melanogaster
aaactttgcagac

SEQ ID NO: 548429 - DNA, 13 bp, D. melanogaster
aaactttgcagca

SEQ ID NO: 548430 - DNA, 13 bp, D. melanogaster
aaactttgccaat

SEQ ID NO: 548431 - DNA, 13 bp, D. melanogaster
aaactttgccgct

SEQ ID NO: 548432 - DNA, 13 bp, D. melanogaster
aaactttgctaaa

SEQ ID NO: 548433 - DNA, 13 bp, D. melanogaster
aaactttggataa

SEQ ID NO: 548434 - DNA, 13 bp, D. melanogaster
aaactttggcaat

SEQ ID NO: 548435 - DNA, 13 bp, D. melanogaster
aaactttggcagc

SEQ ID NO: 548436 - DNA, 13 bp, D. melanogaster
aaactttggcatt

SEQ ID NO: 548437 - DNA, 13 bp, D. melanogaster
aaactttggccca

SEQ ID NO: 548438 - DNA, 13 bp, D. melanogaster
aaactttggtgga

SEQ ID NO: 548439 - DNA, 13 bp, D. melanogaster
aaactttgtaaaa

SEQ ID NO: 548440 - DNA, 13 bp, D. melanogaster
aaactttgtattt

SEQ ID NO: 548441 - DNA, 13 bp, D. melanogaster
aaactttgtgcaa

SEQ ID NO: 548442 - DNA, 13 bp, D. melanogaster
aaactttgttaat

SEQ ID NO: 548443 - DNA, 13 bp, D. melanogaster
aaactttgttgca

SEQ ID NO: 548444 - DNA, 13 bp, D. melanogaster
aaactttgtttaa

SEQ ID NO: 548445 - DNA, 13 bp, D. melanogaster
aaactttgtttat

SEQ ID NO: 548446 - DNA, 13 bp, D. melanogaster
aaactttgtttta

SEQ ID NO: 548447 - DNA, 13 bp, D. melanogaster
aaactttgttttg

SEQ ID NO: 548448 - DNA, 13 bp, D. melanogaster
aaactttgttttt

SEQ ID NO: 548449 - DNA, 13 bp, D. melanogaster
aaacttttaaaac

SEQ ID NO: 548450 - DNA, 13 bp, D. melanogaster
aaacttttaaagt

SEQ ID NO: 548451 - DNA, 13 bp, D. melanogaster
aaacttttaaatg

SEQ ID NO: 548452 - DNA, 13 bp, D. melanogaster
aaacttttaagtt

SEQ ID NO: 548453 - DNA, 13 bp, D. melanogaster
aaacttttaattg

SEQ ID NO: 548454 - DNA, 13 bp, D. melanogaster
aaacttttacaaa

SEQ ID NO: 548455 - DNA, 13 bp, D. melanogaster
aaacttttacttt

SEQ ID NO: 548456 - DNA, 13 bp, D. melanogaster
aaacttttagaaa

SEQ ID NO: 548457 - DNA, 13 bp, D. melanogaster
aaacttttagcca

SEQ ID NO: 548458 - DNA, 13 bp, D. melanogaster
aaacttttagctg

SEQ ID NO: 548459 - DNA, 13 bp, D. melanogaster
aaacttttatggc

SEQ ID NO: 548460 - DNA, 13 bp, D. melanogaster
aaacttttattgt

SEQ ID NO: 548461 - DNA, 13 bp, D. melanogaster
aaacttttatttc

SEQ ID NO: 548462 - DNA, 13 bp, D. melanogaster
aaacttttcaaaa

SEQ ID NO: 548463 - DNA, 14 bp, D. melanogaster
aaacttttcaactt

SEQ ID NO: 548464 - DNA, 13 bp, D. melanogaster
aaacttttcaatt

SEQ ID NO: 548465 - DNA, 14 bp, D. melanogaster
aaacttttcaatta

SEQ ID NO: 548466 - DNA, 13 bp, D. melanogaster
aaacttttcagcc

SEQ ID NO: 548467 - DNA, 13 bp, D. melanogaster
aaacttttcatat

SEQ ID NO: 548468 - DNA, 13 bp, D. melanogaster
aaacttttccaaa

SEQ ID NO: 548469 - DNA, 14 bp, D. melanogaster
aaacttttccaaaa

SEQ ID NO: 548470 - DNA, 13 bp, D. melanogaster
aaacttttccaat

SEQ ID NO: 548471 - DNA, 13 bp, D. melanogaster
aaacttttccaca

SEQ ID NO: 548472 - DNA, 13 bp, D. melanogaster
aaacttttccagc

SEQ ID NO: 548473 - DNA, 13 bp, D. melanogaster
aaacttttccatt

SEQ ID NO: 548474 - DNA, 14 bp, D. melanogaster
aaacttttccattt

SEQ ID NO: 548475 - DNA, 13 bp, D. melanogaster
aaacttttccctt

SEQ ID NO: 548476 - DNA, 13 bp, D. melanogaster
aaacttttcgaca

SEQ ID NO: 548477 - DNA, 13 bp, D. melanogaster
aaacttttcgcca

SEQ ID NO: 548478 - DNA, 13 bp, D. melanogaster
aaacttttcgccc

SEQ ID NO: 548479 - DNA, 13 bp, D. melanogaster
aaacttttcgctt

SEQ ID NO: 548480 - DNA, 13 bp, D. melanogaster
aaacttttctaat

SEQ ID NO: 548481 - DNA, 13 bp, D. melanogaster
aaacttttctcaa

SEQ ID NO: 548482 - DNA, 13 bp, D. melanogaster
aaacttttctgca

SEQ ID NO: 548483 - DNA, 13 bp, D. melanogaster
aaacttttctgtt

SEQ ID NO: 548484 - DNA, 13 bp, D. melanogaster
aaacttttcttaa

SEQ ID NO: 548485 - DNA, 13 bp, D. melanogaster
aaacttttgaaaa

SEQ ID NO: 548486 - DNA, 14 bp, D. melanogaster
aaacttttgaaaaa

SEQ ID NO: 548487 - DNA, 13 bp, D. melanogaster
aaacttttgaaca

SEQ ID NO: 548488 - DNA, 13 bp, D. melanogaster
aaacttttgaact

SEQ ID NO: 548489 - DNA, 13 bp, D. melanogaster
aaacttttgataa

SEQ ID NO: 548490 - DNA, 13 bp, D. melanogaster
aaacttttgcaaa

SEQ ID NO: 548491 - DNA, 14 bp, D. melanogaster
aaacttttgcaaaa

SEQ ID NO: 548492 - DNA, 14 bp, D. melanogaster
aaacttttgcaatt

SEQ ID NO: 548493 - DNA, 13 bp, D. melanogaster
aaacttttgcagc

SEQ ID NO: 548494 - DNA, 13 bp, D. melanogaster
aaacttttgcatt

SEQ ID NO: 548495 - DNA, 14 bp, D. melanogaster
aaacttttgccaac

SEQ ID NO: 548496 - DNA, 13 bp, D. melanogaster
aaacttttgccac

SEQ ID NO: 548497 - DNA, 14 bp, D. melanogaster
aaacttttgccaca

SEQ ID NO: 548498 - DNA, 13 bp, D. melanogaster
aaacttttgccag

SEQ ID NO: 548499 - DNA, 13 bp, D. melanogaster
aaacttttgccat

SEQ ID NO: 548500 - DNA, 13 bp, D. melanogaster
aaacttttgcctg

SEQ ID NO: 548501 - DNA, 13 bp, D. melanogaster
aaacttttgcggc

SEQ ID NO: 548502 - DNA, 13 bp, D. melanogaster
aaacttttgcttg

SEQ ID NO: 548503 - DNA, 13 bp, D. melanogaster
aaacttttggcag

SEQ ID NO: 548504 - DNA, 13 bp, D. melanogaster
aaacttttggcca

SEQ ID NO: 548505 - DNA, 13 bp, D. melanogaster
aaacttttggccc

SEQ ID NO: 548506 - DNA, 13 bp, D. melanogaster
aaacttttggttt

SEQ ID NO: 548507 - DNA, 13 bp, D. melanogaster
aaacttttgtaaa

SEQ ID NO: 548508 - DNA, 13 bp, D. melanogaster
aaacttttgtgcc

SEQ ID NO: 548509 - DNA, 13 bp, D. melanogaster
aaacttttgttat

SEQ ID NO: 548510 - DNA, 13 bp, D. melanogaster
aaacttttgtttt

SEQ ID NO: 548511 - DNA, 13 bp, D. melanogaster
aaactttttaaag

SEQ ID NO: 548512 - DNA, 14 bp, D. melanogaster
aaactttttaaatg

SEQ ID NO: 548513 - DNA, 13 bp, D. melanogaster
aaactttttagaa

SEQ ID NO: 548514 - DNA, 13 bp, D. melanogaster
aaactttttagtt

SEQ ID NO: 548515 - DNA, 13 bp, D. melanogaster
aaactttttccca

SEQ ID NO: 548516 - DNA, 14 bp, D. melanogaster
aaactttttcgatt

SEQ ID NO: 548517 - DNA, 13 bp, D. melanogaster
aaactttttcgtt

SEQ ID NO: 548518 - DNA, 13 bp, D. melanogaster
aaactttttgata

SEQ ID NO: 548519 - DNA, 13 bp, D. melanogaster
aaactttttgatt

SEQ ID NO: 548520 - DNA, 13 bp, D. melanogaster
aaactttttgcca

SEQ ID NO: 548521 - DNA, 14 bp, D. melanogaster
aaactttttgcttt

SEQ ID NO: 548522 - DNA, 13 bp, D. melanogaster
aaactttttggca

SEQ ID NO: 548523 - DNA, 13 bp, D. melanogaster
aaactttttggcc

SEQ ID NO: 548524 - DNA, 14 bp, D. melanogaster
aaactttttggcca

SEQ ID NO: 548525 - DNA, 13 bp, D. melanogaster
aaactttttgttt

SEQ ID NO: 548526 - DNA, 13 bp, D. melanogaster
aaacttttttcac

SEQ ID NO: 548527 - DNA, 13 bp, D. melanogaster
aaacttttttgat

SEQ ID NO: 548528 - DNA, 14 bp, D. melanogaster
aaagaaaaacattt

SEQ ID NO: 548529 - DNA, 13 bp, D. melanogaster
aaagaaaaacctg

SEQ ID NO: 548530 - DNA, 13 bp, D. melanogaster
aaagaaaaactgg

SEQ ID NO: 548531 - DNA, 13 bp, D. melanogaster
aaagaaaaacttt

SEQ ID NO: 548532 - DNA, 14 bp, D. melanogaster
aaagaaaaactttt

SEQ ID NO: 548533 - DNA, 13 bp, D. melanogaster
aaagaaaaatctt

SEQ ID NO: 548534 - DNA, 13 bp, D. melanogaster
aaagaaaaattcc

SEQ ID NO: 548535 - DNA, 14 bp, D. melanogaster
aaagaaaacaattt

SEQ ID NO: 548536 - DNA, 13 bp, D. melanogaster
aaagaaaacattg

SEQ ID NO: 548537 - DNA, 14 bp, D. melanogaster
aaagaaaacatttc

SEQ ID NO: 548538 - DNA, 13 bp, D. melanogaster
aaagaaaaccact

SEQ ID NO: 548539 - DNA, 13 bp, D. melanogaster
aaagaaaaccatt

SEQ ID NO: 548540 - DNA, 13 bp, D. melanogaster
aaagaaaacccat

SEQ ID NO: 548541 - DNA, 13 bp, D. melanogaster
aaagaaaaccttt

SEQ ID NO: 548542 - DNA, 13 bp, D. melanogaster
aaagaaaacgctg

SEQ ID NO: 548543 - DNA, 13 bp, D. melanogaster
aaagaaaactcga

SEQ ID NO: 548544 - DNA, 13 bp, D. melanogaster
aaagaaaactgga

SEQ ID NO: 548545 - DNA, 13 bp, D. melanogaster
aaagaaaacttta

SEQ ID NO: 548546 - DNA, 14 bp, D. melanogaster
aaagaaaactttaa

SEQ ID NO: 548547 - DNA, 13 bp, D. melanogaster
aaagaaaactttt

SEQ ID NO: 548548 - DNA, 13 bp, D. melanogaster
aaagaaaagctga

SEQ ID NO: 548549 - DNA, 13 bp, D. melanogaster
aaagaaaagctgc

SEQ ID NO: 548550 - DNA, 13 bp, D. melanogaster
aaagaaaagtgca

SEQ ID NO: 548551 - DNA, 13 bp, D. melanogaster
aaagaaaagtttc

SEQ ID NO: 548552 - DNA, 13 bp, D. melanogaster
aaagaaaatattc

SEQ ID NO: 548553 - DNA, 13 bp, D. melanogaster
aaagaaaatcact

SEQ ID NO: 548554 - DNA, 14 bp, D. melanogaster
aaagaaaatcactt

SEQ ID NO: 548555 - DNA, 13 bp, D. melanogaster
aaagaaaatccat

SEQ ID NO: 548556 - DNA, 13 bp, D. melanogaster
aaagaaaatccca

SEQ ID NO: 548557 - DNA, 13 bp, D. melanogaster
aaagaaaatgcat

SEQ ID NO: 548558 - DNA, 13 bp, D. melanogaster
aaagaaaatgcca

SEQ ID NO: 548559 - DNA, 13 bp, D. melanogaster
aaagaaaatgctg

SEQ ID NO: 548560 - DNA, 14 bp, D. melanogaster
aaagaaaatggcaa

SEQ ID NO: 548561 - DNA, 13 bp, D. melanogaster
aaagaaaatgttt

SEQ ID NO: 548562 - DNA, 14 bp, D. melanogaster
aaagaaaatgtttt

SEQ ID NO: 548563 - DNA, 14 bp, D. melanogaster
aaagaaaattcaat

SEQ ID NO: 548564 - DNA, 13 bp, D. melanogaster
aaagaaaattcag

SEQ ID NO: 548565 - DNA, 14 bp, D. melanogaster
aaagaaaattcagt

SEQ ID NO: 548566 - DNA, 13 bp, D. melanogaster
aaagaaaattcca

SEQ ID NO: 548567 - DNA, 13 bp, D. melanogaster
aaagaaaattcgc

SEQ ID NO: 548568 - DNA, 14 bp, D. melanogaster
aaagaaacatttta

SEQ ID NO: 548569 - DNA, 13 bp, D. melanogaster
aaagaaaccactt

SEQ ID NO: 548570 - DNA, 13 bp, D. melanogaster
aaagaaaccggat

SEQ ID NO: 548571 - DNA, 13 bp, D. melanogaster
aaagaaacgaatt

SEQ ID NO: 548572 - DNA, 13 bp, D. melanogaster
aaagaaactaatt

SEQ ID NO: 548573 - DNA, 13 bp, D. melanogaster
aaagaaactattt

SEQ ID NO: 548574 - DNA, 13 bp, D. melanogaster
aaagaaactcttc

SEQ ID NO: 548575 - DNA, 13 bp, D. melanogaster
aaagaaactgaat

SEQ ID NO: 548576 - DNA, 13 bp, D. melanogaster
aaagaaactggaa

SEQ ID NO: 548577 - DNA, 13 bp, D. melanogaster
aaagaaacttatt

SEQ ID NO: 548578 - DNA, 13 bp, D. melanogaster
aaagaaactttat

SEQ ID NO: 548579 - DNA, 13 bp, D. melanogaster
aaagaaagccatt

SEQ ID NO: 548580 - DNA, 13 bp, D. melanogaster
aaagaaagtgcaa

SEQ ID NO: 548581 - DNA, 14 bp, D. melanogaster
aaagaaagtgcatt

SEQ ID NO: 548582 - DNA, 13 bp, D. melanogaster
aaagaaagtttta

SEQ ID NO: 548583 - DNA, 13 bp, D. melanogaster
aaagaaagttttc

SEQ ID NO: 548584 - DNA, 13 bp, D. melanogaster
aaagaaatacatt

SEQ ID NO: 548585 - DNA, 13 bp, D. melanogaster
aaagaaatagctt

SEQ ID NO: 548586 - DNA, 14 bp, D. melanogaster
aaagaaatagcttc

SEQ ID NO: 548587 - DNA, 13 bp, D. melanogaster
aaagaaatatctt

SEQ ID NO: 548588 - DNA, 13 bp, D. melanogaster
aaagaaatatgtt

SEQ ID NO: 548589 - DNA, 14 bp, D. melanogaster
aaagaaatatgttt

SEQ ID NO: 548590 - DNA, 13 bp, D. melanogaster
aaagaaatcatac

SEQ ID NO: 548591 - DNA, 14 bp, D. melanogaster
aaagaaatcatact

SEQ ID NO: 548592 - DNA, 14 bp, D. melanogaster
aaagaaatcatttt

SEQ ID NO: 548593 - DNA, 13 bp, D. melanogaster
aaagaaatccaat

SEQ ID NO: 548594 - DNA, 13 bp, D. melanogaster
aaagaaatcgaat

SEQ ID NO: 548595 - DNA, 13 bp, D. melanogaster
aaagaaatcgctg

SEQ ID NO: 548596 - DNA, 13 bp, D. melanogaster
aaagaaatctata

SEQ ID NO: 548597 - DNA, 13 bp, D. melanogaster
aaagaaatcttaa

SEQ ID NO: 548598 - DNA, 13 bp, D. melanogaster
aaagaaatcttta

SEQ ID NO: 548599 - DNA, 13 bp, D. melanogaster
aaagaaatgcaca

SEQ ID NO: 548600 - DNA, 13 bp, D. melanogaster
aaagaaatgcaga

SEQ ID NO: 548601 - DNA, 13 bp, D. melanogaster
aaagaaatgcata

SEQ ID NO: 548602 - DNA, 13 bp, D. melanogaster
aaagaaatgcatt

SEQ ID NO: 548603 - DNA, 14 bp, D. melanogaster
aaagaaatgcattt

SEQ ID NO: 548604 - DNA, 13 bp, D. melanogaster
aaagaaatgccaa

SEQ ID NO: 548605 - DNA, 13 bp, D. melanogaster
aaagaaatgcgaa

SEQ ID NO: 548606 - DNA, 13 bp, D. melanogaster
aaagaaatggcca

SEQ ID NO: 548607 - DNA, 13 bp, D. melanogaster
aaagaaatgtgat

SEQ ID NO: 548608 - DNA, 13 bp, D. melanogaster
aaagaaatgtgca

SEQ ID NO: 548609 - DNA, 13 bp, D. melanogaster
aaagaaattcaag

SEQ ID NO: 548610 - DNA, 14 bp, D. melanogaster
aaagaaattcattt

SEQ ID NO: 548611 - DNA, 13 bp, D. melanogaster
aaagaaattccat

SEQ ID NO: 548612 - DNA, 13 bp, D. melanogaster
aaagaaattgatt

SEQ ID NO: 548613 - DNA, 13 bp, D. melanogaster
aaagaaattgcca

SEQ ID NO: 548614 - DNA, 13 bp, D. melanogaster
aaagaaattggtt

SEQ ID NO: 548615 - DNA, 14 bp, D. melanogaster
aaagaaatttcaaa

SEQ ID NO: 548616 - DNA, 13 bp, D. melanogaster
aaagaaatttcca

SEQ ID NO: 548617 - DNA, 13 bp, D. melanogaster
aaagaaatttctt

SEQ ID NO: 548618 - DNA, 13 bp, D. melanogaster
aaagaaatttttg

SEQ ID NO: 548619 - DNA, 13 bp, D. melanogaster
aaagaacaattgg

SEQ ID NO: 548620 - DNA, 13 bp, D. melanogaster
aaagaacaatttt

SEQ ID NO: 548621 - DNA, 13 bp, D. melanogaster
aaagaacacattt

SEQ ID NO: 548622 - DNA, 13 bp, D. melanogaster
aaagaacatttaa

SEQ ID NO: 548623 - DNA, 13 bp, D. melanogaster
aaagaacttcatt

SEQ ID NO: 548624 - DNA, 13 bp, D. melanogaster
aaagaacttctaa

SEQ ID NO: 548625 - DNA, 13 bp, D. melanogaster
aaagaactttggc

SEQ ID NO: 548626 - DNA, 13 bp, D. melanogaster
aaagaagacatta

SEQ ID NO: 548627 - DNA, 13 bp, D. melanogaster
aaagaagaggatc

SEQ ID NO: 548628 - DNA, 13 bp, D. melanogaster
aaagaagccaact

SEQ ID NO: 548629 - DNA, 13 bp, D. melanogaster
aaagaagccaccg

SEQ ID NO: 548630 - DNA, 13 bp, D. melanogaster
aaagaagcgtttc

SEQ ID NO: 548631 - DNA, 13 bp, D. melanogaster
aaagaagctgaag

SEQ ID NO: 548632 - DNA, 13 bp, D. melanogaster
aaagaagctgggt

SEQ ID NO: 548633 - DNA, 13 bp, D. melanogaster
aaagaaggaaact

SEQ ID NO: 548634 - DNA, 13 bp, D. melanogaster
aaagaagtcgaca

SEQ ID NO: 548635 - DNA, 13 bp, D. melanogaster
aaagaagtgattt

SEQ ID NO: 548636 - DNA, 14 bp, D. melanogaster
aaagaagtgatttt

SEQ ID NO: 548637 - DNA, 13 bp, D. melanogaster
aaagaagtgctgc

SEQ ID NO: 548638 - DNA, 13 bp, D. melanogaster
aaagaagttttta

SEQ ID NO: 548639 - DNA, 13 bp, D. melanogaster
aaagaagtttttt

SEQ ID NO: 548640 - DNA, 13 bp, D. melanogaster
aaagaatatgcta

SEQ ID NO: 548641 - DNA, 13 bp, D. melanogaster
aaagaatatgttt

SEQ ID NO: 548642 - DNA, 14 bp, D. melanogaster
aaagaatatgttta

SEQ ID NO: 548643 - DNA, 13 bp, D. melanogaster
aaagaatcactca

SEQ ID NO: 548644 - DNA, 13 bp, D. melanogaster
aaagaatctatta

SEQ ID NO: 548645 - DNA, 14 bp, D. melanogaster
aaagaatctgtatt

SEQ ID NO: 548646 - DNA, 13 bp, D. melanogaster
aaagaatgaaact

SEQ ID NO: 548647 - DNA, 13 bp, D. melanogaster
aaagaatgccaaa

SEQ ID NO: 548648 - DNA, 13 bp, D. melanogaster
aaagaattcaata

SEQ ID NO: 548649 - DNA, 13 bp, D. melanogaster
aaagaattcgaat

SEQ ID NO: 548650 - DNA, 13 bp, D. melanogaster
aaagaattgattt

SEQ ID NO: 548651 - DNA, 14 bp, D. melanogaster
aaagaattgattta

SEQ ID NO: 548652 - DNA, 14 bp, D. melanogaster
aaagaatttcaaaa

SEQ ID NO: 548653 - DNA, 13 bp, D. melanogaster
aaagaatttcaat

SEQ ID NO: 548654 - DNA, 13 bp, D. melanogaster
aaagaatttcacc

SEQ ID NO: 548655 - DNA, 13 bp, D. melanogaster
aaagaatttcttt

SEQ ID NO: 548656 - DNA, 13 bp, D. melanogaster
aaagaatttgcgg

SEQ ID NO: 548657 - DNA, 13 bp, D. melanogaster
aaagaatttgtat

SEQ ID NO: 548658 - DNA, 13 bp, D. melanogaster
aaagaatttgttt

SEQ ID NO: 548659 - DNA, 14 bp, D. melanogaster
aaagaatttgttta

SEQ ID NO: 548660 - DNA, 13 bp, D. melanogaster
aaagaattttctt

SEQ ID NO: 548661 - DNA, 13 bp, D. melanogaster
aaagaattttgca

SEQ ID NO: 548662 - DNA, 13 bp, D. melanogaster
aaagaattttttc

SEQ ID NO: 548663 - DNA, 13 bp, D. melanogaster
aaagacaaacttt

SEQ ID NO: 548664 - DNA, 13 bp, D. melanogaster
aaagacaacattt

SEQ ID NO: 548665 - DNA, 13 bp, D. melanogaster
aaagacactagaa

SEQ ID NO: 548666 - DNA, 13 bp, D. melanogaster
aaagacatagaat

SEQ ID NO: 548667 - DNA, 13 bp, D. melanogaster
aaagacattaaat

SEQ ID NO: 548668 - DNA, 13 bp, D. melanogaster
aaagacattagaa

SEQ ID NO: 548669 - DNA, 13 bp, D. melanogaster
aaagacatttaaa

SEQ ID NO: 548670 - DNA, 13 bp, D. melanogaster
aaagacatttatt

SEQ ID NO: 548671 - DNA, 13 bp, D. melanogaster
aaagaccaaaatt

SEQ ID NO: 548672 - DNA, 13 bp, D. melanogaster
aaagacggcattt

SEQ ID NO: 548673 - DNA, 13 bp, D. melanogaster
aaagactaaaagg

SEQ ID NO: 548674 - DNA, 15 bp, D. melanogaster
aaagactcaggcaac

SEQ ID NO: 548675 - DNA, 13 bp, D. melanogaster
aaagactccaata

SEQ ID NO: 548676 - DNA, 13 bp, D. melanogaster
aaagactctgctg

SEQ ID NO: 548677 - DNA, 13 bp, D. melanogaster
aaagactgccgaa

SEQ ID NO: 548678 - DNA, 13 bp, D. melanogaster
aaagactgcgaat

SEQ ID NO: 548679 - DNA, 13 bp, D. melanogaster
aaagacttaagac

SEQ ID NO: 548680 - DNA, 13 bp, D. melanogaster
aaagacttacaat

SEQ ID NO: 548681 - DNA, 13 bp, D. melanogaster
aaagacttacatg

SEQ ID NO: 548682 - DNA, 19 bp, D. melanogaster
aaagacttaggcaacgaac

SEQ ID NO: 548683 - DNA, 13 bp, D. melanogaster
aaagactttaaaa

SEQ ID NO: 548684 - DNA, 13 bp, D. melanogaster
aaagacttttcaa

SEQ ID NO: 548685 - DNA, 14 bp, D. melanogaster
aaagagaaccatca

SEQ ID NO: 548686 - DNA, 13 bp, D. melanogaster
aaagagaacttta

SEQ ID NO: 548687 - DNA, 13 bp, D. melanogaster
aaagagaatattt

SEQ ID NO: 548688 - DNA, 13 bp, D. melanogaster
aaagagaattttc

SEQ ID NO: 548689 - DNA, 13 bp, D. melanogaster
aaagagacggagc

SEQ ID NO: 548690 - DNA, 13 bp, D. melanogaster
aaagagacggcag

SEQ ID NO: 548691 - DNA, 13 bp, D. melanogaster
aaagagagcaatt

SEQ ID NO: 548692 - DNA, 14 bp, D. melanogaster
aaagagagcaattt

SEQ ID NO: 548693 - DNA, 14 bp, D. melanogaster
aaagagagccggcg

SEQ ID NO: 548694 - DNA, 13 bp, D. melanogaster
aaagagagcgcca

SEQ ID NO: 548695 - DNA, 13 bp, D. melanogaster
aaagagagcgcga

SEQ ID NO: 548696 - DNA, 13 bp, D. melanogaster
aaagagagtaatt

SEQ ID NO: 548697 - DNA, 13 bp, D. melanogaster
aaagagagtgcag

SEQ ID NO: 548698 - DNA, 14 bp, D. melanogaster
aaagagagtgcagt

SEQ ID NO: 548699 - DNA, 13 bp, D. melanogaster
aaagagattttca

SEQ ID NO: 548700 - DNA, 14 bp, D. melanogaster
aaagagcaaacaat

SEQ ID NO: 548701 - DNA, 13 bp, D. melanogaster
aaagagcaacagc

SEQ ID NO: 548702 - DNA, 13 bp, D. melanogaster
aaagagcacgaag

SEQ ID NO: 548703 - DNA, 14 bp, D. melanogaster
aaagagcacgaagc

SEQ ID NO: 548704 - DNA, 13 bp, D. melanogaster
aaagagccagtgc

SEQ ID NO: 548705 - DNA, 13 bp, D. melanogaster
aaagagccataaa

SEQ ID NO: 548706 - DNA, 13 bp, D. melanogaster
aaagagcgaaata

SEQ ID NO: 548707 - DNA, 13 bp, D. melanogaster
aaagagcggcaaa

SEQ ID NO: 548708 - DNA, 13 bp, D. melanogaster
aaagagctcaaaa

SEQ ID NO: 548709 - DNA, 13 bp, D. melanogaster
aaagagctgaaaa

SEQ ID NO: 548710 - DNA, 13 bp, D. melanogaster
aaagagctggaag

SEQ ID NO: 548711 - DNA, 13 bp, D. melanogaster
aaagagctgttcg

SEQ ID NO: 548712 - DNA, 13 bp, D. melanogaster
aaagagcttaaaa

SEQ ID NO: 548713 - DNA, 13 bp, D. melanogaster
aaagagcttttca

SEQ ID NO: 548714 - DNA, 13 bp, D. melanogaster
aaagaggcaagac

SEQ ID NO: 548715 - DNA, 13 bp, D. melanogaster
aaagaggcaattg

SEQ ID NO: 548716 - DNA, 13 bp, D. melanogaster
aaagaggttactt

SEQ ID NO: 548717 - DNA, 13 bp, D. melanogaster
aaagagtattttt

SEQ ID NO: 548718 - DNA, 13 bp, D. melanogaster
aaagagttaaagg

SEQ ID NO: 548719 - DNA, 13 bp, D. melanogaster
aaagagttagatc

SEQ ID NO: 548720 - DNA, 13 bp, D. melanogaster
aaagagttggaaa

SEQ ID NO: 548721 - DNA, 13 bp, D. melanogaster
aaagagttggcaa

SEQ ID NO: 548722 - DNA, 13 bp, D. melanogaster
aaagagttggcca

SEQ ID NO: 548723 - DNA, 13 bp, D. melanogaster
aaagagtttaaag

SEQ ID NO: 548724 - DNA, 13 bp, D. melanogaster
aaagagtttgcaa

SEQ ID NO: 548725 - DNA, 13 bp, D. melanogaster
aaagagtttttat

SEQ ID NO: 548726 - DNA, 13 bp, D. melanogaster
aaagagttttttt

SEQ ID NO: 548727 - DNA, 14 bp, D. melanogaster
aaagataaaaacgt

SEQ ID NO: 548728 - DNA, 13 bp, D. melanogaster
aaagataaaacgc

SEQ ID NO: 548729 - DNA, 14 bp, D. melanogaster
aaagataaaacgca

SEQ ID NO: 548730 - DNA, 13 bp, D. melanogaster
aaagatacaaagt

SEQ ID NO: 548731 - DNA, 13 bp, D. melanogaster
aaagatacaaatg

SEQ ID NO: 548732 - DNA, 13 bp, D. melanogaster
aaagatacaactt

SEQ ID NO: 548733 - DNA, 14 bp, D. melanogaster
aaagatacaagata

SEQ ID NO: 548734 - DNA, 13 bp, D. melanogaster
aaagatacagata

SEQ ID NO: 548735 - DNA, 13 bp, D. melanogaster
aaagatacatata

SEQ ID NO: 548736 - DNA, 14 bp, D. melanogaster
aaagatacatatat

SEQ ID NO: 548737 - DNA, 13 bp, D. melanogaster
aaagatacattta

SEQ ID NO: 548738 - DNA, 13 bp, D. melanogaster
aaagatacttttt

SEQ ID NO: 548739 - DNA, 13 bp, D. melanogaster
aaagatatacata

SEQ ID NO: 548740 - DNA, 14 bp, D. melanogaster
aaagatatacatat

SEQ ID NO: 548741 - DNA, 13 bp, D. melanogaster
aaagatatagatt

SEQ ID NO: 548742 - DNA, 13 bp, D. melanogaster
aaagatatattca

SEQ ID NO: 548743 - DNA, 13 bp, D. melanogaster
aaagatatgaagg

SEQ ID NO: 548744 - DNA, 13 bp, D. melanogaster
aaagatatgcaaa

SEQ ID NO: 548745 - DNA, 13 bp, D. melanogaster
aaagatattcaaa

SEQ ID NO: 548746 - DNA, 13 bp, D. melanogaster
aaagatattgtat

SEQ ID NO: 548747 - DNA, 13 bp, D. melanogaster
aaagatatttcaa

SEQ ID NO: 548748 - DNA, 13 bp, D. melanogaster
aaagatatttcat

SEQ ID NO: 548749 - DNA, 13 bp, D. melanogaster
aaagatattttca

SEQ ID NO: 548750 - DNA, 13 bp, D. melanogaster
aaagatcaaatta

SEQ ID NO: 548751 - DNA, 13 bp, D. melanogaster
aaagatcaagttt

SEQ ID NO: 548752 - DNA, 13 bp, D. melanogaster
aaagatcaccaac

SEQ ID NO: 548753 - DNA, 13 bp, D. melanogaster
aaagatcacttac

SEQ ID NO: 548754 - DNA, 13 bp, D. melanogaster
aaagatccattta

SEQ ID NO: 548755 - DNA, 13 bp, D. melanogaster
aaagatcccattc

SEQ ID NO: 548756 - DNA, 13 bp, D. melanogaster
aaagatcccgttt

SEQ ID NO: 548757 - DNA, 13 bp, D. melanogaster
aaagatcgtgtaa

SEQ ID NO: 548758 - DNA, 13 bp, D. melanogaster
aaagatctgaaaa

SEQ ID NO: 548759 - DNA, 14 bp, D. melanogaster
aaagatctgaaaac

SEQ ID NO: 548760 - DNA, 13 bp, D. melanogaster
aaagatgatgaac

SEQ ID NO: 548761 - DNA, 13 bp, D. melanogaster
aaagatgatgagc

SEQ ID NO: 548762 - DNA, 13 bp, D. melanogaster
aaagatgatgatg

SEQ ID NO: 548763 - DNA, 13 bp, D. melanogaster
aaagatgcaaatg

SEQ ID NO: 548764 - DNA, 13 bp, D. melanogaster
aaagatgcaggaa

SEQ ID NO: 548765 - DNA, 14 bp, D. melanogaster
aaagatgccaaatt

SEQ ID NO: 548766 - DNA, 13 bp, D. melanogaster
aaagatgcggcaa

SEQ ID NO: 548767 - DNA, 13 bp, D. melanogaster
aaagatggcaaga

SEQ ID NO: 548768 - DNA, 14 bp, D. melanogaster
aaagatggcaagaa

SEQ ID NO: 548769 - DNA, 13 bp, D. melanogaster
aaagatgtacata

SEQ ID NO: 548770 - DNA, 13 bp, D. melanogaster
aaagatgtccaac

SEQ ID NO: 548771 - DNA, 14 bp, D. melanogaster
aaagatgttatatc

SEQ ID NO: 548772 - DNA, 13 bp, D. melanogaster
aaagattacattt

SEQ ID NO: 548773 - DNA, 14 bp, D. melanogaster
aaagattatttgtt

SEQ ID NO: 548774 - DNA, 13 bp, D. melanogaster
aaagattcaaata

SEQ ID NO: 548775 - DNA, 14 bp, D. melanogaster
aaagattcaaatat

SEQ ID NO: 548776 - DNA, 13 bp, D. melanogaster
aaagattcattaa

SEQ ID NO: 548777 - DNA, 14 bp, D. melanogaster
aaagattcttttgt

SEQ ID NO: 548778 - DNA, 13 bp, D. melanogaster
aaagattgattat

SEQ ID NO: 548779 - DNA, 13 bp, D. melanogaster
aaagattgatttt

SEQ ID NO: 548780 - DNA, 13 bp, D. melanogaster
aaagattgccaaa

SEQ ID NO: 548781 - DNA, 13 bp, D. melanogaster
aaagattgttaaa

SEQ ID NO: 548782 - DNA, 13 bp, D. melanogaster
aaagatttaaaac

SEQ ID NO: 548783 - DNA, 13 bp, D. melanogaster
aaagatttatgtt

SEQ ID NO: 548784 - DNA, 13 bp, D. melanogaster
aaagatttcaaaa

SEQ ID NO: 548785 - DNA, 13 bp, D. melanogaster
aaagatttcaata

SEQ ID NO: 548786 - DNA, 13 bp, D. melanogaster
aaagatttcagta

SEQ ID NO: 548787 - DNA, 13 bp, D. melanogaster
aaagatttcgaaa

SEQ ID NO: 548788 - DNA, 13 bp, D. melanogaster
aaagatttctggg

SEQ ID NO: 548789 - DNA, 13 bp, D. melanogaster
aaagatttgattt

SEQ ID NO: 548790 - DNA, 13 bp, D. melanogaster
aaagatttgtttg

SEQ ID NO: 548791 - DNA, 13 bp, D. melanogaster
aaagattttcatt

SEQ ID NO: 548792 - DNA, 13 bp, D. melanogaster
aaagcaaaaagct

SEQ ID NO: 548793 - DNA, 13 bp, D. melanogaster
aaagcaaaaagtt

SEQ ID NO: 548794 - DNA, 13 bp, D. melanogaster
aaagcaaaaatgc

SEQ ID NO: 548795 - DNA, 13 bp, D. melanogaster
aaagcaaaaatgt

SEQ ID NO: 548796 - DNA, 13 bp, D. melanogaster
aaagcaaaaattt

SEQ ID NO: 548797 - DNA, 13 bp, D. melanogaster
aaagcaaaacatt

SEQ ID NO: 548798 - DNA, 13 bp, D. melanogaster
aaagcaaaacttt

SEQ ID NO: 548799 - DNA, 14 bp, D. melanogaster
aaagcaaaactttt

SEQ ID NO: 548800 - DNA, 14 bp, D. melanogaster
aaagcaaaagatac

SEQ ID NO: 548801 - DNA, 13 bp, D. melanogaster
aaagcaaaagcat

SEQ ID NO: 548802 - DNA, 13 bp, D. melanogaster
aaagcaaaagctg

SEQ ID NO: 548803 - DNA, 13 bp, D. melanogaster
aaagcaaaagtca

SEQ ID NO: 548804 - DNA, 13 bp, D. melanogaster
aaagcaaaagttc

SEQ ID NO: 548805 - DNA, 13 bp, D. melanogaster
aaagcaaaagttg

SEQ ID NO: 548806 - DNA, 13 bp, D. melanogaster
aaagcaaaagttt

SEQ ID NO: 548807 - DNA, 13 bp, D. melanogaster
aaagcaaaatatt

SEQ ID NO: 548808 - DNA, 14 bp, D. melanogaster
aaagcaaaatgttt

SEQ ID NO: 548809 - DNA, 13 bp, D. melanogaster
aaagcaaaattat

SEQ ID NO: 548810 - DNA, 13 bp, D. melanogaster
aaagcaaaattca

SEQ ID NO: 548811 - DNA, 13 bp, D. melanogaster
aaagcaaaattgt

SEQ ID NO: 548812 - DNA, 14 bp, D. melanogaster
aaagcaaacaaatt

SEQ ID NO: 548813 - DNA, 14 bp, D. melanogaster
aaagcaaacaattt

SEQ ID NO: 548814 - DNA, 13 bp, D. melanogaster
aaagcaaacacat

SEQ ID NO: 548815 - DNA, 13 bp, D. melanogaster
aaagcaaacagct

SEQ ID NO: 548816 - DNA, 13 bp, D. melanogaster
aaagcaaacagtg

SEQ ID NO: 548817 - DNA, 13 bp, D. melanogaster
aaagcaaacagtt

SEQ ID NO: 548818 - DNA, 13 bp, D. melanogaster
aaagcaaacattt

SEQ ID NO: 548819 - DNA, 14 bp, D. melanogaster
aaagcaaacatttt

SEQ ID NO: 548820 - DNA, 13 bp, D. melanogaster
aaagcaaacgatt

SEQ ID NO: 548821 - DNA, 13 bp, D. melanogaster
aaagcaaacgttt

SEQ ID NO: 548822 - DNA, 14 bp, D. melanogaster
aaagcaaacgtttt

SEQ ID NO: 548823 - DNA, 13 bp, D. melanogaster
aaagcaaactgaa

SEQ ID NO: 548824 - DNA, 13 bp, D. melanogaster
aaagcaaacttat

SEQ ID NO: 548825 - DNA, 13 bp, D. melanogaster
aaagcaaacttta

SEQ ID NO: 548826 - DNA, 13 bp, D. melanogaster
aaagcaaactttg

SEQ ID NO: 548827 - DNA, 13 bp, D. melanogaster
aaagcaaagcaat

SEQ ID NO: 548828 - DNA, 13 bp, D. melanogaster
aaagcaaagcagc

SEQ ID NO: 548829 - DNA, 13 bp, D. melanogaster
aaagcaaaggaat

SEQ ID NO: 548830 - DNA, 13 bp, D. melanogaster
aaagcaaagtcaa

SEQ ID NO: 548831 - DNA, 14 bp, D. melanogaster
aaagcaaagtcaaa

SEQ ID NO: 548832 - DNA, 14 bp, D. melanogaster
aaagcaaagtgaaa

SEQ ID NO: 548833 - DNA, 13 bp, D. melanogaster
aaagcaaagttaa

SEQ ID NO: 548834 - DNA, 14 bp, D. melanogaster
aaagcaaataattt

SEQ ID NO: 548835 - DNA, 13 bp, D. melanogaster
aaagcaaatacat

SEQ ID NO: 548836 - DNA, 13 bp, D. melanogaster
aaagcaaatactt

SEQ ID NO: 548837 - DNA, 13 bp, D. melanogaster
aaagcaaatatca

SEQ ID NO: 548838 - DNA, 13 bp, D. melanogaster
aaagcaaatatta

SEQ ID NO: 548839 - DNA, 13 bp, D. melanogaster
aaagcaaatccaa

SEQ ID NO: 548840 - DNA, 13 bp, D. melanogaster
aaagcaaatctaa

SEQ ID NO: 548841 - DNA, 13 bp, D. melanogaster
aaagcaaatgaat

SEQ ID NO: 548842 - DNA, 13 bp, D. melanogaster
aaagcaaatgcaa

SEQ ID NO: 548843 - DNA, 14 bp, D. melanogaster
aaagcaaatgcaaa

SEQ ID NO: 548844 - DNA, 13 bp, D. melanogaster
aaagcaaatgcag

SEQ ID NO: 548845 - DNA, 14 bp, D. melanogaster
aaagcaaatggaaa

SEQ ID NO: 548846 - DNA, 13 bp, D. melanogaster
aaagcaaatggat

SEQ ID NO: 548847 - DNA, 13 bp, D. melanogaster
aaagcaaatgtca

SEQ ID NO: 548848 - DNA, 13 bp, D. melanogaster
aaagcaaatgttt

SEQ ID NO: 548849 - DNA, 13 bp, D. melanogaster
aaagcaaattaag

SEQ ID NO: 548850 - DNA, 13 bp, D. melanogaster
aaagcaaattagt

SEQ ID NO: 548851 - DNA, 13 bp, D. melanogaster
aaagcaaattatg

SEQ ID NO: 548852 - DNA, 13 bp, D. melanogaster
aaagcaaattcaa

SEQ ID NO: 548853 - DNA, 14 bp, D. melanogaster
aaagcaaattcaat

SEQ ID NO: 548854 - DNA, 13 bp, D. melanogaster
aaagcaaattgaa

SEQ ID NO: 548855 - DNA, 13 bp, D. melanogaster
aaagcaaattgct

SEQ ID NO: 548856 - DNA, 13 bp, D. melanogaster
aaagcaaatttac

SEQ ID NO: 548857 - DNA, 13 bp, D. melanogaster
aaagcaaattttt

SEQ ID NO: 548858 - DNA, 14 bp, D. melanogaster
aaagcaaatttttc

SEQ ID NO: 548859 - DNA, 13 bp, D. melanogaster
aaagcaacaaatt

SEQ ID NO: 548860 - DNA, 13 bp, D. melanogaster
aaagcaacaactg

SEQ ID NO: 548861 - DNA, 13 bp, D. melanogaster
aaagcaacaatta

SEQ ID NO: 548862 - DNA, 13 bp, D. melanogaster
aaagcaacagcat

SEQ ID NO: 548863 - DNA, 13 bp, D. melanogaster
aaagcaacatcaa

SEQ ID NO: 548864 - DNA, 13 bp, D. melanogaster
aaagcaacatttt

SEQ ID NO: 548865 - DNA, 13 bp, D. melanogaster
aaagcaaccgcaa

SEQ ID NO: 548866 - DNA, 13 bp, D. melanogaster
aaagcaaccttta

SEQ ID NO: 548867 - DNA, 13 bp, D. melanogaster
aaagcaacgagtt

SEQ ID NO: 548868 - DNA, 13 bp, D. melanogaster
aaagcaactacaa

SEQ ID NO: 548869 - DNA, 13 bp, D. melanogaster
aaagcaactgcaa

SEQ ID NO: 548870 - DNA, 13 bp, D. melanogaster
aaagcaactgttt

SEQ ID NO: 548871 - DNA, 13 bp, D. melanogaster
aaagcaactttca

SEQ ID NO: 548872 - DNA, 13 bp, D. melanogaster
aaagcaactttta

SEQ ID NO: 548873 - DNA, 13 bp, D. melanogaster
aaagcaagaaagt

SEQ ID NO: 548874 - DNA, 13 bp, D. melanogaster
aaagcaagaaatt

SEQ ID NO: 548875 - DNA, 13 bp, D. melanogaster
aaagcaagaattc

SEQ ID NO: 548876 - DNA, 14 bp, D. melanogaster
aaagcaagactcat

SEQ ID NO: 548877 - DNA, 13 bp, D. melanogaster
aaagcaagcaaat

SEQ ID NO: 548878 - DNA, 13 bp, D. melanogaster
aaagcaagctaaa

SEQ ID NO: 548879 - DNA, 13 bp, D. melanogaster
aaagcaagtgaaa

SEQ ID NO: 548880 - DNA, 13 bp, D. melanogaster
aaagcaataaagc

SEQ ID NO: 548881 - DNA, 13 bp, D. melanogaster
aaagcaataaatt

SEQ ID NO: 548882 - DNA, 13 bp, D. melanogaster
aaagcaataatta

SEQ ID NO: 548883 - DNA, 14 bp, D. melanogaster
aaagcaataattaa

SEQ ID NO: 548884 - DNA, 13 bp, D. melanogaster
aaagcaatagcaa

SEQ ID NO: 548885 - DNA, 13 bp, D. melanogaster
aaagcaatatatt

SEQ ID NO: 548886 - DNA, 13 bp, D. melanogaster
aaagcaatatttc

SEQ ID NO: 548887 - DNA, 13 bp, D. melanogaster
aaagcaatcaaat

SEQ ID NO: 548888 - DNA, 13 bp, D. melanogaster
aaagcaatcaatt

SEQ ID NO: 548889 - DNA, 13 bp, D. melanogaster
aaagcaatcagca

SEQ ID NO: 548890 - DNA, 13 bp, D. melanogaster
aaagcaatccaat

SEQ ID NO: 548891 - DNA, 13 bp, D. melanogaster
aaagcaatctaaa

SEQ ID NO: 548892 - DNA, 13 bp, D. melanogaster
aaagcaatctcat

SEQ ID NO: 548893 - DNA, 14 bp, D. melanogaster
aaagcaatctcatc

SEQ ID NO: 548894 - DNA, 13 bp, D. melanogaster
aaagcaatgaaag

SEQ ID NO: 548895 - DNA, 13 bp, D. melanogaster
aaagcaatgcaaa

SEQ ID NO: 548896 - DNA, 14 bp, D. melanogaster
aaagcaatgcaaag

SEQ ID NO: 548897 - DNA, 13 bp, D. melanogaster
aaagcaatgccaa

SEQ ID NO: 548898 - DNA, 13 bp, D. melanogaster
aaagcaatggaaa

SEQ ID NO: 548899 - DNA, 13 bp, D. melanogaster
aaagcaatggcaa

SEQ ID NO: 548900 - DNA, 13 bp, D. melanogaster
aaagcaatgggaa

SEQ ID NO: 548901 - DNA, 13 bp, D. melanogaster
aaagcaattaata

SEQ ID NO: 548902 - DNA, 13 bp, D. melanogaster
aaagcaattacaa

SEQ ID NO: 548903 - DNA, 13 bp, D. melanogaster
aaagcaattactt

SEQ ID NO: 548904 - DNA, 13 bp, D. melanogaster
aaagcaattagca

SEQ ID NO: 548905 - DNA, 13 bp, D. melanogaster
aaagcaattatat

SEQ ID NO: 548906 - DNA, 13 bp, D. melanogaster
aaagcaattcaaa

SEQ ID NO: 548907 - DNA, 13 bp, D. melanogaster
aaagcaattcaat

SEQ ID NO: 548908 - DNA, 13 bp, D. melanogaster
aaagcaattgaaa

SEQ ID NO: 548909 - DNA, 14 bp, D. melanogaster
aaagcaattgaaaa

SEQ ID NO: 548910 - DNA, 13 bp, D. melanogaster
aaagcaattgcag

SEQ ID NO: 548911 - DNA, 13 bp, D. melanogaster
aaagcaattgttt

SEQ ID NO: 548912 - DNA, 13 bp, D. melanogaster
aaagcaatttaaa

SEQ ID NO: 548913 - DNA, 14 bp, D. melanogaster
aaagcaatttaaat

SEQ ID NO: 548914 - DNA, 13 bp, D. melanogaster
aaagcaatttatg

SEQ ID NO: 548915 - DNA, 14 bp, D. melanogaster
aaagcaatttattt

SEQ ID NO: 548916 - DNA, 13 bp, D. melanogaster
aaagcaatttcaa

SEQ ID NO: 548917 - DNA, 13 bp, D. melanogaster
aaagcaatttcca

SEQ ID NO: 548918 - DNA, 13 bp, D. melanogaster
aaagcaatttctt

SEQ ID NO: 548919 - DNA, 13 bp, D. melanogaster
aaagcaatttgaa

SEQ ID NO: 548920 - DNA, 13 bp, D. melanogaster
aaagcaatttggc

SEQ ID NO: 548921 - DNA, 14 bp, D. melanogaster
aaagcaattttaaa

SEQ ID NO: 548922 - DNA, 13 bp, D. melanogaster
aaagcaattttat

SEQ ID NO: 548923 - DNA, 13 bp, D. melanogaster
aaagcaattttcc

SEQ ID NO: 548924 - DNA, 13 bp, D. melanogaster
aaagcaattttcg

SEQ ID NO: 548925 - DNA, 13 bp, D. melanogaster
aaagcaattttct

SEQ ID NO: 548926 - DNA, 13 bp, D. melanogaster
aaagcacaaaagt

SEQ ID NO: 548927 - DNA, 13 bp, D. melanogaster
aaagcacacggtg

SEQ ID NO: 548928 - DNA, 13 bp, D. melanogaster
aaagcacatgctt

SEQ ID NO: 548929 - DNA, 13 bp, D. melanogaster
aaagcacatttat

SEQ ID NO: 548930 - DNA, 13 bp, D. melanogaster
aaagcacattttt

SEQ ID NO: 548931 - DNA, 13 bp, D. melanogaster
aaagcaccaaagc

SEQ ID NO: 548932 - DNA, 13 bp, D. melanogaster
aaagcactcaaaa

SEQ ID NO: 548933 - DNA, 13 bp, D. melanogaster
aaagcactcgaaa

SEQ ID NO: 548934 - DNA, 13 bp, D. melanogaster
aaagcactgaaat

SEQ ID NO: 548935 - DNA, 13 bp, D. melanogaster
aaagcacttaaaa

SEQ ID NO: 548936 - DNA, 13 bp, D. melanogaster
aaagcacttcaaa

SEQ ID NO: 548937 - DNA, 13 bp, D. melanogaster
aaagcacttgagg

SEQ ID NO: 548938 - DNA, 13 bp, D. melanogaster
aaagcagaaaatt

SEQ ID NO: 548939 - DNA, 13 bp, D. melanogaster
aaagcagaagcag

SEQ ID NO: 548940 - DNA, 13 bp, D. melanogaster
aaagcagagcaga

SEQ ID NO: 548941 - DNA, 13 bp, D. melanogaster
aaagcagagcagc

SEQ ID NO: 548942 - DNA, 13 bp, D. melanogaster
aaagcagatgaaa

SEQ ID NO: 548943 - DNA, 14 bp, D. melanogaster
aaagcagcaaaagc

SEQ ID NO: 548944 - DNA, 13 bp, D. melanogaster
aaagcagcaaacg

SEQ ID NO: 548945 - DNA, 13 bp, D. melanogaster
aaagcagcaaagc

SEQ ID NO: 548946 - DNA, 13 bp, D. melanogaster
aaagcagcaaatt

SEQ ID NO: 548947 - DNA, 13 bp, D. melanogaster
aaagcagcaacat

SEQ ID NO: 548948 - DNA, 13 bp, D. melanogaster
aaagcagcaaggg

SEQ ID NO: 548949 - DNA, 13 bp, D. melanogaster
aaagcagcacaca

SEQ ID NO: 548950 - DNA, 13 bp, D. melanogaster
aaagcagcagcaa

SEQ ID NO: 548951 - DNA, 14 bp, D. melanogaster
aaagcagcagcaaa

SEQ ID NO: 548952 - DNA, 14 bp, D. melanogaster
aaagcagcagcaac

SEQ ID NO: 548953 - DNA, 13 bp, D. melanogaster
aaagcagcagcac

SEQ ID NO: 548954 - DNA, 13 bp, D. melanogaster
aaagcagcagcat

SEQ ID NO: 548955 - DNA, 13 bp, D. melanogaster
aaagcagcagctg

SEQ ID NO: 548956 - DNA, 13 bp, D. melanogaster
aaagcagcaggag

SEQ ID NO: 548957 - DNA, 13 bp, D. melanogaster
aaagcagcattca

SEQ ID NO: 548958 - DNA, 13 bp, D. melanogaster
aaagcagccaaac

SEQ ID NO: 548959 - DNA, 13 bp, D. melanogaster
aaagcagccaaat

SEQ ID NO: 548960 - DNA, 13 bp, D. melanogaster
aaagcagccagaa

SEQ ID NO: 548961 - DNA, 13 bp, D. melanogaster
aaagcagccagca

SEQ ID NO: 548962 - DNA, 13 bp, D. melanogaster
aaagcagccagtt

SEQ ID NO: 548963 - DNA, 13 bp, D. melanogaster
aaagcagccgaaa

SEQ ID NO: 548964 - DNA, 13 bp, D. melanogaster
aaagcagccgcaa

SEQ ID NO: 548965 - DNA, 13 bp, D. melanogaster
aaagcagcgcaaa

SEQ ID NO: 548966 - DNA, 13 bp, D. melanogaster
aaagcagctcaaa

SEQ ID NO: 548967 - DNA, 13 bp, D. melanogaster
aaagcagctgcaa

SEQ ID NO: 548968 - DNA, 13 bp, D. melanogaster
aaagcagctggaa

SEQ ID NO: 548969 - DNA, 13 bp, D. melanogaster
aaagcagctttaa

SEQ ID NO: 548970 - DNA, 13 bp, D. melanogaster
aaagcaggaaagc

SEQ ID NO: 548971 - DNA, 13 bp, D. melanogaster
aaagcaggcgaaa

SEQ ID NO: 548972 - DNA, 13 bp, D. melanogaster
aaagcaggcgaac

SEQ ID NO: 548973 - DNA, 13 bp, D. melanogaster
aaagcagggcaaa

SEQ ID NO: 548974 - DNA, 13 bp, D. melanogaster
aaagcaggtgaaa

SEQ ID NO: 548975 - DNA, 13 bp, D. melanogaster
aaagcagtgcaaa

SEQ ID NO: 548976 - DNA, 13 bp, D. melanogaster
aaagcagtggaaa

SEQ ID NO: 548977 - DNA, 14 bp, D. melanogaster
aaagcagtggaaaa

SEQ ID NO: 548978 - DNA, 13 bp, D. melanogaster
aaagcataaaagc

SEQ ID NO: 548979 - DNA, 13 bp, D. melanogaster
aaagcataaatca

SEQ ID NO: 548980 - DNA, 13 bp, D. melanogaster
aaagcataaattt

SEQ ID NO: 548981 - DNA, 13 bp, D. melanogaster
aaagcataattaa

SEQ ID NO: 548982 - DNA, 13 bp, D. melanogaster
aaagcatataaat

SEQ ID NO: 548983 - DNA, 13 bp, D. melanogaster
aaagcatatatgt

SEQ ID NO: 548984 - DNA, 13 bp, D. melanogaster
aaagcatattcaa

SEQ ID NO: 548985 - DNA, 13 bp, D. melanogaster
aaagcatattgaa

SEQ ID NO: 548986 - DNA, 13 bp, D. melanogaster
aaagcatatttaa

SEQ ID NO: 548987 - DNA, 13 bp, D. melanogaster
aaagcatattttc

SEQ ID NO: 548988 - DNA, 13 bp, D. melanogaster
aaagcatcagtta

SEQ ID NO: 548989 - DNA, 13 bp, D. melanogaster
aaagcatgaaaat

SEQ ID NO: 548990 - DNA, 13 bp, D. melanogaster
aaagcatgcaaca

SEQ ID NO: 548991 - DNA, 13 bp, D. melanogaster
aaagcatgctttt

SEQ ID NO: 548992 - DNA, 13 bp, D. melanogaster
aaagcattaaaca

SEQ ID NO: 548993 - DNA, 13 bp, D. melanogaster
aaagcattaaata

SEQ ID NO: 548994 - DNA, 13 bp, D. melanogaster
aaagcattaaatt

SEQ ID NO: 548995 - DNA, 13 bp, D. melanogaster
aaagcattcaaaa

SEQ ID NO: 548996 - DNA, 13 bp, D. melanogaster
aaagcattcgaaa

SEQ ID NO: 548997 - DNA, 14 bp, D. melanogaster
aaagcatttaaaat

SEQ ID NO: 548998 - DNA, 13 bp, D. melanogaster
aaagcatttaaat

SEQ ID NO: 548999 - DNA, 14 bp, D. melanogaster
aaagcatttaaatt

SEQ ID NO: 549000 - DNA, 13 bp, D. melanogaster
aaagcatttaaca

SEQ ID NO: 549001 - DNA, 13 bp, D. melanogaster
aaagcatttaagc

SEQ ID NO: 549002 - DNA, 13 bp, D. melanogaster
aaagcatttaatg

SEQ ID NO: 549003 - DNA, 13 bp, D. melanogaster
aaagcatttaatt

SEQ ID NO: 549004 - DNA, 13 bp, D. melanogaster
aaagcatttactt

SEQ ID NO: 549005 - DNA, 13 bp, D. melanogaster
aaagcatttagtt

SEQ ID NO: 549006 - DNA, 13 bp, D. melanogaster
aaagcatttataa

SEQ ID NO: 549007 - DNA, 13 bp, D. melanogaster
aaagcatttatta

SEQ ID NO: 549008 - DNA, 13 bp, D. melanogaster
aaagcatttcaat

SEQ ID NO: 549009 - DNA, 13 bp, D. melanogaster
aaagcatttccat

SEQ ID NO: 549010 - DNA, 13 bp, D. melanogaster
aaagcatttgatt

SEQ ID NO: 549011 - DNA, 14 bp, D. melanogaster
aaagcattttaaac

SEQ ID NO: 549012 - DNA, 13 bp, D. melanogaster
aaagcattttaag

SEQ ID NO: 549013 - DNA, 13 bp, D. melanogaster
aaagcattttaat

SEQ ID NO: 549014 - DNA, 14 bp, D. melanogaster
aaagcattttaatt

SEQ ID NO: 549015 - DNA, 13 bp, D. melanogaster
aaagcattttatg

SEQ ID NO: 549016 - DNA, 13 bp, D. melanogaster
aaagcattttcaa

SEQ ID NO: 549017 - DNA, 13 bp, D. melanogaster
aaagcattttcca

SEQ ID NO: 549018 - DNA, 13 bp, D. melanogaster
aaagcatttttat

SEQ ID NO: 549019 - DNA, 13 bp, D. melanogaster
aaagcattttttg

SEQ ID NO: 549020 - DNA, 13 bp, D. melanogaster
aaagccaaaagcc

SEQ ID NO: 549021 - DNA, 14 bp, D. melanogaster
aaagccaaaaggca

SEQ ID NO: 549022 - DNA, 13 bp, D. melanogaster
aaagccaaaaggg

SEQ ID NO: 549023 - DNA, 13 bp, D. melanogaster
aaagccaaaagtt

SEQ ID NO: 549024 - DNA, 13 bp, D. melanogaster
aaagccaaaatat

SEQ ID NO: 549025 - DNA, 13 bp, D. melanogaster
aaagccaaacaat

SEQ ID NO: 549026 - DNA, 14 bp, D. melanogaster
aaagccaaacaatt

SEQ ID NO: 549027 - DNA, 13 bp, D. melanogaster
aaagccaaactaa

SEQ ID NO: 549028 - DNA, 13 bp, D. melanogaster
aaagccaaagagc

SEQ ID NO: 549029 - DNA, 13 bp, D. melanogaster
aaagccaaagcca

SEQ ID NO: 549030 - DNA, 13 bp, D. melanogaster
aaagccaaagcta

SEQ ID NO: 549031 - DNA, 13 bp, D. melanogaster
aaagccaaaggca

SEQ ID NO: 549032 - DNA, 13 bp, D. melanogaster
aaagccaaagtca

SEQ ID NO: 549033 - DNA, 13 bp, D. melanogaster
aaagccaaagtgc

SEQ ID NO: 549034 - DNA, 14 bp, D. melanogaster
aaagccaaataaat

SEQ ID NO: 549035 - DNA, 14 bp, D. melanogaster
aaagccaaatacaa

SEQ ID NO: 549036 - DNA, 13 bp, D. melanogaster
aaagccaaatcca

SEQ ID NO: 549037 - DNA, 13 bp, D. melanogaster
aaagccaaatgaa

SEQ ID NO: 549038 - DNA, 14 bp, D. melanogaster
aaagccaaatgaaa

SEQ ID NO: 549039 - DNA, 13 bp, D. melanogaster
aaagccaaatgca

SEQ ID NO: 549040 - DNA, 13 bp, D. melanogaster
aaagccaaattaa

SEQ ID NO: 549041 - DNA, 14 bp, D. melanogaster
aaagccaaattaaa

SEQ ID NO: 549042 - DNA, 13 bp, D. melanogaster
aaagccaaattga

SEQ ID NO: 549043 - DNA, 14 bp, D. melanogaster
aaagccaaattgat

SEQ ID NO: 549044 - DNA, 13 bp, D. melanogaster
aaagccaaattgg

SEQ ID NO: 549045 - DNA, 13 bp, D. melanogaster
aaagccaacaact

SEQ ID NO: 549046 - DNA, 14 bp, D. melanogaster
aaagccaacaactt

SEQ ID NO: 549047 - DNA, 13 bp, D. melanogaster
aaagccaacagca

SEQ ID NO: 549048 - DNA, 13 bp, D. melanogaster
aaagccaaccgaa

SEQ ID NO: 549049 - DNA, 13 bp, D. melanogaster
aaagccaacggaa

SEQ ID NO: 549050 - DNA, 13 bp, D. melanogaster
aaagccaactgga

SEQ ID NO: 549051 - DNA, 13 bp, D. melanogaster
aaagccaacttca

SEQ ID NO: 549052 - DNA, 13 bp, D. melanogaster
aaagccaacttga

SEQ ID NO: 549053 - DNA, 13 bp, D. melanogaster
aaagccaagaaat

SEQ ID NO: 549054 - DNA, 13 bp, D. melanogaster
aaagccaagaagc

SEQ ID NO: 549055 - DNA, 14 bp, D. melanogaster
aaagccaagaagct

SEQ ID NO: 549056 - DNA, 13 bp, D. melanogaster
aaagccaagagcc

SEQ ID NO: 549057 - DNA, 13 bp, D. melanogaster
aaagccaagccaa

SEQ ID NO: 549058 - DNA, 14 bp, D. melanogaster
aaagccaagccaaa

SEQ ID NO: 549059 - DNA, 14 bp, D. melanogaster
aaagccaagccaag

SEQ ID NO: 549060 - DNA, 13 bp, D. melanogaster
aaagccaagccca

SEQ ID NO: 549061 - DNA, 13 bp, D. melanogaster
aaagccaagcgaa

SEQ ID NO: 549062 - DNA, 13 bp, D. melanogaster
aaagccaagctaa

SEQ ID NO: 549063 - DNA, 14 bp, D. melanogaster
aaagccaaggatgc

SEQ ID NO: 549064 - DNA, 13 bp, D. melanogaster
aaagccaaggcaa

SEQ ID NO: 549065 - DNA, 14 bp, D. melanogaster
aaagccaaggcaaa

SEQ ID NO: 549066 - DNA, 13 bp, D. melanogaster
aaagccaagtgca

SEQ ID NO: 549067 - DNA, 13 bp, D. melanogaster
aaagccaagttaa

SEQ ID NO: 549068 - DNA, 13 bp, D. melanogaster
aaagccaatcaaa

SEQ ID NO: 549069 - DNA, 13 bp, D. melanogaster
aaagccaatcaat

SEQ ID NO: 549070 - DNA, 13 bp, D. melanogaster
aaagccaatgaaa

SEQ ID NO: 549071 - DNA, 13 bp, D. melanogaster
aaagccaattaaa

SEQ ID NO: 549072 - DNA, 13 bp, D. melanogaster
aaagccaattcaa

SEQ ID NO: 549073 - DNA, 13 bp, D. melanogaster
aaagccaattgaa

SEQ ID NO: 549074 - DNA, 13 bp, D. melanogaster
aaagccaattgca

SEQ ID NO: 549075 - DNA, 13 bp, D. melanogaster
aaagccaatttat

SEQ ID NO: 549076 - DNA, 13 bp, D. melanogaster
aaagccaatttgc

SEQ ID NO: 549077 - DNA, 14 bp, D. melanogaster
aaagccacaaaaat

SEQ ID NO: 549078 - DNA, 13 bp, D. melanogaster
aaagccacaaagt

SEQ ID NO: 549079 - DNA, 13 bp, D. melanogaster
aaagccacaaata

SEQ ID NO: 549080 - DNA, 13 bp, D. melanogaster
aaagccacagcaa

SEQ ID NO: 549081 - DNA, 13 bp, D. melanogaster
aaagccacataaa

SEQ ID NO: 549082 - DNA, 13 bp, D. melanogaster
aaagccactaaaa

SEQ ID NO: 549083 - DNA, 13 bp, D. melanogaster
aaagccagaaaat

SEQ ID NO: 549084 - DNA, 13 bp, D. melanogaster
aaagccagaaagc

SEQ ID NO: 549085 - DNA, 13 bp, D. melanogaster
aaagccagaaagt

SEQ ID NO: 549086 - DNA, 13 bp, D. melanogaster
aaagccagaagct

SEQ ID NO: 549087 - DNA, 13 bp, D. melanogaster
aaagccagagttt

SEQ ID NO: 549088 - DNA, 13 bp, D. melanogaster
aaagccagataaa

SEQ ID NO: 549089 - DNA, 13 bp, D. melanogaster
aaagccagcagca

SEQ ID NO: 549090 - DNA, 13 bp, D. melanogaster
aaagccagccaga

SEQ ID NO: 549091 - DNA, 13 bp, D. melanogaster
aaagccagccagc

SEQ ID NO: 549092 - DNA, 13 bp, D. melanogaster
aaagccagcgaaa

SEQ ID NO: 549093 - DNA, 13 bp, D. melanogaster
aaagccagctggc

SEQ ID NO: 549094 - DNA, 13 bp, D. melanogaster
aaagccaggcaaa

SEQ ID NO: 549095 - DNA, 13 bp, D. melanogaster
aaagccagggaaa

SEQ ID NO: 549096 - DNA, 13 bp, D. melanogaster
aaagccagtgaaa

SEQ ID NO: 549097 - DNA, 13 bp, D. melanogaster
aaagccagttaag

SEQ ID NO: 549098 - DNA, 13 bp, D. melanogaster
aaagccataacaa

SEQ ID NO: 549099 - DNA, 13 bp, D. melanogaster
aaagccatacaaa

SEQ ID NO: 549100 - DNA, 13 bp, D. melanogaster
aaagccatcgaaa

SEQ ID NO: 549101 - DNA, 13 bp, D. melanogaster
aaagccatgaaaa

SEQ ID NO: 549102 - DNA, 13 bp, D. melanogaster
aaagccatgcaaa

SEQ ID NO: 549103 - DNA, 13 bp, D. melanogaster
aaagccatggcaa

SEQ ID NO: 549104 - DNA, 13 bp, D. melanogaster
aaagccattaaaa

SEQ ID NO: 549105 - DNA, 13 bp, D. melanogaster
aaagccattaatt

SEQ ID NO: 549106 - DNA, 13 bp, D. melanogaster
aaagccattcaaa

SEQ ID NO: 549107 - DNA, 13 bp, D. melanogaster
aaagccattgaaa

SEQ ID NO: 549108 - DNA, 13 bp, D. melanogaster
aaagccatttaaa

SEQ ID NO: 549109 - DNA, 13 bp, D. melanogaster
aaagccatttgaa

SEQ ID NO: 549110 - DNA, 13 bp, D. melanogaster
aaagccatttggc

SEQ ID NO: 549111 - DNA, 13 bp, D. melanogaster
aaagccattttat

SEQ ID NO: 549112 - DNA, 13 bp, D. melanogaster
aaagcccaaagtc

SEQ ID NO: 549113 - DNA, 14 bp, D. melanogaster
aaagcccaaagtct

SEQ ID NO: 549114 - DNA, 13 bp, D. melanogaster
aaagcccataaat

SEQ ID NO: 549115 - DNA, 13 bp, D. melanogaster
aaagccccaaaag

SEQ ID NO: 549116 - DNA, 13 bp, D. melanogaster
aaagcccttacac

SEQ ID NO: 549117 - DNA, 13 bp, D. melanogaster
aaagccgaaaacc

SEQ ID NO: 549118 - DNA, 13 bp, D. melanogaster
aaagccgaaaact

SEQ ID NO: 549119 - DNA, 13 bp, D. melanogaster
aaagccgaaaagc

SEQ ID NO: 549120 - DNA, 13 bp, D. melanogaster
aaagccgaaagcc

SEQ ID NO: 549121 - DNA, 13 bp, D. melanogaster
aaagccgaacaat

SEQ ID NO: 549122 - DNA, 13 bp, D. melanogaster
aaagccgaagcaa

SEQ ID NO: 549123 - DNA, 13 bp, D. melanogaster
aaagccgaatcaa

SEQ ID NO: 549124 - DNA, 13 bp, D. melanogaster
aaagccgaggaaa

SEQ ID NO: 549125 - DNA, 13 bp, D. melanogaster
aaagccgcaacaa

SEQ ID NO: 549126 - DNA, 13 bp, D. melanogaster
aaagccgcacaaa

SEQ ID NO: 549127 - DNA, 13 bp, D. melanogaster
aaagccgcagaca

SEQ ID NO: 549128 - DNA, 13 bp, D. melanogaster
aaagccggaaaac

SEQ ID NO: 549129 - DNA, 13 bp, D. melanogaster
aaagccggaaaag

SEQ ID NO: 549130 - DNA, 13 bp, D. melanogaster
aaagccggcaaca

SEQ ID NO: 549131 - DNA, 13 bp, D. melanogaster
aaagcctactttc

SEQ ID NO: 549132 - DNA, 13 bp, D. melanogaster
aaagcctcgttaa

SEQ ID NO: 549133 - DNA, 43 bp, D. melanogaster
aaagcctctgcgacgccgtcacatccgccaactcagcaaatgg

SEQ ID NO: 549134 - DNA, 13 bp, D. melanogaster
aaagcctggccaa

SEQ ID NO: 549135 - DNA, 13 bp, D. melanogaster
aaagccttaaaaa

SEQ ID NO: 549136 - DNA, 14 bp, D. melanogaster
aaagccttaaaaca

SEQ ID NO: 549137 - DNA, 13 bp, D. melanogaster
aaagccttaagtt

SEQ ID NO: 549138 - DNA, 13 bp, D. melanogaster
aaagcgaaaaagt

SEQ ID NO: 549139 - DNA, 13 bp, D. melanogaster
aaagcgaaaaatg

SEQ ID NO: 549140 - DNA, 13 bp, D. melanogaster
aaagcgaaaagcg

SEQ ID NO: 549141 - DNA, 13 bp, D. melanogaster
aaagcgaaaagta

SEQ ID NO: 549142 - DNA, 13 bp, D. melanogaster
aaagcgaaaattt

SEQ ID NO: 549143 - DNA, 13 bp, D. melanogaster
aaagcgaaacaat

SEQ ID NO: 549144 - DNA, 13 bp, D. melanogaster
aaagcgaaacttt

SEQ ID NO: 549145 - DNA, 14 bp, D. melanogaster
aaagcgaaactttt

SEQ ID NO: 549146 - DNA, 13 bp, D. melanogaster
aaagcgaaagagc

SEQ ID NO: 549147 - DNA, 13 bp, D. melanogaster
aaagcgaaagagt

SEQ ID NO: 549148 - DNA, 13 bp, D. melanogaster
aaagcgaaagcca

SEQ ID NO: 549149 - DNA, 14 bp, D. melanogaster
aaagcgaaagccaa

SEQ ID NO: 549150 - DNA, 13 bp, D. melanogaster
aaagcgaaagtaa

SEQ ID NO: 549151 - DNA, 13 bp, D. melanogaster
aaagcgaaagtca

SEQ ID NO: 549152 - DNA, 13 bp, D. melanogaster
aaagcgaaagtga

SEQ ID NO: 549153 - DNA, 13 bp, D. melanogaster
aaagcgaaagttt

SEQ ID NO: 549154 - DNA, 14 bp, D. melanogaster
aaagcgaaagtttt

SEQ ID NO: 549155 - DNA, 13 bp, D. melanogaster
aaagcgaaataat

SEQ ID NO: 549156 - DNA, 13 bp, D. melanogaster
aaagcgaaatatg

SEQ ID NO: 549157 - DNA, 13 bp, D. melanogaster
aaagcgaaatatt

SEQ ID NO: 549158 - DNA, 14 bp, D. melanogaster
aaagcgaaatattt

SEQ ID NO: 549159 - DNA, 13 bp, D. melanogaster
aaagcgaaatcaa

SEQ ID NO: 549160 - DNA, 14 bp, D. melanogaster
aaagcgaaatcaat

SEQ ID NO: 549161 - DNA, 13 bp, D. melanogaster
aaagcgaaatgca

SEQ ID NO: 549162 - DNA, 13 bp, D. melanogaster
aaagcgaaatgga

SEQ ID NO: 549163 - DNA, 13 bp, D. melanogaster
aaagcgaaatgtg

SEQ ID NO: 549164 - DNA, 14 bp, D. melanogaster
aaagcgaaattgaa

SEQ ID NO: 549165 - DNA, 14 bp, D. melanogaster
aaagcgaaattttt

SEQ ID NO: 549166 - DNA, 13 bp, D. melanogaster
aaagcgaacaagt

SEQ ID NO: 549167 - DNA, 13 bp, D. melanogaster
aaagcgaacgctt

SEQ ID NO: 549168 - DNA, 13 bp, D. melanogaster
aaagcgaactaaa

SEQ ID NO: 549169 - DNA, 13 bp, D. melanogaster
aaagcgaagcgaa

SEQ ID NO: 549170 - DNA, 13 bp, D. melanogaster
aaagcgaatcatt

SEQ ID NO: 549171 - DNA, 13 bp, D. melanogaster
aaagcgaatggca

SEQ ID NO: 549172 - DNA, 13 bp, D. melanogaster
aaagcgaattatt

SEQ ID NO: 549173 - DNA, 13 bp, D. melanogaster
aaagcgaatttca

SEQ ID NO: 549174 - DNA, 13 bp, D. melanogaster
aaagcgacagcaa

SEQ ID NO: 549175 - DNA, 13 bp, D. melanogaster
aaagcgagaagca

SEQ ID NO: 549176 - DNA, 13 bp, D. melanogaster
aaagcgagtggaa

SEQ ID NO: 549177 - DNA, 13 bp, D. melanogaster
aaagcgatatata

SEQ ID NO: 549178 - DNA, 13 bp, D. melanogaster
aaagcgatatcga

SEQ ID NO: 549179 - DNA, 13 bp, D. melanogaster
aaagcgatggctt

SEQ ID NO: 549180 - DNA, 13 bp, D. melanogaster
aaagcgattccca

SEQ ID NO: 549181 - DNA, 13 bp, D. melanogaster
aaagcgattgcaa

SEQ ID NO: 549182 - DNA, 13 bp, D. melanogaster
aaagcgatttaaa

SEQ ID NO: 549183 - DNA, 13 bp, D. melanogaster
aaagcgattttaa

SEQ ID NO: 549184 - DNA, 13 bp, D. melanogaster
aaagcgcaaaagt

SEQ ID NO: 549185 - DNA, 13 bp, D. melanogaster
aaagcgcaaataa

SEQ ID NO: 549186 - DNA, 13 bp, D. melanogaster
aaagcgcacacac

SEQ ID NO: 549187 - DNA, 13 bp, D. melanogaster
aaagcgcagcagc

SEQ ID NO: 549188 - DNA, 13 bp, D. melanogaster
aaagcgcatttaa

SEQ ID NO: 549189 - DNA, 13 bp, D. melanogaster
aaagcgccaaaag

SEQ ID NO: 549190 - DNA, 13 bp, D. melanogaster
aaagcgccacaaa

SEQ ID NO: 549191 - DNA, 13 bp, D. melanogaster
aaagcgccataaa

SEQ ID NO: 549192 - DNA, 13 bp, D. melanogaster
aaagcgccgaaaa

SEQ ID NO: 549193 - DNA, 13 bp, D. melanogaster
aaagcgcgccaaa

SEQ ID NO: 549194 - DNA, 13 bp, D. melanogaster
aaagcgcggaaaa

SEQ ID NO: 549195 - DNA, 13 bp, D. melanogaster
aaagcgctggaaa

SEQ ID NO: 549196 - DNA, 13 bp, D. melanogaster
aaagcgctggcca

SEQ ID NO: 549197 - DNA, 13 bp, D. melanogaster
aaagcgcttaaat

SEQ ID NO: 549198 - DNA, 13 bp, D. melanogaster
aaagcggaaaaat

SEQ ID NO: 549199 - DNA, 13 bp, D. melanogaster
aaagcggaaaacg

SEQ ID NO: 549200 - DNA, 13 bp, D. melanogaster
aaagcggaaaact

SEQ ID NO: 549201 - DNA, 13 bp, D. melanogaster
aaagcggaaaagc

SEQ ID NO: 549202 - DNA, 14 bp, D. melanogaster
aaagcggaaacgga

SEQ ID NO: 549203 - DNA, 13 bp, D. melanogaster
aaagcggaaagca

SEQ ID NO: 549204 - DNA, 13 bp, D. melanogaster
aaagcggaaatga

SEQ ID NO: 549205 - DNA, 13 bp, D. melanogaster
aaagcggaaatgt

SEQ ID NO: 549206 - DNA, 13 bp, D. melanogaster
aaagcggaagtgc

SEQ ID NO: 549207 - DNA, 13 bp, D. melanogaster
aaagcggaataaa

SEQ ID NO: 549208 - DNA, 13 bp, D. melanogaster
aaagcggagcaga

SEQ ID NO: 549209 - DNA, 13 bp, D. melanogaster
aaagcggcaaaag

SEQ ID NO: 549210 - DNA, 13 bp, D. melanogaster
aaagcggcaaaat

SEQ ID NO: 549211 - DNA, 13 bp, D. melanogaster
aaagcggcaagaa

SEQ ID NO: 549212 - DNA, 13 bp, D. melanogaster
aaagcggcacaaa

SEQ ID NO: 549213 - DNA, 13 bp, D. melanogaster
aaagcggcagcag

SEQ ID NO: 549214 - DNA, 13 bp, D. melanogaster
aaagcggccaaaa

SEQ ID NO: 549215 - DNA, 13 bp, D. melanogaster
aaagcggccaaca

SEQ ID NO: 549216 - DNA, 13 bp, D. melanogaster
aaagcggcgaaaa

SEQ ID NO: 549217 - DNA, 13 bp, D. melanogaster
aaagcggcgaact

SEQ ID NO: 549218 - DNA, 13 bp, D. melanogaster
aaagcggcgacaa

SEQ ID NO: 549219 - DNA, 13 bp, D. melanogaster
aaagcggcggaaa

SEQ ID NO: 549220 - DNA, 13 bp, D. melanogaster
aaagcggctgaaa

SEQ ID NO: 549221 - DNA, 13 bp, D. melanogaster
aaagcggcttaaa

SEQ ID NO: 549222 - DNA, 14 bp, D. melanogaster
aaagcgggaaaagc

SEQ ID NO: 549223 - DNA, 13 bp, D. melanogaster
aaagcgggaaatg

SEQ ID NO: 549224 - DNA, 13 bp, D. melanogaster
aaagcgggcaaaa

SEQ ID NO: 549225 - DNA, 13 bp, D. melanogaster
aaagcgggcaaca

SEQ ID NO: 549226 - DNA, 14 bp, D. melanogaster
aaagcgggccaaaa

SEQ ID NO: 549227 - DNA, 13 bp, D. melanogaster
aaagcgggtggaa

SEQ ID NO: 549228 - DNA, 14 bp, D. melanogaster
aaagcgggtggaaa

SEQ ID NO: 549229 - DNA, 13 bp, D. melanogaster
aaagcggtggaaa

SEQ ID NO: 549230 - DNA, 13 bp, D. melanogaster
aaagcgtaaacaa

SEQ ID NO: 549231 - DNA, 13 bp, D. melanogaster
aaagcgtaattaa

SEQ ID NO: 549232 - DNA, 13 bp, D. melanogaster
aaagcgtcaaagg

SEQ ID NO: 549233 - DNA, 13 bp, D. melanogaster
aaagcgtgaaaat

SEQ ID NO: 549234 - DNA, 13 bp, D. melanogaster
aaagcgtggaaaa

SEQ ID NO: 549235 - DNA, 13 bp, D. melanogaster
aaagcgttaaaaa

SEQ ID NO: 549236 - DNA, 13 bp, D. melanogaster
aaagcgtttattt

SEQ ID NO: 549237 - DNA, 13 bp, D. melanogaster
aaagcgttttaaa

SEQ ID NO: 549238 - DNA, 13 bp, D. melanogaster
aaagcgtttttat

SEQ ID NO: 549239 - DNA, 13 bp, D. melanogaster
aaagctaaaaagt

SEQ ID NO: 549240 - DNA, 13 bp, D. melanogaster
aaagctaaaatat

SEQ ID NO: 549241 - DNA, 13 bp, D. melanogaster
aaagctaaagcca

SEQ ID NO: 549242 - DNA, 13 bp, D. melanogaster
aaagctaaagcta

SEQ ID NO: 549243 - DNA, 14 bp, D. melanogaster
aaagctaaataaat

SEQ ID NO: 549244 - DNA, 13 bp, D. melanogaster
aaagctaaatgaa

SEQ ID NO: 549245 - DNA, 14 bp, D. melanogaster
aaagctaaatgaaa

SEQ ID NO: 549246 - DNA, 13 bp, D. melanogaster
aaagctaacaaat

SEQ ID NO: 549247 - DNA, 13 bp, D. melanogaster
aaagctaataaat

SEQ ID NO: 549248 - DNA, 13 bp, D. melanogaster
aaagctaattaaa

SEQ ID NO: 549249 - DNA, 13 bp, D. melanogaster
aaagctacatgca

SEQ ID NO: 549250 - DNA, 13 bp, D. melanogaster
aaagctaccaaaa

SEQ ID NO: 549251 - DNA, 14 bp, D. melanogaster
aaagctagaaagtt

SEQ ID NO: 549252 - DNA, 14 bp, D. melanogaster
aaagctagaatgtt

SEQ ID NO: 549253 - DNA, 13 bp, D. melanogaster
aaagctagataaa

SEQ ID NO: 549254 - DNA, 14 bp, D. melanogaster
aaagctagataaaa

SEQ ID NO: 549255 - DNA, 13 bp, D. melanogaster
aaagctataaata

SEQ ID NO: 549256 - DNA, 13 bp, D. melanogaster
aaagctattaaaa

SEQ ID NO: 549257 - DNA, 13 bp, D. melanogaster
aaagctattgaaa

SEQ ID NO: 549258 - DNA, 13 bp, D. melanogaster
aaagctcaaagcc

SEQ ID NO: 549259 - DNA, 13 bp, D. melanogaster
aaagctcagccca

SEQ ID NO: 549260 - DNA, 13 bp, D. melanogaster
aaagctcattaaa

SEQ ID NO: 549261 - DNA, 13 bp, D. melanogaster
aaagctccgtctc

SEQ ID NO: 549262 - DNA, 13 bp, D. melanogaster
aaagctcttaaaa

SEQ ID NO: 549263 - DNA, 13 bp, D. melanogaster
aaagctcttctat

SEQ ID NO: 549264 - DNA, 13 bp, D. melanogaster
aaagctgaaaaat

SEQ ID NO: 549265 - DNA, 14 bp, D. melanogaster
aaagctgaaataaa

SEQ ID NO: 549266 - DNA, 13 bp, D. melanogaster
aaagctgaacaaa

SEQ ID NO: 549267 - DNA, 14 bp, D. melanogaster
aaagctgaacaaaa

SEQ ID NO: 549268 - DNA, 13 bp, D. melanogaster
aaagctgaagaaa

SEQ ID NO: 549269 - DNA, 13 bp, D. melanogaster
aaagctgaagctg

SEQ ID NO: 549270 - DNA, 13 bp, D. melanogaster
aaagctgaatgtc

SEQ ID NO: 549271 - DNA, 13 bp, D. melanogaster
aaagctgacaaat

SEQ ID NO: 549272 - DNA, 14 bp, D. melanogaster
aaagctgagatgta

SEQ ID NO: 549273 - DNA, 13 bp, D. melanogaster
aaagctgagcaaa

SEQ ID NO: 549274 - DNA, 13 bp, D. melanogaster
aaagctgatgaaa

SEQ ID NO: 549275 - DNA, 13 bp, D. melanogaster
aaagctgattaaa

SEQ ID NO: 549276 - DNA, 13 bp, D. melanogaster
aaagctgcaaatt

SEQ ID NO: 549277 - DNA, 13 bp, D. melanogaster
aaagctgcaattt

SEQ ID NO: 549278 - DNA, 13 bp, D. melanogaster
aaagctgcacaaa

SEQ ID NO: 549279 - DNA, 13 bp, D. melanogaster
aaagctgcagaaa

SEQ ID NO: 549280 - DNA, 13 bp, D. melanogaster
aaagctgcagctg

SEQ ID NO: 549281 - DNA, 13 bp, D. melanogaster
aaagctgcgaaaa

SEQ ID NO: 549282 - DNA, 13 bp, D. melanogaster
aaagctgctttaa

SEQ ID NO: 549283 - DNA, 13 bp, D. melanogaster
aaagctggaaaaa

SEQ ID NO: 549284 - DNA, 13 bp, D. melanogaster
aaagctggaaaag

SEQ ID NO: 549285 - DNA, 13 bp, D. melanogaster
aaagctggaaaat

SEQ ID NO: 549286 - DNA, 14 bp, D. melanogaster
aaagctggaatcgt

SEQ ID NO: 549287 - DNA, 13 bp, D. melanogaster
aaagctggcaaag

SEQ ID NO: 549288 - DNA, 13 bp, D. melanogaster
aaagctggcaaca

SEQ ID NO: 549289 - DNA, 13 bp, D. melanogaster
aaagctggctggc

SEQ ID NO: 549290 - DNA, 13 bp, D. melanogaster
aaagctgggaaaa

SEQ ID NO: 549291 - DNA, 13 bp, D. melanogaster
aaagctggtgaaa

SEQ ID NO: 549292 - DNA, 13 bp, D. melanogaster
aaagctgttcaaa

SEQ ID NO: 549293 - DNA, 14 bp, D. melanogaster
aaagctgtttgaaa

SEQ ID NO: 549294 - DNA, 13 bp, D. melanogaster
aaagctgttttta

SEQ ID NO: 549295 - DNA, 13 bp, D. melanogaster
aaagcttaaaaag

SEQ ID NO: 549296 - DNA, 13 bp, D. melanogaster
aaagcttaatttg

SEQ ID NO: 549297 - DNA, 13 bp, D. melanogaster
aaagcttataaaa

SEQ ID NO: 549298 - DNA, 13 bp, D. melanogaster
aaagcttattcaa

SEQ ID NO: 549299 - DNA, 13 bp, D. melanogaster
aaagcttatttaa

SEQ ID NO: 549300 - DNA, 13 bp, D. melanogaster
aaagcttcaaata

SEQ ID NO: 549301 - DNA, 13 bp, D. melanogaster
aaagctttaaaat

SEQ ID NO: 549302 - DNA, 13 bp, D. melanogaster
aaagctttaaagt

SEQ ID NO: 549303 - DNA, 13 bp, D. melanogaster
aaagctttaaatg

SEQ ID NO: 549304 - DNA, 13 bp, D. melanogaster
aaagctttaaatt

SEQ ID NO: 549305 - DNA, 13 bp, D. melanogaster
aaagctttaactt

SEQ ID NO: 549306 - DNA, 13 bp, D. melanogaster
aaagctttaataa

SEQ ID NO: 549307 - DNA, 13 bp, D. melanogaster
aaagctttatcaa

SEQ ID NO: 549308 - DNA, 13 bp, D. melanogaster
aaagctttattag

SEQ ID NO: 549309 - DNA, 13 bp, D. melanogaster
aaagctttcaaat

SEQ ID NO: 549310 - DNA, 13 bp, D. melanogaster
aaagctttcgaaa

SEQ ID NO: 549311 - DNA, 13 bp, D. melanogaster
aaagctttgaaat

SEQ ID NO: 549312 - DNA, 13 bp, D. melanogaster
aaagctttgacaa

SEQ ID NO: 549313 - DNA, 13 bp, D. melanogaster
aaagctttgattt

SEQ ID NO: 549314 - DNA, 13 bp, D. melanogaster
aaagctttgccaa

SEQ ID NO: 549315 - DNA, 13 bp, D. melanogaster
aaagcttttaaaa

SEQ ID NO: 549316 - DNA, 13 bp, D. melanogaster
aaagcttttaaat

SEQ ID NO: 549317 - DNA, 13 bp, D. melanogaster
aaagcttttaaga

SEQ ID NO: 549318 - DNA, 13 bp, D. melanogaster
aaagcttttcaaa

SEQ ID NO: 549319 - DNA, 13 bp, D. melanogaster
aaagcttttgcaa

SEQ ID NO: 549320 - DNA, 13 bp, D. melanogaster
aaagcttttgcca

SEQ ID NO: 549321 - DNA, 13 bp, D. melanogaster
aaagctttttaaa

SEQ ID NO: 549322 - DNA, 13 bp, D. melanogaster
aaagctttttcca

SEQ ID NO: 549323 - DNA, 13 bp, D. melanogaster
aaagctttttgaa

SEQ ID NO: 549324 - DNA, 13 bp, D. melanogaster
aaagcttttttat

SEQ ID NO: 549325 - DNA, 13 bp, D. melanogaster
aaagcttttttct

SEQ ID NO: 549326 - DNA, 13 bp, D. melanogaster
aaaggaaaaatgc

SEQ ID NO: 549327 - DNA, 14 bp, D. melanogaster
aaaggaaaacattt

SEQ ID NO: 549328 - DNA, 13 bp, D. melanogaster
aaaggaaaactca

SEQ ID NO: 549329 - DNA, 13 bp, D. melanogaster
aaaggaaaactga

SEQ ID NO: 549330 - DNA, 13 bp, D. melanogaster
aaaggaaaacttc

SEQ ID NO: 549331 - DNA, 13 bp, D. melanogaster
aaaggaaaacttt

SEQ ID NO: 549332 - DNA, 13 bp, D. melanogaster
aaaggaaaagctt

SEQ ID NO: 549333 - DNA, 13 bp, D. melanogaster
aaaggaaaaggct

SEQ ID NO: 549334 - DNA, 14 bp, D. melanogaster
aaaggaaaaggtca

SEQ ID NO: 549335 - DNA, 13 bp, D. melanogaster
aaaggaaaagttg

SEQ ID NO: 549336 - DNA, 13 bp, D. melanogaster
aaaggaaaagttt

SEQ ID NO: 549337 - DNA, 13 bp, D. melanogaster
aaaggaaaatacg

SEQ ID NO: 549338 - DNA, 13 bp, D. melanogaster
aaaggaaaatagc

SEQ ID NO: 549339 - DNA, 13 bp, D. melanogaster
aaaggaaaatgtg

SEQ ID NO: 549340 - DNA, 13 bp, D. melanogaster
aaaggaaaatgtt

SEQ ID NO: 549341 - DNA, 13 bp, D. melanogaster
aaaggaaaattca

SEQ ID NO: 549342 - DNA, 13 bp, D. melanogaster
aaaggaaaattgc

SEQ ID NO: 549343 - DNA, 14 bp, D. melanogaster
aaaggaaacatttt

SEQ ID NO: 549344 - DNA, 13 bp, D. melanogaster
aaaggaaacccat

SEQ ID NO: 549345 - DNA, 13 bp, D. melanogaster
aaaggaaactatt

SEQ ID NO: 549346 - DNA, 13 bp, D. melanogaster
aaaggaaactcaa

SEQ ID NO: 549347 - DNA, 13 bp, D. melanogaster
aaaggaaactgca

SEQ ID NO: 549348 - DNA, 13 bp, D. melanogaster
aaaggaaactttt

SEQ ID NO: 549349 - DNA, 13 bp, D. melanogaster
aaaggaaatattt

SEQ ID NO: 549350 - DNA, 13 bp, D. melanogaster
aaaggaaatcaac

SEQ ID NO: 549351 - DNA, 13 bp, D. melanogaster
aaaggaaatcaat

SEQ ID NO: 549352 - DNA, 13 bp, D. melanogaster
aaaggaaatgatt

SEQ ID NO: 549353 - DNA, 13 bp, D. melanogaster
aaaggaaatgcaa

SEQ ID NO: 549354 - DNA, 14 bp, D. melanogaster
aaaggaaatgcaaa

SEQ ID NO: 549355 - DNA, 13 bp, D. melanogaster
aaaggaaatgcat

SEQ ID NO: 549356 - DNA, 13 bp, D. melanogaster
aaaggaaatggca

SEQ ID NO: 549357 - DNA, 13 bp, D. melanogaster
aaaggaaatgtat

SEQ ID NO: 549358 - DNA, 13 bp, D. melanogaster
aaaggaaatgttc

SEQ ID NO: 549359 - DNA, 13 bp, D. melanogaster
aaaggaaatgttt

SEQ ID NO: 549360 - DNA, 13 bp, D. melanogaster
aaaggaaattagt

SEQ ID NO: 549361 - DNA, 13 bp, D. melanogaster
aaaggaaattatt

SEQ ID NO: 549362 - DNA, 13 bp, D. melanogaster
aaaggaaattgca

SEQ ID NO: 549363 - DNA, 13 bp, D. melanogaster
aaaggaaattgga

SEQ ID NO: 549364 - DNA, 13 bp, D. melanogaster
aaaggaaattttc

SEQ ID NO: 549365 - DNA, 14 bp, D. melanogaster
aaaggaaattttct

SEQ ID NO: 549366 - DNA, 13 bp, D. melanogaster
aaaggaaccgaat

SEQ ID NO: 549367 - DNA, 14 bp, D. melanogaster
aaaggaaccgaatg

SEQ ID NO: 549368 - DNA, 13 bp, D. melanogaster
aaaggaacttgga

SEQ ID NO: 549369 - DNA, 14 bp, D. melanogaster
aaaggaagcgtttc

SEQ ID NO: 549370 - DNA, 13 bp, D. melanogaster
aaaggaagctaac

SEQ ID NO: 549371 - DNA, 14 bp, D. melanogaster
aaaggaagctaact

SEQ ID NO: 549372 - DNA, 13 bp, D. melanogaster
aaaggaagtcttg

SEQ ID NO: 549373 - DNA, 15 bp, D. melanogaster
aaaggaagtcttgcc

SEQ ID NO: 549374 - DNA, 13 bp, D. melanogaster
aaaggaatccaaa

SEQ ID NO: 549375 - DNA, 13 bp, D. melanogaster
aaaggaatgcaaa

SEQ ID NO: 549376 - DNA, 13 bp, D. melanogaster
aaaggaattcaaa

SEQ ID NO: 549377 - DNA, 13 bp, D. melanogaster
aaaggaattcact

SEQ ID NO: 549378 - DNA, 13 bp, D. melanogaster
aaaggaattgtaa

SEQ ID NO: 549379 - DNA, 13 bp, D. melanogaster
aaaggacattaaa

SEQ ID NO: 549380 - DNA, 13 bp, D. melanogaster
aaaggaccgatta

SEQ ID NO: 549381 - DNA, 14 bp, D. melanogaster
aaaggacgaaggac

SEQ ID NO: 549382 - DNA, 14 bp, D. melanogaster
aaaggacgcaggac

SEQ ID NO: 549383 - DNA, 13 bp, D. melanogaster
aaaggagacgcac

SEQ ID NO: 549384 - DNA, 13 bp, D. melanogaster
aaaggagcaaagt

SEQ ID NO: 549385 - DNA, 13 bp, D. melanogaster
aaaggagcacgct

SEQ ID NO: 549386 - DNA, 14 bp, D. melanogaster
aaaggagcagcagc

SEQ ID NO: 549387 - DNA, 13 bp, D. melanogaster
aaaggagctcgtt

SEQ ID NO: 549388 - DNA, 13 bp, D. melanogaster
aaaggaggatata

SEQ ID NO: 549389 - DNA, 15 bp, D. melanogaster
aaaggaggttggtag

SEQ ID NO: 549390 - DNA, 13 bp, D. melanogaster
aaaggataacatg

SEQ ID NO: 549391 - DNA, 13 bp, D. melanogaster
aaaggataatgga

SEQ ID NO: 549392 - DNA, 13 bp, D. melanogaster
aaaggatatattt

SEQ ID NO: 549393 - DNA, 13 bp, D. melanogaster
aaaggatatgcaa

SEQ ID NO: 549394 - DNA, 13 bp, D. melanogaster
aaaggatatgcca

SEQ ID NO: 549395 - DNA, 13 bp, D. melanogaster
aaaggatattatt

SEQ ID NO: 549396 - DNA, 13 bp, D. melanogaster
aaaggatattcaa

SEQ ID NO: 549397 - DNA, 13 bp, D. melanogaster
aaaggatatttac

SEQ ID NO: 549398 - DNA, 13 bp, D. melanogaster
aaaggatccgaag

SEQ ID NO: 549399 - DNA, 13 bp, D. melanogaster
aaaggatgcaaaa

SEQ ID NO: 549400 - DNA, 13 bp, D. melanogaster
aaaggatgtggaa

SEQ ID NO: 549401 - DNA, 13 bp, D. melanogaster
aaaggatgtgtgt

SEQ ID NO: 549402 - DNA, 13 bp, D. melanogaster
aaaggattacaaa

SEQ ID NO: 549403 - DNA, 13 bp, D. melanogaster
aaaggattattta

SEQ ID NO: 549404 - DNA, 13 bp, D. melanogaster
aaaggattcaaat

SEQ ID NO: 549405 - DNA, 13 bp, D. melanogaster
aaaggatttcaaa

SEQ ID NO: 549406 - DNA, 13 bp, D. melanogaster
aaaggatttcaat

SEQ ID NO: 549407 - DNA, 13 bp, D. melanogaster
aaaggattttcta

SEQ ID NO: 549408 - DNA, 13 bp, D. melanogaster
aaaggattttctt

SEQ ID NO: 549409 - DNA, 13 bp, D. melanogaster
aaaggattttttc

SEQ ID NO: 549410 - DNA, 13 bp, D. melanogaster
aaaggattttttt

SEQ ID NO: 549411 - DNA, 13 bp, D. melanogaster
aaaggcaaaaagt

SEQ ID NO: 549412 - DNA, 13 bp, D. melanogaster
aaaggcaaaagcg

SEQ ID NO: 549413 - DNA, 13 bp, D. melanogaster
aaaggcaaaagtc

SEQ ID NO: 549414 - DNA, 13 bp, D. melanogaster
aaaggcaaaatca

SEQ ID NO: 549415 - DNA, 13 bp, D. melanogaster
aaaggcaaacaat

SEQ ID NO: 549416 - DNA, 13 bp, D. melanogaster
aaaggcaaacagc

SEQ ID NO: 549417 - DNA, 14 bp, D. melanogaster
aaaggcaaacattt

SEQ ID NO: 549418 - DNA, 13 bp, D. melanogaster
aaaggcaaacgca

SEQ ID NO: 549419 - DNA, 13 bp, D. melanogaster
aaaggcaaagcca

SEQ ID NO: 549420 - DNA, 13 bp, D. melanogaster
aaaggcaaataag

SEQ ID NO: 549421 - DNA, 13 bp, D. melanogaster
aaaggcaaataga

SEQ ID NO: 549422 - DNA, 13 bp, D. melanogaster
aaaggcaaatcaa

SEQ ID NO: 549423 - DNA, 14 bp, D. melanogaster
aaaggcaaatgcaa

SEQ ID NO: 549424 - DNA, 13 bp, D. melanogaster
aaaggcaaatgcg

SEQ ID NO: 549425 - DNA, 13 bp, D. melanogaster
aaaggcaaatgtt

SEQ ID NO: 549426 - DNA, 13 bp, D. melanogaster
aaaggcaaattag

SEQ ID NO: 549427 - DNA, 13 bp, D. melanogaster
aaaggcaaattat

SEQ ID NO: 549428 - DNA, 13 bp, D. melanogaster
aaaggcaacaaat

SEQ ID NO: 549429 - DNA, 13 bp, D. melanogaster
aaaggcaaccgca

SEQ ID NO: 549430 - DNA, 13 bp, D. melanogaster
aaaggcaacgcaa

SEQ ID NO: 549431 - DNA, 13 bp, D. melanogaster
aaaggcaactaag

SEQ ID NO: 549432 - DNA, 13 bp, D. melanogaster
aaaggcaactgaa

SEQ ID NO: 549433 - DNA, 13 bp, D. melanogaster
aaaggcaagccaa

SEQ ID NO: 549434 - DNA, 13 bp, D. melanogaster
aaaggcaaggcaa

SEQ ID NO: 549435 - DNA, 13 bp, D. melanogaster
aaaggcaataaat

SEQ ID NO: 549436 - DNA, 13 bp, D. melanogaster
aaaggcaataaca

SEQ ID NO: 549437 - DNA, 13 bp, D. melanogaster
aaaggcaatgcaa

SEQ ID NO: 549438 - DNA, 13 bp, D. melanogaster
aaaggcaattaaa

SEQ ID NO: 549439 - DNA, 13 bp, D. melanogaster
aaaggcacaaaat

SEQ ID NO: 549440 - DNA, 14 bp, D. melanogaster
aaaggcacaaagat

SEQ ID NO: 549441 - DNA, 13 bp, D. melanogaster
aaaggcacataaa

SEQ ID NO: 549442 - DNA, 13 bp, D. melanogaster
aaaggcacctact

SEQ ID NO: 549443 - DNA, 14 bp, D. melanogaster
aaaggcacctactg

SEQ ID NO: 549444 - DNA, 13 bp, D. melanogaster
aaaggcactcaaa

SEQ ID NO: 549445 - DNA, 13 bp, D. melanogaster
aaaggcagaaaat

SEQ ID NO: 549446 - DNA, 13 bp, D. melanogaster
aaaggcagacaga

SEQ ID NO: 549447 - DNA, 13 bp, D. melanogaster
aaaggcagaggca

SEQ ID NO: 549448 - DNA, 13 bp, D. melanogaster
aaaggcagcaaag

SEQ ID NO: 549449 - DNA, 13 bp, D. melanogaster
aaaggcagcaaca

SEQ ID NO: 549450 - DNA, 13 bp, D. melanogaster
aaaggcagcagca

SEQ ID NO: 549451 - DNA, 13 bp, D. melanogaster
aaaggcagccaaa

SEQ ID NO: 549452 - DNA, 13 bp, D. melanogaster
aaaggcagccaag

SEQ ID NO: 549453 - DNA, 18 bp, D. melanogaster
aaaggcagccaagaaggc

SEQ ID NO: 549454 - DNA, 13 bp, D. melanogaster
aaaggcagccaca

SEQ ID NO: 549455 - DNA, 13 bp, D. melanogaster
aaaggcagccagc

SEQ ID NO: 549456 - DNA, 13 bp, D. melanogaster
aaaggcagccgaa

SEQ ID NO: 549457 - DNA, 13 bp, D. melanogaster
aaaggcagcgaaa

SEQ ID NO: 549458 - DNA, 13 bp, D. melanogaster
aaaggcaggccaa

SEQ ID NO: 549459 - DNA, 13 bp, D. melanogaster
aaaggcagtggca

SEQ ID NO: 549460 - DNA, 13 bp, D. melanogaster
aaaggcagttaaa

SEQ ID NO: 549461 - DNA, 13 bp, D. melanogaster
aaaggcattaaaa

SEQ ID NO: 549462 - DNA, 13 bp, D. melanogaster
aaaggcattgaaa

SEQ ID NO: 549463 - DNA, 13 bp, D. melanogaster
aaaggcattgcaa

SEQ ID NO: 549464 - DNA, 13 bp, D. melanogaster
aaaggcatttaag

SEQ ID NO: 549465 - DNA, 13 bp, D. melanogaster
aaaggcatttgtt

SEQ ID NO: 549466 - DNA, 13 bp, D. melanogaster
aaaggcattttaa

SEQ ID NO: 549467 - DNA, 14 bp, D. melanogaster
aaaggcattttggt

SEQ ID NO: 549468 - DNA, 13 bp, D. melanogaster
aaaggcattttta

SEQ ID NO: 549469 - DNA, 13 bp, D. melanogaster
aaaggccaaaagc

SEQ ID NO: 549470 - DNA, 13 bp, D. melanogaster
aaaggccaaagga

SEQ ID NO: 549471 - DNA, 13 bp, D. melanogaster
aaaggccaaatgg

SEQ ID NO: 549472 - DNA, 13 bp, D. melanogaster
aaaggccacaaag

SEQ ID NO: 549473 - DNA, 13 bp, D. melanogaster
aaaggccacaaca

SEQ ID NO: 549474 - DNA, 13 bp, D. melanogaster
aaaggccagcaaa

SEQ ID NO: 549475 - DNA, 13 bp, D. melanogaster
aaaggccataaaa

SEQ ID NO: 549476 - DNA, 13 bp, D. melanogaster
aaaggccattaaa

SEQ ID NO: 549477 - DNA, 13 bp, D. melanogaster
aaaggccccaaaa

SEQ ID NO: 549478 - DNA, 13 bp, D. melanogaster
aaaggcctttgaa

SEQ ID NO: 549479 - DNA, 13 bp, D. melanogaster
aaaggcgaaaggc

SEQ ID NO: 549480 - DNA, 13 bp, D. melanogaster
aaaggcgaatcgc

SEQ ID NO: 549481 - DNA, 13 bp, D. melanogaster
aaaggcgagcaaa

SEQ ID NO: 549482 - DNA, 13 bp, D. melanogaster
aaaggcgaggcaa

SEQ ID NO: 549483 - DNA, 13 bp, D. melanogaster
aaaggcgcacaaa

SEQ ID NO: 549484 - DNA, 13 bp, D. melanogaster
aaaggcggaaaat

SEQ ID NO: 549485 - DNA, 13 bp, D. melanogaster
aaaggcggccaaa

SEQ ID NO: 549486 - DNA, 13 bp, D. melanogaster
aaaggcggtggca

SEQ ID NO: 549487 - DNA, 13 bp, D. melanogaster
aaaggctcaattc

SEQ ID NO: 549488 - DNA, 13 bp, D. melanogaster
aaaggctgaaaaa

SEQ ID NO: 549489 - DNA, 13 bp, D. melanogaster
aaaggctggaaaa

SEQ ID NO: 549490 - DNA, 14 bp, D. melanogaster
aaaggctgttatct

SEQ ID NO: 549491 - DNA, 13 bp, D. melanogaster
aaaggcttgggaa

SEQ ID NO: 549492 - DNA, 13 bp, D. melanogaster
aaaggcttttaat

SEQ ID NO: 549493 - DNA, 13 bp, D. melanogaster
aaagggaaaacta

SEQ ID NO: 549494 - DNA, 13 bp, D. melanogaster
aaagggaaaactt

SEQ ID NO: 549495 - DNA, 13 bp, D. melanogaster
aaagggaaaatgc

SEQ ID NO: 549496 - DNA, 13 bp, D. melanogaster
aaagggaaaattc

SEQ ID NO: 549497 - DNA, 13 bp, D. melanogaster
aaagggaaacatt

SEQ ID NO: 549498 - DNA, 13 bp, D. melanogaster
aaagggaaacttt

SEQ ID NO: 549499 - DNA, 13 bp, D. melanogaster
aaagggaaagcca

SEQ ID NO: 549500 - DNA, 13 bp, D. melanogaster
aaagggaaagttt

SEQ ID NO: 549501 - DNA, 13 bp, D. melanogaster
aaagggaaatcaa

SEQ ID NO: 549502 - DNA, 13 bp, D. melanogaster
aaagggaaatgca

SEQ ID NO: 549503 - DNA, 13 bp, D. melanogaster
aaagggaaattca

SEQ ID NO: 549504 - DNA, 13 bp, D. melanogaster
aaagggaattttc

SEQ ID NO: 549505 - DNA, 13 bp, D. melanogaster
aaagggatctgcc

SEQ ID NO: 549506 - DNA, 13 bp, D. melanogaster
aaagggatgagtg

SEQ ID NO: 549507 - DNA, 13 bp, D. melanogaster
aaagggcaaataa

SEQ ID NO: 549508 - DNA, 13 bp, D. melanogaster
aaagggcaaccga

SEQ ID NO: 549509 - DNA, 14 bp, D. melanogaster
aaagggcaaccgag

SEQ ID NO: 549510 - DNA, 13 bp, D. melanogaster
aaagggcaaggac

SEQ ID NO: 549511 - DNA, 13 bp, D. melanogaster
aaagggccaacaa

SEQ ID NO: 549512 - DNA, 13 bp, D. melanogaster
aaagggccagcaa

SEQ ID NO: 549513 - DNA, 14 bp, D. melanogaster
aaagggccagcaag

SEQ ID NO: 549514 - DNA, 13 bp, D. melanogaster
aaagggcttaaaa

SEQ ID NO: 549515 - DNA, 13 bp, D. melanogaster
aaaggggaaaact

SEQ ID NO: 549516 - DNA, 13 bp, D. melanogaster
aaaggggaaaatt

SEQ ID NO: 549517 - DNA, 13 bp, D. melanogaster
aaaggggaaactt

SEQ ID NO: 549518 - DNA, 13 bp, D. melanogaster
aaaggggaaatat

SEQ ID NO: 549519 - DNA, 13 bp, D. melanogaster
aaaggggccaaaa

SEQ ID NO: 549520 - DNA, 13 bp, D. melanogaster
aaaggggcggtgg

SEQ ID NO: 549521 - DNA, 13 bp, D. melanogaster
aaaggggcgtggc

SEQ ID NO: 549522 - DNA, 14 bp, D. melanogaster
aaaggggcgtggca

SEQ ID NO: 549523 - DNA, 14 bp, D. melanogaster
aaaggggcgtggcc

SEQ ID NO: 549524 - DNA, 14 bp, D. melanogaster
aaaggggcgtggct

SEQ ID NO: 549525 - DNA, 13 bp, D. melanogaster
aaagggggcggca

SEQ ID NO: 549526 - DNA, 14 bp, D. melanogaster
aaagggggcgtggc

SEQ ID NO: 549527 - DNA, 13 bp, D. melanogaster
aaagggtaaacaa

SEQ ID NO: 549528 - DNA, 13 bp, D. melanogaster
aaagggtaactgt

SEQ ID NO: 549529 - DNA, 13 bp, D. melanogaster
aaagggtatttca

SEQ ID NO: 549530 - DNA, 13 bp, D. melanogaster
aaagggtgggcaa

SEQ ID NO: 549531 - DNA, 13 bp, D. melanogaster
aaagggttaacaa

SEQ ID NO: 549532 - DNA, 13 bp, D. melanogaster
aaagggttaaggg

SEQ ID NO: 549533 - DNA, 13 bp, D. melanogaster
aaagggttttccc

SEQ ID NO: 549534 - DNA, 14 bp, D. melanogaster
aaagggttttttgc

SEQ ID NO: 549535 - DNA, 13 bp, D. melanogaster
aaaggtatttaaa

SEQ ID NO: 549536 - DNA, 14 bp, D. melanogaster
aaaggtatttattt

SEQ ID NO: 549537 - DNA, 13 bp, D. melanogaster
aaaggtattttaa

SEQ ID NO: 549538 - DNA, 13 bp, D. melanogaster
aaaggtcaagaaa

SEQ ID NO: 549539 - DNA, 13 bp, D. melanogaster
aaaggtgctgcaa

SEQ ID NO: 549540 - DNA, 13 bp, D. melanogaster
aaaggtggaaaat

SEQ ID NO: 549541 - DNA, 13 bp, D. melanogaster
aaaggtggcctga

SEQ ID NO: 549542 - DNA, 13 bp, D. melanogaster
aaaggtgtctaaa

SEQ ID NO: 549543 - DNA, 13 bp, D. melanogaster
aaaggtgtgaaaa

SEQ ID NO: 549544 - DNA, 13 bp, D. melanogaster
aaaggttaaagtt

SEQ ID NO: 549545 - DNA, 13 bp, D. melanogaster
aaaggttatttaa

SEQ ID NO: 549546 - DNA, 13 bp, D. melanogaster
aaaggttttatat

SEQ ID NO: 549547 - DNA, 13 bp, D. melanogaster
aaaggttttgatt

SEQ ID NO: 549548 - DNA, 14 bp, D. melanogaster
aaaggttttgtaaa

SEQ ID NO: 549549 - DNA, 13 bp, D. melanogaster
aaaggtttttaaa

SEQ ID NO: 549550 - DNA, 14 bp, D. melanogaster
aaaggtttttaaaa

SEQ ID NO: 549551 - DNA, 13 bp, D. melanogaster
aaaggttttttaa

SEQ ID NO: 549552 - DNA, 13 bp, D. melanogaster
aaagtaaaaactc

SEQ ID NO: 549553 - DNA, 13 bp, D. melanogaster
aaagtaaaacatt

SEQ ID NO: 549554 - DNA, 13 bp, D. melanogaster
aaagtaaaagcca

SEQ ID NO: 549555 - DNA, 13 bp, D. melanogaster
aaagtaaaagtgt

SEQ ID NO: 549556 - DNA, 13 bp, D. melanogaster
aaagtaaaagttg

SEQ ID NO: 549557 - DNA, 13 bp, D. melanogaster
aaagtaaaagttt

SEQ ID NO: 549558 - DNA, 14 bp, D. melanogaster
aaagtaaaagtttt

SEQ ID NO: 549559 - DNA, 13 bp, D. melanogaster
aaagtaaaatgct

SEQ ID NO: 549560 - DNA, 13 bp, D. melanogaster
aaagtaaaattgt

SEQ ID NO: 549561 - DNA, 14 bp, D. melanogaster
aaagtaaacaaatg

SEQ ID NO: 549562 - DNA, 14 bp, D. melanogaster
aaagtaaacaaatt

SEQ ID NO: 549563 - DNA, 13 bp, D. melanogaster
aaagtaaacatat

SEQ ID NO: 549564 - DNA, 13 bp, D. melanogaster
aaagtaaacctaa

SEQ ID NO: 549565 - DNA, 14 bp, D. melanogaster
aaagtaaacctaaa

SEQ ID NO: 549566 - DNA, 13 bp, D. melanogaster
aaagtaaactaat

SEQ ID NO: 549567 - DNA, 13 bp, D. melanogaster
aaagtaaacttaa

SEQ ID NO: 549568 - DNA, 13 bp, D. melanogaster
aaagtaaactttg

SEQ ID NO: 549569 - DNA, 14 bp, D. melanogaster
aaagtaaagcaaag

SEQ ID NO: 549570 - DNA, 13 bp, D. melanogaster
aaagtaaagccaa

SEQ ID NO: 549571 - DNA, 13 bp, D. melanogaster
aaagtaaatacga

SEQ ID NO: 549572 - DNA, 13 bp, D. melanogaster
aaagtaaatatca

SEQ ID NO: 549573 - DNA, 14 bp, D. melanogaster
aaagtaaatgcaaa

SEQ ID NO: 549574 - DNA, 13 bp, D. melanogaster
aaagtaaatggca

SEQ ID NO: 549575 - DNA, 13 bp, D. melanogaster
aaagtaaattgca

SEQ ID NO: 549576 - DNA, 13 bp, D. melanogaster
aaagtaacttaaa

SEQ ID NO: 549577 - DNA, 13 bp, D. melanogaster
aaagtaactttaa

SEQ ID NO: 549578 - DNA, 13 bp, D. melanogaster
aaagtaacttttc

SEQ ID NO: 549579 - DNA, 13 bp, D. melanogaster
aaagtaacttttt

SEQ ID NO: 549580 - DNA, 13 bp, D. melanogaster
aaagtaagtaagt

SEQ ID NO: 549581 - DNA, 13 bp, D. melanogaster
aaagtaataacga

SEQ ID NO: 549582 - DNA, 13 bp, D. melanogaster
aaagtaatatcaa

SEQ ID NO: 549583 - DNA, 13 bp, D. melanogaster
aaagtaatcgaaa

SEQ ID NO: 549584 - DNA, 13 bp, D. melanogaster
aaagtaatgcaaa

SEQ ID NO: 549585 - DNA, 13 bp, D. melanogaster
aaagtaattacaa

SEQ ID NO: 549586 - DNA, 13 bp, D. melanogaster
aaagtaattcaaa

SEQ ID NO: 549587 - DNA, 13 bp, D. melanogaster
aaagtaattctcc

SEQ ID NO: 549588 - DNA, 13 bp, D. melanogaster
aaagtaatttatg

SEQ ID NO: 549589 - DNA, 13 bp, D. melanogaster
aaagtaatttcca

SEQ ID NO: 549590 - DNA, 13 bp, D. melanogaster
aaagtaatttctt

SEQ ID NO: 549591 - DNA, 13 bp, D. melanogaster
aaagtaatttgtt

SEQ ID NO: 549592 - DNA, 13 bp, D. melanogaster
aaagtaattttct

SEQ ID NO: 549593 - DNA, 13 bp, D. melanogaster
aaagtaatttttc

SEQ ID NO: 549594 - DNA, 13 bp, D. melanogaster
aaagtacaaaatg

SEQ ID NO: 549595 - DNA, 13 bp, D. melanogaster
aaagtacaaagta

SEQ ID NO: 549596 - DNA, 13 bp, D. melanogaster
aaagtacaaatag

SEQ ID NO: 549597 - DNA, 13 bp, D. melanogaster
aaagtacaacaat

SEQ ID NO: 549598 - DNA, 13 bp, D. melanogaster
aaagtacacaaat

SEQ ID NO: 549599 - DNA, 13 bp, D. melanogaster
aaagtacacagaa

SEQ ID NO: 549600 - DNA, 13 bp, D. melanogaster
aaagtacacataa

SEQ ID NO: 549601 - DNA, 13 bp, D. melanogaster
aaagtacagtgaa

SEQ ID NO: 549602 - DNA, 13 bp, D. melanogaster
aaagtacatacat

SEQ ID NO: 549603 - DNA, 14 bp, D. melanogaster
aaagtacatacata

SEQ ID NO: 549604 - DNA, 13 bp, D. melanogaster
aaagtacatatat

SEQ ID NO: 549605 - DNA, 14 bp, D. melanogaster
aaagtacatatatt

SEQ ID NO: 549606 - DNA, 13 bp, D. melanogaster
aaagtacatattt

SEQ ID NO: 549607 - DNA, 13 bp, D. melanogaster
aaagtacatttaa

SEQ ID NO: 549608 - DNA, 13 bp, D. melanogaster
aaagtacgagtat

SEQ ID NO: 549609 - DNA, 13 bp, D. melanogaster
aaagtacgagttc

SEQ ID NO: 549610 - DNA, 13 bp, D. melanogaster
aaagtacttgaaa

SEQ ID NO: 549611 - DNA, 13 bp, D. melanogaster
aaagtagaagtag

SEQ ID NO: 549612 - DNA, 13 bp, D. melanogaster
aaagtagagcatt

SEQ ID NO: 549613 - DNA, 13 bp, D. melanogaster
aaagtagcaaaag

SEQ ID NO: 549614 - DNA, 13 bp, D. melanogaster
aaagtagcaccaa

SEQ ID NO: 549615 - DNA, 13 bp, D. melanogaster
aaagtagccaaaa

SEQ ID NO: 549616 - DNA, 13 bp, D. melanogaster
aaagtagccaaca

SEQ ID NO: 549617 - DNA, 13 bp, D. melanogaster
aaagtagccacac

SEQ ID NO: 549618 - DNA, 13 bp, D. melanogaster
aaagtagctattg

SEQ ID NO: 549619 - DNA, 13 bp, D. melanogaster
aaagtagctttaa

SEQ ID NO: 549620 - DNA, 13 bp, D. melanogaster
aaagtaggaaaac

SEQ ID NO: 549621 - DNA, 13 bp, D. melanogaster
aaagtaggcaaca

SEQ ID NO: 549622 - DNA, 14 bp, D. melanogaster
aaagtaggcaacaa

SEQ ID NO: 549623 - DNA, 14 bp, D. melanogaster
aaagtaggcaacac

SEQ ID NO: 549624 - DNA, 13 bp, D. melanogaster
aaagtagtagtat

SEQ ID NO: 549625 - DNA, 13 bp, D. melanogaster
aaagtataaaatc

SEQ ID NO: 549626 - DNA, 13 bp, D. melanogaster
aaagtataaattc

SEQ ID NO: 549627 - DNA, 14 bp, D. melanogaster
aaagtataatttga

SEQ ID NO: 549628 - DNA, 13 bp, D. melanogaster
aaagtatacaaat

SEQ ID NO: 549629 - DNA, 13 bp, D. melanogaster
aaagtatacatat

SEQ ID NO: 549630 - DNA, 13 bp, D. melanogaster
aaagtatagatat

SEQ ID NO: 549631 - DNA, 13 bp, D. melanogaster
aaagtatatacaa

SEQ ID NO: 549632 - DNA, 14 bp, D. melanogaster
aaagtatatacaaa

SEQ ID NO: 549633 - DNA, 14 bp, D. melanogaster
aaagtatatacaat

SEQ ID NO: 549634 - DNA, 13 bp, D. melanogaster
aaagtatatcaaa

SEQ ID NO: 549635 - DNA, 13 bp, D. melanogaster
aaagtatcaaaac

SEQ ID NO: 549636 - DNA, 14 bp, D. melanogaster
aaagtatcaaaaca

SEQ ID NO: 549637 - DNA, 13 bp, D. melanogaster
aaagtatcaaatt

SEQ ID NO: 549638 - DNA, 13 bp, D. melanogaster
aaagtatccaaaa

SEQ ID NO: 549639 - DNA, 13 bp, D. melanogaster
aaagtatccgaaa

SEQ ID NO: 549640 - DNA, 13 bp, D. melanogaster
aaagtatctaaaa

SEQ ID NO: 549641 - DNA, 13 bp, D. melanogaster
aaagtatctgaaa

SEQ ID NO: 549642 - DNA, 13 bp, D. melanogaster
aaagtatctgcaa

SEQ ID NO: 549643 - DNA, 13 bp, D. melanogaster
aaagtatcttaaa

SEQ ID NO: 549644 - DNA, 13 bp, D. melanogaster
aaagtatctttta

SEQ ID NO: 549645 - DNA, 13 bp, D. melanogaster
aaagtatcttttt

SEQ ID NO: 549646 - DNA, 14 bp, D. melanogaster
aaagtatgaggaaa

SEQ ID NO: 549647 - DNA, 13 bp, D. melanogaster
aaagtatgcaaca

SEQ ID NO: 549648 - DNA, 14 bp, D. melanogaster
aaagtatgcaacac

SEQ ID NO: 549649 - DNA, 14 bp, D. melanogaster
aaagtatgcaataa

SEQ ID NO: 549650 - DNA, 13 bp, D. melanogaster
aaagtatgcaatg

SEQ ID NO: 549651 - DNA, 13 bp, D. melanogaster
aaagtatgcagca

SEQ ID NO: 549652 - DNA, 14 bp, D. melanogaster
aaagtatgcagcaa

SEQ ID NO: 549653 - DNA, 14 bp, D. melanogaster
aaagtatgcagcac

SEQ ID NO: 549654 - DNA, 13 bp, D. melanogaster
aaagtatgcagtg

SEQ ID NO: 549655 - DNA, 13 bp, D. melanogaster
aaagtatgccaca

SEQ ID NO: 549656 - DNA, 13 bp, D. melanogaster
aaagtatgctaca

SEQ ID NO: 549657 - DNA, 14 bp, D. melanogaster
aaagtatgctacaa

SEQ ID NO: 549658 - DNA, 14 bp, D. melanogaster
aaagtatgctacac

SEQ ID NO: 549659 - DNA, 13 bp, D. melanogaster
aaagtatgctacg

SEQ ID NO: 549660 - DNA, 13 bp, D. melanogaster
aaagtatgctatg

SEQ ID NO: 549661 - DNA, 13 bp, D. melanogaster
aaagtatgctatt

SEQ ID NO: 549662 - DNA, 13 bp, D. melanogaster
aaagtatggcaaa

SEQ ID NO: 549663 - DNA, 14 bp, D. melanogaster
aaagtatggcaaaa

SEQ ID NO: 549664 - DNA, 13 bp, D. melanogaster
aaagtatgtacat

SEQ ID NO: 549665 - DNA, 13 bp, D. melanogaster
aaagtatgtatgt

SEQ ID NO: 549666 - DNA, 13 bp, D. melanogaster
aaagtatgtgaaa

SEQ ID NO: 549667 - DNA, 13 bp, D. melanogaster
aaagtattaaagt

SEQ ID NO: 549668 - DNA, 13 bp, D. melanogaster
aaagtattacaaa

SEQ ID NO: 549669 - DNA, 13 bp, D. melanogaster
aaagtattcaaaa

SEQ ID NO: 549670 - DNA, 13 bp, D. melanogaster
aaagtattcaaat

SEQ ID NO: 549671 - DNA, 13 bp, D. melanogaster
aaagtattcaata

SEQ ID NO: 549672 - DNA, 13 bp, D. melanogaster
aaagtattcattt

SEQ ID NO: 549673 - DNA, 13 bp, D. melanogaster
aaagtattgaaat

SEQ ID NO: 549674 - DNA, 13 bp, D. melanogaster
aaagtattggatt

SEQ ID NO: 549675 - DNA, 13 bp, D. melanogaster
aaagtattgtaaa

SEQ ID NO: 549676 - DNA, 13 bp, D. melanogaster
aaagtattgtatt

SEQ ID NO: 549677 - DNA, 13 bp, D. melanogaster
aaagtatttaact

SEQ ID NO: 549678 - DNA, 13 bp, D. melanogaster
aaagtatttaaga

SEQ ID NO: 549679 - DNA, 13 bp, D. melanogaster
aaagtatttacaa

SEQ ID NO: 549680 - DNA, 14 bp, D. melanogaster
aaagtatttacaag

SEQ ID NO: 549681 - DNA, 14 bp, D. melanogaster
aaagtatttacaca

SEQ ID NO: 549682 - DNA, 14 bp, D. melanogaster
aaagtatttcaatt

SEQ ID NO: 549683 - DNA, 13 bp, D. melanogaster
aaagtatttcttt

SEQ ID NO: 549684 - DNA, 13 bp, D. melanogaster
aaagtatttgaaa

SEQ ID NO: 549685 - DNA, 13 bp, D. melanogaster
aaagtatttgaat

SEQ ID NO: 549686 - DNA, 13 bp, D. melanogaster
aaagtatttgatt

SEQ ID NO: 549687 - DNA, 13 bp, D. melanogaster
aaagtatttgcaa

SEQ ID NO: 549688 - DNA, 13 bp, D. melanogaster
aaagtatttgcat

SEQ ID NO: 549689 - DNA, 13 bp, D. melanogaster
aaagtatttggca

SEQ ID NO: 549690 - DNA, 13 bp, D. melanogaster
aaagtatttggtt

SEQ ID NO: 549691 - DNA, 14 bp, D. melanogaster
aaagtattttaaag

SEQ ID NO: 549692 - DNA, 13 bp, D. melanogaster
aaagtattttcaa

SEQ ID NO: 549693 - DNA, 14 bp, D. melanogaster
aaagtattttcaaa

SEQ ID NO: 549694 - DNA, 13 bp, D. melanogaster
aaagtattttcat

SEQ ID NO: 549695 - DNA, 13 bp, D. melanogaster
aaagtattttcta

SEQ ID NO: 549696 - DNA, 13 bp, D. melanogaster
aaagtattttctt

SEQ ID NO: 549697 - DNA, 13 bp, D. melanogaster
aaagtattttgca

SEQ ID NO: 549698 - DNA, 13 bp, D. melanogaster
aaagtattttgtt

SEQ ID NO: 549699 - DNA, 13 bp, D. melanogaster
aaagtatttttac

SEQ ID NO: 549700 - DNA, 13 bp, D. melanogaster
aaagtatttttca

SEQ ID NO: 549701 - DNA, 13 bp, D. melanogaster
aaagtattttttc

SEQ ID NO: 549702 - DNA, 13 bp, D. melanogaster
aaagtcaaaaagg

SEQ ID NO: 549703 - DNA, 13 bp, D. melanogaster
aaagtcaaaaatt

SEQ ID NO: 549704 - DNA, 13 bp, D. melanogaster
aaagtcaaaagca

SEQ ID NO: 549705 - DNA, 13 bp, D. melanogaster
aaagtcaaaagga

SEQ ID NO: 549706 - DNA, 13 bp, D. melanogaster
aaagtcaaaagtg

SEQ ID NO: 549707 - DNA, 13 bp, D. melanogaster
aaagtcaaactta

SEQ ID NO: 549708 - DNA, 14 bp, D. melanogaster
aaagtcaaagaact

SEQ ID NO: 549709 - DNA, 13 bp, D. melanogaster
aaagtcaaagcca

SEQ ID NO: 549710 - DNA, 13 bp, D. melanogaster
aaagtcaaagcga

SEQ ID NO: 549711 - DNA, 13 bp, D. melanogaster
aaagtcaaaggca

SEQ ID NO: 549712 - DNA, 13 bp, D. melanogaster
aaagtcaaagtca

SEQ ID NO: 549713 - DNA, 14 bp, D. melanogaster
aaagtcaaagtcaa

SEQ ID NO: 549714 - DNA, 13 bp, D. melanogaster
aaagtcaaagtcc

SEQ ID NO: 549715 - DNA, 13 bp, D. melanogaster
aaagtcaaagtta

SEQ ID NO: 549716 - DNA, 13 bp, D. melanogaster
aaagtcaaatatt

SEQ ID NO: 549717 - DNA, 13 bp, D. melanogaster
aaagtcaaatcaa

SEQ ID NO: 549718 - DNA, 13 bp, D. melanogaster
aaagtcaaatgaa

SEQ ID NO: 549719 - DNA, 13 bp, D. melanogaster
aaagtcaaatgca

SEQ ID NO: 549720 - DNA, 13 bp, D. melanogaster
aaagtcaacaaac

SEQ ID NO: 549721 - DNA, 13 bp, D. melanogaster
aaagtcaacaaag

SEQ ID NO: 549722 - DNA, 13 bp, D. melanogaster
aaagtcaacacaa

SEQ ID NO: 549723 - DNA, 13 bp, D. melanogaster
aaagtcaacagaa

SEQ ID NO: 549724 - DNA, 13 bp, D. melanogaster
aaagtcaacagca

SEQ ID NO: 549725 - DNA, 13 bp, D. melanogaster
aaagtcaactaaa

SEQ ID NO: 549726 - DNA, 13 bp, D. melanogaster
aaagtcaaggaaa

SEQ ID NO: 549727 - DNA, 13 bp, D. melanogaster
aaagtcaaggcaa

SEQ ID NO: 549728 - DNA, 13 bp, D. melanogaster
aaagtcaagtgca

SEQ ID NO: 549729 - DNA, 13 bp, D. melanogaster
aaagtcaagtgct

SEQ ID NO: 549730 - DNA, 13 bp, D. melanogaster
aaagtcaagtgga

SEQ ID NO: 549731 - DNA, 13 bp, D. melanogaster
aaagtcaagtgtc

SEQ ID NO: 549732 - DNA, 13 bp, D. melanogaster
aaagtcaagttga

SEQ ID NO: 549733 - DNA, 13 bp, D. melanogaster
aaagtcaataaat

SEQ ID NO: 549734 - DNA, 13 bp, D. melanogaster
aaagtcaatcaat

SEQ ID NO: 549735 - DNA, 13 bp, D. melanogaster
aaagtcaatgcca

SEQ ID NO: 549736 - DNA, 13 bp, D. melanogaster
aaagtcaatggca

SEQ ID NO: 549737 - DNA, 13 bp, D. melanogaster
aaagtcaattaaa

SEQ ID NO: 549738 - DNA, 14 bp, D. melanogaster
aaagtcaattaaaa

SEQ ID NO: 549739 - DNA, 14 bp, D. melanogaster
aaagtcaatttcta

SEQ ID NO: 549740 - DNA, 13 bp, D. melanogaster
aaagtcacaaaat

SEQ ID NO: 549741 - DNA, 13 bp, D. melanogaster
aaagtcacacaaa

SEQ ID NO: 549742 - DNA, 13 bp, D. melanogaster
aaagtcactaaag

SEQ ID NO: 549743 - DNA, 13 bp, D. melanogaster
aaagtcagaataa

SEQ ID NO: 549744 - DNA, 13 bp, D. melanogaster
aaagtcagcaaaa

SEQ ID NO: 549745 - DNA, 13 bp, D. melanogaster
aaagtcagcatta

SEQ ID NO: 549746 - DNA, 13 bp, D. melanogaster
aaagtcaggccaa

SEQ ID NO: 549747 - DNA, 13 bp, D. melanogaster
aaagtcagtcgta

SEQ ID NO: 549748 - DNA, 13 bp, D. melanogaster
aaagtcataaatt

SEQ ID NO: 549749 - DNA, 13 bp, D. melanogaster
aaagtcattattt

SEQ ID NO: 549750 - DNA, 13 bp, D. melanogaster
aaagtcatttatt

SEQ ID NO: 549751 - DNA, 13 bp, D. melanogaster
aaagtcatttcca

SEQ ID NO: 549752 - DNA, 13 bp, D. melanogaster
aaagtcatttgtg

SEQ ID NO: 549753 - DNA, 13 bp, D. melanogaster
aaagtcattttta

SEQ ID NO: 549754 - DNA, 13 bp, D. melanogaster
aaagtcatttttg

SEQ ID NO: 549755 - DNA, 13 bp, D. melanogaster
aaagtccaactca

SEQ ID NO: 549756 - DNA, 13 bp, D. melanogaster
aaagtccaatgct

SEQ ID NO: 549757 - DNA, 13 bp, D. melanogaster
aaagtccacaaaa

SEQ ID NO: 549758 - DNA, 13 bp, D. melanogaster
aaagtccatcaaa

SEQ ID NO: 549759 - DNA, 13 bp, D. melanogaster
aaagtccatcgag

SEQ ID NO: 549760 - DNA, 13 bp, D. melanogaster
aaagtccattaaa

SEQ ID NO: 549761 - DNA, 13 bp, D. melanogaster
aaagtcccaattt

SEQ ID NO: 549762 - DNA, 13 bp, D. melanogaster
aaagtccggaaaa

SEQ ID NO: 549763 - DNA, 13 bp, D. melanogaster
aaagtcctttggc

SEQ ID NO: 549764 - DNA, 13 bp, D. melanogaster
aaagtcgaaaagt

SEQ ID NO: 549765 - DNA, 13 bp, D. melanogaster
aaagtcgaaagaa

SEQ ID NO: 549766 - DNA, 13 bp, D. melanogaster
aaagtcgaaagtc

SEQ ID NO: 549767 - DNA, 13 bp, D. melanogaster
aaagtcgagaaaa

SEQ ID NO: 549768 - DNA, 13 bp, D. melanogaster
aaagtcgaggaaa

SEQ ID NO: 549769 - DNA, 13 bp, D. melanogaster
aaagtcgaggggc

SEQ ID NO: 549770 - DNA, 13 bp, D. melanogaster
aaagtcggaaaaa

SEQ ID NO: 549771 - DNA, 13 bp, D. melanogaster
aaagtcggaaaat

SEQ ID NO: 549772 - DNA, 13 bp, D. melanogaster
aaagtcgtaaaat

SEQ ID NO: 549773 - DNA, 13 bp, D. melanogaster
aaagtctaaaaat

SEQ ID NO: 549774 - DNA, 13 bp, D. melanogaster
aaagtctataatt

SEQ ID NO: 549775 - DNA, 13 bp, D. melanogaster
aaagtctcaaaac

SEQ ID NO: 549776 - DNA, 13 bp, D. melanogaster
aaagtctgaaaag

SEQ ID NO: 549777 - DNA, 13 bp, D. melanogaster
aaagtctgactgg

SEQ ID NO: 549778 - DNA, 13 bp, D. melanogaster
aaagtcttctaaa

SEQ ID NO: 549779 - DNA, 13 bp, D. melanogaster
aaagtctttaaat

SEQ ID NO: 549780 - DNA, 13 bp, D. melanogaster
aaagtctttgaaa

SEQ ID NO: 549781 - DNA, 13 bp, D. melanogaster
aaagtcttttaaa

SEQ ID NO: 549782 - DNA, 13 bp, D. melanogaster
aaagtcttttttt

SEQ ID NO: 549783 - DNA, 13 bp, D. melanogaster
aaagtgaaaaacg

SEQ ID NO: 549784 - DNA, 13 bp, D. melanogaster
aaagtgaaaaact

SEQ ID NO: 549785 - DNA, 13 bp, D. melanogaster
aaagtgaaaacat

SEQ ID NO: 549786 - DNA, 13 bp, D. melanogaster
aaagtgaaaacca

SEQ ID NO: 549787 - DNA, 14 bp, D. melanogaster
aaagtgaaaacgaa

SEQ ID NO: 549788 - DNA, 13 bp, D. melanogaster
aaagtgaaaacta

SEQ ID NO: 549789 - DNA, 13 bp, D. melanogaster
aaagtgaaaactg

SEQ ID NO: 549790 - DNA, 13 bp, D. melanogaster
aaagtgaaaagtg

SEQ ID NO: 549791 - DNA, 13 bp, D. melanogaster
aaagtgaaaagtt

SEQ ID NO: 549792 - DNA, 13 bp, D. melanogaster
aaagtgaaaatca

SEQ ID NO: 549793 - DNA, 13 bp, D. melanogaster
aaagtgaaaatgt

SEQ ID NO: 549794 - DNA, 13 bp, D. melanogaster
aaagtgaaacaat

SEQ ID NO: 549795 - DNA, 13 bp, D. melanogaster
aaagtgaaacatt

SEQ ID NO: 549796 - DNA, 14 bp, D. melanogaster
aaagtgaaacattt

SEQ ID NO: 549797 - DNA, 14 bp, D. melanogaster
aaagtgaaaccgaa

SEQ ID NO: 549798 - DNA, 13 bp, D. melanogaster
aaagtgaaactaa

SEQ ID NO: 549799 - DNA, 13 bp, D. melanogaster
aaagtgaaactta

SEQ ID NO: 549800 - DNA, 13 bp, D. melanogaster
aaagtgaaacttg

SEQ ID NO: 549801 - DNA, 13 bp, D. melanogaster
aaagtgaaacttt

SEQ ID NO: 549802 - DNA, 13 bp, D. melanogaster
aaagtgaaagcca

SEQ ID NO: 549803 - DNA, 13 bp, D. melanogaster
aaagtgaaaggca

SEQ ID NO: 549804 - DNA, 13 bp, D. melanogaster
aaagtgaaagtag

SEQ ID NO: 549805 - DNA, 14 bp, D. melanogaster
aaagtgaaagtagg

SEQ ID NO: 549806 - DNA, 13 bp, D. melanogaster
aaagtgaaagtca

SEQ ID NO: 549807 - DNA, 13 bp, D. melanogaster
aaagtgaaagttg

SEQ ID NO: 549808 - DNA, 13 bp, D. melanogaster
aaagtgaaagttt

SEQ ID NO: 549809 - DNA, 14 bp, D. melanogaster
aaagtgaaagtttt

SEQ ID NO: 549810 - DNA, 13 bp, D. melanogaster
aaagtgaaatcaa

SEQ ID NO: 549811 - DNA, 14 bp, D. melanogaster
aaagtgaaatgcaa

SEQ ID NO: 549812 - DNA, 13 bp, D. melanogaster
aaagtgaaatgct

SEQ ID NO: 549813 - DNA, 13 bp, D. melanogaster
aaagtgaaatgtg

SEQ ID NO: 549814 - DNA, 13 bp, D. melanogaster
aaagtgaaatgtt

SEQ ID NO: 549815 - DNA, 13 bp, D. melanogaster
aaagtgaaattca

SEQ ID NO: 549816 - DNA, 13 bp, D. melanogaster
aaagtgaaattga

SEQ ID NO: 549817 - DNA, 13 bp, D. melanogaster
aaagtgaaattgt

SEQ ID NO: 549818 - DNA, 14 bp, D. melanogaster
aaagtgaaatttat

SEQ ID NO: 549819 - DNA, 13 bp, D. melanogaster
aaagtgaaatttg

SEQ ID NO: 549820 - DNA, 13 bp, D. melanogaster
aaagtgaacaaat

SEQ ID NO: 549821 - DNA, 13 bp, D. melanogaster
aaagtgaacaatt

SEQ ID NO: 549822 - DNA, 13 bp, D. melanogaster
aaagtgaacattt

SEQ ID NO: 549823 - DNA, 13 bp, D. melanogaster
aaagtgaaccaat

SEQ ID NO: 549824 - DNA, 13 bp, D. melanogaster
aaagtgaactaaa

SEQ ID NO: 549825 - DNA, 13 bp, D. melanogaster
aaagtgaactttt

SEQ ID NO: 549826 - DNA, 13 bp, D. melanogaster
aaagtgaagaatt

SEQ ID NO: 549827 - DNA, 13 bp, D. melanogaster
aaagtgaagcaga

SEQ ID NO: 549828 - DNA, 13 bp, D. melanogaster
aaagtgaagtaac

SEQ ID NO: 549829 - DNA, 13 bp, D. melanogaster
aaagtgaagtgaa

SEQ ID NO: 549830 - DNA, 14 bp, D. melanogaster
aaagtgaagtgaag

SEQ ID NO: 549831 - DNA, 13 bp, D. melanogaster
aaagtgaagtgag

SEQ ID NO: 549832 - DNA, 13 bp, D. melanogaster
aaagtgaagtgtt

SEQ ID NO: 549833 - DNA, 13 bp, D. melanogaster
aaagtgaagtttt

SEQ ID NO: 549834 - DNA, 13 bp, D. melanogaster
aaagtgaatacaa

SEQ ID NO: 549835 - DNA, 13 bp, D. melanogaster
aaagtgaatgaat

SEQ ID NO: 549836 - DNA, 13 bp, D. melanogaster
aaagtgaatggga

SEQ ID NO: 549837 - DNA, 13 bp, D. melanogaster
aaagtgaatttca

SEQ ID NO: 549838 - DNA, 13 bp, D. melanogaster
aaagtgaatttta

SEQ ID NO: 549839 - DNA, 13 bp, D. melanogaster
aaagtgacaaatt

SEQ ID NO: 549840 - DNA, 13 bp, D. melanogaster
aaagtgacaattt

SEQ ID NO: 549841 - DNA, 13 bp, D. melanogaster
aaagtgagcgaaa

SEQ ID NO: 549842 - DNA, 13 bp, D. melanogaster
aaagtgagtgagt

SEQ ID NO: 549843 - DNA, 13 bp, D. melanogaster
aaagtgatatatt

SEQ ID NO: 549844 - DNA, 13 bp, D. melanogaster
aaagtgatgaaat

SEQ ID NO: 549845 - DNA, 13 bp, D. melanogaster
aaagtgattgcaa

SEQ ID NO: 549846 - DNA, 13 bp, D. melanogaster
aaagtgatttata

SEQ ID NO: 549847 - DNA, 13 bp, D. melanogaster
aaagtgatttcaa

SEQ ID NO: 549848 - DNA, 13 bp, D. melanogaster
aaagtgatttctt

SEQ ID NO: 549849 - DNA, 13 bp, D. melanogaster
aaagtgatttgaa

SEQ ID NO: 549850 - DNA, 13 bp, D. melanogaster
aaagtgattttat

SEQ ID NO: 549851 - DNA, 13 bp, D. melanogaster
aaagtgattttct

SEQ ID NO: 549852 - DNA, 13 bp, D. melanogaster
aaagtgattttta

SEQ ID NO: 549853 - DNA, 13 bp, D. melanogaster
aaagtgatttttc

SEQ ID NO: 549854 - DNA, 13 bp, D. melanogaster
aaagtgcaaaaac

SEQ ID NO: 549855 - DNA, 14 bp, D. melanogaster
aaagtgcaaaaata

SEQ ID NO: 549856 - DNA, 13 bp, D. melanogaster
aaagtgcaaaagc

SEQ ID NO: 549857 - DNA, 13 bp, D. melanogaster
aaagtgcaaaagg

SEQ ID NO: 549858 - DNA, 13 bp, D. melanogaster
aaagtgcaaaagt

SEQ ID NO: 549859 - DNA, 13 bp, D. melanogaster
aaagtgcaaaatc

SEQ ID NO: 549860 - DNA, 13 bp, D. melanogaster
aaagtgcaaaatt

SEQ ID NO: 549861 - DNA, 13 bp, D. melanogaster
aaagtgcaaacaa

SEQ ID NO: 549862 - DNA, 13 bp, D. melanogaster
aaagtgcaaacag

SEQ ID NO: 549863 - DNA, 13 bp, D. melanogaster
aaagtgcaaagaa

SEQ ID NO: 549864 - DNA, 13 bp, D. melanogaster
aaagtgcaaagtg

SEQ ID NO: 549865 - DNA, 13 bp, D. melanogaster
aaagtgcaaatgt

SEQ ID NO: 549866 - DNA, 13 bp, D. melanogaster
aaagtgcaacaaa

SEQ ID NO: 549867 - DNA, 13 bp, D. melanogaster
aaagtgcaagcca

SEQ ID NO: 549868 - DNA, 13 bp, D. melanogaster
aaagtgcaagtga

SEQ ID NO: 549869 - DNA, 13 bp, D. melanogaster
aaagtgcaagtgc

SEQ ID NO: 549870 - DNA, 13 bp, D. melanogaster
aaagtgcaagttt

SEQ ID NO: 549871 - DNA, 13 bp, D. melanogaster
aaagtgcaataaa

SEQ ID NO: 549872 - DNA, 14 bp, D. melanogaster
aaagtgcaataaat

SEQ ID NO: 549873 - DNA, 13 bp, D. melanogaster
aaagtgcaataat

SEQ ID NO: 549874 - DNA, 13 bp, D. melanogaster
aaagtgcaatatt

SEQ ID NO: 549875 - DNA, 13 bp, D. melanogaster
aaagtgcaatcaa

SEQ ID NO: 549876 - DNA, 13 bp, D. melanogaster
aaagtgcaatgaa

SEQ ID NO: 549877 - DNA, 13 bp, D. melanogaster
aaagtgcaatgca

SEQ ID NO: 549878 - DNA, 13 bp, D. melanogaster
aaagtgcaattaa

SEQ ID NO: 549879 - DNA, 14 bp, D. melanogaster
aaagtgcaattaaa

SEQ ID NO: 549880 - DNA, 13 bp, D. melanogaster
aaagtgcaattga

SEQ ID NO: 549881 - DNA, 13 bp, D. melanogaster
aaagtgcacaaat

SEQ ID NO: 549882 - DNA, 13 bp, D. melanogaster
aaagtgcacacac

SEQ ID NO: 549883 - DNA, 13 bp, D. melanogaster
aaagtgcacttaa

SEQ ID NO: 549884 - DNA, 14 bp, D. melanogaster
aaagtgcacttaaa

SEQ ID NO: 549885 - DNA, 13 bp, D. melanogaster
aaagtgcagaaag

SEQ ID NO: 549886 - DNA, 13 bp, D. melanogaster
aaagtgcagaaat

SEQ ID NO: 549887 - DNA, 13 bp, D. melanogaster
aaagtgcagacaa

SEQ ID NO: 549888 - DNA, 13 bp, D. melanogaster
aaagtgcagcaaa

SEQ ID NO: 549889 - DNA, 13 bp, D. melanogaster
aaagtgcagcaga

SEQ ID NO: 549890 - DNA, 13 bp, D. melanogaster
aaagtgcagcagc

SEQ ID NO: 549891 - DNA, 13 bp, D. melanogaster
aaagtgcagccaa

SEQ ID NO: 549892 - DNA, 13 bp, D. melanogaster
aaagtgcagctca

SEQ ID NO: 549893 - DNA, 13 bp, D. melanogaster
aaagtgcaggaaa

SEQ ID NO: 549894 - DNA, 13 bp, D. melanogaster
aaagtgcagtaaa

SEQ ID NO: 549895 - DNA, 14 bp, D. melanogaster
aaagtgcagtattt

SEQ ID NO: 549896 - DNA, 14 bp, D. melanogaster
aaagtgcagtttgc

SEQ ID NO: 549897 - DNA, 13 bp, D. melanogaster
aaagtgcagtttt

SEQ ID NO: 549898 - DNA, 13 bp, D. melanogaster
aaagtgcataaca

SEQ ID NO: 549899 - DNA, 13 bp, D. melanogaster
aaagtgcatatat

SEQ ID NO: 549900 - DNA, 13 bp, D. melanogaster
aaagtgcattaaa

SEQ ID NO: 549901 - DNA, 13 bp, D. melanogaster
aaagtgcattgaa

SEQ ID NO: 549902 - DNA, 13 bp, D. melanogaster
aaagtgcatttaa

SEQ ID NO: 549903 - DNA, 14 bp, D. melanogaster
aaagtgcatttaaa

SEQ ID NO: 549904 - DNA, 13 bp, D. melanogaster
aaagtgcatttca

SEQ ID NO: 549905 - DNA, 13 bp, D. melanogaster
aaagtgcatttcc

SEQ ID NO: 549906 - DNA, 13 bp, D. melanogaster
aaagtgcatttta

SEQ ID NO: 549907 - DNA, 13 bp, D. melanogaster
aaagtgcattttt

SEQ ID NO: 549908 - DNA, 14 bp, D. melanogaster
aaagtgcatttttc

SEQ ID NO: 549909 - DNA, 14 bp, D. melanogaster
aaagtgccaaaaag

SEQ ID NO: 549910 - DNA, 13 bp, D. melanogaster
aaagtgccaaaag

SEQ ID NO: 549911 - DNA, 14 bp, D. melanogaster
aaagtgccaagaaa

SEQ ID NO: 549912 - DNA, 13 bp, D. melanogaster
aaagtgccaatta

SEQ ID NO: 549913 - DNA, 13 bp, D. melanogaster
aaagtgccagaaa

SEQ ID NO: 549914 - DNA, 13 bp, D. melanogaster
aaagtgccagcaa

SEQ ID NO: 549915 - DNA, 13 bp, D. melanogaster
aaagtgcccgaaa

SEQ ID NO: 549916 - DNA, 14 bp, D. melanogaster
aaagtgcctgaaaa

SEQ ID NO: 549917 - DNA, 13 bp, D. melanogaster
aaagtgcctgtat

SEQ ID NO: 549918 - DNA, 13 bp, D. melanogaster
aaagtgccttaaa

SEQ ID NO: 549919 - DNA, 13 bp, D. melanogaster
aaagtgcgaaaaa

SEQ ID NO: 549920 - DNA, 13 bp, D. melanogaster
aaagtgcgaaaag

SEQ ID NO: 549921 - DNA, 13 bp, D. melanogaster
aaagtgcggaaaa

SEQ ID NO: 549922 - DNA, 13 bp, D. melanogaster
aaagtgctaaaaa

SEQ ID NO: 549923 - DNA, 13 bp, D. melanogaster
aaagtgctcgaaa

SEQ ID NO: 549924 - DNA, 13 bp, D. melanogaster
aaagtgctgaaaa

SEQ ID NO: 549925 - DNA, 13 bp, D. melanogaster
aaagtgctgaaat

SEQ ID NO: 549926 - DNA, 14 bp, D. melanogaster
aaagtgctgccata

SEQ ID NO: 549927 - DNA, 13 bp, D. melanogaster
aaagtgctggcca

SEQ ID NO: 549928 - DNA, 13 bp, D. melanogaster
aaagtgcttaaaa

SEQ ID NO: 549929 - DNA, 13 bp, D. melanogaster
aaagtgctttaaa

SEQ ID NO: 549930 - DNA, 14 bp, D. melanogaster
aaagtggaaaaatt

SEQ ID NO: 549931 - DNA, 13 bp, D. melanogaster
aaagtggaaaaca

SEQ ID NO: 549932 - DNA, 13 bp, D. melanogaster
aaagtggaaaacg

SEQ ID NO: 549933 - DNA, 13 bp, D. melanogaster
aaagtggaaaagc

SEQ ID NO: 549934 - DNA, 14 bp, D. melanogaster
aaagtggaaaagcg

SEQ ID NO: 549935 - DNA, 14 bp, D. melanogaster
aaagtggaaaatgg

SEQ ID NO: 549936 - DNA, 13 bp, D. melanogaster
aaagtggaaaatt

SEQ ID NO: 549937 - DNA, 14 bp, D. melanogaster
aaagtggaaaattg

SEQ ID NO: 549938 - DNA, 13 bp, D. melanogaster
aaagtggaaacaa

SEQ ID NO: 549939 - DNA, 13 bp, D. melanogaster
aaagtggaaagcg

SEQ ID NO: 549940 - DNA, 13 bp, D. melanogaster
aaagtggaaagtg

SEQ ID NO: 549941 - DNA, 14 bp, D. melanogaster
aaagtggaaagtgg

SEQ ID NO: 549942 - DNA, 13 bp, D. melanogaster
aaagtggaaagtt

SEQ ID NO: 549943 - DNA, 13 bp, D. melanogaster
aaagtggaaatat

SEQ ID NO: 549944 - DNA, 13 bp, D. melanogaster
aaagtggaaatgc

SEQ ID NO: 549945 - DNA, 13 bp, D. melanogaster
aaagtggaaatgg

SEQ ID NO: 549946 - DNA, 13 bp, D. melanogaster
aaagtggaaattt

SEQ ID NO: 549947 - DNA, 13 bp, D. melanogaster
aaagtggagcaaa

SEQ ID NO: 549948 - DNA, 13 bp, D. melanogaster
aaagtggagcaca

SEQ ID NO: 549949 - DNA, 13 bp, D. melanogaster
aaagtggatgtgg

SEQ ID NO: 549950 - DNA, 13 bp, D. melanogaster
aaagtggcaaaaa

SEQ ID NO: 549951 - DNA, 13 bp, D. melanogaster
aaagtggcaaaag

SEQ ID NO: 549952 - DNA, 13 bp, D. melanogaster
aaagtggcaaaca

SEQ ID NO: 549953 - DNA, 13 bp, D. melanogaster
aaagtggcaaagt

SEQ ID NO: 549954 - DNA, 14 bp, D. melanogaster
aaagtggcaacaaa

SEQ ID NO: 549955 - DNA, 13 bp, D. melanogaster
aaagtggcaagaa

SEQ ID NO: 549956 - DNA, 13 bp, D. melanogaster
aaagtggcaagag

SEQ ID NO: 549957 - DNA, 13 bp, D. melanogaster
aaagtggcacaaa

SEQ ID NO: 549958 - DNA, 13 bp, D. melanogaster
aaagtggcagaaa

SEQ ID NO: 549959 - DNA, 13 bp, D. melanogaster
aaagtggcagcca

SEQ ID NO: 549960 - DNA, 13 bp, D. melanogaster
aaagtggcagtgg

SEQ ID NO: 549961 - DNA, 13 bp, D. melanogaster
aaagtggcatcga

SEQ ID NO: 549962 - DNA, 13 bp, D. melanogaster
aaagtggcattta

SEQ ID NO: 549963 - DNA, 13 bp, D. melanogaster
aaagtggccaaaa

SEQ ID NO: 549964 - DNA, 13 bp, D. melanogaster
aaagtggccaaca

SEQ ID NO: 549965 - DNA, 13 bp, D. melanogaster
aaagtggccaaga

SEQ ID NO: 549966 - DNA, 13 bp, D. melanogaster
aaagtggccaagt

SEQ ID NO: 549967 - DNA, 13 bp, D. melanogaster
aaagtggccataa

SEQ ID NO: 549968 - DNA, 13 bp, D. melanogaster
aaagtggcccaaa

SEQ ID NO: 549969 - DNA, 13 bp, D. melanogaster
aaagtggcgaaaa

SEQ ID NO: 549970 - DNA, 13 bp, D. melanogaster
aaagtggcgcaaa

SEQ ID NO: 549971 - DNA, 13 bp, D. melanogaster
aaagtggcggaaa

SEQ ID NO: 549972 - DNA, 13 bp, D. melanogaster
aaagtggctgcat

SEQ ID NO: 549973 - DNA, 13 bp, D. melanogaster
aaagtggctgcca

SEQ ID NO: 549974 - DNA, 13 bp, D. melanogaster
aaagtggcttaaa

SEQ ID NO: 549975 - DNA, 13 bp, D. melanogaster
aaagtgggaaata

SEQ ID NO: 549976 - DNA, 13 bp, D. melanogaster
aaagtgggcaaaa

SEQ ID NO: 549977 - DNA, 13 bp, D. melanogaster
aaagtgggcaaag

SEQ ID NO: 549978 - DNA, 13 bp, D. melanogaster
aaagtgggccaaa

SEQ ID NO: 549979 - DNA, 14 bp, D. melanogaster
aaagtgggcggaaa

SEQ ID NO: 549980 - DNA, 13 bp, D. melanogaster
aaagtgggcggtg

SEQ ID NO: 549981 - DNA, 13 bp, D. melanogaster
aaagtgggcgtgg

SEQ ID NO: 549982 - DNA, 14 bp, D. melanogaster
aaagtggggaaaac

SEQ ID NO: 549983 - DNA, 14 bp, D. melanogaster
aaagtggggaaaat

SEQ ID NO: 549984 - DNA, 13 bp, D. melanogaster
aaagtgggtgaaa

SEQ ID NO: 549985 - DNA, 13 bp, D. melanogaster
aaagtgggtggca

SEQ ID NO: 549986 - DNA, 13 bp, D. melanogaster
aaagtggtccaaa

SEQ ID NO: 549987 - DNA, 13 bp, D. melanogaster
aaagtggtcttca

SEQ ID NO: 549988 - DNA, 13 bp, D. melanogaster
aaagtggttaaat

SEQ ID NO: 549989 - DNA, 13 bp, D. melanogaster
aaagtggttttca

SEQ ID NO: 549990 - DNA, 13 bp, D. melanogaster
aaagtgtaaaatg

SEQ ID NO: 549991 - DNA, 14 bp, D. melanogaster
aaagtgtaaacaaa

SEQ ID NO: 549992 - DNA, 13 bp, D. melanogaster
aaagtgtaaagtg

SEQ ID NO: 549993 - DNA, 14 bp, D. melanogaster
aaagtgtaaagtgc

SEQ ID NO: 549994 - DNA, 13 bp, D. melanogaster
aaagtgtaatatt

SEQ ID NO: 549995 - DNA, 13 bp, D. melanogaster
aaagtgtaatcaa

SEQ ID NO: 549996 - DNA, 13 bp, D. melanogaster
aaagtgtaattaa

SEQ ID NO: 549997 - DNA, 13 bp, D. melanogaster
aaagtgtaattta

SEQ ID NO: 549998 - DNA, 13 bp, D. melanogaster
aaagtgtacaaaa

SEQ ID NO: 549999 - DNA, 13 bp, D. melanogaster
aaagtgtacatcc

SEQ ID NO: 550000 - DNA, 14 bp, D. melanogaster
aaagtgtagcatac

SEQ ID NO: 550001 - DNA, 13 bp, D. melanogaster
aaagtgtataaat

SEQ ID NO: 550002 - DNA, 13 bp, D. melanogaster
aaagtgtataatt

SEQ ID NO: 550003 - DNA, 13 bp, D. melanogaster
aaagtgtatataa

SEQ ID NO: 550004 - DNA, 13 bp, D. melanogaster
aaagtgtatatat

SEQ ID NO: 550005 - DNA, 13 bp, D. melanogaster
aaagtgtatttaa

SEQ ID NO: 550006 - DNA, 13 bp, D. melanogaster
aaagtgtattttt

SEQ ID NO: 550007 - DNA, 13 bp, D. melanogaster
aaagtgtcaaagt

SEQ ID NO: 550008 - DNA, 13 bp, D. melanogaster
aaagtgtcaacaa

SEQ ID NO: 550009 - DNA, 13 bp, D. melanogaster
aaagtgtcacaat

SEQ ID NO: 550010 - DNA, 13 bp, D. melanogaster
aaagtgtcagaaa

SEQ ID NO: 550011 - DNA, 13 bp, D. melanogaster
aaagtgtcataaa

SEQ ID NO: 550012 - DNA, 13 bp, D. melanogaster
aaagtgtcgaaaa

SEQ ID NO: 550013 - DNA, 13 bp, D. melanogaster
aaagtgtgaaaat

SEQ ID NO: 550014 - DNA, 13 bp, D. melanogaster
aaagtgtgaaatt

SEQ ID NO: 550015 - DNA, 13 bp, D. melanogaster
aaagtgtgccaca

SEQ ID NO: 550016 - DNA, 13 bp, D. melanogaster
aaagtgtgcgaaa

SEQ ID NO: 550017 - DNA, 13 bp, D. melanogaster
aaagtgtggaaat

SEQ ID NO: 550018 - DNA, 13 bp, D. melanogaster
aaagtgtggacgt

SEQ ID NO: 550019 - DNA, 13 bp, D. melanogaster
aaagtgtgggcgt

SEQ ID NO: 550020 - DNA, 14 bp, D. melanogaster
aaagtgtgggcgtg

SEQ ID NO: 550021 - DNA, 13 bp, D. melanogaster
aaagtgtgtatgt

SEQ ID NO: 550022 - DNA, 13 bp, D. melanogaster
aaagtgtgtgaaa

SEQ ID NO: 550023 - DNA, 13 bp, D. melanogaster
aaagtgtgtgcaa

SEQ ID NO: 550024 - DNA, 13 bp, D. melanogaster
aaagtgtgtgcgt

SEQ ID NO: 550025 - DNA, 13 bp, D. melanogaster
aaagtgtgtggaa

SEQ ID NO: 550026 - DNA, 13 bp, D. melanogaster
aaagtgtgtgttg

SEQ ID NO: 550027 - DNA, 14 bp, D. melanogaster
aaagtgtgtgtttt

SEQ ID NO: 550028 - DNA, 13 bp, D. melanogaster
aaagtgtgtttta

SEQ ID NO: 550029 - DNA, 13 bp, D. melanogaster
aaagtgtgttttt

SEQ ID NO: 550030 - DNA, 13 bp, D. melanogaster
aaagtgttaagaa

SEQ ID NO: 550031 - DNA, 13 bp, D. melanogaster
aaagtgttaataa

SEQ ID NO: 550032 - DNA, 13 bp, D. melanogaster
aaagtgttaatta

SEQ ID NO: 550033 - DNA, 13 bp, D. melanogaster
aaagtgttataaa

SEQ ID NO: 550034 - DNA, 13 bp, D. melanogaster
aaagtgttattat

SEQ ID NO: 550035 - DNA, 13 bp, D. melanogaster
aaagtgttattta

SEQ ID NO: 550036 - DNA, 13 bp, D. melanogaster
aaagtgttatttt

SEQ ID NO: 550037 - DNA, 13 bp, D. melanogaster
aaagtgttgaaaa

SEQ ID NO: 550038 - DNA, 13 bp, D. melanogaster
aaagtgttgcaaa

SEQ ID NO: 550039 - DNA, 13 bp, D. melanogaster
aaagtgttgcata

SEQ ID NO: 550040 - DNA, 14 bp, D. melanogaster
aaagtgttgcatac

SEQ ID NO: 550041 - DNA, 13 bp, D. melanogaster
aaagtgttgccaa

SEQ ID NO: 550042 - DNA, 13 bp, D. melanogaster
aaagtgttggaaa

SEQ ID NO: 550043 - DNA, 13 bp, D. melanogaster
aaagtgttggcaa

SEQ ID NO: 550044 - DNA, 13 bp, D. melanogaster
aaagtgttggcca

SEQ ID NO: 550045 - DNA, 14 bp, D. melanogaster
aaagtgttggccaa

SEQ ID NO: 550046 - DNA, 13 bp, D. melanogaster
aaagtgtttaaag

SEQ ID NO: 550047 - DNA, 13 bp, D. melanogaster
aaagtgtttattt

SEQ ID NO: 550048 - DNA, 13 bp, D. melanogaster
aaagtgtttcaaa

SEQ ID NO: 550049 - DNA, 13 bp, D. melanogaster
aaagtgtttgaaa

SEQ ID NO: 550050 - DNA, 13 bp, D. melanogaster
aaagtgtttgaat

SEQ ID NO: 550051 - DNA, 13 bp, D. melanogaster
aaagtgtttgcca

SEQ ID NO: 550052 - DNA, 13 bp, D. melanogaster
aaagtgtttggat

SEQ ID NO: 550053 - DNA, 13 bp, D. melanogaster
aaagtgttttaca

SEQ ID NO: 550054 - DNA, 13 bp, D. melanogaster
aaagtgttttcaa

SEQ ID NO: 550055 - DNA, 14 bp, D. melanogaster
aaagtgttttgttt

SEQ ID NO: 550056 - DNA, 13 bp, D. melanogaster
aaagtgtttttaa

SEQ ID NO: 550057 - DNA, 13 bp, D. melanogaster
aaagtgtttttct

SEQ ID NO: 550058 - DNA, 13 bp, D. melanogaster
aaagtgtttttta

SEQ ID NO: 550059 - DNA, 13 bp, D. melanogaster
aaagttaaaagtg

SEQ ID NO: 550060 - DNA, 14 bp, D. melanogaster
aaagttaaaattct

SEQ ID NO: 550061 - DNA, 13 bp, D. melanogaster
aaagttaaacata

SEQ ID NO: 550062 - DNA, 14 bp, D. melanogaster
aaagttaaacataa

SEQ ID NO: 550063 - DNA, 13 bp, D. melanogaster
aaagttaaagcca

SEQ ID NO: 550064 - DNA, 13 bp, D. melanogaster
aaagttaaatgtt

SEQ ID NO: 550065 - DNA, 13 bp, D. melanogaster
aaagttaaattga

SEQ ID NO: 550066 - DNA, 13 bp, D. melanogaster
aaagttaacaaat

SEQ ID NO: 550067 - DNA, 13 bp, D. melanogaster
aaagttaacttaa

SEQ ID NO: 550068 - DNA, 13 bp, D. melanogaster
aaagttaacttta

SEQ ID NO: 550069 - DNA, 13 bp, D. melanogaster
aaagttaagatta

SEQ ID NO: 550070 - DNA, 13 bp, D. melanogaster
aaagttaagcaaa

SEQ ID NO: 550071 - DNA, 13 bp, D. melanogaster
aaagttaagcatt

SEQ ID NO: 550072 - DNA, 13 bp, D. melanogaster
aaagttaagccaa

SEQ ID NO: 550073 - DNA, 13 bp, D. melanogaster
aaagttaagctaa

SEQ ID NO: 550074 - DNA, 13 bp, D. melanogaster
aaagttaagtgaa

SEQ ID NO: 550075 - DNA, 13 bp, D. melanogaster
aaagttaagttaa

SEQ ID NO: 550076 - DNA, 13 bp, D. melanogaster
aaagttaagtttt

SEQ ID NO: 550077 - DNA, 13 bp, D. melanogaster
aaagttaataaac

SEQ ID NO: 550078 - DNA, 13 bp, D. melanogaster
aaagttaatcaaa

SEQ ID NO: 550079 - DNA, 14 bp, D. melanogaster
aaagttaattaaca

SEQ ID NO: 550080 - DNA, 13 bp, D. melanogaster
aaagttaattaag

SEQ ID NO: 550081 - DNA, 13 bp, D. melanogaster
aaagttaattgtt

SEQ ID NO: 550082 - DNA, 13 bp, D. melanogaster
aaagttaatttca

SEQ ID NO: 550083 - DNA, 13 bp, D. melanogaster
aaagttacaaaat

SEQ ID NO: 550084 - DNA, 13 bp, D. melanogaster
aaagttacacaaa

SEQ ID NO: 550085 - DNA, 13 bp, D. melanogaster
aaagttacataaa

SEQ ID NO: 550086 - DNA, 13 bp, D. melanogaster
aaagttaccaaaa

SEQ ID NO: 550087 - DNA, 13 bp, D. melanogaster
aaagttagttagt

SEQ ID NO: 550088 - DNA, 13 bp, D. melanogaster
aaagttagtttaa

SEQ ID NO: 550089 - DNA, 13 bp, D. melanogaster
aaagttataaaac

SEQ ID NO: 550090 - DNA, 13 bp, D. melanogaster
aaagttatcaaag

SEQ ID NO: 550091 - DNA, 13 bp, D. melanogaster
aaagttatcctta

SEQ ID NO: 550092 - DNA, 13 bp, D. melanogaster
aaagttatctaaa

SEQ ID NO: 550093 - DNA, 13 bp, D. melanogaster
aaagttatcttta

SEQ ID NO: 550094 - DNA, 13 bp, D. melanogaster
aaagttattaaag

SEQ ID NO: 550095 - DNA, 13 bp, D. melanogaster
aaagttattcatt

SEQ ID NO: 550096 - DNA, 13 bp, D. melanogaster
aaagttattgaaa

SEQ ID NO: 550097 - DNA, 13 bp, D. melanogaster
aaagttattgcaa

SEQ ID NO: 550098 - DNA, 13 bp, D. melanogaster
aaagttatttaag

SEQ ID NO: 550099 - DNA, 13 bp, D. melanogaster
aaagttatttact

SEQ ID NO: 550100 - DNA, 13 bp, D. melanogaster
aaagttatttcat

SEQ ID NO: 550101 - DNA, 13 bp, D. melanogaster
aaagttatttctt

SEQ ID NO: 550102 - DNA, 13 bp, D. melanogaster
aaagttatttgaa

SEQ ID NO: 550103 - DNA, 13 bp, D. melanogaster
aaagttatttgat

SEQ ID NO: 550104 - DNA, 13 bp, D. melanogaster
aaagttatttgca

SEQ ID NO: 550105 - DNA, 13 bp, D. melanogaster
aaagttatttgta

SEQ ID NO: 550106 - DNA, 13 bp, D. melanogaster
aaagttcaaaaac

SEQ ID NO: 550107 - DNA, 13 bp, D. melanogaster
aaagttcaaaaag

SEQ ID NO: 550108 - DNA, 13 bp, D. melanogaster
aaagttcaaaatg

SEQ ID NO: 550109 - DNA, 13 bp, D. melanogaster
aaagttcaaaatt

SEQ ID NO: 550110 - DNA, 13 bp, D. melanogaster
aaagttcaaagca

SEQ ID NO: 550111 - DNA, 13 bp, D. melanogaster
aaagttcaaagtg

SEQ ID NO: 550112 - DNA, 13 bp, D. melanogaster
aaagttcaaagtt

SEQ ID NO: 550113 - DNA, 14 bp, D. melanogaster
aaagttcaaagttt

SEQ ID NO: 550114 - DNA, 13 bp, D. melanogaster
aaagttcaaataa

SEQ ID NO: 550115 - DNA, 13 bp, D. melanogaster
aaagttcaaatta

SEQ ID NO: 550116 - DNA, 13 bp, D. melanogaster
aaagttcaacaac

SEQ ID NO: 550117 - DNA, 13 bp, D. melanogaster
aaagttcaacatt

SEQ ID NO: 550118 - DNA, 13 bp, D. melanogaster
aaagttcaacttt

SEQ ID NO: 550119 - DNA, 13 bp, D. melanogaster
aaagttcaagaaa

SEQ ID NO: 550120 - DNA, 13 bp, D. melanogaster
aaagttcaagttc

SEQ ID NO: 550121 - DNA, 13 bp, D. melanogaster
aaagttcaagttt

SEQ ID NO: 550122 - DNA, 13 bp, D. melanogaster
aaagttcaataaa

SEQ ID NO: 550123 - DNA, 13 bp, D. melanogaster
aaagttcaatatt

SEQ ID NO: 550124 - DNA, 13 bp, D. melanogaster
aaagttcaattca

SEQ ID NO: 550125 - DNA, 13 bp, D. melanogaster
aaagttcacgttc

SEQ ID NO: 550126 - DNA, 14 bp, D. melanogaster
aaagttcacgttca

SEQ ID NO: 550127 - DNA, 13 bp, D. melanogaster
aaagttcactgca

SEQ ID NO: 550128 - DNA, 13 bp, D. melanogaster
aaagttcactttt

SEQ ID NO: 550129 - DNA, 13 bp, D. melanogaster
aaagttcagaaag

SEQ ID NO: 550130 - DNA, 13 bp, D. melanogaster
aaagttcagcaaa

SEQ ID NO: 550131 - DNA, 14 bp, D. melanogaster
aaagttcataaaaa

SEQ ID NO: 550132 - DNA, 13 bp, D. melanogaster
aaagttcataatt

SEQ ID NO: 550133 - DNA, 13 bp, D. melanogaster
aaagttcatattt

SEQ ID NO: 550134 - DNA, 13 bp, D. melanogaster
aaagttcatttaa

SEQ ID NO: 550135 - DNA, 13 bp, D. melanogaster
aaagttcatttgc

SEQ ID NO: 550136 - DNA, 13 bp, D. melanogaster
aaagttcccaaaa

SEQ ID NO: 550137 - DNA, 13 bp, D. melanogaster
aaagttctcaaaa

SEQ ID NO: 550138 - DNA, 13 bp, D. melanogaster
aaagttctcagtt

SEQ ID NO: 550139 - DNA, 13 bp, D. melanogaster
aaagttcttaaaa

SEQ ID NO: 550140 - DNA, 13 bp, D. melanogaster
aaagttcttattt

SEQ ID NO: 550141 - DNA, 14 bp, D. melanogaster
aaagttctttaaaa

SEQ ID NO: 550142 - DNA, 13 bp, D. melanogaster
aaagttctttgac

SEQ ID NO: 550143 - DNA, 13 bp, D. melanogaster
aaagttgaaagca

SEQ ID NO: 550144 - DNA, 13 bp, D. melanogaster
aaagttgaaagtt

SEQ ID NO: 550145 - DNA, 14 bp, D. melanogaster
aaagttgaaagttg

SEQ ID NO: 550146 - DNA, 13 bp, D. melanogaster
aaagttgaagttg

SEQ ID NO: 550147 - DNA, 13 bp, D. melanogaster
aaagttgaatgaa

SEQ ID NO: 550148 - DNA, 13 bp, D. melanogaster
aaagttgacattt

SEQ ID NO: 550149 - DNA, 13 bp, D. melanogaster
aaagttgaccaaa

SEQ ID NO: 550150 - DNA, 13 bp, D. melanogaster
aaagttgagaaat

SEQ ID NO: 550151 - DNA, 13 bp, D. melanogaster
aaagttgatattt

SEQ ID NO: 550152 - DNA, 13 bp, D. melanogaster
aaagttgatcaaa

SEQ ID NO: 550153 - DNA, 13 bp, D. melanogaster
aaagttgattaaa

SEQ ID NO: 550154 - DNA, 13 bp, D. melanogaster
aaagttgcaaatg

SEQ ID NO: 550155 - DNA, 13 bp, D. melanogaster
aaagttgcaacaa

SEQ ID NO: 550156 - DNA, 13 bp, D. melanogaster
aaagttgcaagac

SEQ ID NO: 550157 - DNA, 13 bp, D. melanogaster
aaagttgcagcag

SEQ ID NO: 550158 - DNA, 13 bp, D. melanogaster
aaagttgcagcca

SEQ ID NO: 550159 - DNA, 13 bp, D. melanogaster
aaagttgcagctt

SEQ ID NO: 550160 - DNA, 14 bp, D. melanogaster
aaagttgccaaaaa

SEQ ID NO: 550161 - DNA, 13 bp, D. melanogaster
aaagttgccaaag

SEQ ID NO: 550162 - DNA, 13 bp, D. melanogaster
aaagttgccaaat

SEQ ID NO: 550163 - DNA, 13 bp, D. melanogaster
aaagttgccaact

SEQ ID NO: 550164 - DNA, 13 bp, D. melanogaster
aaagttgccatta

SEQ ID NO: 550165 - DNA, 13 bp, D. melanogaster
aaagttgcccaaa

SEQ ID NO: 550166 - DNA, 13 bp, D. melanogaster
aaagttgccgaaa

SEQ ID NO: 550167 - DNA, 13 bp, D. melanogaster
aaagttgctaaaa

SEQ ID NO: 550168 - DNA, 13 bp, D. melanogaster
aaagttgctgcca

SEQ ID NO: 550169 - DNA, 13 bp, D. melanogaster
aaagttgctggcc

SEQ ID NO: 550170 - DNA, 14 bp, D. melanogaster
aaagttgctggccg

SEQ ID NO: 550171 - DNA, 13 bp, D. melanogaster
aaagttggaaaag

SEQ ID NO: 550172 - DNA, 13 bp, D. melanogaster
aaagttggaaaat

SEQ ID NO: 550173 - DNA, 13 bp, D. melanogaster
aaagttggaaatt

SEQ ID NO: 550174 - DNA, 13 bp, D. melanogaster
aaagttggcaaaa

SEQ ID NO: 550175 - DNA, 14 bp, D. melanogaster
aaagttggcaaaaa

SEQ ID NO: 550176 - DNA, 13 bp, D. melanogaster
aaagttggccaaa

SEQ ID NO: 550177 - DNA, 14 bp, D. melanogaster
aaagttggccaaaa

SEQ ID NO: 550178 - DNA, 14 bp, D. melanogaster
aaagttggccaact

SEQ ID NO: 550179 - DNA, 13 bp, D. melanogaster
aaagttggccatt

SEQ ID NO: 550180 - DNA, 13 bp, D. melanogaster
aaagttggcgaaa

SEQ ID NO: 550181 - DNA, 13 bp, D. melanogaster
aaagttgggcaaa

SEQ ID NO: 550182 - DNA, 13 bp, D. melanogaster
aaagttggggaaa

SEQ ID NO: 550183 - DNA, 13 bp, D. melanogaster
aaagttggtaaaa

SEQ ID NO: 550184 - DNA, 13 bp, D. melanogaster
aaagttggtaaat

SEQ ID NO: 550185 - DNA, 13 bp, D. melanogaster
aaagttgtaaaat

SEQ ID NO: 550186 - DNA, 13 bp, D. melanogaster
aaagttgtaaatt

SEQ ID NO: 550187 - DNA, 13 bp, D. melanogaster
aaagttgtacaaa

SEQ ID NO: 550188 - DNA, 13 bp, D. melanogaster
aaagttgtacgta

SEQ ID NO: 550189 - DNA, 13 bp, D. melanogaster
aaagttgtataaa

SEQ ID NO: 550190 - DNA, 13 bp, D. melanogaster
aaagttgtattta

SEQ ID NO: 550191 - DNA, 13 bp, D. melanogaster
aaagttgtcaaaa

SEQ ID NO: 550192 - DNA, 13 bp, D. melanogaster
aaagttgtcgaaa

SEQ ID NO: 550193 - DNA, 13 bp, D. melanogaster
aaagttgtctgct

SEQ ID NO: 550194 - DNA, 13 bp, D. melanogaster
aaagttgtgcaac

SEQ ID NO: 550195 - DNA, 13 bp, D. melanogaster
aaagttgtggaaa

SEQ ID NO: 550196 - DNA, 13 bp, D. melanogaster
aaagttgtggata

SEQ ID NO: 550197 - DNA, 13 bp, D. melanogaster
aaagttgtgttta

SEQ ID NO: 550198 - DNA, 13 bp, D. melanogaster
aaagttgttaaat

SEQ ID NO: 550199 - DNA, 14 bp, D. melanogaster
aaagttgttctaaa

SEQ ID NO: 550200 - DNA, 13 bp, D. melanogaster
aaagttgttgcaa

SEQ ID NO: 550201 - DNA, 13 bp, D. melanogaster
aaagttgttggcc

SEQ ID NO: 550202 - DNA, 13 bp, D. melanogaster
aaagttgttgttt

SEQ ID NO: 550203 - DNA, 13 bp, D. melanogaster
aaagttgttttcc

SEQ ID NO: 550204 - DNA, 13 bp, D. melanogaster
aaagttgttttcg

SEQ ID NO: 550205 - DNA, 13 bp, D. melanogaster
aaagtttaaaaca

SEQ ID NO: 550206 - DNA, 13 bp, D. melanogaster
aaagtttaaaagt

SEQ ID NO: 550207 - DNA, 13 bp, D. melanogaster
aaagtttaaaatg

SEQ ID NO: 550208 - DNA, 14 bp, D. melanogaster
aaagtttaaacaaa

SEQ ID NO: 550209 - DNA, 13 bp, D. melanogaster
aaagtttaaactg

SEQ ID NO: 550210 - DNA, 13 bp, D. melanogaster
aaagtttaaagca

SEQ ID NO: 550211 - DNA, 13 bp, D. melanogaster
aaagtttaaagtt

SEQ ID NO: 550212 - DNA, 13 bp, D. melanogaster
aaagtttaagcca

SEQ ID NO: 550213 - DNA, 13 bp, D. melanogaster
aaagtttaagcta

SEQ ID NO: 550214 - DNA, 13 bp, D. melanogaster
aaagtttaagttt

SEQ ID NO: 550215 - DNA, 13 bp, D. melanogaster
aaagtttaatcaa

SEQ ID NO: 550216 - DNA, 13 bp, D. melanogaster
aaagtttaatttg

SEQ ID NO: 550217 - DNA, 14 bp, D. melanogaster
aaagtttaatttga

SEQ ID NO: 550218 - DNA, 13 bp, D. melanogaster
aaagtttacaaaa

SEQ ID NO: 550219 - DNA, 13 bp, D. melanogaster
aaagtttacttta

SEQ ID NO: 550220 - DNA, 13 bp, D. melanogaster
aaagtttactttc

SEQ ID NO: 550221 - DNA, 13 bp, D. melanogaster
aaagtttagttat

SEQ ID NO: 550222 - DNA, 13 bp, D. melanogaster
aaagtttagttta

SEQ ID NO: 550223 - DNA, 14 bp, D. melanogaster
aaagtttataatac

SEQ ID NO: 550224 - DNA, 13 bp, D. melanogaster
aaagtttatacaa

SEQ ID NO: 550225 - DNA, 13 bp, D. melanogaster
aaagtttatagtt

SEQ ID NO: 550226 - DNA, 13 bp, D. melanogaster
aaagtttatcttt

SEQ ID NO: 550227 - DNA, 13 bp, D. melanogaster
aaagtttatgcaa

SEQ ID NO: 550228 - DNA, 13 bp, D. melanogaster
aaagtttattgaa

SEQ ID NO: 550229 - DNA, 13 bp, D. melanogaster
aaagtttattgca

SEQ ID NO: 550230 - DNA, 13 bp, D. melanogaster
aaagtttatttgt

SEQ ID NO: 550231 - DNA, 13 bp, D. melanogaster
aaagtttcaaaat

SEQ ID NO: 550232 - DNA, 13 bp, D. melanogaster
aaagtttcaaata

SEQ ID NO: 550233 - DNA, 13 bp, D. melanogaster
aaagtttcaactt

SEQ ID NO: 550234 - DNA, 13 bp, D. melanogaster
aaagtttcacttt

SEQ ID NO: 550235 - DNA, 13 bp, D. melanogaster
aaagtttcagttg

SEQ ID NO: 550236 - DNA, 13 bp, D. melanogaster
aaagtttcagttt

SEQ ID NO: 550237 - DNA, 13 bp, D. melanogaster
aaagtttcatttt

SEQ ID NO: 550238 - DNA, 13 bp, D. melanogaster
aaagtttccaaag

SEQ ID NO: 550239 - DNA, 13 bp, D. melanogaster
aaagtttccattg

SEQ ID NO: 550240 - DNA, 13 bp, D. melanogaster
aaagtttccattt

SEQ ID NO: 550241 - DNA, 13 bp, D. melanogaster
aaagtttccgttt

SEQ ID NO: 550242 - DNA, 13 bp, D. melanogaster
aaagtttcctcct

SEQ ID NO: 550243 - DNA, 13 bp, D. melanogaster
aaagtttcctttt

SEQ ID NO: 550244 - DNA, 13 bp, D. melanogaster
aaagtttcgactt

SEQ ID NO: 550245 - DNA, 13 bp, D. melanogaster
aaagtttcgagtg

SEQ ID NO: 550246 - DNA, 13 bp, D. melanogaster
aaagtttcgattt

SEQ ID NO: 550247 - DNA, 13 bp, D. melanogaster
aaagtttcgcctt

SEQ ID NO: 550248 - DNA, 13 bp, D. melanogaster
aaagtttcgcttg

SEQ ID NO: 550249 - DNA, 13 bp, D. melanogaster
aaagtttcgcttt

SEQ ID NO: 550250 - DNA, 13 bp, D. melanogaster
aaagtttcgtttg

SEQ ID NO: 550251 - DNA, 13 bp, D. melanogaster
aaagtttcgtttt

SEQ ID NO: 550252 - DNA, 13 bp, D. melanogaster
aaagtttcttatt

SEQ ID NO: 550253 - DNA, 13 bp, D. melanogaster
aaagtttgatatt

SEQ ID NO: 550254 - DNA, 13 bp, D. melanogaster
aaagtttgattga

SEQ ID NO: 550255 - DNA, 13 bp, D. melanogaster
aaagtttgcaaca

SEQ ID NO: 550256 - DNA, 13 bp, D. melanogaster
aaagtttgcacaa

SEQ ID NO: 550257 - DNA, 13 bp, D. melanogaster
aaagtttgcattt

SEQ ID NO: 550258 - DNA, 13 bp, D. melanogaster
aaagtttgccaaa

SEQ ID NO: 550259 - DNA, 13 bp, D. melanogaster
aaagtttgccagc

SEQ ID NO: 550260 - DNA, 13 bp, D. melanogaster
aaagtttgccatt

SEQ ID NO: 550261 - DNA, 13 bp, D. melanogaster
aaagtttgcccag

SEQ ID NO: 550262 - DNA, 13 bp, D. melanogaster
aaagtttgcgaaa

SEQ ID NO: 550263 - DNA, 13 bp, D. melanogaster
aaagtttggaata

SEQ ID NO: 550264 - DNA, 13 bp, D. melanogaster
aaagtttggcatt

SEQ ID NO: 550265 - DNA, 13 bp, D. melanogaster
aaagtttggccaa

SEQ ID NO: 550266 - DNA, 13 bp, D. melanogaster
aaagtttggtaaa

SEQ ID NO: 550267 - DNA, 13 bp, D. melanogaster
aaagtttgtcttt

SEQ ID NO: 550268 - DNA, 13 bp, D. melanogaster
aaagtttgtgaaa

SEQ ID NO: 550269 - DNA, 13 bp, D. melanogaster
aaagtttgttatt

SEQ ID NO: 550270 - DNA, 13 bp, D. melanogaster
aaagtttgttgct

SEQ ID NO: 550271 - DNA, 13 bp, D. melanogaster
aaagtttgtttaa

SEQ ID NO: 550272 - DNA, 13 bp, D. melanogaster
aaagtttgtttga

SEQ ID NO: 550273 - DNA, 13 bp, D. melanogaster
aaagtttgttttg

SEQ ID NO: 550274 - DNA, 13 bp, D. melanogaster
aaagttttaaaag

SEQ ID NO: 550275 - DNA, 13 bp, D. melanogaster
aaagttttaaaca

SEQ ID NO: 550276 - DNA, 14 bp, D. melanogaster
aaagttttaaagtt

SEQ ID NO: 550277 - DNA, 13 bp, D. melanogaster
aaagttttaaatg

SEQ ID NO: 550278 - DNA, 13 bp, D. melanogaster
aaagttttaaggc

SEQ ID NO: 550279 - DNA, 13 bp, D. melanogaster
aaagttttaagtt

SEQ ID NO: 550280 - DNA, 13 bp, D. melanogaster
aaagttttaatga

SEQ ID NO: 550281 - DNA, 13 bp, D. melanogaster
aaagttttacaat

SEQ ID NO: 550282 - DNA, 13 bp, D. melanogaster
aaagttttacata

SEQ ID NO: 550283 - DNA, 13 bp, D. melanogaster
aaagttttacttt

SEQ ID NO: 550284 - DNA, 13 bp, D. melanogaster
aaagttttagttt

SEQ ID NO: 550285 - DNA, 13 bp, D. melanogaster
aaagttttatgaa

SEQ ID NO: 550286 - DNA, 13 bp, D. melanogaster
aaagttttatgtt

SEQ ID NO: 550287 - DNA, 13 bp, D. melanogaster
aaagttttattga

SEQ ID NO: 550288 - DNA, 13 bp, D. melanogaster
aaagttttattgg

SEQ ID NO: 550289 - DNA, 13 bp, D. melanogaster
aaagttttatttc

SEQ ID NO: 550290 - DNA, 13 bp, D. melanogaster
aaagttttcaaaa

SEQ ID NO: 550291 - DNA, 14 bp, D. melanogaster
aaagttttcaaaaa

SEQ ID NO: 550292 - DNA, 13 bp, D. melanogaster
aaagttttcaaat

SEQ ID NO: 550293 - DNA, 14 bp, D. melanogaster
aaagttttcaaatt

SEQ ID NO: 550294 - DNA, 13 bp, D. melanogaster
aaagttttcaata

SEQ ID NO: 550295 - DNA, 13 bp, D. melanogaster
aaagttttcagca

SEQ ID NO: 550296 - DNA, 13 bp, D. melanogaster
aaagttttcagct

SEQ ID NO: 550297 - DNA, 13 bp, D. melanogaster
aaagttttcagtt

SEQ ID NO: 550298 - DNA, 13 bp, D. melanogaster
aaagttttcattt

SEQ ID NO: 550299 - DNA, 14 bp, D. melanogaster
aaagttttcatttt

SEQ ID NO: 550300 - DNA, 13 bp, D. melanogaster
aaagttttccaaa

SEQ ID NO: 550301 - DNA, 14 bp, D. melanogaster
aaagttttccaaaa

SEQ ID NO: 550302 - DNA, 13 bp, D. melanogaster
aaagttttccaca

SEQ ID NO: 550303 - DNA, 14 bp, D. melanogaster
aaagttttccattt

SEQ ID NO: 550304 - DNA, 13 bp, D. melanogaster
aaagttttcccag

SEQ ID NO: 550305 - DNA, 13 bp, D. melanogaster
aaagttttccccg

SEQ ID NO: 550306 - DNA, 15 bp, D. melanogaster
aaagttttcctgaaa

SEQ ID NO: 550307 - DNA, 14 bp, D. melanogaster
aaagttttcgaaaa

SEQ ID NO: 550308 - DNA, 13 bp, D. melanogaster
aaagttttcgagc

SEQ ID NO: 550309 - DNA, 13 bp, D. melanogaster
aaagttttcgttt

SEQ ID NO: 550310 - DNA, 13 bp, D. melanogaster
aaagttttctaaa

SEQ ID NO: 550311 - DNA, 14 bp, D. melanogaster
aaagttttctattt

SEQ ID NO: 550312 - DNA, 13 bp, D. melanogaster
aaagttttcttct

SEQ ID NO: 550313 - DNA, 13 bp, D. melanogaster
aaagttttcttgc

SEQ ID NO: 550314 - DNA, 13 bp, D. melanogaster
aaagttttcttgt

SEQ ID NO: 550315 - DNA, 13 bp, D. melanogaster
aaagttttgaaaa

SEQ ID NO: 550316 - DNA, 13 bp, D. melanogaster
aaagttttgaatt

SEQ ID NO: 550317 - DNA, 13 bp, D. melanogaster
aaagttttgacaa

SEQ ID NO: 550318 - DNA, 14 bp, D. melanogaster
aaagttttgacaat

SEQ ID NO: 550319 - DNA, 13 bp, D. melanogaster
aaagttttgatag

SEQ ID NO: 550320 - DNA, 13 bp, D. melanogaster
aaagttttgatta

SEQ ID NO: 550321 - DNA, 13 bp, D. melanogaster
aaagttttgattt

SEQ ID NO: 550322 - DNA, 13 bp, D. melanogaster
aaagttttgcaat

SEQ ID NO: 550323 - DNA, 13 bp, D. melanogaster
aaagttttgcaga

SEQ ID NO: 550324 - DNA, 13 bp, D. melanogaster
aaagttttgccaa

SEQ ID NO: 550325 - DNA, 13 bp, D. melanogaster
aaagttttgctca

SEQ ID NO: 550326 - DNA, 13 bp, D. melanogaster
aaagttttgcttt

SEQ ID NO: 550327 - DNA, 14 bp, D. melanogaster
aaagttttgctttt

SEQ ID NO: 550328 - DNA, 13 bp, D. melanogaster
aaagttttgtatt

SEQ ID NO: 550329 - DNA, 14 bp, D. melanogaster
aaagttttgtatta

SEQ ID NO: 550330 - DNA, 13 bp, D. melanogaster
aaagttttgtgcg

SEQ ID NO: 550331 - DNA, 13 bp, D. melanogaster
aaagttttgtggc

SEQ ID NO: 550332 - DNA, 13 bp, D. melanogaster
aaagttttgttag

SEQ ID NO: 550333 - DNA, 14 bp, D. melanogaster
aaagtttttaaaag

SEQ ID NO: 550334 - DNA, 13 bp, D. melanogaster
aaagtttttaatg

SEQ ID NO: 550335 - DNA, 13 bp, D. melanogaster
aaagtttttacat

SEQ ID NO: 550336 - DNA, 13 bp, D. melanogaster
aaagtttttacga

SEQ ID NO: 550337 - DNA, 13 bp, D. melanogaster
aaagtttttactc

SEQ ID NO: 550338 - DNA, 13 bp, D. melanogaster
aaagtttttagct

SEQ ID NO: 550339 - DNA, 14 bp, D. melanogaster
aaagtttttcaatt

SEQ ID NO: 550340 - DNA, 13 bp, D. melanogaster
aaagtttttcatg

SEQ ID NO: 550341 - DNA, 13 bp, D. melanogaster
aaagtttttcatt

SEQ ID NO: 550342 - DNA, 14 bp, D. melanogaster
aaagtttttcattt

SEQ ID NO: 550343 - DNA, 13 bp, D. melanogaster
aaagtttttcctc

SEQ ID NO: 550344 - DNA, 13 bp, D. melanogaster
aaagtttttcctg

SEQ ID NO: 550345 - DNA, 13 bp, D. melanogaster
aaagtttttcgtt

SEQ ID NO: 550346 - DNA, 13 bp, D. melanogaster
aaagtttttcttt

SEQ ID NO: 550347 - DNA, 14 bp, D. melanogaster
aaagtttttctttg

SEQ ID NO: 550348 - DNA, 13 bp, D. melanogaster
aaagtttttgaat

SEQ ID NO: 550349 - DNA, 13 bp, D. melanogaster
aaagtttttgata

SEQ ID NO: 550350 - DNA, 13 bp, D. melanogaster
aaagtttttgcat

SEQ ID NO: 550351 - DNA, 13 bp, D. melanogaster
aaagtttttgctt

SEQ ID NO: 550352 - DNA, 13 bp, D. melanogaster
aaagtttttggca

SEQ ID NO: 550353 - DNA, 13 bp, D. melanogaster
aaagtttttggcc

SEQ ID NO: 550354 - DNA, 14 bp, D. melanogaster
aaagtttttggcca

SEQ ID NO: 550355 - DNA, 14 bp, D. melanogaster
aaagtttttggcct

SEQ ID NO: 550356 - DNA, 13 bp, D. melanogaster
aaagtttttgggg

SEQ ID NO: 550357 - DNA, 14 bp, D. melanogaster
aaagtttttgttcg

SEQ ID NO: 550358 - DNA, 13 bp, D. melanogaster
aaagttttttcat

SEQ ID NO: 550359 - DNA, 13 bp, D. melanogaster
aaagttttttgga

SEQ ID NO: 550360 - DNA, 13 bp, D. melanogaster
aaagtttttttct

SEQ ID NO: 550361 - DNA, 14 bp, D. melanogaster
aaataaaaacaccg

SEQ ID NO: 550362 - DNA, 13 bp, D. melanogaster
aaataaaaacgcc

SEQ ID NO: 550363 - DNA, 14 bp, D. melanogaster
aaataaaaagtctt

SEQ ID NO: 550364 - DNA, 13 bp, D. melanogaster
aaataaaaagtgc

SEQ ID NO: 550365 - DNA, 13 bp, D. melanogaster
aaataaaaatggc

SEQ ID NO: 550366 - DNA, 14 bp, D. melanogaster
aaataaaaatggca

SEQ ID NO: 550367 - DNA, 13 bp, D. melanogaster
aaataaaacagtt

SEQ ID NO: 550368 - DNA, 14 bp, D. melanogaster
aaataaaacagttt

SEQ ID NO: 550369 - DNA, 13 bp, D. melanogaster
aaataaaacattg

SEQ ID NO: 550370 - DNA, 14 bp, D. melanogaster
aaataaaactagtt

SEQ ID NO: 550371 - DNA, 13 bp, D. melanogaster
aaataaaactcga

SEQ ID NO: 550372 - DNA, 13 bp, D. melanogaster
aaataaaactgtc

SEQ ID NO: 550373 - DNA, 13 bp, D. melanogaster
aaataaaactttc

SEQ ID NO: 550374 - DNA, 13 bp, D. melanogaster
aaataaaactttg

SEQ ID NO: 550375 - DNA, 13 bp, D. melanogaster
aaataaaagagcg

SEQ ID NO: 550376 - DNA, 13 bp, D. melanogaster
aaataaaagcagc

SEQ ID NO: 550377 - DNA, 13 bp, D. melanogaster
aaataaaagccat

SEQ ID NO: 550378 - DNA, 13 bp, D. melanogaster
aaataaaagcgga

SEQ ID NO: 550379 - DNA, 14 bp, D. melanogaster
aaataaaagctttt

SEQ ID NO: 550380 - DNA, 13 bp, D. melanogaster
aaataaaaggcga

SEQ ID NO: 550381 - DNA, 13 bp, D. melanogaster
aaataaaagtcga

SEQ ID NO: 550382 - DNA, 13 bp, D. melanogaster
aaataaaagtgca

SEQ ID NO: 550383 - DNA, 14 bp, D. melanogaster
aaataaaagtgcaa

SEQ ID NO: 550384 - DNA, 13 bp, D. melanogaster
aaataaaagttgg

SEQ ID NO: 550385 - DNA, 14 bp, D. melanogaster
aaataaaatagcat

SEQ ID NO: 550386 - DNA, 13 bp, D. melanogaster
aaataaaatcagg

SEQ ID NO: 550387 - DNA, 13 bp, D. melanogaster
aaataaaatcagt

SEQ ID NO: 550388 - DNA, 13 bp, D. melanogaster
aaataaaatcctt

SEQ ID NO: 550389 - DNA, 14 bp, D. melanogaster
aaataaaatcgaat

SEQ ID NO: 550390 - DNA, 13 bp, D. melanogaster
aaataaaatcgat

SEQ ID NO: 550391 - DNA, 13 bp, D. melanogaster
aaataaaatcgga

SEQ ID NO: 550392 - DNA, 14 bp, D. melanogaster
aaataaaatgccaa

SEQ ID NO: 550393 - DNA, 14 bp, D. melanogaster
aaataaaatgcgaa

SEQ ID NO: 550394 - DNA, 13 bp, D. melanogaster
aaataaaatgctg

SEQ ID NO: 550395 - DNA, 13 bp, D. melanogaster
aaataaaatggtt

SEQ ID NO: 550396 - DNA, 13 bp, D. melanogaster
aaataaaatgtgc

SEQ ID NO: 550397 - DNA, 13 bp, D. melanogaster
aaataaaatgtgg

SEQ ID NO: 550398 - DNA, 14 bp, D. melanogaster
aaataaaatgtttg

SEQ ID NO: 550399 - DNA, 13 bp, D. melanogaster
aaataaaattgac

SEQ ID NO: 550400 - DNA, 14 bp, D. melanogaster
aaataaaattgcaa

SEQ ID NO: 550401 - DNA, 13 bp, D. melanogaster
aaataaaattgcg

SEQ ID NO: 550402 - DNA, 14 bp, D. melanogaster
aaataaaattgttg

SEQ ID NO: 550403 - DNA, 14 bp, D. melanogaster
aaataaacaagttt

SEQ ID NO: 550404 - DNA, 13 bp, D. melanogaster
aaataaacacttt

SEQ ID NO: 550405 - DNA, 14 bp, D. melanogaster
aaataaacactttt

SEQ ID NO: 550406 - DNA, 13 bp, D. melanogaster
aaataaacagtat

SEQ ID NO: 550407 - DNA, 13 bp, D. melanogaster
aaataaacatggc

SEQ ID NO: 550408 - DNA, 13 bp, D. melanogaster
aaataaaccttta

SEQ ID NO: 550409 - DNA, 14 bp, D. melanogaster
aaataaacgaaatg

SEQ ID NO: 550410 - DNA, 13 bp, D. melanogaster
aaataaacgaagc

SEQ ID NO: 550411 - DNA, 13 bp, D. melanogaster
aaataaacgagca

SEQ ID NO: 550412 - DNA, 13 bp, D. melanogaster
aaataaacgatat

SEQ ID NO: 550413 - DNA, 13 bp, D. melanogaster
aaataaacgcttt

SEQ ID NO: 550414 - DNA, 13 bp, D. melanogaster
aaataaacgggga

SEQ ID NO: 550415 - DNA, 13 bp, D. melanogaster
aaataaacgtaat

SEQ ID NO: 550416 - DNA, 13 bp, D. melanogaster
aaataaacgtttt

SEQ ID NO: 550417 - DNA, 13 bp, D. melanogaster
aaataaactagtt

SEQ ID NO: 550418 - DNA, 13 bp, D. melanogaster
aaataaactcgaa

SEQ ID NO: 550419 - DNA, 13 bp, D. melanogaster
aaataaactcgtt

SEQ ID NO: 550420 - DNA, 13 bp, D. melanogaster
aaataaactgcag

SEQ ID NO: 550421 - DNA, 13 bp, D. melanogaster
aaataaactggaa

SEQ ID NO: 550422 - DNA, 13 bp, D. melanogaster
aaataaacttgaa

SEQ ID NO: 550423 - DNA, 13 bp, D. melanogaster
aaataaacttggc

SEQ ID NO: 550424 - DNA, 13 bp, D. melanogaster
aaataaactttac

SEQ ID NO: 550425 - DNA, 13 bp, D. melanogaster
aaataaactttgc

SEQ ID NO: 550426 - DNA, 13 bp, D. melanogaster
aaataaacttttg

SEQ ID NO: 550427 - DNA, 13 bp, D. melanogaster
aaataaagacatt

SEQ ID NO: 550428 - DNA, 13 bp, D. melanogaster
aaataaagagcca

SEQ ID NO: 550429 - DNA, 14 bp, D. melanogaster
aaataaagcaaatt

SEQ ID NO: 550430 - DNA, 13 bp, D. melanogaster
aaataaagcaatt

SEQ ID NO: 550431 - DNA, 14 bp, D. melanogaster
aaataaagcaattt

SEQ ID NO: 550432 - DNA, 13 bp, D. melanogaster
aaataaagccaag

SEQ ID NO: 550433 - DNA, 13 bp, D. melanogaster
aaataaagccaat

SEQ ID NO: 550434 - DNA, 13 bp, D. melanogaster
aaataaagcccaa

SEQ ID NO: 550435 - DNA, 15 bp, D. melanogaster
aaataaagcctattc

SEQ ID NO: 550436 - DNA, 14 bp, D. melanogaster
aaataaagcgaaag

SEQ ID NO: 550437 - DNA, 13 bp, D. melanogaster
aaataaagctaag

SEQ ID NO: 550438 - DNA, 13 bp, D. melanogaster
aaataaagctaat

SEQ ID NO: 550439 - DNA, 14 bp, D. melanogaster
aaataaagctgaaa

SEQ ID NO: 550440 - DNA, 13 bp, D. melanogaster
aaataaagcttaa

SEQ ID NO: 550441 - DNA, 13 bp, D. melanogaster
aaataaaggcaat

SEQ ID NO: 550442 - DNA, 13 bp, D. melanogaster
aaataaagggcaa

SEQ ID NO: 550443 - DNA, 13 bp, D. melanogaster
aaataaagtcgaa

SEQ ID NO: 550444 - DNA, 13 bp, D. melanogaster
aaataaagtgaca

SEQ ID NO: 550445 - DNA, 13 bp, D. melanogaster
aaataaagtgcaa

SEQ ID NO: 550446 - DNA, 13 bp, D. melanogaster
aaataaagtgcag

SEQ ID NO: 550447 - DNA, 13 bp, D. melanogaster
aaataaagtgtat

SEQ ID NO: 550448 - DNA, 13 bp, D. melanogaster
aaataaagttgca

SEQ ID NO: 550449 - DNA, 13 bp, D. melanogaster
aaataaagttggc

SEQ ID NO: 550450 - DNA, 13 bp, D. melanogaster
aaataaagttgtt

SEQ ID NO: 550451 - DNA, 14 bp, D. melanogaster
aaataaataaactg

SEQ ID NO: 550452 - DNA, 14 bp, D. melanogaster
aaataaataaagcc

SEQ ID NO: 550453 - DNA, 13 bp, D. melanogaster
aaataaataagcc

SEQ ID NO: 550454 - DNA, 14 bp, D. melanogaster
aaataaataattgc

SEQ ID NO: 550455 - DNA, 13 bp, D. melanogaster
aaataaataccag

SEQ ID NO: 550456 - DNA, 13 bp, D. melanogaster
aaataaatacgca

SEQ ID NO: 550457 - DNA, 13 bp, D. melanogaster
aaataaatacgta

SEQ ID NO: 550458 - DNA, 13 bp, D. melanogaster
aaataaatactgt

SEQ ID NO: 550459 - DNA, 13 bp, D. melanogaster
aaataaatagtca

SEQ ID NO: 550460 - DNA, 13 bp, D. melanogaster
aaataaatagttc

SEQ ID NO: 550461 - DNA, 13 bp, D. melanogaster
aaataaatatctg

SEQ ID NO: 550462 - DNA, 14 bp, D. melanogaster
aaataaatatgcat

SEQ ID NO: 550463 - DNA, 14 bp, D. melanogaster
aaataaatcaaagc

SEQ ID NO: 550464 - DNA, 14 bp, D. melanogaster
aaataaatcaaagt

SEQ ID NO: 550465 - DNA, 14 bp, D. melanogaster
aaataaatcaaatg

SEQ ID NO: 550466 - DNA, 13 bp, D. melanogaster
aaataaatcactt

SEQ ID NO: 550467 - DNA, 13 bp, D. melanogaster
aaataaatcagat

SEQ ID NO: 550468 - DNA, 13 bp, D. melanogaster
aaataaatcagcg

SEQ ID NO: 550469 - DNA, 13 bp, D. melanogaster
aaataaatcgaag

SEQ ID NO: 550470 - DNA, 13 bp, D. melanogaster
aaataaatcgaat

SEQ ID NO: 550471 - DNA, 14 bp, D. melanogaster
aaataaatcgaatt

SEQ ID NO: 550472 - DNA, 13 bp, D. melanogaster
aaataaatcgatt

SEQ ID NO: 550473 - DNA, 13 bp, D. melanogaster
aaataaatcgcca

SEQ ID NO: 550474 - DNA, 13 bp, D. melanogaster
aaataaatcgtaa

SEQ ID NO: 550475 - DNA, 14 bp, D. melanogaster
aaataaatcgtttt

SEQ ID NO: 550476 - DNA, 13 bp, D. melanogaster
aaataaatctgaa

SEQ ID NO: 550477 - DNA, 13 bp, D. melanogaster
aaataaatctgat

SEQ ID NO: 550478 - DNA, 14 bp, D. melanogaster
aaataaatgaaact

SEQ ID NO: 550479 - DNA, 17 bp, D. melanogaster
aaataaatgaacatata

SEQ ID NO: 550480 - DNA, 13 bp, D. melanogaster
aaataaatgatac

SEQ ID NO: 550481 - DNA, 13 bp, D. melanogaster
aaataaatgatgt

SEQ ID NO: 550482 - DNA, 14 bp, D. melanogaster
aaataaatgcaaat

SEQ ID NO: 550483 - DNA, 14 bp, D. melanogaster
aaataaatgcaata

SEQ ID NO: 550484 - DNA, 14 bp, D. melanogaster
aaataaatgcatat

SEQ ID NO: 550485 - DNA, 13 bp, D. melanogaster
aaataaatgcatt

SEQ ID NO: 550486 - DNA, 14 bp, D. melanogaster
aaataaatgcatta

SEQ ID NO: 550487 - DNA, 14 bp, D. melanogaster
aaataaatgcattt

SEQ ID NO: 550488 - DNA, 13 bp, D. melanogaster
aaataaatgccaa

SEQ ID NO: 550489 - DNA, 13 bp, D. melanogaster
aaataaatgccac

SEQ ID NO: 550490 - DNA, 13 bp, D. melanogaster
aaataaatgcgaa

SEQ ID NO: 550491 - DNA, 14 bp, D. melanogaster
aaataaatgcgaaa

SEQ ID NO: 550492 - DNA, 13 bp, D. melanogaster
aaataaatgcttt

SEQ ID NO: 550493 - DNA, 13 bp, D. melanogaster
aaataaatggaca

SEQ ID NO: 550494 - DNA, 13 bp, D. melanogaster
aaataaatggcaa

SEQ ID NO: 550495 - DNA, 13 bp, D. melanogaster
aaataaatggcag

SEQ ID NO: 550496 - DNA, 13 bp, D. melanogaster
aaataaatgggat

SEQ ID NO: 550497 - DNA, 13 bp, D. melanogaster
aaataaatggttt

SEQ ID NO: 550498 - DNA, 14 bp, D. melanogaster
aaataaatggtttt

SEQ ID NO: 550499 - DNA, 13 bp, D. melanogaster
aaataaatgtgat

SEQ ID NO: 550500 - DNA, 13 bp, D. melanogaster
aaataaatgttgt

SEQ ID NO: 550501 - DNA, 13 bp, D. melanogaster
aaataaattacga

SEQ ID NO: 550502 - DNA, 13 bp, D. melanogaster
aaataaattcaag

SEQ ID NO: 550503 - DNA, 13 bp, D. melanogaster
aaataaattcaga

SEQ ID NO: 550504 - DNA, 13 bp, D. melanogaster
aaataaattcagc

SEQ ID NO: 550505 - DNA, 13 bp, D. melanogaster
aaataaattccct

SEQ ID NO: 550506 - DNA, 13 bp, D. melanogaster
aaataaattcgaa

SEQ ID NO: 550507 - DNA, 13 bp, D. melanogaster
aaataaattcgat

SEQ ID NO: 550508 - DNA, 13 bp, D. melanogaster
aaataaattcgct

SEQ ID NO: 550509 - DNA, 13 bp, D. melanogaster
aaataaattgagc

SEQ ID NO: 550510 - DNA, 13 bp, D. melanogaster
aaataaattgcaa

SEQ ID NO: 550511 - DNA, 14 bp, D. melanogaster
aaataaattgcaat

SEQ ID NO: 550512 - DNA, 13 bp, D. melanogaster
aaataaattgcga

SEQ ID NO: 550513 - DNA, 13 bp, D. melanogaster
aaataaattgctt

SEQ ID NO: 550514 - DNA, 14 bp, D. melanogaster
aaataaattgcttt

SEQ ID NO: 550515 - DNA, 13 bp, D. melanogaster
aaataaattggcc

SEQ ID NO: 550516 - DNA, 14 bp, D. melanogaster
aaataaattgtatg

SEQ ID NO: 550517 - DNA, 13 bp, D. melanogaster
aaataaatttcct

SEQ ID NO: 550518 - DNA, 14 bp, D. melanogaster
aaataaatttcgaa

SEQ ID NO: 550519 - DNA, 13 bp, D. melanogaster
aaataaatttgca

SEQ ID NO: 550520 - DNA, 14 bp, D. melanogaster
aaataaatttgcat

SEQ ID NO: 550521 - DNA, 13 bp, D. melanogaster
aaataaatttggc

SEQ ID NO: 550522 - DNA, 13 bp, D. melanogaster
aaataacaaagtt

SEQ ID NO: 550523 - DNA, 13 bp, D. melanogaster
aaataacaacagt

SEQ ID NO: 550524 - DNA, 13 bp, D. melanogaster
aaataacaattag

SEQ ID NO: 550525 - DNA, 13 bp, D. melanogaster
aaataacaattgc

SEQ ID NO: 550526 - DNA, 13 bp, D. melanogaster
aaataacaatttg

SEQ ID NO: 550527 - DNA, 13 bp, D. melanogaster
aaataacacattt

SEQ ID NO: 550528 - DNA, 13 bp, D. melanogaster
aaataacactttt

SEQ ID NO: 550529 - DNA, 13 bp, D. melanogaster
aaataacagcagc

SEQ ID NO: 550530 - DNA, 13 bp, D. melanogaster
aaataacatttga

SEQ ID NO: 550531 - DNA, 13 bp, D. melanogaster
aaataacatttgg

SEQ ID NO: 550532 - DNA, 13 bp, D. melanogaster
aaataaccattta

SEQ ID NO: 550533 - DNA, 13 bp, D. melanogaster
aaataaccatttt

SEQ ID NO: 550534 - DNA, 13 bp, D. melanogaster
aaataacgaaatt

SEQ ID NO: 550535 - DNA, 13 bp, D. melanogaster
aaataactcaatt

SEQ ID NO: 550536 - DNA, 13 bp, D. melanogaster
aaataactgaata

SEQ ID NO: 550537 - DNA, 13 bp, D. melanogaster
aaataacttaaag

SEQ ID NO: 550538 - DNA, 13 bp, D. melanogaster
aaataacttgaaa

SEQ ID NO: 550539 - DNA, 13 bp, D. melanogaster
aaataacttggaa

SEQ ID NO: 550540 - DNA, 13 bp, D. melanogaster
aaataactttgaa

SEQ ID NO: 550541 - DNA, 13 bp, D. melanogaster
aaataacttttac

SEQ ID NO: 550542 - DNA, 14 bp, D. melanogaster
aaataagaaaatcc

SEQ ID NO: 550543 - DNA, 13 bp, D. melanogaster
aaataagaactgc

SEQ ID NO: 550544 - DNA, 13 bp, D. melanogaster
aaataagagtgga

SEQ ID NO: 550545 - DNA, 13 bp, D. melanogaster
aaataagattttc

SEQ ID NO: 550546 - DNA, 13 bp, D. melanogaster
aaataagcaacat

SEQ ID NO: 550547 - DNA, 13 bp, D. melanogaster
aaataagcaggca

SEQ ID NO: 550548 - DNA, 13 bp, D. melanogaster
aaataagcatata

SEQ ID NO: 550549 - DNA, 13 bp, D. melanogaster
aaataagccaaat

SEQ ID NO: 550550 - DNA, 13 bp, D. melanogaster
aaataagccaaga

SEQ ID NO: 550551 - DNA, 13 bp, D. melanogaster
aaataagctgaat

SEQ ID NO: 550552 - DNA, 13 bp, D. melanogaster
aaataagcttatt

SEQ ID NO: 550553 - DNA, 13 bp, D. melanogaster
aaataagctttta

SEQ ID NO: 550554 - DNA, 13 bp, D. melanogaster
aaataagtaatca

SEQ ID NO: 550555 - DNA, 14 bp, D. melanogaster
aaataagtacatat

SEQ ID NO: 550556 - DNA, 13 bp, D. melanogaster
aaataagtacatt

SEQ ID NO: 550557 - DNA, 13 bp, D. melanogaster
aaataagtatttg

SEQ ID NO: 550558 - DNA, 13 bp, D. melanogaster
aaataagtgaaca

SEQ ID NO: 550559 - DNA, 13 bp, D. melanogaster
aaataagtgattt

SEQ ID NO: 550560 - DNA, 13 bp, D. melanogaster
aaataagttaagt

SEQ ID NO: 550561 - DNA, 13 bp, D. melanogaster
aaataagttacac

SEQ ID NO: 550562 - DNA, 14 bp, D. melanogaster
aaataagttacaca

SEQ ID NO: 550563 - DNA, 13 bp, D. melanogaster
aaataagttcaaa

SEQ ID NO: 550564 - DNA, 13 bp, D. melanogaster
aaataagttgatt

SEQ ID NO: 550565 - DNA, 13 bp, D. melanogaster
aaataagttgcaa

SEQ ID NO: 550566 - DNA, 13 bp, D. melanogaster
aaataagtttcaa

SEQ ID NO: 550567 - DNA, 13 bp, D. melanogaster
aaataagttttag

SEQ ID NO: 550568 - DNA, 13 bp, D. melanogaster
aaataagttttga

SEQ ID NO: 550569 - DNA, 13 bp, D. melanogaster
aaataataaatgc

SEQ ID NO: 550570 - DNA, 14 bp, D. melanogaster
aaataataacaatg

SEQ ID NO: 550571 - DNA, 13 bp, D. melanogaster
aaataataagctt

SEQ ID NO: 550572 - DNA, 14 bp, D. melanogaster
aaataataataacg

SEQ ID NO: 550573 - DNA, 13 bp, D. melanogaster
aaataataatagc

SEQ ID NO: 550574 - DNA, 13 bp, D. melanogaster
aaataataatgtc

SEQ ID NO: 550575 - DNA, 13 bp, D. melanogaster
aaataataccatt

SEQ ID NO: 550576 - DNA, 13 bp, D. melanogaster
aaataatacgaag

SEQ ID NO: 550577 - DNA, 13 bp, D. melanogaster
aaataatacgttt

SEQ ID NO: 550578 - DNA, 13 bp, D. melanogaster
aaataatagcaat

SEQ ID NO: 550579 - DNA, 13 bp, D. melanogaster
aaataatagcttt

SEQ ID NO: 550580 - DNA, 13 bp, D. melanogaster
aaataatagtttc

SEQ ID NO: 550581 - DNA, 14 bp, D. melanogaster
aaataatatttgca

SEQ ID NO: 550582 - DNA, 13 bp, D. melanogaster
aaataatcaatga

SEQ ID NO: 550583 - DNA, 13 bp, D. melanogaster
aaataatcacatt

SEQ ID NO: 550584 - DNA, 13 bp, D. melanogaster
aaataatcagcaa

SEQ ID NO: 550585 - DNA, 13 bp, D. melanogaster
aaataatcagttt

SEQ ID NO: 550586 - DNA, 14 bp, D. melanogaster
aaataatcagtttt

SEQ ID NO: 550587 - DNA, 13 bp, D. melanogaster
aaataatccaatt

SEQ ID NO: 550588 - DNA, 13 bp, D. melanogaster
aaataatcccatt

SEQ ID NO: 550589 - DNA, 13 bp, D. melanogaster
aaataatccgttt

SEQ ID NO: 550590 - DNA, 14 bp, D. melanogaster
aaataatccgtttt

SEQ ID NO: 550591 - DNA, 13 bp, D. melanogaster
aaataatcctttt

SEQ ID NO: 550592 - DNA, 13 bp, D. melanogaster
aaataatcgattt

SEQ ID NO: 550593 - DNA, 14 bp, D. melanogaster
aaataatcgattta

SEQ ID NO: 550594 - DNA, 13 bp, D. melanogaster
aaataatcggttt

SEQ ID NO: 550595 - DNA, 13 bp, D. melanogaster
aaataatgaacat

SEQ ID NO: 550596 - DNA, 13 bp, D. melanogaster
aaataatgaagtt

SEQ ID NO: 550597 - DNA, 13 bp, D. melanogaster
aaataatgcaaat

SEQ ID NO: 550598 - DNA, 14 bp, D. melanogaster
aaataatgcaaata

SEQ ID NO: 550599 - DNA, 13 bp, D. melanogaster
aaataatgcaaca

SEQ ID NO: 550600 - DNA, 13 bp, D. melanogaster
aaataatgcaatt

SEQ ID NO: 550601 - DNA, 14 bp, D. melanogaster
aaataatgcaattt

SEQ ID NO: 550602 - DNA, 13 bp, D. melanogaster
aaataatgcacaa

SEQ ID NO: 550603 - DNA, 13 bp, D. melanogaster
aaataatgcactt

SEQ ID NO: 550604 - DNA, 14 bp, D. melanogaster
aaataatgccaaaa

SEQ ID NO: 550605 - DNA, 13 bp, D. melanogaster
aaataatgccaag

SEQ ID NO: 550606 - DNA, 13 bp, D. melanogaster
aaataatgccctg

SEQ ID NO: 550607 - DNA, 13 bp, D. melanogaster
aaataatggcaac

SEQ ID NO: 550608 - DNA, 13 bp, D. melanogaster
aaataatggcaat

SEQ ID NO: 550609 - DNA, 13 bp, D. melanogaster
aaataatgtcgaa

SEQ ID NO: 550610 - DNA, 13 bp, D. melanogaster
aaataatgttgaa

SEQ ID NO: 550611 - DNA, 13 bp, D. melanogaster
aaataatgttgtt

SEQ ID NO: 550612 - DNA, 13 bp, D. melanogaster
aaataatgtttgt

SEQ ID NO: 550613 - DNA, 13 bp, D. melanogaster
aaataatgttttc

SEQ ID NO: 550614 - DNA, 14 bp, D. melanogaster
aaataattaaagca

SEQ ID NO: 550615 - DNA, 13 bp, D. melanogaster
aaataattaccca

SEQ ID NO: 550616 - DNA, 14 bp, D. melanogaster
aaataattacccaa

SEQ ID NO: 550617 - DNA, 13 bp, D. melanogaster
aaataattagcaa

SEQ ID NO: 550618 - DNA, 13 bp, D. melanogaster
aaataattaggtg

SEQ ID NO: 550619 - DNA, 13 bp, D. melanogaster
aaataattatgct

SEQ ID NO: 550620 - DNA, 13 bp, D. melanogaster
aaataattcaact

SEQ ID NO: 550621 - DNA, 14 bp, D. melanogaster
aaataattcaattg

SEQ ID NO: 550622 - DNA, 13 bp, D. melanogaster
aaataattcagta

SEQ ID NO: 550623 - DNA, 13 bp, D. melanogaster
aaataattcagtt

SEQ ID NO: 550624 - DNA, 13 bp, D. melanogaster
aaataattcattg

SEQ ID NO: 550625 - DNA, 13 bp, D. melanogaster
aaataattccatt

SEQ ID NO: 550626 - DNA, 13 bp, D. melanogaster
aaataattcctta

SEQ ID NO: 550627 - DNA, 13 bp, D. melanogaster
aaataattcgaaa

SEQ ID NO: 550628 - DNA, 13 bp, D. melanogaster
aaataattcgaat

SEQ ID NO: 550629 - DNA, 13 bp, D. melanogaster
aaataattctgaa

SEQ ID NO: 550630 - DNA, 14 bp, D. melanogaster
aaataattctgaac

SEQ ID NO: 550631 - DNA, 13 bp, D. melanogaster
aaataattgacaa

SEQ ID NO: 550632 - DNA, 13 bp, D. melanogaster
aaataattgatga

SEQ ID NO: 550633 - DNA, 13 bp, D. melanogaster
aaataattgcaaa

SEQ ID NO: 550634 - DNA, 14 bp, D. melanogaster
aaataattgcaaaa

SEQ ID NO: 550635 - DNA, 13 bp, D. melanogaster
aaataattgcaat

SEQ ID NO: 550636 - DNA, 14 bp, D. melanogaster
aaataattgcaatt

SEQ ID NO: 550637 - DNA, 13 bp, D. melanogaster
aaataattgcata

SEQ ID NO: 550638 - DNA, 13 bp, D. melanogaster
aaataattgcatt

SEQ ID NO: 550639 - DNA, 14 bp, D. melanogaster
aaataattgcattt

SEQ ID NO: 550640 - DNA, 13 bp, D. melanogaster
aaataattgccaa

SEQ ID NO: 550641 - DNA, 13 bp, D. melanogaster
aaataattgccag

SEQ ID NO: 550642 - DNA, 13 bp, D. melanogaster
aaataattgcctg

SEQ ID NO: 550643 - DNA, 13 bp, D. melanogaster
aaataattgcgaa

SEQ ID NO: 550644 - DNA, 13 bp, D. melanogaster
aaataattgctat

SEQ ID NO: 550645 - DNA, 13 bp, D. melanogaster
aaataattgctta

SEQ ID NO: 550646 - DNA, 13 bp, D. melanogaster
aaataattgcttt

SEQ ID NO: 550647 - DNA, 13 bp, D. melanogaster
aaataattgggaa

SEQ ID NO: 550648 - DNA, 13 bp, D. melanogaster
aaataattgtcaa

SEQ ID NO: 550649 - DNA, 13 bp, D. melanogaster
aaataattgtcca

SEQ ID NO: 550650 - DNA, 14 bp, D. melanogaster
aaataattgtccaa

SEQ ID NO: 550651 - DNA, 13 bp, D. melanogaster
aaataattgtgca

SEQ ID NO: 550652 - DNA, 13 bp, D. melanogaster
aaataattgttca

SEQ ID NO: 550653 - DNA, 13 bp, D. melanogaster
aaataatttaagc

SEQ ID NO: 550654 - DNA, 13 bp, D. melanogaster
aaataatttatgc

SEQ ID NO: 550655 - DNA, 14 bp, D. melanogaster
aaataatttatgca

SEQ ID NO: 550656 - DNA, 13 bp, D. melanogaster
aaataatttccac

SEQ ID NO: 550657 - DNA, 13 bp, D. melanogaster
aaataatttcgaa

SEQ ID NO: 550658 - DNA, 14 bp, D. melanogaster
aaataatttcgaat

SEQ ID NO: 550659 - DNA, 13 bp, D. melanogaster
aaataatttcgat

SEQ ID NO: 550660 - DNA, 13 bp, D. melanogaster
aaataatttcgtt

SEQ ID NO: 550661 - DNA, 13 bp, D. melanogaster
aaataatttgacc

SEQ ID NO: 550662 - DNA, 13 bp, D. melanogaster
aaataatttgcaa

SEQ ID NO: 550663 - DNA, 13 bp, D. melanogaster
aaataatttgcag

SEQ ID NO: 550664 - DNA, 14 bp, D. melanogaster
aaataatttgcatt

SEQ ID NO: 550665 - DNA, 13 bp, D. melanogaster
aaataatttggaa

SEQ ID NO: 550666 - DNA, 13 bp, D. melanogaster
aaataatttgtgt

SEQ ID NO: 550667 - DNA, 13 bp, D. melanogaster
aaataatttgttc

SEQ ID NO: 550668 - DNA, 14 bp, D. melanogaster
aaataatttgttct

SEQ ID NO: 550669 - DNA, 13 bp, D. melanogaster
aaataatttgttg

SEQ ID NO: 550670 - DNA, 13 bp, D. melanogaster
aaataattttagc

SEQ ID NO: 550671 - DNA, 13 bp, D. melanogaster
aaataattttcca

SEQ ID NO: 550672 - DNA, 14 bp, D. melanogaster
aaataattttctcc

SEQ ID NO: 550673 - DNA, 13 bp, D. melanogaster
aaataattttgcc

SEQ ID NO: 550674 - DNA, 14 bp, D. melanogaster
aaataatttttgag

SEQ ID NO: 550675 - DNA, 14 bp, D. melanogaster
aaatacaaaatgca

SEQ ID NO: 550676 - DNA, 13 bp, D. melanogaster
aaatacaaagtat

SEQ ID NO: 550677 - DNA, 13 bp, D. melanogaster
aaatacaaatacg

SEQ ID NO: 550678 - DNA, 13 bp, D. melanogaster
aaatacaaatgca

SEQ ID NO: 550679 - DNA, 13 bp, D. melanogaster
aaatacaaatgga

SEQ ID NO: 550680 - DNA, 13 bp, D. melanogaster
aaatacaaatggt

SEQ ID NO: 550681 - DNA, 13 bp, D. melanogaster
aaatacaaatgtg

SEQ ID NO: 550682 - DNA, 13 bp, D. melanogaster
aaatacaaatgtt

SEQ ID NO: 550683 - DNA, 13 bp, D. melanogaster
aaatacaaattga

SEQ ID NO: 550684 - DNA, 13 bp, D. melanogaster
aaatacaaatttc

SEQ ID NO: 550685 - DNA, 13 bp, D. melanogaster
aaatacaactttt

SEQ ID NO: 550686 - DNA, 13 bp, D. melanogaster
aaatacaagaatt

SEQ ID NO: 550687 - DNA, 13 bp, D. melanogaster
aaatacaagcaat

SEQ ID NO: 550688 - DNA, 13 bp, D. melanogaster
aaatacaagccca

SEQ ID NO: 550689 - DNA, 14 bp, D. melanogaster
aaatacaagcccaa

SEQ ID NO: 550690 - DNA, 13 bp, D. melanogaster
aaatacaagctaa

SEQ ID NO: 550691 - DNA, 13 bp, D. melanogaster
aaatacaagtatt

SEQ ID NO: 550692 - DNA, 13 bp, D. melanogaster
aaatacaagtttt

SEQ ID NO: 550693 - DNA, 13 bp, D. melanogaster
aaatacaatagtt

SEQ ID NO: 550694 - DNA, 13 bp, D. melanogaster
aaatacaatctgc

SEQ ID NO: 550695 - DNA, 13 bp, D. melanogaster
aaatacaatgtaa

SEQ ID NO: 550696 - DNA, 13 bp, D. melanogaster
aaatacaatgtat

SEQ ID NO: 550697 - DNA, 13 bp, D. melanogaster
aaatacaattcca

SEQ ID NO: 550698 - DNA, 13 bp, D. melanogaster
aaatacaattgta

SEQ ID NO: 550699 - DNA, 13 bp, D. melanogaster
aaatacaatttag

SEQ ID NO: 550700 - DNA, 13 bp, D. melanogaster
aaatacaatttca

SEQ ID NO: 550701 - DNA, 13 bp, D. melanogaster
aaatacaatttct

SEQ ID NO: 550702 - DNA, 13 bp, D. melanogaster
aaatacaatttga

SEQ ID NO: 550703 - DNA, 13 bp, D. melanogaster
aaatacaatttgt

SEQ ID NO: 550704 - DNA, 14 bp, D. melanogaster
aaatacaatttgta

SEQ ID NO: 550705 - DNA, 13 bp, D. melanogaster
aaatacaattttc

SEQ ID NO: 550706 - DNA, 14 bp, D. melanogaster
aaatacaattttca

SEQ ID NO: 550707 - DNA, 13 bp, D. melanogaster
aaatacacaagac

SEQ ID NO: 550708 - DNA, 13 bp, D. melanogaster
aaatacacaatgg

SEQ ID NO: 550709 - DNA, 13 bp, D. melanogaster
aaatacacaattt

SEQ ID NO: 550710 - DNA, 13 bp, D. melanogaster
aaatacacacgca

SEQ ID NO: 550711 - DNA, 13 bp, D. melanogaster
aaatacacatatg

SEQ ID NO: 550712 - DNA, 13 bp, D. melanogaster
aaatacacatatt

SEQ ID NO: 550713 - DNA, 13 bp, D. melanogaster
aaatacacatgca

SEQ ID NO: 550714 - DNA, 13 bp, D. melanogaster
aaatacacatgtg

SEQ ID NO: 550715 - DNA, 13 bp, D. melanogaster
aaatacacatttt

SEQ ID NO: 550716 - DNA, 14 bp, D. melanogaster
aaatacacattttt

SEQ ID NO: 550717 - DNA, 14 bp, D. melanogaster
aaatacactgaaaa

SEQ ID NO: 550718 - DNA, 13 bp, D. melanogaster
aaatacactttaa

SEQ ID NO: 550719 - DNA, 13 bp, D. melanogaster
aaatacactttac

SEQ ID NO: 550720 - DNA, 13 bp, D. melanogaster
aaatacactttat

SEQ ID NO: 550721 - DNA, 13 bp, D. melanogaster
aaatacagaaatt

SEQ ID NO: 550722 - DNA, 13 bp, D. melanogaster
aaatacagataca

SEQ ID NO: 550723 - DNA, 13 bp, D. melanogaster
aaatacagattat

SEQ ID NO: 550724 - DNA, 13 bp, D. melanogaster
aaatacagcaaat

SEQ ID NO: 550725 - DNA, 13 bp, D. melanogaster
aaatacagcaaca

SEQ ID NO: 550726 - DNA, 13 bp, D. melanogaster
aaatacagcaatt

SEQ ID NO: 550727 - DNA, 13 bp, D. melanogaster
aaatacaggaata

SEQ ID NO: 550728 - DNA, 13 bp, D. melanogaster
aaatacataagta

SEQ ID NO: 550729 - DNA, 13 bp, D. melanogaster
aaatacatacact

SEQ ID NO: 550730 - DNA, 14 bp, D. melanogaster
aaatacatacattt

SEQ ID NO: 550731 - DNA, 13 bp, D. melanogaster
aaatacatacgaa

SEQ ID NO: 550732 - DNA, 13 bp, D. melanogaster
aaatacatagaac

SEQ ID NO: 550733 - DNA, 13 bp, D. melanogaster
aaatacatatatc

SEQ ID NO: 550734 - DNA, 13 bp, D. melanogaster
aaatacatatgta

SEQ ID NO: 550735 - DNA, 13 bp, D. melanogaster
aaatacatatgtt

SEQ ID NO: 550736 - DNA, 13 bp, D. melanogaster
aaatacatcaatt

SEQ ID NO: 550737 - DNA, 14 bp, D. melanogaster
aaatacatgaagaa

SEQ ID NO: 550738 - DNA, 13 bp, D. melanogaster
aaatacatgttta

SEQ ID NO: 550739 - DNA, 13 bp, D. melanogaster
aaatacattacat

SEQ ID NO: 550740 - DNA, 13 bp, D. melanogaster
aaatacattcata

SEQ ID NO: 550741 - DNA, 14 bp, D. melanogaster
aaatacattgaaaa

SEQ ID NO: 550742 - DNA, 13 bp, D. melanogaster
aaatacattgtat

SEQ ID NO: 550743 - DNA, 13 bp, D. melanogaster
aaatacatttaag

SEQ ID NO: 550744 - DNA, 13 bp, D. melanogaster
aaatacatttcaa

SEQ ID NO: 550745 - DNA, 13 bp, D. melanogaster
aaatacatttcca

SEQ ID NO: 550746 - DNA, 13 bp, D. melanogaster
aaatacatttgaa

SEQ ID NO: 550747 - DNA, 14 bp, D. melanogaster
aaatacatttgaat

SEQ ID NO: 550748 - DNA, 13 bp, D. melanogaster
aaatacatttgcc

SEQ ID NO: 550749 - DNA, 13 bp, D. melanogaster
aaatacatttgtt

SEQ ID NO: 550750 - DNA, 13 bp, D. melanogaster
aaatacattttca

SEQ ID NO: 550751 - DNA, 14 bp, D. melanogaster
aaatacattttcaa

SEQ ID NO: 550752 - DNA, 14 bp, D. melanogaster
aaatacattttcat

SEQ ID NO: 550753 - DNA, 13 bp, D. melanogaster
aaatacattttct

SEQ ID NO: 550754 - DNA, 13 bp, D. melanogaster
aaatacattttga

SEQ ID NO: 550755 - DNA, 13 bp, D. melanogaster
aaatacatttttg

SEQ ID NO: 550756 - DNA, 14 bp, D. melanogaster
aaatacatttttgt

SEQ ID NO: 550757 - DNA, 13 bp, D. melanogaster
aaataccaaaagt

SEQ ID NO: 550758 - DNA, 13 bp, D. melanogaster
aaataccaaatgt

SEQ ID NO: 550759 - DNA, 13 bp, D. melanogaster
aaataccaaattc

SEQ ID NO: 550760 - DNA, 13 bp, D. melanogaster
aaataccaacaga

SEQ ID NO: 550761 - DNA, 14 bp, D. melanogaster
aaataccaacagat

SEQ ID NO: 550762 - DNA, 13 bp, D. melanogaster
aaataccaagcaa

SEQ ID NO: 550763 - DNA, 13 bp, D. melanogaster
aaataccaatacc

SEQ ID NO: 550764 - DNA, 13 bp, D. melanogaster
aaataccaatatt

SEQ ID NO: 550765 - DNA, 13 bp, D. melanogaster
aaataccaattta

SEQ ID NO: 550766 - DNA, 13 bp, D. melanogaster
aaataccacagat

SEQ ID NO: 550767 - DNA, 13 bp, D. melanogaster
aaataccagaaat

SEQ ID NO: 550768 - DNA, 13 bp, D. melanogaster
aaataccatttaa

SEQ ID NO: 550769 - DNA, 13 bp, D. melanogaster
aaatacccaaaag

SEQ ID NO: 550770 - DNA, 13 bp, D. melanogaster
aaatacccaaatt

SEQ ID NO: 550771 - DNA, 13 bp, D. melanogaster
aaatacccatctg

SEQ ID NO: 550772 - DNA, 13 bp, D. melanogaster
aaatacccgaaaa

SEQ ID NO: 550773 - DNA, 13 bp, D. melanogaster
aaatacccgttac

SEQ ID NO: 550774 - DNA, 14 bp, D. melanogaster
aaatacccgttact

SEQ ID NO: 550775 - DNA, 13 bp, D. melanogaster
aaatacccttaaa

SEQ ID NO: 550776 - DNA, 13 bp, D. melanogaster
aaataccctttaa

SEQ ID NO: 550777 - DNA, 13 bp, D. melanogaster
aaatacccttttt

SEQ ID NO: 550778 - DNA, 13 bp, D. melanogaster
aaataccgaaaat

SEQ ID NO: 550779 - DNA, 13 bp, D. melanogaster
aaataccgaatat

SEQ ID NO: 550780 - DNA, 13 bp, D. melanogaster
aaatacctacatt

SEQ ID NO: 550781 - DNA, 13 bp, D. melanogaster
aaatacctgaaat

SEQ ID NO: 550782 - DNA, 13 bp, D. melanogaster
aaatacctttatt

SEQ ID NO: 550783 - DNA, 13 bp, D. melanogaster
aaataccttttaa

SEQ ID NO: 550784 - DNA, 13 bp, D. melanogaster
aaataccttttga

SEQ ID NO: 550785 - DNA, 14 bp, D. melanogaster
aaataccttttgaa

SEQ ID NO: 550786 - DNA, 13 bp, D. melanogaster
aaatacgaaaatt

SEQ ID NO: 550787 - DNA, 13 bp, D. melanogaster
aaatacgaaatac

SEQ ID NO: 550788 - DNA, 14 bp, D. melanogaster
aaatacgaaataca

SEQ ID NO: 550789 - DNA, 13 bp, D. melanogaster
aaatacgaaatat

SEQ ID NO: 550790 - DNA, 14 bp, D. melanogaster
aaatacgaaattaa

SEQ ID NO: 550791 - DNA, 13 bp, D. melanogaster
aaatacgaaattt

SEQ ID NO: 550792 - DNA, 13 bp, D. melanogaster
aaatacgaatata

SEQ ID NO: 550793 - DNA, 13 bp, D. melanogaster
aaatacgaattta

SEQ ID NO: 550794 - DNA, 13 bp, D. melanogaster
aaatacgaatttt

SEQ ID NO: 550795 - DNA, 13 bp, D. melanogaster
aaatacgcacaca

SEQ ID NO: 550796 - DNA, 13 bp, D. melanogaster
aaatacggaaaac

SEQ ID NO: 550797 - DNA, 13 bp, D. melanogaster
aaatacggcaaaa

SEQ ID NO: 550798 - DNA, 13 bp, D. melanogaster
aaatacgggaaaa

SEQ ID NO: 550799 - DNA, 13 bp, D. melanogaster
aaatacgtaaata

SEQ ID NO: 550800 - DNA, 13 bp, D. melanogaster
aaatacgtaattt

SEQ ID NO: 550801 - DNA, 13 bp, D. melanogaster
aaatacgtattta

SEQ ID NO: 550802 - DNA, 13 bp, D. melanogaster
aaatacgttaaaa

SEQ ID NO: 550803 - DNA, 13 bp, D. melanogaster
aaatacgtttgaa

SEQ ID NO: 550804 - DNA, 13 bp, D. melanogaster
aaatacgttttta

SEQ ID NO: 550805 - DNA, 14 bp, D. melanogaster
aaatacgtttttat

SEQ ID NO: 550806 - DNA, 13 bp, D. melanogaster
aaatacgtttttg

SEQ ID NO: 550807 - DNA, 13 bp, D. melanogaster
aaatacgtttttt

SEQ ID NO: 550808 - DNA, 13 bp, D. melanogaster
aaatactaaaatg

SEQ ID NO: 550809 - DNA, 13 bp, D. melanogaster
aaatactaacttc

SEQ ID NO: 550810 - DNA, 13 bp, D. melanogaster
aaatactaattct

SEQ ID NO: 550811 - DNA, 13 bp, D. melanogaster
aaatactatatac

SEQ ID NO: 550812 - DNA, 13 bp, D. melanogaster
aaatactatttct

SEQ ID NO: 550813 - DNA, 13 bp, D. melanogaster
aaatactcatttt

SEQ ID NO: 550814 - DNA, 13 bp, D. melanogaster
aaatactcgaata

SEQ ID NO: 550815 - DNA, 13 bp, D. melanogaster
aaatactcgtaca

SEQ ID NO: 550816 - DNA, 13 bp, D. melanogaster
aaatactcttaaa

SEQ ID NO: 550817 - DNA, 13 bp, D. melanogaster
aaatactctttat

SEQ ID NO: 550818 - DNA, 13 bp, D. melanogaster
aaatactgaatgg

SEQ ID NO: 550819 - DNA, 13 bp, D. melanogaster
aaatactgcaaat

SEQ ID NO: 550820 - DNA, 13 bp, D. melanogaster
aaatactgcgact

SEQ ID NO: 550821 - DNA, 13 bp, D. melanogaster
aaatactggaaaa

SEQ ID NO: 550822 - DNA, 13 bp, D. melanogaster
aaatactgtaaaa

SEQ ID NO: 550823 - DNA, 13 bp, D. melanogaster
aaatacttaacat

SEQ ID NO: 550824 - DNA, 13 bp, D. melanogaster
aaatacttaagca

SEQ ID NO: 550825 - DNA, 13 bp, D. melanogaster
aaatacttacata

SEQ ID NO: 550826 - DNA, 13 bp, D. melanogaster
aaatacttcaaac

SEQ ID NO: 550827 - DNA, 13 bp, D. melanogaster
aaatacttcaaat

SEQ ID NO: 550828 - DNA, 13 bp, D. melanogaster
aaatacttcaatt

SEQ ID NO: 550829 - DNA, 13 bp, D. melanogaster
aaatacttcattt

SEQ ID NO: 550830 - DNA, 13 bp, D. melanogaster
aaatacttctaaa

SEQ ID NO: 550831 - DNA, 13 bp, D. melanogaster
aaatacttgaaaa

SEQ ID NO: 550832 - DNA, 13 bp, D. melanogaster
aaatacttgtaaa

SEQ ID NO: 550833 - DNA, 13 bp, D. melanogaster
aaatacttgttat

SEQ ID NO: 550834 - DNA, 13 bp, D. melanogaster
aaatactttcaaa

SEQ ID NO: 550835 - DNA, 13 bp, D. melanogaster
aaatactttgatt

SEQ ID NO: 550836 - DNA, 14 bp, D. melanogaster
aaatactttgattg

SEQ ID NO: 550837 - DNA, 13 bp, D. melanogaster
aaatactttgcaa

SEQ ID NO: 550838 - DNA, 13 bp, D. melanogaster
aaatactttgcca

SEQ ID NO: 550839 - DNA, 13 bp, D. melanogaster
aaatactttgctc

SEQ ID NO: 550840 - DNA, 13 bp, D. melanogaster
aaatacttttcaa

SEQ ID NO: 550841 - DNA, 14 bp, D. melanogaster
aaatacttttcaaa

SEQ ID NO: 550842 - DNA, 14 bp, D. melanogaster
aaatacttttgacc

SEQ ID NO: 550843 - DNA, 13 bp, D. melanogaster
aaatacttttgat

SEQ ID NO: 550844 - DNA, 13 bp, D. melanogaster
aaatacttttgcc

SEQ ID NO: 550845 - DNA, 13 bp, D. melanogaster
aaatactttttca

SEQ ID NO: 550846 - DNA, 13 bp, D. melanogaster
aaatactttttgt

SEQ ID NO: 550847 - DNA, 13 bp, D. melanogaster
aaatagaaaactt

SEQ ID NO: 550848 - DNA, 13 bp, D. melanogaster
aaatagaaaatcg

SEQ ID NO: 550849 - DNA, 13 bp, D. melanogaster
aaatagaaagcat

SEQ ID NO: 550850 - DNA, 14 bp, D. melanogaster
aaatagaaatcaat

SEQ ID NO: 550851 - DNA, 13 bp, D. melanogaster
aaatagaaatcat

SEQ ID NO: 550852 - DNA, 13 bp, D. melanogaster
aaatagaaatcca

SEQ ID NO: 550853 - DNA, 13 bp, D. melanogaster
aaatagaaatgca

SEQ ID NO: 550854 - DNA, 13 bp, D. melanogaster
aaatagaaatttc

SEQ ID NO: 550855 - DNA, 13 bp, D. melanogaster
aaatagaacatat

SEQ ID NO: 550856 - DNA, 13 bp, D. melanogaster
aaatagaactgaa

SEQ ID NO: 550857 - DNA, 13 bp, D. melanogaster
aaatagaacttaa

SEQ ID NO: 550858 - DNA, 13 bp, D. melanogaster
aaatagaacttga

SEQ ID NO: 550859 - DNA, 13 bp, D. melanogaster
aaatagaagcgaa

SEQ ID NO: 550860 - DNA, 13 bp, D. melanogaster
aaatagaatttcc

SEQ ID NO: 550861 - DNA, 13 bp, D. melanogaster
aaatagacaattt

SEQ ID NO: 550862 - DNA, 13 bp, D. melanogaster
aaatagacagata

SEQ ID NO: 550863 - DNA, 13 bp, D. melanogaster
aaatagacagcag

SEQ ID NO: 550864 - DNA, 13 bp, D. melanogaster
aaatagacatttt

SEQ ID NO: 550865 - DNA, 13 bp, D. melanogaster
aaatagagcagac

SEQ ID NO: 550866 - DNA, 13 bp, D. melanogaster
aaatagataacct

SEQ ID NO: 550867 - DNA, 13 bp, D. melanogaster
aaatagatacata

SEQ ID NO: 550868 - DNA, 13 bp, D. melanogaster
aaatagatacctt

SEQ ID NO: 550869 - DNA, 13 bp, D. melanogaster
aaatagatgatcc

SEQ ID NO: 550870 - DNA, 13 bp, D. melanogaster
aaatagatttctt

SEQ ID NO: 550871 - DNA, 13 bp, D. melanogaster
aaatagattttga

SEQ ID NO: 550872 - DNA, 13 bp, D. melanogaster
aaatagattttgt

SEQ ID NO: 550873 - DNA, 14 bp, D. melanogaster
aaatagattttgtt

SEQ ID NO: 550874 - DNA, 13 bp, D. melanogaster
aaatagcaaaatt

SEQ ID NO: 550875 - DNA, 13 bp, D. melanogaster
aaatagcaaagca

SEQ ID NO: 550876 - DNA, 13 bp, D. melanogaster
aaatagcaaagtt

SEQ ID NO: 550877 - DNA, 14 bp, D. melanogaster
aaatagcaaatagc

SEQ ID NO: 550878 - DNA, 13 bp, D. melanogaster
aaatagcaacaac

SEQ ID NO: 550879 - DNA, 14 bp, D. melanogaster
aaatagcaacaaca

SEQ ID NO: 550880 - DNA, 13 bp, D. melanogaster
aaatagcaacagc

SEQ ID NO: 550881 - DNA, 14 bp, D. melanogaster
aaatagcaacagca

SEQ ID NO: 550882 - DNA, 13 bp, D. melanogaster
aaatagcaactaa

SEQ ID NO: 550883 - DNA, 13 bp, D. melanogaster
aaatagcaagcaa

SEQ ID NO: 550884 - DNA, 13 bp, D. melanogaster
aaatagcaattaa

SEQ ID NO: 550885 - DNA, 13 bp, D. melanogaster
aaatagcaattac

SEQ ID NO: 550886 - DNA, 13 bp, D. melanogaster
aaatagcagcaaa

SEQ ID NO: 550887 - DNA, 13 bp, D. melanogaster
aaatagcagtgcg

SEQ ID NO: 550888 - DNA, 13 bp, D. melanogaster
aaatagcagtgct

SEQ ID NO: 550889 - DNA, 13 bp, D. melanogaster
aaatagcataaat

SEQ ID NO: 550890 - DNA, 13 bp, D. melanogaster
aaatagcatcatt

SEQ ID NO: 550891 - DNA, 13 bp, D. melanogaster
aaatagcatttaa

SEQ ID NO: 550892 - DNA, 14 bp, D. melanogaster
aaatagcatttaaa

SEQ ID NO: 550893 - DNA, 13 bp, D. melanogaster
aaatagcattttc

SEQ ID NO: 550894 - DNA, 13 bp, D. melanogaster
aaatagccaaata

SEQ ID NO: 550895 - DNA, 13 bp, D. melanogaster
aaatagccaaatc

SEQ ID NO: 550896 - DNA, 13 bp, D. melanogaster
aaatagccaaatg

SEQ ID NO: 550897 - DNA, 13 bp, D. melanogaster
aaatagccaacta

SEQ ID NO: 550898 - DNA, 13 bp, D. melanogaster
aaatagccgaaaa

SEQ ID NO: 550899 - DNA, 13 bp, D. melanogaster
aaatagctaataa

SEQ ID NO: 550900 - DNA, 13 bp, D. melanogaster
aaatagctcaaaa

SEQ ID NO: 550901 - DNA, 13 bp, D. melanogaster
aaatagctgaaaa

SEQ ID NO: 550902 - DNA, 13 bp, D. melanogaster
aaatagctgaaat

SEQ ID NO: 550903 - DNA, 13 bp, D. melanogaster
aaatagctgaata

SEQ ID NO: 550904 - DNA, 13 bp, D. melanogaster
aaatagctggcaa

SEQ ID NO: 550905 - DNA, 13 bp, D. melanogaster
aaatagcttttaa

SEQ ID NO: 550906 - DNA, 14 bp, D. melanogaster
aaataggaaaatca

SEQ ID NO: 550907 - DNA, 13 bp, D. melanogaster
aaataggaaattt

SEQ ID NO: 550908 - DNA, 13 bp, D. melanogaster
aaataggagctga

SEQ ID NO: 550909 - DNA, 13 bp, D. melanogaster
aaataggatttaa

SEQ ID NO: 550910 - DNA, 13 bp, D. melanogaster
aaataggattttt

SEQ ID NO: 550911 - DNA, 13 bp, D. melanogaster
aaataggcaaaca

SEQ ID NO: 550912 - DNA, 13 bp, D. melanogaster
aaataggtttaaa

SEQ ID NO: 550913 - DNA, 13 bp, D. melanogaster
aaataggtttctt

SEQ ID NO: 550914 - DNA, 13 bp, D. melanogaster
aaatagtaatagc

SEQ ID NO: 550915 - DNA, 13 bp, D. melanogaster
aaatagtacataa

SEQ ID NO: 550916 - DNA, 14 bp, D. melanogaster
aaatagtatacaaa

SEQ ID NO: 550917 - DNA, 13 bp, D. melanogaster
aaatagtatccaa

SEQ ID NO: 550918 - DNA, 13 bp, D. melanogaster
aaatagtattttc

SEQ ID NO: 550919 - DNA, 13 bp, D. melanogaster
aaatagtcaagtt

SEQ ID NO: 550920 - DNA, 13 bp, D. melanogaster
aaatagtgaacac

SEQ ID NO: 550921 - DNA, 13 bp, D. melanogaster
aaatagtgcaaat

SEQ ID NO: 550922 - DNA, 13 bp, D. melanogaster
aaatagttaaaac

SEQ ID NO: 550923 - DNA, 13 bp, D. melanogaster
aaatagttaaatg

SEQ ID NO: 550924 - DNA, 13 bp, D. melanogaster
aaatagttaatca

SEQ ID NO: 550925 - DNA, 13 bp, D. melanogaster
aaatagttacaca

SEQ ID NO: 550926 - DNA, 13 bp, D. melanogaster
aaatagttagtta

SEQ ID NO: 550927 - DNA, 13 bp, D. melanogaster
aaatagttatgta

SEQ ID NO: 550928 - DNA, 13 bp, D. melanogaster
aaatagttcaaag

SEQ ID NO: 550929 - DNA, 13 bp, D. melanogaster
aaatagttcaata

SEQ ID NO: 550930 - DNA, 13 bp, D. melanogaster
aaatagttcttat

SEQ ID NO: 550931 - DNA, 13 bp, D. melanogaster
aaatagttgcaca

SEQ ID NO: 550932 - DNA, 13 bp, D. melanogaster
aaatagttgcata

SEQ ID NO: 550933 - DNA, 13 bp, D. melanogaster
aaatagttgccgc

SEQ ID NO: 550934 - DNA, 13 bp, D. melanogaster
aaatagttgttta

SEQ ID NO: 550935 - DNA, 13 bp, D. melanogaster
aaatagtttaaca

SEQ ID NO: 550936 - DNA, 13 bp, D. melanogaster
aaatagtttcaat

SEQ ID NO: 550937 - DNA, 14 bp, D. melanogaster
aaatagtttcattt

SEQ ID NO: 550938 - DNA, 13 bp, D. melanogaster
aaatagtttcgtt

SEQ ID NO: 550939 - DNA, 13 bp, D. melanogaster
aaatagtttgaaa

SEQ ID NO: 550940 - DNA, 13 bp, D. melanogaster
aaatagtttggct

SEQ ID NO: 550941 - DNA, 13 bp, D. melanogaster
aaatagtttgtga

SEQ ID NO: 550942 - DNA, 13 bp, D. melanogaster
aaatagtttgttt

SEQ ID NO: 550943 - DNA, 13 bp, D. melanogaster
aaatagttttcaa

SEQ ID NO: 550944 - DNA, 13 bp, D. melanogaster
aaatagttttcat

SEQ ID NO: 550945 - DNA, 13 bp, D. melanogaster
aaatagttttcgt

SEQ ID NO: 550946 - DNA, 13 bp, D. melanogaster
aaatagttttctc

SEQ ID NO: 550947 - DNA, 13 bp, D. melanogaster
aaatagttttctt

SEQ ID NO: 550948 - DNA, 13 bp, D. melanogaster
aaatagttttgag

SEQ ID NO: 550949 - DNA, 14 bp, D. melanogaster
aaatagttttgagt

SEQ ID NO: 550950 - DNA, 13 bp, D. melanogaster
aaatagtttttac

SEQ ID NO: 550951 - DNA, 13 bp, D. melanogaster
aaatagtttttag

SEQ ID NO: 550952 - DNA, 13 bp, D. melanogaster
aaatagtttttcc

SEQ ID NO: 550953 - DNA, 14 bp, D. melanogaster
aaatataaataagc

SEQ ID NO: 550954 - DNA, 14 bp, D. melanogaster
aaatataaatgcaa

SEQ ID NO: 550955 - DNA, 13 bp, D. melanogaster
aaatataaatgtg

SEQ ID NO: 550956 - DNA, 13 bp, D. melanogaster
aaatataacttac

SEQ ID NO: 550957 - DNA, 13 bp, D. melanogaster
aaatataagatac

SEQ ID NO: 550958 - DNA, 13 bp, D. melanogaster
aaatataaggctt

SEQ ID NO: 550959 - DNA, 13 bp, D. melanogaster
aaatataatacga

SEQ ID NO: 550960 - DNA, 13 bp, D. melanogaster
aaatataatgcac

SEQ ID NO: 550961 - DNA, 13 bp, D. melanogaster
aaatataattacc

SEQ ID NO: 550962 - DNA, 13 bp, D. melanogaster
aaatataattgcc

SEQ ID NO: 550963 - DNA, 13 bp, D. melanogaster
aaatataattgtg

SEQ ID NO: 550964 - DNA, 13 bp, D. melanogaster
aaatatacaaagt

SEQ ID NO: 550965 - DNA, 13 bp, D. melanogaster
aaatatacaaatg

SEQ ID NO: 550966 - DNA, 13 bp, D. melanogaster
aaatatacaactt

SEQ ID NO: 550967 - DNA, 13 bp, D. melanogaster
aaatatacaagta

SEQ ID NO: 550968 - DNA, 13 bp, D. melanogaster
aaatatacacaga

SEQ ID NO: 550969 - DNA, 13 bp, D. melanogaster
aaatatacactta

SEQ ID NO: 550970 - DNA, 13 bp, D. melanogaster
aaatatacatatc

SEQ ID NO: 550971 - DNA, 15 bp, D. melanogaster
aaatatacatatgta

SEQ ID NO: 550972 - DNA, 14 bp, D. melanogaster
aaatatacatattc

SEQ ID NO: 550973 - DNA, 13 bp, D. melanogaster
aaatatacatgta

SEQ ID NO: 550974 - DNA, 13 bp, D. melanogaster
aaatatacatttg

SEQ ID NO: 550975 - DNA, 13 bp, D. melanogaster
aaatataccattt

SEQ ID NO: 550976 - DNA, 13 bp, D. melanogaster
aaatataccttaa

SEQ ID NO: 550977 - DNA, 13 bp, D. melanogaster
aaatatacgaaat

SEQ ID NO: 550978 - DNA, 13 bp, D. melanogaster
aaatatacgaata

SEQ ID NO: 550979 - DNA, 14 bp, D. melanogaster
aaatatacgtatat

SEQ ID NO: 550980 - DNA, 13 bp, D. melanogaster
aaatatagaatct

SEQ ID NO: 550981 - DNA, 13 bp, D. melanogaster
aaatatagcaaac

SEQ ID NO: 550982 - DNA, 13 bp, D. melanogaster
aaatatagcaaat

SEQ ID NO: 550983 - DNA, 13 bp, D. melanogaster
aaatatagcattt

SEQ ID NO: 550984 - DNA, 13 bp, D. melanogaster
aaatatagctaat

SEQ ID NO: 550985 - DNA, 13 bp, D. melanogaster
aaatatagtgtga

SEQ ID NO: 550986 - DNA, 13 bp, D. melanogaster
aaatatataaagc

SEQ ID NO: 550987 - DNA, 14 bp, D. melanogaster
aaatatatacacac

SEQ ID NO: 550988 - DNA, 13 bp, D. melanogaster
aaatatatacaga

SEQ ID NO: 550989 - DNA, 13 bp, D. melanogaster
aaatatataccta

SEQ ID NO: 550990 - DNA, 13 bp, D. melanogaster
aaatatatagaca

SEQ ID NO: 550991 - DNA, 13 bp, D. melanogaster
aaatatatagtac

SEQ ID NO: 550992 - DNA, 13 bp, D. melanogaster
aaatatatagttc

SEQ ID NO: 550993 - DNA, 13 bp, D. melanogaster
aaatatatatacc

SEQ ID NO: 550994 - DNA, 14 bp, D. melanogaster
aaatatatatacgt

SEQ ID NO: 550995 - DNA, 14 bp, D. melanogaster
aaatatatatatgg

SEQ ID NO: 550996 - DNA, 13 bp, D. melanogaster
aaatatatatcca

SEQ ID NO: 550997 - DNA, 13 bp, D. melanogaster
aaatatatatgca

SEQ ID NO: 550998 - DNA, 13 bp, D. melanogaster
aaatatatatggt

SEQ ID NO: 550999 - DNA, 16 bp, D. melanogaster
aaatatatatgtacat

SEQ ID NO: 551000 - DNA, 13 bp, D. melanogaster
aaatatatatgtc

SEQ ID NO: 551001 - DNA, 13 bp, D. melanogaster
aaatatatatgtg

SEQ ID NO: 551002 - DNA, 13 bp, D. melanogaster
aaatatatattgc

SEQ ID NO: 551003 - DNA, 13 bp, D. melanogaster
aaatatatcacat

SEQ ID NO: 551004 - DNA, 13 bp, D. melanogaster
aaatatatctcat

SEQ ID NO: 551005 - DNA, 13 bp, D. melanogaster
aaatatatgatca

SEQ ID NO: 551006 - DNA, 13 bp, D. melanogaster
aaatatatgcaaa

SEQ ID NO: 551007 - DNA, 14 bp, D. melanogaster
aaatatatgcaaaa

SEQ ID NO: 551008 - DNA, 13 bp, D. melanogaster
aaatatatgcaca

SEQ ID NO: 551009 - DNA, 13 bp, D. melanogaster
aaatatatgcagc

SEQ ID NO: 551010 - DNA, 13 bp, D. melanogaster
aaatatatgcata

SEQ ID NO: 551011 - DNA, 14 bp, D. melanogaster
aaatatatgcatat

SEQ ID NO: 551012 - DNA, 14 bp, D. melanogaster
aaatatatgcattt

SEQ ID NO: 551013 - DNA, 13 bp, D. melanogaster
aaatatatgctaa

SEQ ID NO: 551014 - DNA, 13 bp, D. melanogaster
aaatatatgctta

SEQ ID NO: 551015 - DNA, 13 bp, D. melanogaster
aaatatatggcaa

SEQ ID NO: 551016 - DNA, 13 bp, D. melanogaster
aaatatatggcat

SEQ ID NO: 551017 - DNA, 13 bp, D. melanogaster
aaatatatggtaa

SEQ ID NO: 551018 - DNA, 13 bp, D. melanogaster
aaatatatggttt

SEQ ID NO: 551019 - DNA, 13 bp, D. melanogaster
aaatatatgtact

SEQ ID NO: 551020 - DNA, 13 bp, D. melanogaster
aaatatatgtgct

SEQ ID NO: 551021 - DNA, 14 bp, D. melanogaster
aaatatatgtgtat

SEQ ID NO: 551022 - DNA, 13 bp, D. melanogaster
aaatatattaagc

SEQ ID NO: 551023 - DNA, 13 bp, D. melanogaster
aaatatattacag

SEQ ID NO: 551024 - DNA, 13 bp, D. melanogaster
aaatatattcaga

SEQ ID NO: 551025 - DNA, 13 bp, D. melanogaster
aaatatattccaa

SEQ ID NO: 551026 - DNA, 13 bp, D. melanogaster
aaatatattcctt

SEQ ID NO: 551027 - DNA, 14 bp, D. melanogaster
aaatatattcgaaa

SEQ ID NO: 551028 - DNA, 13 bp, D. melanogaster
aaatatattcgtt

SEQ ID NO: 551029 - DNA, 13 bp, D. melanogaster
aaatatattcttc

SEQ ID NO: 551030 - DNA, 14 bp, D. melanogaster
aaatatattcttga

SEQ ID NO: 551031 - DNA, 14 bp, D. melanogaster
aaatatattgcaaa

SEQ ID NO: 551032 - DNA, 13 bp, D. melanogaster
aaatatattgctg

SEQ ID NO: 551033 - DNA, 13 bp, D. melanogaster
aaatatatttagg

SEQ ID NO: 551034 - DNA, 14 bp, D. melanogaster
aaatatatttcaac

SEQ ID NO: 551035 - DNA, 13 bp, D. melanogaster
aaatatatttcca

SEQ ID NO: 551036 - DNA, 13 bp, D. melanogaster
aaatatatttccc

SEQ ID NO: 551037 - DNA, 13 bp, D. melanogaster
aaatatatttcga

SEQ ID NO: 551038 - DNA, 13 bp, D. melanogaster
aaatatatttcgc

SEQ ID NO: 551039 - DNA, 13 bp, D. melanogaster
aaatatatttctg

SEQ ID NO: 551040 - DNA, 13 bp, D. melanogaster
aaatatatttgca

SEQ ID NO: 551041 - DNA, 14 bp, D. melanogaster
aaatatatttgcaa

SEQ ID NO: 551042 - DNA, 13 bp, D. melanogaster
aaatatatttggc

SEQ ID NO: 551043 - DNA, 13 bp, D. melanogaster
aaatatattttcc

SEQ ID NO: 551044 - DNA, 14 bp, D. melanogaster
aaatatattttcct

SEQ ID NO: 551045 - DNA, 13 bp, D. melanogaster
aaatatattttgc

SEQ ID NO: 551046 - DNA, 13 bp, D. melanogaster
aaatatcaaagca

SEQ ID NO: 551047 - DNA, 13 bp, D. melanogaster
aaatatcaacagc

SEQ ID NO: 551048 - DNA, 13 bp, D. melanogaster
aaatatcaacttt

SEQ ID NO: 551049 - DNA, 13 bp, D. melanogaster
aaatatcaagtat

SEQ ID NO: 551050 - DNA, 13 bp, D. melanogaster
aaatatcaatgaa

SEQ ID NO: 551051 - DNA, 13 bp, D. melanogaster
aaatatcaatgca

SEQ ID NO: 551052 - DNA, 13 bp, D. melanogaster
aaatatcaattac

SEQ ID NO: 551053 - DNA, 13 bp, D. melanogaster
aaatatcaattga

SEQ ID NO: 551054 - DNA, 14 bp, D. melanogaster
aaatatcaattgca

SEQ ID NO: 551055 - DNA, 13 bp, D. melanogaster
aaatatcacacat

SEQ ID NO: 551056 - DNA, 13 bp, D. melanogaster
aaatatcagaaac

SEQ ID NO: 551057 - DNA, 13 bp, D. melanogaster
aaatatcatatca

SEQ ID NO: 551058 - DNA, 13 bp, D. melanogaster
aaatatcattcaa

SEQ ID NO: 551059 - DNA, 13 bp, D. melanogaster
aaatatcattcca

SEQ ID NO: 551060 - DNA, 13 bp, D. melanogaster
aaatatcattgat

SEQ ID NO: 551061 - DNA, 13 bp, D. melanogaster
aaatatcatttac

SEQ ID NO: 551062 - DNA, 14 bp, D. melanogaster
aaatatcatttaca

SEQ ID NO: 551063 - DNA, 13 bp, D. melanogaster
aaatatccaaatt

SEQ ID NO: 551064 - DNA, 13 bp, D. melanogaster
aaatatccattaa

SEQ ID NO: 551065 - DNA, 13 bp, D. melanogaster
aaatatccatttc

SEQ ID NO: 551066 - DNA, 13 bp, D. melanogaster
aaatatccgaact

SEQ ID NO: 551067 - DNA, 14 bp, D. melanogaster
aaatatccgatttt

SEQ ID NO: 551068 - DNA, 13 bp, D. melanogaster
aaatatcctgatt

SEQ ID NO: 551069 - DNA, 13 bp, D. melanogaster
aaatatccttaat

SEQ ID NO: 551070 - DNA, 13 bp, D. melanogaster
aaatatccttgct

SEQ ID NO: 551071 - DNA, 13 bp, D. melanogaster
aaatatcctttaa

SEQ ID NO: 551072 - DNA, 13 bp, D. melanogaster
aaatatccttttg

SEQ ID NO: 551073 - DNA, 13 bp, D. melanogaster
aaatatcgaaaat

SEQ ID NO: 551074 - DNA, 13 bp, D. melanogaster
aaatatcgaaata

SEQ ID NO: 551075 - DNA, 13 bp, D. melanogaster
aaatatcgaaatt

SEQ ID NO: 551076 - DNA, 13 bp, D. melanogaster
aaatatcgaatat

SEQ ID NO: 551077 - DNA, 13 bp, D. melanogaster
aaatatcgatatt

SEQ ID NO: 551078 - DNA, 13 bp, D. melanogaster
aaatatcgatttt

SEQ ID NO: 551079 - DNA, 13 bp, D. melanogaster
aaatatcgtttat

SEQ ID NO: 551080 - DNA, 13 bp, D. melanogaster
aaatatcgttttt

SEQ ID NO: 551081 - DNA, 13 bp, D. melanogaster
aaatatctaaatg

SEQ ID NO: 551082 - DNA, 13 bp, D. melanogaster
aaatatctacaca

SEQ ID NO: 551083 - DNA, 13 bp, D. melanogaster
aaatatctactac

SEQ ID NO: 551084 - DNA, 13 bp, D. melanogaster
aaatatctacttt

SEQ ID NO: 551085 - DNA, 13 bp, D. melanogaster
aaatatctatcga

SEQ ID NO: 551086 - DNA, 13 bp, D. melanogaster
aaatatctcaaat

SEQ ID NO: 551087 - DNA, 13 bp, D. melanogaster
aaatatctgaatg

SEQ ID NO: 551088 - DNA, 13 bp, D. melanogaster
aaatatctgttct

SEQ ID NO: 551089 - DNA, 14 bp, D. melanogaster
aaatatctgttctg

SEQ ID NO: 551090 - DNA, 13 bp, D. melanogaster
aaatatcttcaat

SEQ ID NO: 551091 - DNA, 13 bp, D. melanogaster
aaatatcttgaaa

SEQ ID NO: 551092 - DNA, 13 bp, D. melanogaster
aaatatcttgaat

SEQ ID NO: 551093 - DNA, 13 bp, D. melanogaster
aaatatctttatc

SEQ ID NO: 551094 - DNA, 13 bp, D. melanogaster
aaatatctttgat

SEQ ID NO: 551095 - DNA, 13 bp, D. melanogaster
aaatatctttttg

SEQ ID NO: 551096 - DNA, 13 bp, D. melanogaster
aaatatgaaaacg

SEQ ID NO: 551097 - DNA, 13 bp, D. melanogaster
aaatatgaaaact

SEQ ID NO: 551098 - DNA, 14 bp, D. melanogaster
aaatatgaaaactg

SEQ ID NO: 551099 - DNA, 13 bp, D. melanogaster
aaatatgaaaagc

SEQ ID NO: 551100 - DNA, 14 bp, D. melanogaster
aaatatgaaaatgg

SEQ ID NO: 551101 - DNA, 13 bp, D. melanogaster
aaatatgaaacag

SEQ ID NO: 551102 - DNA, 13 bp, D. melanogaster
aaatatgaaatca

SEQ ID NO: 551103 - DNA, 13 bp, D. melanogaster
aaatatgaaatgt

SEQ ID NO: 551104 - DNA, 13 bp, D. melanogaster
aaatatgaaattc

SEQ ID NO: 551105 - DNA, 14 bp, D. melanogaster
aaatatgaaattca

SEQ ID NO: 551106 - DNA, 13 bp, D. melanogaster
aaatatgaagcaa

SEQ ID NO: 551107 - DNA, 13 bp, D. melanogaster
aaatatgaagtta

SEQ ID NO: 551108 - DNA, 14 bp, D. melanogaster
aaatatgaagttat

SEQ ID NO: 551109 - DNA, 13 bp, D. melanogaster
aaatatgaatgtg

SEQ ID NO: 551110 - DNA, 13 bp, D. melanogaster
aaatatgacaaat

SEQ ID NO: 551111 - DNA, 13 bp, D. melanogaster
aaatatgacaatt

SEQ ID NO: 551112 - DNA, 13 bp, D. melanogaster
aaatatgacattt

SEQ ID NO: 551113 - DNA, 13 bp, D. melanogaster
aaatatgactcaa

SEQ ID NO: 551114 - DNA, 13 bp, D. melanogaster
aaatatgagaatt

SEQ ID NO: 551115 - DNA, 14 bp, D. melanogaster
aaatatgagccact

SEQ ID NO: 551116 - DNA, 13 bp, D. melanogaster
aaatatgataact

SEQ ID NO: 551117 - DNA, 13 bp, D. melanogaster
aaatatgatggaa

SEQ ID NO: 551118 - DNA, 13 bp, D. melanogaster
aaatatgatgtca

SEQ ID NO: 551119 - DNA, 13 bp, D. melanogaster
aaatatgattatg

SEQ ID NO: 551120 - DNA, 13 bp, D. melanogaster
aaatatgattgat

SEQ ID NO: 551121 - DNA, 13 bp, D. melanogaster
aaatatgattgtg

SEQ ID NO: 551122 - DNA, 14 bp, D. melanogaster
aaatatgattgtgt

SEQ ID NO: 551123 - DNA, 14 bp, D. melanogaster
aaatatgcaaaaac

SEQ ID NO: 551124 - DNA, 14 bp, D. melanogaster
aaatatgcaaaaag

SEQ ID NO: 551125 - DNA, 13 bp, D. melanogaster
aaatatgcaaaat

SEQ ID NO: 551126 - DNA, 14 bp, D. melanogaster
aaatatgcaaaata

SEQ ID NO: 551127 - DNA, 14 bp, D. melanogaster
aaatatgcaaaatt

SEQ ID NO: 551128 - DNA, 14 bp, D. melanogaster
aaatatgcaaacaa

SEQ ID NO: 551129 - DNA, 13 bp, D. melanogaster
aaatatgcaaaga

SEQ ID NO: 551130 - DNA, 14 bp, D. melanogaster
aaatatgcaaataa

SEQ ID NO: 551131 - DNA, 13 bp, D. melanogaster
aaatatgcaaatg

SEQ ID NO: 551132 - DNA, 14 bp, D. melanogaster
aaatatgcaaatga

SEQ ID NO: 551133 - DNA, 13 bp, D. melanogaster
aaatatgcaaatt

SEQ ID NO: 551134 - DNA, 14 bp, D. melanogaster
aaatatgcaaatta

SEQ ID NO: 551135 - DNA, 14 bp, D. melanogaster
aaatatgcaaattt

SEQ ID NO: 551136 - DNA, 13 bp, D. melanogaster
aaatatgcaacaa

SEQ ID NO: 551137 - DNA, 14 bp, D. melanogaster
aaatatgcaacaaa

SEQ ID NO: 551138 - DNA, 13 bp, D. melanogaster
aaatatgcaacac

SEQ ID NO: 551139 - DNA, 13 bp, D. melanogaster
aaatatgcaacat

SEQ ID NO: 551140 - DNA, 13 bp, D. melanogaster
aaatatgcaacta

SEQ ID NO: 551141 - DNA, 13 bp, D. melanogaster
aaatatgcaactt

SEQ ID NO: 551142 - DNA, 13 bp, D. melanogaster
aaatatgcaagaa

SEQ ID NO: 551143 - DNA, 13 bp, D. melanogaster
aaatatgcaataa

SEQ ID NO: 551144 - DNA, 14 bp, D. melanogaster
aaatatgcaataaa

SEQ ID NO: 551145 - DNA, 14 bp, D. melanogaster
aaatatgcaatatt

SEQ ID NO: 551146 - DNA, 13 bp, D. melanogaster
aaatatgcaatta

SEQ ID NO: 551147 - DNA, 13 bp, D. melanogaster
aaatatgcaattt

SEQ ID NO: 551148 - DNA, 13 bp, D. melanogaster
aaatatgcacaaa

SEQ ID NO: 551149 - DNA, 13 bp, D. melanogaster
aaatatgcacaac

SEQ ID NO: 551150 - DNA, 14 bp, D. melanogaster
aaatatgcacaaca

SEQ ID NO: 551151 - DNA, 13 bp, D. melanogaster
aaatatgcacaat

SEQ ID NO: 551152 - DNA, 13 bp, D. melanogaster
aaatatgcacaca

SEQ ID NO: 551153 - DNA, 13 bp, D. melanogaster
aaatatgcactta

SEQ ID NO: 551154 - DNA, 13 bp, D. melanogaster
aaatatgcagaaa

SEQ ID NO: 551155 - DNA, 13 bp, D. melanogaster
aaatatgcagcat

SEQ ID NO: 551156 - DNA, 13 bp, D. melanogaster
aaatatgcataaa

SEQ ID NO: 551157 - DNA, 14 bp, D. melanogaster
aaatatgcataaat

SEQ ID NO: 551158 - DNA, 13 bp, D. melanogaster
aaatatgcataca

SEQ ID NO: 551159 - DNA, 13 bp, D. melanogaster
aaatatgcatatg

SEQ ID NO: 551160 - DNA, 14 bp, D. melanogaster
aaatatgcatatgc

SEQ ID NO: 551161 - DNA, 13 bp, D. melanogaster
aaatatgcatatt

SEQ ID NO: 551162 - DNA, 14 bp, D. melanogaster
aaatatgcatattt

SEQ ID NO: 551163 - DNA, 13 bp, D. melanogaster
aaatatgcatcaa

SEQ ID NO: 551164 - DNA, 13 bp, D. melanogaster
aaatatgcatgaa

SEQ ID NO: 551165 - DNA, 14 bp, D. melanogaster
aaatatgcatgaaa

SEQ ID NO: 551166 - DNA, 13 bp, D. melanogaster
aaatatgcattaa

SEQ ID NO: 551167 - DNA, 13 bp, D. melanogaster
aaatatgcattga

SEQ ID NO: 551168 - DNA, 13 bp, D. melanogaster
aaatatgcattta

SEQ ID NO: 551169 - DNA, 14 bp, D. melanogaster
aaatatgcatttaa

SEQ ID NO: 551170 - DNA, 13 bp, D. melanogaster
aaatatgcatttt

SEQ ID NO: 551171 - DNA, 14 bp, D. melanogaster
aaatatgcattttt

SEQ ID NO: 551172 - DNA, 13 bp, D. melanogaster
aaatatgccaaaa

SEQ ID NO: 551173 - DNA, 13 bp, D. melanogaster
aaatatgccacaa

SEQ ID NO: 551174 - DNA, 13 bp, D. melanogaster
aaatatgccacat

SEQ ID NO: 551175 - DNA, 13 bp, D. melanogaster
aaatatgccattt

SEQ ID NO: 551176 - DNA, 13 bp, D. melanogaster
aaatatgctaaaa

SEQ ID NO: 551177 - DNA, 13 bp, D. melanogaster
aaatatgctaatt

SEQ ID NO: 551178 - DNA, 13 bp, D. melanogaster
aaatatgctacaa

SEQ ID NO: 551179 - DNA, 13 bp, D. melanogaster
aaatatgctcaaa

SEQ ID NO: 551180 - DNA, 13 bp, D. melanogaster
aaatatgctgaaa

SEQ ID NO: 551181 - DNA, 13 bp, D. melanogaster
aaatatgcttata

SEQ ID NO: 551182 - DNA, 13 bp, D. melanogaster
aaatatgcttttc

SEQ ID NO: 551183 - DNA, 13 bp, D. melanogaster
aaatatggaaatt

SEQ ID NO: 551184 - DNA, 13 bp, D. melanogaster
aaatatggaatat

SEQ ID NO: 551185 - DNA, 13 bp, D. melanogaster
aaatatggatcca

SEQ ID NO: 551186 - DNA, 13 bp, D. melanogaster
aaatatggatttt

SEQ ID NO: 551187 - DNA, 13 bp, D. melanogaster
aaatatggcaaaa

SEQ ID NO: 551188 - DNA, 13 bp, D. melanogaster
aaatatggcaaat

SEQ ID NO: 551189 - DNA, 13 bp, D. melanogaster
aaatatggcaaca

SEQ ID NO: 551190 - DNA, 13 bp, D. melanogaster
aaatatggcaata

SEQ ID NO: 551191 - DNA, 14 bp, D. melanogaster
aaatatggccaaaa

SEQ ID NO: 551192 - DNA, 13 bp, D. melanogaster
aaatatggtaacc

SEQ ID NO: 551193 - DNA, 13 bp, D. melanogaster
aaatatggtgcag

SEQ ID NO: 551194 - DNA, 13 bp, D. melanogaster
aaatatgtaaaca

SEQ ID NO: 551195 - DNA, 13 bp, D. melanogaster
aaatatgtaaagc

SEQ ID NO: 551196 - DNA, 13 bp, D. melanogaster
aaatatgtaaatg

SEQ ID NO: 551197 - DNA, 14 bp, D. melanogaster
aaatatgtaaattc

SEQ ID NO: 551198 - DNA, 13 bp, D. melanogaster
aaatatgtaacaa

SEQ ID NO: 551199 - DNA, 13 bp, D. melanogaster
aaatatgtacaaa

SEQ ID NO: 551200 - DNA, 13 bp, D. melanogaster
aaatatgtacaca

SEQ ID NO: 551201 - DNA, 13 bp, D. melanogaster
aaatatgtacata

SEQ ID NO: 551202 - DNA, 14 bp, D. melanogaster
aaatatgtacatac

SEQ ID NO: 551203 - DNA, 13 bp, D. melanogaster
aaatatgtagata

SEQ ID NO: 551204 - DNA, 14 bp, D. melanogaster
aaatatgtagatat

SEQ ID NO: 551205 - DNA, 13 bp, D. melanogaster
aaatatgtataag

SEQ ID NO: 551206 - DNA, 14 bp, D. melanogaster
aaatatgtatatgc

SEQ ID NO: 551207 - DNA, 13 bp, D. melanogaster
aaatatgtatcaa

SEQ ID NO: 551208 - DNA, 13 bp, D. melanogaster
aaatatgtatgca

SEQ ID NO: 551209 - DNA, 14 bp, D. melanogaster
aaatatgtatgcaa

SEQ ID NO: 551210 - DNA, 14 bp, D. melanogaster
aaatatgtatgtat

SEQ ID NO: 551211 - DNA, 13 bp, D. melanogaster
aaatatgtattag

SEQ ID NO: 551212 - DNA, 13 bp, D. melanogaster
aaatatgtcaaaa

SEQ ID NO: 551213 - DNA, 13 bp, D. melanogaster
aaatatgtcaaca

SEQ ID NO: 551214 - DNA, 13 bp, D. melanogaster
aaatatgtgcata

SEQ ID NO: 551215 - DNA, 13 bp, D. melanogaster
aaatatgtggaaa

SEQ ID NO: 551216 - DNA, 13 bp, D. melanogaster
aaatatgtgtaat

SEQ ID NO: 551217 - DNA, 13 bp, D. melanogaster
aaatatgtgtaca

SEQ ID NO: 551218 - DNA, 13 bp, D. melanogaster
aaatatgtgtgaa

SEQ ID NO: 551219 - DNA, 13 bp, D. melanogaster
aaatatgtgttta

SEQ ID NO: 551220 - DNA, 14 bp, D. melanogaster
aaatatgttaaact

SEQ ID NO: 551221 - DNA, 13 bp, D. melanogaster
aaatatgttgaaa

SEQ ID NO: 551222 - DNA, 13 bp, D. melanogaster
aaatatgttgaat

SEQ ID NO: 551223 - DNA, 13 bp, D. melanogaster
aaatatgttgata

SEQ ID NO: 551224 - DNA, 13 bp, D. melanogaster
aaatatgttgcat

SEQ ID NO: 551225 - DNA, 13 bp, D. melanogaster
aaatatgtttaca

SEQ ID NO: 551226 - DNA, 13 bp, D. melanogaster
aaatatgtttacc

SEQ ID NO: 551227 - DNA, 13 bp, D. melanogaster
aaatatgtttagt

SEQ ID NO: 551228 - DNA, 13 bp, D. melanogaster
aaatatgtttgct

SEQ ID NO: 551229 - DNA, 13 bp, D. melanogaster
aaatatgttttca

SEQ ID NO: 551230 - DNA, 13 bp, D. melanogaster
aaatatgtttttc

SEQ ID NO: 551231 - DNA, 13 bp, D. melanogaster
aaatattaaagcc

SEQ ID NO: 551232 - DNA, 14 bp, D. melanogaster
aaatattaaagcca

SEQ ID NO: 551233 - DNA, 13 bp, D. melanogaster
aaatattaaagtg

SEQ ID NO: 551234 - DNA, 13 bp, D. melanogaster
aaatattaaatgc

SEQ ID NO: 551235 - DNA, 13 bp, D. melanogaster
aaatattaagcaa

SEQ ID NO: 551236 - DNA, 13 bp, D. melanogaster
aaatattaagctt

SEQ ID NO: 551237 - DNA, 13 bp, D. melanogaster
aaatattaagttg

SEQ ID NO: 551238 - DNA, 13 bp, D. melanogaster
aaatattaatagc

SEQ ID NO: 551239 - DNA, 13 bp, D. melanogaster
aaatattacacat

SEQ ID NO: 551240 - DNA, 13 bp, D. melanogaster
aaatattacagaa

SEQ ID NO: 551241 - DNA, 13 bp, D. melanogaster
aaatattacgaaa

SEQ ID NO: 551242 - DNA, 13 bp, D. melanogaster
aaatattactttc

SEQ ID NO: 551243 - DNA, 13 bp, D. melanogaster
aaatattatgcaa

SEQ ID NO: 551244 - DNA, 13 bp, D. melanogaster
aaatattatggta

SEQ ID NO: 551245 - DNA, 13 bp, D. melanogaster
aaatattattgca

SEQ ID NO: 551246 - DNA, 13 bp, D. melanogaster
aaatattatttgc

SEQ ID NO: 551247 - DNA, 13 bp, D. melanogaster
aaatattcaaagc

SEQ ID NO: 551248 - DNA, 13 bp, D. melanogaster
aaatattcaaagt

SEQ ID NO: 551249 - DNA, 14 bp, D. melanogaster
aaatattcaaatgt

SEQ ID NO: 551250 - DNA, 13 bp, D. melanogaster
aaatattcaacat

SEQ ID NO: 551251 - DNA, 13 bp, D. melanogaster
aaatattcaagtt

SEQ ID NO: 551252 - DNA, 13 bp, D. melanogaster
aaatattcaatca

SEQ ID NO: 551253 - DNA, 13 bp, D. melanogaster
aaatattcacatt

SEQ ID NO: 551254 - DNA, 14 bp, D. melanogaster
aaatattcactttt

SEQ ID NO: 551255 - DNA, 13 bp, D. melanogaster
aaatattcagaaa

SEQ ID NO: 551256 - DNA, 13 bp, D. melanogaster
aaatattcagaat

SEQ ID NO: 551257 - DNA, 13 bp, D. melanogaster
aaatattcagcaa

SEQ ID NO: 551258 - DNA, 13 bp, D. melanogaster
aaatattcagtta

SEQ ID NO: 551259 - DNA, 13 bp, D. melanogaster
aaatattcagttt

SEQ ID NO: 551260 - DNA, 13 bp, D. melanogaster
aaatattcataga

SEQ ID NO: 551261 - DNA, 13 bp, D. melanogaster
aaatattcatcaa

SEQ ID NO: 551262 - DNA, 13 bp, D. melanogaster
aaatattcatgaa

SEQ ID NO: 551263 - DNA, 13 bp, D. melanogaster
aaatattcatgca

SEQ ID NO: 551264 - DNA, 13 bp, D. melanogaster
aaatattccaaat

SEQ ID NO: 551265 - DNA, 13 bp, D. melanogaster
aaatattccaatt

SEQ ID NO: 551266 - DNA, 13 bp, D. melanogaster
aaatattccacaa

SEQ ID NO: 551267 - DNA, 13 bp, D. melanogaster
aaatattccaccc

SEQ ID NO: 551268 - DNA, 13 bp, D. melanogaster
aaatattccattt

SEQ ID NO: 551269 - DNA, 13 bp, D. melanogaster
aaatattccttat

SEQ ID NO: 551270 - DNA, 13 bp, D. melanogaster
aaatattccttta

SEQ ID NO: 551271 - DNA, 13 bp, D. melanogaster
aaatattcgaaaa

SEQ ID NO: 551272 - DNA, 14 bp, D. melanogaster
aaatattcgaaaat

SEQ ID NO: 551273 - DNA, 13 bp, D. melanogaster
aaatattcgaata

SEQ ID NO: 551274 - DNA, 13 bp, D. melanogaster
aaatattcgattt

SEQ ID NO: 551275 - DNA, 14 bp, D. melanogaster
aaatattcgatttt

SEQ ID NO: 551276 - DNA, 13 bp, D. melanogaster
aaatattcgcaaa

SEQ ID NO: 551277 - DNA, 13 bp, D. melanogaster
aaatattcgcaca

SEQ ID NO: 551278 - DNA, 13 bp, D. melanogaster
aaatattcggtaa

SEQ ID NO: 551279 - DNA, 14 bp, D. melanogaster
aaatattcggtaac

SEQ ID NO: 551280 - DNA, 13 bp, D. melanogaster
aaatattcggtat

SEQ ID NO: 551281 - DNA, 13 bp, D. melanogaster
aaatattcgtaaa

SEQ ID NO: 551282 - DNA, 13 bp, D. melanogaster
aaatattctacat

SEQ ID NO: 551283 - DNA, 13 bp, D. melanogaster
aaatattctcaaa

SEQ ID NO: 551284 - DNA, 13 bp, D. melanogaster
aaatattctttct

SEQ ID NO: 551285 - DNA, 14 bp, D. melanogaster
aaatattgaaaaca

SEQ ID NO: 551286 - DNA, 13 bp, D. melanogaster
aaatattgaaaca

SEQ ID NO: 551287 - DNA, 14 bp, D. melanogaster
aaatattgaaacaa

SEQ ID NO: 551288 - DNA, 13 bp, D. melanogaster
aaatattgaacaa

SEQ ID NO: 551289 - DNA, 13 bp, D. melanogaster
aaatattgaattc

SEQ ID NO: 551290 - DNA, 13 bp, D. melanogaster
aaatattgacagc

SEQ ID NO: 551291 - DNA, 13 bp, D. melanogaster
aaatattgacttt

SEQ ID NO: 551292 - DNA, 14 bp, D. melanogaster
aaatattgactttt

SEQ ID NO: 551293 - DNA, 13 bp, D. melanogaster
aaatattgatcaa

SEQ ID NO: 551294 - DNA, 13 bp, D. melanogaster
aaatattgatgaa

SEQ ID NO: 551295 - DNA, 13 bp, D. melanogaster
aaatattgattga

SEQ ID NO: 551296 - DNA, 13 bp, D. melanogaster
aaatattgcaaaa

SEQ ID NO: 551297 - DNA, 14 bp, D. melanogaster
aaatattgcaaaaa

SEQ ID NO: 551298 - DNA, 13 bp, D. melanogaster
aaatattgcaaat

SEQ ID NO: 551299 - DNA, 14 bp, D. melanogaster
aaatattgcaaatt

SEQ ID NO: 551300 - DNA, 13 bp, D. melanogaster
aaatattgcaaca

SEQ ID NO: 551301 - DNA, 13 bp, D. melanogaster
aaatattgcaagt

SEQ ID NO: 551302 - DNA, 13 bp, D. melanogaster
aaatattgcaatc

SEQ ID NO: 551303 - DNA, 13 bp, D. melanogaster
aaatattgcaatt

SEQ ID NO: 551304 - DNA, 13 bp, D. melanogaster
aaatattgcataa

SEQ ID NO: 551305 - DNA, 13 bp, D. melanogaster
aaatattgcatgt

SEQ ID NO: 551306 - DNA, 13 bp, D. melanogaster
aaatattgcattt

SEQ ID NO: 551307 - DNA, 13 bp, D. melanogaster
aaatattgccagc

SEQ ID NO: 551308 - DNA, 13 bp, D. melanogaster
aaatattgccata

SEQ ID NO: 551309 - DNA, 13 bp, D. melanogaster
aaatattgccatt

SEQ ID NO: 551310 - DNA, 13 bp, D. melanogaster
aaatattgccttt

SEQ ID NO: 551311 - DNA, 13 bp, D. melanogaster
aaatattgcgaaa

SEQ ID NO: 551312 - DNA, 13 bp, D. melanogaster
aaatattgctatt

SEQ ID NO: 551313 - DNA, 13 bp, D. melanogaster
aaatattggaaat

SEQ ID NO: 551314 - DNA, 13 bp, D. melanogaster
aaatattggaatt

SEQ ID NO: 551315 - DNA, 13 bp, D. melanogaster
aaatattggataa

SEQ ID NO: 551316 - DNA, 13 bp, D. melanogaster
aaatattggcaaa

SEQ ID NO: 551317 - DNA, 13 bp, D. melanogaster
aaatattggcaat

SEQ ID NO: 551318 - DNA, 14 bp, D. melanogaster
aaatattggcattt

SEQ ID NO: 551319 - DNA, 13 bp, D. melanogaster
aaatattggccaa

SEQ ID NO: 551320 - DNA, 13 bp, D. melanogaster
aaatattggggaa

SEQ ID NO: 551321 - DNA, 13 bp, D. melanogaster
aaatattggtaaa

SEQ ID NO: 551322 - DNA, 13 bp, D. melanogaster
aaatattggtatt

SEQ ID NO: 551323 - DNA, 14 bp, D. melanogaster
aaatattgtaaaac

SEQ ID NO: 551324 - DNA, 13 bp, D. melanogaster
aaatattgtaaca

SEQ ID NO: 551325 - DNA, 14 bp, D. melanogaster
aaatattgtaacat

SEQ ID NO: 551326 - DNA, 13 bp, D. melanogaster
aaatattgtagat

SEQ ID NO: 551327 - DNA, 13 bp, D. melanogaster
aaatattgtagta

SEQ ID NO: 551328 - DNA, 13 bp, D. melanogaster
aaatattgtagtt

SEQ ID NO: 551329 - DNA, 14 bp, D. melanogaster
aaatattgtatttc

SEQ ID NO: 551330 - DNA, 13 bp, D. melanogaster
aaatattgtccat

SEQ ID NO: 551331 - DNA, 13 bp, D. melanogaster
aaatattgtgaaa

SEQ ID NO: 551332 - DNA, 13 bp, D. melanogaster
aaatattgtgata

SEQ ID NO: 551333 - DNA, 14 bp, D. melanogaster
aaatattgtgcaaa

SEQ ID NO: 551334 - DNA, 13 bp, D. melanogaster
aaatattgttaag

SEQ ID NO: 551335 - DNA, 13 bp, D. melanogaster
aaatattgttcaa

SEQ ID NO: 551336 - DNA, 13 bp, D. melanogaster
aaatattgttcat

SEQ ID NO: 551337 - DNA, 13 bp, D. melanogaster
aaatattgttgaa

SEQ ID NO: 551338 - DNA, 13 bp, D. melanogaster
aaatattgttgat

SEQ ID NO: 551339 - DNA, 13 bp, D. melanogaster
aaatattgttgca

SEQ ID NO: 551340 - DNA, 13 bp, D. melanogaster
aaatattgttgtt

SEQ ID NO: 551341 - DNA, 13 bp, D. melanogaster
aaatattgtttgc

SEQ ID NO: 551342 - DNA, 14 bp, D. melanogaster
aaatatttaaaagc

SEQ ID NO: 551343 - DNA, 13 bp, D. melanogaster
aaatatttaaagc

SEQ ID NO: 551344 - DNA, 13 bp, D. melanogaster
aaatatttaaagg

SEQ ID NO: 551345 - DNA, 14 bp, D. melanogaster
aaatatttaaatgc

SEQ ID NO: 551346 - DNA, 13 bp, D. melanogaster
aaatatttaacga

SEQ ID NO: 551347 - DNA, 13 bp, D. melanogaster
aaatatttaagca

SEQ ID NO: 551348 - DNA, 14 bp, D. melanogaster
aaatatttaagcaa

SEQ ID NO: 551349 - DNA, 14 bp, D. melanogaster
aaatatttaagcag

SEQ ID NO: 551350 - DNA, 13 bp, D. melanogaster
aaatatttaatgc

SEQ ID NO: 551351 - DNA, 13 bp, D. melanogaster
aaatatttacaag

SEQ ID NO: 551352 - DNA, 13 bp, D. melanogaster
aaatatttacaca

SEQ ID NO: 551353 - DNA, 14 bp, D. melanogaster
aaatatttacacac

SEQ ID NO: 551354 - DNA, 14 bp, D. melanogaster
aaatatttacacag

SEQ ID NO: 551355 - DNA, 14 bp, D. melanogaster
aaatatttacacat

SEQ ID NO: 551356 - DNA, 13 bp, D. melanogaster
aaatatttacact

SEQ ID NO: 551357 - DNA, 14 bp, D. melanogaster
aaatatttacatac

SEQ ID NO: 551358 - DNA, 13 bp, D. melanogaster
aaatatttaccaa

SEQ ID NO: 551359 - DNA, 13 bp, D. melanogaster
aaatatttaccac

SEQ ID NO: 551360 - DNA, 13 bp, D. melanogaster
aaatatttaccca

SEQ ID NO: 551361 - DNA, 13 bp, D. melanogaster
aaatatttacgaa

SEQ ID NO: 551362 - DNA, 13 bp, D. melanogaster
aaatatttactca

SEQ ID NO: 551363 - DNA, 13 bp, D. melanogaster
aaatatttagcaa

SEQ ID NO: 551364 - DNA, 14 bp, D. melanogaster
aaatatttagcaaa

SEQ ID NO: 551365 - DNA, 13 bp, D. melanogaster
aaatatttaggtt

SEQ ID NO: 551366 - DNA, 14 bp, D. melanogaster
aaatatttatacac

SEQ ID NO: 551367 - DNA, 14 bp, D. melanogaster
aaatatttatatgc

SEQ ID NO: 551368 - DNA, 13 bp, D. melanogaster
aaatatttatgca

SEQ ID NO: 551369 - DNA, 14 bp, D. melanogaster
aaatatttatggaa

SEQ ID NO: 551370 - DNA, 13 bp, D. melanogaster
aaatatttatgtg

SEQ ID NO: 551371 - DNA, 13 bp, D. melanogaster
aaatatttcaaca

SEQ ID NO: 551372 - DNA, 13 bp, D. melanogaster
aaatatttcaatg

SEQ ID NO: 551373 - DNA, 13 bp, D. melanogaster
aaatatttcacaa

SEQ ID NO: 551374 - DNA, 13 bp, D. melanogaster
aaatatttcactt

SEQ ID NO: 551375 - DNA, 13 bp, D. melanogaster
aaatatttcagat

SEQ ID NO: 551376 - DNA, 13 bp, D. melanogaster
aaatatttcagca

SEQ ID NO: 551377 - DNA, 13 bp, D. melanogaster
aaatatttcattc

SEQ ID NO: 551378 - DNA, 13 bp, D. melanogaster
aaatatttcattg

SEQ ID NO: 551379 - DNA, 14 bp, D. melanogaster
aaatatttccaatt

SEQ ID NO: 551380 - DNA, 13 bp, D. melanogaster
aaatatttccatt

SEQ ID NO: 551381 - DNA, 14 bp, D. melanogaster
aaatatttcccaaa

SEQ ID NO: 551382 - DNA, 13 bp, D. melanogaster
aaatatttcccta

SEQ ID NO: 551383 - DNA, 13 bp, D. melanogaster
aaatatttcctta

SEQ ID NO: 551384 - DNA, 13 bp, D. melanogaster
aaatatttcgaaa

SEQ ID NO: 551385 - DNA, 14 bp, D. melanogaster
aaatatttcgaaaa

SEQ ID NO: 551386 - DNA, 14 bp, D. melanogaster
aaatatttcgaaat

SEQ ID NO: 551387 - DNA, 14 bp, D. melanogaster
aaatatttcgctgt

SEQ ID NO: 551388 - DNA, 13 bp, D. melanogaster
aaatatttcgctt

SEQ ID NO: 551389 - DNA, 13 bp, D. melanogaster
aaatatttcggtt

SEQ ID NO: 551390 - DNA, 13 bp, D. melanogaster
aaatatttctact

SEQ ID NO: 551391 - DNA, 13 bp, D. melanogaster
aaatatttctctc

SEQ ID NO: 551392 - DNA, 13 bp, D. melanogaster
aaatatttctgaa

SEQ ID NO: 551393 - DNA, 13 bp, D. melanogaster
aaatatttctgat

SEQ ID NO: 551394 - DNA, 13 bp, D. melanogaster
aaatatttctgtg

SEQ ID NO: 551395 - DNA, 13 bp, D. melanogaster
aaatatttcttca

SEQ ID NO: 551396 - DNA, 13 bp, D. melanogaster
aaatatttgaaac

SEQ ID NO: 551397 - DNA, 14 bp, D. melanogaster
aaatatttgaacaa

SEQ ID NO: 551398 - DNA, 13 bp, D. melanogaster
aaatatttgacaa

SEQ ID NO: 551399 - DNA, 13 bp, D. melanogaster
aaatatttgactt

SEQ ID NO: 551400 - DNA, 13 bp, D. melanogaster
aaatatttgattg

SEQ ID NO: 551401 - DNA, 13 bp, D. melanogaster
aaatatttgcaaa

SEQ ID NO: 551402 - DNA, 14 bp, D. melanogaster
aaatatttgcaaaa

SEQ ID NO: 551403 - DNA, 13 bp, D. melanogaster
aaatatttgcaag

SEQ ID NO: 551404 - DNA, 13 bp, D. melanogaster
aaatatttgcaat

SEQ ID NO: 551405 - DNA, 14 bp, D. melanogaster
aaatatttgcaatg

SEQ ID NO: 551406 - DNA, 14 bp, D. melanogaster
aaatatttgcaatt

SEQ ID NO: 551407 - DNA, 13 bp, D. melanogaster
aaatatttgcaca

SEQ ID NO: 551408 - DNA, 13 bp, D. melanogaster
aaatatttgcatt

SEQ ID NO: 551409 - DNA, 14 bp, D. melanogaster
aaatatttgcattt

SEQ ID NO: 551410 - DNA, 13 bp, D. melanogaster
aaatatttgccaa

SEQ ID NO: 551411 - DNA, 14 bp, D. melanogaster
aaatatttgccaat

SEQ ID NO: 551412 - DNA, 13 bp, D. melanogaster
aaatatttgccgc

SEQ ID NO: 551413 - DNA, 13 bp, D. melanogaster
aaatatttgcctg

SEQ ID NO: 551414 - DNA, 13 bp, D. melanogaster
aaatatttgcctt

SEQ ID NO: 551415 - DNA, 13 bp, D. melanogaster
aaatatttgcgcc

SEQ ID NO: 551416 - DNA, 13 bp, D. melanogaster
aaatatttgctca

SEQ ID NO: 551417 - DNA, 13 bp, D. melanogaster
aaatatttgcttt

SEQ ID NO: 551418 - DNA, 13 bp, D. melanogaster
aaatatttggaca

SEQ ID NO: 551419 - DNA, 14 bp, D. melanogaster
aaatatttggattt

SEQ ID NO: 551420 - DNA, 13 bp, D. melanogaster
aaatatttggcat

SEQ ID NO: 551421 - DNA, 13 bp, D. melanogaster
aaatatttggcca

SEQ ID NO: 551422 - DNA, 13 bp, D. melanogaster
aaatatttggtaa

SEQ ID NO: 551423 - DNA, 14 bp, D. melanogaster
aaatatttggtaaa

SEQ ID NO: 551424 - DNA, 14 bp, D. melanogaster
aaatatttggtatt

SEQ ID NO: 551425 - DNA, 14 bp, D. melanogaster
aaatatttgtaaac

SEQ ID NO: 551426 - DNA, 13 bp, D. melanogaster
aaatatttgtagt

SEQ ID NO: 551427 - DNA, 13 bp, D. melanogaster
aaatatttgtcaa

SEQ ID NO: 551428 - DNA, 14 bp, D. melanogaster
aaatatttgtcaaa

SEQ ID NO: 551429 - DNA, 13 bp, D. melanogaster
aaatatttgtctg

SEQ ID NO: 551430 - DNA, 13 bp, D. melanogaster
aaatatttgtctt

SEQ ID NO: 551431 - DNA, 13 bp, D. melanogaster
aaatatttgtgat

SEQ ID NO: 551432 - DNA, 13 bp, D. melanogaster
aaatatttgtgct

SEQ ID NO: 551433 - DNA, 14 bp, D. melanogaster
aaatatttgtggtt

SEQ ID NO: 551434 - DNA, 14 bp, D. melanogaster
aaatatttgtgtaa

SEQ ID NO: 551435 - DNA, 14 bp, D. melanogaster
aaatatttgtgtgt

SEQ ID NO: 551436 - DNA, 13 bp, D. melanogaster
aaatatttgtgtt

SEQ ID NO: 551437 - DNA, 14 bp, D. melanogaster
aaatatttgtgtta

SEQ ID NO: 551438 - DNA, 13 bp, D. melanogaster
aaatatttgttga

SEQ ID NO: 551439 - DNA, 13 bp, D. melanogaster
aaatatttgttgt

SEQ ID NO: 551440 - DNA, 14 bp, D. melanogaster
aaatatttgttgta

SEQ ID NO: 551441 - DNA, 13 bp, D. melanogaster
aaatattttacga

SEQ ID NO: 551442 - DNA, 13 bp, D. melanogaster
aaatattttaggg

SEQ ID NO: 551443 - DNA, 13 bp, D. melanogaster
aaatattttagtg

SEQ ID NO: 551444 - DNA, 14 bp, D. melanogaster
aaatattttatgca

SEQ ID NO: 551445 - DNA, 13 bp, D. melanogaster
aaatattttatgg

SEQ ID NO: 551446 - DNA, 13 bp, D. melanogaster
aaatattttcaag

SEQ ID NO: 551447 - DNA, 14 bp, D. melanogaster
aaatattttcaatg

SEQ ID NO: 551448 - DNA, 13 bp, D. melanogaster
aaatattttccaa

SEQ ID NO: 551449 - DNA, 14 bp, D. melanogaster
aaatattttccaaa

SEQ ID NO: 551450 - DNA, 13 bp, D. melanogaster
aaatattttccac

SEQ ID NO: 551451 - DNA, 14 bp, D. melanogaster
aaatattttccact

SEQ ID NO: 551452 - DNA, 14 bp, D. melanogaster
aaatattttccatg

SEQ ID NO: 551453 - DNA, 14 bp, D. melanogaster
aaatattttccatt

SEQ ID NO: 551454 - DNA, 13 bp, D. melanogaster
aaatattttccca

SEQ ID NO: 551455 - DNA, 13 bp, D. melanogaster
aaatattttccct

SEQ ID NO: 551456 - DNA, 14 bp, D. melanogaster
aaatattttccctt

SEQ ID NO: 551457 - DNA, 13 bp, D. melanogaster
aaatattttccgc

SEQ ID NO: 551458 - DNA, 14 bp, D. melanogaster
aaatattttcgaaa

SEQ ID NO: 551459 - DNA, 13 bp, D. melanogaster
aaatattttcgca

SEQ ID NO: 551460 - DNA, 13 bp, D. melanogaster
aaatattttcggc

SEQ ID NO: 551461 - DNA, 13 bp, D. melanogaster
aaatattttcgtt

SEQ ID NO: 551462 - DNA, 14 bp, D. melanogaster
aaatattttcgttt

SEQ ID NO: 551463 - DNA, 13 bp, D. melanogaster
aaatattttctca

SEQ ID NO: 551464 - DNA, 13 bp, D. melanogaster
aaatattttgcaa

SEQ ID NO: 551465 - DNA, 14 bp, D. melanogaster
aaatattttgcaaa

SEQ ID NO: 551466 - DNA, 13 bp, D. melanogaster
aaatattttgcat

SEQ ID NO: 551467 - DNA, 14 bp, D. melanogaster
aaatattttgcata

SEQ ID NO: 551468 - DNA, 13 bp, D. melanogaster
aaatattttgcca

SEQ ID NO: 551469 - DNA, 13 bp, D. melanogaster
aaatattttgcga

SEQ ID NO: 551470 - DNA, 13 bp, D. melanogaster
aaatattttgcta

SEQ ID NO: 551471 - DNA, 13 bp, D. melanogaster
aaatattttggaa

SEQ ID NO: 551472 - DNA, 13 bp, D. melanogaster
aaatattttggat

SEQ ID NO: 551473 - DNA, 13 bp, D. melanogaster
aaatattttggtc

SEQ ID NO: 551474 - DNA, 13 bp, D. melanogaster
aaatattttggtt

SEQ ID NO: 551475 - DNA, 13 bp, D. melanogaster
aaatattttgtac

SEQ ID NO: 551476 - DNA, 14 bp, D. melanogaster
aaatattttgtaca

SEQ ID NO: 551477 - DNA, 13 bp, D. melanogaster
aaatattttgtca

SEQ ID NO: 551478 - DNA, 13 bp, D. melanogaster
aaatatttttagc

SEQ ID NO: 551479 - DNA, 14 bp, D. melanogaster
aaatatttttctgt

SEQ ID NO: 551480 - DNA, 14 bp, D. melanogaster
aaatatttttgcca

SEQ ID NO: 551481 - DNA, 13 bp, D. melanogaster
aaatatttttgct

SEQ ID NO: 551482 - DNA, 14 bp, D. melanogaster
aaatatttttgcta

SEQ ID NO: 551483 - DNA, 13 bp, D. melanogaster
aaatatttttggc

SEQ ID NO: 551484 - DNA, 13 bp, D. melanogaster
aaatatttttgtg

SEQ ID NO: 551485 - DNA, 13 bp, D. melanogaster
aaatattttttgc

SEQ ID NO: 551486 - DNA, 13 bp, D. melanogaster
aaatcaaaaatcg

SEQ ID NO: 551487 - DNA, 13 bp, D. melanogaster
aaatcaaaaatgc

SEQ ID NO: 551488 - DNA, 13 bp, D. melanogaster
aaatcaaaaatgt

SEQ ID NO: 551489 - DNA, 14 bp, D. melanogaster
aaatcaaaaccgaa

SEQ ID NO: 551490 - DNA, 13 bp, D. melanogaster
aaatcaaaacttt

SEQ ID NO: 551491 - DNA, 13 bp, D. melanogaster
aaatcaaaagatt

SEQ ID NO: 551492 - DNA, 14 bp, D. melanogaster
aaatcaaaagattt

SEQ ID NO: 551493 - DNA, 13 bp, D. melanogaster
aaatcaaaagcag

SEQ ID NO: 551494 - DNA, 13 bp, D. melanogaster
aaatcaaaagcca

SEQ ID NO: 551495 - DNA, 13 bp, D. melanogaster
aaatcaaaagcta

SEQ ID NO: 551496 - DNA, 13 bp, D. melanogaster
aaatcaaaagctt

SEQ ID NO: 551497 - DNA, 13 bp, D. melanogaster
aaatcaaaagtat

SEQ ID NO: 551498 - DNA, 13 bp, D. melanogaster
aaatcaaaagttg

SEQ ID NO: 551499 - DNA, 14 bp, D. melanogaster
aaatcaaaatcaga

SEQ ID NO: 551500 - DNA, 13 bp, D. melanogaster
aaatcaaaatcct

SEQ ID NO: 551501 - DNA, 13 bp, D. melanogaster
aaatcaaaatcgt

SEQ ID NO: 551502 - DNA, 13 bp, D. melanogaster
aaatcaaaatgag

SEQ ID NO: 551503 - DNA, 13 bp, D. melanogaster
aaatcaaaatgca

SEQ ID NO: 551504 - DNA, 14 bp, D. melanogaster
aaatcaaaatggaa

SEQ ID NO: 551505 - DNA, 13 bp, D. melanogaster
aaatcaaaatggc

SEQ ID NO: 551506 - DNA, 13 bp, D. melanogaster
aaatcaaaatgtt

SEQ ID NO: 551507 - DNA, 13 bp, D. melanogaster
aaatcaaaattct

SEQ ID NO: 551508 - DNA, 14 bp, D. melanogaster
aaatcaaaattgaa

SEQ ID NO: 551509 - DNA, 13 bp, D. melanogaster
aaatcaaaatttg

SEQ ID NO: 551510 - DNA, 14 bp, D. melanogaster
aaatcaaaatttgt

SEQ ID NO: 551511 - DNA, 14 bp, D. melanogaster
aaatcaaaattttg

SEQ ID NO: 551512 - DNA, 14 bp, D. melanogaster
aaatcaaacaattc

SEQ ID NO: 551513 - DNA, 17 bp, D. melanogaster
aaatcaaacaattcaat

SEQ ID NO: 551514 - DNA, 13 bp, D. melanogaster
aaatcaaacactg

SEQ ID NO: 551515 - DNA, 13 bp, D. melanogaster
aaatcaaacactt

SEQ ID NO: 551516 - DNA, 13 bp, D. melanogaster
aaatcaaacagat

SEQ ID NO: 551517 - DNA, 13 bp, D. melanogaster
aaatcaaacattt

SEQ ID NO: 551518 - DNA, 14 bp, D. melanogaster
aaatcaaacatttt

SEQ ID NO: 551519 - DNA, 13 bp, D. melanogaster
aaatcaaaccgaa

SEQ ID NO: 551520 - DNA, 13 bp, D. melanogaster
aaatcaaacgcaa

SEQ ID NO: 551521 - DNA, 13 bp, D. melanogaster
aaatcaaactgac

SEQ ID NO: 551522 - DNA, 13 bp, D. melanogaster
aaatcaaactgca

SEQ ID NO: 551523 - DNA, 13 bp, D. melanogaster
aaatcaaagagat

SEQ ID NO: 551524 - DNA, 13 bp, D. melanogaster
aaatcaaagagca

SEQ ID NO: 551525 - DNA, 13 bp, D. melanogaster
aaatcaaagagtc

SEQ ID NO: 551526 - DNA, 13 bp, D. melanogaster
aaatcaaagcaat

SEQ ID NO: 551527 - DNA, 13 bp, D. melanogaster
aaatcaaagcatt

SEQ ID NO: 551528 - DNA, 14 bp, D. melanogaster
aaatcaaagccaaa

SEQ ID NO: 551529 - DNA, 13 bp, D. melanogaster
aaatcaaagccag

SEQ ID NO: 551530 - DNA, 13 bp, D. melanogaster
aaatcaaagcgaa

SEQ ID NO: 551531 - DNA, 14 bp, D. melanogaster
aaatcaaagcgaaa

SEQ ID NO: 551532 - DNA, 13 bp, D. melanogaster
aaatcaaaggaat

SEQ ID NO: 551533 - DNA, 13 bp, D. melanogaster
aaatcaaaggcaa

SEQ ID NO: 551534 - DNA, 13 bp, D. melanogaster
aaatcaaagtaat

SEQ ID NO: 551535 - DNA, 13 bp, D. melanogaster
aaatcaaagtcaa

SEQ ID NO: 551536 - DNA, 14 bp, D. melanogaster
aaatcaaagtcaaa

SEQ ID NO: 551537 - DNA, 14 bp, D. melanogaster
aaatcaaagttaaa

SEQ ID NO: 551538 - DNA, 13 bp, D. melanogaster
aaatcaaagttat

SEQ ID NO: 551539 - DNA, 13 bp, D. melanogaster
aaatcaaagttta

SEQ ID NO: 551540 - DNA, 14 bp, D. melanogaster
aaatcaaataaagc

SEQ ID NO: 551541 - DNA, 13 bp, D. melanogaster
aaatcaaatagca

SEQ ID NO: 551542 - DNA, 14 bp, D. melanogaster
aaatcaaatcaaag

SEQ ID NO: 551543 - DNA, 13 bp, D. melanogaster
aaatcaaatcaag

SEQ ID NO: 551544 - DNA, 14 bp, D. melanogaster
aaatcaaatcaagt

SEQ ID NO: 551545 - DNA, 13 bp, D. melanogaster
aaatcaaatcaga

SEQ ID NO: 551546 - DNA, 14 bp, D. melanogaster
aaatcaaatcagaa

SEQ ID NO: 551547 - DNA, 13 bp, D. melanogaster
aaatcaaatcatg

SEQ ID NO: 551548 - DNA, 14 bp, D. melanogaster
aaatcaaatcattt

SEQ ID NO: 551549 - DNA, 13 bp, D. melanogaster
aaatcaaatcgaa

SEQ ID NO: 551550 - DNA, 14 bp, D. melanogaster
aaatcaaatcgaaa

SEQ ID NO: 551551 - DNA, 14 bp, D. melanogaster
aaatcaaatcgaat

SEQ ID NO: 551552 - DNA, 13 bp, D. melanogaster
aaatcaaatcgat

SEQ ID NO: 551553 - DNA, 13 bp, D. melanogaster
aaatcaaatgaga

SEQ ID NO: 551554 - DNA, 13 bp, D. melanogaster
aaatcaaatgatg

SEQ ID NO: 551555 - DNA, 14 bp, D. melanogaster
aaatcaaatgattt

SEQ ID NO: 551556 - DNA, 13 bp, D. melanogaster
aaatcaaatgcta

SEQ ID NO: 551557 - DNA, 13 bp, D. melanogaster
aaatcaaatggaa

SEQ ID NO: 551558 - DNA, 14 bp, D. melanogaster
aaatcaaatggaaa

SEQ ID NO: 551559 - DNA, 14 bp, D. melanogaster
aaatcaaatggaat

SEQ ID NO: 551560 - DNA, 13 bp, D. melanogaster
aaatcaaatggca

SEQ ID NO: 551561 - DNA, 13 bp, D. melanogaster
aaatcaaatgtaa

SEQ ID NO: 551562 - DNA, 14 bp, D. melanogaster
aaatcaaatgtttt

SEQ ID NO: 551563 - DNA, 13 bp, D. melanogaster
aaatcaaattaag

SEQ ID NO: 551564 - DNA, 13 bp, D. melanogaster
aaatcaaattagt

SEQ ID NO: 551565 - DNA, 14 bp, D. melanogaster
aaatcaaattagta

SEQ ID NO: 551566 - DNA, 14 bp, D. melanogaster
aaatcaaattgaaa

SEQ ID NO: 551567 - DNA, 14 bp, D. melanogaster
aaatcaaattgaat

SEQ ID NO: 551568 - DNA, 13 bp, D. melanogaster
aaatcaaattgat

SEQ ID NO: 551569 - DNA, 14 bp, D. melanogaster
aaatcaaattgatt

SEQ ID NO: 551570 - DNA, 14 bp, D. melanogaster
aaatcaaattgcaa

SEQ ID NO: 551571 - DNA, 13 bp, D. melanogaster
aaatcaaattgtg

SEQ ID NO: 551572 - DNA, 13 bp, D. melanogaster
aaatcaaatttac

SEQ ID NO: 551573 - DNA, 13 bp, D. melanogaster
aaatcaaatttga

SEQ ID NO: 551574 - DNA, 14 bp, D. melanogaster
aaatcaaatttgaa

SEQ ID NO: 551575 - DNA, 14 bp, D. melanogaster
aaatcaaatttgtt

SEQ ID NO: 551576 - DNA, 13 bp, D. melanogaster
aaatcaacaaatg

SEQ ID NO: 551577 - DNA, 14 bp, D. melanogaster
aaatcaacaaatgc

SEQ ID NO: 551578 - DNA, 13 bp, D. melanogaster
aaatcaacaacag

SEQ ID NO: 551579 - DNA, 13 bp, D. melanogaster
aaatcaacacatt

SEQ ID NO: 551580 - DNA, 13 bp, D. melanogaster
aaatcaacagcaa

SEQ ID NO: 551581 - DNA, 13 bp, D. melanogaster
aaatcaacagcca

SEQ ID NO: 551582 - DNA, 13 bp, D. melanogaster
aaatcaacatttt

SEQ ID NO: 551583 - DNA, 14 bp, D. melanogaster
aaatcaacattttt

SEQ ID NO: 551584 - DNA, 13 bp, D. melanogaster
aaatcaaccattt

SEQ ID NO: 551585 - DNA, 13 bp, D. melanogaster
aaatcaaccgaaa

SEQ ID NO: 551586 - DNA, 13 bp, D. melanogaster
aaatcaacgcaaa

SEQ ID NO: 551587 - DNA, 13 bp, D. melanogaster
aaatcaactcaat

SEQ ID NO: 551588 - DNA, 13 bp, D. melanogaster
aaatcaactgaaa

SEQ ID NO: 551589 - DNA, 13 bp, D. melanogaster
aaatcaacttaat

SEQ ID NO: 551590 - DNA, 13 bp, D. melanogaster
aaatcaacttcaa

SEQ ID NO: 551591 - DNA, 13 bp, D. melanogaster
aaatcaactttaa

SEQ ID NO: 551592 - DNA, 13 bp, D. melanogaster
aaatcaactttca

SEQ ID NO: 551593 - DNA, 13 bp, D. melanogaster
aaatcaactttgg

SEQ ID NO: 551594 - DNA, 14 bp, D. melanogaster
aaatcaagaaagag

SEQ ID NO: 551595 - DNA, 13 bp, D. melanogaster
aaatcaagagtga

SEQ ID NO: 551596 - DNA, 13 bp, D. melanogaster
aaatcaagccaaa

SEQ ID NO: 551597 - DNA, 13 bp, D. melanogaster
aaatcaagccaag

SEQ ID NO: 551598 - DNA, 13 bp, D. melanogaster
aaatcaagcgaaa

SEQ ID NO: 551599 - DNA, 13 bp, D. melanogaster
aaatcaaggcaaa

SEQ ID NO: 551600 - DNA, 14 bp, D. melanogaster
aaatcaagtaataa

SEQ ID NO: 551601 - DNA, 13 bp, D. melanogaster
aaatcaagtatac

SEQ ID NO: 551602 - DNA, 14 bp, D. melanogaster
aaatcaagtatacg

SEQ ID NO: 551603 - DNA, 13 bp, D. melanogaster
aaatcaagtgaaa

SEQ ID NO: 551604 - DNA, 13 bp, D. melanogaster
aaatcaagtggaa

SEQ ID NO: 551605 - DNA, 13 bp, D. melanogaster
aaatcaagttaaa

SEQ ID NO: 551606 - DNA, 13 bp, D. melanogaster
aaatcaagttaat

SEQ ID NO: 551607 - DNA, 13 bp, D. melanogaster
aaatcaagttgaa

SEQ ID NO: 551608 - DNA, 13 bp, D. melanogaster
aaatcaagtttat

SEQ ID NO: 551609 - DNA, 13 bp, D. melanogaster
aaatcaagttttt

SEQ ID NO: 551610 - DNA, 14 bp, D. melanogaster
aaatcaataaaagt

SEQ ID NO: 551611 - DNA, 14 bp, D. melanogaster
aaatcaataaactg

SEQ ID NO: 551612 - DNA, 13 bp, D. melanogaster
aaatcaataaatg

SEQ ID NO: 551613 - DNA, 13 bp, D. melanogaster
aaatcaataagca

SEQ ID NO: 551614 - DNA, 13 bp, D. melanogaster
aaatcaataagct

SEQ ID NO: 551615 - DNA, 13 bp, D. melanogaster
aaatcaataatcg

SEQ ID NO: 551616 - DNA, 14 bp, D. melanogaster
aaatcaatagaaat

SEQ ID NO: 551617 - DNA, 13 bp, D. melanogaster
aaatcaatagata

SEQ ID NO: 551618 - DNA, 13 bp, D. melanogaster
aaatcaatatact

SEQ ID NO: 551619 - DNA, 13 bp, D. melanogaster
aaatcaatattgt

SEQ ID NO: 551620 - DNA, 13 bp, D. melanogaster
aaatcaatatttg

SEQ ID NO: 551621 - DNA, 15 bp, D. melanogaster
aaatcaatcaatcaa

SEQ ID NO: 551622 - DNA, 13 bp, D. melanogaster
aaatcaatcaatg

SEQ ID NO: 551623 - DNA, 14 bp, D. melanogaster
aaatcaatcaattt

SEQ ID NO: 551624 - DNA, 13 bp, D. melanogaster
aaatcaatcagat

SEQ ID NO: 551625 - DNA, 13 bp, D. melanogaster
aaatcaatcagtt

SEQ ID NO: 551626 - DNA, 13 bp, D. melanogaster
aaatcaatcgaaa

SEQ ID NO: 551627 - DNA, 13 bp, D. melanogaster
aaatcaatcgaac

SEQ ID NO: 551628 - DNA, 13 bp, D. melanogaster
aaatcaatcgaat

SEQ ID NO: 551629 - DNA, 14 bp, D. melanogaster
aaatcaatcgattt

SEQ ID NO: 551630 - DNA, 13 bp, D. melanogaster
aaatcaatctgaa

SEQ ID NO: 551631 - DNA, 13 bp, D. melanogaster
aaatcaatcttaa

SEQ ID NO: 551632 - DNA, 13 bp, D. melanogaster
aaatcaatgaaat

SEQ ID NO: 551633 - DNA, 13 bp, D. melanogaster
aaatcaatgaact

SEQ ID NO: 551634 - DNA, 13 bp, D. melanogaster
aaatcaatgaatt

SEQ ID NO: 551635 - DNA, 13 bp, D. melanogaster
aaatcaatgacaa

SEQ ID NO: 551636 - DNA, 13 bp, D. melanogaster
aaatcaatgataa

SEQ ID NO: 551637 - DNA, 13 bp, D. melanogaster
aaatcaatgattt

SEQ ID NO: 551638 - DNA, 13 bp, D. melanogaster
aaatcaatgccaa

SEQ ID NO: 551639 - DNA, 13 bp, D. melanogaster
aaatcaatgccat

SEQ ID NO: 551640 - DNA, 13 bp, D. melanogaster
aaatcaatgcgaa

SEQ ID NO: 551641 - DNA, 13 bp, D. melanogaster
aaatcaatgcgac

SEQ ID NO: 551642 - DNA, 13 bp, D. melanogaster
aaatcaatggaaa

SEQ ID NO: 551643 - DNA, 14 bp, D. melanogaster
aaatcaatggaaat

SEQ ID NO: 551644 - DNA, 13 bp, D. melanogaster
aaatcaatggcaa

SEQ ID NO: 551645 - DNA, 13 bp, D. melanogaster
aaatcaatgtaaa

SEQ ID NO: 551646 - DNA, 13 bp, D. melanogaster
aaatcaatgtcaa

SEQ ID NO: 551647 - DNA, 13 bp, D. melanogaster
aaatcaatgttta

SEQ ID NO: 551648 - DNA, 13 bp, D. melanogaster
aaatcaatgtttt

SEQ ID NO: 551649 - DNA, 14 bp, D. melanogaster
aaatcaattaaatg

SEQ ID NO: 551650 - DNA, 13 bp, D. melanogaster
aaatcaattaact

SEQ ID NO: 551651 - DNA, 13 bp, D. melanogaster
aaatcaattacat

SEQ ID NO: 551652 - DNA, 13 bp, D. melanogaster
aaatcaattagat

SEQ ID NO: 551653 - DNA, 13 bp, D. melanogaster
aaatcaattatgt

SEQ ID NO: 551654 - DNA, 13 bp, D. melanogaster
aaatcaattattc

SEQ ID NO: 551655 - DNA, 13 bp, D. melanogaster
aaatcaattcaag

SEQ ID NO: 551656 - DNA, 13 bp, D. melanogaster
aaatcaattctct

SEQ ID NO: 551657 - DNA, 13 bp, D. melanogaster
aaatcaattctga

SEQ ID NO: 551658 - DNA, 13 bp, D. melanogaster
aaatcaattgatt

SEQ ID NO: 551659 - DNA, 14 bp, D. melanogaster
aaatcaattgattg

SEQ ID NO: 551660 - DNA, 14 bp, D. melanogaster
aaatcaattgattt

SEQ ID NO: 551661 - DNA, 13 bp, D. melanogaster
aaatcaattgcaa

SEQ ID NO: 551662 - DNA, 14 bp, D. melanogaster
aaatcaattgcaat

SEQ ID NO: 551663 - DNA, 13 bp, D. melanogaster
aaatcaattggaa

SEQ ID NO: 551664 - DNA, 14 bp, D. melanogaster
aaatcaattggaaa

SEQ ID NO: 551665 - DNA, 13 bp, D. melanogaster
aaatcaattggca

SEQ ID NO: 551666 - DNA, 13 bp, D. melanogaster
aaatcaattgtgt

SEQ ID NO: 551667 - DNA, 13 bp, D. melanogaster
aaatcaattgtta

SEQ ID NO: 551668 - DNA, 13 bp, D. melanogaster
aaatcaatttaac

SEQ ID NO: 551669 - DNA, 13 bp, D. melanogaster
aaatcaatttaca

SEQ ID NO: 551670 - DNA, 13 bp, D. melanogaster
aaatcaatttacg

SEQ ID NO: 551671 - DNA, 13 bp, D. melanogaster
aaatcaatttcaa

SEQ ID NO: 551672 - DNA, 13 bp, D. melanogaster
aaatcaatttcat

SEQ ID NO: 551673 - DNA, 14 bp, D. melanogaster
aaatcaatttcata

SEQ ID NO: 551674 - DNA, 13 bp, D. melanogaster
aaatcaatttgaa

SEQ ID NO: 551675 - DNA, 14 bp, D. melanogaster
aaatcaatttgaat

SEQ ID NO: 551676 - DNA, 13 bp, D. melanogaster
aaatcaatttgca

SEQ ID NO: 551677 - DNA, 14 bp, D. melanogaster
aaatcaatttgcca

SEQ ID NO: 551678 - DNA, 13 bp, D. melanogaster
aaatcaatttgcg

SEQ ID NO: 551679 - DNA, 13 bp, D. melanogaster
aaatcaatttgct

SEQ ID NO: 551680 - DNA, 14 bp, D. melanogaster
aaatcaattttcat

SEQ ID NO: 551681 - DNA, 13 bp, D. melanogaster
aaatcaattttga

SEQ ID NO: 551682 - DNA, 14 bp, D. melanogaster
aaatcaattttgat

SEQ ID NO: 551683 - DNA, 13 bp, D. melanogaster
aaatcacaaatgt

SEQ ID NO: 551684 - DNA, 13 bp, D. melanogaster
aaatcacaattta

SEQ ID NO: 551685 - DNA, 13 bp, D. melanogaster
aaatcacacattt

SEQ ID NO: 551686 - DNA, 13 bp, D. melanogaster
aaatcacagaaat

SEQ ID NO: 551687 - DNA, 13 bp, D. melanogaster
aaatcacagaagg

SEQ ID NO: 551688 - DNA, 13 bp, D. melanogaster
aaatcacagcaaa

SEQ ID NO: 551689 - DNA, 13 bp, D. melanogaster
aaatcacagttga

SEQ ID NO: 551690 - DNA, 14 bp, D. melanogaster
aaatcacagttgat

SEQ ID NO: 551691 - DNA, 13 bp, D. melanogaster
aaatcacataatt

SEQ ID NO: 551692 - DNA, 13 bp, D. melanogaster
aaatcacattatt

SEQ ID NO: 551693 - DNA, 13 bp, D. melanogaster
aaatcacatttct

SEQ ID NO: 551694 - DNA, 13 bp, D. melanogaster
aaatcacatttta

SEQ ID NO: 551695 - DNA, 13 bp, D. melanogaster
aaatcaccgaaaa

SEQ ID NO: 551696 - DNA, 13 bp, D. melanogaster
aaatcacgatcaa

SEQ ID NO: 551697 - DNA, 13 bp, D. melanogaster
aaatcacgcatac

SEQ ID NO: 551698 - DNA, 13 bp, D. melanogaster
aaatcacgccact

SEQ ID NO: 551699 - DNA, 13 bp, D. melanogaster
aaatcacttaaag

SEQ ID NO: 551700 - DNA, 13 bp, D. melanogaster
aaatcacttaatt

SEQ ID NO: 551701 - DNA, 13 bp, D. melanogaster
aaatcacttattt

SEQ ID NO: 551702 - DNA, 13 bp, D. melanogaster
aaatcacttcaaa

SEQ ID NO: 551703 - DNA, 13 bp, D. melanogaster
aaatcacttcttt

SEQ ID NO: 551704 - DNA, 13 bp, D. melanogaster
aaatcacttgaaa

SEQ ID NO: 551705 - DNA, 13 bp, D. melanogaster
aaatcacttggca

SEQ ID NO: 551706 - DNA, 13 bp, D. melanogaster
aaatcactttaaa

SEQ ID NO: 551707 - DNA, 13 bp, D. melanogaster
aaatcactttcaa

SEQ ID NO: 551708 - DNA, 13 bp, D. melanogaster
aaatcactttgaa

SEQ ID NO: 551709 - DNA, 13 bp, D. melanogaster
aaatcacttttaa

SEQ ID NO: 551710 - DNA, 13 bp, D. melanogaster
aaatcagaaaact

SEQ ID NO: 551711 - DNA, 13 bp, D. melanogaster
aaatcagaaaagt

SEQ ID NO: 551712 - DNA, 13 bp, D. melanogaster
aaatcagaaaatg

SEQ ID NO: 551713 - DNA, 13 bp, D. melanogaster
aaatcagaaaatt

SEQ ID NO: 551714 - DNA, 13 bp, D. melanogaster
aaatcagaaatcg

SEQ ID NO: 551715 - DNA, 13 bp, D. melanogaster
aaatcagaaatgt

SEQ ID NO: 551716 - DNA, 13 bp, D. melanogaster
aaatcagaatata

SEQ ID NO: 551717 - DNA, 14 bp, D. melanogaster
aaatcagaatgaaa

SEQ ID NO: 551718 - DNA, 13 bp, D. melanogaster
aaatcagaattat

SEQ ID NO: 551719 - DNA, 13 bp, D. melanogaster
aaatcagacaaat

SEQ ID NO: 551720 - DNA, 13 bp, D. melanogaster
aaatcagagaaat

SEQ ID NO: 551721 - DNA, 13 bp, D. melanogaster
aaatcagagagtt

SEQ ID NO: 551722 - DNA, 13 bp, D. melanogaster
aaatcagagcaaa

SEQ ID NO: 551723 - DNA, 13 bp, D. melanogaster
aaatcagatcaaa

SEQ ID NO: 551724 - DNA, 13 bp, D. melanogaster
aaatcagattaaa

SEQ ID NO: 551725 - DNA, 13 bp, D. melanogaster
aaatcagatttat

SEQ ID NO: 551726 - DNA, 13 bp, D. melanogaster
aaatcagattttt

SEQ ID NO: 551727 - DNA, 13 bp, D. melanogaster
aaatcagcaaata

SEQ ID NO: 551728 - DNA, 13 bp, D. melanogaster
aaatcagcaacat

SEQ ID NO: 551729 - DNA, 13 bp, D. melanogaster
aaatcagcaagca

SEQ ID NO: 551730 - DNA, 13 bp, D. melanogaster
aaatcagcagaaa

SEQ ID NO: 551731 - DNA, 13 bp, D. melanogaster
aaatcagcagcac

SEQ ID NO: 551732 - DNA, 13 bp, D. melanogaster
aaatcagcagcca

SEQ ID NO: 551733 - DNA, 13 bp, D. melanogaster
aaatcagcaggaa

SEQ ID NO: 551734 - DNA, 13 bp, D. melanogaster
aaatcagcataaa

SEQ ID NO: 551735 - DNA, 13 bp, D. melanogaster
aaatcagctaaaa

SEQ ID NO: 551736 - DNA, 15 bp, D. melanogaster
aaatcagctcataaa

SEQ ID NO: 551737 - DNA, 13 bp, D. melanogaster
aaatcagctgaaa

SEQ ID NO: 551738 - DNA, 13 bp, D. melanogaster
aaatcagctgtgc

SEQ ID NO: 551739 - DNA, 13 bp, D. melanogaster
aaatcagctgttt

SEQ ID NO: 551740 - DNA, 13 bp, D. melanogaster
aaatcagcttaaa

SEQ ID NO: 551741 - DNA, 13 bp, D. melanogaster
aaatcaggaaaat

SEQ ID NO: 551742 - DNA, 14 bp, D. melanogaster
aaatcaggagctgc

SEQ ID NO: 551743 - DNA, 14 bp, D. melanogaster
aaatcaggaggaaa

SEQ ID NO: 551744 - DNA, 13 bp, D. melanogaster
aaatcaggcaaaa

SEQ ID NO: 551745 - DNA, 13 bp, D. melanogaster
aaatcaggcaatt

SEQ ID NO: 551746 - DNA, 13 bp, D. melanogaster
aaatcagtaaaat

SEQ ID NO: 551747 - DNA, 13 bp, D. melanogaster
aaatcagtagaaa

SEQ ID NO: 551748 - DNA, 13 bp, D. melanogaster
aaatcagtgaaaa

SEQ ID NO: 551749 - DNA, 13 bp, D. melanogaster
aaatcagtgcaaa

SEQ ID NO: 551750 - DNA, 13 bp, D. melanogaster
aaatcagtggaaa

SEQ ID NO: 551751 - DNA, 13 bp, D. melanogaster
aaatcagttaaat

SEQ ID NO: 551752 - DNA, 13 bp, D. melanogaster
aaatcagttcaaa

SEQ ID NO: 551753 - DNA, 13 bp, D. melanogaster
aaatcagttgaaa

SEQ ID NO: 551754 - DNA, 13 bp, D. melanogaster
aaatcagtttatt

SEQ ID NO: 551755 - DNA, 13 bp, D. melanogaster
aaatcagtttcaa

SEQ ID NO: 551756 - DNA, 13 bp, D. melanogaster
aaatcagtttgaa

SEQ ID NO: 551757 - DNA, 13 bp, D. melanogaster
aaatcagtttttt

SEQ ID NO: 551758 - DNA, 13 bp, D. melanogaster
aaatcataaacga

SEQ ID NO: 551759 - DNA, 13 bp, D. melanogaster
aaatcataaagca

SEQ ID NO: 551760 - DNA, 13 bp, D. melanogaster
aaatcataaattc

SEQ ID NO: 551761 - DNA, 13 bp, D. melanogaster
aaatcataagcaa

SEQ ID NO: 551762 - DNA, 13 bp, D. melanogaster
aaatcataattca

SEQ ID NO: 551763 - DNA, 13 bp, D. melanogaster
aaatcataattga

SEQ ID NO: 551764 - DNA, 13 bp, D. melanogaster
aaatcatagaatg

SEQ ID NO: 551765 - DNA, 13 bp, D. melanogaster
aaatcatagcata

SEQ ID NO: 551766 - DNA, 14 bp, D. melanogaster
aaatcatatgtaaa

SEQ ID NO: 551767 - DNA, 13 bp, D. melanogaster
aaatcatatgtat

SEQ ID NO: 551768 - DNA, 13 bp, D. melanogaster
aaatcatatgttt

SEQ ID NO: 551769 - DNA, 13 bp, D. melanogaster
aaatcatatttca

SEQ ID NO: 551770 - DNA, 13 bp, D. melanogaster
aaatcatcaaatt

SEQ ID NO: 551771 - DNA, 13 bp, D. melanogaster
aaatcatcatttt

SEQ ID NO: 551772 - DNA, 13 bp, D. melanogaster
aaatcatccagat

SEQ ID NO: 551773 - DNA, 13 bp, D. melanogaster
aaatcatcggaca

SEQ ID NO: 551774 - DNA, 13 bp, D. melanogaster
aaatcatctttaa

SEQ ID NO: 551775 - DNA, 13 bp, D. melanogaster
aaatcatcttttt

SEQ ID NO: 551776 - DNA, 13 bp, D. melanogaster
aaatcatgaaatc

SEQ ID NO: 551777 - DNA, 13 bp, D. melanogaster
aaatcatgaaatt

SEQ ID NO: 551778 - DNA, 13 bp, D. melanogaster
aaatcatgcaaaa

SEQ ID NO: 551779 - DNA, 13 bp, D. melanogaster
aaatcatgcaaat

SEQ ID NO: 551780 - DNA, 13 bp, D. melanogaster
aaatcatgcattt

SEQ ID NO: 551781 - DNA, 13 bp, D. melanogaster
aaatcatggaaaa

SEQ ID NO: 551782 - DNA, 13 bp, D. melanogaster
aaatcatggaaat

SEQ ID NO: 551783 - DNA, 13 bp, D. melanogaster
aaatcatgttaaa

SEQ ID NO: 551784 - DNA, 13 bp, D. melanogaster
aaatcatgtttta

SEQ ID NO: 551785 - DNA, 13 bp, D. melanogaster
aaatcatgttttt

SEQ ID NO: 551786 - DNA, 13 bp, D. melanogaster
aaatcattaaagt

SEQ ID NO: 551787 - DNA, 13 bp, D. melanogaster
aaatcattaaggg

SEQ ID NO: 551788 - DNA, 13 bp, D. melanogaster
aaatcattaatca

SEQ ID NO: 551789 - DNA, 13 bp, D. melanogaster
aaatcattcgaaa

SEQ ID NO: 551790 - DNA, 13 bp, D. melanogaster
aaatcattcgatt

SEQ ID NO: 551791 - DNA, 13 bp, D. melanogaster
aaatcattgaaaa

SEQ ID NO: 551792 - DNA, 13 bp, D. melanogaster
aaatcattgattt

SEQ ID NO: 551793 - DNA, 13 bp, D. melanogaster
aaatcattggaaa

SEQ ID NO: 551794 - DNA, 13 bp, D. melanogaster
aaatcattggcaa

SEQ ID NO: 551795 - DNA, 13 bp, D. melanogaster
aaatcattgtaga

SEQ ID NO: 551796 - DNA, 14 bp, D. melanogaster
aaatcattgtagat

SEQ ID NO: 551797 - DNA, 13 bp, D. melanogaster
aaatcattgtttt

SEQ ID NO: 551798 - DNA, 13 bp, D. melanogaster
aaatcatttaact

SEQ ID NO: 551799 - DNA, 13 bp, D. melanogaster
aaatcatttacaa

SEQ ID NO: 551800 - DNA, 13 bp, D. melanogaster
aaatcatttacat

SEQ ID NO: 551801 - DNA, 13 bp, D. melanogaster
aaatcatttcaca

SEQ ID NO: 551802 - DNA, 13 bp, D. melanogaster
aaatcatttcata

SEQ ID NO: 551803 - DNA, 13 bp, D. melanogaster
aaatcatttcatt

SEQ ID NO: 551804 - DNA, 13 bp, D. melanogaster
aaatcatttccaa

SEQ ID NO: 551805 - DNA, 13 bp, D. melanogaster
aaatcatttccat

SEQ ID NO: 551806 - DNA, 13 bp, D. melanogaster
aaatcatttcctt

SEQ ID NO: 551807 - DNA, 13 bp, D. melanogaster
aaatcatttcgaa

SEQ ID NO: 551808 - DNA, 13 bp, D. melanogaster
aaatcatttcttt

SEQ ID NO: 551809 - DNA, 13 bp, D. melanogaster
aaatcatttgatt

SEQ ID NO: 551810 - DNA, 13 bp, D. melanogaster
aaatcatttgtaa

SEQ ID NO: 551811 - DNA, 14 bp, D. melanogaster
aaatcatttgtttt

SEQ ID NO: 551812 - DNA, 13 bp, D. melanogaster
aaatcattttagt

SEQ ID NO: 551813 - DNA, 13 bp, D. melanogaster
aaatcattttcaa

SEQ ID NO: 551814 - DNA, 13 bp, D. melanogaster
aaatcattttcct

SEQ ID NO: 551815 - DNA, 13 bp, D. melanogaster
aaatcattttctg

SEQ ID NO: 551816 - DNA, 13 bp, D. melanogaster
aaatcattttctt

SEQ ID NO: 551817 - DNA, 13 bp, D. melanogaster
aaatcattttgaa

SEQ ID NO: 551818 - DNA, 13 bp, D. melanogaster
aaatcattttgct

SEQ ID NO: 551819 - DNA, 13 bp, D. melanogaster
aaatcattttggc

SEQ ID NO: 551820 - DNA, 13 bp, D. melanogaster
aaatcattttggg

SEQ ID NO: 551821 - DNA, 13 bp, D. melanogaster
aaatcatttttca

SEQ ID NO: 551822 - DNA, 14 bp, D. melanogaster
aaatcatttttcaa

SEQ ID NO: 551823 - DNA, 13 bp, D. melanogaster
aaatcatttttgg

SEQ ID NO: 551824 - DNA, 13 bp, D. melanogaster
aaatcatttttgt

SEQ ID NO: 551825 - DNA, 14 bp, D. melanogaster
aaatcatttttgtt

SEQ ID NO: 551826 - DNA, 13 bp, D. melanogaster
aaatccaaaatcc

SEQ ID NO: 551827 - DNA, 13 bp, D. melanogaster
aaatccaaaatct

SEQ ID NO: 551828 - DNA, 13 bp, D. melanogaster
aaatccaaaattt

SEQ ID NO: 551829 - DNA, 13 bp, D. melanogaster
aaatccaaacaag

SEQ ID NO: 551830 - DNA, 13 bp, D. melanogaster
aaatccaaagcaa

SEQ ID NO: 551831 - DNA, 13 bp, D. melanogaster
aaatccaaagcca

SEQ ID NO: 551832 - DNA, 13 bp, D. melanogaster
aaatccaaagcga

SEQ ID NO: 551833 - DNA, 13 bp, D. melanogaster
aaatccaaagctg

SEQ ID NO: 551834 - DNA, 13 bp, D. melanogaster
aaatccaaataga

SEQ ID NO: 551835 - DNA, 13 bp, D. melanogaster
aaatccaaatccc

SEQ ID NO: 551836 - DNA, 13 bp, D. melanogaster
aaatccaaatccg

SEQ ID NO: 551837 - DNA, 13 bp, D. melanogaster
aaatccaaatcga

SEQ ID NO: 551838 - DNA, 14 bp, D. melanogaster
aaatccaaatcgaa

SEQ ID NO: 551839 - DNA, 13 bp, D. melanogaster
aaatccaaatgcc

SEQ ID NO: 551840 - DNA, 14 bp, D. melanogaster
aaatccaaattcaa

SEQ ID NO: 551841 - DNA, 13 bp, D. melanogaster
aaatccaaattgg

SEQ ID NO: 551842 - DNA, 13 bp, D. melanogaster
aaatccaaattta

SEQ ID NO: 551843 - DNA, 13 bp, D. melanogaster
aaatccaaatttt

SEQ ID NO: 551844 - DNA, 13 bp, D. melanogaster
aaatccaacttaa

SEQ ID NO: 551845 - DNA, 13 bp, D. melanogaster
aaatccaagcaaa

SEQ ID NO: 551846 - DNA, 13 bp, D. melanogaster
aaatccaagccaa

SEQ ID NO: 551847 - DNA, 14 bp, D. melanogaster
aaatccaagccaat

SEQ ID NO: 551848 - DNA, 13 bp, D. melanogaster
aaatccaagccca

SEQ ID NO: 551849 - DNA, 13 bp, D. melanogaster
aaatccaagttca

SEQ ID NO: 551850 - DNA, 14 bp, D. melanogaster
aaatccaagttcaa

SEQ ID NO: 551851 - DNA, 13 bp, D. melanogaster
aaatccaatatta

SEQ ID NO: 551852 - DNA, 14 bp, D. melanogaster
aaatccaatcaaat

SEQ ID NO: 551853 - DNA, 13 bp, D. melanogaster
aaatccaatcaag

SEQ ID NO: 551854 - DNA, 14 bp, D. melanogaster
aaatccaatccaat

SEQ ID NO: 551855 - DNA, 13 bp, D. melanogaster
aaatccaatgaaa

SEQ ID NO: 551856 - DNA, 13 bp, D. melanogaster
aaatccaattaat

SEQ ID NO: 551857 - DNA, 13 bp, D. melanogaster
aaatccaattcaa

SEQ ID NO: 551858 - DNA, 13 bp, D. melanogaster
aaatccaattgaa

SEQ ID NO: 551859 - DNA, 13 bp, D. melanogaster
aaatccaatttag

SEQ ID NO: 551860 - DNA, 13 bp, D. melanogaster
aaatccaatttca

SEQ ID NO: 551861 - DNA, 13 bp, D. melanogaster
aaatccaatttga

SEQ ID NO: 551862 - DNA, 13 bp, D. melanogaster
aaatccaatttgt

SEQ ID NO: 551863 - DNA, 13 bp, D. melanogaster
aaatccacaaatt

SEQ ID NO: 551864 - DNA, 13 bp, D. melanogaster
aaatccacgcaca

SEQ ID NO: 551865 - DNA, 14 bp, D. melanogaster
aaatccacgttaga

SEQ ID NO: 551866 - DNA, 13 bp, D. melanogaster
aaatccacttaaa

SEQ ID NO: 551867 - DNA, 13 bp, D. melanogaster
aaatccagcctca

SEQ ID NO: 551868 - DNA, 13 bp, D. melanogaster
aaatccatagaaa

SEQ ID NO: 551869 - DNA, 13 bp, D. melanogaster
aaatccatatttt

SEQ ID NO: 551870 - DNA, 13 bp, D. melanogaster
aaatccatgaaaa

SEQ ID NO: 551871 - DNA, 13 bp, D. melanogaster
aaatccatgtatt

SEQ ID NO: 551872 - DNA, 13 bp, D. melanogaster
aaatccattaaat

SEQ ID NO: 551873 - DNA, 13 bp, D. melanogaster
aaatccattaata

SEQ ID NO: 551874 - DNA, 13 bp, D. melanogaster
aaatccattacaa

SEQ ID NO: 551875 - DNA, 13 bp, D. melanogaster
aaatccattgaaa

SEQ ID NO: 551876 - DNA, 13 bp, D. melanogaster
aaatccatttaaa

SEQ ID NO: 551877 - DNA, 13 bp, D. melanogaster
aaatccatttaat

SEQ ID NO: 551878 - DNA, 13 bp, D. melanogaster
aaatccatttaga

SEQ ID NO: 551879 - DNA, 13 bp, D. melanogaster
aaatccatttagt

SEQ ID NO: 551880 - DNA, 13 bp, D. melanogaster
aaatccatttata

SEQ ID NO: 551881 - DNA, 13 bp, D. melanogaster
aaatccatttcaa

SEQ ID NO: 551882 - DNA, 13 bp, D. melanogaster
aaatccattttca

SEQ ID NO: 551883 - DNA, 13 bp, D. melanogaster
aaatccattttta

SEQ ID NO: 551884 - DNA, 13 bp, D. melanogaster
aaatccatttttc

SEQ ID NO: 551885 - DNA, 13 bp, D. melanogaster
aaatcccaaatcc

SEQ ID NO: 551886 - DNA, 13 bp, D. melanogaster
aaatcccaaatga

SEQ ID NO: 551887 - DNA, 13 bp, D. melanogaster
aaatcccaaattg

SEQ ID NO: 551888 - DNA, 13 bp, D. melanogaster
aaatcccaatccc

SEQ ID NO: 551889 - DNA, 14 bp, D. melanogaster
aaatcccaatccca

SEQ ID NO: 551890 - DNA, 13 bp, D. melanogaster
aaatcccaatcga

SEQ ID NO: 551891 - DNA, 14 bp, D. melanogaster
aaatcccaatcgat

SEQ ID NO: 551892 - DNA, 13 bp, D. melanogaster
aaatcccaattca

SEQ ID NO: 551893 - DNA, 13 bp, D. melanogaster
aaatcccattaaa

SEQ ID NO: 551894 - DNA, 13 bp, D. melanogaster
aaatcccattttt

SEQ ID NO: 551895 - DNA, 13 bp, D. melanogaster
aaatccccattcc

SEQ ID NO: 551896 - DNA, 13 bp, D. melanogaster
aaatccctctacc

SEQ ID NO: 551897 - DNA, 13 bp, D. melanogaster
aaatccctctttt

SEQ ID NO: 551898 - DNA, 14 bp, D. melanogaster
aaatccctttgcca

SEQ ID NO: 551899 - DNA, 13 bp, D. melanogaster
aaatcccttttaa

SEQ ID NO: 551900 - DNA, 13 bp, D. melanogaster
aaatccgaaatcc

SEQ ID NO: 551901 - DNA, 13 bp, D. melanogaster
aaatccgaatcca

SEQ ID NO: 551902 - DNA, 13 bp, D. melanogaster
aaatccgataaaa

SEQ ID NO: 551903 - DNA, 14 bp, D. melanogaster
aaatccgataaaaa

SEQ ID NO: 551904 - DNA, 13 bp, D. melanogaster
aaatccgcaaaaa

SEQ ID NO: 551905 - DNA, 13 bp, D. melanogaster
aaatccggctccg

SEQ ID NO: 551906 - DNA, 13 bp, D. melanogaster
aaatccgtagagg

SEQ ID NO: 551907 - DNA, 13 bp, D. melanogaster
aaatccgtcaaaa

SEQ ID NO: 551908 - DNA, 13 bp, D. melanogaster
aaatccgtctgtt

SEQ ID NO: 551909 - DNA, 14 bp, D. melanogaster
aaatccgtctgttc

SEQ ID NO: 551910 - DNA, 13 bp, D. melanogaster
aaatccgtgaatc

SEQ ID NO: 551911 - DNA, 13 bp, D. melanogaster
aaatccgttaaaa

SEQ ID NO: 551912 - DNA, 13 bp, D. melanogaster
aaatccgtttttt

SEQ ID NO: 551913 - DNA, 13 bp, D. melanogaster
aaatcctacttcc

SEQ ID NO: 551914 - DNA, 13 bp, D. melanogaster
aaatcctatttat

SEQ ID NO: 551915 - DNA, 13 bp, D. melanogaster
aaatcctgatgct

SEQ ID NO: 551916 - DNA, 13 bp, D. melanogaster
aaatcctggccag

SEQ ID NO: 551917 - DNA, 13 bp, D. melanogaster
aaatcctggccgt

SEQ ID NO: 551918 - DNA, 13 bp, D. melanogaster
aaatccttaaatt

SEQ ID NO: 551919 - DNA, 13 bp, D. melanogaster
aaatccttcaaaa

SEQ ID NO: 551920 - DNA, 14 bp, D. melanogaster
aaatccttcaaaaa

SEQ ID NO: 551921 - DNA, 13 bp, D. melanogaster
aaatcctttaaaa

SEQ ID NO: 551922 - DNA, 13 bp, D. melanogaster
aaatcctttcaaa

SEQ ID NO: 551923 - DNA, 13 bp, D. melanogaster
aaatcctttgcca

SEQ ID NO: 551924 - DNA, 13 bp, D. melanogaster
aaatccttttcaa

SEQ ID NO: 551925 - DNA, 13 bp, D. melanogaster
aaatccttttcat

SEQ ID NO: 551926 - DNA, 13 bp, D. melanogaster
aaatccttttgca

SEQ ID NO: 551927 - DNA, 13 bp, D. melanogaster
aaatccttttgcc

SEQ ID NO: 551928 - DNA, 13 bp, D. melanogaster
aaatccttttgtt

SEQ ID NO: 551929 - DNA, 14 bp, D. melanogaster
aaatccttttgttt

SEQ ID NO: 551930 - DNA, 13 bp, D. melanogaster
aaatcgaaaaact

SEQ ID NO: 551931 - DNA, 13 bp, D. melanogaster
aaatcgaaaaatc

SEQ ID NO: 551932 - DNA, 14 bp, D. melanogaster
aaatcgaaaaatca

SEQ ID NO: 551933 - DNA, 13 bp, D. melanogaster
aaatcgaaaaatt

SEQ ID NO: 551934 - DNA, 13 bp, D. melanogaster
aaatcgaaaaccg

SEQ ID NO: 551935 - DNA, 14 bp, D. melanogaster
aaatcgaaaacgaa

SEQ ID NO: 551936 - DNA, 13 bp, D. melanogaster
aaatcgaaaactt

SEQ ID NO: 551937 - DNA, 14 bp, D. melanogaster
aaatcgaaaaggaa

SEQ ID NO: 551938 - DNA, 13 bp, D. melanogaster
aaatcgaaaagtt

SEQ ID NO: 551939 - DNA, 13 bp, D. melanogaster
aaatcgaaaatat

SEQ ID NO: 551940 - DNA, 13 bp, D. melanogaster
aaatcgaaaatca

SEQ ID NO: 551941 - DNA, 14 bp, D. melanogaster
aaatcgaaaatgaa

SEQ ID NO: 551942 - DNA, 13 bp, D. melanogaster
aaatcgaaacaca

SEQ ID NO: 551943 - DNA, 13 bp, D. melanogaster
aaatcgaaacatc

SEQ ID NO: 551944 - DNA, 13 bp, D. melanogaster
aaatcgaaaccaa

SEQ ID NO: 551945 - DNA, 14 bp, D. melanogaster
aaatcgaaaccaaa

SEQ ID NO: 551946 - DNA, 14 bp, D. melanogaster
aaatcgaaaccgaa

SEQ ID NO: 551947 - DNA, 14 bp, D. melanogaster
aaatcgaaacgaaa

SEQ ID NO: 551948 - DNA, 13 bp, D. melanogaster
aaatcgaaacgca

SEQ ID NO: 551949 - DNA, 13 bp, D. melanogaster
aaatcgaaactaa

SEQ ID NO: 551950 - DNA, 13 bp, D. melanogaster
aaatcgaaactca

SEQ ID NO: 551951 - DNA, 13 bp, D. melanogaster
aaatcgaaactga

SEQ ID NO: 551952 - DNA, 13 bp, D. melanogaster
aaatcgaaagaag

SEQ ID NO: 551953 - DNA, 13 bp, D. melanogaster
aaatcgaaagaga

SEQ ID NO: 551954 - DNA, 13 bp, D. melanogaster
aaatcgaaagtgt

SEQ ID NO: 551955 - DNA, 13 bp, D. melanogaster
aaatcgaaagtta

SEQ ID NO: 551956 - DNA, 13 bp, D. melanogaster
aaatcgaaagttt

SEQ ID NO: 551957 - DNA, 13 bp, D. melanogaster
aaatcgaaataat

SEQ ID NO: 551958 - DNA, 14 bp, D. melanogaster
aaatcgaaatatat

SEQ ID NO: 551959 - DNA, 13 bp, D. melanogaster
aaatcgaaatcaa

SEQ ID NO: 551960 - DNA, 14 bp, D. melanogaster
aaatcgaaatcaaa

SEQ ID NO: 551961 - DNA, 13 bp, D. melanogaster
aaatcgaaatcag

SEQ ID NO: 551962 - DNA, 13 bp, D. melanogaster
aaatcgaaatcca

SEQ ID NO: 551963 - DNA, 14 bp, D. melanogaster
aaatcgaaatcgaa

SEQ ID NO: 551964 - DNA, 15 bp, D. melanogaster
aaatcgaaatcgaat

SEQ ID NO: 551965 - DNA, 13 bp, D. melanogaster
aaatcgaaatcgg

SEQ ID NO: 551966 - DNA, 13 bp, D. melanogaster
aaatcgaaatcgt

SEQ ID NO: 551967 - DNA, 14 bp, D. melanogaster
aaatcgaaatgaaa

SEQ ID NO: 551968 - DNA, 13 bp, D. melanogaster
aaatcgaaatgga

SEQ ID NO: 551969 - DNA, 13 bp, D. melanogaster
aaatcgaaatgtt

SEQ ID NO: 551970 - DNA, 14 bp, D. melanogaster
aaatcgaaatgttt

SEQ ID NO: 551971 - DNA, 13 bp, D. melanogaster
aaatcgaaattaa

SEQ ID NO: 551972 - DNA, 14 bp, D. melanogaster
aaatcgaaattaaa

SEQ ID NO: 551973 - DNA, 13 bp, D. melanogaster
aaatcgaaattcg

SEQ ID NO: 551974 - DNA, 13 bp, D. melanogaster
aaatcgaaattga

SEQ ID NO: 551975 - DNA, 13 bp, D. melanogaster
aaatcgaaatttc

SEQ ID NO: 551976 - DNA, 13 bp, D. melanogaster
aaatcgaacaaat

SEQ ID NO: 551977 - DNA, 13 bp, D. melanogaster
aaatcgaacaatt

SEQ ID NO: 551978 - DNA, 13 bp, D. melanogaster
aaatcgaacattt

SEQ ID NO: 551979 - DNA, 13 bp, D. melanogaster
aaatcgaaccaaa

SEQ ID NO: 551980 - DNA, 13 bp, D. melanogaster
aaatcgaacgaaa

SEQ ID NO: 551981 - DNA, 13 bp, D. melanogaster
aaatcgaactaaa

SEQ ID NO: 551982 - DNA, 13 bp, D. melanogaster
aaatcgaactttt

SEQ ID NO: 551983 - DNA, 13 bp, D. melanogaster
aaatcgaagccaa

SEQ ID NO: 551984 - DNA, 13 bp, D. melanogaster
aaatcgaagcgaa

SEQ ID NO: 551985 - DNA, 13 bp, D. melanogaster
aaatcgaaggaaa

SEQ ID NO: 551986 - DNA, 13 bp, D. melanogaster
aaatcgaagggaa

SEQ ID NO: 551987 - DNA, 13 bp, D. melanogaster
aaatcgaagttat

SEQ ID NO: 551988 - DNA, 14 bp, D. melanogaster
aaatcgaataaaat

SEQ ID NO: 551989 - DNA, 13 bp, D. melanogaster
aaatcgaataaat

SEQ ID NO: 551990 - DNA, 13 bp, D. melanogaster
aaatcgaataata

SEQ ID NO: 551991 - DNA, 13 bp, D. melanogaster
aaatcgaatatat

SEQ ID NO: 551992 - DNA, 13 bp, D. melanogaster
aaatcgaatattt

SEQ ID NO: 551993 - DNA, 13 bp, D. melanogaster
aaatcgaatcaaa

SEQ ID NO: 551994 - DNA, 13 bp, D. melanogaster
aaatcgaatcaat

SEQ ID NO: 551995 - DNA, 14 bp, D. melanogaster
aaatcgaatcgaaa

SEQ ID NO: 551996 - DNA, 14 bp, D. melanogaster
aaatcgaatcgaat

SEQ ID NO: 551997 - DNA, 13 bp, D. melanogaster
aaatcgaatgaaa

SEQ ID NO: 551998 - DNA, 13 bp, D. melanogaster
aaatcgaatgaat

SEQ ID NO: 551999 - DNA, 13 bp, D. melanogaster
aaatcgaatgcaa

SEQ ID NO: 552000 - DNA, 14 bp, D. melanogaster
aaatcgaatgcaaa

SEQ ID NO: 552001 - DNA, 13 bp, D. melanogaster
aaatcgaatgcga

SEQ ID NO: 552002 - DNA, 13 bp, D. melanogaster
aaatcgaatggga

SEQ ID NO: 552003 - DNA, 13 bp, D. melanogaster
aaatcgaatgttt

SEQ ID NO: 552004 - DNA, 13 bp, D. melanogaster
aaatcgaattata

SEQ ID NO: 552005 - DNA, 13 bp, D. melanogaster
aaatcgaattcaa

SEQ ID NO: 552006 - DNA, 14 bp, D. melanogaster
aaatcgaattcaaa

SEQ ID NO: 552007 - DNA, 13 bp, D. melanogaster
aaatcgaattcat

SEQ ID NO: 552008 - DNA, 14 bp, D. melanogaster
aaatcgaattcgga

SEQ ID NO: 552009 - DNA, 13 bp, D. melanogaster
aaatcgaattgga

SEQ ID NO: 552010 - DNA, 13 bp, D. melanogaster
aaatcgaatttaa

SEQ ID NO: 552011 - DNA, 13 bp, D. melanogaster
aaatcgaattttg

SEQ ID NO: 552012 - DNA, 13 bp, D. melanogaster
aaatcgaattttt

SEQ ID NO: 552013 - DNA, 13 bp, D. melanogaster
aaatcgacaaaat

SEQ ID NO: 552014 - DNA, 13 bp, D. melanogaster
aaatcgacaacaa

SEQ ID NO: 552015 - DNA, 14 bp, D. melanogaster
aaatcgaccaagtt

SEQ ID NO: 552016 - DNA, 13 bp, D. melanogaster
aaatcgacgataa

SEQ ID NO: 552017 - DNA, 13 bp, D. melanogaster
aaatcgactgact

SEQ ID NO: 552018 - DNA, 13 bp, D. melanogaster
aaatcgacttcgg

SEQ ID NO: 552019 - DNA, 13 bp, D. melanogaster
aaatcgagaaaat

SEQ ID NO: 552020 - DNA, 13 bp, D. melanogaster
aaatcgagcaaaa

SEQ ID NO: 552021 - DNA, 13 bp, D. melanogaster
aaatcgagcggct

SEQ ID NO: 552022 - DNA, 13 bp, D. melanogaster
aaatcgagtaaat

SEQ ID NO: 552023 - DNA, 13 bp, D. melanogaster
aaatcgagtgaaa

SEQ ID NO: 552024 - DNA, 14 bp, D. melanogaster
aaatcgataactgt

SEQ ID NO: 552025 - DNA, 13 bp, D. melanogaster
aaatcgatagaaa

SEQ ID NO: 552026 - DNA, 14 bp, D. melanogaster
aaatcgatagaaat

SEQ ID NO: 552027 - DNA, 13 bp, D. melanogaster
aaatcgatagata

SEQ ID NO: 552028 - DNA, 13 bp, D. melanogaster
aaatcgatagcaa

SEQ ID NO: 552029 - DNA, 13 bp, D. melanogaster
aaatcgatataaa

SEQ ID NO: 552030 - DNA, 13 bp, D. melanogaster
aaatcgatatttt

SEQ ID NO: 552031 - DNA, 13 bp, D. melanogaster
aaatcgatcataa

SEQ ID NO: 552032 - DNA, 13 bp, D. melanogaster
aaatcgatgaaaa

SEQ ID NO: 552033 - DNA, 13 bp, D. melanogaster
aaatcgatgaact

SEQ ID NO: 552034 - DNA, 13 bp, D. melanogaster
aaatcgatgccaa

SEQ ID NO: 552035 - DNA, 13 bp, D. melanogaster
aaatcgatggaaa

SEQ ID NO: 552036 - DNA, 14 bp, D. melanogaster
aaatcgatggaaat

SEQ ID NO: 552037 - DNA, 13 bp, D. melanogaster
aaatcgatgtatt

SEQ ID NO: 552038 - DNA, 13 bp, D. melanogaster
aaatcgatgtttt

SEQ ID NO: 552039 - DNA, 13 bp, D. melanogaster
aaatcgattaatt

SEQ ID NO: 552040 - DNA, 13 bp, D. melanogaster
aaatcgattattt

SEQ ID NO: 552041 - DNA, 13 bp, D. melanogaster
aaatcgattcgaa

SEQ ID NO: 552042 - DNA, 13 bp, D. melanogaster
aaatcgattgaaa

SEQ ID NO: 552043 - DNA, 13 bp, D. melanogaster
aaatcgattgaac

SEQ ID NO: 552044 - DNA, 13 bp, D. melanogaster
aaatcgattgaat

SEQ ID NO: 552045 - DNA, 13 bp, D. melanogaster
aaatcgattgata

SEQ ID NO: 552046 - DNA, 13 bp, D. melanogaster
aaatcgattgatt

SEQ ID NO: 552047 - DNA, 13 bp, D. melanogaster
aaatcgattgcaa

SEQ ID NO: 552048 - DNA, 13 bp, D. melanogaster
aaatcgattgctt

SEQ ID NO: 552049 - DNA, 13 bp, D. melanogaster
aaatcgattggaa

SEQ ID NO: 552050 - DNA, 13 bp, D. melanogaster
aaatcgattggga

SEQ ID NO: 552051 - DNA, 13 bp, D. melanogaster
aaatcgatttaaa

SEQ ID NO: 552052 - DNA, 14 bp, D. melanogaster
aaatcgatttaaac

SEQ ID NO: 552053 - DNA, 14 bp, D. melanogaster
aaatcgatttaaat

SEQ ID NO: 552054 - DNA, 13 bp, D. melanogaster
aaatcgatttcga

SEQ ID NO: 552055 - DNA, 13 bp, D. melanogaster
aaatcgatttgca

SEQ ID NO: 552056 - DNA, 13 bp, D. melanogaster
aaatcgatttgga

SEQ ID NO: 552057 - DNA, 13 bp, D. melanogaster
aaatcgatttggc

SEQ ID NO: 552058 - DNA, 14 bp, D. melanogaster
aaatcgatttggca

SEQ ID NO: 552059 - DNA, 13 bp, D. melanogaster
aaatcgatttgtt

SEQ ID NO: 552060 - DNA, 13 bp, D. melanogaster
aaatcgattttat

SEQ ID NO: 552061 - DNA, 13 bp, D. melanogaster
aaatcgatttttc

SEQ ID NO: 552062 - DNA, 14 bp, D. melanogaster
aaatcgattttttt

SEQ ID NO: 552063 - DNA, 13 bp, D. melanogaster
aaatcgcaaaaat

SEQ ID NO: 552064 - DNA, 13 bp, D. melanogaster
aaatcgcaaaata

SEQ ID NO: 552065 - DNA, 13 bp, D. melanogaster
aaatcgcaaaatc

SEQ ID NO: 552066 - DNA, 13 bp, D. melanogaster
aaatcgcaaaatt

SEQ ID NO: 552067 - DNA, 13 bp, D. melanogaster
aaatcgcaaacaa

SEQ ID NO: 552068 - DNA, 14 bp, D. melanogaster
aaatcgcaaatgat

SEQ ID NO: 552069 - DNA, 13 bp, D. melanogaster
aaatcgcaaattg

SEQ ID NO: 552070 - DNA, 13 bp, D. melanogaster
aaatcgcaatcga

SEQ ID NO: 552071 - DNA, 13 bp, D. melanogaster
aaatcgcaattaa

SEQ ID NO: 552072 - DNA, 13 bp, D. melanogaster
aaatcgcaatttt

SEQ ID NO: 552073 - DNA, 13 bp, D. melanogaster
aaatcgcacaaaa

SEQ ID NO: 552074 - DNA, 13 bp, D. melanogaster
aaatcgcagaaaa

SEQ ID NO: 552075 - DNA, 13 bp, D. melanogaster
aaatcgcagacaa

SEQ ID NO: 552076 - DNA, 13 bp, D. melanogaster
aaatcgcagcaaa

SEQ ID NO: 552077 - DNA, 13 bp, D. melanogaster
aaatcgcagcagc

SEQ ID NO: 552078 - DNA, 13 bp, D. melanogaster
aaatcgcataaaa

SEQ ID NO: 552079 - DNA, 14 bp, D. melanogaster
aaatcgcataaaaa

SEQ ID NO: 552080 - DNA, 14 bp, D. melanogaster
aaatcgcataaaac

SEQ ID NO: 552081 - DNA, 13 bp, D. melanogaster
aaatcgcataaat

SEQ ID NO: 552082 - DNA, 13 bp, D. melanogaster
aaatcgcatatat

SEQ ID NO: 552083 - DNA, 13 bp, D. melanogaster
aaatcgcattaag

SEQ ID NO: 552084 - DNA, 13 bp, D. melanogaster
aaatcgcattaat

SEQ ID NO: 552085 - DNA, 13 bp, D. melanogaster
aaatcgcattcaa

SEQ ID NO: 552086 - DNA, 13 bp, D. melanogaster
aaatcgcatttaa

SEQ ID NO: 552087 - DNA, 13 bp, D. melanogaster
aaatcgcatttgg

SEQ ID NO: 552088 - DNA, 13 bp, D. melanogaster
aaatcgcatttgt

SEQ ID NO: 552089 - DNA, 13 bp, D. melanogaster
aaatcgccaaaaa

SEQ ID NO: 552090 - DNA, 13 bp, D. melanogaster
aaatcgccagaca

SEQ ID NO: 552091 - DNA, 13 bp, D. melanogaster
aaatcgccgctcg

SEQ ID NO: 552092 - DNA, 13 bp, D. melanogaster
aaatcgcgtactt

SEQ ID NO: 552093 - DNA, 13 bp, D. melanogaster
aaatcgctgaaaa

SEQ ID NO: 552094 - DNA, 13 bp, D. melanogaster
aaatcgctgcaaa

SEQ ID NO: 552095 - DNA, 13 bp, D. melanogaster
aaatcgctggaaa

SEQ ID NO: 552096 - DNA, 13 bp, D. melanogaster
aaatcgctggcaa

SEQ ID NO: 552097 - DNA, 13 bp, D. melanogaster
aaatcgcttaaaa

SEQ ID NO: 552098 - DNA, 13 bp, D. melanogaster
aaatcgcttgaaa

SEQ ID NO: 552099 - DNA, 13 bp, D. melanogaster
aaatcgcttgcca

SEQ ID NO: 552100 - DNA, 13 bp, D. melanogaster
aaatcgctttcaa

SEQ ID NO: 552101 - DNA, 13 bp, D. melanogaster
aaatcgcttttaa

SEQ ID NO: 552102 - DNA, 13 bp, D. melanogaster
aaatcgcttttca

SEQ ID NO: 552103 - DNA, 13 bp, D. melanogaster
aaatcggaaaatg

SEQ ID NO: 552104 - DNA, 13 bp, D. melanogaster
aaatcggaaaatt

SEQ ID NO: 552105 - DNA, 13 bp, D. melanogaster
aaatcggaaatca

SEQ ID NO: 552106 - DNA, 13 bp, D. melanogaster
aaatcggaaattt

SEQ ID NO: 552107 - DNA, 14 bp, D. melanogaster
aaatcggaaatttg

SEQ ID NO: 552108 - DNA, 13 bp, D. melanogaster
aaatcggaatcgg

SEQ ID NO: 552109 - DNA, 14 bp, D. melanogaster
aaatcggaatcgga

SEQ ID NO: 552110 - DNA, 13 bp, D. melanogaster
aaatcggagaaaa

SEQ ID NO: 552111 - DNA, 13 bp, D. melanogaster
aaatcggagatgg

SEQ ID NO: 552112 - DNA, 14 bp, D. melanogaster
aaatcggagatggc

SEQ ID NO: 552113 - DNA, 13 bp, D. melanogaster
aaatcggaggaaa

SEQ ID NO: 552114 - DNA, 14 bp, D. melanogaster
aaatcggattgtgg

SEQ ID NO: 552115 - DNA, 13 bp, D. melanogaster
aaatcggcaatat

SEQ ID NO: 552116 - DNA, 13 bp, D. melanogaster
aaatcggcatgaa

SEQ ID NO: 552117 - DNA, 13 bp, D. melanogaster
aaatcggcttaaa

SEQ ID NO: 552118 - DNA, 13 bp, D. melanogaster
aaatcgggaaaaa

SEQ ID NO: 552119 - DNA, 13 bp, D. melanogaster
aaatcgggaaaat

SEQ ID NO: 552120 - DNA, 13 bp, D. melanogaster
aaatcgggagaag

SEQ ID NO: 552121 - DNA, 13 bp, D. melanogaster
aaatcggggaaaa

SEQ ID NO: 552122 - DNA, 13 bp, D. melanogaster
aaatcgggggaaa

SEQ ID NO: 552123 - DNA, 13 bp, D. melanogaster
aaatcggtgaaaa

SEQ ID NO: 552124 - DNA, 13 bp, D. melanogaster
aaatcggtggaaa

SEQ ID NO: 552125 - DNA, 13 bp, D. melanogaster
aaatcggttatat

SEQ ID NO: 552126 - DNA, 13 bp, D. melanogaster
aaatcggtttttt

SEQ ID NO: 552127 - DNA, 13 bp, D. melanogaster
aaatcgtaaaaat

SEQ ID NO: 552128 - DNA, 13 bp, D. melanogaster
aaatcgtaaaatt

SEQ ID NO: 552129 - DNA, 13 bp, D. melanogaster
aaatcgtaaatca

SEQ ID NO: 552130 - DNA, 13 bp, D. melanogaster
aaatcgtacaaaa

SEQ ID NO: 552131 - DNA, 13 bp, D. melanogaster
aaatcgtatatat

SEQ ID NO: 552132 - DNA, 13 bp, D. melanogaster
aaatcgtatgaaa

SEQ ID NO: 552133 - DNA, 13 bp, D. melanogaster
aaatcgtattaaa

SEQ ID NO: 552134 - DNA, 13 bp, D. melanogaster
aaatcgtatttat

SEQ ID NO: 552135 - DNA, 13 bp, D. melanogaster
aaatcgtatttta

SEQ ID NO: 552136 - DNA, 13 bp, D. melanogaster
aaatcgtattttt

SEQ ID NO: 552137 - DNA, 13 bp, D. melanogaster
aaatcgtggccaa

SEQ ID NO: 552138 - DNA, 13 bp, D. melanogaster
aaatcgtgggaaa

SEQ ID NO: 552139 - DNA, 13 bp, D. melanogaster
aaatcgtgtgcca

SEQ ID NO: 552140 - DNA, 13 bp, D. melanogaster
aaatcgttaaaat

SEQ ID NO: 552141 - DNA, 13 bp, D. melanogaster
aaatcgttaaata

SEQ ID NO: 552142 - DNA, 14 bp, D. melanogaster
aaatcgttaacaat

SEQ ID NO: 552143 - DNA, 13 bp, D. melanogaster
aaatcgttaagat

SEQ ID NO: 552144 - DNA, 14 bp, D. melanogaster
aaatcgttaagatt

SEQ ID NO: 552145 - DNA, 13 bp, D. melanogaster
aaatcgttgggat

SEQ ID NO: 552146 - DNA, 13 bp, D. melanogaster
aaatcgtttaaaa

SEQ ID NO: 552147 - DNA, 14 bp, D. melanogaster
aaatcgtttaaaaa

SEQ ID NO: 552148 - DNA, 13 bp, D. melanogaster
aaatcgtttaatt

SEQ ID NO: 552149 - DNA, 14 bp, D. melanogaster
aaatcgtttaattt

SEQ ID NO: 552150 - DNA, 13 bp, D. melanogaster
aaatcgtttcaaa

SEQ ID NO: 552151 - DNA, 13 bp, D. melanogaster
aaatcgtttcttt

SEQ ID NO: 552152 - DNA, 13 bp, D. melanogaster
aaatcgtttgatt

SEQ ID NO: 552153 - DNA, 13 bp, D. melanogaster
aaatcgtttggaa

SEQ ID NO: 552154 - DNA, 13 bp, D. melanogaster
aaatcgttttcaa

SEQ ID NO: 552155 - DNA, 13 bp, D. melanogaster
aaatcgttttcca

SEQ ID NO: 552156 - DNA, 13 bp, D. melanogaster
aaatcgttttcct

SEQ ID NO: 552157 - DNA, 13 bp, D. melanogaster
aaatcgttttgtt

SEQ ID NO: 552158 - DNA, 13 bp, D. melanogaster
aaatcgtttttat

SEQ ID NO: 552159 - DNA, 14 bp, D. melanogaster
aaatctaaaaatag

SEQ ID NO: 552160 - DNA, 14 bp, D. melanogaster
aaatctaaacaaga

SEQ ID NO: 552161 - DNA, 13 bp, D. melanogaster
aaatctaaattca

SEQ ID NO: 552162 - DNA, 13 bp, D. melanogaster
aaatctaacattt

SEQ ID NO: 552163 - DNA, 13 bp, D. melanogaster
aaatctaatctaa

SEQ ID NO: 552164 - DNA, 13 bp, D. melanogaster
aaatctaatgaaa

SEQ ID NO: 552165 - DNA, 13 bp, D. melanogaster
aaatctaattaca

SEQ ID NO: 552166 - DNA, 13 bp, D. melanogaster
aaatctaatttgc

SEQ ID NO: 552167 - DNA, 14 bp, D. melanogaster
aaatctaatttgca

SEQ ID NO: 552168 - DNA, 13 bp, D. melanogaster
aaatctatagaaa

SEQ ID NO: 552169 - DNA, 13 bp, D. melanogaster
aaatctatatgta

SEQ ID NO: 552170 - DNA, 13 bp, D. melanogaster
aaatctatctata

SEQ ID NO: 552171 - DNA, 13 bp, D. melanogaster
aaatctatgcaaa

SEQ ID NO: 552172 - DNA, 13 bp, D. melanogaster
aaatctatggaaa

SEQ ID NO: 552173 - DNA, 13 bp, D. melanogaster
aaatctattcaaa

SEQ ID NO: 552174 - DNA, 13 bp, D. melanogaster
aaatctattgttt

SEQ ID NO: 552175 - DNA, 13 bp, D. melanogaster
aaatctatttcaa

SEQ ID NO: 552176 - DNA, 13 bp, D. melanogaster
aaatctatttgaa

SEQ ID NO: 552177 - DNA, 13 bp, D. melanogaster
aaatctatttgca

SEQ ID NO: 552178 - DNA, 13 bp, D. melanogaster
aaatctcaaaatc

SEQ ID NO: 552179 - DNA, 13 bp, D. melanogaster
aaatctcaaatct

SEQ ID NO: 552180 - DNA, 13 bp, D. melanogaster
aaatctcaattaa

SEQ ID NO: 552181 - DNA, 13 bp, D. melanogaster
aaatctcaatttt

SEQ ID NO: 552182 - DNA, 13 bp, D. melanogaster
aaatctcattaaa

SEQ ID NO: 552183 - DNA, 13 bp, D. melanogaster
aaatctccgattg

SEQ ID NO: 552184 - DNA, 13 bp, D. melanogaster
aaatctgaaaaat

SEQ ID NO: 552185 - DNA, 13 bp, D. melanogaster
aaatctgaaaata

SEQ ID NO: 552186 - DNA, 13 bp, D. melanogaster
aaatctgaaaatc

SEQ ID NO: 552187 - DNA, 13 bp, D. melanogaster
aaatctgaaaatg

SEQ ID NO: 552188 - DNA, 13 bp, D. melanogaster
aaatctgaaatat

SEQ ID NO: 552189 - DNA, 13 bp, D. melanogaster
aaatctgaaatct

SEQ ID NO: 552190 - DNA, 13 bp, D. melanogaster
aaatctgaaattt

SEQ ID NO: 552191 - DNA, 13 bp, D. melanogaster
aaatctgaatctg

SEQ ID NO: 552192 - DNA, 13 bp, D. melanogaster
aaatctgaatttt

SEQ ID NO: 552193 - DNA, 13 bp, D. melanogaster
aaatctgcataaa

SEQ ID NO: 552194 - DNA, 13 bp, D. melanogaster
aaatctgcattaa

SEQ ID NO: 552195 - DNA, 13 bp, D. melanogaster
aaatctgcgaaaa

SEQ ID NO: 552196 - DNA, 13 bp, D. melanogaster
aaatctgcttaaa

SEQ ID NO: 552197 - DNA, 13 bp, D. melanogaster
aaatctggaaaat

SEQ ID NO: 552198 - DNA, 13 bp, D. melanogaster
aaatctggccaaa

SEQ ID NO: 552199 - DNA, 13 bp, D. melanogaster
aaatctggctaaa

SEQ ID NO: 552200 - DNA, 13 bp, D. melanogaster
aaatctgtaaata

SEQ ID NO: 552201 - DNA, 13 bp, D. melanogaster
aaatctgtaaatt

SEQ ID NO: 552202 - DNA, 13 bp, D. melanogaster
aaatctgtataaa

SEQ ID NO: 552203 - DNA, 13 bp, D. melanogaster
aaatctgtgaaat

SEQ ID NO: 552204 - DNA, 13 bp, D. melanogaster
aaatctgtgcaaa

SEQ ID NO: 552205 - DNA, 13 bp, D. melanogaster
aaatctgtgcaat

SEQ ID NO: 552206 - DNA, 13 bp, D. melanogaster
aaatctgtgcaca

SEQ ID NO: 552207 - DNA, 13 bp, D. melanogaster
aaatctgttaaaa

SEQ ID NO: 552208 - DNA, 13 bp, D. melanogaster
aaatctgttgaaa

SEQ ID NO: 552209 - DNA, 13 bp, D. melanogaster
aaatctgtttaaa

SEQ ID NO: 552210 - DNA, 13 bp, D. melanogaster
aaatctgtttcaa

SEQ ID NO: 552211 - DNA, 13 bp, D. melanogaster
aaatctgtttgtt

SEQ ID NO: 552212 - DNA, 13 bp, D. melanogaster
aaatctgttttat

SEQ ID NO: 552213 - DNA, 14 bp, D. melanogaster
aaatctgttttttt

SEQ ID NO: 552214 - DNA, 13 bp, D. melanogaster
aaatcttaagaaa

SEQ ID NO: 552215 - DNA, 13 bp, D. melanogaster
aaatcttaatcta

SEQ ID NO: 552216 - DNA, 13 bp, D. melanogaster
aaatcttatcttt

SEQ ID NO: 552217 - DNA, 13 bp, D. melanogaster
aaatcttattttc

SEQ ID NO: 552218 - DNA, 13 bp, D. melanogaster
aaatcttcgaatt

SEQ ID NO: 552219 - DNA, 14 bp, D. melanogaster
aaatcttcgaattt

SEQ ID NO: 552220 - DNA, 15 bp, D. melanogaster
aaatcttctaaagat

SEQ ID NO: 552221 - DNA, 13 bp, D. melanogaster
aaatcttgaaaca

SEQ ID NO: 552222 - DNA, 13 bp, D. melanogaster
aaatcttgaatat

SEQ ID NO: 552223 - DNA, 13 bp, D. melanogaster
aaatcttggaaaa

SEQ ID NO: 552224 - DNA, 13 bp, D. melanogaster
aaatcttggccaa

SEQ ID NO: 552225 - DNA, 13 bp, D. melanogaster
aaatcttggccag

SEQ ID NO: 552226 - DNA, 13 bp, D. melanogaster
aaatcttgggaaa

SEQ ID NO: 552227 - DNA, 13 bp, D. melanogaster
aaatcttgttaaa

SEQ ID NO: 552228 - DNA, 13 bp, D. melanogaster
aaatcttgttttt

SEQ ID NO: 552229 - DNA, 13 bp, D. melanogaster
aaatctttaaaag

SEQ ID NO: 552230 - DNA, 13 bp, D. melanogaster
aaatctttaaatg

SEQ ID NO: 552231 - DNA, 13 bp, D. melanogaster
aaatctttagaaa

SEQ ID NO: 552232 - DNA, 13 bp, D. melanogaster
aaatctttcactt

SEQ ID NO: 552233 - DNA, 13 bp, D. melanogaster
aaatctttctatc

SEQ ID NO: 552234 - DNA, 14 bp, D. melanogaster
aaatctttcttcat

SEQ ID NO: 552235 - DNA, 13 bp, D. melanogaster
aaatctttcttta

SEQ ID NO: 552236 - DNA, 13 bp, D. melanogaster
aaatctttgaaaa

SEQ ID NO: 552237 - DNA, 13 bp, D. melanogaster
aaatctttgaagg

SEQ ID NO: 552238 - DNA, 13 bp, D. melanogaster
aaatctttgaatt

SEQ ID NO: 552239 - DNA, 13 bp, D. melanogaster
aaatctttgattt

SEQ ID NO: 552240 - DNA, 13 bp, D. melanogaster
aaatctttggcaa

SEQ ID NO: 552241 - DNA, 13 bp, D. melanogaster
aaatcttttcaaa

SEQ ID NO: 552242 - DNA, 13 bp, D. melanogaster
aaatcttttgaaa

SEQ ID NO: 552243 - DNA, 14 bp, D. melanogaster
aaatcttttgattt

SEQ ID NO: 552244 - DNA, 13 bp, D. melanogaster
aaatcttttgctt

SEQ ID NO: 552245 - DNA, 14 bp, D. melanogaster
aaatctttttaact

SEQ ID NO: 552246 - DNA, 13 bp, D. melanogaster
aaatctttttgaa

SEQ ID NO: 552247 - DNA, 13 bp, D. melanogaster
aaatgaaaaactc

SEQ ID NO: 552248 - DNA, 13 bp, D. melanogaster
aaatgaaaaactt

SEQ ID NO: 552249 - DNA, 14 bp, D. melanogaster
aaatgaaaaactta

SEQ ID NO: 552250 - DNA, 16 bp, D. melanogaster
aaatgaaaaacttaag

SEQ ID NO: 552251 - DNA, 13 bp, D. melanogaster
aaatgaaaaattc

SEQ ID NO: 552252 - DNA, 14 bp, D. melanogaster
aaatgaaaacaatt

SEQ ID NO: 552253 - DNA, 13 bp, D. melanogaster
aaatgaaaacatt

SEQ ID NO: 552254 - DNA, 14 bp, D. melanogaster
aaatgaaaacatta

SEQ ID NO: 552255 - DNA, 14 bp, D. melanogaster
aaatgaaaacattg

SEQ ID NO: 552256 - DNA, 13 bp, D. melanogaster
aaatgaaaaccac

SEQ ID NO: 552257 - DNA, 13 bp, D. melanogaster
aaatgaaaaccga

SEQ ID NO: 552258 - DNA, 14 bp, D. melanogaster
aaatgaaaaccgaa

SEQ ID NO: 552259 - DNA, 14 bp, D. melanogaster
aaatgaaaacgaat

SEQ ID NO: 552260 - DNA, 13 bp, D. melanogaster
aaatgaaaactca

SEQ ID NO: 552261 - DNA, 13 bp, D. melanogaster
aaatgaaaactga

SEQ ID NO: 552262 - DNA, 13 bp, D. melanogaster
aaatgaaaactgt

SEQ ID NO: 552263 - DNA, 13 bp, D. melanogaster
aaatgaaaacttt

SEQ ID NO: 552264 - DNA, 13 bp, D. melanogaster
aaatgaaaagcga

SEQ ID NO: 552265 - DNA, 14 bp, D. melanogaster
aaatgaaaagcgaa

SEQ ID NO: 552266 - DNA, 13 bp, D. melanogaster
aaatgaaaagcgc

SEQ ID NO: 552267 - DNA, 13 bp, D. melanogaster
aaatgaaaagctc

SEQ ID NO: 552268 - DNA, 13 bp, D. melanogaster
aaatgaaaagtgt

SEQ ID NO: 552269 - DNA, 13 bp, D. melanogaster
aaatgaaaagttt

SEQ ID NO: 552270 - DNA, 14 bp, D. melanogaster
aaatgaaaagtttt

SEQ ID NO: 552271 - DNA, 14 bp, D. melanogaster
aaatgaaaatcaag

SEQ ID NO: 552272 - DNA, 13 bp, D. melanogaster
aaatgaaaatcga

SEQ ID NO: 552273 - DNA, 14 bp, D. melanogaster
aaatgaaaatcgaa

SEQ ID NO: 552274 - DNA, 13 bp, D. melanogaster
aaatgaaaatcgt

SEQ ID NO: 552275 - DNA, 14 bp, D. melanogaster
aaatgaaaatgaac

SEQ ID NO: 552276 - DNA, 13 bp, D. melanogaster
aaatgaaaatgac

SEQ ID NO: 552277 - DNA, 13 bp, D. melanogaster
aaatgaaaatgca

SEQ ID NO: 552278 - DNA, 14 bp, D. melanogaster
aaatgaaaatgctt

SEQ ID NO: 552279 - DNA, 14 bp, D. melanogaster
aaatgaaaatgttt

SEQ ID NO: 552280 - DNA, 13 bp, D. melanogaster
aaatgaaaattca

SEQ ID NO: 552281 - DNA, 14 bp, D. melanogaster
aaatgaaaattcat

SEQ ID NO: 552282 - DNA, 13 bp, D. melanogaster
aaatgaaaattcc

SEQ ID NO: 552283 - DNA, 13 bp, D. melanogaster
aaatgaaaattgc

SEQ ID NO: 552284 - DNA, 14 bp, D. melanogaster
aaatgaaaattgca

SEQ ID NO: 552285 - DNA, 14 bp, D. melanogaster
aaatgaaaattgct

SEQ ID NO: 552286 - DNA, 13 bp, D. melanogaster
aaatgaaaattgt

SEQ ID NO: 552287 - DNA, 13 bp, D. melanogaster
aaatgaaaatttc

SEQ ID NO: 552288 - DNA, 14 bp, D. melanogaster
aaatgaaaatttca

SEQ ID NO: 552289 - DNA, 13 bp, D. melanogaster
aaatgaaacatat

SEQ ID NO: 552290 - DNA, 13 bp, D. melanogaster
aaatgaaacattc

SEQ ID NO: 552291 - DNA, 14 bp, D. melanogaster
aaatgaaacatttt

SEQ ID NO: 552292 - DNA, 13 bp, D. melanogaster
aaatgaaaccaac

SEQ ID NO: 552293 - DNA, 13 bp, D. melanogaster
aaatgaaaccaat

SEQ ID NO: 552294 - DNA, 13 bp, D. melanogaster
aaatgaaacccaa

SEQ ID NO: 552295 - DNA, 14 bp, D. melanogaster
aaatgaaacccaaa

SEQ ID NO: 552296 - DNA, 13 bp, D. melanogaster
aaatgaaacccga

SEQ ID NO: 552297 - DNA, 14 bp, D. melanogaster
aaatgaaaccgaaa

SEQ ID NO: 552298 - DNA, 14 bp, D. melanogaster
aaatgaaacgaaat

SEQ ID NO: 552299 - DNA, 13 bp, D. melanogaster
aaatgaaacgaag

SEQ ID NO: 552300 - DNA, 13 bp, D. melanogaster
aaatgaaacgaat

SEQ ID NO: 552301 - DNA, 13 bp, D. melanogaster
aaatgaaacgcaa

SEQ ID NO: 552302 - DNA, 13 bp, D. melanogaster
aaatgaaacgttt

SEQ ID NO: 552303 - DNA, 13 bp, D. melanogaster
aaatgaaactcaa

SEQ ID NO: 552304 - DNA, 13 bp, D. melanogaster
aaatgaaactgaa

SEQ ID NO: 552305 - DNA, 14 bp, D. melanogaster
aaatgaaactgaaa

SEQ ID NO: 552306 - DNA, 13 bp, D. melanogaster
aaatgaaactgca

SEQ ID NO: 552307 - DNA, 13 bp, D. melanogaster
aaatgaaactgtt

SEQ ID NO: 552308 - DNA, 13 bp, D. melanogaster
aaatgaaacttaa

SEQ ID NO: 552309 - DNA, 13 bp, D. melanogaster
aaatgaaacttat

SEQ ID NO: 552310 - DNA, 13 bp, D. melanogaster
aaatgaaacttca

SEQ ID NO: 552311 - DNA, 13 bp, D. melanogaster
aaatgaaacttta

SEQ ID NO: 552312 - DNA, 13 bp, D. melanogaster
aaatgaaagattt

SEQ ID NO: 552313 - DNA, 14 bp, D. melanogaster
aaatgaaagcaaat

SEQ ID NO: 552314 - DNA, 13 bp, D. melanogaster
aaatgaaagcaac

SEQ ID NO: 552315 - DNA, 13 bp, D. melanogaster
aaatgaaagcaat

SEQ ID NO: 552316 - DNA, 13 bp, D. melanogaster
aaatgaaagcatt

SEQ ID NO: 552317 - DNA, 13 bp, D. melanogaster
aaatgaaagccaa

SEQ ID NO: 552318 - DNA, 13 bp, D. melanogaster
aaatgaaagccac

SEQ ID NO: 552319 - DNA, 14 bp, D. melanogaster
aaatgaaagcgaaa

SEQ ID NO: 552320 - DNA, 13 bp, D. melanogaster
aaatgaaagtgtt

SEQ ID NO: 552321 - DNA, 13 bp, D. melanogaster
aaatgaaagttgt

SEQ ID NO: 552322 - DNA, 13 bp, D. melanogaster
aaatgaaatacca

SEQ ID NO: 552323 - DNA, 13 bp, D. melanogaster
aaatgaaatagtt

SEQ ID NO: 552324 - DNA, 13 bp, D. melanogaster
aaatgaaatatgt

SEQ ID NO: 552325 - DNA, 13 bp, D. melanogaster
aaatgaaatattg

SEQ ID NO: 552326 - DNA, 14 bp, D. melanogaster
aaatgaaatatttg

SEQ ID NO: 552327 - DNA, 14 bp, D. melanogaster
aaatgaaatcaaat

SEQ ID NO: 552328 - DNA, 13 bp, D. melanogaster
aaatgaaatcata

SEQ ID NO: 552329 - DNA, 14 bp, D. melanogaster
aaatgaaatcgaaa

SEQ ID NO: 552330 - DNA, 13 bp, D. melanogaster
aaatgaaatcgat

SEQ ID NO: 552331 - DNA, 13 bp, D. melanogaster
aaatgaaatcgtt

SEQ ID NO: 552332 - DNA, 13 bp, D. melanogaster
aaatgaaatctgc

SEQ ID NO: 552333 - DNA, 14 bp, D. melanogaster
aaatgaaatgaaca

SEQ ID NO: 552334 - DNA, 13 bp, D. melanogaster
aaatgaaatgagc

SEQ ID NO: 552335 - DNA, 14 bp, D. melanogaster
aaatgaaatgattt

SEQ ID NO: 552336 - DNA, 13 bp, D. melanogaster
aaatgaaatgcaa

SEQ ID NO: 552337 - DNA, 14 bp, D. melanogaster
aaatgaaatgcaat

SEQ ID NO: 552338 - DNA, 13 bp, D. melanogaster
aaatgaaatgcat

SEQ ID NO: 552339 - DNA, 14 bp, D. melanogaster
aaatgaaatgcata

SEQ ID NO: 552340 - DNA, 13 bp, D. melanogaster
aaatgaaatgcga

SEQ ID NO: 552341 - DNA, 14 bp, D. melanogaster
aaatgaaatggaat

SEQ ID NO: 552342 - DNA, 13 bp, D. melanogaster
aaatgaaatggca

SEQ ID NO: 552343 - DNA, 13 bp, D. melanogaster
aaatgaaatgtgt

SEQ ID NO: 552344 - DNA, 13 bp, D. melanogaster
aaatgaaatgttt

SEQ ID NO: 552345 - DNA, 13 bp, D. melanogaster
aaatgaaattcat

SEQ ID NO: 552346 - DNA, 14 bp, D. melanogaster
aaatgaaattcatt

SEQ ID NO: 552347 - DNA, 13 bp, D. melanogaster
aaatgaaattcca

SEQ ID NO: 552348 - DNA, 13 bp, D. melanogaster
aaatgaaattctt

SEQ ID NO: 552349 - DNA, 13 bp, D. melanogaster
aaatgaaattgag

SEQ ID NO: 552350 - DNA, 14 bp, D. melanogaster
aaatgaaattgcaa

SEQ ID NO: 552351 - DNA, 13 bp, D. melanogaster
aaatgaaattggt

SEQ ID NO: 552352 - DNA, 14 bp, D. melanogaster
aaatgaaattgttt

SEQ ID NO: 552353 - DNA, 13 bp, D. melanogaster
aaatgaaatttac

SEQ ID NO: 552354 - DNA, 13 bp, D. melanogaster
aaatgaacaaatt

SEQ ID NO: 552355 - DNA, 13 bp, D. melanogaster
aaatgaacaatga

SEQ ID NO: 552356 - DNA, 13 bp, D. melanogaster
aaatgaacaatta

SEQ ID NO: 552357 - DNA, 13 bp, D. melanogaster
aaatgaacaattg

SEQ ID NO: 552358 - DNA, 13 bp, D. melanogaster
aaatgaacacaca

SEQ ID NO: 552359 - DNA, 13 bp, D. melanogaster
aaatgaacacatt

SEQ ID NO: 552360 - DNA, 13 bp, D. melanogaster
aaatgaacatgaa

SEQ ID NO: 552361 - DNA, 13 bp, D. melanogaster
aaatgaacattaa

SEQ ID NO: 552362 - DNA, 13 bp, D. melanogaster
aaatgaacatttt

SEQ ID NO: 552363 - DNA, 13 bp, D. melanogaster
aaatgaacggaaa

SEQ ID NO: 552364 - DNA, 13 bp, D. melanogaster
aaatgaactaaat

SEQ ID NO: 552365 - DNA, 13 bp, D. melanogaster
aaatgaactcaaa

SEQ ID NO: 552366 - DNA, 13 bp, D. melanogaster
aaatgaactgaat

SEQ ID NO: 552367 - DNA, 13 bp, D. melanogaster
aaatgaactttaa

SEQ ID NO: 552368 - DNA, 13 bp, D. melanogaster
aaatgaacttttc

SEQ ID NO: 552369 - DNA, 13 bp, D. melanogaster
aaatgaagagcaa

SEQ ID NO: 552370 - DNA, 13 bp, D. melanogaster
aaatgaagagcag

SEQ ID NO: 552371 - DNA, 13 bp, D. melanogaster
aaatgaagcaaat

SEQ ID NO: 552372 - DNA, 13 bp, D. melanogaster
aaatgaagcagaa

SEQ ID NO: 552373 - DNA, 13 bp, D. melanogaster
aaatgaagcgaaa

SEQ ID NO: 552374 - DNA, 13 bp, D. melanogaster
aaatgaagcgaat

SEQ ID NO: 552375 - DNA, 13 bp, D. melanogaster
aaatgaagcgcaa

SEQ ID NO: 552376 - DNA, 13 bp, D. melanogaster
aaatgaagctaaa

SEQ ID NO: 552377 - DNA, 13 bp, D. melanogaster
aaatgaaggcaaa

SEQ ID NO: 552378 - DNA, 13 bp, D. melanogaster
aaatgaagtaatt

SEQ ID NO: 552379 - DNA, 13 bp, D. melanogaster
aaatgaagtcatt

SEQ ID NO: 552380 - DNA, 13 bp, D. melanogaster
aaatgaagtgaag

SEQ ID NO: 552381 - DNA, 13 bp, D. melanogaster
aaatgaagtgaat

SEQ ID NO: 552382 - DNA, 14 bp, D. melanogaster
aaatgaagtgcaaa

SEQ ID NO: 552383 - DNA, 13 bp, D. melanogaster
aaatgaagtggca

SEQ ID NO: 552384 - DNA, 13 bp, D. melanogaster
aaatgaagttatt

SEQ ID NO: 552385 - DNA, 13 bp, D. melanogaster
aaatgaagttgca

SEQ ID NO: 552386 - DNA, 13 bp, D. melanogaster
aaatgaagttgta

SEQ ID NO: 552387 - DNA, 13 bp, D. melanogaster
aaatgaagtttta

SEQ ID NO: 552388 - DNA, 13 bp, D. melanogaster
aaatgaataaggt

SEQ ID NO: 552389 - DNA, 13 bp, D. melanogaster
aaatgaataagtt

SEQ ID NO: 552390 - DNA, 13 bp, D. melanogaster
aaatgaataattg

SEQ ID NO: 552391 - DNA, 14 bp, D. melanogaster
aaatgaatacaaat

SEQ ID NO: 552392 - DNA, 13 bp, D. melanogaster
aaatgaatacaat

SEQ ID NO: 552393 - DNA, 13 bp, D. melanogaster
aaatgaatacata

SEQ ID NO: 552394 - DNA, 13 bp, D. melanogaster
aaatgaatacatt

SEQ ID NO: 552395 - DNA, 13 bp, D. melanogaster
aaatgaatacgaa

SEQ ID NO: 552396 - DNA, 13 bp, D. melanogaster
aaatgaatactta

SEQ ID NO: 552397 - DNA, 13 bp, D. melanogaster
aaatgaatacttt

SEQ ID NO: 552398 - DNA, 13 bp, D. melanogaster
aaatgaatagttt

SEQ ID NO: 552399 - DNA, 13 bp, D. melanogaster
aaatgaatataca

SEQ ID NO: 552400 - DNA, 13 bp, D. melanogaster
aaatgaatcaaat

SEQ ID NO: 552401 - DNA, 13 bp, D. melanogaster
aaatgaatcccga

SEQ ID NO: 552402 - DNA, 13 bp, D. melanogaster
aaatgaatcgaaa

SEQ ID NO: 552403 - DNA, 14 bp, D. melanogaster
aaatgaatcgagag

SEQ ID NO: 552404 - DNA, 13 bp, D. melanogaster
aaatgaatctgaa

SEQ ID NO: 552405 - DNA, 13 bp, D. melanogaster
aaatgaatcttaa

SEQ ID NO: 552406 - DNA, 13 bp, D. melanogaster
aaatgaatgatga

SEQ ID NO: 552407 - DNA, 13 bp, D. melanogaster
aaatgaatgatta

SEQ ID NO: 552408 - DNA, 13 bp, D. melanogaster
aaatgaatgattt

SEQ ID NO: 552409 - DNA, 13 bp, D. melanogaster
aaatgaatgcaaa

SEQ ID NO: 552410 - DNA, 14 bp, D. melanogaster
aaatgaatgcaaaa

SEQ ID NO: 552411 - DNA, 14 bp, D. melanogaster
aaatgaatgcaaat

SEQ ID NO: 552412 - DNA, 14 bp, D. melanogaster
aaatgaatgcaatt

SEQ ID NO: 552413 - DNA, 14 bp, D. melanogaster
aaatgaatgcattt

SEQ ID NO: 552414 - DNA, 13 bp, D. melanogaster
aaatgaatgcgaa

SEQ ID NO: 552415 - DNA, 13 bp, D. melanogaster
aaatgaatgctaa

SEQ ID NO: 552416 - DNA, 13 bp, D. melanogaster
aaatgaatgcttt

SEQ ID NO: 552417 - DNA, 14 bp, D. melanogaster
aaatgaatggaaat

SEQ ID NO: 552418 - DNA, 13 bp, D. melanogaster
aaatgaatggaat

SEQ ID NO: 552419 - DNA, 13 bp, D. melanogaster
aaatgaatgtata

SEQ ID NO: 552420 - DNA, 13 bp, D. melanogaster
aaatgaatgtatt

SEQ ID NO: 552421 - DNA, 13 bp, D. melanogaster
aaatgaatgtcaa

SEQ ID NO: 552422 - DNA, 13 bp, D. melanogaster
aaatgaatgtgtc

SEQ ID NO: 552423 - DNA, 13 bp, D. melanogaster
aaatgaatgtgtt

SEQ ID NO: 552424 - DNA, 13 bp, D. melanogaster
aaatgaatgttaa

SEQ ID NO: 552425 - DNA, 13 bp, D. melanogaster
aaatgaatgtttt

SEQ ID NO: 552426 - DNA, 13 bp, D. melanogaster
aaatgaattaagt

SEQ ID NO: 552427 - DNA, 13 bp, D. melanogaster
aaatgaattacaa

SEQ ID NO: 552428 - DNA, 13 bp, D. melanogaster
aaatgaattcaat

SEQ ID NO: 552429 - DNA, 13 bp, D. melanogaster
aaatgaattcctt

SEQ ID NO: 552430 - DNA, 13 bp, D. melanogaster
aaatgaattctat

SEQ ID NO: 552431 - DNA, 13 bp, D. melanogaster
aaatgaattgaac

SEQ ID NO: 552432 - DNA, 14 bp, D. melanogaster
aaatgaattgaatt

SEQ ID NO: 552433 - DNA, 13 bp, D. melanogaster
aaatgaattgcaa

SEQ ID NO: 552434 - DNA, 13 bp, D. melanogaster
aaatgaattggtt

SEQ ID NO: 552435 - DNA, 13 bp, D. melanogaster
aaatgaatttaac

SEQ ID NO: 552436 - DNA, 13 bp, D. melanogaster
aaatgaatttaca

SEQ ID NO: 552437 - DNA, 14 bp, D. melanogaster
aaatgaatttacat

SEQ ID NO: 552438 - DNA, 13 bp, D. melanogaster
aaatgaatttcaa

SEQ ID NO: 552439 - DNA, 14 bp, D. melanogaster
aaatgaatttcaaa

SEQ ID NO: 552440 - DNA, 14 bp, D. melanogaster
aaatgaatttcatt

SEQ ID NO: 552441 - DNA, 13 bp, D. melanogaster
aaatgaatttcgc

SEQ ID NO: 552442 - DNA, 13 bp, D. melanogaster
aaatgaatttctt

SEQ ID NO: 552443 - DNA, 14 bp, D. melanogaster
aaatgaatttcttt

SEQ ID NO: 552444 - DNA, 13 bp, D. melanogaster
aaatgaattttgt

SEQ ID NO: 552445 - DNA, 13 bp, D. melanogaster
aaatgaatttttc

SEQ ID NO: 552446 - DNA, 13 bp, D. melanogaster
aaatgacaaacag

SEQ ID NO: 552447 - DNA, 14 bp, D. melanogaster
aaatgacaaaggca

SEQ ID NO: 552448 - DNA, 13 bp, D. melanogaster
aaatgacaaatgc

SEQ ID NO: 552449 - DNA, 13 bp, D. melanogaster
aaatgacaaatgt

SEQ ID NO: 552450 - DNA, 13 bp, D. melanogaster
aaatgacactttt

SEQ ID NO: 552451 - DNA, 13 bp, D. melanogaster
aaatgacagcaaa

SEQ ID NO: 552452 - DNA, 13 bp, D. melanogaster
aaatgacagccaa

SEQ ID NO: 552453 - DNA, 13 bp, D. melanogaster
aaatgacagcgaa

SEQ ID NO: 552454 - DNA, 13 bp, D. melanogaster
aaatgacagtttt

SEQ ID NO: 552455 - DNA, 13 bp, D. melanogaster
aaatgaccacaac

SEQ ID NO: 552456 - DNA, 13 bp, D. melanogaster
aaatgacccagtt

SEQ ID NO: 552457 - DNA, 13 bp, D. melanogaster
aaatgactgatgt

SEQ ID NO: 552458 - DNA, 13 bp, D. melanogaster
aaatgactgcaat

SEQ ID NO: 552459 - DNA, 13 bp, D. melanogaster
aaatgacttaata

SEQ ID NO: 552460 - DNA, 13 bp, D. melanogaster
aaatgacttcatt

SEQ ID NO: 552461 - DNA, 13 bp, D. melanogaster
aaatgactttaat

SEQ ID NO: 552462 - DNA, 13 bp, D. melanogaster
aaatgagaaaatc

SEQ ID NO: 552463 - DNA, 13 bp, D. melanogaster
aaatgagaaatgg

SEQ ID NO: 552464 - DNA, 13 bp, D. melanogaster
aaatgagaaatgt

SEQ ID NO: 552465 - DNA, 13 bp, D. melanogaster
aaatgagaacttt

SEQ ID NO: 552466 - DNA, 13 bp, D. melanogaster
aaatgagaagact

SEQ ID NO: 552467 - DNA, 13 bp, D. melanogaster
aaatgagaattta

SEQ ID NO: 552468 - DNA, 13 bp, D. melanogaster
aaatgagagcaaa

SEQ ID NO: 552469 - DNA, 13 bp, D. melanogaster
aaatgagatgaga

SEQ ID NO: 552470 - DNA, 13 bp, D. melanogaster
aaatgagatggaa

SEQ ID NO: 552471 - DNA, 13 bp, D. melanogaster
aaatgagatttaa

SEQ ID NO: 552472 - DNA, 13 bp, D. melanogaster
aaatgagatttca

SEQ ID NO: 552473 - DNA, 13 bp, D. melanogaster
aaatgagatttgc

SEQ ID NO: 552474 - DNA, 13 bp, D. melanogaster
aaatgagattttc

SEQ ID NO: 552475 - DNA, 14 bp, D. melanogaster
aaatgagcaaaaat

SEQ ID NO: 552476 - DNA, 13 bp, D. melanogaster
aaatgagcaaaca

SEQ ID NO: 552477 - DNA, 13 bp, D. melanogaster
aaatgagcaaatg

SEQ ID NO: 552478 - DNA, 13 bp, D. melanogaster
aaatgagcaaatt

SEQ ID NO: 552479 - DNA, 13 bp, D. melanogaster
aaatgagcaataa

SEQ ID NO: 552480 - DNA, 13 bp, D. melanogaster
aaatgagcaattt

SEQ ID NO: 552481 - DNA, 13 bp, D. melanogaster
aaatgagcagaaa

SEQ ID NO: 552482 - DNA, 13 bp, D. melanogaster
aaatgagcagcaa

SEQ ID NO: 552483 - DNA, 13 bp, D. melanogaster
aaatgagcagcag

SEQ ID NO: 552484 - DNA, 13 bp, D. melanogaster
aaatgagccaaaa

SEQ ID NO: 552485 - DNA, 13 bp, D. melanogaster
aaatgagccacat

SEQ ID NO: 552486 - DNA, 13 bp, D. melanogaster
aaatgagcgaaat

SEQ ID NO: 552487 - DNA, 13 bp, D. melanogaster
aaatgagctaaat

SEQ ID NO: 552488 - DNA, 13 bp, D. melanogaster
aaatgagctaatt

SEQ ID NO: 552489 - DNA, 13 bp, D. melanogaster
aaatgagctgaaa

SEQ ID NO: 552490 - DNA, 14 bp, D. melanogaster
aaatgagcttcaaa

SEQ ID NO: 552491 - DNA, 13 bp, D. melanogaster
aaatgaggaaatc

SEQ ID NO: 552492 - DNA, 13 bp, D. melanogaster
aaatgaggcaaaa

SEQ ID NO: 552493 - DNA, 13 bp, D. melanogaster
aaatgagtatgca

SEQ ID NO: 552494 - DNA, 13 bp, D. melanogaster
aaatgagtggaaa

SEQ ID NO: 552495 - DNA, 13 bp, D. melanogaster
aaatgagttgaaa

SEQ ID NO: 552496 - DNA, 13 bp, D. melanogaster
aaatgagttgagt

SEQ ID NO: 552497 - DNA, 13 bp, D. melanogaster
aaatgagtttaaa

SEQ ID NO: 552498 - DNA, 13 bp, D. melanogaster
aaatgagtttata

SEQ ID NO: 552499 - DNA, 13 bp, D. melanogaster
aaatgagtttgaa

SEQ ID NO: 552500 - DNA, 13 bp, D. melanogaster
aaatgagttttcc

SEQ ID NO: 552501 - DNA, 13 bp, D. melanogaster
aaatgagtttttt

SEQ ID NO: 552502 - DNA, 13 bp, D. melanogaster
aaatgataaaacg

SEQ ID NO: 552503 - DNA, 13 bp, D. melanogaster
aaatgataaatgt

SEQ ID NO: 552504 - DNA, 13 bp, D. melanogaster
aaatgataagttt

SEQ ID NO: 552505 - DNA, 13 bp, D. melanogaster
aaatgataatgat

SEQ ID NO: 552506 - DNA, 13 bp, D. melanogaster
aaatgatagtaac

SEQ ID NO: 552507 - DNA, 13 bp, D. melanogaster
aaatgatatacat

SEQ ID NO: 552508 - DNA, 13 bp, D. melanogaster
aaatgatatatac

SEQ ID NO: 552509 - DNA, 13 bp, D. melanogaster
aaatgatatgcaa

SEQ ID NO: 552510 - DNA, 13 bp, D. melanogaster
aaatgatatgtat

SEQ ID NO: 552511 - DNA, 13 bp, D. melanogaster
aaatgatattgat

SEQ ID NO: 552512 - DNA, 13 bp, D. melanogaster
aaatgatatttca

SEQ ID NO: 552513 - DNA, 14 bp, D. melanogaster
aaatgatcaaaaat

SEQ ID NO: 552514 - DNA, 13 bp, D. melanogaster
aaatgatcaaata

SEQ ID NO: 552515 - DNA, 13 bp, D. melanogaster
aaatgatcaaatt

SEQ ID NO: 552516 - DNA, 13 bp, D. melanogaster
aaatgatcggaga

SEQ ID NO: 552517 - DNA, 13 bp, D. melanogaster
aaatgatcttaac

SEQ ID NO: 552518 - DNA, 13 bp, D. melanogaster
aaatgatgatgat

SEQ ID NO: 552519 - DNA, 13 bp, D. melanogaster
aaatgatgatgtt

SEQ ID NO: 552520 - DNA, 13 bp, D. melanogaster
aaatgatgatttt

SEQ ID NO: 552521 - DNA, 13 bp, D. melanogaster
aaatgatgcaaat

SEQ ID NO: 552522 - DNA, 13 bp, D. melanogaster
aaatgatggaaat

SEQ ID NO: 552523 - DNA, 13 bp, D. melanogaster
aaatgatggcata

SEQ ID NO: 552524 - DNA, 13 bp, D. melanogaster
aaatgatggccat

SEQ ID NO: 552525 - DNA, 13 bp, D. melanogaster
aaatgatgtgaaa

SEQ ID NO: 552526 - DNA, 13 bp, D. melanogaster
aaatgattaagga

SEQ ID NO: 552527 - DNA, 13 bp, D. melanogaster
aaatgattacaat

SEQ ID NO: 552528 - DNA, 13 bp, D. melanogaster
aaatgattagttt

SEQ ID NO: 552529 - DNA, 13 bp, D. melanogaster
aaatgattcaaaa

SEQ ID NO: 552530 - DNA, 13 bp, D. melanogaster
aaatgattcaaat

SEQ ID NO: 552531 - DNA, 13 bp, D. melanogaster
aaatgattcaatt

SEQ ID NO: 552532 - DNA, 13 bp, D. melanogaster
aaatgattgcaaa

SEQ ID NO: 552533 - DNA, 13 bp, D. melanogaster
aaatgattgcaat

SEQ ID NO: 552534 - DNA, 13 bp, D. melanogaster
aaatgattgcttt

SEQ ID NO: 552535 - DNA, 13 bp, D. melanogaster
aaatgattgttta

SEQ ID NO: 552536 - DNA, 13 bp, D. melanogaster
aaatgattgtttt

SEQ ID NO: 552537 - DNA, 13 bp, D. melanogaster
aaatgatttaaag

SEQ ID NO: 552538 - DNA, 13 bp, D. melanogaster
aaatgatttaaga

SEQ ID NO: 552539 - DNA, 14 bp, D. melanogaster
aaatgatttaattg

SEQ ID NO: 552540 - DNA, 13 bp, D. melanogaster
aaatgatttacaa

SEQ ID NO: 552541 - DNA, 13 bp, D. melanogaster
aaatgatttacat

SEQ ID NO: 552542 - DNA, 13 bp, D. melanogaster
aaatgatttatgc

SEQ ID NO: 552543 - DNA, 13 bp, D. melanogaster
aaatgatttatgg

SEQ ID NO: 552544 - DNA, 13 bp, D. melanogaster
aaatgatttccaa

SEQ ID NO: 552545 - DNA, 13 bp, D. melanogaster
aaatgatttccat

SEQ ID NO: 552546 - DNA, 13 bp, D. melanogaster
aaatgatttccca

SEQ ID NO: 552547 - DNA, 13 bp, D. melanogaster
aaatgatttcgtt

SEQ ID NO: 552548 - DNA, 13 bp, D. melanogaster
aaatgatttgaat

SEQ ID NO: 552549 - DNA, 13 bp, D. melanogaster
aaatgatttggaa

SEQ ID NO: 552550 - DNA, 13 bp, D. melanogaster
aaatgatttgtta

SEQ ID NO: 552551 - DNA, 13 bp, D. melanogaster
aaatgatttgttg

SEQ ID NO: 552552 - DNA, 13 bp, D. melanogaster
aaatgatttgttt

SEQ ID NO: 552553 - DNA, 13 bp, D. melanogaster
aaatgattttagc

SEQ ID NO: 552554 - DNA, 13 bp, D. melanogaster
aaatgattttatg

SEQ ID NO: 552555 - DNA, 13 bp, D. melanogaster
aaatgattttcaa

SEQ ID NO: 552556 - DNA, 13 bp, D. melanogaster
aaatgattttcca

SEQ ID NO: 552557 - DNA, 14 bp, D. melanogaster
aaatgattttgaaa

SEQ ID NO: 552558 - DNA, 13 bp, D. melanogaster
aaatgattttgag

SEQ ID NO: 552559 - DNA, 13 bp, D. melanogaster
aaatgattttgat

SEQ ID NO: 552560 - DNA, 13 bp, D. melanogaster
aaatgattttgca

SEQ ID NO: 552561 - DNA, 13 bp, D. melanogaster
aaatgattttgta

SEQ ID NO: 552562 - DNA, 13 bp, D. melanogaster
aaatgatttttgg

SEQ ID NO: 552563 - DNA, 13 bp, D. melanogaster
aaatgcaaaaact

SEQ ID NO: 552564 - DNA, 13 bp, D. melanogaster
aaatgcaaaaagg

SEQ ID NO: 552565 - DNA, 13 bp, D. melanogaster
aaatgcaaaaagt

SEQ ID NO: 552566 - DNA, 13 bp, D. melanogaster
aaatgcaaaaatt

SEQ ID NO: 552567 - DNA, 14 bp, D. melanogaster
aaatgcaaaacaat

SEQ ID NO: 552568 - DNA, 13 bp, D. melanogaster
aaatgcaaaacta

SEQ ID NO: 552569 - DNA, 14 bp, D. melanogaster
aaatgcaaaacttt

SEQ ID NO: 552570 - DNA, 13 bp, D. melanogaster
aaatgcaaaagag

SEQ ID NO: 552571 - DNA, 13 bp, D. melanogaster
aaatgcaaaagat

SEQ ID NO: 552572 - DNA, 13 bp, D. melanogaster
aaatgcaaaagcc

SEQ ID NO: 552573 - DNA, 13 bp, D. melanogaster
aaatgcaaaagcg

SEQ ID NO: 552574 - DNA, 13 bp, D. melanogaster
aaatgcaaaaggc

SEQ ID NO: 552575 - DNA, 13 bp, D. melanogaster
aaatgcaaaagta

SEQ ID NO: 552576 - DNA, 13 bp, D. melanogaster
aaatgcaaaagtt

SEQ ID NO: 552577 - DNA, 14 bp, D. melanogaster
aaatgcaaaatatt

SEQ ID NO: 552578 - DNA, 13 bp, D. melanogaster
aaatgcaaaatga

SEQ ID NO: 552579 - DNA, 14 bp, D. melanogaster
aaatgcaaaatgca

SEQ ID NO: 552580 - DNA, 13 bp, D. melanogaster
aaatgcaaaatgg

SEQ ID NO: 552581 - DNA, 14 bp, D. melanogaster
aaatgcaaacaaat

SEQ ID NO: 552582 - DNA, 13 bp, D. melanogaster
aaatgcaaacaat

SEQ ID NO: 552583 - DNA, 13 bp, D. melanogaster
aaatgcaaacaga

SEQ ID NO: 552584 - DNA, 14 bp, D. melanogaster
aaatgcaaacagaa

SEQ ID NO: 552585 - DNA, 14 bp, D. melanogaster
aaatgcaaacataa

SEQ ID NO: 552586 - DNA, 13 bp, D. melanogaster
aaatgcaaacgaa

SEQ ID NO: 552587 - DNA, 14 bp, D. melanogaster
aaatgcaaacgaaa

SEQ ID NO: 552588 - DNA, 13 bp, D. melanogaster
aaatgcaaacgat

SEQ ID NO: 552589 - DNA, 13 bp, D. melanogaster
aaatgcaaacgca

SEQ ID NO: 552590 - DNA, 13 bp, D. melanogaster
aaatgcaaacgga

SEQ ID NO: 552591 - DNA, 13 bp, D. melanogaster
aaatgcaaactgc

SEQ ID NO: 552592 - DNA, 13 bp, D. melanogaster
aaatgcaaactgt

SEQ ID NO: 552593 - DNA, 13 bp, D. melanogaster
aaatgcaaacttg

SEQ ID NO: 552594 - DNA, 13 bp, D. melanogaster
aaatgcaaacttt

SEQ ID NO: 552595 - DNA, 14 bp, D. melanogaster
aaatgcaaagcaaa

SEQ ID NO: 552596 - DNA, 13 bp, D. melanogaster
aaatgcaaagcag

SEQ ID NO: 552597 - DNA, 13 bp, D. melanogaster
aaatgcaaagcat

SEQ ID NO: 552598 - DNA, 13 bp, D. melanogaster
aaatgcaaagcca

SEQ ID NO: 552599 - DNA, 14 bp, D. melanogaster
aaatgcaaaggaaa

SEQ ID NO: 552600 - DNA, 13 bp, D. melanogaster
aaatgcaaaggca

SEQ ID NO: 552601 - DNA, 13 bp, D. melanogaster
aaatgcaaagtca

SEQ ID NO: 552602 - DNA, 13 bp, D. melanogaster
aaatgcaaagttt

SEQ ID NO: 552603 - DNA, 14 bp, D. melanogaster
aaatgcaaataaac

SEQ ID NO: 552604 - DNA, 14 bp, D. melanogaster
aaatgcaaataaat

SEQ ID NO: 552605 - DNA, 13 bp, D. melanogaster
aaatgcaaataag

SEQ ID NO: 552606 - DNA, 13 bp, D. melanogaster
aaatgcaaatata

SEQ ID NO: 552607 - DNA, 14 bp, D. melanogaster
aaatgcaaatataa

SEQ ID NO: 552608 - DNA, 13 bp, D. melanogaster
aaatgcaaatatt

SEQ ID NO: 552609 - DNA, 13 bp, D. melanogaster
aaatgcaaatcaa

SEQ ID NO: 552610 - DNA, 14 bp, D. melanogaster
aaatgcaaatcaaa

SEQ ID NO: 552611 - DNA, 14 bp, D. melanogaster
aaatgcaaatcaat

SEQ ID NO: 552612 - DNA, 13 bp, D. melanogaster
aaatgcaaatcga

SEQ ID NO: 552613 - DNA, 14 bp, D. melanogaster
aaatgcaaatcgaa

SEQ ID NO: 552614 - DNA, 13 bp, D. melanogaster
aaatgcaaatgaa

SEQ ID NO: 552615 - DNA, 14 bp, D. melanogaster
aaatgcaaatgaaa

SEQ ID NO: 552616 - DNA, 13 bp, D. melanogaster
aaatgcaaatgca

SEQ ID NO: 552617 - DNA, 13 bp, D. melanogaster
aaatgcaaatgcc

SEQ ID NO: 552618 - DNA, 13 bp, D. melanogaster
aaatgcaaatgcg

SEQ ID NO: 552619 - DNA, 14 bp, D. melanogaster
aaatgcaaatgcga

SEQ ID NO: 552620 - DNA, 13 bp, D. melanogaster
aaatgcaaatgct

SEQ ID NO: 552621 - DNA, 14 bp, D. melanogaster
aaatgcaaatgcta

SEQ ID NO: 552622 - DNA, 14 bp, D. melanogaster
aaatgcaaatggaa

SEQ ID NO: 552623 - DNA, 13 bp, D. melanogaster
aaatgcaaatggc

SEQ ID NO: 552624 - DNA, 14 bp, D. melanogaster
aaatgcaaatggca

SEQ ID NO: 552625 - DNA, 13 bp, D. melanogaster
aaatgcaaatgta

SEQ ID NO: 552626 - DNA, 13 bp, D. melanogaster
aaatgcaaattaa

SEQ ID NO: 552627 - DNA, 14 bp, D. melanogaster
aaatgcaaattaaa

SEQ ID NO: 552628 - DNA, 13 bp, D. melanogaster
aaatgcaaattca

SEQ ID NO: 552629 - DNA, 14 bp, D. melanogaster
aaatgcaaattcaa

SEQ ID NO: 552630 - DNA, 14 bp, D. melanogaster
aaatgcaaattgaa

SEQ ID NO: 552631 - DNA, 13 bp, D. melanogaster
aaatgcaaattgg

SEQ ID NO: 552632 - DNA, 14 bp, D. melanogaster
aaatgcaaattgga

SEQ ID NO: 552633 - DNA, 14 bp, D. melanogaster
aaatgcaaattgtt

SEQ ID NO: 552634 - DNA, 13 bp, D. melanogaster
aaatgcaaattta

SEQ ID NO: 552635 - DNA, 14 bp, D. melanogaster
aaatgcaaatttaa

SEQ ID NO: 552636 - DNA, 14 bp, D. melanogaster
aaatgcaaatttat

SEQ ID NO: 552637 - DNA, 13 bp, D. melanogaster
aaatgcaaatttc

SEQ ID NO: 552638 - DNA, 14 bp, D. melanogaster
aaatgcaaatttcg

SEQ ID NO: 552639 - DNA, 14 bp, D. melanogaster
aaatgcaacaaaat

SEQ ID NO: 552640 - DNA, 13 bp, D. melanogaster
aaatgcaacaaat

SEQ ID NO: 552641 - DNA, 14 bp, D. melanogaster
aaatgcaacaaatt

SEQ ID NO: 552642 - DNA, 13 bp, D. melanogaster
aaatgcaacaaca

SEQ ID NO: 552643 - DNA, 13 bp, D. melanogaster
aaatgcaacaagc

SEQ ID NO: 552644 - DNA, 13 bp, D. melanogaster
aaatgcaacattc

SEQ ID NO: 552645 - DNA, 13 bp, D. melanogaster
aaatgcaacattt

SEQ ID NO: 552646 - DNA, 13 bp, D. melanogaster
aaatgcaaccaaa

SEQ ID NO: 552647 - DNA, 13 bp, D. melanogaster
aaatgcaaccgaa

SEQ ID NO: 552648 - DNA, 13 bp, D. melanogaster
aaatgcaaccgca

SEQ ID NO: 552649 - DNA, 13 bp, D. melanogaster
aaatgcaacgaaa

SEQ ID NO: 552650 - DNA, 13 bp, D. melanogaster
aaatgcaactaaa

SEQ ID NO: 552651 - DNA, 13 bp, D. melanogaster
aaatgcaactaat

SEQ ID NO: 552652 - DNA, 13 bp, D. melanogaster
aaatgcaactcta

SEQ ID NO: 552653 - DNA, 13 bp, D. melanogaster
aaatgcaactgaa

SEQ ID NO: 552654 - DNA, 14 bp, D. melanogaster
aaatgcaactgaaa

SEQ ID NO: 552655 - DNA, 14 bp, D. melanogaster
aaatgcaactgcaa

SEQ ID NO: 552656 - DNA, 13 bp, D. melanogaster
aaatgcaagcaaa

SEQ ID NO: 552657 - DNA, 13 bp, D. melanogaster
aaatgcaagcgaa

SEQ ID NO: 552658 - DNA, 13 bp, D. melanogaster
aaatgcaagggtc

SEQ ID NO: 552659 - DNA, 13 bp, D. melanogaster
aaatgcaagtgaa

SEQ ID NO: 552660 - DNA, 14 bp, D. melanogaster
aaatgcaataaaag

SEQ ID NO: 552661 - DNA, 13 bp, D. melanogaster
aaatgcaataaac

SEQ ID NO: 552662 - DNA, 13 bp, D. melanogaster
aaatgcaatatat

SEQ ID NO: 552663 - DNA, 13 bp, D. melanogaster
aaatgcaatattg

SEQ ID NO: 552664 - DNA, 13 bp, D. melanogaster
aaatgcaatattt

SEQ ID NO: 552665 - DNA, 14 bp, D. melanogaster
aaatgcaatattta

SEQ ID NO: 552666 - DNA, 14 bp, D. melanogaster
aaatgcaatatttt

SEQ ID NO: 552667 - DNA, 13 bp, D. melanogaster
aaatgcaatcaaa

SEQ ID NO: 552668 - DNA, 14 bp, D. melanogaster
aaatgcaatcaaaa

SEQ ID NO: 552669 - DNA, 14 bp, D. melanogaster
aaatgcaatcaaat

SEQ ID NO: 552670 - DNA, 13 bp, D. melanogaster
aaatgcaatcgaa

SEQ ID NO: 552671 - DNA, 13 bp, D. melanogaster
aaatgcaatcgca

SEQ ID NO: 552672 - DNA, 14 bp, D. melanogaster
aaatgcaatgcaaa

SEQ ID NO: 552673 - DNA, 13 bp, D. melanogaster
aaatgcaatgcga

SEQ ID NO: 552674 - DNA, 13 bp, D. melanogaster
aaatgcaatggca

SEQ ID NO: 552675 - DNA, 13 bp, D. melanogaster
aaatgcaattaaa

SEQ ID NO: 552676 - DNA, 14 bp, D. melanogaster
aaatgcaattaaat

SEQ ID NO: 552677 - DNA, 13 bp, D. melanogaster
aaatgcaattaat

SEQ ID NO: 552678 - DNA, 13 bp, D. melanogaster
aaatgcaattagt

SEQ ID NO: 552679 - DNA, 13 bp, D. melanogaster
aaatgcaattatt

SEQ ID NO: 552680 - DNA, 14 bp, D. melanogaster
aaatgcaattattt

SEQ ID NO: 552681 - DNA, 13 bp, D. melanogaster
aaatgcaattcaa

SEQ ID NO: 552682 - DNA, 14 bp, D. melanogaster
aaatgcaattcaat

SEQ ID NO: 552683 - DNA, 13 bp, D. melanogaster
aaatgcaattcga

SEQ ID NO: 552684 - DNA, 13 bp, D. melanogaster
aaatgcaattgaa

SEQ ID NO: 552685 - DNA, 14 bp, D. melanogaster
aaatgcaattgaaa

SEQ ID NO: 552686 - DNA, 13 bp, D. melanogaster
aaatgcaattgca

SEQ ID NO: 552687 - DNA, 14 bp, D. melanogaster
aaatgcaattgcaa

SEQ ID NO: 552688 - DNA, 13 bp, D. melanogaster
aaatgcaatttaa

SEQ ID NO: 552689 - DNA, 14 bp, D. melanogaster
aaatgcaatttaaa

SEQ ID NO: 552690 - DNA, 13 bp, D. melanogaster
aaatgcaatttat

SEQ ID NO: 552691 - DNA, 14 bp, D. melanogaster
aaatgcaatttatg

SEQ ID NO: 552692 - DNA, 13 bp, D. melanogaster
aaatgcaatttca

SEQ ID NO: 552693 - DNA, 14 bp, D. melanogaster
aaatgcaatttcaa

SEQ ID NO: 552694 - DNA, 13 bp, D. melanogaster
aaatgcaatttcc

SEQ ID NO: 552695 - DNA, 14 bp, D. melanogaster
aaatgcaatttcca

SEQ ID NO: 552696 - DNA, 14 bp, D. melanogaster
aaatgcaatttgat

SEQ ID NO: 552697 - DNA, 14 bp, D. melanogaster
aaatgcaatttgca

SEQ ID NO: 552698 - DNA, 13 bp, D. melanogaster
aaatgcaatttgt

SEQ ID NO: 552699 - DNA, 14 bp, D. melanogaster
aaatgcaattttaa

SEQ ID NO: 552700 - DNA, 14 bp, D. melanogaster
aaatgcaattttca

SEQ ID NO: 552701 - DNA, 13 bp, D. melanogaster
aaatgcaattttg

SEQ ID NO: 552702 - DNA, 14 bp, D. melanogaster
aaatgcacaaaaat

SEQ ID NO: 552703 - DNA, 13 bp, D. melanogaster
aaatgcacaaaat

SEQ ID NO: 552704 - DNA, 14 bp, D. melanogaster
aaatgcacaaaata

SEQ ID NO: 552705 - DNA, 13 bp, D. melanogaster
aaatgcacaaacg

SEQ ID NO: 552706 - DNA, 13 bp, D. melanogaster
aaatgcacaaatg

SEQ ID NO: 552707 - DNA, 13 bp, D. melanogaster
aaatgcacaaatt

SEQ ID NO: 552708 - DNA, 13 bp, D. melanogaster
aaatgcacaacaa

SEQ ID NO: 552709 - DNA, 13 bp, D. melanogaster
aaatgcacacaaa

SEQ ID NO: 552710 - DNA, 14 bp, D. melanogaster
aaatgcacacaaat

SEQ ID NO: 552711 - DNA, 13 bp, D. melanogaster
aaatgcacagaaa

SEQ ID NO: 552712 - DNA, 13 bp, D. melanogaster
aaatgcacagaga

SEQ ID NO: 552713 - DNA, 13 bp, D. melanogaster
aaatgcacagata

SEQ ID NO: 552714 - DNA, 13 bp, D. melanogaster
aaatgcacagatg

SEQ ID NO: 552715 - DNA, 13 bp, D. melanogaster
aaatgcacataaa

SEQ ID NO: 552716 - DNA, 14 bp, D. melanogaster
aaatgcacataaaa

SEQ ID NO: 552717 - DNA, 14 bp, D. melanogaster
aaatgcacataaat

SEQ ID NO: 552718 - DNA, 13 bp, D. melanogaster
aaatgcacataat

SEQ ID NO: 552719 - DNA, 13 bp, D. melanogaster
aaatgcacatttc

SEQ ID NO: 552720 - DNA, 13 bp, D. melanogaster
aaatgcacgaaat

SEQ ID NO: 552721 - DNA, 13 bp, D. melanogaster
aaatgcactaaaa

SEQ ID NO: 552722 - DNA, 13 bp, D. melanogaster
aaatgcactcaaa

SEQ ID NO: 552723 - DNA, 13 bp, D. melanogaster
aaatgcactgaaa

SEQ ID NO: 552724 - DNA, 13 bp, D. melanogaster
aaatgcactgaga

SEQ ID NO: 552725 - DNA, 13 bp, D. melanogaster
aaatgcactgcaa

SEQ ID NO: 552726 - DNA, 13 bp, D. melanogaster
aaatgcacttaaa

SEQ ID NO: 552727 - DNA, 13 bp, D. melanogaster
aaatgcacttcaa

SEQ ID NO: 552728 - DNA, 13 bp, D. melanogaster
aaatgcacttgct

SEQ ID NO: 552729 - DNA, 13 bp, D. melanogaster
aaatgcacttggc

SEQ ID NO: 552730 - DNA, 13 bp, D. melanogaster
aaatgcactttct

SEQ ID NO: 552731 - DNA, 13 bp, D. melanogaster
aaatgcactttgg

SEQ ID NO: 552732 - DNA, 13 bp, D. melanogaster
aaatgcactttgt

SEQ ID NO: 552733 - DNA, 13 bp, D. melanogaster
aaatgcagaaaat

SEQ ID NO: 552734 - DNA, 13 bp, D. melanogaster
aaatgcagaaaca

SEQ ID NO: 552735 - DNA, 13 bp, D. melanogaster
aaatgcagaacaa

SEQ ID NO: 552736 - DNA, 13 bp, D. melanogaster
aaatgcagaatgc

SEQ ID NO: 552737 - DNA, 13 bp, D. melanogaster
aaatgcagagaaa

SEQ ID NO: 552738 - DNA, 13 bp, D. melanogaster
aaatgcagagcag

SEQ ID NO: 552739 - DNA, 13 bp, D. melanogaster
aaatgcagataaa

SEQ ID NO: 552740 - DNA, 13 bp, D. melanogaster
aaatgcagataca

SEQ ID NO: 552741 - DNA, 13 bp, D. melanogaster
aaatgcagatatt

SEQ ID NO: 552742 - DNA, 13 bp, D. melanogaster
aaatgcagatgca

SEQ ID NO: 552743 - DNA, 13 bp, D. melanogaster
aaatgcagcaaac

SEQ ID NO: 552744 - DNA, 13 bp, D. melanogaster
aaatgcagcaaag

SEQ ID NO: 552745 - DNA, 13 bp, D. melanogaster
aaatgcagcaaca

SEQ ID NO: 552746 - DNA, 13 bp, D. melanogaster
aaatgcagcacaa

SEQ ID NO: 552747 - DNA, 13 bp, D. melanogaster
aaatgcagcagaa

SEQ ID NO: 552748 - DNA, 13 bp, D. melanogaster
aaatgcagcataa

SEQ ID NO: 552749 - DNA, 13 bp, D. melanogaster
aaatgcagccaag

SEQ ID NO: 552750 - DNA, 13 bp, D. melanogaster
aaatgcagccagc

SEQ ID NO: 552751 - DNA, 13 bp, D. melanogaster
aaatgcagcccaa

SEQ ID NO: 552752 - DNA, 13 bp, D. melanogaster
aaatgcagcgaaa

SEQ ID NO: 552753 - DNA, 13 bp, D. melanogaster
aaatgcagcgcca

SEQ ID NO: 552754 - DNA, 13 bp, D. melanogaster
aaatgcagctaac

SEQ ID NO: 552755 - DNA, 13 bp, D. melanogaster
aaatgcagctgca

SEQ ID NO: 552756 - DNA, 13 bp, D. melanogaster
aaatgcaggaaaa

SEQ ID NO: 552757 - DNA, 13 bp, D. melanogaster
aaatgcaggaaat

SEQ ID NO: 552758 - DNA, 13 bp, D. melanogaster
aaatgcaggcaca

SEQ ID NO: 552759 - DNA, 13 bp, D. melanogaster
aaatgcagggaaa

SEQ ID NO: 552760 - DNA, 13 bp, D. melanogaster
aaatgcagtaaaa

SEQ ID NO: 552761 - DNA, 13 bp, D. melanogaster
aaatgcagtcaag

SEQ ID NO: 552762 - DNA, 13 bp, D. melanogaster
aaatgcagtgaaa

SEQ ID NO: 552763 - DNA, 13 bp, D. melanogaster
aaatgcagtgcaa

SEQ ID NO: 552764 - DNA, 13 bp, D. melanogaster
aaatgcagtggca

SEQ ID NO: 552765 - DNA, 13 bp, D. melanogaster
aaatgcagttctt

SEQ ID NO: 552766 - DNA, 13 bp, D. melanogaster
aaatgcagttgca

SEQ ID NO: 552767 - DNA, 13 bp, D. melanogaster
aaatgcagttgga

SEQ ID NO: 552768 - DNA, 13 bp, D. melanogaster
aaatgcagttggg

SEQ ID NO: 552769 - DNA, 13 bp, D. melanogaster
aaatgcagtttga

SEQ ID NO: 552770 - DNA, 13 bp, D. melanogaster
aaatgcagttttt

SEQ ID NO: 552771 - DNA, 13 bp, D. melanogaster
aaatgcataaaca

SEQ ID NO: 552772 - DNA, 14 bp, D. melanogaster
aaatgcataaacaa

SEQ ID NO: 552773 - DNA, 13 bp, D. melanogaster
aaatgcataacaa

SEQ ID NO: 552774 - DNA, 13 bp, D. melanogaster
aaatgcataattg

SEQ ID NO: 552775 - DNA, 13 bp, D. melanogaster
aaatgcataattt

SEQ ID NO: 552776 - DNA, 13 bp, D. melanogaster
aaatgcatagaaa

SEQ ID NO: 552777 - DNA, 13 bp, D. melanogaster
aaatgcatataaa

SEQ ID NO: 552778 - DNA, 13 bp, D. melanogaster
aaatgcatataca

SEQ ID NO: 552779 - DNA, 13 bp, D. melanogaster
aaatgcatatata

SEQ ID NO: 552780 - DNA, 14 bp, D. melanogaster
aaatgcatatattt

SEQ ID NO: 552781 - DNA, 13 bp, D. melanogaster
aaatgcatatgta

SEQ ID NO: 552782 - DNA, 13 bp, D. melanogaster
aaatgcatattaa

SEQ ID NO: 552783 - DNA, 14 bp, D. melanogaster
aaatgcatattaaa

SEQ ID NO: 552784 - DNA, 13 bp, D. melanogaster
aaatgcatattga

SEQ ID NO: 552785 - DNA, 13 bp, D. melanogaster
aaatgcatattgt

SEQ ID NO: 552786 - DNA, 13 bp, D. melanogaster
aaatgcatattta

SEQ ID NO: 552787 - DNA, 14 bp, D. melanogaster
aaatgcatatttaa

SEQ ID NO: 552788 - DNA, 13 bp, D. melanogaster
aaatgcatatttt

SEQ ID NO: 552789 - DNA, 13 bp, D. melanogaster
aaatgcatcaaaa

SEQ ID NO: 552790 - DNA, 13 bp, D. melanogaster
aaatgcatcataa

SEQ ID NO: 552791 - DNA, 13 bp, D. melanogaster
aaatgcatgaaaa

SEQ ID NO: 552792 - DNA, 13 bp, D. melanogaster
aaatgcatgaaat

SEQ ID NO: 552793 - DNA, 13 bp, D. melanogaster
aaatgcatgcaaa

SEQ ID NO: 552794 - DNA, 14 bp, D. melanogaster
aaatgcatgcaaat

SEQ ID NO: 552795 - DNA, 13 bp, D. melanogaster
aaatgcatgcatt

SEQ ID NO: 552796 - DNA, 13 bp, D. melanogaster
aaatgcatgcgag

SEQ ID NO: 552797 - DNA, 13 bp, D. melanogaster
aaatgcatgtaaa

SEQ ID NO: 552798 - DNA, 13 bp, D. melanogaster
aaatgcatgtgca

SEQ ID NO: 552799 - DNA, 13 bp, D. melanogaster
aaatgcattaaaa

SEQ ID NO: 552800 - DNA, 14 bp, D. melanogaster
aaatgcattaaaaa

SEQ ID NO: 552801 - DNA, 13 bp, D. melanogaster
aaatgcattaaat

SEQ ID NO: 552802 - DNA, 14 bp, D. melanogaster
aaatgcattaaata

SEQ ID NO: 552803 - DNA, 13 bp, D. melanogaster
aaatgcattaagt

SEQ ID NO: 552804 - DNA, 14 bp, D. melanogaster
aaatgcattaatat

SEQ ID NO: 552805 - DNA, 14 bp, D. melanogaster
aaatgcattaattt

SEQ ID NO: 552806 - DNA, 13 bp, D. melanogaster
aaatgcattacaa

SEQ ID NO: 552807 - DNA, 13 bp, D. melanogaster
aaatgcattacat

SEQ ID NO: 552808 - DNA, 13 bp, D. melanogaster
aaatgcattagaa

SEQ ID NO: 552809 - DNA, 13 bp, D. melanogaster
aaatgcattattt

SEQ ID NO: 552810 - DNA, 13 bp, D. melanogaster
aaatgcattcaaa

SEQ ID NO: 552811 - DNA, 13 bp, D. melanogaster
aaatgcattcaac

SEQ ID NO: 552812 - DNA, 13 bp, D. melanogaster
aaatgcattccat

SEQ ID NO: 552813 - DNA, 13 bp, D. melanogaster
aaatgcattcgaa

SEQ ID NO: 552814 - DNA, 13 bp, D. melanogaster
aaatgcattgaaa

SEQ ID NO: 552815 - DNA, 13 bp, D. melanogaster
aaatgcattgcaa

SEQ ID NO: 552816 - DNA, 13 bp, D. melanogaster
aaatgcattggaa

SEQ ID NO: 552817 - DNA, 13 bp, D. melanogaster
aaatgcattggca

SEQ ID NO: 552818 - DNA, 13 bp, D. melanogaster
aaatgcattgtca

SEQ ID NO: 552819 - DNA, 13 bp, D. melanogaster
aaatgcattgttt

SEQ ID NO: 552820 - DNA, 13 bp, D. melanogaster
aaatgcatttaaa

SEQ ID NO: 552821 - DNA, 14 bp, D. melanogaster
aaatgcatttaaaa

SEQ ID NO: 552822 - DNA, 14 bp, D. melanogaster
aaatgcatttacat

SEQ ID NO: 552823 - DNA, 13 bp, D. melanogaster
aaatgcatttatc

SEQ ID NO: 552824 - DNA, 13 bp, D. melanogaster
aaatgcatttcaa

SEQ ID NO: 552825 - DNA, 13 bp, D. melanogaster
aaatgcatttcat

SEQ ID NO: 552826 - DNA, 13 bp, D. melanogaster
aaatgcatttcca

SEQ ID NO: 552827 - DNA, 13 bp, D. melanogaster
aaatgcatttcta

SEQ ID NO: 552828 - DNA, 13 bp, D. melanogaster
aaatgcatttctt

SEQ ID NO: 552829 - DNA, 13 bp, D. melanogaster
aaatgcatttgaa

SEQ ID NO: 552830 - DNA, 14 bp, D. melanogaster
aaatgcatttgaaa

SEQ ID NO: 552831 - DNA, 14 bp, D. melanogaster
aaatgcatttgaat

SEQ ID NO: 552832 - DNA, 13 bp, D. melanogaster
aaatgcatttgat

SEQ ID NO: 552833 - DNA, 13 bp, D. melanogaster
aaatgcatttgca

SEQ ID NO: 552834 - DNA, 14 bp, D. melanogaster
aaatgcatttgcat

SEQ ID NO: 552835 - DNA, 13 bp, D. melanogaster
aaatgcatttgct

SEQ ID NO: 552836 - DNA, 13 bp, D. melanogaster
aaatgcatttgtg

SEQ ID NO: 552837 - DNA, 13 bp, D. melanogaster
aaatgcattttaa

SEQ ID NO: 552838 - DNA, 14 bp, D. melanogaster
aaatgcattttaaa

SEQ ID NO: 552839 - DNA, 13 bp, D. melanogaster
aaatgcattttat

SEQ ID NO: 552840 - DNA, 13 bp, D. melanogaster
aaatgcattttca

SEQ ID NO: 552841 - DNA, 13 bp, D. melanogaster
aaatgcattttcc

SEQ ID NO: 552842 - DNA, 13 bp, D. melanogaster
aaatgcattttct

SEQ ID NO: 552843 - DNA, 13 bp, D. melanogaster
aaatgcattttgc

SEQ ID NO: 552844 - DNA, 14 bp, D. melanogaster
aaatgccaaaaaat

SEQ ID NO: 552845 - DNA, 13 bp, D. melanogaster
aaatgccaaaaag

SEQ ID NO: 552846 - DNA, 13 bp, D. melanogaster
aaatgccaaaaat

SEQ ID NO: 552847 - DNA, 13 bp, D. melanogaster
aaatgccaaaacc

SEQ ID NO: 552848 - DNA, 13 bp, D. melanogaster
aaatgccaaaagg

SEQ ID NO: 552849 - DNA, 13 bp, D. melanogaster
aaatgccaaaagt

SEQ ID NO: 552850 - DNA, 13 bp, D. melanogaster
aaatgccaaaata

SEQ ID NO: 552851 - DNA, 14 bp, D. melanogaster
aaatgccaaaataa

SEQ ID NO: 552852 - DNA, 13 bp, D. melanogaster
aaatgccaaaatg

SEQ ID NO: 552853 - DNA, 13 bp, D. melanogaster
aaatgccaaacaa

SEQ ID NO: 552854 - DNA, 14 bp, D. melanogaster
aaatgccaaacaaa

SEQ ID NO: 552855 - DNA, 13 bp, D. melanogaster
aaatgccaaagaa

SEQ ID NO: 552856 - DNA, 14 bp, D. melanogaster
aaatgccaaagaaa

SEQ ID NO: 552857 - DNA, 13 bp, D. melanogaster
aaatgccaaagat

SEQ ID NO: 552858 - DNA, 13 bp, D. melanogaster
aaatgccaaagtg

SEQ ID NO: 552859 - DNA, 13 bp, D. melanogaster
aaatgccaaagtt

SEQ ID NO: 552860 - DNA, 14 bp, D. melanogaster
aaatgccaaataaa

SEQ ID NO: 552861 - DNA, 13 bp, D. melanogaster
aaatgccaaatga

SEQ ID NO: 552862 - DNA, 13 bp, D. melanogaster
aaatgccaaatgc

SEQ ID NO: 552863 - DNA, 13 bp, D. melanogaster
aaatgccaaatgt

SEQ ID NO: 552864 - DNA, 13 bp, D. melanogaster
aaatgccaaatta

SEQ ID NO: 552865 - DNA, 13 bp, D. melanogaster
aaatgccaaattg

SEQ ID NO: 552866 - DNA, 13 bp, D. melanogaster
aaatgccaacaat

SEQ ID NO: 552867 - DNA, 13 bp, D. melanogaster
aaatgccaacaca

SEQ ID NO: 552868 - DNA, 13 bp, D. melanogaster
aaatgccaacaga

SEQ ID NO: 552869 - DNA, 13 bp, D. melanogaster
aaatgccaacgaa

SEQ ID NO: 552870 - DNA, 13 bp, D. melanogaster
aaatgccaactca

SEQ ID NO: 552871 - DNA, 13 bp, D. melanogaster
aaatgccaactgc

SEQ ID NO: 552872 - DNA, 13 bp, D. melanogaster
aaatgccaagcaa

SEQ ID NO: 552873 - DNA, 13 bp, D. melanogaster
aaatgccaagttc

SEQ ID NO: 552874 - DNA, 14 bp, D. melanogaster
aaatgccaataaaa

SEQ ID NO: 552875 - DNA, 13 bp, D. melanogaster
aaatgccaataat

SEQ ID NO: 552876 - DNA, 13 bp, D. melanogaster
aaatgccaataga

SEQ ID NO: 552877 - DNA, 13 bp, D. melanogaster
aaatgccaatcaa

SEQ ID NO: 552878 - DNA, 13 bp, D. melanogaster
aaatgccaatcga

SEQ ID NO: 552879 - DNA, 13 bp, D. melanogaster
aaatgccaatgaa

SEQ ID NO: 552880 - DNA, 13 bp, D. melanogaster
aaatgccaatgcc

SEQ ID NO: 552881 - DNA, 14 bp, D. melanogaster
aaatgccaatgccc

SEQ ID NO: 552882 - DNA, 13 bp, D. melanogaster
aaatgccaatggc

SEQ ID NO: 552883 - DNA, 13 bp, D. melanogaster
aaatgccaattaa

SEQ ID NO: 552884 - DNA, 14 bp, D. melanogaster
aaatgccaattaaa

SEQ ID NO: 552885 - DNA, 13 bp, D. melanogaster
aaatgccaattta

SEQ ID NO: 552886 - DNA, 13 bp, D. melanogaster
aaatgccacaaaa

SEQ ID NO: 552887 - DNA, 14 bp, D. melanogaster
aaatgccacaaaag

SEQ ID NO: 552888 - DNA, 13 bp, D. melanogaster
aaatgccacaaag

SEQ ID NO: 552889 - DNA, 13 bp, D. melanogaster
aaatgccacaaat

SEQ ID NO: 552890 - DNA, 13 bp, D. melanogaster
aaatgccacacat

SEQ ID NO: 552891 - DNA, 13 bp, D. melanogaster
aaatgccacagca

SEQ ID NO: 552892 - DNA, 13 bp, D. melanogaster
aaatgccacattt

SEQ ID NO: 552893 - DNA, 13 bp, D. melanogaster
aaatgccacccac

SEQ ID NO: 552894 - DNA, 13 bp, D. melanogaster
aaatgccacttga

SEQ ID NO: 552895 - DNA, 13 bp, D. melanogaster
aaatgccagaaaa

SEQ ID NO: 552896 - DNA, 13 bp, D. melanogaster
aaatgccagaaac

SEQ ID NO: 552897 - DNA, 13 bp, D. melanogaster
aaatgccagaaat

SEQ ID NO: 552898 - DNA, 13 bp, D. melanogaster
aaatgccagcaaa

SEQ ID NO: 552899 - DNA, 13 bp, D. melanogaster
aaatgccagcaca

SEQ ID NO: 552900 - DNA, 13 bp, D. melanogaster
aaatgccagcagc

SEQ ID NO: 552901 - DNA, 13 bp, D. melanogaster
aaatgccagccaa

SEQ ID NO: 552902 - DNA, 13 bp, D. melanogaster
aaatgccagcgaa

SEQ ID NO: 552903 - DNA, 13 bp, D. melanogaster
aaatgccagcgag

SEQ ID NO: 552904 - DNA, 13 bp, D. melanogaster
aaatgccagggaa

SEQ ID NO: 552905 - DNA, 13 bp, D. melanogaster
aaatgccagtgga

SEQ ID NO: 552906 - DNA, 13 bp, D. melanogaster
aaatgccagttaa

SEQ ID NO: 552907 - DNA, 13 bp, D. melanogaster
aaatgccataaat

SEQ ID NO: 552908 - DNA, 14 bp, D. melanogaster
aaatgccataaata

SEQ ID NO: 552909 - DNA, 13 bp, D. melanogaster
aaatgccatacct

SEQ ID NO: 552910 - DNA, 13 bp, D. melanogaster
aaatgccatataa

SEQ ID NO: 552911 - DNA, 13 bp, D. melanogaster
aaatgccatatta

SEQ ID NO: 552912 - DNA, 13 bp, D. melanogaster
aaatgccatcaaa

SEQ ID NO: 552913 - DNA, 13 bp, D. melanogaster
aaatgccatcaat

SEQ ID NO: 552914 - DNA, 13 bp, D. melanogaster
aaatgccatggaa

SEQ ID NO: 552915 - DNA, 13 bp, D. melanogaster
aaatgccatggca

SEQ ID NO: 552916 - DNA, 13 bp, D. melanogaster
aaatgccattaat

SEQ ID NO: 552917 - DNA, 13 bp, D. melanogaster
aaatgccattgca

SEQ ID NO: 552918 - DNA, 13 bp, D. melanogaster
aaatgccatttat

SEQ ID NO: 552919 - DNA, 13 bp, D. melanogaster
aaatgcccaaaca

SEQ ID NO: 552920 - DNA, 13 bp, D. melanogaster
aaatgcccaaata

SEQ ID NO: 552921 - DNA, 13 bp, D. melanogaster
aaatgcccaaatg

SEQ ID NO: 552922 - DNA, 13 bp, D. melanogaster
aaatgcccaaatt

SEQ ID NO: 552923 - DNA, 13 bp, D. melanogaster
aaatgcccaagaa

SEQ ID NO: 552924 - DNA, 13 bp, D. melanogaster
aaatgcccagaaa

SEQ ID NO: 552925 - DNA, 13 bp, D. melanogaster
aaatgccccaaaa

SEQ ID NO: 552926 - DNA, 13 bp, D. melanogaster
aaatgcccccaaa

SEQ ID NO: 552927 - DNA, 13 bp, D. melanogaster
aaatgccccgaaa

SEQ ID NO: 552928 - DNA, 13 bp, D. melanogaster
aaatgcccgaaaa

SEQ ID NO: 552929 - DNA, 13 bp, D. melanogaster
aaatgccgaaaaa

SEQ ID NO: 552930 - DNA, 13 bp, D. melanogaster
aaatgccgaaata

SEQ ID NO: 552931 - DNA, 13 bp, D. melanogaster
aaatgccgaatgc

SEQ ID NO: 552932 - DNA, 13 bp, D. melanogaster
aaatgccgagcaa

SEQ ID NO: 552933 - DNA, 13 bp, D. melanogaster
aaatgccgcaaaa

SEQ ID NO: 552934 - DNA, 13 bp, D. melanogaster
aaatgccgcaaat

SEQ ID NO: 552935 - DNA, 13 bp, D. melanogaster
aaatgccgcacaa

SEQ ID NO: 552936 - DNA, 13 bp, D. melanogaster
aaatgccggcaaa

SEQ ID NO: 552937 - DNA, 13 bp, D. melanogaster
aaatgccgtcttt

SEQ ID NO: 552938 - DNA, 13 bp, D. melanogaster
aaatgcctaaaat

SEQ ID NO: 552939 - DNA, 13 bp, D. melanogaster
aaatgcctaattt

SEQ ID NO: 552940 - DNA, 13 bp, D. melanogaster
aaatgcctcaaaa

SEQ ID NO: 552941 - DNA, 13 bp, D. melanogaster
aaatgcctcaaca

SEQ ID NO: 552942 - DNA, 14 bp, D. melanogaster
aaatgcctcaacac

SEQ ID NO: 552943 - DNA, 13 bp, D. melanogaster
aaatgcctgaaaa

SEQ ID NO: 552944 - DNA, 13 bp, D. melanogaster
aaatgcctgcaaa

SEQ ID NO: 552945 - DNA, 14 bp, D. melanogaster
aaatgcctgctcta

SEQ ID NO: 552946 - DNA, 13 bp, D. melanogaster
aaatgcctggaaa

SEQ ID NO: 552947 - DNA, 13 bp, D. melanogaster
aaatgcctggcat

SEQ ID NO: 552948 - DNA, 13 bp, D. melanogaster
aaatgccttgaaa

SEQ ID NO: 552949 - DNA, 13 bp, D. melanogaster
aaatgcctttaaa

SEQ ID NO: 552950 - DNA, 14 bp, D. melanogaster
aaatgcctttaaaa

SEQ ID NO: 552951 - DNA, 13 bp, D. melanogaster
aaatgcctttaat

SEQ ID NO: 552952 - DNA, 13 bp, D. melanogaster
aaatgcctttcaa

SEQ ID NO: 552953 - DNA, 13 bp, D. melanogaster
aaatgcctttgca

SEQ ID NO: 552954 - DNA, 13 bp, D. melanogaster
aaatgcgaaaaat

SEQ ID NO: 552955 - DNA, 14 bp, D. melanogaster
aaatgcgaaaaatt

SEQ ID NO: 552956 - DNA, 14 bp, D. melanogaster
aaatgcgaaaacaa

SEQ ID NO: 552957 - DNA, 13 bp, D. melanogaster
aaatgcgaaaacg

SEQ ID NO: 552958 - DNA, 13 bp, D. melanogaster
aaatgcgaaaagc

SEQ ID NO: 552959 - DNA, 13 bp, D. melanogaster
aaatgcgaaaagt

SEQ ID NO: 552960 - DNA, 13 bp, D. melanogaster
aaatgcgaaaatc

SEQ ID NO: 552961 - DNA, 13 bp, D. melanogaster
aaatgcgaaaatg

SEQ ID NO: 552962 - DNA, 14 bp, D. melanogaster
aaatgcgaaaatgt

SEQ ID NO: 552963 - DNA, 13 bp, D. melanogaster
aaatgcgaaaatt

SEQ ID NO: 552964 - DNA, 14 bp, D. melanogaster
aaatgcgaaaattg

SEQ ID NO: 552965 - DNA, 14 bp, D. melanogaster
aaatgcgaaaattt

SEQ ID NO: 552966 - DNA, 14 bp, D. melanogaster
aaatgcgaaatgaa

SEQ ID NO: 552967 - DNA, 13 bp, D. melanogaster
aaatgcgaaatgc

SEQ ID NO: 552968 - DNA, 13 bp, D. melanogaster
aaatgcgaaatta

SEQ ID NO: 552969 - DNA, 13 bp, D. melanogaster
aaatgcgaacgcg

SEQ ID NO: 552970 - DNA, 13 bp, D. melanogaster
aaatgcgaataaa

SEQ ID NO: 552971 - DNA, 14 bp, D. melanogaster
aaatgcgaataaaa

SEQ ID NO: 552972 - DNA, 13 bp, D. melanogaster
aaatgcgaatcaa

SEQ ID NO: 552973 - DNA, 14 bp, D. melanogaster
aaatgcgaatgaaa

SEQ ID NO: 552974 - DNA, 13 bp, D. melanogaster
aaatgcgaatgga

SEQ ID NO: 552975 - DNA, 13 bp, D. melanogaster
aaatgcgaatttt

SEQ ID NO: 552976 - DNA, 13 bp, D. melanogaster
aaatgcgacaaaa

SEQ ID NO: 552977 - DNA, 13 bp, D. melanogaster
aaatgcgagcaaa

SEQ ID NO: 552978 - DNA, 13 bp, D. melanogaster
aaatgcgaggaaa

SEQ ID NO: 552979 - DNA, 13 bp, D. melanogaster
aaatgcgagtggg

SEQ ID NO: 552980 - DNA, 13 bp, D. melanogaster
aaatgcgatcgat

SEQ ID NO: 552981 - DNA, 13 bp, D. melanogaster
aaatgcgatttat

SEQ ID NO: 552982 - DNA, 13 bp, D. melanogaster
aaatgcgattttc

SEQ ID NO: 552983 - DNA, 13 bp, D. melanogaster
aaatgcgcaaaaa

SEQ ID NO: 552984 - DNA, 14 bp, D. melanogaster
aaatgcgcaaaaaa

SEQ ID NO: 552985 - DNA, 14 bp, D. melanogaster
aaatgcgcataaat

SEQ ID NO: 552986 - DNA, 13 bp, D. melanogaster
aaatgcgcgccaa

SEQ ID NO: 552987 - DNA, 13 bp, D. melanogaster
aaatgcgctgcaa

SEQ ID NO: 552988 - DNA, 14 bp, D. melanogaster
aaatgcggaaaaaa

SEQ ID NO: 552989 - DNA, 13 bp, D. melanogaster
aaatgcggaaatg

SEQ ID NO: 552990 - DNA, 13 bp, D. melanogaster
aaatgcggcaaat

SEQ ID NO: 552991 - DNA, 13 bp, D. melanogaster
aaatgcggcaaca

SEQ ID NO: 552992 - DNA, 13 bp, D. melanogaster
aaatgcgggaaaa

SEQ ID NO: 552993 - DNA, 13 bp, D. melanogaster
aaatgcggggaaa

SEQ ID NO: 552994 - DNA, 13 bp, D. melanogaster
aaatgcgtaaata

SEQ ID NO: 552995 - DNA, 13 bp, D. melanogaster
aaatgcgtatttt

SEQ ID NO: 552996 - DNA, 13 bp, D. melanogaster
aaatgcgtctgaa

SEQ ID NO: 552997 - DNA, 13 bp, D. melanogaster
aaatgcgtgaaaa

SEQ ID NO: 552998 - DNA, 13 bp, D. melanogaster
aaatgcgtgtgtg

SEQ ID NO: 552999 - DNA, 13 bp, D. melanogaster
aaatgcgttaaaa

SEQ ID NO: 553000 - DNA, 13 bp, D. melanogaster
aaatgcgtttaaa

SEQ ID NO: 553001 - DNA, 13 bp, D. melanogaster
aaatgcgtttgtt

SEQ ID NO: 553002 - DNA, 13 bp, D. melanogaster
aaatgcgttttaa

SEQ ID NO: 553003 - DNA, 13 bp, D. melanogaster
aaatgctaaaagt

SEQ ID NO: 553004 - DNA, 13 bp, D. melanogaster
aaatgctaaaata

SEQ ID NO: 553005 - DNA, 13 bp, D. melanogaster
aaatgctaaacaa

SEQ ID NO: 553006 - DNA, 14 bp, D. melanogaster
aaatgctaaacaaa

SEQ ID NO: 553007 - DNA, 13 bp, D. melanogaster
aaatgctaaagat

SEQ ID NO: 553008 - DNA, 13 bp, D. melanogaster
aaatgctaaataa

SEQ ID NO: 553009 - DNA, 14 bp, D. melanogaster
aaatgctaaataaa

SEQ ID NO: 553010 - DNA, 13 bp, D. melanogaster
aaatgctaaatga

SEQ ID NO: 553011 - DNA, 13 bp, D. melanogaster
aaatgctaaatgc

SEQ ID NO: 553012 - DNA, 14 bp, D. melanogaster
aaatgctaaatgct

SEQ ID NO: 553013 - DNA, 13 bp, D. melanogaster
aaatgctaaattt

SEQ ID NO: 553014 - DNA, 13 bp, D. melanogaster
aaatgctaataaa

SEQ ID NO: 553015 - DNA, 13 bp, D. melanogaster
aaatgctaataat

SEQ ID NO: 553016 - DNA, 13 bp, D. melanogaster
aaatgctaatgaa

SEQ ID NO: 553017 - DNA, 13 bp, D. melanogaster
aaatgctaatgag

SEQ ID NO: 553018 - DNA, 13 bp, D. melanogaster
aaatgctaatttc

SEQ ID NO: 553019 - DNA, 13 bp, D. melanogaster
aaatgctacaaaa

SEQ ID NO: 553020 - DNA, 14 bp, D. melanogaster
aaatgctacaaaac

SEQ ID NO: 553021 - DNA, 13 bp, D. melanogaster
aaatgctacaaat

SEQ ID NO: 553022 - DNA, 13 bp, D. melanogaster
aaatgctataaaa

SEQ ID NO: 553023 - DNA, 13 bp, D. melanogaster
aaatgctataaat

SEQ ID NO: 553024 - DNA, 14 bp, D. melanogaster
aaatgctatagtcg

SEQ ID NO: 553025 - DNA, 14 bp, D. melanogaster
aaatgctattaaaa

SEQ ID NO: 553026 - DNA, 13 bp, D. melanogaster
aaatgctattttt

SEQ ID NO: 553027 - DNA, 13 bp, D. melanogaster
aaatgctcaaaaa

SEQ ID NO: 553028 - DNA, 13 bp, D. melanogaster
aaatgctcaaatg

SEQ ID NO: 553029 - DNA, 13 bp, D. melanogaster
aaatgctcaacaa

SEQ ID NO: 553030 - DNA, 13 bp, D. melanogaster
aaatgctcaatta

SEQ ID NO: 553031 - DNA, 13 bp, D. melanogaster
aaatgctcgaaaa

SEQ ID NO: 553032 - DNA, 13 bp, D. melanogaster
aaatgctcgctct

SEQ ID NO: 553033 - DNA, 13 bp, D. melanogaster
aaatgctgaaaac

SEQ ID NO: 553034 - DNA, 14 bp, D. melanogaster
aaatgctgaaatgc

SEQ ID NO: 553035 - DNA, 13 bp, D. melanogaster
aaatgctgaacaa

SEQ ID NO: 553036 - DNA, 13 bp, D. melanogaster
aaatgctgaatgc

SEQ ID NO: 553037 - DNA, 13 bp, D. melanogaster
aaatgctgcaaaa

SEQ ID NO: 553038 - DNA, 13 bp, D. melanogaster
aaatgctgcaaat

SEQ ID NO: 553039 - DNA, 13 bp, D. melanogaster
aaatgctgcacaa

SEQ ID NO: 553040 - DNA, 13 bp, D. melanogaster
aaatgctgcacat

SEQ ID NO: 553041 - DNA, 13 bp, D. melanogaster
aaatgctgcagct

SEQ ID NO: 553042 - DNA, 13 bp, D. melanogaster
aaatgctgcattt

SEQ ID NO: 553043 - DNA, 13 bp, D. melanogaster
aaatgctgcctgc

SEQ ID NO: 553044 - DNA, 13 bp, D. melanogaster
aaatgctgctaat

SEQ ID NO: 553045 - DNA, 13 bp, D. melanogaster
aaatgctgctgct

SEQ ID NO: 553046 - DNA, 13 bp, D. melanogaster
aaatgctgcttaa

SEQ ID NO: 553047 - DNA, 13 bp, D. melanogaster
aaatgctggaaaa

SEQ ID NO: 553048 - DNA, 14 bp, D. melanogaster
aaatgctggaaaaa

SEQ ID NO: 553049 - DNA, 13 bp, D. melanogaster
aaatgctggatca

SEQ ID NO: 553050 - DNA, 13 bp, D. melanogaster
aaatgctggccaa

SEQ ID NO: 553051 - DNA, 13 bp, D. melanogaster
aaatgctggccat

SEQ ID NO: 553052 - DNA, 14 bp, D. melanogaster
aaatgctggccatt

SEQ ID NO: 553053 - DNA, 13 bp, D. melanogaster
aaatgctgggaaa

SEQ ID NO: 553054 - DNA, 13 bp, D. melanogaster
aaatgctgtaaaa

SEQ ID NO: 553055 - DNA, 13 bp, D. melanogaster
aaatgctgtaatt

SEQ ID NO: 553056 - DNA, 13 bp, D. melanogaster
aaatgctgttaat

SEQ ID NO: 553057 - DNA, 13 bp, D. melanogaster
aaatgctgttgaa

SEQ ID NO: 553058 - DNA, 13 bp, D. melanogaster
aaatgctgttgct

SEQ ID NO: 553059 - DNA, 13 bp, D. melanogaster
aaatgctgttttt

SEQ ID NO: 553060 - DNA, 13 bp, D. melanogaster
aaatgcttaaaaa

SEQ ID NO: 553061 - DNA, 13 bp, D. melanogaster
aaatgcttaaaag

SEQ ID NO: 553062 - DNA, 13 bp, D. melanogaster
aaatgcttaaaat

SEQ ID NO: 553063 - DNA, 13 bp, D. melanogaster
aaatgcttaacaa

SEQ ID NO: 553064 - DNA, 13 bp, D. melanogaster
aaatgcttaagaa

SEQ ID NO: 553065 - DNA, 13 bp, D. melanogaster
aaatgcttaattg

SEQ ID NO: 553066 - DNA, 13 bp, D. melanogaster
aaatgcttaattt

SEQ ID NO: 553067 - DNA, 13 bp, D. melanogaster
aaatgcttagaaa

SEQ ID NO: 553068 - DNA, 13 bp, D. melanogaster
aaatgcttcaaat

SEQ ID NO: 553069 - DNA, 13 bp, D. melanogaster
aaatgcttcatta

SEQ ID NO: 553070 - DNA, 13 bp, D. melanogaster
aaatgcttctttt

SEQ ID NO: 553071 - DNA, 13 bp, D. melanogaster
aaatgcttgcaaa

SEQ ID NO: 553072 - DNA, 13 bp, D. melanogaster
aaatgcttgccaa

SEQ ID NO: 553073 - DNA, 13 bp, D. melanogaster
aaatgcttgccat

SEQ ID NO: 553074 - DNA, 14 bp, D. melanogaster
aaatgcttgccata

SEQ ID NO: 553075 - DNA, 13 bp, D. melanogaster
aaatgcttggact

SEQ ID NO: 553076 - DNA, 13 bp, D. melanogaster
aaatgcttggcaa

SEQ ID NO: 553077 - DNA, 13 bp, D. melanogaster
aaatgcttgtaaa

SEQ ID NO: 553078 - DNA, 13 bp, D. melanogaster
aaatgcttgtagc

SEQ ID NO: 553079 - DNA, 13 bp, D. melanogaster
aaatgcttgttaa

SEQ ID NO: 553080 - DNA, 13 bp, D. melanogaster
aaatgctttaaaa

SEQ ID NO: 553081 - DNA, 13 bp, D. melanogaster
aaatgctttaata

SEQ ID NO: 553082 - DNA, 14 bp, D. melanogaster
aaatgctttaatta

SEQ ID NO: 553083 - DNA, 14 bp, D. melanogaster
aaatgctttactaa

SEQ ID NO: 553084 - DNA, 13 bp, D. melanogaster
aaatgctttagaa

SEQ ID NO: 553085 - DNA, 13 bp, D. melanogaster
aaatgctttatat

SEQ ID NO: 553086 - DNA, 13 bp, D. melanogaster
aaatgctttattt

SEQ ID NO: 553087 - DNA, 13 bp, D. melanogaster
aaatgctttcaaa

SEQ ID NO: 553088 - DNA, 13 bp, D. melanogaster
aaatgctttcagc

SEQ ID NO: 553089 - DNA, 13 bp, D. melanogaster
aaatgctttccat

SEQ ID NO: 553090 - DNA, 13 bp, D. melanogaster
aaatgctttctta

SEQ ID NO: 553091 - DNA, 13 bp, D. melanogaster
aaatgctttgaaa

SEQ ID NO: 553092 - DNA, 14 bp, D. melanogaster
aaatgcttttaatt

SEQ ID NO: 553093 - DNA, 13 bp, D. melanogaster
aaatgcttttaca

SEQ ID NO: 553094 - DNA, 13 bp, D. melanogaster
aaatgcttttata

SEQ ID NO: 553095 - DNA, 13 bp, D. melanogaster
aaatgcttttcaa

SEQ ID NO: 553096 - DNA, 14 bp, D. melanogaster
aaatgcttttcaat

SEQ ID NO: 553097 - DNA, 13 bp, D. melanogaster
aaatgcttttcga

SEQ ID NO: 553098 - DNA, 13 bp, D. melanogaster
aaatgcttttctt

SEQ ID NO: 553099 - DNA, 13 bp, D. melanogaster
aaatgcttttgaa

SEQ ID NO: 553100 - DNA, 13 bp, D. melanogaster
aaatgcttttgat

SEQ ID NO: 553101 - DNA, 13 bp, D. melanogaster
aaatgctttttaa

SEQ ID NO: 553102 - DNA, 13 bp, D. melanogaster
aaatgctttttta

SEQ ID NO: 553103 - DNA, 13 bp, D. melanogaster
aaatggaaaaact

SEQ ID NO: 553104 - DNA, 14 bp, D. melanogaster
aaatggaaaaatca

SEQ ID NO: 553105 - DNA, 14 bp, D. melanogaster
aaatggaaaacatt

SEQ ID NO: 553106 - DNA, 13 bp, D. melanogaster
aaatggaaaacga

SEQ ID NO: 553107 - DNA, 14 bp, D. melanogaster
aaatggaaaacgaa

SEQ ID NO: 553108 - DNA, 13 bp, D. melanogaster
aaatggaaaacgc

SEQ ID NO: 553109 - DNA, 14 bp, D. melanogaster
aaatggaaaacgga

SEQ ID NO: 553110 - DNA, 13 bp, D. melanogaster
aaatggaaaactt

SEQ ID NO: 553111 - DNA, 14 bp, D. melanogaster
aaatggaaaacttt

SEQ ID NO: 553112 - DNA, 13 bp, D. melanogaster
aaatggaaaagcg

SEQ ID NO: 553113 - DNA, 13 bp, D. melanogaster
aaatggaaaagct

SEQ ID NO: 553114 - DNA, 13 bp, D. melanogaster
aaatggaaaagtg

SEQ ID NO: 553115 - DNA, 13 bp, D. melanogaster
aaatggaaaatac

SEQ ID NO: 553116 - DNA, 13 bp, D. melanogaster
aaatggaaaatca

SEQ ID NO: 553117 - DNA, 14 bp, D. melanogaster
aaatggaaaatcaa

SEQ ID NO: 553118 - DNA, 13 bp, D. melanogaster
aaatggaaaatcg

SEQ ID NO: 553119 - DNA, 13 bp, D. melanogaster
aaatggaaaattc

SEQ ID NO: 553120 - DNA, 14 bp, D. melanogaster
aaatggaaaatttt

SEQ ID NO: 553121 - DNA, 13 bp, D. melanogaster
aaatggaaacagt

SEQ ID NO: 553122 - DNA, 13 bp, D. melanogaster
aaatggaaacatt

SEQ ID NO: 553123 - DNA, 13 bp, D. melanogaster
aaatggaaacgaa

SEQ ID NO: 553124 - DNA, 14 bp, D. melanogaster
aaatggaaacgaaa

SEQ ID NO: 553125 - DNA, 13 bp, D. melanogaster
aaatggaaacgag

SEQ ID NO: 553126 - DNA, 13 bp, D. melanogaster
aaatggaaacgga

SEQ ID NO: 553127 - DNA, 13 bp, D. melanogaster
aaatggaaactaa

SEQ ID NO: 553128 - DNA, 13 bp, D. melanogaster
aaatggaaactgc

SEQ ID NO: 553129 - DNA, 13 bp, D. melanogaster
aaatggaaacttt

SEQ ID NO: 553130 - DNA, 13 bp, D. melanogaster
aaatggaaagcaa

SEQ ID NO: 553131 - DNA, 14 bp, D. melanogaster
aaatggaaagcaaa

SEQ ID NO: 553132 - DNA, 14 bp, D. melanogaster
aaatggaaagcaat

SEQ ID NO: 553133 - DNA, 13 bp, D. melanogaster
aaatggaaagcga

SEQ ID NO: 553134 - DNA, 13 bp, D. melanogaster
aaatggaaagtac

SEQ ID NO: 553135 - DNA, 13 bp, D. melanogaster
aaatggaaagtga

SEQ ID NO: 553136 - DNA, 14 bp, D. melanogaster
aaatggaaagtgac

SEQ ID NO: 553137 - DNA, 13 bp, D. melanogaster
aaatggaaagtgg

SEQ ID NO: 553138 - DNA, 13 bp, D. melanogaster
aaatggaaagttt

SEQ ID NO: 553139 - DNA, 14 bp, D. melanogaster
aaatggaaagtttt

SEQ ID NO: 553140 - DNA, 14 bp, D. melanogaster
aaatggaaatattt

SEQ ID NO: 553141 - DNA, 13 bp, D. melanogaster
aaatggaaatcaa

SEQ ID NO: 553142 - DNA, 13 bp, D. melanogaster
aaatggaaatcat

SEQ ID NO: 553143 - DNA, 13 bp, D. melanogaster
aaatggaaatcga

SEQ ID NO: 553144 - DNA, 14 bp, D. melanogaster
aaatggaaatcgaa

SEQ ID NO: 553145 - DNA, 13 bp, D. melanogaster
aaatggaaatgca

SEQ ID NO: 553146 - DNA, 14 bp, D. melanogaster
aaatggaaatgcca

SEQ ID NO: 553147 - DNA, 13 bp, D. melanogaster
aaatggaaatgct

SEQ ID NO: 553148 - DNA, 14 bp, D. melanogaster
aaatggaaatggcc

SEQ ID NO: 553149 - DNA, 13 bp, D. melanogaster
aaatggaaatgta

SEQ ID NO: 553150 - DNA, 14 bp, D. melanogaster
aaatggaaatgtaa

SEQ ID NO: 553151 - DNA, 13 bp, D. melanogaster
aaatggaaatgtt

SEQ ID NO: 553152 - DNA, 14 bp, D. melanogaster
aaatggaaatgttt

SEQ ID NO: 553153 - DNA, 13 bp, D. melanogaster
aaatggaaattat

SEQ ID NO: 553154 - DNA, 13 bp, D. melanogaster
aaatggaaattcc

SEQ ID NO: 553155 - DNA, 13 bp, D. melanogaster
aaatggaaattct

SEQ ID NO: 553156 - DNA, 14 bp, D. melanogaster
aaatggaaattcta

SEQ ID NO: 553157 - DNA, 13 bp, D. melanogaster
aaatggaaattgt

SEQ ID NO: 553158 - DNA, 14 bp, D. melanogaster
aaatggaaattgtt

SEQ ID NO: 553159 - DNA, 13 bp, D. melanogaster
aaatggaaatttc

SEQ ID NO: 553160 - DNA, 14 bp, D. melanogaster
aaatggaaatttgt

SEQ ID NO: 553161 - DNA, 13 bp, D. melanogaster
aaatggaacaaat

SEQ ID NO: 553162 - DNA, 13 bp, D. melanogaster
aaatggaactgca

SEQ ID NO: 553163 - DNA, 13 bp, D. melanogaster
aaatggaacttaa

SEQ ID NO: 553164 - DNA, 13 bp, D. melanogaster
aaatggaagaact

SEQ ID NO: 553165 - DNA, 13 bp, D. melanogaster
aaatggaagcaaa

SEQ ID NO: 553166 - DNA, 13 bp, D. melanogaster
aaatggaagccaa

SEQ ID NO: 553167 - DNA, 13 bp, D. melanogaster
aaatggaaggcaa

SEQ ID NO: 553168 - DNA, 13 bp, D. melanogaster
aaatggaagtgaa

SEQ ID NO: 553169 - DNA, 13 bp, D. melanogaster
aaatggaataatt

SEQ ID NO: 553170 - DNA, 13 bp, D. melanogaster
aaatggaatacaa

SEQ ID NO: 553171 - DNA, 14 bp, D. melanogaster
aaatggaatacaaa

SEQ ID NO: 553172 - DNA, 13 bp, D. melanogaster
aaatggaatatgt

SEQ ID NO: 553173 - DNA, 13 bp, D. melanogaster
aaatggaatattt

SEQ ID NO: 553174 - DNA, 14 bp, D. melanogaster
aaatggaatatttt

SEQ ID NO: 553175 - DNA, 13 bp, D. melanogaster
aaatggaatcaat

SEQ ID NO: 553176 - DNA, 13 bp, D. melanogaster
aaatggaatccaa

SEQ ID NO: 553177 - DNA, 13 bp, D. melanogaster
aaatggaatcgaa

SEQ ID NO: 553178 - DNA, 13 bp, D. melanogaster
aaatggaatgcaa

SEQ ID NO: 553179 - DNA, 13 bp, D. melanogaster
aaatggaatgcca

SEQ ID NO: 553180 - DNA, 14 bp, D. melanogaster
aaatggaatggaat

SEQ ID NO: 553181 - DNA, 13 bp, D. melanogaster
aaatggaatggca

SEQ ID NO: 553182 - DNA, 13 bp, D. melanogaster
aaatggaatgtgt

SEQ ID NO: 553183 - DNA, 13 bp, D. melanogaster
aaatggaattatt

SEQ ID NO: 553184 - DNA, 13 bp, D. melanogaster
aaatggaattcaa

SEQ ID NO: 553185 - DNA, 14 bp, D. melanogaster
aaatggaattcaaa

SEQ ID NO: 553186 - DNA, 13 bp, D. melanogaster
aaatggaattcca

SEQ ID NO: 553187 - DNA, 13 bp, D. melanogaster
aaatggaattgct

SEQ ID NO: 553188 - DNA, 13 bp, D. melanogaster
aaatggaatttaa

SEQ ID NO: 553189 - DNA, 14 bp, D. melanogaster
aaatggaatttaat

SEQ ID NO: 553190 - DNA, 13 bp, D. melanogaster
aaatggaatttac

SEQ ID NO: 553191 - DNA, 14 bp, D. melanogaster
aaatggaatttgaa

SEQ ID NO: 553192 - DNA, 13 bp, D. melanogaster
aaatggaatttgt

SEQ ID NO: 553193 - DNA, 14 bp, D. melanogaster
aaatggaattttaa

SEQ ID NO: 553194 - DNA, 13 bp, D. melanogaster
aaatggaattttc

SEQ ID NO: 553195 - DNA, 13 bp, D. melanogaster
aaatggaattttt

SEQ ID NO: 553196 - DNA, 13 bp, D. melanogaster
aaatggacaaaat

SEQ ID NO: 553197 - DNA, 13 bp, D. melanogaster
aaatggacaaacg

SEQ ID NO: 553198 - DNA, 13 bp, D. melanogaster
aaatggacaacaa

SEQ ID NO: 553199 - DNA, 13 bp, D. melanogaster
aaatggacgaaga

SEQ ID NO: 553200 - DNA, 14 bp, D. melanogaster
aaatggactttaaa

SEQ ID NO: 553201 - DNA, 13 bp, D. melanogaster
aaatggagaaaca

SEQ ID NO: 553202 - DNA, 13 bp, D. melanogaster
aaatggagagcag

SEQ ID NO: 553203 - DNA, 13 bp, D. melanogaster
aaatggagcaaat

SEQ ID NO: 553204 - DNA, 13 bp, D. melanogaster
aaatggagcatta

SEQ ID NO: 553205 - DNA, 13 bp, D. melanogaster
aaatggaggagca

SEQ ID NO: 553206 - DNA, 13 bp, D. melanogaster
aaatggagtttct

SEQ ID NO: 553207 - DNA, 13 bp, D. melanogaster
aaatggataatta

SEQ ID NO: 553208 - DNA, 13 bp, D. melanogaster
aaatggatacaaa

SEQ ID NO: 553209 - DNA, 13 bp, D. melanogaster
aaatggatatata

SEQ ID NO: 553210 - DNA, 13 bp, D. melanogaster
aaatggatatatt

SEQ ID NO: 553211 - DNA, 13 bp, D. melanogaster
aaatggatatgca

SEQ ID NO: 553212 - DNA, 13 bp, D. melanogaster
aaatggatgaaat

SEQ ID NO: 553213 - DNA, 13 bp, D. melanogaster
aaatggatggaaa

SEQ ID NO: 553214 - DNA, 13 bp, D. melanogaster
aaatggatgtaaa

SEQ ID NO: 553215 - DNA, 13 bp, D. melanogaster
aaatggatgtgga

SEQ ID NO: 553216 - DNA, 13 bp, D. melanogaster
aaatggattaaat

SEQ ID NO: 553217 - DNA, 13 bp, D. melanogaster
aaatggattaatt

SEQ ID NO: 553218 - DNA, 13 bp, D. melanogaster
aaatggattacaa

SEQ ID NO: 553219 - DNA, 13 bp, D. melanogaster
aaatggattatat

SEQ ID NO: 553220 - DNA, 13 bp, D. melanogaster
aaatggattattt

SEQ ID NO: 553221 - DNA, 13 bp, D. melanogaster
aaatggattgaaa

SEQ ID NO: 553222 - DNA, 13 bp, D. melanogaster
aaatggattggaa

SEQ ID NO: 553223 - DNA, 13 bp, D. melanogaster
aaatggatttaaa

SEQ ID NO: 553224 - DNA, 13 bp, D. melanogaster
aaatggatttaat

SEQ ID NO: 553225 - DNA, 13 bp, D. melanogaster
aaatggatttcaa

SEQ ID NO: 553226 - DNA, 13 bp, D. melanogaster
aaatggatttcag

SEQ ID NO: 553227 - DNA, 13 bp, D. melanogaster
aaatggatttcat

SEQ ID NO: 553228 - DNA, 13 bp, D. melanogaster
aaatggatttcca

SEQ ID NO: 553229 - DNA, 14 bp, D. melanogaster
aaatggatttccaa

SEQ ID NO: 553230 - DNA, 13 bp, D. melanogaster
aaatggatttgat

SEQ ID NO: 553231 - DNA, 13 bp, D. melanogaster
aaatggatttgtt

SEQ ID NO: 553232 - DNA, 13 bp, D. melanogaster
aaatggattttaa

SEQ ID NO: 553233 - DNA, 14 bp, D. melanogaster
aaatggattttatt

SEQ ID NO: 553234 - DNA, 13 bp, D. melanogaster
aaatggattttcc

SEQ ID NO: 553235 - DNA, 13 bp, D. melanogaster
aaatggattttct

SEQ ID NO: 553236 - DNA, 13 bp, D. melanogaster
aaatggattttta

SEQ ID NO: 553237 - DNA, 14 bp, D. melanogaster
aaatggatttttat

SEQ ID NO: 553238 - DNA, 14 bp, D. melanogaster
aaatggcaaaaaac

SEQ ID NO: 553239 - DNA, 13 bp, D. melanogaster
aaatggcaaaaac

SEQ ID NO: 553240 - DNA, 14 bp, D. melanogaster
aaatggcaaaaaca

SEQ ID NO: 553241 - DNA, 13 bp, D. melanogaster
aaatggcaaaaat

SEQ ID NO: 553242 - DNA, 14 bp, D. melanogaster
aaatggcaaaaatg

SEQ ID NO: 553243 - DNA, 14 bp, D. melanogaster
aaatggcaaaaatt

SEQ ID NO: 553244 - DNA, 14 bp, D. melanogaster
aaatggcaaaacaa

SEQ ID NO: 553245 - DNA, 14 bp, D. melanogaster
aaatggcaaaagtt

SEQ ID NO: 553246 - DNA, 13 bp, D. melanogaster
aaatggcaaaatg

SEQ ID NO: 553247 - DNA, 13 bp, D. melanogaster
aaatggcaaacaa

SEQ ID NO: 553248 - DNA, 14 bp, D. melanogaster
aaatggcaaacaaa

SEQ ID NO: 553249 - DNA, 13 bp, D. melanogaster
aaatggcaaacag

SEQ ID NO: 553250 - DNA, 13 bp, D. melanogaster
aaatggcaaacta

SEQ ID NO: 553251 - DNA, 13 bp, D. melanogaster
aaatggcaaagaa

SEQ ID NO: 553252 - DNA, 14 bp, D. melanogaster
aaatggcaaagaaa

SEQ ID NO: 553253 - DNA, 13 bp, D. melanogaster
aaatggcaaagac

SEQ ID NO: 553254 - DNA, 13 bp, D. melanogaster
aaatggcaaagca

SEQ ID NO: 553255 - DNA, 13 bp, D. melanogaster
aaatggcaaaggg

SEQ ID NO: 553256 - DNA, 13 bp, D. melanogaster
aaatggcaaataa

SEQ ID NO: 553257 - DNA, 14 bp, D. melanogaster
aaatggcaaataat

SEQ ID NO: 553258 - DNA, 13 bp, D. melanogaster
aaatggcaaatgg

SEQ ID NO: 553259 - DNA, 14 bp, D. melanogaster
aaatggcaaatggc

SEQ ID NO: 553260 - DNA, 14 bp, D. melanogaster
aaatggcaaattaa

SEQ ID NO: 553261 - DNA, 13 bp, D. melanogaster
aaatggcaacaac

SEQ ID NO: 553262 - DNA, 13 bp, D. melanogaster
aaatggcaacaat

SEQ ID NO: 553263 - DNA, 13 bp, D. melanogaster
aaatggcaacaca

SEQ ID NO: 553264 - DNA, 13 bp, D. melanogaster
aaatggcaacagc

SEQ ID NO: 553265 - DNA, 14 bp, D. melanogaster
aaatggcaacagca

SEQ ID NO: 553266 - DNA, 13 bp, D. melanogaster
aaatggcaacgaa

SEQ ID NO: 553267 - DNA, 13 bp, D. melanogaster
aaatggcaactaa

SEQ ID NO: 553268 - DNA, 14 bp, D. melanogaster
aaatggcaactaaa

SEQ ID NO: 553269 - DNA, 13 bp, D. melanogaster
aaatggcaactga

SEQ ID NO: 553270 - DNA, 13 bp, D. melanogaster
aaatggcaagaaa

SEQ ID NO: 553271 - DNA, 14 bp, D. melanogaster
aaatggcaagaaaa

SEQ ID NO: 553272 - DNA, 13 bp, D. melanogaster
aaatggcaataaa

SEQ ID NO: 553273 - DNA, 13 bp, D. melanogaster
aaatggcaatata

SEQ ID NO: 553274 - DNA, 13 bp, D. melanogaster
aaatggcaatatg

SEQ ID NO: 553275 - DNA, 14 bp, D. melanogaster
aaatggcaatggaa

SEQ ID NO: 553276 - DNA, 13 bp, D. melanogaster
aaatggcaatggc

SEQ ID NO: 553277 - DNA, 13 bp, D. melanogaster
aaatggcaatggg

SEQ ID NO: 553278 - DNA, 13 bp, D. melanogaster
aaatggcaattaa

SEQ ID NO: 553279 - DNA, 14 bp, D. melanogaster
aaatggcaatttaa

SEQ ID NO: 553280 - DNA, 13 bp, D. melanogaster
aaatggcaatttg

SEQ ID NO: 553281 - DNA, 13 bp, D. melanogaster
aaatggcacaaaa

SEQ ID NO: 553282 - DNA, 14 bp, D. melanogaster
aaatggcacaaaaa

SEQ ID NO: 553283 - DNA, 13 bp, D. melanogaster
aaatggcacaaag

SEQ ID NO: 553284 - DNA, 13 bp, D. melanogaster
aaatggcacaaat

SEQ ID NO: 553285 - DNA, 13 bp, D. melanogaster
aaatggcacacaa

SEQ ID NO: 553286 - DNA, 13 bp, D. melanogaster
aaatggcacgcaa

SEQ ID NO: 553287 - DNA, 13 bp, D. melanogaster
aaatggcagaaaa

SEQ ID NO: 553288 - DNA, 13 bp, D. melanogaster
aaatggcagaagg

SEQ ID NO: 553289 - DNA, 13 bp, D. melanogaster
aaatggcagacaa

SEQ ID NO: 553290 - DNA, 13 bp, D. melanogaster
aaatggcagcaaa

SEQ ID NO: 553291 - DNA, 13 bp, D. melanogaster
aaatggcagccaa

SEQ ID NO: 553292 - DNA, 13 bp, D. melanogaster
aaatggcagccag

SEQ ID NO: 553293 - DNA, 13 bp, D. melanogaster
aaatggcagccga

SEQ ID NO: 553294 - DNA, 13 bp, D. melanogaster
aaatggcaggaaa

SEQ ID NO: 553295 - DNA, 14 bp, D. melanogaster
aaatggcaggaaaa

SEQ ID NO: 553296 - DNA, 13 bp, D. melanogaster
aaatggcagtggc

SEQ ID NO: 553297 - DNA, 13 bp, D. melanogaster
aaatggcataatc

SEQ ID NO: 553298 - DNA, 13 bp, D. melanogaster
aaatggcatgaaa

SEQ ID NO: 553299 - DNA, 13 bp, D. melanogaster
aaatggcatggaa

SEQ ID NO: 553300 - DNA, 13 bp, D. melanogaster
aaatggcattctt

SEQ ID NO: 553301 - DNA, 13 bp, D. melanogaster
aaatggcattgca

SEQ ID NO: 553302 - DNA, 13 bp, D. melanogaster
aaatggcatttaa

SEQ ID NO: 553303 - DNA, 14 bp, D. melanogaster
aaatggcatttaaa

SEQ ID NO: 553304 - DNA, 14 bp, D. melanogaster
aaatggcatttaat

SEQ ID NO: 553305 - DNA, 13 bp, D. melanogaster
aaatggccaaaag

SEQ ID NO: 553306 - DNA, 14 bp, D. melanogaster
aaatggccaaaagc

SEQ ID NO: 553307 - DNA, 13 bp, D. melanogaster
aaatggccaaaat

SEQ ID NO: 553308 - DNA, 14 bp, D. melanogaster
aaatggccaaaatg

SEQ ID NO: 553309 - DNA, 13 bp, D. melanogaster
aaatggccaaaca

SEQ ID NO: 553310 - DNA, 13 bp, D. melanogaster
aaatggccaaatg

SEQ ID NO: 553311 - DNA, 14 bp, D. melanogaster
aaatggccaacaaa

SEQ ID NO: 553312 - DNA, 13 bp, D. melanogaster
aaatggccaacag

SEQ ID NO: 553313 - DNA, 13 bp, D. melanogaster
aaatggccaacga

SEQ ID NO: 553314 - DNA, 13 bp, D. melanogaster
aaatggccaactg

SEQ ID NO: 553315 - DNA, 13 bp, D. melanogaster
aaatggccaagaa

SEQ ID NO: 553316 - DNA, 14 bp, D. melanogaster
aaatggccaagaaa

SEQ ID NO: 553317 - DNA, 13 bp, D. melanogaster
aaatggccaagac

SEQ ID NO: 553318 - DNA, 13 bp, D. melanogaster
aaatggccaagga

SEQ ID NO: 553319 - DNA, 13 bp, D. melanogaster
aaatggccaatgg

SEQ ID NO: 553320 - DNA, 13 bp, D. melanogaster
aaatggccacaaa

SEQ ID NO: 553321 - DNA, 14 bp, D. melanogaster
aaatggccacaaaa

SEQ ID NO: 553322 - DNA, 13 bp, D. melanogaster
aaatggccagaaa

SEQ ID NO: 553323 - DNA, 14 bp, D. melanogaster
aaatggccagcaaa

SEQ ID NO: 553324 - DNA, 13 bp, D. melanogaster
aaatggccagtgg

SEQ ID NO: 553325 - DNA, 13 bp, D. melanogaster
aaatggccataaa

SEQ ID NO: 553326 - DNA, 14 bp, D. melanogaster
aaatggccataaat

SEQ ID NO: 553327 - DNA, 13 bp, D. melanogaster
aaatggccattta

SEQ ID NO: 553328 - DNA, 13 bp, D. melanogaster
aaatggcccaaaa

SEQ ID NO: 553329 - DNA, 13 bp, D. melanogaster
aaatggccgcaaa

SEQ ID NO: 553330 - DNA, 14 bp, D. melanogaster
aaatggcgaaaaaa

SEQ ID NO: 553331 - DNA, 13 bp, D. melanogaster
aaatggcgaaaag

SEQ ID NO: 553332 - DNA, 13 bp, D. melanogaster
aaatggcgaatgg

SEQ ID NO: 553333 - DNA, 13 bp, D. melanogaster
aaatggcggcaaa

SEQ ID NO: 553334 - DNA, 13 bp, D. melanogaster
aaatggcgggaaa

SEQ ID NO: 553335 - DNA, 13 bp, D. melanogaster
aaatggcgtttaa

SEQ ID NO: 553336 - DNA, 13 bp, D. melanogaster
aaatggcgttttt

SEQ ID NO: 553337 - DNA, 13 bp, D. melanogaster
aaatggctaaaaa

SEQ ID NO: 553338 - DNA, 14 bp, D. melanogaster
aaatggctaaaaaa

SEQ ID NO: 553339 - DNA, 13 bp, D. melanogaster
aaatggctaaatg

SEQ ID NO: 553340 - DNA, 13 bp, D. melanogaster
aaatggctgaaaa

SEQ ID NO: 553341 - DNA, 13 bp, D. melanogaster
aaatggctgaaag

SEQ ID NO: 553342 - DNA, 13 bp, D. melanogaster
aaatggctgaaat

SEQ ID NO: 553343 - DNA, 13 bp, D. melanogaster
aaatggctgacaa

SEQ ID NO: 553344 - DNA, 13 bp, D. melanogaster
aaatggctgccaa

SEQ ID NO: 553345 - DNA, 13 bp, D. melanogaster
aaatggctgccag

SEQ ID NO: 553346 - DNA, 13 bp, D. melanogaster
aaatggctggaaa

SEQ ID NO: 553347 - DNA, 14 bp, D. melanogaster
aaatggctggcaaa

SEQ ID NO: 553348 - DNA, 13 bp, D. melanogaster
aaatggctggcag

SEQ ID NO: 553349 - DNA, 14 bp, D. melanogaster
aaatggctgtgcag

SEQ ID NO: 553350 - DNA, 13 bp, D. melanogaster
aaatggcttaaaa

SEQ ID NO: 553351 - DNA, 13 bp, D. melanogaster
aaatggcttacaa

SEQ ID NO: 553352 - DNA, 13 bp, D. melanogaster
aaatggcttgcaa

SEQ ID NO: 553353 - DNA, 13 bp, D. melanogaster
aaatggctttgaa

SEQ ID NO: 553354 - DNA, 13 bp, D. melanogaster
aaatggcttttat

SEQ ID NO: 553355 - DNA, 13 bp, D. melanogaster
aaatggctttttg

SEQ ID NO: 553356 - DNA, 14 bp, D. melanogaster
aaatgggaaaacaa

SEQ ID NO: 553357 - DNA, 13 bp, D. melanogaster
aaatgggaaaagc

SEQ ID NO: 553358 - DNA, 14 bp, D. melanogaster
aaatgggaaaagcg

SEQ ID NO: 553359 - DNA, 13 bp, D. melanogaster
aaatgggaaaatg

SEQ ID NO: 553360 - DNA, 14 bp, D. melanogaster
aaatgggaaaatgt

SEQ ID NO: 553361 - DNA, 13 bp, D. melanogaster
aaatgggaaacag

SEQ ID NO: 553362 - DNA, 13 bp, D. melanogaster
aaatgggaaacat

SEQ ID NO: 553363 - DNA, 13 bp, D. melanogaster
aaatgggaaatat

SEQ ID NO: 553364 - DNA, 13 bp, D. melanogaster
aaatgggaaatga

SEQ ID NO: 553365 - DNA, 13 bp, D. melanogaster
aaatgggaaatgg

SEQ ID NO: 553366 - DNA, 13 bp, D. melanogaster
aaatgggaaattg

SEQ ID NO: 553367 - DNA, 13 bp, D. melanogaster
aaatgggaattaa

SEQ ID NO: 553368 - DNA, 13 bp, D. melanogaster
aaatgggagcaaa

SEQ ID NO: 553369 - DNA, 13 bp, D. melanogaster
aaatgggaggcac

SEQ ID NO: 553370 - DNA, 13 bp, D. melanogaster
aaatgggataaat

SEQ ID NO: 553371 - DNA, 13 bp, D. melanogaster
aaatgggatggtt

SEQ ID NO: 553372 - DNA, 13 bp, D. melanogaster
aaatgggattggg

SEQ ID NO: 553373 - DNA, 13 bp, D. melanogaster
aaatgggattttc

SEQ ID NO: 553374 - DNA, 13 bp, D. melanogaster
aaatgggattttt

SEQ ID NO: 553375 - DNA, 13 bp, D. melanogaster
aaatgggcaaaag

SEQ ID NO: 553376 - DNA, 14 bp, D. melanogaster
aaatgggcaaacaa

SEQ ID NO: 553377 - DNA, 13 bp, D. melanogaster
aaatgggcaaatg

SEQ ID NO: 553378 - DNA, 13 bp, D. melanogaster
aaatgggcaacaa

SEQ ID NO: 553379 - DNA, 13 bp, D. melanogaster
aaatgggcaataa

SEQ ID NO: 553380 - DNA, 13 bp, D. melanogaster
aaatgggcatggg

SEQ ID NO: 553381 - DNA, 13 bp, D. melanogaster
aaatgggccaaaa

SEQ ID NO: 553382 - DNA, 13 bp, D. melanogaster
aaatgggccaaca

SEQ ID NO: 553383 - DNA, 13 bp, D. melanogaster
aaatgggccaaga

SEQ ID NO: 553384 - DNA, 13 bp, D. melanogaster
aaatgggcggaaa

SEQ ID NO: 553385 - DNA, 13 bp, D. melanogaster
aaatgggcgggaa

SEQ ID NO: 553386 - DNA, 13 bp, D. melanogaster
aaatgggcggtgg

SEQ ID NO: 553387 - DNA, 13 bp, D. melanogaster
aaatgggcgtggc

SEQ ID NO: 553388 - DNA, 14 bp, D. melanogaster
aaatgggcgtggca

SEQ ID NO: 553389 - DNA, 13 bp, D. melanogaster
aaatgggctaaaa

SEQ ID NO: 553390 - DNA, 13 bp, D. melanogaster
aaatgggctttaa

SEQ ID NO: 553391 - DNA, 13 bp, D. melanogaster
aaatggggaaaat

SEQ ID NO: 553392 - DNA, 13 bp, D. melanogaster
aaatggggaaagt

SEQ ID NO: 553393 - DNA, 13 bp, D. melanogaster
aaatggggaatgg

SEQ ID NO: 553394 - DNA, 13 bp, D. melanogaster
aaatggggttttt

SEQ ID NO: 553395 - DNA, 13 bp, D. melanogaster
aaatgggtaaaat

SEQ ID NO: 553396 - DNA, 13 bp, D. melanogaster
aaatgggtattat

SEQ ID NO: 553397 - DNA, 13 bp, D. melanogaster
aaatgggtggaaa

SEQ ID NO: 553398 - DNA, 14 bp, D. melanogaster
aaatgggtttttaa

SEQ ID NO: 553399 - DNA, 13 bp, D. melanogaster
aaatggtaaaatg

SEQ ID NO: 553400 - DNA, 13 bp, D. melanogaster
aaatggtaaacaa

SEQ ID NO: 553401 - DNA, 13 bp, D. melanogaster
aaatggtaaatat

SEQ ID NO: 553402 - DNA, 13 bp, D. melanogaster
aaatggtaaatgg

SEQ ID NO: 553403 - DNA, 13 bp, D. melanogaster
aaatggtaaatta

SEQ ID NO: 553404 - DNA, 13 bp, D. melanogaster
aaatggtaatatt

SEQ ID NO: 553405 - DNA, 13 bp, D. melanogaster
aaatggtaatgaa

SEQ ID NO: 553406 - DNA, 13 bp, D. melanogaster
aaatggtaatggt

SEQ ID NO: 553407 - DNA, 15 bp, D. melanogaster
aaatggtacttcttt

SEQ ID NO: 553408 - DNA, 13 bp, D. melanogaster
aaatggtatagag

SEQ ID NO: 553409 - DNA, 13 bp, D. melanogaster
aaatggtatccaa

SEQ ID NO: 553410 - DNA, 13 bp, D. melanogaster
aaatggtattgaa

SEQ ID NO: 553411 - DNA, 13 bp, D. melanogaster
aaatggtatttca

SEQ ID NO: 553412 - DNA, 13 bp, D. melanogaster
aaatggtattttt

SEQ ID NO: 553413 - DNA, 13 bp, D. melanogaster
aaatggtcaacaa

SEQ ID NO: 553414 - DNA, 13 bp, D. melanogaster
aaatggtcacaga

SEQ ID NO: 553415 - DNA, 13 bp, D. melanogaster
aaatggtcagcga

SEQ ID NO: 553416 - DNA, 14 bp, D. melanogaster
aaatggtcagcgaa

SEQ ID NO: 553417 - DNA, 13 bp, D. melanogaster
aaatggtcataaa

SEQ ID NO: 553418 - DNA, 13 bp, D. melanogaster
aaatggtcatttt

SEQ ID NO: 553419 - DNA, 13 bp, D. melanogaster
aaatggtgaaatt

SEQ ID NO: 553420 - DNA, 13 bp, D. melanogaster
aaatggtggaaaa

SEQ ID NO: 553421 - DNA, 14 bp, D. melanogaster
aaatggtggaacaa

SEQ ID NO: 553422 - DNA, 13 bp, D. melanogaster
aaatggtgggcaa

SEQ ID NO: 553423 - DNA, 14 bp, D. melanogaster
aaatggtgggcaaa

SEQ ID NO: 553424 - DNA, 13 bp, D. melanogaster
aaatggtgtgaaa

SEQ ID NO: 553425 - DNA, 13 bp, D. melanogaster
aaatggttaaaca

SEQ ID NO: 553426 - DNA, 13 bp, D. melanogaster
aaatggttaaata

SEQ ID NO: 553427 - DNA, 13 bp, D. melanogaster
aaatggttaatat

SEQ ID NO: 553428 - DNA, 13 bp, D. melanogaster
aaatggttaattg

SEQ ID NO: 553429 - DNA, 13 bp, D. melanogaster
aaatggttaattt

SEQ ID NO: 553430 - DNA, 13 bp, D. melanogaster
aaatggttacaaa

SEQ ID NO: 553431 - DNA, 13 bp, D. melanogaster
aaatggttataaa

SEQ ID NO: 553432 - DNA, 13 bp, D. melanogaster
aaatggttatata

SEQ ID NO: 553433 - DNA, 13 bp, D. melanogaster
aaatggttcaaaa

SEQ ID NO: 553434 - DNA, 13 bp, D. melanogaster
aaatggttctgtc

SEQ ID NO: 553435 - DNA, 13 bp, D. melanogaster
aaatggttgaaaa

SEQ ID NO: 553436 - DNA, 13 bp, D. melanogaster
aaatggttgaatg

SEQ ID NO: 553437 - DNA, 13 bp, D. melanogaster
aaatggttgcaaa

SEQ ID NO: 553438 - DNA, 13 bp, D. melanogaster
aaatggttgcaat

SEQ ID NO: 553439 - DNA, 14 bp, D. melanogaster
aaatggttgcaata

SEQ ID NO: 553440 - DNA, 13 bp, D. melanogaster
aaatggttgtttt

SEQ ID NO: 553441 - DNA, 13 bp, D. melanogaster
aaatggtttaaat

SEQ ID NO: 553442 - DNA, 13 bp, D. melanogaster
aaatggtttaatt

SEQ ID NO: 553443 - DNA, 13 bp, D. melanogaster
aaatggtttcaaa

SEQ ID NO: 553444 - DNA, 13 bp, D. melanogaster
aaatggtttcaga

SEQ ID NO: 553445 - DNA, 13 bp, D. melanogaster
aaatggtttgatt

SEQ ID NO: 553446 - DNA, 13 bp, D. melanogaster
aaatggtttggaa

SEQ ID NO: 553447 - DNA, 13 bp, D. melanogaster
aaatggtttgttt

SEQ ID NO: 553448 - DNA, 13 bp, D. melanogaster
aaatggttttaaa

SEQ ID NO: 553449 - DNA, 13 bp, D. melanogaster
aaatggttttaat

SEQ ID NO: 553450 - DNA, 14 bp, D. melanogaster
aaatggttttaatt

SEQ ID NO: 553451 - DNA, 13 bp, D. melanogaster
aaatggttttact

SEQ ID NO: 553452 - DNA, 13 bp, D. melanogaster
aaatggttttcaa

SEQ ID NO: 553453 - DNA, 13 bp, D. melanogaster
aaatggttttcca

SEQ ID NO: 553454 - DNA, 13 bp, D. melanogaster
aaatggttttgca

SEQ ID NO: 553455 - DNA, 13 bp, D. melanogaster
aaatggttttgtt

SEQ ID NO: 553456 - DNA, 13 bp, D. melanogaster
aaatggtttttaa

SEQ ID NO: 553457 - DNA, 14 bp, D. melanogaster
aaatggtttttaat

SEQ ID NO: 553458 - DNA, 13 bp, D. melanogaster
aaatggtttttgg

SEQ ID NO: 553459 - DNA, 13 bp, D. melanogaster
aaatgtaaaagtt

SEQ ID NO: 553460 - DNA, 13 bp, D. melanogaster
aaatgtaaaatca

SEQ ID NO: 553461 - DNA, 13 bp, D. melanogaster
aaatgtaaaatcc

SEQ ID NO: 553462 - DNA, 13 bp, D. melanogaster
aaatgtaaaatgc

SEQ ID NO: 553463 - DNA, 14 bp, D. melanogaster
aaatgtaaaatgca

SEQ ID NO: 553464 - DNA, 14 bp, D. melanogaster
aaatgtaaaatgtt

SEQ ID NO: 553465 - DNA, 13 bp, D. melanogaster
aaatgtaaacaat

SEQ ID NO: 553466 - DNA, 13 bp, D. melanogaster
aaatgtaaactat

SEQ ID NO: 553467 - DNA, 13 bp, D. melanogaster
aaatgtaaacttt

SEQ ID NO: 553468 - DNA, 13 bp, D. melanogaster
aaatgtaaagtcc

SEQ ID NO: 553469 - DNA, 14 bp, D. melanogaster
aaatgtaaatacaa

SEQ ID NO: 553470 - DNA, 13 bp, D. melanogaster
aaatgtaaatatg

SEQ ID NO: 553471 - DNA, 13 bp, D. melanogaster
aaatgtaaatcga

SEQ ID NO: 553472 - DNA, 14 bp, D. melanogaster
aaatgtaaatcttt

SEQ ID NO: 553473 - DNA, 13 bp, D. melanogaster
aaatgtaaatgat

SEQ ID NO: 553474 - DNA, 13 bp, D. melanogaster
aaatgtaaatgca

SEQ ID NO: 553475 - DNA, 14 bp, D. melanogaster
aaatgtaaatgcaa

SEQ ID NO: 553476 - DNA, 13 bp, D. melanogaster
aaatgtaaatgct

SEQ ID NO: 553477 - DNA, 13 bp, D. melanogaster
aaatgtaaatgga

SEQ ID NO: 553478 - DNA, 13 bp, D. melanogaster
aaatgtaaattga

SEQ ID NO: 553479 - DNA, 13 bp, D. melanogaster
aaatgtaaattgt

SEQ ID NO: 553480 - DNA, 13 bp, D. melanogaster
aaatgtaacagaa

SEQ ID NO: 553481 - DNA, 13 bp, D. melanogaster
aaatgtaacattt

SEQ ID NO: 553482 - DNA, 14 bp, D. melanogaster
aaatgtaacatttt

SEQ ID NO: 553483 - DNA, 13 bp, D. melanogaster
aaatgtaaccaaa

SEQ ID NO: 553484 - DNA, 13 bp, D. melanogaster
aaatgtaacgaaa

SEQ ID NO: 553485 - DNA, 13 bp, D. melanogaster
aaatgtaactaaa

SEQ ID NO: 553486 - DNA, 13 bp, D. melanogaster
aaatgtaagccaa

SEQ ID NO: 553487 - DNA, 13 bp, D. melanogaster
aaatgtaatacaa

SEQ ID NO: 553488 - DNA, 13 bp, D. melanogaster
aaatgtaatctaa

SEQ ID NO: 553489 - DNA, 13 bp, D. melanogaster
aaatgtaatgcaa

SEQ ID NO: 553490 - DNA, 13 bp, D. melanogaster
aaatgtaatgtaa

SEQ ID NO: 553491 - DNA, 13 bp, D. melanogaster
aaatgtaattaca

SEQ ID NO: 553492 - DNA, 13 bp, D. melanogaster
aaatgtaattgaa

SEQ ID NO: 553493 - DNA, 13 bp, D. melanogaster
aaatgtaatttcc

SEQ ID NO: 553494 - DNA, 14 bp, D. melanogaster
aaatgtaatttgca

SEQ ID NO: 553495 - DNA, 13 bp, D. melanogaster
aaatgtaattttc

SEQ ID NO: 553496 - DNA, 14 bp, D. melanogaster
aaatgtacaaaaag

SEQ ID NO: 553497 - DNA, 13 bp, D. melanogaster
aaatgtacaaaat

SEQ ID NO: 553498 - DNA, 13 bp, D. melanogaster
aaatgtacaaaca

SEQ ID NO: 553499 - DNA, 13 bp, D. melanogaster
aaatgtacaaatc

SEQ ID NO: 553500 - DNA, 13 bp, D. melanogaster
aaatgtacaaatt

SEQ ID NO: 553501 - DNA, 13 bp, D. melanogaster
aaatgtacacaaa

SEQ ID NO: 553502 - DNA, 14 bp, D. melanogaster
aaatgtacacaaaa

SEQ ID NO: 553503 - DNA, 13 bp, D. melanogaster
aaatgtacataca

SEQ ID NO: 553504 - DNA, 13 bp, D. melanogaster
aaatgtacatcaa

SEQ ID NO: 553505 - DNA, 13 bp, D. melanogaster
aaatgtacgaaaa

SEQ ID NO: 553506 - DNA, 13 bp, D. melanogaster
aaatgtacgaaat

SEQ ID NO: 553507 - DNA, 13 bp, D. melanogaster
aaatgtacttaaa

SEQ ID NO: 553508 - DNA, 13 bp, D. melanogaster
aaatgtacttaat

SEQ ID NO: 553509 - DNA, 13 bp, D. melanogaster
aaatgtacttcaa

SEQ ID NO: 553510 - DNA, 13 bp, D. melanogaster
aaatgtagaaatt

SEQ ID NO: 553511 - DNA, 13 bp, D. melanogaster
aaatgtagaacag

SEQ ID NO: 553512 - DNA, 14 bp, D. melanogaster
aaatgtagaacaga

SEQ ID NO: 553513 - DNA, 13 bp, D. melanogaster
aaatgtagcaaaa

SEQ ID NO: 553514 - DNA, 13 bp, D. melanogaster
aaatgtagcattt

SEQ ID NO: 553515 - DNA, 13 bp, D. melanogaster
aaatgtaggtaaa

SEQ ID NO: 553516 - DNA, 13 bp, D. melanogaster
aaatgtagtgaaa

SEQ ID NO: 553517 - DNA, 13 bp, D. melanogaster
aaatgtagtggtc

SEQ ID NO: 553518 - DNA, 13 bp, D. melanogaster
aaatgtagttata

SEQ ID NO: 553519 - DNA, 13 bp, D. melanogaster
aaatgtagttcaa

SEQ ID NO: 553520 - DNA, 13 bp, D. melanogaster
aaatgtataaatg

SEQ ID NO: 553521 - DNA, 13 bp, D. melanogaster
aaatgtataatga

SEQ ID NO: 553522 - DNA, 14 bp, D. melanogaster
aaatgtatacaaaa

SEQ ID NO: 553523 - DNA, 13 bp, D. melanogaster
aaatgtatacaat

SEQ ID NO: 553524 - DNA, 13 bp, D. melanogaster
aaatgtatacata

SEQ ID NO: 553525 - DNA, 13 bp, D. melanogaster
aaatgtatagata

SEQ ID NO: 553526 - DNA, 13 bp, D. melanogaster
aaatgtatataag

SEQ ID NO: 553527 - DNA, 14 bp, D. melanogaster
aaatgtatatacat

SEQ ID NO: 553528 - DNA, 13 bp, D. melanogaster
aaatgtatatagt

SEQ ID NO: 553529 - DNA, 14 bp, D. melanogaster
aaatgtatatgtat

SEQ ID NO: 553530 - DNA, 13 bp, D. melanogaster
aaatgtatatgtt

SEQ ID NO: 553531 - DNA, 13 bp, D. melanogaster
aaatgtatattac

SEQ ID NO: 553532 - DNA, 13 bp, D. melanogaster
aaatgtatattca

SEQ ID NO: 553533 - DNA, 13 bp, D. melanogaster
aaatgtatcaaaa

SEQ ID NO: 553534 - DNA, 13 bp, D. melanogaster
aaatgtatccaaa

SEQ ID NO: 553535 - DNA, 13 bp, D. melanogaster
aaatgtatctaaa

SEQ ID NO: 553536 - DNA, 13 bp, D. melanogaster
aaatgtatctaat

SEQ ID NO: 553537 - DNA, 13 bp, D. melanogaster
aaatgtatctaca

SEQ ID NO: 553538 - DNA, 13 bp, D. melanogaster
aaatgtatctata

SEQ ID NO: 553539 - DNA, 13 bp, D. melanogaster
aaatgtatctcaa

SEQ ID NO: 553540 - DNA, 13 bp, D. melanogaster
aaatgtatctgaa

SEQ ID NO: 553541 - DNA, 13 bp, D. melanogaster
aaatgtatctgag

SEQ ID NO: 553542 - DNA, 13 bp, D. melanogaster
aaatgtatctgca

SEQ ID NO: 553543 - DNA, 14 bp, D. melanogaster
aaatgtatctgcaa

SEQ ID NO: 553544 - DNA, 14 bp, D. melanogaster
aaatgtatctgcat

SEQ ID NO: 553545 - DNA, 13 bp, D. melanogaster
aaatgtatctgta

SEQ ID NO: 553546 - DNA, 14 bp, D. melanogaster
aaatgtatctgtat

SEQ ID NO: 553547 - DNA, 13 bp, D. melanogaster
aaatgtatcttaa

SEQ ID NO: 553548 - DNA, 14 bp, D. melanogaster
aaatgtatcttaaa

SEQ ID NO: 553549 - DNA, 13 bp, D. melanogaster
aaatgtatctttt

SEQ ID NO: 553550 - DNA, 14 bp, D. melanogaster
aaatgtatcttttg

SEQ ID NO: 553551 - DNA, 14 bp, D. melanogaster
aaatgtatcttttt

SEQ ID NO: 553552 - DNA, 13 bp, D. melanogaster
aaatgtatgaatg

SEQ ID NO: 553553 - DNA, 13 bp, D. melanogaster
aaatgtatgattt

SEQ ID NO: 553554 - DNA, 13 bp, D. melanogaster
aaatgtatgcaaa

SEQ ID NO: 553555 - DNA, 14 bp, D. melanogaster
aaatgtatgcaaaa

SEQ ID NO: 553556 - DNA, 14 bp, D. melanogaster
aaatgtatgcaaat

SEQ ID NO: 553557 - DNA, 14 bp, D. melanogaster
aaatgtatgtaaat

SEQ ID NO: 553558 - DNA, 14 bp, D. melanogaster
aaatgtatgtattt

SEQ ID NO: 553559 - DNA, 13 bp, D. melanogaster
aaatgtatgtgtg

SEQ ID NO: 553560 - DNA, 13 bp, D. melanogaster
aaatgtatgtttc

SEQ ID NO: 553561 - DNA, 14 bp, D. melanogaster
aaatgtattaaaac

SEQ ID NO: 553562 - DNA, 13 bp, D. melanogaster
aaatgtattaatc

SEQ ID NO: 553563 - DNA, 13 bp, D. melanogaster
aaatgtattacaa

SEQ ID NO: 553564 - DNA, 14 bp, D. melanogaster
aaatgtattacatt

SEQ ID NO: 553565 - DNA, 13 bp, D. melanogaster
aaatgtattactt

SEQ ID NO: 553566 - DNA, 14 bp, D. melanogaster
aaatgtattacttg

SEQ ID NO: 553567 - DNA, 13 bp, D. melanogaster
aaatgtattagtt

SEQ ID NO: 553568 - DNA, 14 bp, D. melanogaster
aaatgtattatgaa

SEQ ID NO: 553569 - DNA, 13 bp, D. melanogaster
aaatgtattattg

SEQ ID NO: 553570 - DNA, 14 bp, D. melanogaster
aaatgtattattgc

SEQ ID NO: 553571 - DNA, 13 bp, D. melanogaster
aaatgtattcaaa

SEQ ID NO: 553572 - DNA, 14 bp, D. melanogaster
aaatgtattcaaaa

SEQ ID NO: 553573 - DNA, 13 bp, D. melanogaster
aaatgtattcatt

SEQ ID NO: 553574 - DNA, 13 bp, D. melanogaster
aaatgtattgaaa

SEQ ID NO: 553575 - DNA, 13 bp, D. melanogaster
aaatgtattgcaa

SEQ ID NO: 553576 - DNA, 13 bp, D. melanogaster
aaatgtattgcat

SEQ ID NO: 553577 - DNA, 13 bp, D. melanogaster
aaatgtattgtat

SEQ ID NO: 553578 - DNA, 13 bp, D. melanogaster
aaatgtatttaca

SEQ ID NO: 553579 - DNA, 13 bp, D. melanogaster
aaatgtatttcag

SEQ ID NO: 553580 - DNA, 13 bp, D. melanogaster
aaatgtatttctt

SEQ ID NO: 553581 - DNA, 13 bp, D. melanogaster
aaatgtatttgct

SEQ ID NO: 553582 - DNA, 14 bp, D. melanogaster
aaatgtatttgtta

SEQ ID NO: 553583 - DNA, 14 bp, D. melanogaster
aaatgtattttcat

SEQ ID NO: 553584 - DNA, 13 bp, D. melanogaster
aaatgtattttcc

SEQ ID NO: 553585 - DNA, 14 bp, D. melanogaster
aaatgtattttgaa

SEQ ID NO: 553586 - DNA, 14 bp, D. melanogaster
aaatgtatttttac

SEQ ID NO: 553587 - DNA, 13 bp, D. melanogaster
aaatgtatttttc

SEQ ID NO: 553588 - DNA, 13 bp, D. melanogaster
aaatgtatttttg

SEQ ID NO: 553589 - DNA, 14 bp, D. melanogaster
aaatgtatttttga

SEQ ID NO: 553590 - DNA, 13 bp, D. melanogaster
aaatgtcaaaatg

SEQ ID NO: 553591 - DNA, 13 bp, D. melanogaster
aaatgtcaaaatt

SEQ ID NO: 553592 - DNA, 14 bp, D. melanogaster
aaatgtcaaacaaa

SEQ ID NO: 553593 - DNA, 13 bp, D. melanogaster
aaatgtcaaactt

SEQ ID NO: 553594 - DNA, 13 bp, D. melanogaster
aaatgtcaaagtt

SEQ ID NO: 553595 - DNA, 13 bp, D. melanogaster
aaatgtcaaatgt

SEQ ID NO: 553596 - DNA, 13 bp, D. melanogaster
aaatgtcaaattg

SEQ ID NO: 553597 - DNA, 13 bp, D. melanogaster
aaatgtcaacagc

SEQ ID NO: 553598 - DNA, 13 bp, D. melanogaster
aaatgtcaatgca

SEQ ID NO: 553599 - DNA, 13 bp, D. melanogaster
aaatgtcaattgt

SEQ ID NO: 553600 - DNA, 13 bp, D. melanogaster
aaatgtcaattta

SEQ ID NO: 553601 - DNA, 13 bp, D. melanogaster
aaatgtcaatttt

SEQ ID NO: 553602 - DNA, 13 bp, D. melanogaster
aaatgtcacaatt

SEQ ID NO: 553603 - DNA, 13 bp, D. melanogaster
aaatgtcacattt

SEQ ID NO: 553604 - DNA, 13 bp, D. melanogaster
aaatgtcagaaat

SEQ ID NO: 553605 - DNA, 13 bp, D. melanogaster
aaatgtcagttgg

SEQ ID NO: 553606 - DNA, 13 bp, D. melanogaster
aaatgtcataaaa

SEQ ID NO: 553607 - DNA, 14 bp, D. melanogaster
aaatgtcataaaaa

SEQ ID NO: 553608 - DNA, 13 bp, D. melanogaster
aaatgtcataaat

SEQ ID NO: 553609 - DNA, 14 bp, D. melanogaster
aaatgtcataaatt

SEQ ID NO: 553610 - DNA, 13 bp, D. melanogaster
aaatgtcattaaa

SEQ ID NO: 553611 - DNA, 14 bp, D. melanogaster
aaatgtcattaaat

SEQ ID NO: 553612 - DNA, 13 bp, D. melanogaster
aaatgtcattcat

SEQ ID NO: 553613 - DNA, 13 bp, D. melanogaster
aaatgtcattgca

SEQ ID NO: 553614 - DNA, 13 bp, D. melanogaster
aaatgtcatttaa

SEQ ID NO: 553615 - DNA, 13 bp, D. melanogaster
aaatgtcatttgt

SEQ ID NO: 553616 - DNA, 13 bp, D. melanogaster
aaatgtccattaa

SEQ ID NO: 553617 - DNA, 13 bp, D. melanogaster
aaatgtccgaaaa

SEQ ID NO: 553618 - DNA, 13 bp, D. melanogaster
aaatgtcctttaa

SEQ ID NO: 553619 - DNA, 13 bp, D. melanogaster
aaatgtcgaaaaa

SEQ ID NO: 553620 - DNA, 13 bp, D. melanogaster
aaatgtcgcaaaa

SEQ ID NO: 553621 - DNA, 13 bp, D. melanogaster
aaatgtcgccaaa

SEQ ID NO: 553622 - DNA, 13 bp, D. melanogaster
aaatgtctattga

SEQ ID NO: 553623 - DNA, 13 bp, D. melanogaster
aaatgtctcaagt

SEQ ID NO: 553624 - DNA, 14 bp, D. melanogaster
aaatgtctcaagtg

SEQ ID NO: 553625 - DNA, 13 bp, D. melanogaster
aaatgtctcttca

SEQ ID NO: 553626 - DNA, 13 bp, D. melanogaster
aaatgtctgccaa

SEQ ID NO: 553627 - DNA, 13 bp, D. melanogaster
aaatgtctggcaa

SEQ ID NO: 553628 - DNA, 13 bp, D. melanogaster
aaatgtcttaaaa

SEQ ID NO: 553629 - DNA, 13 bp, D. melanogaster
aaatgtcttgaaa

SEQ ID NO: 553630 - DNA, 13 bp, D. melanogaster
aaatgtgaaaagt

SEQ ID NO: 553631 - DNA, 13 bp, D. melanogaster
aaatgtgaaaatc

SEQ ID NO: 553632 - DNA, 13 bp, D. melanogaster
aaatgtgaaaatt

SEQ ID NO: 553633 - DNA, 14 bp, D. melanogaster
aaatgtgaaaattt

SEQ ID NO: 553634 - DNA, 13 bp, D. melanogaster
aaatgtgaaacat

SEQ ID NO: 553635 - DNA, 13 bp, D. melanogaster
aaatgtgaaacta

SEQ ID NO: 553636 - DNA, 13 bp, D. melanogaster
aaatgtgaaactt

SEQ ID NO: 553637 - DNA, 13 bp, D. melanogaster
aaatgtgaaatat

SEQ ID NO: 553638 - DNA, 14 bp, D. melanogaster
aaatgtgaaatatt

SEQ ID NO: 553639 - DNA, 13 bp, D. melanogaster
aaatgtgaaatgt

SEQ ID NO: 553640 - DNA, 14 bp, D. melanogaster
aaatgtgaaatgtg

SEQ ID NO: 553641 - DNA, 13 bp, D. melanogaster
aaatgtgaacaaa

SEQ ID NO: 553642 - DNA, 13 bp, D. melanogaster
aaatgtgaatatt

SEQ ID NO: 553643 - DNA, 13 bp, D. melanogaster
aaatgtgaatgaa

SEQ ID NO: 553644 - DNA, 13 bp, D. melanogaster
aaatgtgaatgca

SEQ ID NO: 553645 - DNA, 13 bp, D. melanogaster
aaatgtgacaaaa

SEQ ID NO: 553646 - DNA, 13 bp, D. melanogaster
aaatgtgacaaat

SEQ ID NO: 553647 - DNA, 13 bp, D. melanogaster
aaatgtgacattt

SEQ ID NO: 553648 - DNA, 13 bp, D. melanogaster
aaatgtgactaaa

SEQ ID NO: 553649 - DNA, 13 bp, D. melanogaster
aaatgtgagcaaa

SEQ ID NO: 553650 - DNA, 13 bp, D. melanogaster
aaatgtgaggaaa

SEQ ID NO: 553651 - DNA, 13 bp, D. melanogaster
aaatgtgagtgtg

SEQ ID NO: 553652 - DNA, 13 bp, D. melanogaster
aaatgtgataaat

SEQ ID NO: 553653 - DNA, 13 bp, D. melanogaster
aaatgtgatataa

SEQ ID NO: 553654 - DNA, 13 bp, D. melanogaster
aaatgtgatgaaa

SEQ ID NO: 553655 - DNA, 13 bp, D. melanogaster
aaatgtgattaaa

SEQ ID NO: 553656 - DNA, 13 bp, D. melanogaster
aaatgtgattatt

SEQ ID NO: 553657 - DNA, 13 bp, D. melanogaster
aaatgtgattttt

SEQ ID NO: 553658 - DNA, 13 bp, D. melanogaster
aaatgtgcaaaaa

SEQ ID NO: 553659 - DNA, 14 bp, D. melanogaster
aaatgtgcaaaaat

SEQ ID NO: 553660 - DNA, 13 bp, D. melanogaster
aaatgtgcaaaat

SEQ ID NO: 553661 - DNA, 14 bp, D. melanogaster
aaatgtgcaaaata

SEQ ID NO: 553662 - DNA, 13 bp, D. melanogaster
aaatgtgcaaaga

SEQ ID NO: 553663 - DNA, 13 bp, D. melanogaster
aaatgtgcaaagg

SEQ ID NO: 553664 - DNA, 14 bp, D. melanogaster
aaatgtgcaaataa

SEQ ID NO: 553665 - DNA, 13 bp, D. melanogaster
aaatgtgcaaatg

SEQ ID NO: 553666 - DNA, 13 bp, D. melanogaster
aaatgtgcaaatt

SEQ ID NO: 553667 - DNA, 13 bp, D. melanogaster
aaatgtgcaataa

SEQ ID NO: 553668 - DNA, 14 bp, D. melanogaster
aaatgtgcaataaa

SEQ ID NO: 553669 - DNA, 14 bp, D. melanogaster
aaatgtgcaattaa

SEQ ID NO: 553670 - DNA, 13 bp, D. melanogaster
aaatgtgcaattt

SEQ ID NO: 553671 - DNA, 13 bp, D. melanogaster
aaatgtgcacaaa

SEQ ID NO: 553672 - DNA, 13 bp, D. melanogaster
aaatgtgcagaaa

SEQ ID NO: 553673 - DNA, 13 bp, D. melanogaster
aaatgtgcagcaa

SEQ ID NO: 553674 - DNA, 13 bp, D. melanogaster
aaatgtgcataaa

SEQ ID NO: 553675 - DNA, 14 bp, D. melanogaster
aaatgtgcataaat

SEQ ID NO: 553676 - DNA, 13 bp, D. melanogaster
aaatgtgcatatg

SEQ ID NO: 553677 - DNA, 14 bp, D. melanogaster
aaatgtgcattaaa

SEQ ID NO: 553678 - DNA, 13 bp, D. melanogaster
aaatgtgcattta

SEQ ID NO: 553679 - DNA, 13 bp, D. melanogaster
aaatgtgcatttt

SEQ ID NO: 553680 - DNA, 13 bp, D. melanogaster
aaatgtgccaaaa

SEQ ID NO: 553681 - DNA, 14 bp, D. melanogaster
aaatgtgccaaaaa

SEQ ID NO: 553682 - DNA, 13 bp, D. melanogaster
aaatgtgcgaaat

SEQ ID NO: 553683 - DNA, 13 bp, D. melanogaster
aaatgtgcgcaaa

SEQ ID NO: 553684 - DNA, 13 bp, D. melanogaster
aaatgtgcgtaac

SEQ ID NO: 553685 - DNA, 13 bp, D. melanogaster
aaatgtgctaaaa

SEQ ID NO: 553686 - DNA, 13 bp, D. melanogaster
aaatgtgctgaaa

SEQ ID NO: 553687 - DNA, 13 bp, D. melanogaster
aaatgtgctgatc

SEQ ID NO: 553688 - DNA, 13 bp, D. melanogaster
aaatgtgctgtgc

SEQ ID NO: 553689 - DNA, 13 bp, D. melanogaster
aaatgtgcttaaa

SEQ ID NO: 553690 - DNA, 13 bp, D. melanogaster
aaatgtgctttta

SEQ ID NO: 553691 - DNA, 14 bp, D. melanogaster
aaatgtggaaaagt

SEQ ID NO: 553692 - DNA, 13 bp, D. melanogaster
aaatgtggaaaat

SEQ ID NO: 553693 - DNA, 14 bp, D. melanogaster
aaatgtggaaaatt

SEQ ID NO: 553694 - DNA, 13 bp, D. melanogaster
aaatgtggagaaa

SEQ ID NO: 553695 - DNA, 14 bp, D. melanogaster
aaatgtggagcaga

SEQ ID NO: 553696 - DNA, 13 bp, D. melanogaster
aaatgtggatacc

SEQ ID NO: 553697 - DNA, 13 bp, D. melanogaster
aaatgtggcaaca

SEQ ID NO: 553698 - DNA, 13 bp, D. melanogaster
aaatgtggcataa

SEQ ID NO: 553699 - DNA, 13 bp, D. melanogaster
aaatgtggcattt

SEQ ID NO: 553700 - DNA, 13 bp, D. melanogaster
aaatgtggccaaa

SEQ ID NO: 553701 - DNA, 13 bp, D. melanogaster
aaatgtggccaac

SEQ ID NO: 553702 - DNA, 13 bp, D. melanogaster
aaatgtggccaag

SEQ ID NO: 553703 - DNA, 13 bp, D. melanogaster
aaatgtggcgaaa

SEQ ID NO: 553704 - DNA, 13 bp, D. melanogaster
aaatgtgggaaaa

SEQ ID NO: 553705 - DNA, 13 bp, D. melanogaster
aaatgtgggaaat

SEQ ID NO: 553706 - DNA, 13 bp, D. melanogaster
aaatgtgggcaaa

SEQ ID NO: 553707 - DNA, 13 bp, D. melanogaster
aaatgtgggcatg

SEQ ID NO: 553708 - DNA, 13 bp, D. melanogaster
aaatgtgggcgtg

SEQ ID NO: 553709 - DNA, 13 bp, D. melanogaster
aaatgtggggaaa

SEQ ID NO: 553710 - DNA, 14 bp, D. melanogaster
aaatgtggggaaaa

SEQ ID NO: 553711 - DNA, 13 bp, D. melanogaster
aaatgtggtttaa

SEQ ID NO: 553712 - DNA, 13 bp, D. melanogaster
aaatgtggtttat

SEQ ID NO: 553713 - DNA, 13 bp, D. melanogaster
aaatgtgtaaaca

SEQ ID NO: 553714 - DNA, 13 bp, D. melanogaster
aaatgtgtaaatg

SEQ ID NO: 553715 - DNA, 13 bp, D. melanogaster
aaatgtgtaatta

SEQ ID NO: 553716 - DNA, 13 bp, D. melanogaster
aaatgtgtacaca

SEQ ID NO: 553717 - DNA, 13 bp, D. melanogaster
aaatgtgtataaa

SEQ ID NO: 553718 - DNA, 13 bp, D. melanogaster
aaatgtgtataat

SEQ ID NO: 553719 - DNA, 14 bp, D. melanogaster
aaatgtgtatttaa

SEQ ID NO: 553720 - DNA, 13 bp, D. melanogaster
aaatgtgtatttt

SEQ ID NO: 553721 - DNA, 13 bp, D. melanogaster
aaatgtgtcgaaa

SEQ ID NO: 553722 - DNA, 13 bp, D. melanogaster
aaatgtgtgaaaa

SEQ ID NO: 553723 - DNA, 14 bp, D. melanogaster
aaatgtgtgaaaat

SEQ ID NO: 553724 - DNA, 13 bp, D. melanogaster
aaatgtgtgaaag

SEQ ID NO: 553725 - DNA, 13 bp, D. melanogaster
aaatgtgtgcaaa

SEQ ID NO: 553726 - DNA, 14 bp, D. melanogaster
aaatgtgtgcaaaa

SEQ ID NO: 553727 - DNA, 13 bp, D. melanogaster
aaatgtgtgcatt

SEQ ID NO: 553728 - DNA, 13 bp, D. melanogaster
aaatgtgtggaaa

SEQ ID NO: 553729 - DNA, 13 bp, D. melanogaster
aaatgtgtggcaa

SEQ ID NO: 553730 - DNA, 13 bp, D. melanogaster
aaatgtgtggcag

SEQ ID NO: 553731 - DNA, 14 bp, D. melanogaster
aaatgtgtgtatat

SEQ ID NO: 553732 - DNA, 13 bp, D. melanogaster
aaatgtgtgtgtg

SEQ ID NO: 553733 - DNA, 14 bp, D. melanogaster
aaatgtgtgtgtgt

SEQ ID NO: 553734 - DNA, 13 bp, D. melanogaster
aaatgtgtgtgtt

SEQ ID NO: 553735 - DNA, 13 bp, D. melanogaster
aaatgtgtgttat

SEQ ID NO: 553736 - DNA, 14 bp, D. melanogaster
aaatgtgttaaaat

SEQ ID NO: 553737 - DNA, 13 bp, D. melanogaster
aaatgtgttaagc

SEQ ID NO: 553738 - DNA, 13 bp, D. melanogaster
aaatgtgttaatt

SEQ ID NO: 553739 - DNA, 13 bp, D. melanogaster
aaatgtgttatta

SEQ ID NO: 553740 - DNA, 13 bp, D. melanogaster
aaatgtgttattt

SEQ ID NO: 553741 - DNA, 13 bp, D. melanogaster
aaatgtgttcaat

SEQ ID NO: 553742 - DNA, 13 bp, D. melanogaster
aaatgtgttgaaa

SEQ ID NO: 553743 - DNA, 14 bp, D. melanogaster
aaatgtgttgaaaa

SEQ ID NO: 553744 - DNA, 13 bp, D. melanogaster
aaatgtgttgata

SEQ ID NO: 553745 - DNA, 13 bp, D. melanogaster
aaatgtgttggta

SEQ ID NO: 553746 - DNA, 14 bp, D. melanogaster
aaatgtgttggtag

SEQ ID NO: 553747 - DNA, 13 bp, D. melanogaster
aaatgtgttgttt

SEQ ID NO: 553748 - DNA, 13 bp, D. melanogaster
aaatgtgtttatt

SEQ ID NO: 553749 - DNA, 13 bp, D. melanogaster
aaatgtgtttctt

SEQ ID NO: 553750 - DNA, 13 bp, D. melanogaster
aaatgtgtttgcc

SEQ ID NO: 553751 - DNA, 13 bp, D. melanogaster
aaatgtgttttaa

SEQ ID NO: 553752 - DNA, 14 bp, D. melanogaster
aaatgtgttttaaa

SEQ ID NO: 553753 - DNA, 13 bp, D. melanogaster
aaatgtgttttgc

SEQ ID NO: 553754 - DNA, 14 bp, D. melanogaster
aaatgtgtttttaa

SEQ ID NO: 553755 - DNA, 13 bp, D. melanogaster
aaatgttaaaagc

SEQ ID NO: 553756 - DNA, 13 bp, D. melanogaster
aaatgttaaaagt

SEQ ID NO: 553757 - DNA, 13 bp, D. melanogaster
aaatgttaaacaa

SEQ ID NO: 553758 - DNA, 14 bp, D. melanogaster
aaatgttaaacaat

SEQ ID NO: 553759 - DNA, 13 bp, D. melanogaster
aaatgttaaatga

SEQ ID NO: 553760 - DNA, 14 bp, D. melanogaster
aaatgttaaatgtt

SEQ ID NO: 553761 - DNA, 13 bp, D. melanogaster
aaatgttaactaa

SEQ ID NO: 553762 - DNA, 13 bp, D. melanogaster
aaatgttaagtaa

SEQ ID NO: 553763 - DNA, 13 bp, D. melanogaster
aaatgttaagtat

SEQ ID NO: 553764 - DNA, 13 bp, D. melanogaster
aaatgttaagtgt

SEQ ID NO: 553765 - DNA, 13 bp, D. melanogaster
aaatgttaatcat

SEQ ID NO: 553766 - DNA, 13 bp, D. melanogaster
aaatgttaatgaa

SEQ ID NO: 553767 - DNA, 13 bp, D. melanogaster
aaatgttaatgga

SEQ ID NO: 553768 - DNA, 13 bp, D. melanogaster
aaatgttaatgtt

SEQ ID NO: 553769 - DNA, 13 bp, D. melanogaster
aaatgttaattac

SEQ ID NO: 553770 - DNA, 13 bp, D. melanogaster
aaatgttaattga

SEQ ID NO: 553771 - DNA, 13 bp, D. melanogaster
aaatgttaattgc

SEQ ID NO: 553772 - DNA, 13 bp, D. melanogaster
aaatgttaatttc

SEQ ID NO: 553773 - DNA, 13 bp, D. melanogaster
aaatgttaatttg

SEQ ID NO: 553774 - DNA, 13 bp, D. melanogaster
aaatgttactaaa

SEQ ID NO: 553775 - DNA, 13 bp, D. melanogaster
aaatgttagattt

SEQ ID NO: 553776 - DNA, 13 bp, D. melanogaster
aaatgttaggaaa

SEQ ID NO: 553777 - DNA, 13 bp, D. melanogaster
aaatgttatcatc

SEQ ID NO: 553778 - DNA, 13 bp, D. melanogaster
aaatgttatgaaa

SEQ ID NO: 553779 - DNA, 13 bp, D. melanogaster
aaatgttatggaa

SEQ ID NO: 553780 - DNA, 13 bp, D. melanogaster
aaatgttatgttt

SEQ ID NO: 553781 - DNA, 13 bp, D. melanogaster
aaatgttattaag

SEQ ID NO: 553782 - DNA, 13 bp, D. melanogaster
aaatgttattgaa

SEQ ID NO: 553783 - DNA, 13 bp, D. melanogaster
aaatgttcaaaaa

SEQ ID NO: 553784 - DNA, 14 bp, D. melanogaster
aaatgttcaaaaaa

SEQ ID NO: 553785 - DNA, 14 bp, D. melanogaster
aaatgttcaaaaat

SEQ ID NO: 553786 - DNA, 13 bp, D. melanogaster
aaatgttcaaaat

SEQ ID NO: 553787 - DNA, 14 bp, D. melanogaster
aaatgttcaaaatt

SEQ ID NO: 553788 - DNA, 13 bp, D. melanogaster
aaatgttcaaatg

SEQ ID NO: 553789 - DNA, 13 bp, D. melanogaster
aaatgttcaacaa

SEQ ID NO: 553790 - DNA, 13 bp, D. melanogaster
aaatgttcaacat

SEQ ID NO: 553791 - DNA, 13 bp, D. melanogaster
aaatgttcaactt

SEQ ID NO: 553792 - DNA, 13 bp, D. melanogaster
aaatgttcaatat

SEQ ID NO: 553793 - DNA, 13 bp, D. melanogaster
aaatgttcattaa

SEQ ID NO: 553794 - DNA, 14 bp, D. melanogaster
aaatgttcattttt

SEQ ID NO: 553795 - DNA, 13 bp, D. melanogaster
aaatgttccaatt

SEQ ID NO: 553796 - DNA, 13 bp, D. melanogaster
aaatgttcgcttt

SEQ ID NO: 553797 - DNA, 13 bp, D. melanogaster
aaatgttctatat

SEQ ID NO: 553798 - DNA, 13 bp, D. melanogaster
aaatgttctgaaa

SEQ ID NO: 553799 - DNA, 13 bp, D. melanogaster
aaatgttcttaaa

SEQ ID NO: 553800 - DNA, 13 bp, D. melanogaster
aaatgttcttata

SEQ ID NO: 553801 - DNA, 13 bp, D. melanogaster
aaatgttctttaa

SEQ ID NO: 553802 - DNA, 13 bp, D. melanogaster
aaatgttctttat

SEQ ID NO: 553803 - DNA, 14 bp, D. melanogaster
aaatgttctttctt

SEQ ID NO: 553804 - DNA, 13 bp, D. melanogaster
aaatgttcttttc

SEQ ID NO: 553805 - DNA, 13 bp, D. melanogaster
aaatgttgaaaag

SEQ ID NO: 553806 - DNA, 13 bp, D. melanogaster
aaatgttgaaaat

SEQ ID NO: 553807 - DNA, 13 bp, D. melanogaster
aaatgttgaaaga

SEQ ID NO: 553808 - DNA, 13 bp, D. melanogaster
aaatgttgaaagc

SEQ ID NO: 553809 - DNA, 13 bp, D. melanogaster
aaatgttgaaatg

SEQ ID NO: 553810 - DNA, 14 bp, D. melanogaster
aaatgttgaatttt

SEQ ID NO: 553811 - DNA, 13 bp, D. melanogaster
aaatgttgattaa

SEQ ID NO: 553812 - DNA, 13 bp, D. melanogaster
aaatgttgattta

SEQ ID NO: 553813 - DNA, 13 bp, D. melanogaster
aaatgttgcaaaa

SEQ ID NO: 553814 - DNA, 13 bp, D. melanogaster
aaatgttgcaaac

SEQ ID NO: 553815 - DNA, 13 bp, D. melanogaster
aaatgttgcaaat

SEQ ID NO: 553816 - DNA, 13 bp, D. melanogaster
aaatgttgcaata

SEQ ID NO: 553817 - DNA, 13 bp, D. melanogaster
aaatgttgcacat

SEQ ID NO: 553818 - DNA, 13 bp, D. melanogaster
aaatgttgcactt

SEQ ID NO: 553819 - DNA, 13 bp, D. melanogaster
aaatgttgcagaa

SEQ ID NO: 553820 - DNA, 13 bp, D. melanogaster
aaatgttgcataa

SEQ ID NO: 553821 - DNA, 13 bp, D. melanogaster
aaatgttgcatgc

SEQ ID NO: 553822 - DNA, 13 bp, D. melanogaster
aaatgttgccaac

SEQ ID NO: 553823 - DNA, 13 bp, D. melanogaster
aaatgttgcccaa

SEQ ID NO: 553824 - DNA, 13 bp, D. melanogaster
aaatgttgccgct

SEQ ID NO: 553825 - DNA, 13 bp, D. melanogaster
aaatgttgccttt

SEQ ID NO: 553826 - DNA, 13 bp, D. melanogaster
aaatgttgctaat

SEQ ID NO: 553827 - DNA, 13 bp, D. melanogaster
aaatgttgctcaa

SEQ ID NO: 553828 - DNA, 13 bp, D. melanogaster
aaatgttgctgct

SEQ ID NO: 553829 - DNA, 13 bp, D. melanogaster
aaatgttgctggc

SEQ ID NO: 553830 - DNA, 13 bp, D. melanogaster
aaatgttggaaaa

SEQ ID NO: 553831 - DNA, 13 bp, D. melanogaster
aaatgttggcaaa

SEQ ID NO: 553832 - DNA, 14 bp, D. melanogaster
aaatgttggcaaaa

SEQ ID NO: 553833 - DNA, 13 bp, D. melanogaster
aaatgttggccaa

SEQ ID NO: 553834 - DNA, 14 bp, D. melanogaster
aaatgttggccaaa

SEQ ID NO: 553835 - DNA, 13 bp, D. melanogaster
aaatgttggccag

SEQ ID NO: 553836 - DNA, 13 bp, D. melanogaster
aaatgttggccat

SEQ ID NO: 553837 - DNA, 13 bp, D. melanogaster
aaatgttggccca

SEQ ID NO: 553838 - DNA, 13 bp, D. melanogaster
aaatgttggtttt

SEQ ID NO: 553839 - DNA, 13 bp, D. melanogaster
aaatgttgtaaat

SEQ ID NO: 553840 - DNA, 13 bp, D. melanogaster
aaatgttgtaata

SEQ ID NO: 553841 - DNA, 13 bp, D. melanogaster
aaatgttgtacaa

SEQ ID NO: 553842 - DNA, 13 bp, D. melanogaster
aaatgttgtacat

SEQ ID NO: 553843 - DNA, 13 bp, D. melanogaster
aaatgttgtactt

SEQ ID NO: 553844 - DNA, 13 bp, D. melanogaster
aaatgttgtataa

SEQ ID NO: 553845 - DNA, 13 bp, D. melanogaster
aaatgttgtatat

SEQ ID NO: 553846 - DNA, 13 bp, D. melanogaster
aaatgttgtatta

SEQ ID NO: 553847 - DNA, 13 bp, D. melanogaster
aaatgttgtattt

SEQ ID NO: 553848 - DNA, 13 bp, D. melanogaster
aaatgttgtcaat

SEQ ID NO: 553849 - DNA, 13 bp, D. melanogaster
aaatgttgtctgc

SEQ ID NO: 553850 - DNA, 13 bp, D. melanogaster
aaatgttgtcttg

SEQ ID NO: 553851 - DNA, 14 bp, D. melanogaster
aaatgttgtcttgt

SEQ ID NO: 553852 - DNA, 13 bp, D. melanogaster
aaatgttgtcttt

SEQ ID NO: 553853 - DNA, 13 bp, D. melanogaster
aaatgttgtgaaa

SEQ ID NO: 553854 - DNA, 13 bp, D. melanogaster
aaatgttgtgcca

SEQ ID NO: 553855 - DNA, 13 bp, D. melanogaster
aaatgttgtgcga

SEQ ID NO: 553856 - DNA, 13 bp, D. melanogaster
aaatgttgttaat

SEQ ID NO: 553857 - DNA, 13 bp, D. melanogaster
aaatgttgttgaa

SEQ ID NO: 553858 - DNA, 13 bp, D. melanogaster
aaatgttgttgtt

SEQ ID NO: 553859 - DNA, 13 bp, D. melanogaster
aaatgttgtttat

SEQ ID NO: 553860 - DNA, 13 bp, D. melanogaster
aaatgtttaaaac

SEQ ID NO: 553861 - DNA, 14 bp, D. melanogaster
aaatgtttaaacaa

SEQ ID NO: 553862 - DNA, 13 bp, D. melanogaster
aaatgtttaaagc

SEQ ID NO: 553863 - DNA, 13 bp, D. melanogaster
aaatgtttaacaa

SEQ ID NO: 553864 - DNA, 13 bp, D. melanogaster
aaatgtttaagaa

SEQ ID NO: 553865 - DNA, 13 bp, D. melanogaster
aaatgtttaagca

SEQ ID NO: 553866 - DNA, 13 bp, D. melanogaster
aaatgtttaagct

SEQ ID NO: 553867 - DNA, 13 bp, D. melanogaster
aaatgtttaatga

SEQ ID NO: 553868 - DNA, 13 bp, D. melanogaster
aaatgtttaatgc

SEQ ID NO: 553869 - DNA, 13 bp, D. melanogaster
aaatgtttacaaa

SEQ ID NO: 553870 - DNA, 14 bp, D. melanogaster
aaatgtttacaaaa

SEQ ID NO: 553871 - DNA, 13 bp, D. melanogaster
aaatgtttacaag

SEQ ID NO: 553872 - DNA, 13 bp, D. melanogaster
aaatgtttacaat

SEQ ID NO: 553873 - DNA, 13 bp, D. melanogaster
aaatgtttacata

SEQ ID NO: 553874 - DNA, 13 bp, D. melanogaster
aaatgtttacatt

SEQ ID NO: 553875 - DNA, 13 bp, D. melanogaster
aaatgtttacctt

SEQ ID NO: 553876 - DNA, 13 bp, D. melanogaster
aaatgtttactgg

SEQ ID NO: 553877 - DNA, 13 bp, D. melanogaster
aaatgtttactta

SEQ ID NO: 553878 - DNA, 13 bp, D. melanogaster
aaatgtttacttc

SEQ ID NO: 553879 - DNA, 13 bp, D. melanogaster
aaatgtttacttt

SEQ ID NO: 553880 - DNA, 14 bp, D. melanogaster
aaatgtttactttt

SEQ ID NO: 553881 - DNA, 13 bp, D. melanogaster
aaatgtttagaaa

SEQ ID NO: 553882 - DNA, 13 bp, D. melanogaster
aaatgtttagcca

SEQ ID NO: 553883 - DNA, 13 bp, D. melanogaster
aaatgtttagctt

SEQ ID NO: 553884 - DNA, 14 bp, D. melanogaster
aaatgtttataaac

SEQ ID NO: 553885 - DNA, 13 bp, D. melanogaster
aaatgtttataag

SEQ ID NO: 553886 - DNA, 14 bp, D. melanogaster
aaatgtttataagt

SEQ ID NO: 553887 - DNA, 13 bp, D. melanogaster
aaatgtttatcaa

SEQ ID NO: 553888 - DNA, 13 bp, D. melanogaster
aaatgtttatgaa

SEQ ID NO: 553889 - DNA, 13 bp, D. melanogaster
aaatgtttatgca

SEQ ID NO: 553890 - DNA, 14 bp, D. melanogaster
aaatgtttatgcaa

SEQ ID NO: 553891 - DNA, 13 bp, D. melanogaster
aaatgtttatgta

SEQ ID NO: 553892 - DNA, 13 bp, D. melanogaster
aaatgtttatgtg

SEQ ID NO: 553893 - DNA, 13 bp, D. melanogaster
aaatgtttattca

SEQ ID NO: 553894 - DNA, 13 bp, D. melanogaster
aaatgtttattga

SEQ ID NO: 553895 - DNA, 13 bp, D. melanogaster
aaatgtttattgt

SEQ ID NO: 553896 - DNA, 13 bp, D. melanogaster
aaatgtttcaaaa

SEQ ID NO: 553897 - DNA, 14 bp, D. melanogaster
aaatgtttcaaaag

SEQ ID NO: 553898 - DNA, 13 bp, D. melanogaster
aaatgtttcaaat

SEQ ID NO: 553899 - DNA, 13 bp, D. melanogaster
aaatgtttcaact

SEQ ID NO: 553900 - DNA, 13 bp, D. melanogaster
aaatgtttcaata

SEQ ID NO: 553901 - DNA, 13 bp, D. melanogaster
aaatgtttcaatt

SEQ ID NO: 553902 - DNA, 14 bp, D. melanogaster
aaatgtttcaatta

SEQ ID NO: 553903 - DNA, 14 bp, D. melanogaster
aaatgtttcaattt

SEQ ID NO: 553904 - DNA, 13 bp, D. melanogaster
aaatgtttcacat

SEQ ID NO: 553905 - DNA, 13 bp, D. melanogaster
aaatgtttcactt

SEQ ID NO: 553906 - DNA, 13 bp, D. melanogaster
aaatgtttcataa

SEQ ID NO: 553907 - DNA, 14 bp, D. melanogaster
aaatgtttcataaa

SEQ ID NO: 553908 - DNA, 13 bp, D. melanogaster
aaatgtttcatat

SEQ ID NO: 553909 - DNA, 13 bp, D. melanogaster
aaatgtttcatta

SEQ ID NO: 553910 - DNA, 13 bp, D. melanogaster
aaatgtttcccaa

SEQ ID NO: 553911 - DNA, 13 bp, D. melanogaster
aaatgtttccttt

SEQ ID NO: 553912 - DNA, 13 bp, D. melanogaster
aaatgtttcgaaa

SEQ ID NO: 553913 - DNA, 13 bp, D. melanogaster
aaatgtttcgcat

SEQ ID NO: 553914 - DNA, 13 bp, D. melanogaster
aaatgtttcgctt

SEQ ID NO: 553915 - DNA, 13 bp, D. melanogaster
aaatgtttcgtta

SEQ ID NO: 553916 - DNA, 13 bp, D. melanogaster
aaatgtttctaat

SEQ ID NO: 553917 - DNA, 13 bp, D. melanogaster
aaatgtttctatt

SEQ ID NO: 553918 - DNA, 13 bp, D. melanogaster
aaatgtttctcat

SEQ ID NO: 553919 - DNA, 13 bp, D. melanogaster
aaatgtttctgtt

SEQ ID NO: 553920 - DNA, 13 bp, D. melanogaster
aaatgtttcttaa

SEQ ID NO: 553921 - DNA, 14 bp, D. melanogaster
aaatgtttcttttt

SEQ ID NO: 553922 - DNA, 13 bp, D. melanogaster
aaatgtttgaaaa

SEQ ID NO: 553923 - DNA, 13 bp, D. melanogaster
aaatgtttgaaat

SEQ ID NO: 553924 - DNA, 13 bp, D. melanogaster
aaatgtttgaact

SEQ ID NO: 553925 - DNA, 13 bp, D. melanogaster
aaatgtttgaata

SEQ ID NO: 553926 - DNA, 13 bp, D. melanogaster
aaatgtttgaatg

SEQ ID NO: 553927 - DNA, 13 bp, D. melanogaster
aaatgtttgaatt

SEQ ID NO: 553928 - DNA, 13 bp, D. melanogaster
aaatgtttgacca

SEQ ID NO: 553929 - DNA, 13 bp, D. melanogaster
aaatgtttgactg

SEQ ID NO: 553930 - DNA, 13 bp, D. melanogaster
aaatgtttgactt

SEQ ID NO: 553931 - DNA, 13 bp, D. melanogaster
aaatgtttgagca

SEQ ID NO: 553932 - DNA, 13 bp, D. melanogaster
aaatgtttgattt

SEQ ID NO: 553933 - DNA, 13 bp, D. melanogaster
aaatgtttgcaaa

SEQ ID NO: 553934 - DNA, 14 bp, D. melanogaster
aaatgtttgcaaac

SEQ ID NO: 553935 - DNA, 13 bp, D. melanogaster
aaatgtttgcaag

SEQ ID NO: 553936 - DNA, 13 bp, D. melanogaster
aaatgtttgcaat

SEQ ID NO: 553937 - DNA, 13 bp, D. melanogaster
aaatgtttgcaca

SEQ ID NO: 553938 - DNA, 14 bp, D. melanogaster
aaatgtttgcacaa

SEQ ID NO: 553939 - DNA, 13 bp, D. melanogaster
aaatgtttgcact

SEQ ID NO: 553940 - DNA, 13 bp, D. melanogaster
aaatgtttgcagc

SEQ ID NO: 553941 - DNA, 13 bp, D. melanogaster
aaatgtttgcata

SEQ ID NO: 553942 - DNA, 14 bp, D. melanogaster
aaatgtttgcattt

SEQ ID NO: 553943 - DNA, 13 bp, D. melanogaster
aaatgtttgccaa

SEQ ID NO: 553944 - DNA, 14 bp, D. melanogaster
aaatgtttgccaaa

SEQ ID NO: 553945 - DNA, 13 bp, D. melanogaster
aaatgtttgccag

SEQ ID NO: 553946 - DNA, 13 bp, D. melanogaster
aaatgtttgccat

SEQ ID NO: 553947 - DNA, 13 bp, D. melanogaster
aaatgtttgccca

SEQ ID NO: 553948 - DNA, 13 bp, D. melanogaster
aaatgtttgcctg

SEQ ID NO: 553949 - DNA, 13 bp, D. melanogaster
aaatgtttgcgca

SEQ ID NO: 553950 - DNA, 13 bp, D. melanogaster
aaatgtttgctaa

SEQ ID NO: 553951 - DNA, 13 bp, D. melanogaster
aaatgtttgctca

SEQ ID NO: 553952 - DNA, 13 bp, D. melanogaster
aaatgtttgcttt

SEQ ID NO: 553953 - DNA, 13 bp, D. melanogaster
aaatgtttggttt

SEQ ID NO: 553954 - DNA, 13 bp, D. melanogaster
aaatgtttgtata

SEQ ID NO: 553955 - DNA, 13 bp, D. melanogaster
aaatgtttgtgat

SEQ ID NO: 553956 - DNA, 14 bp, D. melanogaster
aaatgtttgtgatg

SEQ ID NO: 553957 - DNA, 13 bp, D. melanogaster
aaatgtttgtgca

SEQ ID NO: 553958 - DNA, 13 bp, D. melanogaster
aaatgtttgtgtt

SEQ ID NO: 553959 - DNA, 13 bp, D. melanogaster
aaatgtttgttta

SEQ ID NO: 553960 - DNA, 14 bp, D. melanogaster
aaatgtttgtttaa

SEQ ID NO: 553961 - DNA, 13 bp, D. melanogaster
aaatgttttaaac

SEQ ID NO: 553962 - DNA, 14 bp, D. melanogaster
aaatgttttaaatg

SEQ ID NO: 553963 - DNA, 13 bp, D. melanogaster
aaatgttttaaca

SEQ ID NO: 553964 - DNA, 13 bp, D. melanogaster
aaatgttttaagg

SEQ ID NO: 553965 - DNA, 14 bp, D. melanogaster
aaatgttttaaggc

SEQ ID NO: 553966 - DNA, 13 bp, D. melanogaster
aaatgttttaagt

SEQ ID NO: 553967 - DNA, 13 bp, D. melanogaster
aaatgttttaatc

SEQ ID NO: 553968 - DNA, 13 bp, D. melanogaster
aaatgttttacaa

SEQ ID NO: 553969 - DNA, 13 bp, D. melanogaster
aaatgttttactt

SEQ ID NO: 553970 - DNA, 13 bp, D. melanogaster
aaatgttttagtt

SEQ ID NO: 553971 - DNA, 13 bp, D. melanogaster
aaatgttttatca

SEQ ID NO: 553972 - DNA, 13 bp, D. melanogaster
aaatgttttcaaa

SEQ ID NO: 553973 - DNA, 14 bp, D. melanogaster
aaatgttttcaaat

SEQ ID NO: 553974 - DNA, 13 bp, D. melanogaster
aaatgttttcaac

SEQ ID NO: 553975 - DNA, 13 bp, D. melanogaster
aaatgttttcaag

SEQ ID NO: 553976 - DNA, 13 bp, D. melanogaster
aaatgttttcaca

SEQ ID NO: 553977 - DNA, 13 bp, D. melanogaster
aaatgttttcact

SEQ ID NO: 553978 - DNA, 14 bp, D. melanogaster
aaatgttttcattt

SEQ ID NO: 553979 - DNA, 14 bp, D. melanogaster
aaatgttttccatt

SEQ ID NO: 553980 - DNA, 13 bp, D. melanogaster
aaatgttttccct

SEQ ID NO: 553981 - DNA, 13 bp, D. melanogaster
aaatgttttccgt

SEQ ID NO: 553982 - DNA, 13 bp, D. melanogaster
aaatgttttcctt

SEQ ID NO: 553983 - DNA, 14 bp, D. melanogaster
aaatgttttccttt

SEQ ID NO: 553984 - DNA, 13 bp, D. melanogaster
aaatgttttctgc

SEQ ID NO: 553985 - DNA, 13 bp, D. melanogaster
aaatgttttcttt

SEQ ID NO: 553986 - DNA, 14 bp, D. melanogaster
aaatgttttctttt

SEQ ID NO: 553987 - DNA, 13 bp, D. melanogaster
aaatgttttgaat

SEQ ID NO: 553988 - DNA, 14 bp, D. melanogaster
aaatgttttgaata

SEQ ID NO: 553989 - DNA, 13 bp, D. melanogaster
aaatgttttgatt

SEQ ID NO: 553990 - DNA, 13 bp, D. melanogaster
aaatgttttgcat

SEQ ID NO: 553991 - DNA, 13 bp, D. melanogaster
aaatgttttgcca

SEQ ID NO: 553992 - DNA, 13 bp, D. melanogaster
aaatgttttgggt

SEQ ID NO: 553993 - DNA, 13 bp, D. melanogaster
aaatgttttgtca

SEQ ID NO: 553994 - DNA, 13 bp, D. melanogaster
aaatgtttttcaa

SEQ ID NO: 553995 - DNA, 13 bp, D. melanogaster
aaatgtttttcca

SEQ ID NO: 553996 - DNA, 14 bp, D. melanogaster
aaatgtttttccat

SEQ ID NO: 553997 - DNA, 13 bp, D. melanogaster
aaatgtttttgaa

SEQ ID NO: 553998 - DNA, 13 bp, D. melanogaster
aaatgtttttgca

SEQ ID NO: 553999 - DNA, 13 bp, D. melanogaster
aaatgtttttgtg

SEQ ID NO: 554000 - DNA, 14 bp, D. melanogaster
aaatgttttttctt

SEQ ID NO: 554001 - DNA, 13 bp, D. melanogaster
aaatgttttttgg

SEQ ID NO: 554002 - DNA, 13 bp, D. melanogaster
aaatgtttttttc

SEQ ID NO: 554003 - DNA, 13 bp, D. melanogaster
aaattaaaaacgc

SEQ ID NO: 554004 - DNA, 14 bp, D. melanogaster
aaattaaaaagcca

SEQ ID NO: 554005 - DNA, 14 bp, D. melanogaster
aaattaaaaagtgc

SEQ ID NO: 554006 - DNA, 14 bp, D. melanogaster
aaattaaaaccgaa

SEQ ID NO: 554007 - DNA, 14 bp, D. melanogaster
aaattaaaacgaat

SEQ ID NO: 554008 - DNA, 13 bp, D. melanogaster
aaattaaaactga

SEQ ID NO: 554009 - DNA, 14 bp, D. melanogaster
aaattaaaactgaa

SEQ ID NO: 554010 - DNA, 14 bp, D. melanogaster
aaattaaaagcaat

SEQ ID NO: 554011 - DNA, 13 bp, D. melanogaster
aaattaaaagcca

SEQ ID NO: 554012 - DNA, 13 bp, D. melanogaster
aaattaaaagcga

SEQ ID NO: 554013 - DNA, 13 bp, D. melanogaster
aaattaaaatcga

SEQ ID NO: 554014 - DNA, 14 bp, D. melanogaster
aaattaaaatcgaa

SEQ ID NO: 554015 - DNA, 14 bp, D. melanogaster
aaattaaaatgagc

SEQ ID NO: 554016 - DNA, 14 bp, D. melanogaster
aaattaaaatgtca

SEQ ID NO: 554017 - DNA, 14 bp, D. melanogaster
aaattaaacgaaat

SEQ ID NO: 554018 - DNA, 13 bp, D. melanogaster
aaattaaacgatt

SEQ ID NO: 554019 - DNA, 13 bp, D. melanogaster
aaattaaacgcat

SEQ ID NO: 554020 - DNA, 13 bp, D. melanogaster
aaattaaacggaa

SEQ ID NO: 554021 - DNA, 13 bp, D. melanogaster
aaattaaacgttt

SEQ ID NO: 554022 - DNA, 13 bp, D. melanogaster
aaattaaagacac

SEQ ID NO: 554023 - DNA, 13 bp, D. melanogaster
aaattaaagcagc

SEQ ID NO: 554024 - DNA, 13 bp, D. melanogaster
aaattaaagccca

SEQ ID NO: 554025 - DNA, 13 bp, D. melanogaster
aaattaaagcgaa

SEQ ID NO: 554026 - DNA, 13 bp, D. melanogaster
aaattaaagctaa

SEQ ID NO: 554027 - DNA, 13 bp, D. melanogaster
aaattaaagctta

SEQ ID NO: 554028 - DNA, 13 bp, D. melanogaster
aaattaaagcttt

SEQ ID NO: 554029 - DNA, 13 bp, D. melanogaster
aaattaaagtcaa

SEQ ID NO: 554030 - DNA, 13 bp, D. melanogaster
aaattaaagtctt

SEQ ID NO: 554031 - DNA, 14 bp, D. melanogaster
aaattaaatccatt

SEQ ID NO: 554032 - DNA, 13 bp, D. melanogaster
aaattaaatcgaa

SEQ ID NO: 554033 - DNA, 13 bp, D. melanogaster
aaattaaatcgga

SEQ ID NO: 554034 - DNA, 13 bp, D. melanogaster
aaattaaatctca

SEQ ID NO: 554035 - DNA, 13 bp, D. melanogaster
aaattaaatgagc

SEQ ID NO: 554036 - DNA, 13 bp, D. melanogaster
aaattaaatgcca

SEQ ID NO: 554037 - DNA, 13 bp, D. melanogaster
aaattaaatggct

SEQ ID NO: 554038 - DNA, 13 bp, D. melanogaster
aaattaaatggtt

SEQ ID NO: 554039 - DNA, 13 bp, D. melanogaster
aaattaaatgtca

SEQ ID NO: 554040 - DNA, 13 bp, D. melanogaster
aaattaaatgttg

SEQ ID NO: 554041 - DNA, 13 bp, D. melanogaster
aaattaaattcct

SEQ ID NO: 554042 - DNA, 14 bp, D. melanogaster
aaattaaattcctt

SEQ ID NO: 554043 - DNA, 14 bp, D. melanogaster
aaattaaattgcaa

SEQ ID NO: 554044 - DNA, 13 bp, D. melanogaster
aaattaaattgct

SEQ ID NO: 554045 - DNA, 13 bp, D. melanogaster
aaattaaattgtc

SEQ ID NO: 554046 - DNA, 13 bp, D. melanogaster
aaattaaatttgg

SEQ ID NO: 554047 - DNA, 14 bp, D. melanogaster
aaattaacaaaatg

SEQ ID NO: 554048 - DNA, 13 bp, D. melanogaster
aaattaacaactt

SEQ ID NO: 554049 - DNA, 13 bp, D. melanogaster
aaattaacaattg

SEQ ID NO: 554050 - DNA, 13 bp, D. melanogaster
aaattaaccaatt

SEQ ID NO: 554051 - DNA, 14 bp, D. melanogaster
aaattaaccaattt

SEQ ID NO: 554052 - DNA, 13 bp, D. melanogaster
aaattaacgaaat

SEQ ID NO: 554053 - DNA, 13 bp, D. melanogaster
aaattaacgaatt

SEQ ID NO: 554054 - DNA, 14 bp, D. melanogaster
aaattaactagaat

SEQ ID NO: 554055 - DNA, 13 bp, D. melanogaster
aaattaacttgtt

SEQ ID NO: 554056 - DNA, 13 bp, D. melanogaster
aaattaagagttt

SEQ ID NO: 554057 - DNA, 13 bp, D. melanogaster
aaattaagcaaac

SEQ ID NO: 554058 - DNA, 13 bp, D. melanogaster
aaattaagcaaat

SEQ ID NO: 554059 - DNA, 14 bp, D. melanogaster
aaattaagcaaatt

SEQ ID NO: 554060 - DNA, 13 bp, D. melanogaster
aaattaagcaaca

SEQ ID NO: 554061 - DNA, 13 bp, D. melanogaster
aaattaagcaata

SEQ ID NO: 554062 - DNA, 13 bp, D. melanogaster
aaattaagcaatt

SEQ ID NO: 554063 - DNA, 14 bp, D. melanogaster
aaattaagcaatta

SEQ ID NO: 554064 - DNA, 13 bp, D. melanogaster
aaattaagcattt

SEQ ID NO: 554065 - DNA, 13 bp, D. melanogaster
aaattaagccaaa

SEQ ID NO: 554066 - DNA, 13 bp, D. melanogaster
aaattaagccatt

SEQ ID NO: 554067 - DNA, 13 bp, D. melanogaster
aaattaagcccaa

SEQ ID NO: 554068 - DNA, 13 bp, D. melanogaster
aaattaagcgaat

SEQ ID NO: 554069 - DNA, 13 bp, D. melanogaster
aaattaagcgcat

SEQ ID NO: 554070 - DNA, 13 bp, D. melanogaster
aaattaagctcat

SEQ ID NO: 554071 - DNA, 13 bp, D. melanogaster
aaattaagctgaa

SEQ ID NO: 554072 - DNA, 13 bp, D. melanogaster
aaattaaggagct

SEQ ID NO: 554073 - DNA, 13 bp, D. melanogaster
aaattaagtacaa

SEQ ID NO: 554074 - DNA, 13 bp, D. melanogaster
aaattaagtcaaa

SEQ ID NO: 554075 - DNA, 13 bp, D. melanogaster
aaattaagtcatt

SEQ ID NO: 554076 - DNA, 13 bp, D. melanogaster
aaattaagtggaa

SEQ ID NO: 554077 - DNA, 13 bp, D. melanogaster
aaattaagtgtta

SEQ ID NO: 554078 - DNA, 13 bp, D. melanogaster
aaattaagttgta

SEQ ID NO: 554079 - DNA, 13 bp, D. melanogaster
aaattaagttgtt

SEQ ID NO: 554080 - DNA, 13 bp, D. melanogaster
aaattaagttttc

SEQ ID NO: 554081 - DNA, 13 bp, D. melanogaster
aaattaataagcg

SEQ ID NO: 554082 - DNA, 14 bp, D. melanogaster
aaattaatatgcaa

SEQ ID NO: 554083 - DNA, 13 bp, D. melanogaster
aaattaatcagca

SEQ ID NO: 554084 - DNA, 13 bp, D. melanogaster
aaattaatcagtt

SEQ ID NO: 554085 - DNA, 13 bp, D. melanogaster
aaattaatgacaa

SEQ ID NO: 554086 - DNA, 13 bp, D. melanogaster
aaattaatgagct

SEQ ID NO: 554087 - DNA, 13 bp, D. melanogaster
aaattaatgatga

SEQ ID NO: 554088 - DNA, 13 bp, D. melanogaster
aaattaatgcaaa

SEQ ID NO: 554089 - DNA, 14 bp, D. melanogaster
aaattaatgcaaaa

SEQ ID NO: 554090 - DNA, 13 bp, D. melanogaster
aaattaatgcaat

SEQ ID NO: 554091 - DNA, 13 bp, D. melanogaster
aaattaatgcata

SEQ ID NO: 554092 - DNA, 13 bp, D. melanogaster
aaattaatgctaa

SEQ ID NO: 554093 - DNA, 13 bp, D. melanogaster
aaattaatgctga

SEQ ID NO: 554094 - DNA, 13 bp, D. melanogaster
aaattaatggaat

SEQ ID NO: 554095 - DNA, 13 bp, D. melanogaster
aaattaatggcaa

SEQ ID NO: 554096 - DNA, 13 bp, D. melanogaster
aaattaatgtgtt

SEQ ID NO: 554097 - DNA, 14 bp, D. melanogaster
aaattaatgtgttc

SEQ ID NO: 554098 - DNA, 13 bp, D. melanogaster
aaattaatgttgc

SEQ ID NO: 554099 - DNA, 14 bp, D. melanogaster
aaattaattagcaa

SEQ ID NO: 554100 - DNA, 13 bp, D. melanogaster
aaattaattagct

SEQ ID NO: 554101 - DNA, 13 bp, D. melanogaster
aaattaattcgtt

SEQ ID NO: 554102 - DNA, 13 bp, D. melanogaster
aaattaattgcag

SEQ ID NO: 554103 - DNA, 13 bp, D. melanogaster
aaattaattgcca

SEQ ID NO: 554104 - DNA, 14 bp, D. melanogaster
aaattaattgccac

SEQ ID NO: 554105 - DNA, 13 bp, D. melanogaster
aaattaattgctt

SEQ ID NO: 554106 - DNA, 14 bp, D. melanogaster
aaattaattgcttt

SEQ ID NO: 554107 - DNA, 13 bp, D. melanogaster
aaattaattggcg

SEQ ID NO: 554108 - DNA, 13 bp, D. melanogaster
aaattaattgtgt

SEQ ID NO: 554109 - DNA, 13 bp, D. melanogaster
aaattaatttacg

SEQ ID NO: 554110 - DNA, 13 bp, D. melanogaster
aaattaatttccc

SEQ ID NO: 554111 - DNA, 13 bp, D. melanogaster
aaattaatttcga

SEQ ID NO: 554112 - DNA, 13 bp, D. melanogaster
aaattaatttgca

SEQ ID NO: 554113 - DNA, 14 bp, D. melanogaster
aaattaatttgcaa

SEQ ID NO: 554114 - DNA, 14 bp, D. melanogaster
aaattaatttgcac

SEQ ID NO: 554115 - DNA, 14 bp, D. melanogaster
aaattaatttgcat

SEQ ID NO: 554116 - DNA, 13 bp, D. melanogaster
aaattaatttgtg

SEQ ID NO: 554117 - DNA, 14 bp, D. melanogaster
aaattaatttttgg

SEQ ID NO: 554118 - DNA, 13 bp, D. melanogaster
aaattacaaatga

SEQ ID NO: 554119 - DNA, 13 bp, D. melanogaster
aaattacaaattc

SEQ ID NO: 554120 - DNA, 13 bp, D. melanogaster
aaattacaacagg

SEQ ID NO: 554121 - DNA, 13 bp, D. melanogaster
aaattacaacatt

SEQ ID NO: 554122 - DNA, 13 bp, D. melanogaster
aaattacaacttt

SEQ ID NO: 554123 - DNA, 13 bp, D. melanogaster
aaattacaattac

SEQ ID NO: 554124 - DNA, 13 bp, D. melanogaster
aaattacaattca

SEQ ID NO: 554125 - DNA, 13 bp, D. melanogaster
aaattacaatttg

SEQ ID NO: 554126 - DNA, 14 bp, D. melanogaster
aaattacacaatga

SEQ ID NO: 554127 - DNA, 13 bp, D. melanogaster
aaattacacacat

SEQ ID NO: 554128 - DNA, 13 bp, D. melanogaster
aaattacacagaa

SEQ ID NO: 554129 - DNA, 13 bp, D. melanogaster
aaattacacatta

SEQ ID NO: 554130 - DNA, 13 bp, D. melanogaster
aaattacacccaa

SEQ ID NO: 554131 - DNA, 13 bp, D. melanogaster
aaattacacgatc

SEQ ID NO: 554132 - DNA, 13 bp, D. melanogaster
aaattacagaaat

SEQ ID NO: 554133 - DNA, 13 bp, D. melanogaster
aaattacagcaca

SEQ ID NO: 554134 - DNA, 13 bp, D. melanogaster
aaattacatatgt

SEQ ID NO: 554135 - DNA, 13 bp, D. melanogaster
aaattacatgaac

SEQ ID NO: 554136 - DNA, 14 bp, D. melanogaster
aaattacatgaact

SEQ ID NO: 554137 - DNA, 14 bp, D. melanogaster
aaattacatgtttt

SEQ ID NO: 554138 - DNA, 13 bp, D. melanogaster
aaattacattgtt

SEQ ID NO: 554139 - DNA, 13 bp, D. melanogaster
aaattacatttga

SEQ ID NO: 554140 - DNA, 13 bp, D. melanogaster
aaattacatttgt

SEQ ID NO: 554141 - DNA, 13 bp, D. melanogaster
aaattacattttg

SEQ ID NO: 554142 - DNA, 13 bp, D. melanogaster
aaattaccaaaag

SEQ ID NO: 554143 - DNA, 13 bp, D. melanogaster
aaattaccaattt

SEQ ID NO: 554144 - DNA, 13 bp, D. melanogaster
aaattaccaggcg

SEQ ID NO: 554145 - DNA, 13 bp, D. melanogaster
aaattaccataat

SEQ ID NO: 554146 - DNA, 13 bp, D. melanogaster
aaattacccattt

SEQ ID NO: 554147 - DNA, 13 bp, D. melanogaster
aaattaccgaaaa

SEQ ID NO: 554148 - DNA, 13 bp, D. melanogaster
aaattaccttttt

SEQ ID NO: 554149 - DNA, 13 bp, D. melanogaster
aaattacgaaaat

SEQ ID NO: 554150 - DNA, 13 bp, D. melanogaster
aaattacgaaatt

SEQ ID NO: 554151 - DNA, 13 bp, D. melanogaster
aaattacgcatac

SEQ ID NO: 554152 - DNA, 13 bp, D. melanogaster
aaattacggaaaa

SEQ ID NO: 554153 - DNA, 13 bp, D. melanogaster
aaattactcaatt

SEQ ID NO: 554154 - DNA, 13 bp, D. melanogaster
aaattactcatac

SEQ ID NO: 554155 - DNA, 13 bp, D. melanogaster
aaattactcattt

SEQ ID NO: 554156 - DNA, 13 bp, D. melanogaster
aaattactgaatt

SEQ ID NO: 554157 - DNA, 13 bp, D. melanogaster
aaattacttcaaa

SEQ ID NO: 554158 - DNA, 13 bp, D. melanogaster
aaattacttgatt

SEQ ID NO: 554159 - DNA, 13 bp, D. melanogaster
aaattacttgcaa

SEQ ID NO: 554160 - DNA, 13 bp, D. melanogaster
aaattactttcac

SEQ ID NO: 554161 - DNA, 13 bp, D. melanogaster
aaattagaatttc

SEQ ID NO: 554162 - DNA, 13 bp, D. melanogaster
aaattagagcaaa

SEQ ID NO: 554163 - DNA, 13 bp, D. melanogaster
aaattagatttct

SEQ ID NO: 554164 - DNA, 14 bp, D. melanogaster
aaattagcaaaaat

SEQ ID NO: 554165 - DNA, 13 bp, D. melanogaster
aaattagcaaaag

SEQ ID NO: 554166 - DNA, 14 bp, D. melanogaster
aaattagcaataaa

SEQ ID NO: 554167 - DNA, 13 bp, D. melanogaster
aaattagcaatat

SEQ ID NO: 554168 - DNA, 13 bp, D. melanogaster
aaattagcacaaa

SEQ ID NO: 554169 - DNA, 13 bp, D. melanogaster
aaattagcagcaa

SEQ ID NO: 554170 - DNA, 13 bp, D. melanogaster
aaattagcataaa

SEQ ID NO: 554171 - DNA, 14 bp, D. melanogaster
aaattagcataaat

SEQ ID NO: 554172 - DNA, 13 bp, D. melanogaster
aaattagcataca

SEQ ID NO: 554173 - DNA, 13 bp, D. melanogaster
aaattagcatata

SEQ ID NO: 554174 - DNA, 13 bp, D. melanogaster
aaattagcatatt

SEQ ID NO: 554175 - DNA, 13 bp, D. melanogaster
aaattagcattaa

SEQ ID NO: 554176 - DNA, 13 bp, D. melanogaster
aaattagcattta

SEQ ID NO: 554177 - DNA, 13 bp, D. melanogaster
aaattagcatttt

SEQ ID NO: 554178 - DNA, 14 bp, D. melanogaster
aaattagcattttt

SEQ ID NO: 554179 - DNA, 13 bp, D. melanogaster
aaattagccaaag

SEQ ID NO: 554180 - DNA, 13 bp, D. melanogaster
aaattagccaagt

SEQ ID NO: 554181 - DNA, 13 bp, D. melanogaster
aaattagccaatt

SEQ ID NO: 554182 - DNA, 13 bp, D. melanogaster
aaattagccacaa

SEQ ID NO: 554183 - DNA, 14 bp, D. melanogaster
aaattagccataaa

SEQ ID NO: 554184 - DNA, 13 bp, D. melanogaster
aaattaggcaaaa

SEQ ID NO: 554185 - DNA, 13 bp, D. melanogaster
aaattaggcattt

SEQ ID NO: 554186 - DNA, 13 bp, D. melanogaster
aaattaggttgga

SEQ ID NO: 554187 - DNA, 13 bp, D. melanogaster
aaattagtaatcg

SEQ ID NO: 554188 - DNA, 13 bp, D. melanogaster
aaattagtcaaat

SEQ ID NO: 554189 - DNA, 13 bp, D. melanogaster
aaattagtgcgat

SEQ ID NO: 554190 - DNA, 13 bp, D. melanogaster
aaattagttcaat

SEQ ID NO: 554191 - DNA, 13 bp, D. melanogaster
aaattagttgaaa

SEQ ID NO: 554192 - DNA, 13 bp, D. melanogaster
aaattagttgatt

SEQ ID NO: 554193 - DNA, 13 bp, D. melanogaster
aaattagttgtat

SEQ ID NO: 554194 - DNA, 13 bp, D. melanogaster
aaattagtttctt

SEQ ID NO: 554195 - DNA, 14 bp, D. melanogaster
aaattagtttctta

SEQ ID NO: 554196 - DNA, 13 bp, D. melanogaster
aaattagtttgca

SEQ ID NO: 554197 - DNA, 13 bp, D. melanogaster
aaattagttttca

SEQ ID NO: 554198 - DNA, 14 bp, D. melanogaster
aaattagttttcaa

SEQ ID NO: 554199 - DNA, 13 bp, D. melanogaster
aaattagtttttc

SEQ ID NO: 554200 - DNA, 13 bp, D. melanogaster
aaattataaaagc

SEQ ID NO: 554201 - DNA, 13 bp, D. melanogaster
aaattataagcaa

SEQ ID NO: 554202 - DNA, 13 bp, D. melanogaster
aaattataagctt

SEQ ID NO: 554203 - DNA, 13 bp, D. melanogaster
aaattataatgca

SEQ ID NO: 554204 - DNA, 13 bp, D. melanogaster
aaattataattgc

SEQ ID NO: 554205 - DNA, 13 bp, D. melanogaster
aaattatacgaat

SEQ ID NO: 554206 - DNA, 13 bp, D. melanogaster
aaattatactttc

SEQ ID NO: 554207 - DNA, 13 bp, D. melanogaster
aaattatagaagt

SEQ ID NO: 554208 - DNA, 13 bp, D. melanogaster
aaattatagacga

SEQ ID NO: 554209 - DNA, 13 bp, D. melanogaster
aaattatagcaat

SEQ ID NO: 554210 - DNA, 13 bp, D. melanogaster
aaattatatgcac

SEQ ID NO: 554211 - DNA, 14 bp, D. melanogaster
aaattatatgcatt

SEQ ID NO: 554212 - DNA, 13 bp, D. melanogaster
aaattatattacc

SEQ ID NO: 554213 - DNA, 13 bp, D. melanogaster
aaattatattggt

SEQ ID NO: 554214 - DNA, 15 bp, D. melanogaster
aaattatatttagga

SEQ ID NO: 554215 - DNA, 13 bp, D. melanogaster
aaattatcaaaag

SEQ ID NO: 554216 - DNA, 13 bp, D. melanogaster
aaattatcaaaga

SEQ ID NO: 554217 - DNA, 13 bp, D. melanogaster
aaattatcaactt

SEQ ID NO: 554218 - DNA, 13 bp, D. melanogaster
aaattatcacttt

SEQ ID NO: 554219 - DNA, 13 bp, D. melanogaster
aaattatcagttc

SEQ ID NO: 554220 - DNA, 13 bp, D. melanogaster
aaattatccatat

SEQ ID NO: 554221 - DNA, 13 bp, D. melanogaster
aaattatcctgtc

SEQ ID NO: 554222 - DNA, 13 bp, D. melanogaster
aaattatcgattt

SEQ ID NO: 554223 - DNA, 13 bp, D. melanogaster
aaattatcttcaa

SEQ ID NO: 554224 - DNA, 13 bp, D. melanogaster
aaattatcttgaa

SEQ ID NO: 554225 - DNA, 13 bp, D. melanogaster
aaattatgaaact

SEQ ID NO: 554226 - DNA, 13 bp, D. melanogaster
aaattatgaactt

SEQ ID NO: 554227 - DNA, 13 bp, D. melanogaster
aaattatgaagcc

SEQ ID NO: 554228 - DNA, 13 bp, D. melanogaster
aaattatgacaaa

SEQ ID NO: 554229 - DNA, 13 bp, D. melanogaster
aaattatgactta

SEQ ID NO: 554230 - DNA, 13 bp, D. melanogaster
aaattatgagcca

SEQ ID NO: 554231 - DNA, 13 bp, D. melanogaster
aaattatgcaaaa

SEQ ID NO: 554232 - DNA, 14 bp, D. melanogaster
aaattatgcaaaat

SEQ ID NO: 554233 - DNA, 13 bp, D. melanogaster
aaattatgcaaat

SEQ ID NO: 554234 - DNA, 14 bp, D. melanogaster
aaattatgcaaatg

SEQ ID NO: 554235 - DNA, 13 bp, D. melanogaster
aaattatgcaact

SEQ ID NO: 554236 - DNA, 13 bp, D. melanogaster
aaattatgcaata

SEQ ID NO: 554237 - DNA, 14 bp, D. melanogaster
aaattatgcaataa

SEQ ID NO: 554238 - DNA, 13 bp, D. melanogaster
aaattatgcacag

SEQ ID NO: 554239 - DNA, 13 bp, D. melanogaster
aaattatgcatta

SEQ ID NO: 554240 - DNA, 13 bp, D. melanogaster
aaattatgccaaa

SEQ ID NO: 554241 - DNA, 13 bp, D. melanogaster
aaattatgccaca

SEQ ID NO: 554242 - DNA, 13 bp, D. melanogaster
aaattatgccagc

SEQ ID NO: 554243 - DNA, 13 bp, D. melanogaster
aaattatgcgaat

SEQ ID NO: 554244 - DNA, 13 bp, D. melanogaster
aaattatgctgca

SEQ ID NO: 554245 - DNA, 13 bp, D. melanogaster
aaattatggaaat

SEQ ID NO: 554246 - DNA, 13 bp, D. melanogaster
aaattatggcaaa

SEQ ID NO: 554247 - DNA, 13 bp, D. melanogaster
aaattatggcaac

SEQ ID NO: 554248 - DNA, 13 bp, D. melanogaster
aaattatggccaa

SEQ ID NO: 554249 - DNA, 13 bp, D. melanogaster
aaattatggcgaa

SEQ ID NO: 554250 - DNA, 13 bp, D. melanogaster
aaattatgggaaa

SEQ ID NO: 554251 - DNA, 13 bp, D. melanogaster
aaattatggtaaa

SEQ ID NO: 554252 - DNA, 13 bp, D. melanogaster
aaattatgtcaaa

SEQ ID NO: 554253 - DNA, 13 bp, D. melanogaster
aaattatgtgcaa

SEQ ID NO: 554254 - DNA, 13 bp, D. melanogaster
aaattatgtgtaa

SEQ ID NO: 554255 - DNA, 13 bp, D. melanogaster
aaattatgttgtt

SEQ ID NO: 554256 - DNA, 13 bp, D. melanogaster
aaattattaactg

SEQ ID NO: 554257 - DNA, 13 bp, D. melanogaster
aaattattaccaa

SEQ ID NO: 554258 - DNA, 14 bp, D. melanogaster
aaattattagctga

SEQ ID NO: 554259 - DNA, 13 bp, D. melanogaster
aaattattatggc

SEQ ID NO: 554260 - DNA, 13 bp, D. melanogaster
aaattattattcg

SEQ ID NO: 554261 - DNA, 14 bp, D. melanogaster
aaattattcaaaga

SEQ ID NO: 554262 - DNA, 13 bp, D. melanogaster
aaattattcagat

SEQ ID NO: 554263 - DNA, 13 bp, D. melanogaster
aaattattcagtt

SEQ ID NO: 554264 - DNA, 13 bp, D. melanogaster
aaattattccaaa

SEQ ID NO: 554265 - DNA, 13 bp, D. melanogaster
aaattattccaat

SEQ ID NO: 554266 - DNA, 13 bp, D. melanogaster
aaattattccaca

SEQ ID NO: 554267 - DNA, 13 bp, D. melanogaster
aaattattccatt

SEQ ID NO: 554268 - DNA, 13 bp, D. melanogaster
aaattattcgaaa

SEQ ID NO: 554269 - DNA, 13 bp, D. melanogaster
aaattattcgatt

SEQ ID NO: 554270 - DNA, 13 bp, D. melanogaster
aaattattcgcaa

SEQ ID NO: 554271 - DNA, 13 bp, D. melanogaster
aaattattctcaa

SEQ ID NO: 554272 - DNA, 13 bp, D. melanogaster
aaattattgcaag

SEQ ID NO: 554273 - DNA, 14 bp, D. melanogaster
aaattattgcaaga

SEQ ID NO: 554274 - DNA, 13 bp, D. melanogaster
aaattattgcaca

SEQ ID NO: 554275 - DNA, 13 bp, D. melanogaster
aaattattggaaa

SEQ ID NO: 554276 - DNA, 13 bp, D. melanogaster
aaattattgttca

SEQ ID NO: 554277 - DNA, 13 bp, D. melanogaster
aaattatttagcc

SEQ ID NO: 554278 - DNA, 13 bp, D. melanogaster
aaattatttcaca

SEQ ID NO: 554279 - DNA, 13 bp, D. melanogaster
aaattatttccaa

SEQ ID NO: 554280 - DNA, 13 bp, D. melanogaster
aaattatttcctt

SEQ ID NO: 554281 - DNA, 13 bp, D. melanogaster
aaattatttcgct

SEQ ID NO: 554282 - DNA, 14 bp, D. melanogaster
aaattatttcgttt

SEQ ID NO: 554283 - DNA, 13 bp, D. melanogaster
aaattatttctag

SEQ ID NO: 554284 - DNA, 13 bp, D. melanogaster
aaattatttgcaa

SEQ ID NO: 554285 - DNA, 14 bp, D. melanogaster
aaattatttgcaat

SEQ ID NO: 554286 - DNA, 13 bp, D. melanogaster
aaattatttgctt

SEQ ID NO: 554287 - DNA, 13 bp, D. melanogaster
aaattatttggaa

SEQ ID NO: 554288 - DNA, 13 bp, D. melanogaster
aaattatttggcc

SEQ ID NO: 554289 - DNA, 13 bp, D. melanogaster
aaattattttgct

SEQ ID NO: 554290 - DNA, 14 bp, D. melanogaster
aaattattttggaa

SEQ ID NO: 554291 - DNA, 13 bp, D. melanogaster
aaattatttttcg

SEQ ID NO: 554292 - DNA, 13 bp, D. melanogaster
aaattcaaaacag

SEQ ID NO: 554293 - DNA, 13 bp, D. melanogaster
aaattcaaaacga

SEQ ID NO: 554294 - DNA, 13 bp, D. melanogaster
aaattcaaaagat

SEQ ID NO: 554295 - DNA, 13 bp, D. melanogaster
aaattcaaaatcg

SEQ ID NO: 554296 - DNA, 13 bp, D. melanogaster
aaattcaaaatga

SEQ ID NO: 554297 - DNA, 13 bp, D. melanogaster
aaattcaaaattc

SEQ ID NO: 554298 - DNA, 13 bp, D. melanogaster
aaattcaaacgaa

SEQ ID NO: 554299 - DNA, 13 bp, D. melanogaster
aaattcaaacttt

SEQ ID NO: 554300 - DNA, 13 bp, D. melanogaster
aaattcaaagcaa

SEQ ID NO: 554301 - DNA, 13 bp, D. melanogaster
aaattcaaagcac

SEQ ID NO: 554302 - DNA, 13 bp, D. melanogaster
aaattcaaaggaa

SEQ ID NO: 554303 - DNA, 13 bp, D. melanogaster
aaattcaaaggag

SEQ ID NO: 554304 - DNA, 14 bp, D. melanogaster
aaattcaaaggagc

SEQ ID NO: 554305 - DNA, 14 bp, D. melanogaster
aaattcaaaggcaa

SEQ ID NO: 554306 - DNA, 13 bp, D. melanogaster
aaattcaaagtat

SEQ ID NO: 554307 - DNA, 14 bp, D. melanogaster
aaattcaaatagaa

SEQ ID NO: 554308 - DNA, 13 bp, D. melanogaster
aaattcaaatcga

SEQ ID NO: 554309 - DNA, 13 bp, D. melanogaster
aaattcaaatgaa

SEQ ID NO: 554310 - DNA, 14 bp, D. melanogaster
aaattcaaatgaaa

SEQ ID NO: 554311 - DNA, 13 bp, D. melanogaster
aaattcaaatgac

SEQ ID NO: 554312 - DNA, 13 bp, D. melanogaster
aaattcaaatgag

SEQ ID NO: 554313 - DNA, 13 bp, D. melanogaster
aaattcaaatgca

SEQ ID NO: 554314 - DNA, 13 bp, D. melanogaster
aaattcaaatgcg

SEQ ID NO: 554315 - DNA, 13 bp, D. melanogaster
aaattcaaatgga

SEQ ID NO: 554316 - DNA, 14 bp, D. melanogaster
aaattcaaatggaa

SEQ ID NO: 554317 - DNA, 13 bp, D. melanogaster
aaattcaaatggc

SEQ ID NO: 554318 - DNA, 13 bp, D. melanogaster
aaattcaaatgtg

SEQ ID NO: 554319 - DNA, 13 bp, D. melanogaster
aaattcaaattct

SEQ ID NO: 554320 - DNA, 14 bp, D. melanogaster
aaattcaaattcta

SEQ ID NO: 554321 - DNA, 14 bp, D. melanogaster
aaattcaaattgtt

SEQ ID NO: 554322 - DNA, 13 bp, D. melanogaster
aaattcaacaatt

SEQ ID NO: 554323 - DNA, 13 bp, D. melanogaster
aaattcaacactt

SEQ ID NO: 554324 - DNA, 13 bp, D. melanogaster
aaattcaacatca

SEQ ID NO: 554325 - DNA, 13 bp, D. melanogaster
aaattcaacgcat

SEQ ID NO: 554326 - DNA, 13 bp, D. melanogaster
aaattcaactcaa

SEQ ID NO: 554327 - DNA, 13 bp, D. melanogaster
aaattcaactgca

SEQ ID NO: 554328 - DNA, 13 bp, D. melanogaster
aaattcaacttga

SEQ ID NO: 554329 - DNA, 13 bp, D. melanogaster
aaattcaactttg

SEQ ID NO: 554330 - DNA, 14 bp, D. melanogaster
aaattcaagaaaat

SEQ ID NO: 554331 - DNA, 13 bp, D. melanogaster
aaattcaagaatt

SEQ ID NO: 554332 - DNA, 13 bp, D. melanogaster
aaattcaagattt

SEQ ID NO: 554333 - DNA, 14 bp, D. melanogaster
aaattcaagcaggc

SEQ ID NO: 554334 - DNA, 15 bp, D. melanogaster
aaattcaaggccatt

SEQ ID NO: 554335 - DNA, 13 bp, D. melanogaster
aaattcaagtatt

SEQ ID NO: 554336 - DNA, 13 bp, D. melanogaster
aaattcaagtgaa

SEQ ID NO: 554337 - DNA, 13 bp, D. melanogaster
aaattcaagttaa

SEQ ID NO: 554338 - DNA, 13 bp, D. melanogaster
aaattcaagttcg

SEQ ID NO: 554339 - DNA, 13 bp, D. melanogaster
aaattcaagtttt

SEQ ID NO: 554340 - DNA, 13 bp, D. melanogaster
aaattcaataaag

SEQ ID NO: 554341 - DNA, 13 bp, D. melanogaster
aaattcaatatgc

SEQ ID NO: 554342 - DNA, 14 bp, D. melanogaster
aaattcaatcaatt

SEQ ID NO: 554343 - DNA, 13 bp, D. melanogaster
aaattcaatcgaa

SEQ ID NO: 554344 - DNA, 13 bp, D. melanogaster
aaattcaatgaaa

SEQ ID NO: 554345 - DNA, 14 bp, D. melanogaster
aaattcaatgaaaa

SEQ ID NO: 554346 - DNA, 14 bp, D. melanogaster
aaattcaatgaatt

SEQ ID NO: 554347 - DNA, 13 bp, D. melanogaster
aaattcaatgcaa

SEQ ID NO: 554348 - DNA, 13 bp, D. melanogaster
aaattcaatgcca

SEQ ID NO: 554349 - DNA, 13 bp, D. melanogaster
aaattcaatggaa

SEQ ID NO: 554350 - DNA, 14 bp, D. melanogaster
aaattcaatggaaa

SEQ ID NO: 554351 - DNA, 13 bp, D. melanogaster
aaattcaattact

SEQ ID NO: 554352 - DNA, 13 bp, D. melanogaster
aaattcaattagc

SEQ ID NO: 554353 - DNA, 13 bp, D. melanogaster
aaattcaattcaa

SEQ ID NO: 554354 - DNA, 13 bp, D. melanogaster
aaattcaattcat

SEQ ID NO: 554355 - DNA, 14 bp, D. melanogaster
aaattcaattcatt

SEQ ID NO: 554356 - DNA, 13 bp, D. melanogaster
aaattcaattgga

SEQ ID NO: 554357 - DNA, 13 bp, D. melanogaster
aaattcaattggc

SEQ ID NO: 554358 - DNA, 13 bp, D. melanogaster
aaattcaatttac

SEQ ID NO: 554359 - DNA, 14 bp, D. melanogaster
aaattcaatttaca

SEQ ID NO: 554360 - DNA, 14 bp, D. melanogaster
aaattcaatttcca

SEQ ID NO: 554361 - DNA, 14 bp, D. melanogaster
aaattcaatttcga

SEQ ID NO: 554362 - DNA, 14 bp, D. melanogaster
aaattcaatttgaa

SEQ ID NO: 554363 - DNA, 13 bp, D. melanogaster
aaattcaatttgc

SEQ ID NO: 554364 - DNA, 14 bp, D. melanogaster
aaattcaatttgtt

SEQ ID NO: 554365 - DNA, 13 bp, D. melanogaster
aaattcaattttc

SEQ ID NO: 554366 - DNA, 13 bp, D. melanogaster
aaattcacagaaa

SEQ ID NO: 554367 - DNA, 13 bp, D. melanogaster
aaattcacgaaaa

SEQ ID NO: 554368 - DNA, 13 bp, D. melanogaster
aaattcactttaa

SEQ ID NO: 554369 - DNA, 13 bp, D. melanogaster
aaattcagaaaac

SEQ ID NO: 554370 - DNA, 13 bp, D. melanogaster
aaattcagaaact

SEQ ID NO: 554371 - DNA, 13 bp, D. melanogaster
aaattcagaattt

SEQ ID NO: 554372 - DNA, 13 bp, D. melanogaster
aaattcagatatt

SEQ ID NO: 554373 - DNA, 13 bp, D. melanogaster
aaattcagatttg

SEQ ID NO: 554374 - DNA, 13 bp, D. melanogaster
aaattcagatttt

SEQ ID NO: 554375 - DNA, 13 bp, D. melanogaster
aaattcagcaaat

SEQ ID NO: 554376 - DNA, 13 bp, D. melanogaster
aaattcagcagag

SEQ ID NO: 554377 - DNA, 13 bp, D. melanogaster
aaattcagcagca

SEQ ID NO: 554378 - DNA, 13 bp, D. melanogaster
aaattcagcttaa

SEQ ID NO: 554379 - DNA, 13 bp, D. melanogaster
aaattcagtaatt

SEQ ID NO: 554380 - DNA, 13 bp, D. melanogaster
aaattcagtattt

SEQ ID NO: 554381 - DNA, 13 bp, D. melanogaster
aaattcagttgaa

SEQ ID NO: 554382 - DNA, 13 bp, D. melanogaster
aaattcagtttaa

SEQ ID NO: 554383 - DNA, 13 bp, D. melanogaster
aaattcagtttgc

SEQ ID NO: 554384 - DNA, 13 bp, D. melanogaster
aaattcagtttta

SEQ ID NO: 554385 - DNA, 13 bp, D. melanogaster
aaattcagttttc

SEQ ID NO: 554386 - DNA, 13 bp, D. melanogaster
aaattcagttttt

SEQ ID NO: 554387 - DNA, 13 bp, D. melanogaster
aaattcatacatt

SEQ ID NO: 554388 - DNA, 13 bp, D. melanogaster
aaattcatacgtt

SEQ ID NO: 554389 - DNA, 14 bp, D. melanogaster
aaattcatacgttt

SEQ ID NO: 554390 - DNA, 13 bp, D. melanogaster
aaattcatagaaa

SEQ ID NO: 554391 - DNA, 13 bp, D. melanogaster
aaattcatagata

SEQ ID NO: 554392 - DNA, 13 bp, D. melanogaster
aaattcatcaaat

SEQ ID NO: 554393 - DNA, 13 bp, D. melanogaster
aaattcatccaaa

SEQ ID NO: 554394 - DNA, 13 bp, D. melanogaster
aaattcatgaaaa

SEQ ID NO: 554395 - DNA, 13 bp, D. melanogaster
aaattcatgaatg

SEQ ID NO: 554396 - DNA, 13 bp, D. melanogaster
aaattcatgcaaa

SEQ ID NO: 554397 - DNA, 13 bp, D. melanogaster
aaattcatgttga

SEQ ID NO: 554398 - DNA, 14 bp, D. melanogaster
aaattcattaacca

SEQ ID NO: 554399 - DNA, 13 bp, D. melanogaster
aaattcattaagc

SEQ ID NO: 554400 - DNA, 13 bp, D. melanogaster
aaattcattacac

SEQ ID NO: 554401 - DNA, 13 bp, D. melanogaster
aaattcattagaa

SEQ ID NO: 554402 - DNA, 13 bp, D. melanogaster
aaattcattcaaa

SEQ ID NO: 554403 - DNA, 13 bp, D. melanogaster
aaattcattcaga

SEQ ID NO: 554404 - DNA, 13 bp, D. melanogaster
aaattcattgaaa

SEQ ID NO: 554405 - DNA, 13 bp, D. melanogaster
aaattcattgatt

SEQ ID NO: 554406 - DNA, 14 bp, D. melanogaster
aaattcattgattt

SEQ ID NO: 554407 - DNA, 13 bp, D. melanogaster
aaattcattgcca

SEQ ID NO: 554408 - DNA, 13 bp, D. melanogaster
aaattcatttgaa

SEQ ID NO: 554409 - DNA, 14 bp, D. melanogaster
aaattcatttgaat

SEQ ID NO: 554410 - DNA, 13 bp, D. melanogaster
aaattcatttgtc

SEQ ID NO: 554411 - DNA, 13 bp, D. melanogaster
aaattcatttgtt

SEQ ID NO: 554412 - DNA, 13 bp, D. melanogaster
aaattcattttca

SEQ ID NO: 554413 - DNA, 13 bp, D. melanogaster
aaattcattttga

SEQ ID NO: 554414 - DNA, 13 bp, D. melanogaster
aaattccaaaaga

SEQ ID NO: 554415 - DNA, 13 bp, D. melanogaster
aaattccaaaagg

SEQ ID NO: 554416 - DNA, 13 bp, D. melanogaster
aaattccaaaatg

SEQ ID NO: 554417 - DNA, 13 bp, D. melanogaster
aaattccaaaatt

SEQ ID NO: 554418 - DNA, 13 bp, D. melanogaster
aaattccaaatta

SEQ ID NO: 554419 - DNA, 13 bp, D. melanogaster
aaattccaaattc

SEQ ID NO: 554420 - DNA, 14 bp, D. melanogaster
aaattccaaattcc

SEQ ID NO: 554421 - DNA, 13 bp, D. melanogaster
aaattccaaattt

SEQ ID NO: 554422 - DNA, 13 bp, D. melanogaster
aaattccaacaat

SEQ ID NO: 554423 - DNA, 13 bp, D. melanogaster
aaattccaacatt

SEQ ID NO: 554424 - DNA, 13 bp, D. melanogaster
aaattccaagcaa

SEQ ID NO: 554425 - DNA, 13 bp, D. melanogaster
aaattccaagttt

SEQ ID NO: 554426 - DNA, 13 bp, D. melanogaster
aaattccaatata

SEQ ID NO: 554427 - DNA, 14 bp, D. melanogaster
aaattccaatcgat

SEQ ID NO: 554428 - DNA, 13 bp, D. melanogaster
aaattccaatgca

SEQ ID NO: 554429 - DNA, 13 bp, D. melanogaster
aaattccacaaat

SEQ ID NO: 554430 - DNA, 13 bp, D. melanogaster
aaattccacaaca

SEQ ID NO: 554431 - DNA, 13 bp, D. melanogaster
aaattccacagaa

SEQ ID NO: 554432 - DNA, 13 bp, D. melanogaster
aaattccagaaaa

SEQ ID NO: 554433 - DNA, 13 bp, D. melanogaster
aaattccagcaaa

SEQ ID NO: 554434 - DNA, 13 bp, D. melanogaster
aaattccagcgaa

SEQ ID NO: 554435 - DNA, 13 bp, D. melanogaster
aaattccagctaa

SEQ ID NO: 554436 - DNA, 13 bp, D. melanogaster
aaattccataaat

SEQ ID NO: 554437 - DNA, 14 bp, D. melanogaster
aaattccataaatt

SEQ ID NO: 554438 - DNA, 13 bp, D. melanogaster
aaattccattaaa

SEQ ID NO: 554439 - DNA, 13 bp, D. melanogaster
aaattccattgaa

SEQ ID NO: 554440 - DNA, 13 bp, D. melanogaster
aaattccattgtt

SEQ ID NO: 554441 - DNA, 13 bp, D. melanogaster
aaattccatttaa

SEQ ID NO: 554442 - DNA, 14 bp, D. melanogaster
aaattccatttaaa

SEQ ID NO: 554443 - DNA, 14 bp, D. melanogaster
aaattccatttaat

SEQ ID NO: 554444 - DNA, 13 bp, D. melanogaster
aaattccatttca

SEQ ID NO: 554445 - DNA, 13 bp, D. melanogaster
aaattccattttg

SEQ ID NO: 554446 - DNA, 13 bp, D. melanogaster
aaattccattttt

SEQ ID NO: 554447 - DNA, 14 bp, D. melanogaster
aaattccattttta

SEQ ID NO: 554448 - DNA, 13 bp, D. melanogaster
aaattcccaaaat

SEQ ID NO: 554449 - DNA, 13 bp, D. melanogaster
aaattcccaataa

SEQ ID NO: 554450 - DNA, 14 bp, D. melanogaster
aaattcccaatcga

SEQ ID NO: 554451 - DNA, 13 bp, D. melanogaster
aaattcccaattt

SEQ ID NO: 554452 - DNA, 13 bp, D. melanogaster
aaattcccacttc

SEQ ID NO: 554453 - DNA, 13 bp, D. melanogaster
aaattcccataaa

SEQ ID NO: 554454 - DNA, 13 bp, D. melanogaster
aaattcccatttt

SEQ ID NO: 554455 - DNA, 13 bp, D. melanogaster
aaattccccaaaa

SEQ ID NO: 554456 - DNA, 13 bp, D. melanogaster
aaattccccaaag

SEQ ID NO: 554457 - DNA, 13 bp, D. melanogaster
aaattcccctttt

SEQ ID NO: 554458 - DNA, 13 bp, D. melanogaster
aaattcccgatta

SEQ ID NO: 554459 - DNA, 13 bp, D. melanogaster
aaattccctcatt

SEQ ID NO: 554460 - DNA, 13 bp, D. melanogaster
aaattccgaaaaa

SEQ ID NO: 554461 - DNA, 13 bp, D. melanogaster
aaattccgaaatt

SEQ ID NO: 554462 - DNA, 13 bp, D. melanogaster
aaattccgatttt

SEQ ID NO: 554463 - DNA, 13 bp, D. melanogaster
aaattccgcataa

SEQ ID NO: 554464 - DNA, 13 bp, D. melanogaster
aaattccgcgatg

SEQ ID NO: 554465 - DNA, 13 bp, D. melanogaster
aaattcctgaatg

SEQ ID NO: 554466 - DNA, 13 bp, D. melanogaster
aaattcctgtaaa

SEQ ID NO: 554467 - DNA, 13 bp, D. melanogaster
aaattccttgaaa

SEQ ID NO: 554468 - DNA, 13 bp, D. melanogaster
aaattcctttaat

SEQ ID NO: 554469 - DNA, 13 bp, D. melanogaster
aaattcctttgtc

SEQ ID NO: 554470 - DNA, 13 bp, D. melanogaster
aaattccttttaa

SEQ ID NO: 554471 - DNA, 14 bp, D. melanogaster
aaattcgaaaaaca

SEQ ID NO: 554472 - DNA, 13 bp, D. melanogaster
aaattcgaaaata

SEQ ID NO: 554473 - DNA, 13 bp, D. melanogaster
aaattcgaaatga

SEQ ID NO: 554474 - DNA, 13 bp, D. melanogaster
aaattcgaaatgc

SEQ ID NO: 554475 - DNA, 13 bp, D. melanogaster
aaattcgaaatta

SEQ ID NO: 554476 - DNA, 13 bp, D. melanogaster
aaattcgaaattc

SEQ ID NO: 554477 - DNA, 13 bp, D. melanogaster
aaattcgaataat

SEQ ID NO: 554478 - DNA, 13 bp, D. melanogaster
aaattcgaatatt

SEQ ID NO: 554479 - DNA, 13 bp, D. melanogaster
aaattcgaatgca

SEQ ID NO: 554480 - DNA, 13 bp, D. melanogaster
aaattcgaattaa

SEQ ID NO: 554481 - DNA, 13 bp, D. melanogaster
aaattcgaattca

SEQ ID NO: 554482 - DNA, 14 bp, D. melanogaster
aaattcgaattcaa

SEQ ID NO: 554483 - DNA, 13 bp, D. melanogaster
aaattcgaattcg

SEQ ID NO: 554484 - DNA, 13 bp, D. melanogaster
aaattcgaattgg

SEQ ID NO: 554485 - DNA, 13 bp, D. melanogaster
aaattcgagaaaa

SEQ ID NO: 554486 - DNA, 14 bp, D. melanogaster
aaattcgagaaaaa

SEQ ID NO: 554487 - DNA, 14 bp, D. melanogaster
aaattcgagagagc

SEQ ID NO: 554488 - DNA, 13 bp, D. melanogaster
aaattcgatattt

SEQ ID NO: 554489 - DNA, 14 bp, D. melanogaster
aaattcgatcgaca

SEQ ID NO: 554490 - DNA, 13 bp, D. melanogaster
aaattcgattcaa

SEQ ID NO: 554491 - DNA, 14 bp, D. melanogaster
aaattcgatttaaa

SEQ ID NO: 554492 - DNA, 13 bp, D. melanogaster
aaattcgatttac

SEQ ID NO: 554493 - DNA, 13 bp, D. melanogaster
aaattcgatttgc

SEQ ID NO: 554494 - DNA, 13 bp, D. melanogaster
aaattcgcaaaaa

SEQ ID NO: 554495 - DNA, 13 bp, D. melanogaster
aaattcgcaaata

SEQ ID NO: 554496 - DNA, 13 bp, D. melanogaster
aaattcgcaaatt

SEQ ID NO: 554497 - DNA, 13 bp, D. melanogaster
aaattcgcacaca

SEQ ID NO: 554498 - DNA, 13 bp, D. melanogaster
aaattcgcattaa

SEQ ID NO: 554499 - DNA, 13 bp, D. melanogaster
aaattcggaaaaa

SEQ ID NO: 554500 - DNA, 14 bp, D. melanogaster
aaattcggaaaaac

SEQ ID NO: 554501 - DNA, 13 bp, D. melanogaster
aaattcggaaatt

SEQ ID NO: 554502 - DNA, 13 bp, D. melanogaster
aaattcggttttt

SEQ ID NO: 554503 - DNA, 13 bp, D. melanogaster
aaattcgtaattt

SEQ ID NO: 554504 - DNA, 13 bp, D. melanogaster
aaattcgtattat

SEQ ID NO: 554505 - DNA, 13 bp, D. melanogaster
aaattcgtgaaaa

SEQ ID NO: 554506 - DNA, 13 bp, D. melanogaster
aaattcgttaaat

SEQ ID NO: 554507 - DNA, 13 bp, D. melanogaster
aaattcgttgaaa

SEQ ID NO: 554508 - DNA, 14 bp, D. melanogaster
aaattcgttgaaaa

SEQ ID NO: 554509 - DNA, 15 bp, D. melanogaster
aaattcgttgaaaaa

SEQ ID NO: 554510 - DNA, 13 bp, D. melanogaster
aaattcgtttaaa

SEQ ID NO: 554511 - DNA, 13 bp, D. melanogaster
aaattcgtttatt

SEQ ID NO: 554512 - DNA, 14 bp, D. melanogaster
aaattcgttttttt

SEQ ID NO: 554513 - DNA, 13 bp, D. melanogaster
aaattctaaaact

SEQ ID NO: 554514 - DNA, 13 bp, D. melanogaster
aaattctaaaatg

SEQ ID NO: 554515 - DNA, 13 bp, D. melanogaster
aaattctaaagaa

SEQ ID NO: 554516 - DNA, 13 bp, D. melanogaster
aaattctaaattc

SEQ ID NO: 554517 - DNA, 13 bp, D. melanogaster
aaattctagaaaa

SEQ ID NO: 554518 - DNA, 14 bp, D. melanogaster
aaattctatattgt

SEQ ID NO: 554519 - DNA, 13 bp, D. melanogaster
aaattctatttca

SEQ ID NO: 554520 - DNA, 13 bp, D. melanogaster
aaattctatttgt

SEQ ID NO: 554521 - DNA, 13 bp, D. melanogaster
aaattctcaagaa

SEQ ID NO: 554522 - DNA, 13 bp, D. melanogaster
aaattctcaattt

SEQ ID NO: 554523 - DNA, 13 bp, D. melanogaster
aaattctcagaaa

SEQ ID NO: 554524 - DNA, 13 bp, D. melanogaster
aaattctccaaaa

SEQ ID NO: 554525 - DNA, 13 bp, D. melanogaster
aaattctccaaat

SEQ ID NO: 554526 - DNA, 13 bp, D. melanogaster
aaattctcgaaat

SEQ ID NO: 554527 - DNA, 13 bp, D. melanogaster
aaattctgaaaaa

SEQ ID NO: 554528 - DNA, 13 bp, D. melanogaster
aaattctgaaatc

SEQ ID NO: 554529 - DNA, 13 bp, D. melanogaster
aaattctgaaatt

SEQ ID NO: 554530 - DNA, 13 bp, D. melanogaster
aaattctgcaata

SEQ ID NO: 554531 - DNA, 13 bp, D. melanogaster
aaattctgcattg

SEQ ID NO: 554532 - DNA, 13 bp, D. melanogaster
aaattctggcact

SEQ ID NO: 554533 - DNA, 13 bp, D. melanogaster
aaattctggcatt

SEQ ID NO: 554534 - DNA, 13 bp, D. melanogaster
aaattctgggaaa

SEQ ID NO: 554535 - DNA, 13 bp, D. melanogaster
aaattctgtgaaa

SEQ ID NO: 554536 - DNA, 13 bp, D. melanogaster
aaattcttcaaac

SEQ ID NO: 554537 - DNA, 13 bp, D. melanogaster
aaattcttcaata

SEQ ID NO: 554538 - DNA, 13 bp, D. melanogaster
aaattcttgaaaa

SEQ ID NO: 554539 - DNA, 13 bp, D. melanogaster
aaattcttgaatt

SEQ ID NO: 554540 - DNA, 13 bp, D. melanogaster
aaattcttgatca

SEQ ID NO: 554541 - DNA, 13 bp, D. melanogaster
aaattcttgattt

SEQ ID NO: 554542 - DNA, 13 bp, D. melanogaster
aaattcttggcaa

SEQ ID NO: 554543 - DNA, 13 bp, D. melanogaster
aaattcttggcca

SEQ ID NO: 554544 - DNA, 13 bp, D. melanogaster
aaattcttgtttg

SEQ ID NO: 554545 - DNA, 13 bp, D. melanogaster
aaattcttgtttt

SEQ ID NO: 554546 - DNA, 14 bp, D. melanogaster
aaattcttgttttg

SEQ ID NO: 554547 - DNA, 13 bp, D. melanogaster
aaattctttatct

SEQ ID NO: 554548 - DNA, 14 bp, D. melanogaster
aaattctttatgat

SEQ ID NO: 554549 - DNA, 13 bp, D. melanogaster
aaattctttcaat

SEQ ID NO: 554550 - DNA, 13 bp, D. melanogaster
aaattctttcatt

SEQ ID NO: 554551 - DNA, 13 bp, D. melanogaster
aaattctttccaa

SEQ ID NO: 554552 - DNA, 14 bp, D. melanogaster
aaattctttccaaa

SEQ ID NO: 554553 - DNA, 13 bp, D. melanogaster
aaattctttgaaa

SEQ ID NO: 554554 - DNA, 14 bp, D. melanogaster
aaattctttgaaaa

SEQ ID NO: 554555 - DNA, 13 bp, D. melanogaster
aaattctttgaat

SEQ ID NO: 554556 - DNA, 13 bp, D. melanogaster
aaattctttggca

SEQ ID NO: 554557 - DNA, 13 bp, D. melanogaster
aaattctttgtaa

SEQ ID NO: 554558 - DNA, 14 bp, D. melanogaster
aaattctttgtaaa

SEQ ID NO: 554559 - DNA, 13 bp, D. melanogaster
aaattctttgtta

SEQ ID NO: 554560 - DNA, 13 bp, D. melanogaster
aaattctttgttt

SEQ ID NO: 554561 - DNA, 13 bp, D. melanogaster
aaattcttttcaa

SEQ ID NO: 554562 - DNA, 13 bp, D. melanogaster
aaattcttttgaa

SEQ ID NO: 554563 - DNA, 13 bp, D. melanogaster
aaattgaaaaatc

SEQ ID NO: 554564 - DNA, 14 bp, D. melanogaster
aaattgaaaacaat

SEQ ID NO: 554565 - DNA, 13 bp, D. melanogaster
aaattgaaaacat

SEQ ID NO: 554566 - DNA, 13 bp, D. melanogaster
aaattgaaaacca

SEQ ID NO: 554567 - DNA, 13 bp, D. melanogaster
aaattgaaaactt

SEQ ID NO: 554568 - DNA, 13 bp, D. melanogaster
aaattgaaaagca

SEQ ID NO: 554569 - DNA, 14 bp, D. melanogaster
aaattgaaaagcaa

SEQ ID NO: 554570 - DNA, 13 bp, D. melanogaster
aaattgaaaaggg

SEQ ID NO: 554571 - DNA, 13 bp, D. melanogaster
aaattgaaaagtt

SEQ ID NO: 554572 - DNA, 14 bp, D. melanogaster
aaattgaaaagttt

SEQ ID NO: 554573 - DNA, 13 bp, D. melanogaster
aaattgaaaatgt

SEQ ID NO: 554574 - DNA, 14 bp, D. melanogaster
aaattgaaaatgtt

SEQ ID NO: 554575 - DNA, 13 bp, D. melanogaster
aaattgaaaattc

SEQ ID NO: 554576 - DNA, 14 bp, D. melanogaster
aaattgaaaattgc

SEQ ID NO: 554577 - DNA, 13 bp, D. melanogaster
aaattgaaacaat

SEQ ID NO: 554578 - DNA, 13 bp, D. melanogaster
aaattgaaacaga

SEQ ID NO: 554579 - DNA, 13 bp, D. melanogaster
aaattgaaaccaa

SEQ ID NO: 554580 - DNA, 13 bp, D. melanogaster
aaattgaaaccga

SEQ ID NO: 554581 - DNA, 14 bp, D. melanogaster
aaattgaaaccgaa

SEQ ID NO: 554582 - DNA, 13 bp, D. melanogaster
aaattgaaacgaa

SEQ ID NO: 554583 - DNA, 14 bp, D. melanogaster
aaattgaaacgaaa

SEQ ID NO: 554584 - DNA, 13 bp, D. melanogaster
aaattgaaacgtt

SEQ ID NO: 554585 - DNA, 14 bp, D. melanogaster
aaattgaaacgttc

SEQ ID NO: 554586 - DNA, 13 bp, D. melanogaster
aaattgaaactaa

SEQ ID NO: 554587 - DNA, 13 bp, D. melanogaster
aaattgaaactga

SEQ ID NO: 554588 - DNA, 13 bp, D. melanogaster
aaattgaaacttt

SEQ ID NO: 554589 - DNA, 14 bp, D. melanogaster
aaattgaaagcaaa

SEQ ID NO: 554590 - DNA, 14 bp, D. melanogaster
aaattgaaagccaa

SEQ ID NO: 554591 - DNA, 13 bp, D. melanogaster
aaattgaaaggca

SEQ ID NO: 554592 - DNA, 13 bp, D. melanogaster
aaattgaaagtgg

SEQ ID NO: 554593 - DNA, 13 bp, D. melanogaster
aaattgaaagttt

SEQ ID NO: 554594 - DNA, 14 bp, D. melanogaster
aaattgaaagtttt

SEQ ID NO: 554595 - DNA, 13 bp, D. melanogaster
aaattgaaatctt

SEQ ID NO: 554596 - DNA, 13 bp, D. melanogaster
aaattgaaatgca

SEQ ID NO: 554597 - DNA, 14 bp, D. melanogaster
aaattgaaatgcaa

SEQ ID NO: 554598 - DNA, 13 bp, D. melanogaster
aaattgaaatgcg

SEQ ID NO: 554599 - DNA, 14 bp, D. melanogaster
aaattgaaatggaa

SEQ ID NO: 554600 - DNA, 13 bp, D. melanogaster
aaattgaaatgtg

SEQ ID NO: 554601 - DNA, 14 bp, D. melanogaster
aaattgaaatgttt

SEQ ID NO: 554602 - DNA, 14 bp, D. melanogaster
aaattgaaattatg

SEQ ID NO: 554603 - DNA, 14 bp, D. melanogaster
aaattgaaattcaa

SEQ ID NO: 554604 - DNA, 14 bp, D. melanogaster
aaattgaaattcat

SEQ ID NO: 554605 - DNA, 13 bp, D. melanogaster
aaattgaaattga

SEQ ID NO: 554606 - DNA, 13 bp, D. melanogaster
aaattgaaattgc

SEQ ID NO: 554607 - DNA, 13 bp, D. melanogaster
aaattgaaattgg

SEQ ID NO: 554608 - DNA, 14 bp, D. melanogaster
aaattgaaattgtt

SEQ ID NO: 554609 - DNA, 13 bp, D. melanogaster
aaattgaacaaat

SEQ ID NO: 554610 - DNA, 14 bp, D. melanogaster
aaattgaacaaatt

SEQ ID NO: 554611 - DNA, 14 bp, D. melanogaster
aaattgaacatttt

SEQ ID NO: 554612 - DNA, 13 bp, D. melanogaster
aaattgaacgcaa

SEQ ID NO: 554613 - DNA, 13 bp, D. melanogaster
aaattgaactaaa

SEQ ID NO: 554614 - DNA, 13 bp, D. melanogaster
aaattgaactatt

SEQ ID NO: 554615 - DNA, 13 bp, D. melanogaster
aaattgaactgaa

SEQ ID NO: 554616 - DNA, 13 bp, D. melanogaster
aaattgaactttt

SEQ ID NO: 554617 - DNA, 13 bp, D. melanogaster
aaattgaagaaca

SEQ ID NO: 554618 - DNA, 13 bp, D. melanogaster
aaattgaagagca

SEQ ID NO: 554619 - DNA, 13 bp, D. melanogaster
aaattgaagattt

SEQ ID NO: 554620 - DNA, 13 bp, D. melanogaster
aaattgaagccaa

SEQ ID NO: 554621 - DNA, 13 bp, D. melanogaster
aaattgaagtatt

SEQ ID NO: 554622 - DNA, 13 bp, D. melanogaster
aaattgaagttga

SEQ ID NO: 554623 - DNA, 13 bp, D. melanogaster
aaattgaagttta

SEQ ID NO: 554624 - DNA, 13 bp, D. melanogaster
aaattgaagtttt

SEQ ID NO: 554625 - DNA, 13 bp, D. melanogaster
aaattgaataaca

SEQ ID NO: 554626 - DNA, 13 bp, D. melanogaster
aaattgaatagca

SEQ ID NO: 554627 - DNA, 13 bp, D. melanogaster
aaattgaatagtt

SEQ ID NO: 554628 - DNA, 13 bp, D. melanogaster
aaattgaatatga

SEQ ID NO: 554629 - DNA, 13 bp, D. melanogaster
aaattgaatcaaa

SEQ ID NO: 554630 - DNA, 13 bp, D. melanogaster
aaattgaatcaat

SEQ ID NO: 554631 - DNA, 13 bp, D. melanogaster
aaattgaatcaca

SEQ ID NO: 554632 - DNA, 14 bp, D. melanogaster
aaattgaatcgaat

SEQ ID NO: 554633 - DNA, 13 bp, D. melanogaster
aaattgaatcgca

SEQ ID NO: 554634 - DNA, 13 bp, D. melanogaster
aaattgaatgcaa

SEQ ID NO: 554635 - DNA, 14 bp, D. melanogaster
aaattgaatgcaaa

SEQ ID NO: 554636 - DNA, 14 bp, D. melanogaster
aaattgaatgcaat

SEQ ID NO: 554637 - DNA, 13 bp, D. melanogaster
aaattgaatgcca

SEQ ID NO: 554638 - DNA, 13 bp, D. melanogaster
aaattgaatgcga

SEQ ID NO: 554639 - DNA, 13 bp, D. melanogaster
aaattgaatggaa

SEQ ID NO: 554640 - DNA, 13 bp, D. melanogaster
aaattgaatggga

SEQ ID NO: 554641 - DNA, 13 bp, D. melanogaster
aaattgaatggtt

SEQ ID NO: 554642 - DNA, 13 bp, D. melanogaster
aaattgaatgtaa

SEQ ID NO: 554643 - DNA, 13 bp, D. melanogaster
aaattgaattatg

SEQ ID NO: 554644 - DNA, 14 bp, D. melanogaster
aaattgaattcaaa

SEQ ID NO: 554645 - DNA, 13 bp, D. melanogaster
aaattgaattcca

SEQ ID NO: 554646 - DNA, 13 bp, D. melanogaster
aaattgaattcga

SEQ ID NO: 554647 - DNA, 13 bp, D. melanogaster
aaattgaattctt

SEQ ID NO: 554648 - DNA, 13 bp, D. melanogaster
aaattgaattgaa

SEQ ID NO: 554649 - DNA, 14 bp, D. melanogaster
aaattgaattgaat

SEQ ID NO: 554650 - DNA, 14 bp, D. melanogaster
aaattgaattgcat

SEQ ID NO: 554651 - DNA, 14 bp, D. melanogaster
aaattgaattgttt

SEQ ID NO: 554652 - DNA, 13 bp, D. melanogaster
aaattgaatttag

SEQ ID NO: 554653 - DNA, 13 bp, D. melanogaster
aaattgaatttct

SEQ ID NO: 554654 - DNA, 13 bp, D. melanogaster
aaattgaatttga

SEQ ID NO: 554655 - DNA, 14 bp, D. melanogaster
aaattgaatttgat

SEQ ID NO: 554656 - DNA, 13 bp, D. melanogaster
aaattgaatttgc

SEQ ID NO: 554657 - DNA, 14 bp, D. melanogaster
aaattgaatttgtt

SEQ ID NO: 554658 - DNA, 13 bp, D. melanogaster
aaattgaattttc

SEQ ID NO: 554659 - DNA, 14 bp, D. melanogaster
aaattgaattttca

SEQ ID NO: 554660 - DNA, 14 bp, D. melanogaster
aaattgacaaaaat

SEQ ID NO: 554661 - DNA, 13 bp, D. melanogaster
aaattgacaaatg

SEQ ID NO: 554662 - DNA, 13 bp, D. melanogaster
aaattgacaaatt

SEQ ID NO: 554663 - DNA, 13 bp, D. melanogaster
aaattgacagctt

SEQ ID NO: 554664 - DNA, 13 bp, D. melanogaster
aaattgacataaa

SEQ ID NO: 554665 - DNA, 13 bp, D. melanogaster
aaattgacatatt

SEQ ID NO: 554666 - DNA, 13 bp, D. melanogaster
aaattgacattga

SEQ ID NO: 554667 - DNA, 13 bp, D. melanogaster
aaattgacatttt

SEQ ID NO: 554668 - DNA, 13 bp, D. melanogaster
aaattgaccaaaa

SEQ ID NO: 554669 - DNA, 14 bp, D. melanogaster
aaattgaccaaaaa

SEQ ID NO: 554670 - DNA, 13 bp, D. melanogaster
aaattgaccaaat

SEQ ID NO: 554671 - DNA, 13 bp, D. melanogaster
aaattgactcaaa

SEQ ID NO: 554672 - DNA, 13 bp, D. melanogaster
aaattgactttat

SEQ ID NO: 554673 - DNA, 13 bp, D. melanogaster
aaattgacttttg

SEQ ID NO: 554674 - DNA, 13 bp, D. melanogaster
aaattgagaaatt

SEQ ID NO: 554675 - DNA, 13 bp, D. melanogaster
aaattgagaattt

SEQ ID NO: 554676 - DNA, 13 bp, D. melanogaster
aaattgagagctg

SEQ ID NO: 554677 - DNA, 13 bp, D. melanogaster
aaattgagagttt

SEQ ID NO: 554678 - DNA, 13 bp, D. melanogaster
aaattgagattta

SEQ ID NO: 554679 - DNA, 13 bp, D. melanogaster
aaattgagatttt

SEQ ID NO: 554680 - DNA, 14 bp, D. melanogaster
aaattgagcaaaat

SEQ ID NO: 554681 - DNA, 13 bp, D. melanogaster
aaattgagcagaa

SEQ ID NO: 554682 - DNA, 13 bp, D. melanogaster
aaattgagggttt

SEQ ID NO: 554683 - DNA, 13 bp, D. melanogaster
aaattgagtgaaa

SEQ ID NO: 554684 - DNA, 14 bp, D. melanogaster
aaattgagtgcaga

SEQ ID NO: 554685 - DNA, 13 bp, D. melanogaster
aaattgagttatt

SEQ ID NO: 554686 - DNA, 13 bp, D. melanogaster
aaattgagtttcg

SEQ ID NO: 554687 - DNA, 13 bp, D. melanogaster
aaattgagtttgt

SEQ ID NO: 554688 - DNA, 13 bp, D. melanogaster
aaattgataaatg

SEQ ID NO: 554689 - DNA, 13 bp, D. melanogaster
aaattgataacaa

SEQ ID NO: 554690 - DNA, 13 bp, D. melanogaster
aaattgataagcc

SEQ ID NO: 554691 - DNA, 13 bp, D. melanogaster
aaattgataatga

SEQ ID NO: 554692 - DNA, 13 bp, D. melanogaster
aaattgatatgca

SEQ ID NO: 554693 - DNA, 13 bp, D. melanogaster
aaattgatattct

SEQ ID NO: 554694 - DNA, 13 bp, D. melanogaster
aaattgatcaaat

SEQ ID NO: 554695 - DNA, 13 bp, D. melanogaster
aaattgatcatta

SEQ ID NO: 554696 - DNA, 13 bp, D. melanogaster
aaattgatgaatt

SEQ ID NO: 554697 - DNA, 13 bp, D. melanogaster
aaattgatggcaa

SEQ ID NO: 554698 - DNA, 13 bp, D. melanogaster
aaattgattagaa

SEQ ID NO: 554699 - DNA, 13 bp, D. melanogaster
aaattgattgaaa

SEQ ID NO: 554700 - DNA, 14 bp, D. melanogaster
aaattgattgaaat

SEQ ID NO: 554701 - DNA, 14 bp, D. melanogaster
aaattgattgaatt

SEQ ID NO: 554702 - DNA, 13 bp, D. melanogaster
aaattgattgatt

SEQ ID NO: 554703 - DNA, 14 bp, D. melanogaster
aaattgattgattt

SEQ ID NO: 554704 - DNA, 13 bp, D. melanogaster
aaattgattgcaa

SEQ ID NO: 554705 - DNA, 14 bp, D. melanogaster
aaattgattgcatt

SEQ ID NO: 554706 - DNA, 13 bp, D. melanogaster
aaattgattgctt

SEQ ID NO: 554707 - DNA, 14 bp, D. melanogaster
aaattgattgcttt

SEQ ID NO: 554708 - DNA, 14 bp, D. melanogaster
aaattgattggaaa

SEQ ID NO: 554709 - DNA, 13 bp, D. melanogaster
aaattgattgtaa

SEQ ID NO: 554710 - DNA, 13 bp, D. melanogaster
aaattgattgttt

SEQ ID NO: 554711 - DNA, 13 bp, D. melanogaster
aaattgatttcaa

SEQ ID NO: 554712 - DNA, 13 bp, D. melanogaster
aaattgatttcag

SEQ ID NO: 554713 - DNA, 13 bp, D. melanogaster
aaattgatttcat

SEQ ID NO: 554714 - DNA, 14 bp, D. melanogaster
aaattgatttcatt

SEQ ID NO: 554715 - DNA, 13 bp, D. melanogaster
aaattgatttgca

SEQ ID NO: 554716 - DNA, 13 bp, D. melanogaster
aaattgattttcc

SEQ ID NO: 554717 - DNA, 14 bp, D. melanogaster
aaattgattttccc

SEQ ID NO: 554718 - DNA, 14 bp, D. melanogaster
aaattgattttgat

SEQ ID NO: 554719 - DNA, 13 bp, D. melanogaster
aaattgattttgc

SEQ ID NO: 554720 - DNA, 14 bp, D. melanogaster
aaattgatttttct

SEQ ID NO: 554721 - DNA, 13 bp, D. melanogaster
aaattgcaaaaac

SEQ ID NO: 554722 - DNA, 13 bp, D. melanogaster
aaattgcaaaaat

SEQ ID NO: 554723 - DNA, 14 bp, D. melanogaster
aaattgcaaaaata

SEQ ID NO: 554724 - DNA, 14 bp, D. melanogaster
aaattgcaaaaatt

SEQ ID NO: 554725 - DNA, 13 bp, D. melanogaster
aaattgcaaaaca

SEQ ID NO: 554726 - DNA, 13 bp, D. melanogaster
aaattgcaaaact

SEQ ID NO: 554727 - DNA, 13 bp, D. melanogaster
aaattgcaaaagt

SEQ ID NO: 554728 - DNA, 13 bp, D. melanogaster
aaattgcaaaatg

SEQ ID NO: 554729 - DNA, 14 bp, D. melanogaster
aaattgcaaacaaa

SEQ ID NO: 554730 - DNA, 13 bp, D. melanogaster
aaattgcaaacga

SEQ ID NO: 554731 - DNA, 14 bp, D. melanogaster
aaattgcaaataaa

SEQ ID NO: 554732 - DNA, 13 bp, D. melanogaster
aaattgcaaattg

SEQ ID NO: 554733 - DNA, 14 bp, D. melanogaster
aaattgcaaattga

SEQ ID NO: 554734 - DNA, 14 bp, D. melanogaster
aaattgcaaattgc

SEQ ID NO: 554735 - DNA, 13 bp, D. melanogaster
aaattgcaacaaa

SEQ ID NO: 554736 - DNA, 14 bp, D. melanogaster
aaattgcaacaaaa

SEQ ID NO: 554737 - DNA, 13 bp, D. melanogaster
aaattgcaactgc

SEQ ID NO: 554738 - DNA, 14 bp, D. melanogaster
aaattgcaactgca

SEQ ID NO: 554739 - DNA, 13 bp, D. melanogaster
aaattgcaagaaa

SEQ ID NO: 554740 - DNA, 13 bp, D. melanogaster
aaattgcaagtga

SEQ ID NO: 554741 - DNA, 13 bp, D. melanogaster
aaattgcaataaa

SEQ ID NO: 554742 - DNA, 14 bp, D. melanogaster
aaattgcaataaaa

SEQ ID NO: 554743 - DNA, 14 bp, D. melanogaster
aaattgcaataaac

SEQ ID NO: 554744 - DNA, 13 bp, D. melanogaster
aaattgcaataat

SEQ ID NO: 554745 - DNA, 13 bp, D. melanogaster
aaattgcaatcaa

SEQ ID NO: 554746 - DNA, 14 bp, D. melanogaster
aaattgcaatcaaa

SEQ ID NO: 554747 - DNA, 13 bp, D. melanogaster
aaattgcaatgca

SEQ ID NO: 554748 - DNA, 13 bp, D. melanogaster
aaattgcaattaa

SEQ ID NO: 554749 - DNA, 14 bp, D. melanogaster
aaattgcaattaat

SEQ ID NO: 554750 - DNA, 13 bp, D. melanogaster
aaattgcaattgc

SEQ ID NO: 554751 - DNA, 14 bp, D. melanogaster
aaattgcaattgca

SEQ ID NO: 554752 - DNA, 13 bp, D. melanogaster
aaattgcaattgt

SEQ ID NO: 554753 - DNA, 13 bp, D. melanogaster
aaattgcaattta

SEQ ID NO: 554754 - DNA, 14 bp, D. melanogaster
aaattgcaatttaa

SEQ ID NO: 554755 - DNA, 14 bp, D. melanogaster
aaattgcaatttat

SEQ ID NO: 554756 - DNA, 14 bp, D. melanogaster
aaattgcaattttc

SEQ ID NO: 554757 - DNA, 13 bp, D. melanogaster
aaattgcacaaaa

SEQ ID NO: 554758 - DNA, 14 bp, D. melanogaster
aaattgcacaaaaa

SEQ ID NO: 554759 - DNA, 13 bp, D. melanogaster
aaattgcacaaat

SEQ ID NO: 554760 - DNA, 13 bp, D. melanogaster
aaattgcacaaga

SEQ ID NO: 554761 - DNA, 13 bp, D. melanogaster
aaattgcacagca

SEQ ID NO: 554762 - DNA, 14 bp, D. melanogaster
aaattgcacataaa

SEQ ID NO: 554763 - DNA, 13 bp, D. melanogaster
aaattgcacattt

SEQ ID NO: 554764 - DNA, 14 bp, D. melanogaster
aaattgcacatttt

SEQ ID NO: 554765 - DNA, 13 bp, D. melanogaster
aaattgcaccaaa

SEQ ID NO: 554766 - DNA, 13 bp, D. melanogaster
aaattgcactaaa

SEQ ID NO: 554767 - DNA, 13 bp, D. melanogaster
aaattgcactgcc

SEQ ID NO: 554768 - DNA, 13 bp, D. melanogaster
aaattgcactttt

SEQ ID NO: 554769 - DNA, 13 bp, D. melanogaster
aaattgcagaaaa

SEQ ID NO: 554770 - DNA, 13 bp, D. melanogaster
aaattgcagcaac

SEQ ID NO: 554771 - DNA, 13 bp, D. melanogaster
aaattgcagcagc

SEQ ID NO: 554772 - DNA, 13 bp, D. melanogaster
aaattgcagcagt

SEQ ID NO: 554773 - DNA, 13 bp, D. melanogaster
aaattgcagccaa

SEQ ID NO: 554774 - DNA, 13 bp, D. melanogaster
aaattgcagccat

SEQ ID NO: 554775 - DNA, 14 bp, D. melanogaster
aaattgcagctgca

SEQ ID NO: 554776 - DNA, 13 bp, D. melanogaster
aaattgcagcttt

SEQ ID NO: 554777 - DNA, 13 bp, D. melanogaster
aaattgcaggaaa

SEQ ID NO: 554778 - DNA, 13 bp, D. melanogaster
aaattgcagggaa

SEQ ID NO: 554779 - DNA, 13 bp, D. melanogaster
aaattgcagtgca

SEQ ID NO: 554780 - DNA, 13 bp, D. melanogaster
aaattgcagttgc

SEQ ID NO: 554781 - DNA, 13 bp, D. melanogaster
aaattgcataaaa

SEQ ID NO: 554782 - DNA, 14 bp, D. melanogaster
aaattgcataaaat

SEQ ID NO: 554783 - DNA, 14 bp, D. melanogaster
aaattgcataaatt

SEQ ID NO: 554784 - DNA, 14 bp, D. melanogaster
aaattgcataattt

SEQ ID NO: 554785 - DNA, 13 bp, D. melanogaster
aaattgcatataa

SEQ ID NO: 554786 - DNA, 13 bp, D. melanogaster
aaattgcatatgt

SEQ ID NO: 554787 - DNA, 14 bp, D. melanogaster
aaattgcatattta

SEQ ID NO: 554788 - DNA, 13 bp, D. melanogaster
aaattgcatgcca

SEQ ID NO: 554789 - DNA, 13 bp, D. melanogaster
aaattgcatgcga

SEQ ID NO: 554790 - DNA, 13 bp, D. melanogaster
aaattgcattaat

SEQ ID NO: 554791 - DNA, 13 bp, D. melanogaster
aaattgcattaca

SEQ ID NO: 554792 - DNA, 13 bp, D. melanogaster
aaattgcattcaa

SEQ ID NO: 554793 - DNA, 14 bp, D. melanogaster
aaattgcattcaat

SEQ ID NO: 554794 - DNA, 13 bp, D. melanogaster
aaattgcattcgc

SEQ ID NO: 554795 - DNA, 14 bp, D. melanogaster
aaattgcattgaaa

SEQ ID NO: 554796 - DNA, 13 bp, D. melanogaster
aaattgcattgca

SEQ ID NO: 554797 - DNA, 14 bp, D. melanogaster
aaattgcattgcat

SEQ ID NO: 554798 - DNA, 13 bp, D. melanogaster
aaattgcatttaa

SEQ ID NO: 554799 - DNA, 14 bp, D. melanogaster
aaattgcatttaaa

SEQ ID NO: 554800 - DNA, 13 bp, D. melanogaster
aaattgcatttac

SEQ ID NO: 554801 - DNA, 13 bp, D. melanogaster
aaattgcatttca

SEQ ID NO: 554802 - DNA, 13 bp, D. melanogaster
aaattgcatttcg

SEQ ID NO: 554803 - DNA, 14 bp, D. melanogaster
aaattgcatttgaa

SEQ ID NO: 554804 - DNA, 13 bp, D. melanogaster
aaattgcatttgc

SEQ ID NO: 554805 - DNA, 14 bp, D. melanogaster
aaattgcatttgcc

SEQ ID NO: 554806 - DNA, 14 bp, D. melanogaster
aaattgcatttggc

SEQ ID NO: 554807 - DNA, 14 bp, D. melanogaster
aaattgcatttgta

SEQ ID NO: 554808 - DNA, 14 bp, D. melanogaster
aaattgcatttgtt

SEQ ID NO: 554809 - DNA, 13 bp, D. melanogaster
aaattgcatttta

SEQ ID NO: 554810 - DNA, 13 bp, D. melanogaster
aaattgcattttc

SEQ ID NO: 554811 - DNA, 13 bp, D. melanogaster
aaattgcattttt

SEQ ID NO: 554812 - DNA, 14 bp, D. melanogaster
aaattgccaaaaaa

SEQ ID NO: 554813 - DNA, 14 bp, D. melanogaster
aaattgccaaaaat

SEQ ID NO: 554814 - DNA, 13 bp, D. melanogaster
aaattgccaaaat

SEQ ID NO: 554815 - DNA, 13 bp, D. melanogaster
aaattgccaaaca

SEQ ID NO: 554816 - DNA, 13 bp, D. melanogaster
aaattgccaaatg

SEQ ID NO: 554817 - DNA, 14 bp, D. melanogaster
aaattgccaacaaa

SEQ ID NO: 554818 - DNA, 13 bp, D. melanogaster
aaattgccaactg

SEQ ID NO: 554819 - DNA, 13 bp, D. melanogaster
aaattgccaagct

SEQ ID NO: 554820 - DNA, 13 bp, D. melanogaster
aaattgccaagtt

SEQ ID NO: 554821 - DNA, 13 bp, D. melanogaster
aaattgccaatgg

SEQ ID NO: 554822 - DNA, 13 bp, D. melanogaster
aaattgccaatta

SEQ ID NO: 554823 - DNA, 13 bp, D. melanogaster
aaattgccaattg

SEQ ID NO: 554824 - DNA, 13 bp, D. melanogaster
aaattgccaattt

SEQ ID NO: 554825 - DNA, 13 bp, D. melanogaster
aaattgccacagc

SEQ ID NO: 554826 - DNA, 13 bp, D. melanogaster
aaattgccagcga

SEQ ID NO: 554827 - DNA, 13 bp, D. melanogaster
aaattgccataaa

SEQ ID NO: 554828 - DNA, 14 bp, D. melanogaster
aaattgccataaaa

SEQ ID NO: 554829 - DNA, 14 bp, D. melanogaster
aaattgccataaat

SEQ ID NO: 554830 - DNA, 13 bp, D. melanogaster
aaattgccatatt

SEQ ID NO: 554831 - DNA, 13 bp, D. melanogaster
aaattgccatcaa

SEQ ID NO: 554832 - DNA, 13 bp, D. melanogaster
aaattgccattaa

SEQ ID NO: 554833 - DNA, 13 bp, D. melanogaster
aaattgccattta

SEQ ID NO: 554834 - DNA, 14 bp, D. melanogaster
aaattgccatttaa

SEQ ID NO: 554835 - DNA, 13 bp, D. melanogaster
aaattgcccaaaa

SEQ ID NO: 554836 - DNA, 13 bp, D. melanogaster
aaattgcccaatt

SEQ ID NO: 554837 - DNA, 13 bp, D. melanogaster
aaattgcctattt

SEQ ID NO: 554838 - DNA, 13 bp, D. melanogaster
aaattgcctgcca

SEQ ID NO: 554839 - DNA, 13 bp, D. melanogaster
aaattgcctggca

SEQ ID NO: 554840 - DNA, 13 bp, D. melanogaster
aaattgcctttaa

SEQ ID NO: 554841 - DNA, 13 bp, D. melanogaster
aaattgccttttg

SEQ ID NO: 554842 - DNA, 13 bp, D. melanogaster
aaattgccttttt

SEQ ID NO: 554843 - DNA, 13 bp, D. melanogaster
aaattgcgaaatt

SEQ ID NO: 554844 - DNA, 13 bp, D. melanogaster
aaattgcgaatta

SEQ ID NO: 554845 - DNA, 13 bp, D. melanogaster
aaattgcgattta

SEQ ID NO: 554846 - DNA, 13 bp, D. melanogaster
aaattgcgcaaaa

SEQ ID NO: 554847 - DNA, 13 bp, D. melanogaster
aaattgcgcaaat

SEQ ID NO: 554848 - DNA, 13 bp, D. melanogaster
aaattgcgccaaa

SEQ ID NO: 554849 - DNA, 13 bp, D. melanogaster
aaattgcggaaaa

SEQ ID NO: 554850 - DNA, 13 bp, D. melanogaster
aaattgcgtaaat

SEQ ID NO: 554851 - DNA, 13 bp, D. melanogaster
aaattgcgttgca

SEQ ID NO: 554852 - DNA, 13 bp, D. melanogaster
aaattgcgttttt

SEQ ID NO: 554853 - DNA, 13 bp, D. melanogaster
aaattgctaataa

SEQ ID NO: 554854 - DNA, 13 bp, D. melanogaster
aaattgctaattg

SEQ ID NO: 554855 - DNA, 13 bp, D. melanogaster
aaattgctcaaat

SEQ ID NO: 554856 - DNA, 13 bp, D. melanogaster
aaattgctcaatt

SEQ ID NO: 554857 - DNA, 13 bp, D. melanogaster
aaattgctcattt

SEQ ID NO: 554858 - DNA, 13 bp, D. melanogaster
aaattgctgaaaa

SEQ ID NO: 554859 - DNA, 14 bp, D. melanogaster
aaattgctgaaaaa

SEQ ID NO: 554860 - DNA, 13 bp, D. melanogaster
aaattgctgaata

SEQ ID NO: 554861 - DNA, 13 bp, D. melanogaster
aaattgctgacca

SEQ ID NO: 554862 - DNA, 13 bp, D. melanogaster
aaattgctgcaaa

SEQ ID NO: 554863 - DNA, 14 bp, D. melanogaster
aaattgctgcaaat

SEQ ID NO: 554864 - DNA, 13 bp, D. melanogaster
aaattgctgcaca

SEQ ID NO: 554865 - DNA, 13 bp, D. melanogaster
aaattgctggaaa

SEQ ID NO: 554866 - DNA, 14 bp, D. melanogaster
aaattgctggaaaa

SEQ ID NO: 554867 - DNA, 13 bp, D. melanogaster
aaattgctggcaa

SEQ ID NO: 554868 - DNA, 13 bp, D. melanogaster
aaattgctggcca

SEQ ID NO: 554869 - DNA, 13 bp, D. melanogaster
aaattgctggcga

SEQ ID NO: 554870 - DNA, 13 bp, D. melanogaster
aaattgctgtaaa

SEQ ID NO: 554871 - DNA, 13 bp, D. melanogaster
aaattgctgtcaa

SEQ ID NO: 554872 - DNA, 13 bp, D. melanogaster
aaattgcttaaaa

SEQ ID NO: 554873 - DNA, 13 bp, D. melanogaster
aaattgcttaaat

SEQ ID NO: 554874 - DNA, 13 bp, D. melanogaster
aaattgcttaatt

SEQ ID NO: 554875 - DNA, 14 bp, D. melanogaster
aaattgcttaattt

SEQ ID NO: 554876 - DNA, 13 bp, D. melanogaster
aaattgcttgaaa

SEQ ID NO: 554877 - DNA, 13 bp, D. melanogaster
aaattgcttgatt

SEQ ID NO: 554878 - DNA, 13 bp, D. melanogaster
aaattgctttaca

SEQ ID NO: 554879 - DNA, 14 bp, D. melanogaster
aaattgctttattt

SEQ ID NO: 554880 - DNA, 13 bp, D. melanogaster
aaattgctttgca

SEQ ID NO: 554881 - DNA, 13 bp, D. melanogaster
aaattgctttgct

SEQ ID NO: 554882 - DNA, 13 bp, D. melanogaster
aaattgctttggc

SEQ ID NO: 554883 - DNA, 13 bp, D. melanogaster
aaattgctttgtt

SEQ ID NO: 554884 - DNA, 13 bp, D. melanogaster
aaattgcttttaa

SEQ ID NO: 554885 - DNA, 13 bp, D. melanogaster
aaattgcttttat

SEQ ID NO: 554886 - DNA, 13 bp, D. melanogaster
aaattgcttttct

SEQ ID NO: 554887 - DNA, 13 bp, D. melanogaster
aaattgcttttga

SEQ ID NO: 554888 - DNA, 14 bp, D. melanogaster
aaattgcttttgtt

SEQ ID NO: 554889 - DNA, 13 bp, D. melanogaster
aaattgcttttta

SEQ ID NO: 554890 - DNA, 14 bp, D. melanogaster
aaattggaaaacaa

SEQ ID NO: 554891 - DNA, 13 bp, D. melanogaster
aaattggaaaagc

SEQ ID NO: 554892 - DNA, 13 bp, D. melanogaster
aaattggaaaagg

SEQ ID NO: 554893 - DNA, 13 bp, D. melanogaster
aaattggaaaagt

SEQ ID NO: 554894 - DNA, 13 bp, D. melanogaster
aaattggaaaatt

SEQ ID NO: 554895 - DNA, 14 bp, D. melanogaster
aaattggaaaattg

SEQ ID NO: 554896 - DNA, 14 bp, D. melanogaster
aaattggaaaattt

SEQ ID NO: 554897 - DNA, 13 bp, D. melanogaster
aaattggaaagtt

SEQ ID NO: 554898 - DNA, 13 bp, D. melanogaster
aaattggaaatta

SEQ ID NO: 554899 - DNA, 13 bp, D. melanogaster
aaattggaaattc

SEQ ID NO: 554900 - DNA, 13 bp, D. melanogaster
aaattggaattga

SEQ ID NO: 554901 - DNA, 13 bp, D. melanogaster
aaattggaattgg

SEQ ID NO: 554902 - DNA, 13 bp, D. melanogaster
aaattggacaaaa

SEQ ID NO: 554903 - DNA, 13 bp, D. melanogaster
aaattggagcaaa

SEQ ID NO: 554904 - DNA, 13 bp, D. melanogaster
aaattggataatt

SEQ ID NO: 554905 - DNA, 13 bp, D. melanogaster
aaattggattaaa

SEQ ID NO: 554906 - DNA, 13 bp, D. melanogaster
aaattggattgga

SEQ ID NO: 554907 - DNA, 13 bp, D. melanogaster
aaattggatttaa

SEQ ID NO: 554908 - DNA, 13 bp, D. melanogaster
aaattggatttat

SEQ ID NO: 554909 - DNA, 13 bp, D. melanogaster
aaattggatttca

SEQ ID NO: 554910 - DNA, 13 bp, D. melanogaster
aaattggatttga

SEQ ID NO: 554911 - DNA, 13 bp, D. melanogaster
aaattggattttt

SEQ ID NO: 554912 - DNA, 13 bp, D. melanogaster
aaattggcaaaaa

SEQ ID NO: 554913 - DNA, 14 bp, D. melanogaster
aaattggcaaaaaa

SEQ ID NO: 554914 - DNA, 14 bp, D. melanogaster
aaattggcaaaaac

SEQ ID NO: 554915 - DNA, 14 bp, D. melanogaster
aaattggcaaaaat

SEQ ID NO: 554916 - DNA, 13 bp, D. melanogaster
aaattggcaaaag

SEQ ID NO: 554917 - DNA, 14 bp, D. melanogaster
aaattggcaaacaa

SEQ ID NO: 554918 - DNA, 13 bp, D. melanogaster
aaattggcaaata

SEQ ID NO: 554919 - DNA, 13 bp, D. melanogaster
aaattggcaaatt

SEQ ID NO: 554920 - DNA, 13 bp, D. melanogaster
aaattggcaacaa

SEQ ID NO: 554921 - DNA, 13 bp, D. melanogaster
aaattggcaacac

SEQ ID NO: 554922 - DNA, 13 bp, D. melanogaster
aaattggcaatca

SEQ ID NO: 554923 - DNA, 13 bp, D. melanogaster
aaattggcacaaa

SEQ ID NO: 554924 - DNA, 13 bp, D. melanogaster
aaattggcataat

SEQ ID NO: 554925 - DNA, 13 bp, D. melanogaster
aaattggcatttg

SEQ ID NO: 554926 - DNA, 13 bp, D. melanogaster
aaattggccaaaa

SEQ ID NO: 554927 - DNA, 14 bp, D. melanogaster
aaattggccaaaac

SEQ ID NO: 554928 - DNA, 13 bp, D. melanogaster
aaattggccaaag

SEQ ID NO: 554929 - DNA, 13 bp, D. melanogaster
aaattggccaaat

SEQ ID NO: 554930 - DNA, 13 bp, D. melanogaster
aaattggccaaca

SEQ ID NO: 554931 - DNA, 13 bp, D. melanogaster
aaattggccaact

SEQ ID NO: 554932 - DNA, 13 bp, D. melanogaster
aaattggccaagt

SEQ ID NO: 554933 - DNA, 13 bp, D. melanogaster
aaattggccagaa

SEQ ID NO: 554934 - DNA, 13 bp, D. melanogaster
aaattggcccaaa

SEQ ID NO: 554935 - DNA, 13 bp, D. melanogaster
aaattggcgcaaa

SEQ ID NO: 554936 - DNA, 13 bp, D. melanogaster
aaattggctaatt

SEQ ID NO: 554937 - DNA, 13 bp, D. melanogaster
aaattggctacaa

SEQ ID NO: 554938 - DNA, 13 bp, D. melanogaster
aaattggctggca

SEQ ID NO: 554939 - DNA, 13 bp, D. melanogaster
aaattggcttaaa

SEQ ID NO: 554940 - DNA, 14 bp, D. melanogaster
aaattggcttaaaa

SEQ ID NO: 554941 - DNA, 13 bp, D. melanogaster
aaattggctttat

SEQ ID NO: 554942 - DNA, 13 bp, D. melanogaster
aaattgggaattt

SEQ ID NO: 554943 - DNA, 13 bp, D. melanogaster
aaattgggctttg

SEQ ID NO: 554944 - DNA, 13 bp, D. melanogaster
aaattggggaaaa

SEQ ID NO: 554945 - DNA, 13 bp, D. melanogaster
aaattgggggaaa

SEQ ID NO: 554946 - DNA, 13 bp, D. melanogaster
aaattgggtaaat

SEQ ID NO: 554947 - DNA, 13 bp, D. melanogaster
aaattgggtcaaa

SEQ ID NO: 554948 - DNA, 13 bp, D. melanogaster
aaattgggttaaa

SEQ ID NO: 554949 - DNA, 13 bp, D. melanogaster
aaattgggtttac

SEQ ID NO: 554950 - DNA, 13 bp, D. melanogaster
aaattgggtttgc

SEQ ID NO: 554951 - DNA, 13 bp, D. melanogaster
aaattggtaaatt

SEQ ID NO: 554952 - DNA, 13 bp, D. melanogaster
aaattggtaatta

SEQ ID NO: 554953 - DNA, 13 bp, D. melanogaster
aaattggtatatt

SEQ ID NO: 554954 - DNA, 13 bp, D. melanogaster
aaattggtattaa

SEQ ID NO: 554955 - DNA, 13 bp, D. melanogaster
aaattggtattta

SEQ ID NO: 554956 - DNA, 13 bp, D. melanogaster
aaattggtcaaaa

SEQ ID NO: 554957 - DNA, 13 bp, D. melanogaster
aaattggtgaaat

SEQ ID NO: 554958 - DNA, 13 bp, D. melanogaster
aaattggttaaaa

SEQ ID NO: 554959 - DNA, 13 bp, D. melanogaster
aaattggttaata

SEQ ID NO: 554960 - DNA, 13 bp, D. melanogaster
aaattggttaatt

SEQ ID NO: 554961 - DNA, 13 bp, D. melanogaster
aaattggttataa

SEQ ID NO: 554962 - DNA, 13 bp, D. melanogaster
aaattggttattt

SEQ ID NO: 554963 - DNA, 13 bp, D. melanogaster
aaattggttcaat

SEQ ID NO: 554964 - DNA, 14 bp, D. melanogaster
aaattggtttaaaa

SEQ ID NO: 554965 - DNA, 13 bp, D. melanogaster
aaattggtttatt

SEQ ID NO: 554966 - DNA, 13 bp, D. melanogaster
aaattggtttcat

SEQ ID NO: 554967 - DNA, 13 bp, D. melanogaster
aaattggtttcca

SEQ ID NO: 554968 - DNA, 14 bp, D. melanogaster
aaattggttttaaa

SEQ ID NO: 554969 - DNA, 13 bp, D. melanogaster
aaattggttttct

SEQ ID NO: 554970 - DNA, 14 bp, D. melanogaster
aaattggtttttaa

SEQ ID NO: 554971 - DNA, 13 bp, D. melanogaster
aaattgtaaacaa

SEQ ID NO: 554972 - DNA, 14 bp, D. melanogaster
aaattgtaaacaaa

SEQ ID NO: 554973 - DNA, 13 bp, D. melanogaster
aaattgtaaagca

SEQ ID NO: 554974 - DNA, 13 bp, D. melanogaster
aaattgtaaattg

SEQ ID NO: 554975 - DNA, 14 bp, D. melanogaster
aaattgtaaattgt

SEQ ID NO: 554976 - DNA, 13 bp, D. melanogaster
aaattgtaacatt

SEQ ID NO: 554977 - DNA, 13 bp, D. melanogaster
aaattgtaatgat

SEQ ID NO: 554978 - DNA, 13 bp, D. melanogaster
aaattgtaattgt

SEQ ID NO: 554979 - DNA, 13 bp, D. melanogaster
aaattgtaatttc

SEQ ID NO: 554980 - DNA, 13 bp, D. melanogaster
aaattgtacaaaa

SEQ ID NO: 554981 - DNA, 13 bp, D. melanogaster
aaattgtacaaat

SEQ ID NO: 554982 - DNA, 14 bp, D. melanogaster
aaattgtacaaatt

SEQ ID NO: 554983 - DNA, 13 bp, D. melanogaster
aaattgtacaatt

SEQ ID NO: 554984 - DNA, 14 bp, D. melanogaster
aaattgtacaattt

SEQ ID NO: 554985 - DNA, 13 bp, D. melanogaster
aaattgtacattt

SEQ ID NO: 554986 - DNA, 14 bp, D. melanogaster
aaattgtacatttt

SEQ ID NO: 554987 - DNA, 13 bp, D. melanogaster
aaattgtagaagt

SEQ ID NO: 554988 - DNA, 13 bp, D. melanogaster
aaattgtagcaaa

SEQ ID NO: 554989 - DNA, 13 bp, D. melanogaster
aaattgtataaac

SEQ ID NO: 554990 - DNA, 14 bp, D. melanogaster
aaattgtataaaca

SEQ ID NO: 554991 - DNA, 13 bp, D. melanogaster
aaattgtatatga

SEQ ID NO: 554992 - DNA, 13 bp, D. melanogaster
aaattgtatattg

SEQ ID NO: 554993 - DNA, 13 bp, D. melanogaster
aaattgtatcaaa

SEQ ID NO: 554994 - DNA, 13 bp, D. melanogaster
aaattgtatcatt

SEQ ID NO: 554995 - DNA, 13 bp, D. melanogaster
aaattgtatctat

SEQ ID NO: 554996 - DNA, 13 bp, D. melanogaster
aaattgtatcttt

SEQ ID NO: 554997 - DNA, 13 bp, D. melanogaster
aaattgtatgatt

SEQ ID NO: 554998 - DNA, 13 bp, D. melanogaster
aaattgtatgcaa

SEQ ID NO: 554999 - DNA, 13 bp, D. melanogaster
aaattgtatggaa

SEQ ID NO: 555000 - DNA, 13 bp, D. melanogaster
aaattgtattcat

SEQ ID NO: 555001 - DNA, 13 bp, D. melanogaster
aaattgtattcta

SEQ ID NO: 555002 - DNA, 13 bp, D. melanogaster
aaattgtattgta

SEQ ID NO: 555003 - DNA, 14 bp, D. melanogaster
aaattgtatttaca

SEQ ID NO: 555004 - DNA, 13 bp, D. melanogaster
aaattgtatttca

SEQ ID NO: 555005 - DNA, 13 bp, D. melanogaster
aaattgtatttgt

SEQ ID NO: 555006 - DNA, 13 bp, D. melanogaster
aaattgtcaaaaa

SEQ ID NO: 555007 - DNA, 13 bp, D. melanogaster
aaattgtcaaatt

SEQ ID NO: 555008 - DNA, 13 bp, D. melanogaster
aaattgtcaagtg

SEQ ID NO: 555009 - DNA, 13 bp, D. melanogaster
aaattgtcaataa

SEQ ID NO: 555010 - DNA, 13 bp, D. melanogaster
aaattgtcaatat

SEQ ID NO: 555011 - DNA, 13 bp, D. melanogaster
aaattgtcaatta

SEQ ID NO: 555012 - DNA, 13 bp, D. melanogaster
aaattgtcaattc

SEQ ID NO: 555013 - DNA, 13 bp, D. melanogaster
aaattgtcaattg

SEQ ID NO: 555014 - DNA, 13 bp, D. melanogaster
aaattgtcacagc

SEQ ID NO: 555015 - DNA, 13 bp, D. melanogaster
aaattgtcacttt

SEQ ID NO: 555016 - DNA, 14 bp, D. melanogaster
aaattgtcagcttg

SEQ ID NO: 555017 - DNA, 13 bp, D. melanogaster
aaattgtcataaa

SEQ ID NO: 555018 - DNA, 14 bp, D. melanogaster
aaattgtcataaat

SEQ ID NO: 555019 - DNA, 13 bp, D. melanogaster
aaattgtcatttg

SEQ ID NO: 555020 - DNA, 13 bp, D. melanogaster
aaattgtccaaat

SEQ ID NO: 555021 - DNA, 13 bp, D. melanogaster
aaattgtcggcta

SEQ ID NO: 555022 - DNA, 13 bp, D. melanogaster
aaattgtcgtcct

SEQ ID NO: 555023 - DNA, 13 bp, D. melanogaster
aaattgtctattt

SEQ ID NO: 555024 - DNA, 13 bp, D. melanogaster
aaattgtcttatt

SEQ ID NO: 555025 - DNA, 13 bp, D. melanogaster
aaattgtcttcaa

SEQ ID NO: 555026 - DNA, 14 bp, D. melanogaster
aaattgtgaaaaac

SEQ ID NO: 555027 - DNA, 14 bp, D. melanogaster
aaattgtgaaaaag

SEQ ID NO: 555028 - DNA, 13 bp, D. melanogaster
aaattgtgaaaac

SEQ ID NO: 555029 - DNA, 13 bp, D. melanogaster
aaattgtgaaata

SEQ ID NO: 555030 - DNA, 14 bp, D. melanogaster
aaattgtgaaatag

SEQ ID NO: 555031 - DNA, 14 bp, D. melanogaster
aaattgtgaaatat

SEQ ID NO: 555032 - DNA, 13 bp, D. melanogaster
aaattgtgaaatt

SEQ ID NO: 555033 - DNA, 14 bp, D. melanogaster
aaattgtgaaattt

SEQ ID NO: 555034 - DNA, 13 bp, D. melanogaster
aaattgtgacaaa

SEQ ID NO: 555035 - DNA, 13 bp, D. melanogaster
aaattgtgacgga

SEQ ID NO: 555036 - DNA, 13 bp, D. melanogaster
aaattgtgataaa

SEQ ID NO: 555037 - DNA, 13 bp, D. melanogaster
aaattgtgattta

SEQ ID NO: 555038 - DNA, 13 bp, D. melanogaster
aaattgtgatttt

SEQ ID NO: 555039 - DNA, 13 bp, D. melanogaster
aaattgtgcaaaa

SEQ ID NO: 555040 - DNA, 14 bp, D. melanogaster
aaattgtgcaaaaa

SEQ ID NO: 555041 - DNA, 14 bp, D. melanogaster
aaattgtgcaaaat

SEQ ID NO: 555042 - DNA, 13 bp, D. melanogaster
aaattgtgcaact

SEQ ID NO: 555043 - DNA, 13 bp, D. melanogaster
aaattgtgcaatt

SEQ ID NO: 555044 - DNA, 13 bp, D. melanogaster
aaattgtgcattt

SEQ ID NO: 555045 - DNA, 13 bp, D. melanogaster
aaattgtgccaac

SEQ ID NO: 555046 - DNA, 14 bp, D. melanogaster
aaattgtgccaact

SEQ ID NO: 555047 - DNA, 13 bp, D. melanogaster
aaattgtgcgaaa

SEQ ID NO: 555048 - DNA, 13 bp, D. melanogaster
aaattgtgctaaa

SEQ ID NO: 555049 - DNA, 13 bp, D. melanogaster
aaattgtggaaat

SEQ ID NO: 555050 - DNA, 13 bp, D. melanogaster
aaattgtggaatt

SEQ ID NO: 555051 - DNA, 13 bp, D. melanogaster
aaattgtggcaca

SEQ ID NO: 555052 - DNA, 13 bp, D. melanogaster
aaattgtgggcaa

SEQ ID NO: 555053 - DNA, 13 bp, D. melanogaster
aaattgtgtaaat

SEQ ID NO: 555054 - DNA, 14 bp, D. melanogaster
aaattgtgtaaata

SEQ ID NO: 555055 - DNA, 13 bp, D. melanogaster
aaattgtgtattt

SEQ ID NO: 555056 - DNA, 13 bp, D. melanogaster
aaattgtgtgaaa

SEQ ID NO: 555057 - DNA, 13 bp, D. melanogaster
aaattgtgtgatt

SEQ ID NO: 555058 - DNA, 13 bp, D. melanogaster
aaattgtgtgcat

SEQ ID NO: 555059 - DNA, 13 bp, D. melanogaster
aaattgtgtgtaa

SEQ ID NO: 555060 - DNA, 14 bp, D. melanogaster
aaattgtgtgtaaa

SEQ ID NO: 555061 - DNA, 13 bp, D. melanogaster
aaattgtgttctt

SEQ ID NO: 555062 - DNA, 13 bp, D. melanogaster
aaattgtgttgtt

SEQ ID NO: 555063 - DNA, 13 bp, D. melanogaster
aaattgtgtttgc

SEQ ID NO: 555064 - DNA, 13 bp, D. melanogaster
aaattgtgtttta

SEQ ID NO: 555065 - DNA, 13 bp, D. melanogaster
aaattgtgttttc

SEQ ID NO: 555066 - DNA, 13 bp, D. melanogaster
aaattgttaaaga

SEQ ID NO: 555067 - DNA, 13 bp, D. melanogaster
aaattgttaaagc

SEQ ID NO: 555068 - DNA, 14 bp, D. melanogaster
aaattgttaaattg

SEQ ID NO: 555069 - DNA, 13 bp, D. melanogaster
aaattgttaacaa

SEQ ID NO: 555070 - DNA, 13 bp, D. melanogaster
aaattgttaatac

SEQ ID NO: 555071 - DNA, 14 bp, D. melanogaster
aaattgttaatacc

SEQ ID NO: 555072 - DNA, 13 bp, D. melanogaster
aaattgttacaaa

SEQ ID NO: 555073 - DNA, 13 bp, D. melanogaster
aaattgttagatt

SEQ ID NO: 555074 - DNA, 13 bp, D. melanogaster
aaattgttagtta

SEQ ID NO: 555075 - DNA, 13 bp, D. melanogaster
aaattgttattca

SEQ ID NO: 555076 - DNA, 13 bp, D. melanogaster
aaattgttcaaaa

SEQ ID NO: 555077 - DNA, 14 bp, D. melanogaster
aaattgttcaaaaa

SEQ ID NO: 555078 - DNA, 13 bp, D. melanogaster
aaattgttcaagt

SEQ ID NO: 555079 - DNA, 13 bp, D. melanogaster
aaattgttcaatt

SEQ ID NO: 555080 - DNA, 13 bp, D. melanogaster
aaattgttcaggc

SEQ ID NO: 555081 - DNA, 13 bp, D. melanogaster
aaattgttcgatt

SEQ ID NO: 555082 - DNA, 13 bp, D. melanogaster
aaattgttgaaag

SEQ ID NO: 555083 - DNA, 13 bp, D. melanogaster
aaattgttgaaat

SEQ ID NO: 555084 - DNA, 14 bp, D. melanogaster
aaattgttgaaatt

SEQ ID NO: 555085 - DNA, 13 bp, D. melanogaster
aaattgttgaatt

SEQ ID NO: 555086 - DNA, 13 bp, D. melanogaster
aaattgttgactt

SEQ ID NO: 555087 - DNA, 13 bp, D. melanogaster
aaattgttgataa

SEQ ID NO: 555088 - DNA, 13 bp, D. melanogaster
aaattgttgatat

SEQ ID NO: 555089 - DNA, 13 bp, D. melanogaster
aaattgttgattt

SEQ ID NO: 555090 - DNA, 13 bp, D. melanogaster
aaattgttgcaaa

SEQ ID NO: 555091 - DNA, 14 bp, D. melanogaster
aaattgttgcaaat

SEQ ID NO: 555092 - DNA, 13 bp, D. melanogaster
aaattgttgcaca

SEQ ID NO: 555093 - DNA, 13 bp, D. melanogaster
aaattgttgcatg

SEQ ID NO: 555094 - DNA, 13 bp, D. melanogaster
aaattgttgcatt

SEQ ID NO: 555095 - DNA, 13 bp, D. melanogaster
aaattgttgccaa

SEQ ID NO: 555096 - DNA, 14 bp, D. melanogaster
aaattgttgccaaa

SEQ ID NO: 555097 - DNA, 13 bp, D. melanogaster
aaattgttgccat

SEQ ID NO: 555098 - DNA, 13 bp, D. melanogaster
aaattgttgcctt

SEQ ID NO: 555099 - DNA, 13 bp, D. melanogaster
aaattgttgctaa

SEQ ID NO: 555100 - DNA, 13 bp, D. melanogaster
aaattgttggaaa

SEQ ID NO: 555101 - DNA, 14 bp, D. melanogaster
aaattgttggaaaa

SEQ ID NO: 555102 - DNA, 13 bp, D. melanogaster
aaattgttggcaa

SEQ ID NO: 555103 - DNA, 14 bp, D. melanogaster
aaattgttggccaa

SEQ ID NO: 555104 - DNA, 13 bp, D. melanogaster
aaattgttggttt

SEQ ID NO: 555105 - DNA, 14 bp, D. melanogaster
aaattgttgtaaat

SEQ ID NO: 555106 - DNA, 13 bp, D. melanogaster
aaattgttgtaca

SEQ ID NO: 555107 - DNA, 13 bp, D. melanogaster
aaattgttgtagc

SEQ ID NO: 555108 - DNA, 13 bp, D. melanogaster
aaattgttgtata

SEQ ID NO: 555109 - DNA, 13 bp, D. melanogaster
aaattgttgtcaa

SEQ ID NO: 555110 - DNA, 13 bp, D. melanogaster
aaattgttgtgtt

SEQ ID NO: 555111 - DNA, 13 bp, D. melanogaster
aaattgttgttat

SEQ ID NO: 555112 - DNA, 14 bp, D. melanogaster
aaattgttgttgtt

SEQ ID NO: 555113 - DNA, 13 bp, D. melanogaster
aaattgtttaaac

SEQ ID NO: 555114 - DNA, 14 bp, D. melanogaster
aaattgtttaaaca

SEQ ID NO: 555115 - DNA, 13 bp, D. melanogaster
aaattgtttaaga

SEQ ID NO: 555116 - DNA, 14 bp, D. melanogaster
aaattgtttaattg

SEQ ID NO: 555117 - DNA, 13 bp, D. melanogaster
aaattgtttacaa

SEQ ID NO: 555118 - DNA, 13 bp, D. melanogaster
aaattgtttacac

SEQ ID NO: 555119 - DNA, 13 bp, D. melanogaster
aaattgtttacat

SEQ ID NO: 555120 - DNA, 13 bp, D. melanogaster
aaattgtttacca

SEQ ID NO: 555121 - DNA, 14 bp, D. melanogaster
aaattgtttacttt

SEQ ID NO: 555122 - DNA, 13 bp, D. melanogaster
aaattgtttagtt

SEQ ID NO: 555123 - DNA, 13 bp, D. melanogaster
aaattgtttatga

SEQ ID NO: 555124 - DNA, 14 bp, D. melanogaster
aaattgtttatgat

SEQ ID NO: 555125 - DNA, 13 bp, D. melanogaster
aaattgtttatgt

SEQ ID NO: 555126 - DNA, 13 bp, D. melanogaster
aaattgtttccat

SEQ ID NO: 555127 - DNA, 13 bp, D. melanogaster
aaattgtttcgct

SEQ ID NO: 555128 - DNA, 13 bp, D. melanogaster
aaattgtttctgc

SEQ ID NO: 555129 - DNA, 13 bp, D. melanogaster
aaattgtttcttg

SEQ ID NO: 555130 - DNA, 13 bp, D. melanogaster
aaattgtttcttt

SEQ ID NO: 555131 - DNA, 13 bp, D. melanogaster
aaattgtttgaaa

SEQ ID NO: 555132 - DNA, 14 bp, D. melanogaster
aaattgtttgaaaa

SEQ ID NO: 555133 - DNA, 13 bp, D. melanogaster
aaattgtttgaag

SEQ ID NO: 555134 - DNA, 14 bp, D. melanogaster
aaattgtttgatat

SEQ ID NO: 555135 - DNA, 14 bp, D. melanogaster
aaattgtttgcaca

SEQ ID NO: 555136 - DNA, 13 bp, D. melanogaster
aaattgtttgcca

SEQ ID NO: 555137 - DNA, 13 bp, D. melanogaster
aaattgtttgctc

SEQ ID NO: 555138 - DNA, 13 bp, D. melanogaster
aaattgtttgctt

SEQ ID NO: 555139 - DNA, 13 bp, D. melanogaster
aaattgtttggat

SEQ ID NO: 555140 - DNA, 13 bp, D. melanogaster
aaattgtttggca

SEQ ID NO: 555141 - DNA, 13 bp, D. melanogaster
aaattgtttgtaa

SEQ ID NO: 555142 - DNA, 14 bp, D. melanogaster
aaattgtttgtttg

SEQ ID NO: 555143 - DNA, 13 bp, D. melanogaster
aaattgttttcaa

SEQ ID NO: 555144 - DNA, 13 bp, D. melanogaster
aaattgttttcca

SEQ ID NO: 555145 - DNA, 14 bp, D. melanogaster
aaattgttttccaa

SEQ ID NO: 555146 - DNA, 13 bp, D. melanogaster
aaattgttttccc

SEQ ID NO: 555147 - DNA, 13 bp, D. melanogaster
aaattgttttcct

SEQ ID NO: 555148 - DNA, 13 bp, D. melanogaster
aaattgttttctt

SEQ ID NO: 555149 - DNA, 13 bp, D. melanogaster
aaattgttttgct

SEQ ID NO: 555150 - DNA, 13 bp, D. melanogaster
aaattgtttttca

SEQ ID NO: 555151 - DNA, 14 bp, D. melanogaster
aaattgtttttcaa

SEQ ID NO: 555152 - DNA, 14 bp, D. melanogaster
aaattgtttttcat

SEQ ID NO: 555153 - DNA, 14 bp, D. melanogaster
aaattgtttttctt

SEQ ID NO: 555154 - DNA, 13 bp, D. melanogaster
aaattgtttttgg

SEQ ID NO: 555155 - DNA, 13 bp, D. melanogaster
aaatttaaaaagc

SEQ ID NO: 555156 - DNA, 14 bp, D. melanogaster
aaatttaaaaagct

SEQ ID NO: 555157 - DNA, 13 bp, D. melanogaster
aaatttaaaaccg

SEQ ID NO: 555158 - DNA, 14 bp, D. melanogaster
aaatttaaacgaaa

SEQ ID NO: 555159 - DNA, 13 bp, D. melanogaster
aaatttaaacgat

SEQ ID NO: 555160 - DNA, 13 bp, D. melanogaster
aaatttaaagcaa

SEQ ID NO: 555161 - DNA, 13 bp, D. melanogaster
aaatttaaagcat

SEQ ID NO: 555162 - DNA, 13 bp, D. melanogaster
aaatttaaagcgt

SEQ ID NO: 555163 - DNA, 13 bp, D. melanogaster
aaatttaaagtgt

SEQ ID NO: 555164 - DNA, 13 bp, D. melanogaster
aaatttaaatcac

SEQ ID NO: 555165 - DNA, 13 bp, D. melanogaster
aaatttaaatcga

SEQ ID NO: 555166 - DNA, 13 bp, D. melanogaster
aaatttaaatgct

SEQ ID NO: 555167 - DNA, 14 bp, D. melanogaster
aaatttaaatggca

SEQ ID NO: 555168 - DNA, 14 bp, D. melanogaster
aaatttaaattgca

SEQ ID NO: 555169 - DNA, 13 bp, D. melanogaster
aaatttaacaagt

SEQ ID NO: 555170 - DNA, 13 bp, D. melanogaster
aaatttaagaagt

SEQ ID NO: 555171 - DNA, 13 bp, D. melanogaster
aaatttaagcaaa

SEQ ID NO: 555172 - DNA, 14 bp, D. melanogaster
aaatttaagcaaaa

SEQ ID NO: 555173 - DNA, 13 bp, D. melanogaster
aaatttaagcact

SEQ ID NO: 555174 - DNA, 13 bp, D. melanogaster
aaatttaagcatt

SEQ ID NO: 555175 - DNA, 13 bp, D. melanogaster
aaatttaagccat

SEQ ID NO: 555176 - DNA, 14 bp, D. melanogaster
aaatttaagcttaa

SEQ ID NO: 555177 - DNA, 13 bp, D. melanogaster
aaatttaagtggc

SEQ ID NO: 555178 - DNA, 13 bp, D. melanogaster
aaatttaagtttg

SEQ ID NO: 555179 - DNA, 13 bp, D. melanogaster
aaatttaatcaag

SEQ ID NO: 555180 - DNA, 13 bp, D. melanogaster
aaatttaatgagc

SEQ ID NO: 555181 - DNA, 13 bp, D. melanogaster
aaatttaatgcgc

SEQ ID NO: 555182 - DNA, 13 bp, D. melanogaster
aaatttaattacg

SEQ ID NO: 555183 - DNA, 14 bp, D. melanogaster
aaatttaattacga

SEQ ID NO: 555184 - DNA, 13 bp, D. melanogaster
aaatttaattggg

SEQ ID NO: 555185 - DNA, 13 bp, D. melanogaster
aaatttaatttcc

SEQ ID NO: 555186 - DNA, 14 bp, D. melanogaster
aaatttaatttcca

SEQ ID NO: 555187 - DNA, 13 bp, D. melanogaster
aaatttaatttgc

SEQ ID NO: 555188 - DNA, 13 bp, D. melanogaster
aaatttacaaatg

SEQ ID NO: 555189 - DNA, 16 bp, D. melanogaster
aaatttacaatgcatg

SEQ ID NO: 555190 - DNA, 13 bp, D. melanogaster
aaatttacataca

SEQ ID NO: 555191 - DNA, 13 bp, D. melanogaster
aaatttacatttc

SEQ ID NO: 555192 - DNA, 14 bp, D. melanogaster
aaatttacatttca

SEQ ID NO: 555193 - DNA, 14 bp, D. melanogaster
aaatttacccaaaa

SEQ ID NO: 555194 - DNA, 13 bp, D. melanogaster
aaatttacgattt

SEQ ID NO: 555195 - DNA, 13 bp, D. melanogaster
aaatttacttttg

SEQ ID NO: 555196 - DNA, 13 bp, D. melanogaster
aaatttagcaaaa

SEQ ID NO: 555197 - DNA, 13 bp, D. melanogaster
aaatttagcaatt

SEQ ID NO: 555198 - DNA, 13 bp, D. melanogaster
aaatttagcttaa

SEQ ID NO: 555199 - DNA, 13 bp, D. melanogaster
aaatttaggaatt

SEQ ID NO: 555200 - DNA, 13 bp, D. melanogaster
aaatttagtttgg

SEQ ID NO: 555201 - DNA, 13 bp, D. melanogaster
aaatttagttttc

SEQ ID NO: 555202 - DNA, 13 bp, D. melanogaster
aaatttatagcca

SEQ ID NO: 555203 - DNA, 13 bp, D. melanogaster
aaatttatatcga

SEQ ID NO: 555204 - DNA, 14 bp, D. melanogaster
aaatttatcagaga

SEQ ID NO: 555205 - DNA, 13 bp, D. melanogaster
aaatttatcgata

SEQ ID NO: 555206 - DNA, 13 bp, D. melanogaster
aaatttatcgatt

SEQ ID NO: 555207 - DNA, 13 bp, D. melanogaster
aaatttatcgcac

SEQ ID NO: 555208 - DNA, 13 bp, D. melanogaster
aaatttatcgttg

SEQ ID NO: 555209 - DNA, 13 bp, D. melanogaster
aaatttatgagaa

SEQ ID NO: 555210 - DNA, 13 bp, D. melanogaster
aaatttatgcatg

SEQ ID NO: 555211 - DNA, 14 bp, D. melanogaster
aaatttatgcgaaa

SEQ ID NO: 555212 - DNA, 13 bp, D. melanogaster
aaatttatgcgca

SEQ ID NO: 555213 - DNA, 13 bp, D. melanogaster
aaatttatgctaa

SEQ ID NO: 555214 - DNA, 14 bp, D. melanogaster
aaatttatgctaaa

SEQ ID NO: 555215 - DNA, 13 bp, D. melanogaster
aaatttatgctta

SEQ ID NO: 555216 - DNA, 13 bp, D. melanogaster
aaatttatggaaa

SEQ ID NO: 555217 - DNA, 14 bp, D. melanogaster
aaatttatggcatt

SEQ ID NO: 555218 - DNA, 13 bp, D. melanogaster
aaatttatggctt

SEQ ID NO: 555219 - DNA, 13 bp, D. melanogaster
aaatttatgtact

SEQ ID NO: 555220 - DNA, 13 bp, D. melanogaster
aaatttattacca

SEQ ID NO: 555221 - DNA, 13 bp, D. melanogaster
aaatttattacga

SEQ ID NO: 555222 - DNA, 13 bp, D. melanogaster
aaatttattccaa

SEQ ID NO: 555223 - DNA, 14 bp, D. melanogaster
aaatttattccaaa

SEQ ID NO: 555224 - DNA, 13 bp, D. melanogaster
aaatttattccat

SEQ ID NO: 555225 - DNA, 13 bp, D. melanogaster
aaatttattcgca

SEQ ID NO: 555226 - DNA, 13 bp, D. melanogaster
aaatttattgaac

SEQ ID NO: 555227 - DNA, 13 bp, D. melanogaster
aaatttattgact

SEQ ID NO: 555228 - DNA, 13 bp, D. melanogaster
aaatttattgatg

SEQ ID NO: 555229 - DNA, 13 bp, D. melanogaster
aaatttattgcat

SEQ ID NO: 555230 - DNA, 13 bp, D. melanogaster
aaatttattgttg

SEQ ID NO: 555231 - DNA, 14 bp, D. melanogaster
aaatttattgtttc

SEQ ID NO: 555232 - DNA, 13 bp, D. melanogaster
aaatttatttcca

SEQ ID NO: 555233 - DNA, 13 bp, D. melanogaster
aaatttatttggt

SEQ ID NO: 555234 - DNA, 14 bp, D. melanogaster
aaatttcaaaaatg

SEQ ID NO: 555235 - DNA, 13 bp, D. melanogaster
aaatttcaaaact

SEQ ID NO: 555236 - DNA, 13 bp, D. melanogaster
aaatttcaaacca

SEQ ID NO: 555237 - DNA, 13 bp, D. melanogaster
aaatttcaaagaa

SEQ ID NO: 555238 - DNA, 13 bp, D. melanogaster
aaatttcaaatgt

SEQ ID NO: 555239 - DNA, 14 bp, D. melanogaster
aaatttcaaattgt

SEQ ID NO: 555240 - DNA, 13 bp, D. melanogaster
aaatttcaagcaa

SEQ ID NO: 555241 - DNA, 13 bp, D. melanogaster
aaatttcaagttt

SEQ ID NO: 555242 - DNA, 13 bp, D. melanogaster
aaatttcaatatg

SEQ ID NO: 555243 - DNA, 13 bp, D. melanogaster
aaatttcaatcaa

SEQ ID NO: 555244 - DNA, 14 bp, D. melanogaster
aaatttcaatgaaa

SEQ ID NO: 555245 - DNA, 13 bp, D. melanogaster
aaatttcaatgcg

SEQ ID NO: 555246 - DNA, 14 bp, D. melanogaster
aaatttcaattcaa

SEQ ID NO: 555247 - DNA, 13 bp, D. melanogaster
aaatttcaatttc

SEQ ID NO: 555248 - DNA, 13 bp, D. melanogaster
aaatttcacaaat

SEQ ID NO: 555249 - DNA, 14 bp, D. melanogaster
aaatttcacaattt

SEQ ID NO: 555250 - DNA, 14 bp, D. melanogaster
aaatttcaccattt

SEQ ID NO: 555251 - DNA, 13 bp, D. melanogaster
aaatttcactttt

SEQ ID NO: 555252 - DNA, 13 bp, D. melanogaster
aaatttcagaaaa

SEQ ID NO: 555253 - DNA, 13 bp, D. melanogaster
aaatttcagatct

SEQ ID NO: 555254 - DNA, 13 bp, D. melanogaster
aaatttcagattt

SEQ ID NO: 555255 - DNA, 13 bp, D. melanogaster
aaatttcagtaaa

SEQ ID NO: 555256 - DNA, 13 bp, D. melanogaster
aaatttcagtaat

SEQ ID NO: 555257 - DNA, 13 bp, D. melanogaster
aaatttcagtgcg

SEQ ID NO: 555258 - DNA, 14 bp, D. melanogaster
aaatttcagtttgg

SEQ ID NO: 555259 - DNA, 13 bp, D. melanogaster
aaatttcagtttt

SEQ ID NO: 555260 - DNA, 13 bp, D. melanogaster
aaatttcatatga

SEQ ID NO: 555261 - DNA, 14 bp, D. melanogaster
aaatttcatatgac

SEQ ID NO: 555262 - DNA, 13 bp, D. melanogaster
aaatttcatgttt

SEQ ID NO: 555263 - DNA, 13 bp, D. melanogaster
aaatttcattcaa

SEQ ID NO: 555264 - DNA, 13 bp, D. melanogaster
aaatttcattgaa

SEQ ID NO: 555265 - DNA, 13 bp, D. melanogaster
aaatttcattgtt

SEQ ID NO: 555266 - DNA, 13 bp, D. melanogaster
aaatttcatttca

SEQ ID NO: 555267 - DNA, 13 bp, D. melanogaster
aaatttccaaaag

SEQ ID NO: 555268 - DNA, 13 bp, D. melanogaster
aaatttccaaact

SEQ ID NO: 555269 - DNA, 13 bp, D. melanogaster
aaatttccaaatt

SEQ ID NO: 555270 - DNA, 13 bp, D. melanogaster
aaatttccaagaa

SEQ ID NO: 555271 - DNA, 13 bp, D. melanogaster
aaatttccaatta

SEQ ID NO: 555272 - DNA, 14 bp, D. melanogaster
aaatttccaattaa

SEQ ID NO: 555273 - DNA, 13 bp, D. melanogaster
aaatttccacaaa

SEQ ID NO: 555274 - DNA, 14 bp, D. melanogaster
aaatttccacaatt

SEQ ID NO: 555275 - DNA, 13 bp, D. melanogaster
aaatttccagaaa

SEQ ID NO: 555276 - DNA, 13 bp, D. melanogaster
aaatttccagctt

SEQ ID NO: 555277 - DNA, 13 bp, D. melanogaster
aaatttccagttt

SEQ ID NO: 555278 - DNA, 13 bp, D. melanogaster
aaatttccataaa

SEQ ID NO: 555279 - DNA, 13 bp, D. melanogaster
aaatttccatatt

SEQ ID NO: 555280 - DNA, 13 bp, D. melanogaster
aaatttccatcga

SEQ ID NO: 555281 - DNA, 13 bp, D. melanogaster
aaatttccattat

SEQ ID NO: 555282 - DNA, 13 bp, D. melanogaster
aaatttccatttt

SEQ ID NO: 555283 - DNA, 13 bp, D. melanogaster
aaatttcccaaaa

SEQ ID NO: 555284 - DNA, 13 bp, D. melanogaster
aaatttcccattt

SEQ ID NO: 555285 - DNA, 13 bp, D. melanogaster
aaatttccccatt

SEQ ID NO: 555286 - DNA, 13 bp, D. melanogaster
aaatttccgattt

SEQ ID NO: 555287 - DNA, 14 bp, D. melanogaster
aaatttcctctttt

SEQ ID NO: 555288 - DNA, 14 bp, D. melanogaster
aaatttcgaaaaaa

SEQ ID NO: 555289 - DNA, 13 bp, D. melanogaster
aaatttcgaaaag

SEQ ID NO: 555290 - DNA, 13 bp, D. melanogaster
aaatttcgaaata

SEQ ID NO: 555291 - DNA, 13 bp, D. melanogaster
aaatttcgaaatt

SEQ ID NO: 555292 - DNA, 14 bp, D. melanogaster
aaatttcgaataaa

SEQ ID NO: 555293 - DNA, 13 bp, D. melanogaster
aaatttcgagttt

SEQ ID NO: 555294 - DNA, 13 bp, D. melanogaster
aaatttcgatttc

SEQ ID NO: 555295 - DNA, 13 bp, D. melanogaster
aaatttcgatttt

SEQ ID NO: 555296 - DNA, 14 bp, D. melanogaster
aaatttcgattttc

SEQ ID NO: 555297 - DNA, 13 bp, D. melanogaster
aaatttcgcaaca

SEQ ID NO: 555298 - DNA, 13 bp, D. melanogaster
aaatttcgcattc

SEQ ID NO: 555299 - DNA, 13 bp, D. melanogaster
aaatttcgccgac

SEQ ID NO: 555300 - DNA, 13 bp, D. melanogaster
aaatttcgcgttc

SEQ ID NO: 555301 - DNA, 14 bp, D. melanogaster
aaatttcgcgttcg

SEQ ID NO: 555302 - DNA, 13 bp, D. melanogaster
aaatttcgcgttt

SEQ ID NO: 555303 - DNA, 13 bp, D. melanogaster
aaatttcgggatc

SEQ ID NO: 555304 - DNA, 13 bp, D. melanogaster
aaatttcgtgttt

SEQ ID NO: 555305 - DNA, 14 bp, D. melanogaster
aaatttcgtgtttc

SEQ ID NO: 555306 - DNA, 13 bp, D. melanogaster
aaatttcgttaaa

SEQ ID NO: 555307 - DNA, 13 bp, D. melanogaster
aaatttcgttaat

SEQ ID NO: 555308 - DNA, 13 bp, D. melanogaster
aaatttcgtttgc

SEQ ID NO: 555309 - DNA, 13 bp, D. melanogaster
aaatttcgttttc

SEQ ID NO: 555310 - DNA, 13 bp, D. melanogaster
aaatttctaaaca

SEQ ID NO: 555311 - DNA, 13 bp, D. melanogaster
aaatttctaaagt

SEQ ID NO: 555312 - DNA, 13 bp, D. melanogaster
aaatttctattga

SEQ ID NO: 555313 - DNA, 13 bp, D. melanogaster
aaatttctgttgc

SEQ ID NO: 555314 - DNA, 13 bp, D. melanogaster
aaatttctgtttt

SEQ ID NO: 555315 - DNA, 13 bp, D. melanogaster
aaatttcttcagt

SEQ ID NO: 555316 - DNA, 14 bp, D. melanogaster
aaatttcttcagtt

SEQ ID NO: 555317 - DNA, 13 bp, D. melanogaster
aaatttcttctaa

SEQ ID NO: 555318 - DNA, 13 bp, D. melanogaster
aaatttcttgaaa

SEQ ID NO: 555319 - DNA, 14 bp, D. melanogaster
aaatttcttgaaat

SEQ ID NO: 555320 - DNA, 13 bp, D. melanogaster
aaatttcttgatt

SEQ ID NO: 555321 - DNA, 13 bp, D. melanogaster
aaatttcttggcc

SEQ ID NO: 555322 - DNA, 13 bp, D. melanogaster
aaatttctttcaa

SEQ ID NO: 555323 - DNA, 13 bp, D. melanogaster
aaatttctttgtt

SEQ ID NO: 555324 - DNA, 14 bp, D. melanogaster
aaatttgaaaagtt

SEQ ID NO: 555325 - DNA, 15 bp, D. melanogaster
aaatttgaaagctgg

SEQ ID NO: 555326 - DNA, 13 bp, D. melanogaster
aaatttgaaatcc

SEQ ID NO: 555327 - DNA, 13 bp, D. melanogaster
aaatttgaaatgt

SEQ ID NO: 555328 - DNA, 13 bp, D. melanogaster
aaatttgaaattc

SEQ ID NO: 555329 - DNA, 13 bp, D. melanogaster
aaatttgaacaaa

SEQ ID NO: 555330 - DNA, 14 bp, D. melanogaster
aaatttgaacaaat

SEQ ID NO: 555331 - DNA, 13 bp, D. melanogaster
aaatttgaacatt

SEQ ID NO: 555332 - DNA, 13 bp, D. melanogaster
aaatttgaagttt

SEQ ID NO: 555333 - DNA, 13 bp, D. melanogaster
aaatttgaatatc

SEQ ID NO: 555334 - DNA, 13 bp, D. melanogaster
aaatttgaattca

SEQ ID NO: 555335 - DNA, 13 bp, D. melanogaster
aaatttgaatttc

SEQ ID NO: 555336 - DNA, 13 bp, D. melanogaster
aaatttgacaaaa

SEQ ID NO: 555337 - DNA, 14 bp, D. melanogaster
aaatttgacaaaaa

SEQ ID NO: 555338 - DNA, 14 bp, D. melanogaster
aaatttgacaaaat

SEQ ID NO: 555339 - DNA, 13 bp, D. melanogaster
aaatttgacaaca

SEQ ID NO: 555340 - DNA, 13 bp, D. melanogaster
aaatttgagttta

SEQ ID NO: 555341 - DNA, 13 bp, D. melanogaster
aaatttgagtttt

SEQ ID NO: 555342 - DNA, 13 bp, D. melanogaster
aaatttgatatga

SEQ ID NO: 555343 - DNA, 13 bp, D. melanogaster
aaatttgatctta

SEQ ID NO: 555344 - DNA, 13 bp, D. melanogaster
aaatttgatgaaa

SEQ ID NO: 555345 - DNA, 13 bp, D. melanogaster
aaatttgatgatg

SEQ ID NO: 555346 - DNA, 13 bp, D. melanogaster
aaatttgattagt

SEQ ID NO: 555347 - DNA, 13 bp, D. melanogaster
aaatttgattgca

SEQ ID NO: 555348 - DNA, 13 bp, D. melanogaster
aaatttgatttca

SEQ ID NO: 555349 - DNA, 14 bp, D. melanogaster
aaatttgatttgat

SEQ ID NO: 555350 - DNA, 13 bp, D. melanogaster
aaatttgattttc

SEQ ID NO: 555351 - DNA, 13 bp, D. melanogaster
aaatttgcaaaaa

SEQ ID NO: 555352 - DNA, 13 bp, D. melanogaster
aaatttgcaaatt

SEQ ID NO: 555353 - DNA, 13 bp, D. melanogaster
aaatttgcaagct

SEQ ID NO: 555354 - DNA, 14 bp, D. melanogaster
aaatttgcaataaa

SEQ ID NO: 555355 - DNA, 13 bp, D. melanogaster
aaatttgcacaca

SEQ ID NO: 555356 - DNA, 13 bp, D. melanogaster
aaatttgcagaaa

SEQ ID NO: 555357 - DNA, 13 bp, D. melanogaster
aaatttgcagttt

SEQ ID NO: 555358 - DNA, 13 bp, D. melanogaster
aaatttgcataaa

SEQ ID NO: 555359 - DNA, 14 bp, D. melanogaster
aaatttgcataaat

SEQ ID NO: 555360 - DNA, 13 bp, D. melanogaster
aaatttgcataat

SEQ ID NO: 555361 - DNA, 14 bp, D. melanogaster
aaatttgcataatt

SEQ ID NO: 555362 - DNA, 13 bp, D. melanogaster
aaatttgcataga

SEQ ID NO: 555363 - DNA, 14 bp, D. melanogaster
aaatttgcatataa

SEQ ID NO: 555364 - DNA, 13 bp, D. melanogaster
aaatttgcatatt

SEQ ID NO: 555365 - DNA, 13 bp, D. melanogaster
aaatttgcatctg

SEQ ID NO: 555366 - DNA, 13 bp, D. melanogaster
aaatttgcatgca

SEQ ID NO: 555367 - DNA, 13 bp, D. melanogaster
aaatttgcattaa

SEQ ID NO: 555368 - DNA, 13 bp, D. melanogaster
aaatttgcattca

SEQ ID NO: 555369 - DNA, 13 bp, D. melanogaster
aaatttgcattta

SEQ ID NO: 555370 - DNA, 13 bp, D. melanogaster
aaatttgcatttt

SEQ ID NO: 555371 - DNA, 14 bp, D. melanogaster
aaatttgcattttt

SEQ ID NO: 555372 - DNA, 14 bp, D. melanogaster
aaatttgccaaaaa

SEQ ID NO: 555373 - DNA, 13 bp, D. melanogaster
aaatttgcccctc

SEQ ID NO: 555374 - DNA, 13 bp, D. melanogaster
aaatttgcgaaaa

SEQ ID NO: 555375 - DNA, 13 bp, D. melanogaster
aaatttgcgaact

SEQ ID NO: 555376 - DNA, 13 bp, D. melanogaster
aaatttgcgataa

SEQ ID NO: 555377 - DNA, 13 bp, D. melanogaster
aaatttgctgaat

SEQ ID NO: 555378 - DNA, 14 bp, D. melanogaster
aaatttggaaaatt

SEQ ID NO: 555379 - DNA, 13 bp, D. melanogaster
aaatttggaaatt

SEQ ID NO: 555380 - DNA, 13 bp, D. melanogaster
aaatttggaattt

SEQ ID NO: 555381 - DNA, 13 bp, D. melanogaster
aaatttggagaaa

SEQ ID NO: 555382 - DNA, 13 bp, D. melanogaster
aaatttggcaaaa

SEQ ID NO: 555383 - DNA, 13 bp, D. melanogaster
aaatttggcaaca

SEQ ID NO: 555384 - DNA, 13 bp, D. melanogaster
aaatttggcatat

SEQ ID NO: 555385 - DNA, 14 bp, D. melanogaster
aaatttggcatatc

SEQ ID NO: 555386 - DNA, 13 bp, D. melanogaster
aaatttggcattt

SEQ ID NO: 555387 - DNA, 14 bp, D. melanogaster
aaatttggccaaaa

SEQ ID NO: 555388 - DNA, 13 bp, D. melanogaster
aaatttgggaaaa

SEQ ID NO: 555389 - DNA, 13 bp, D. melanogaster
aaatttgggttta

SEQ ID NO: 555390 - DNA, 13 bp, D. melanogaster
aaatttggtaaat

SEQ ID NO: 555391 - DNA, 13 bp, D. melanogaster
aaatttggtttat

SEQ ID NO: 555392 - DNA, 13 bp, D. melanogaster
aaatttgtaaatg

SEQ ID NO: 555393 - DNA, 13 bp, D. melanogaster
aaatttgtaagaa

SEQ ID NO: 555394 - DNA, 13 bp, D. melanogaster
aaatttgtaatga

SEQ ID NO: 555395 - DNA, 14 bp, D. melanogaster
aaatttgtaatgat

SEQ ID NO: 555396 - DNA, 13 bp, D. melanogaster
aaatttgtaattc

SEQ ID NO: 555397 - DNA, 13 bp, D. melanogaster
aaatttgtacata

SEQ ID NO: 555398 - DNA, 13 bp, D. melanogaster
aaatttgtacatt

SEQ ID NO: 555399 - DNA, 13 bp, D. melanogaster
aaatttgtagtaa

SEQ ID NO: 555400 - DNA, 13 bp, D. melanogaster
aaatttgtatatc

SEQ ID NO: 555401 - DNA, 14 bp, D. melanogaster
aaatttgtatatcc

SEQ ID NO: 555402 - DNA, 13 bp, D. melanogaster
aaatttgtatctg

SEQ ID NO: 555403 - DNA, 13 bp, D. melanogaster
aaatttgtattgc

SEQ ID NO: 555404 - DNA, 13 bp, D. melanogaster
aaatttgtattgt

SEQ ID NO: 555405 - DNA, 14 bp, D. melanogaster
aaatttgtcaaatt

SEQ ID NO: 555406 - DNA, 13 bp, D. melanogaster
aaatttgtcagtt

SEQ ID NO: 555407 - DNA, 13 bp, D. melanogaster
aaatttgtcattt

SEQ ID NO: 555408 - DNA, 13 bp, D. melanogaster
aaatttgtcgcac

SEQ ID NO: 555409 - DNA, 13 bp, D. melanogaster
aaatttgtctaaa

SEQ ID NO: 555410 - DNA, 13 bp, D. melanogaster
aaatttgtgaaaa

SEQ ID NO: 555411 - DNA, 13 bp, D. melanogaster
aaatttgtgaaat

SEQ ID NO: 555412 - DNA, 14 bp, D. melanogaster
aaatttgtgaaatt

SEQ ID NO: 555413 - DNA, 13 bp, D. melanogaster
aaatttgtgaatt

SEQ ID NO: 555414 - DNA, 13 bp, D. melanogaster
aaatttgtgcaca

SEQ ID NO: 555415 - DNA, 13 bp, D. melanogaster
aaatttgtggacc

SEQ ID NO: 555416 - DNA, 13 bp, D. melanogaster
aaatttgtgtgtg

SEQ ID NO: 555417 - DNA, 13 bp, D. melanogaster
aaatttgtgttgt

SEQ ID NO: 555418 - DNA, 13 bp, D. melanogaster
aaatttgttaaac

SEQ ID NO: 555419 - DNA, 13 bp, D. melanogaster
aaatttgttaaca

SEQ ID NO: 555420 - DNA, 13 bp, D. melanogaster
aaatttgttcagt

SEQ ID NO: 555421 - DNA, 13 bp, D. melanogaster
aaatttgttcatt

SEQ ID NO: 555422 - DNA, 13 bp, D. melanogaster
aaatttgttgaaa

SEQ ID NO: 555423 - DNA, 14 bp, D. melanogaster
aaatttgttgaaaa

SEQ ID NO: 555424 - DNA, 14 bp, D. melanogaster
aaatttgttgaaat

SEQ ID NO: 555425 - DNA, 13 bp, D. melanogaster
aaatttgttgact

SEQ ID NO: 555426 - DNA, 13 bp, D. melanogaster
aaatttgttgatt

SEQ ID NO: 555427 - DNA, 13 bp, D. melanogaster
aaatttgttgttc

SEQ ID NO: 555428 - DNA, 13 bp, D. melanogaster
aaatttgtttcaa

SEQ ID NO: 555429 - DNA, 13 bp, D. melanogaster
aaatttgtttcca

SEQ ID NO: 555430 - DNA, 13 bp, D. melanogaster
aaatttgtttgct

SEQ ID NO: 555431 - DNA, 13 bp, D. melanogaster
aaatttgtttggc

SEQ ID NO: 555432 - DNA, 13 bp, D. melanogaster
aaatttgttttag

SEQ ID NO: 555433 - DNA, 13 bp, D. melanogaster
aaatttgttttct

SEQ ID NO: 555434 - DNA, 13 bp, D. melanogaster
aaatttgttttgc

SEQ ID NO: 555435 - DNA, 13 bp, D. melanogaster
aaatttgtttttc

SEQ ID NO: 555436 - DNA, 13 bp, D. melanogaster
aaattttaaagct

SEQ ID NO: 555437 - DNA, 13 bp, D. melanogaster
aaattttaaagga

SEQ ID NO: 555438 - DNA, 14 bp, D. melanogaster
aaattttaaaggta

SEQ ID NO: 555439 - DNA, 13 bp, D. melanogaster
aaattttaaatgc

SEQ ID NO: 555440 - DNA, 14 bp, D. melanogaster
aaattttaaatgca

SEQ ID NO: 555441 - DNA, 13 bp, D. melanogaster
aaattttaagcca

SEQ ID NO: 555442 - DNA, 13 bp, D. melanogaster
aaattttaagctg

SEQ ID NO: 555443 - DNA, 13 bp, D. melanogaster
aaattttaaggaa

SEQ ID NO: 555444 - DNA, 13 bp, D. melanogaster
aaattttaagtgg

SEQ ID NO: 555445 - DNA, 14 bp, D. melanogaster
aaattttaatgatg

SEQ ID NO: 555446 - DNA, 13 bp, D. melanogaster
aaattttaattgc

SEQ ID NO: 555447 - DNA, 14 bp, D. melanogaster
aaattttaattgct

SEQ ID NO: 555448 - DNA, 13 bp, D. melanogaster
aaattttacaaca

SEQ ID NO: 555449 - DNA, 13 bp, D. melanogaster
aaattttaccaat

SEQ ID NO: 555450 - DNA, 13 bp, D. melanogaster
aaattttacgttt

SEQ ID NO: 555451 - DNA, 13 bp, D. melanogaster
aaattttactcaa

SEQ ID NO: 555452 - DNA, 13 bp, D. melanogaster
aaattttactcga

SEQ ID NO: 555453 - DNA, 13 bp, D. melanogaster
aaattttactgct

SEQ ID NO: 555454 - DNA, 13 bp, D. melanogaster
aaattttagaaca

SEQ ID NO: 555455 - DNA, 13 bp, D. melanogaster
aaattttagcaaa

SEQ ID NO: 555456 - DNA, 13 bp, D. melanogaster
aaattttatgcca

SEQ ID NO: 555457 - DNA, 13 bp, D. melanogaster
aaattttatggcc

SEQ ID NO: 555458 - DNA, 13 bp, D. melanogaster
aaattttatgtgt

SEQ ID NO: 555459 - DNA, 13 bp, D. melanogaster
aaattttattcag

SEQ ID NO: 555460 - DNA, 13 bp, D. melanogaster
aaattttatttgc

SEQ ID NO: 555461 - DNA, 14 bp, D. melanogaster
aaattttatttgct

SEQ ID NO: 555462 - DNA, 14 bp, D. melanogaster
aaattttcaaaagt

SEQ ID NO: 555463 - DNA, 14 bp, D. melanogaster
aaattttcaaaatg

SEQ ID NO: 555464 - DNA, 13 bp, D. melanogaster
aaattttcaaaca

SEQ ID NO: 555465 - DNA, 13 bp, D. melanogaster
aaattttcaacaa

SEQ ID NO: 555466 - DNA, 13 bp, D. melanogaster
aaattttcaatgt

SEQ ID NO: 555467 - DNA, 14 bp, D. melanogaster
aaattttcaatttg

SEQ ID NO: 555468 - DNA, 13 bp, D. melanogaster
aaattttcacaca

SEQ ID NO: 555469 - DNA, 13 bp, D. melanogaster
aaattttcacagc

SEQ ID NO: 555470 - DNA, 13 bp, D. melanogaster
aaattttcacttt

SEQ ID NO: 555471 - DNA, 13 bp, D. melanogaster
aaattttcagaaa

SEQ ID NO: 555472 - DNA, 13 bp, D. melanogaster
aaattttcagatg

SEQ ID NO: 555473 - DNA, 13 bp, D. melanogaster
aaattttcagttt

SEQ ID NO: 555474 - DNA, 13 bp, D. melanogaster
aaattttcatcaa

SEQ ID NO: 555475 - DNA, 13 bp, D. melanogaster
aaattttcattct

SEQ ID NO: 555476 - DNA, 14 bp, D. melanogaster
aaattttcattttg

SEQ ID NO: 555477 - DNA, 13 bp, D. melanogaster
aaattttccaaaa

SEQ ID NO: 555478 - DNA, 14 bp, D. melanogaster
aaattttccaaatt

SEQ ID NO: 555479 - DNA, 13 bp, D. melanogaster
aaattttccacat

SEQ ID NO: 555480 - DNA, 13 bp, D. melanogaster
aaattttccatac

SEQ ID NO: 555481 - DNA, 13 bp, D. melanogaster
aaattttccatat

SEQ ID NO: 555482 - DNA, 13 bp, D. melanogaster
aaattttccattt

SEQ ID NO: 555483 - DNA, 13 bp, D. melanogaster
aaattttcccaca

SEQ ID NO: 555484 - DNA, 13 bp, D. melanogaster
aaattttccgaaa

SEQ ID NO: 555485 - DNA, 13 bp, D. melanogaster
aaattttccgctt

SEQ ID NO: 555486 - DNA, 13 bp, D. melanogaster
aaattttccgttt

SEQ ID NO: 555487 - DNA, 13 bp, D. melanogaster
aaattttcctttc

SEQ ID NO: 555488 - DNA, 13 bp, D. melanogaster
aaattttcgaaaa

SEQ ID NO: 555489 - DNA, 14 bp, D. melanogaster
aaattttcgaaaat

SEQ ID NO: 555490 - DNA, 13 bp, D. melanogaster
aaattttcgaact

SEQ ID NO: 555491 - DNA, 13 bp, D. melanogaster
aaattttcgattt

SEQ ID NO: 555492 - DNA, 14 bp, D. melanogaster
aaattttcgcattt

SEQ ID NO: 555493 - DNA, 13 bp, D. melanogaster
aaattttcgcttt

SEQ ID NO: 555494 - DNA, 14 bp, D. melanogaster
aaattttcggttaa

SEQ ID NO: 555495 - DNA, 14 bp, D. melanogaster
aaattttctaaaga

SEQ ID NO: 555496 - DNA, 13 bp, D. melanogaster
aaattttctagct

SEQ ID NO: 555497 - DNA, 13 bp, D. melanogaster
aaattttctattc

SEQ ID NO: 555498 - DNA, 13 bp, D. melanogaster
aaattttctgtaa

SEQ ID NO: 555499 - DNA, 14 bp, D. melanogaster
aaattttcttatac

SEQ ID NO: 555500 - DNA, 13 bp, D. melanogaster
aaattttcttgat

SEQ ID NO: 555501 - DNA, 13 bp, D. melanogaster
aaattttgaaagt

SEQ ID NO: 555502 - DNA, 13 bp, D. melanogaster
aaattttgaaatg

SEQ ID NO: 555503 - DNA, 13 bp, D. melanogaster
aaattttgaacta

SEQ ID NO: 555504 - DNA, 13 bp, D. melanogaster
aaattttgaattc

SEQ ID NO: 555505 - DNA, 14 bp, D. melanogaster
aaattttgaattcc

SEQ ID NO: 555506 - DNA, 13 bp, D. melanogaster
aaattttgaattg

SEQ ID NO: 555507 - DNA, 13 bp, D. melanogaster
aaattttgacaaa

SEQ ID NO: 555508 - DNA, 13 bp, D. melanogaster
aaattttgataag

SEQ ID NO: 555509 - DNA, 13 bp, D. melanogaster
aaattttgatgaa

SEQ ID NO: 555510 - DNA, 13 bp, D. melanogaster
aaattttgatgat

SEQ ID NO: 555511 - DNA, 13 bp, D. melanogaster
aaattttgatggg

SEQ ID NO: 555512 - DNA, 13 bp, D. melanogaster
aaattttgattga

SEQ ID NO: 555513 - DNA, 13 bp, D. melanogaster
aaattttgattgc

SEQ ID NO: 555514 - DNA, 13 bp, D. melanogaster
aaattttgcaaaa

SEQ ID NO: 555515 - DNA, 14 bp, D. melanogaster
aaattttgcaaaaa

SEQ ID NO: 555516 - DNA, 13 bp, D. melanogaster
aaattttgcaaca

SEQ ID NO: 555517 - DNA, 13 bp, D. melanogaster
aaattttgcaatt

SEQ ID NO: 555518 - DNA, 13 bp, D. melanogaster
aaattttgcacaa

SEQ ID NO: 555519 - DNA, 13 bp, D. melanogaster
aaattttgcattt

SEQ ID NO: 555520 - DNA, 13 bp, D. melanogaster
aaattttgcgttt

SEQ ID NO: 555521 - DNA, 13 bp, D. melanogaster
aaattttgctaaa

SEQ ID NO: 555522 - DNA, 13 bp, D. melanogaster
aaattttgcttat

SEQ ID NO: 555523 - DNA, 13 bp, D. melanogaster
aaattttggattt

SEQ ID NO: 555524 - DNA, 13 bp, D. melanogaster
aaattttggtttc

SEQ ID NO: 555525 - DNA, 13 bp, D. melanogaster
aaattttgtaaac

SEQ ID NO: 555526 - DNA, 13 bp, D. melanogaster
aaattttgtaagt

SEQ ID NO: 555527 - DNA, 13 bp, D. melanogaster
aaattttgtagga

SEQ ID NO: 555528 - DNA, 13 bp, D. melanogaster
aaattttgtagtt

SEQ ID NO: 555529 - DNA, 13 bp, D. melanogaster
aaattttgtatgt

SEQ ID NO: 555530 - DNA, 13 bp, D. melanogaster
aaattttgtcttt

SEQ ID NO: 555531 - DNA, 13 bp, D. melanogaster
aaattttgtgatt

SEQ ID NO: 555532 - DNA, 13 bp, D. melanogaster
aaattttgttgaa

SEQ ID NO: 555533 - DNA, 13 bp, D. melanogaster
aaattttgttggc

SEQ ID NO: 555534 - DNA, 13 bp, D. melanogaster
aaattttgttggt

SEQ ID NO: 555535 - DNA, 13 bp, D. melanogaster
aaattttgtttac

SEQ ID NO: 555536 - DNA, 13 bp, D. melanogaster
aaatttttaacag

SEQ ID NO: 555537 - DNA, 13 bp, D. melanogaster
aaatttttagcaa

SEQ ID NO: 555538 - DNA, 13 bp, D. melanogaster
aaatttttagcat

SEQ ID NO: 555539 - DNA, 13 bp, D. melanogaster
aaatttttagctg

SEQ ID NO: 555540 - DNA, 13 bp, D. melanogaster
aaatttttagctt

SEQ ID NO: 555541 - DNA, 13 bp, D. melanogaster
aaatttttcaatc

SEQ ID NO: 555542 - DNA, 13 bp, D. melanogaster
aaatttttcagtt

SEQ ID NO: 555543 - DNA, 13 bp, D. melanogaster
aaatttttcctga

SEQ ID NO: 555544 - DNA, 14 bp, D. melanogaster
aaatttttcgaaaa

SEQ ID NO: 555545 - DNA, 13 bp, D. melanogaster
aaatttttcgctt

SEQ ID NO: 555546 - DNA, 13 bp, D. melanogaster
aaatttttcgttt

SEQ ID NO: 555547 - DNA, 13 bp, D. melanogaster
aaatttttgagaa

SEQ ID NO: 555548 - DNA, 13 bp, D. melanogaster
aaatttttgagca

SEQ ID NO: 555549 - DNA, 13 bp, D. melanogaster
aaatttttgagtt

SEQ ID NO: 555550 - DNA, 13 bp, D. melanogaster
aaatttttgatga

SEQ ID NO: 555551 - DNA, 14 bp, D. melanogaster
aaatttttgatttc

SEQ ID NO: 555552 - DNA, 14 bp, D. melanogaster
aaatttttgcaaaa

SEQ ID NO: 555553 - DNA, 13 bp, D. melanogaster
aaatttttgcata

SEQ ID NO: 555554 - DNA, 13 bp, D. melanogaster
aaatttttgccaa

SEQ ID NO: 555555 - DNA, 13 bp, D. melanogaster
aaatttttgctat

SEQ ID NO: 555556 - DNA, 14 bp, D. melanogaster
aaatttttggaaaa

SEQ ID NO: 555557 - DNA, 13 bp, D. melanogaster
aaatttttggcag

SEQ ID NO: 555558 - DNA, 13 bp, D. melanogaster
aaatttttgtcaa

SEQ ID NO: 555559 - DNA, 13 bp, D. melanogaster
aaatttttgtgat

SEQ ID NO: 555560 - DNA, 13 bp, D. melanogaster
aaatttttgttca

SEQ ID NO: 555561 - DNA, 13 bp, D. melanogaster
aaattttttgttc

SEQ ID NO: 555562 - DNA, 13 bp, D. melanogaster
aaatttttttccc

SEQ ID NO: 555563 - DNA, 13 bp, D. melanogaster
aaatttttttgca

SEQ ID NO: 555564 - DNA, 13 bp, D. melanogaster
aaattttttttcg

SEQ ID NO: 555565 - DNA, 14 bp, D. melanogaster
aaattttttttcga

SEQ ID NO: 555566 - DNA, 13 bp, D. melanogaster
aacaaaaaagctg

SEQ ID NO: 555567 - DNA, 14 bp, D. melanogaster
aacaaaaaatatgt

SEQ ID NO: 555568 - DNA, 13 bp, D. melanogaster
aacaaaaaatcgt

SEQ ID NO: 555569 - DNA, 13 bp, D. melanogaster
aacaaaaaatctg

SEQ ID NO: 555570 - DNA, 13 bp, D. melanogaster
aacaaaaaatggt

SEQ ID NO: 555571 - DNA, 14 bp, D. melanogaster
aacaaaaaatggtt

SEQ ID NO: 555572 - DNA, 14 bp, D. melanogaster
aacaaaaaatgttt

SEQ ID NO: 555573 - DNA, 13 bp, D. melanogaster
aacaaaaaattgt

SEQ ID NO: 555574 - DNA, 13 bp, D. melanogaster
aacaaaaaatttg

SEQ ID NO: 555575 - DNA, 14 bp, D. melanogaster
aacaaaaacaattg

SEQ ID NO: 555576 - DNA, 13 bp, D. melanogaster
aacaaaaacagtt

SEQ ID NO: 555577 - DNA, 14 bp, D. melanogaster
aacaaaaacgtaat

SEQ ID NO: 555578 - DNA, 14 bp, D. melanogaster
aacaaaaactgaag

SEQ ID NO: 555579 - DNA, 13 bp, D. melanogaster
aacaaaaactgca

SEQ ID NO: 555580 - DNA, 13 bp, D. melanogaster
aacaaaaactggc

SEQ ID NO: 555581 - DNA, 13 bp, D. melanogaster
aacaaaaacttga

SEQ ID NO: 555582 - DNA, 14 bp, D. melanogaster
aacaaaaacttttg

SEQ ID NO: 555583 - DNA, 14 bp, D. melanogaster
aacaaaaacttttt

SEQ ID NO: 555584 - DNA, 13 bp, D. melanogaster
aacaaaaagattt

SEQ ID NO: 555585 - DNA, 13 bp, D. melanogaster
aacaaaaagcagt

SEQ ID NO: 555586 - DNA, 13 bp, D. melanogaster
aacaaaaagcatt

SEQ ID NO: 555587 - DNA, 13 bp, D. melanogaster
aacaaaaagcgtt

SEQ ID NO: 555588 - DNA, 13 bp, D. melanogaster
aacaaaaagctta

SEQ ID NO: 555589 - DNA, 13 bp, D. melanogaster
aacaaaaaggttt

SEQ ID NO: 555590 - DNA, 13 bp, D. melanogaster
aacaaaaagtatc

SEQ ID NO: 555591 - DNA, 13 bp, D. melanogaster
aacaaaaagtgca

SEQ ID NO: 555592 - DNA, 13 bp, D. melanogaster
aacaaaaagtgga

SEQ ID NO: 555593 - DNA, 13 bp, D. melanogaster
aacaaaaagtggt

SEQ ID NO: 555594 - DNA, 13 bp, D. melanogaster
aacaaaaagttac

SEQ ID NO: 555595 - DNA, 13 bp, D. melanogaster
aacaaaaagttga

SEQ ID NO: 555596 - DNA, 13 bp, D. melanogaster
aacaaaaagttgt

SEQ ID NO: 555597 - DNA, 13 bp, D. melanogaster
aacaaaaagttta

SEQ ID NO: 555598 - DNA, 13 bp, D. melanogaster
aacaaaaagtttc

SEQ ID NO: 555599 - DNA, 13 bp, D. melanogaster
aacaaaaagtttt

SEQ ID NO: 555600 - DNA, 13 bp, D. melanogaster
aacaaaaatattg

SEQ ID NO: 555601 - DNA, 13 bp, D. melanogaster
aacaaaaatcctt

SEQ ID NO: 555602 - DNA, 13 bp, D. melanogaster
aacaaaaatcgca

SEQ ID NO: 555603 - DNA, 13 bp, D. melanogaster
aacaaaaatgcca

SEQ ID NO: 555604 - DNA, 13 bp, D. melanogaster
aacaaaaatgcga

SEQ ID NO: 555605 - DNA, 13 bp, D. melanogaster
aacaaaaatgtat

SEQ ID NO: 555606 - DNA, 13 bp, D. melanogaster
aacaaaaatgtgt

SEQ ID NO: 555607 - DNA, 13 bp, D. melanogaster
aacaaaaatgtta

SEQ ID NO: 555608 - DNA, 13 bp, D. melanogaster
aacaaaaattcga

SEQ ID NO: 555609 - DNA, 13 bp, D. melanogaster
aacaaaaattctt

SEQ ID NO: 555610 - DNA, 13 bp, D. melanogaster
aacaaaaattgta

SEQ ID NO: 555611 - DNA, 14 bp, D. melanogaster
aacaaaacaaattg

SEQ ID NO: 555612 - DNA, 13 bp, D. melanogaster
aacaaaacaatcg

SEQ ID NO: 555613 - DNA, 13 bp, D. melanogaster
aacaaaacaatgc

SEQ ID NO: 555614 - DNA, 13 bp, D. melanogaster
aacaaaacaattg

SEQ ID NO: 555615 - DNA, 13 bp, D. melanogaster
aacaaaacacttt

SEQ ID NO: 555616 - DNA, 13 bp, D. melanogaster
aacaaaacagttt

SEQ ID NO: 555617 - DNA, 13 bp, D. melanogaster
aacaaaacatttg

SEQ ID NO: 555618 - DNA, 14 bp, D. melanogaster
aacaaaacgaaatg

SEQ ID NO: 555619 - DNA, 13 bp, D. melanogaster
aacaaaacgattt

SEQ ID NO: 555620 - DNA, 13 bp, D. melanogaster
aacaaaacgctgc

SEQ ID NO: 555621 - DNA, 13 bp, D. melanogaster
aacaaaactattt

SEQ ID NO: 555622 - DNA, 13 bp, D. melanogaster
aacaaaactgaag

SEQ ID NO: 555623 - DNA, 13 bp, D. melanogaster
aacaaaagactca

SEQ ID NO: 555624 - DNA, 13 bp, D. melanogaster
aacaaaagagttt

SEQ ID NO: 555625 - DNA, 13 bp, D. melanogaster
aacaaaagattat

SEQ ID NO: 555626 - DNA, 13 bp, D. melanogaster
aacaaaagatttt

SEQ ID NO: 555627 - DNA, 14 bp, D. melanogaster
aacaaaagcaaatg

SEQ ID NO: 555628 - DNA, 13 bp, D. melanogaster
aacaaaagcaact

SEQ ID NO: 555629 - DNA, 13 bp, D. melanogaster
aacaaaagcaatt

SEQ ID NO: 555630 - DNA, 14 bp, D. melanogaster
aacaaaagcaattt

SEQ ID NO: 555631 - DNA, 13 bp, D. melanogaster
aacaaaagcagct

SEQ ID NO: 555632 - DNA, 13 bp, D. melanogaster
aacaaaagccaat

SEQ ID NO: 555633 - DNA, 13 bp, D. melanogaster
aacaaaagcccag

SEQ ID NO: 555634 - DNA, 13 bp, D. melanogaster
aacaaaagccgag

SEQ ID NO: 555635 - DNA, 13 bp, D. melanogaster
aacaaaagccgca

SEQ ID NO: 555636 - DNA, 13 bp, D. melanogaster
aacaaaagcggca

SEQ ID NO: 555637 - DNA, 14 bp, D. melanogaster
aacaaaagcggcaa

SEQ ID NO: 555638 - DNA, 13 bp, D. melanogaster
aacaaaagcgttt

SEQ ID NO: 555639 - DNA, 13 bp, D. melanogaster
aacaaaagctggc

SEQ ID NO: 555640 - DNA, 13 bp, D. melanogaster
aacaaaagcttaa

SEQ ID NO: 555641 - DNA, 13 bp, D. melanogaster
aacaaaagctttt

SEQ ID NO: 555642 - DNA, 13 bp, D. melanogaster
aacaaaaggaatt

SEQ ID NO: 555643 - DNA, 13 bp, D. melanogaster
aacaaaaggatat

SEQ ID NO: 555644 - DNA, 13 bp, D. melanogaster
aacaaaaggcaat

SEQ ID NO: 555645 - DNA, 13 bp, D. melanogaster
aacaaaaggcagc

SEQ ID NO: 555646 - DNA, 13 bp, D. melanogaster
aacaaaaggcatt

SEQ ID NO: 555647 - DNA, 13 bp, D. melanogaster
aacaaaaggcgat

SEQ ID NO: 555648 - DNA, 13 bp, D. melanogaster
aacaaaaggcgca

SEQ ID NO: 555649 - DNA, 13 bp, D. melanogaster
aacaaaaggcggc

SEQ ID NO: 555650 - DNA, 13 bp, D. melanogaster
aacaaaaggctgc

SEQ ID NO: 555651 - DNA, 13 bp, D. melanogaster
aacaaaagtcaat

SEQ ID NO: 555652 - DNA, 13 bp, D. melanogaster
aacaaaagtcact

SEQ ID NO: 555653 - DNA, 14 bp, D. melanogaster
aacaaaagtcactg

SEQ ID NO: 555654 - DNA, 13 bp, D. melanogaster
aacaaaagtccat

SEQ ID NO: 555655 - DNA, 14 bp, D. melanogaster
aacaaaagtgaaat

SEQ ID NO: 555656 - DNA, 13 bp, D. melanogaster
aacaaaagtgaag

SEQ ID NO: 555657 - DNA, 13 bp, D. melanogaster
aacaaaagtgatt

SEQ ID NO: 555658 - DNA, 14 bp, D. melanogaster
aacaaaagtgattg

SEQ ID NO: 555659 - DNA, 13 bp, D. melanogaster
aacaaaagtgcaa

SEQ ID NO: 555660 - DNA, 14 bp, D. melanogaster
aacaaaagtgcctt

SEQ ID NO: 555661 - DNA, 13 bp, D. melanogaster
aacaaaagtggca

SEQ ID NO: 555662 - DNA, 13 bp, D. melanogaster
aacaaaagttgaa

SEQ ID NO: 555663 - DNA, 13 bp, D. melanogaster
aacaaaagttggc

SEQ ID NO: 555664 - DNA, 13 bp, D. melanogaster
aacaaaagttgtt

SEQ ID NO: 555665 - DNA, 13 bp, D. melanogaster
aacaaaagtttct

SEQ ID NO: 555666 - DNA, 14 bp, D. melanogaster
aacaaaagtttgaa

SEQ ID NO: 555667 - DNA, 13 bp, D. melanogaster
aacaaaagttttt

SEQ ID NO: 555668 - DNA, 14 bp, D. melanogaster
aacaaaagtttttg

SEQ ID NO: 555669 - DNA, 13 bp, D. melanogaster
aacaaaataagtt

SEQ ID NO: 555670 - DNA, 13 bp, D. melanogaster
aacaaaatacgca

SEQ ID NO: 555671 - DNA, 13 bp, D. melanogaster
aacaaaatatgta

SEQ ID NO: 555672 - DNA, 14 bp, D. melanogaster
aacaaaatatgttt

SEQ ID NO: 555673 - DNA, 13 bp, D. melanogaster
aacaaaatattct

SEQ ID NO: 555674 - DNA, 13 bp, D. melanogaster
aacaaaatcagca

SEQ ID NO: 555675 - DNA, 13 bp, D. melanogaster
aacaaaatcagtt

SEQ ID NO: 555676 - DNA, 14 bp, D. melanogaster
aacaaaatcattga

SEQ ID NO: 555677 - DNA, 13 bp, D. melanogaster
aacaaaatctttg

SEQ ID NO: 555678 - DNA, 14 bp, D. melanogaster
aacaaaatgaaatt

SEQ ID NO: 555679 - DNA, 13 bp, D. melanogaster
aacaaaatgaatc

SEQ ID NO: 555680 - DNA, 13 bp, D. melanogaster
aacaaaatgattg

SEQ ID NO: 555681 - DNA, 14 bp, D. melanogaster
aacaaaatgcaaat

SEQ ID NO: 555682 - DNA, 13 bp, D. melanogaster
aacaaaatgcaga

SEQ ID NO: 555683 - DNA, 13 bp, D. melanogaster
aacaaaatgcagt

SEQ ID NO: 555684 - DNA, 13 bp, D. melanogaster
aacaaaatgcgaa

SEQ ID NO: 555685 - DNA, 13 bp, D. melanogaster
aacaaaatgctaa

SEQ ID NO: 555686 - DNA, 13 bp, D. melanogaster
aacaaaatgctga

SEQ ID NO: 555687 - DNA, 13 bp, D. melanogaster
aacaaaatggcag

SEQ ID NO: 555688 - DNA, 14 bp, D. melanogaster
aacaaaatgggaaa

SEQ ID NO: 555689 - DNA, 14 bp, D. melanogaster
aacaaaatgtaaat

SEQ ID NO: 555690 - DNA, 13 bp, D. melanogaster
aacaaaatgtaca

SEQ ID NO: 555691 - DNA, 13 bp, D. melanogaster
aacaaaatgtata

SEQ ID NO: 555692 - DNA, 13 bp, D. melanogaster
aacaaaatgtatg

SEQ ID NO: 555693 - DNA, 13 bp, D. melanogaster
aacaaaatgtatt

SEQ ID NO: 555694 - DNA, 13 bp, D. melanogaster
aacaaaatgtgca

SEQ ID NO: 555695 - DNA, 13 bp, D. melanogaster
aacaaaatgttaa

SEQ ID NO: 555696 - DNA, 13 bp, D. melanogaster
aacaaaatgttat

SEQ ID NO: 555697 - DNA, 13 bp, D. melanogaster
aacaaaatgttca

SEQ ID NO: 555698 - DNA, 14 bp, D. melanogaster
aacaaaatgtttgc

SEQ ID NO: 555699 - DNA, 14 bp, D. melanogaster
aacaaaatgttttt

SEQ ID NO: 555700 - DNA, 13 bp, D. melanogaster
aacaaaattagtg

SEQ ID NO: 555701 - DNA, 14 bp, D. melanogaster
aacaaaattcattt

SEQ ID NO: 555702 - DNA, 13 bp, D. melanogaster
aacaaaattcgaa

SEQ ID NO: 555703 - DNA, 14 bp, D. melanogaster
aacaaaattgaagt

SEQ ID NO: 555704 - DNA, 13 bp, D. melanogaster
aacaaaattgaat

SEQ ID NO: 555705 - DNA, 13 bp, D. melanogaster
aacaaaattgcaa

SEQ ID NO: 555706 - DNA, 13 bp, D. melanogaster
aacaaaattgcca

SEQ ID NO: 555707 - DNA, 13 bp, D. melanogaster
aacaaaattgtaa

SEQ ID NO: 555708 - DNA, 13 bp, D. melanogaster
aacaaaattgttg

SEQ ID NO: 555709 - DNA, 13 bp, D. melanogaster
aacaaaattgttt

SEQ ID NO: 555710 - DNA, 14 bp, D. melanogaster
aacaaaattgtttt

SEQ ID NO: 555711 - DNA, 13 bp, D. melanogaster
aacaaaatttctc

SEQ ID NO: 555712 - DNA, 13 bp, D. melanogaster
aacaaaatttctg

SEQ ID NO: 555713 - DNA, 13 bp, D. melanogaster
aacaaaatttgaa

SEQ ID NO: 555714 - DNA, 13 bp, D. melanogaster
aacaaaatttgca

SEQ ID NO: 555715 - DNA, 13 bp, D. melanogaster
aacaaaattttga

SEQ ID NO: 555716 - DNA, 14 bp, D. melanogaster
aacaaacaaaatgt

SEQ ID NO: 555717 - DNA, 14 bp, D. melanogaster
aacaaacaaacatg

SEQ ID NO: 555718 - DNA, 13 bp, D. melanogaster
aacaaacaaactg

SEQ ID NO: 555719 - DNA, 14 bp, D. melanogaster
aacaaacaaactga

SEQ ID NO: 555720 - DNA, 13 bp, D. melanogaster
aacaaacaaagct

SEQ ID NO: 555721 - DNA, 13 bp, D. melanogaster
aacaaacaagtga

SEQ ID NO: 555722 - DNA, 13 bp, D. melanogaster
aacaaacaagtgc

SEQ ID NO: 555723 - DNA, 13 bp, D. melanogaster
aacaaacaatttc

SEQ ID NO: 555724 - DNA, 13 bp, D. melanogaster
aacaaacaatttt

SEQ ID NO: 555725 - DNA, 13 bp, D. melanogaster
aacaaacacagtt

SEQ ID NO: 555726 - DNA, 13 bp, D. melanogaster
aacaaacacatgt

SEQ ID NO: 555727 - DNA, 13 bp, D. melanogaster
aacaaacacattg

SEQ ID NO: 555728 - DNA, 13 bp, D. melanogaster
aacaaacacttat

SEQ ID NO: 555729 - DNA, 13 bp, D. melanogaster
aacaaacagccag

SEQ ID NO: 555730 - DNA, 13 bp, D. melanogaster
aacaaacagcggc

SEQ ID NO: 555731 - DNA, 13 bp, D. melanogaster
aacaaacagctga

SEQ ID NO: 555732 - DNA, 13 bp, D. melanogaster
aacaaacatggca

SEQ ID NO: 555733 - DNA, 13 bp, D. melanogaster
aacaaacattaag

SEQ ID NO: 555734 - DNA, 14 bp, D. melanogaster
aacaaacattaaga

SEQ ID NO: 555735 - DNA, 13 bp, D. melanogaster
aacaaacatttcg

SEQ ID NO: 555736 - DNA, 13 bp, D. melanogaster
aacaaacattttc

SEQ ID NO: 555737 - DNA, 13 bp, D. melanogaster
aacaaacattttg

SEQ ID NO: 555738 - DNA, 14 bp, D. melanogaster
aacaaacatttttc

SEQ ID NO: 555739 - DNA, 13 bp, D. melanogaster
aacaaaccaattt

SEQ ID NO: 555740 - DNA, 13 bp, D. melanogaster
aacaaaccgaaat

SEQ ID NO: 555741 - DNA, 13 bp, D. melanogaster
aacaaaccgcgaa

SEQ ID NO: 555742 - DNA, 14 bp, D. melanogaster
aacaaaccgcgaag

SEQ ID NO: 555743 - DNA, 13 bp, D. melanogaster
aacaaacgaaact

SEQ ID NO: 555744 - DNA, 13 bp, D. melanogaster
aacaaacgaaatt

SEQ ID NO: 555745 - DNA, 13 bp, D. melanogaster
aacaaacgaattt

SEQ ID NO: 555746 - DNA, 13 bp, D. melanogaster
aacaaacgcaaat

SEQ ID NO: 555747 - DNA, 13 bp, D. melanogaster
aacaaacgcagca

SEQ ID NO: 555748 - DNA, 13 bp, D. melanogaster
aacaaacggctcc

SEQ ID NO: 555749 - DNA, 13 bp, D. melanogaster
aacaaacggggtc

SEQ ID NO: 555750 - DNA, 13 bp, D. melanogaster
aacaaactaaagt

SEQ ID NO: 555751 - DNA, 13 bp, D. melanogaster
aacaaactatatg

SEQ ID NO: 555752 - DNA, 13 bp, D. melanogaster
aacaaactcaacg

SEQ ID NO: 555753 - DNA, 14 bp, D. melanogaster
aacaaactcaacga

SEQ ID NO: 555754 - DNA, 13 bp, D. melanogaster
aacaaactcaatt

SEQ ID NO: 555755 - DNA, 13 bp, D. melanogaster
aacaaactgaaat

SEQ ID NO: 555756 - DNA, 13 bp, D. melanogaster
aacaaactgcagc

SEQ ID NO: 555757 - DNA, 13 bp, D. melanogaster
aacaaactggaaa

SEQ ID NO: 555758 - DNA, 13 bp, D. melanogaster
aacaaactggctc

SEQ ID NO: 555759 - DNA, 14 bp, D. melanogaster
aacaaactggctca

SEQ ID NO: 555760 - DNA, 13 bp, D. melanogaster
aacaaactgttgc

SEQ ID NO: 555761 - DNA, 13 bp, D. melanogaster
aacaaactgtttt

SEQ ID NO: 555762 - DNA, 13 bp, D. melanogaster
aacaaacttttta

SEQ ID NO: 555763 - DNA, 14 bp, D. melanogaster
aacaaagaatgcaa

SEQ ID NO: 555764 - DNA, 13 bp, D. melanogaster
aacaaagaatttc

SEQ ID NO: 555765 - DNA, 13 bp, D. melanogaster
aacaaagacacta

SEQ ID NO: 555766 - DNA, 13 bp, D. melanogaster
aacaaagactggt

SEQ ID NO: 555767 - DNA, 13 bp, D. melanogaster
aacaaagatattt

SEQ ID NO: 555768 - DNA, 13 bp, D. melanogaster
aacaaagcaaatg

SEQ ID NO: 555769 - DNA, 13 bp, D. melanogaster
aacaaagcaatat

SEQ ID NO: 555770 - DNA, 13 bp, D. melanogaster
aacaaagcaattt

SEQ ID NO: 555771 - DNA, 13 bp, D. melanogaster
aacaaagcagcca

SEQ ID NO: 555772 - DNA, 13 bp, D. melanogaster
aacaaagcattaa

SEQ ID NO: 555773 - DNA, 13 bp, D. melanogaster
aacaaagccatta

SEQ ID NO: 555774 - DNA, 13 bp, D. melanogaster
aacaaagcccaat

SEQ ID NO: 555775 - DNA, 15 bp, D. melanogaster
aacaaagcctccgcc

SEQ ID NO: 555776 - DNA, 13 bp, D. melanogaster
aacaaagcgaatt

SEQ ID NO: 555777 - DNA, 13 bp, D. melanogaster
aacaaagcgcagc

SEQ ID NO: 555778 - DNA, 13 bp, D. melanogaster
aacaaaggcaaat

SEQ ID NO: 555779 - DNA, 13 bp, D. melanogaster
aacaaaggcaatt

SEQ ID NO: 555780 - DNA, 13 bp, D. melanogaster
aacaaaggccaag

SEQ ID NO: 555781 - DNA, 13 bp, D. melanogaster
aacaaaggccgaa

SEQ ID NO: 555782 - DNA, 13 bp, D. melanogaster
aacaaagggaaat

SEQ ID NO: 555783 - DNA, 13 bp, D. melanogaster
aacaaagggccaa

SEQ ID NO: 555784 - DNA, 13 bp, D. melanogaster
aacaaagtaaatg

SEQ ID NO: 555785 - DNA, 13 bp, D. melanogaster
aacaaagtaatta

SEQ ID NO: 555786 - DNA, 13 bp, D. melanogaster
aacaaagtaattg

SEQ ID NO: 555787 - DNA, 14 bp, D. melanogaster
aacaaagtacaaat

SEQ ID NO: 555788 - DNA, 13 bp, D. melanogaster
aacaaagtcaaat

SEQ ID NO: 555789 - DNA, 13 bp, D. melanogaster
aacaaagtcgaaa

SEQ ID NO: 555790 - DNA, 14 bp, D. melanogaster
aacaaagtgaaaat

SEQ ID NO: 555791 - DNA, 13 bp, D. melanogaster
aacaaagtgaaat

SEQ ID NO: 555792 - DNA, 13 bp, D. melanogaster
aacaaagtgcatt

SEQ ID NO: 555793 - DNA, 13 bp, D. melanogaster
aacaaagtggaaa

SEQ ID NO: 555794 - DNA, 13 bp, D. melanogaster
aacaaagtggcat

SEQ ID NO: 555795 - DNA, 13 bp, D. melanogaster
aacaaagtgtaaa

SEQ ID NO: 555796 - DNA, 13 bp, D. melanogaster
aacaaagttgcaa

SEQ ID NO: 555797 - DNA, 13 bp, D. melanogaster
aacaaagtttttt

SEQ ID NO: 555798 - DNA, 13 bp, D. melanogaster
aacaaataaatgc

SEQ ID NO: 555799 - DNA, 13 bp, D. melanogaster
aacaaataaattg

SEQ ID NO: 555800 - DNA, 14 bp, D. melanogaster
aacaaataaatttg

SEQ ID NO: 555801 - DNA, 13 bp, D. melanogaster
aacaaataacgca

SEQ ID NO: 555802 - DNA, 13 bp, D. melanogaster
aacaaataatgca

SEQ ID NO: 555803 - DNA, 13 bp, D. melanogaster
aacaaatacattt

SEQ ID NO: 555804 - DNA, 13 bp, D. melanogaster
aacaaatacgaat

SEQ ID NO: 555805 - DNA, 13 bp, D. melanogaster
aacaaatactatt

SEQ ID NO: 555806 - DNA, 13 bp, D. melanogaster
aacaaatacttca

SEQ ID NO: 555807 - DNA, 13 bp, D. melanogaster
aacaaatactttt

SEQ ID NO: 555808 - DNA, 14 bp, D. melanogaster
aacaaatagaaatg

SEQ ID NO: 555809 - DNA, 13 bp, D. melanogaster
aacaaatagatat

SEQ ID NO: 555810 - DNA, 13 bp, D. melanogaster
aacaaatagccaa

SEQ ID NO: 555811 - DNA, 13 bp, D. melanogaster
aacaaatagtaca

SEQ ID NO: 555812 - DNA, 13 bp, D. melanogaster
aacaaatatattg

SEQ ID NO: 555813 - DNA, 13 bp, D. melanogaster
aacaaatatgtga

SEQ ID NO: 555814 - DNA, 13 bp, D. melanogaster
aacaaatattcat

SEQ ID NO: 555815 - DNA, 13 bp, D. melanogaster
aacaaatattgtg

SEQ ID NO: 555816 - DNA, 14 bp, D. melanogaster
aacaaatatttaca

SEQ ID NO: 555817 - DNA, 13 bp, D. melanogaster
aacaaatatttgc

SEQ ID NO: 555818 - DNA, 13 bp, D. melanogaster
aacaaatatttgt

SEQ ID NO: 555819 - DNA, 13 bp, D. melanogaster
aacaaatattttg

SEQ ID NO: 555820 - DNA, 14 bp, D. melanogaster
aacaaatattttga

SEQ ID NO: 555821 - DNA, 13 bp, D. melanogaster
aacaaatcaaacg

SEQ ID NO: 555822 - DNA, 13 bp, D. melanogaster
aacaaatcaattc

SEQ ID NO: 555823 - DNA, 13 bp, D. melanogaster
aacaaatcaattt

SEQ ID NO: 555824 - DNA, 14 bp, D. melanogaster
aacaaatcaatttg

SEQ ID NO: 555825 - DNA, 13 bp, D. melanogaster
aacaaatcatcgg

SEQ ID NO: 555826 - DNA, 13 bp, D. melanogaster
aacaaatccaatt

SEQ ID NO: 555827 - DNA, 14 bp, D. melanogaster
aacaaatcgaaaac

SEQ ID NO: 555828 - DNA, 13 bp, D. melanogaster
aacaaatcgaaag

SEQ ID NO: 555829 - DNA, 13 bp, D. melanogaster
aacaaatcgaata

SEQ ID NO: 555830 - DNA, 13 bp, D. melanogaster
aacaaatcgaatt

SEQ ID NO: 555831 - DNA, 13 bp, D. melanogaster
aacaaatcgcaaa

SEQ ID NO: 555832 - DNA, 13 bp, D. melanogaster
aacaaatcggaaa

SEQ ID NO: 555833 - DNA, 13 bp, D. melanogaster
aacaaatcgtttt

SEQ ID NO: 555834 - DNA, 13 bp, D. melanogaster
aacaaatctttgg

SEQ ID NO: 555835 - DNA, 14 bp, D. melanogaster
aacaaatgaaaatg

SEQ ID NO: 555836 - DNA, 14 bp, D. melanogaster
aacaaatgaaattc

SEQ ID NO: 555837 - DNA, 13 bp, D. melanogaster
aacaaatgaacga

SEQ ID NO: 555838 - DNA, 13 bp, D. melanogaster
aacaaatgaattt

SEQ ID NO: 555839 - DNA, 13 bp, D. melanogaster
aacaaatgacgag

SEQ ID NO: 555840 - DNA, 13 bp, D. melanogaster
aacaaatgatgaa

SEQ ID NO: 555841 - DNA, 14 bp, D. melanogaster
aacaaatgatgaat

SEQ ID NO: 555842 - DNA, 13 bp, D. melanogaster
aacaaatgattaa

SEQ ID NO: 555843 - DNA, 13 bp, D. melanogaster
aacaaatgattca

SEQ ID NO: 555844 - DNA, 14 bp, D. melanogaster
aacaaatgcaaaat

SEQ ID NO: 555845 - DNA, 13 bp, D. melanogaster
aacaaatgcaaac

SEQ ID NO: 555846 - DNA, 13 bp, D. melanogaster
aacaaatgcaaag

SEQ ID NO: 555847 - DNA, 14 bp, D. melanogaster
aacaaatgcaacaa

SEQ ID NO: 555848 - DNA, 13 bp, D. melanogaster
aacaaatgcaata

SEQ ID NO: 555849 - DNA, 13 bp, D. melanogaster
aacaaatgcaatc

SEQ ID NO: 555850 - DNA, 13 bp, D. melanogaster
aacaaatgcaatg

SEQ ID NO: 555851 - DNA, 13 bp, D. melanogaster
aacaaatgcaatt

SEQ ID NO: 555852 - DNA, 14 bp, D. melanogaster
aacaaatgcaattt

SEQ ID NO: 555853 - DNA, 13 bp, D. melanogaster
aacaaatgcagtt

SEQ ID NO: 555854 - DNA, 13 bp, D. melanogaster
aacaaatgcattt

SEQ ID NO: 555855 - DNA, 13 bp, D. melanogaster
aacaaatgccaaa

SEQ ID NO: 555856 - DNA, 13 bp, D. melanogaster
aacaaatgccaga

SEQ ID NO: 555857 - DNA, 13 bp, D. melanogaster
aacaaatgccatg

SEQ ID NO: 555858 - DNA, 13 bp, D. melanogaster
aacaaatgccgtc

SEQ ID NO: 555859 - DNA, 13 bp, D. melanogaster
aacaaatgcgaaa

SEQ ID NO: 555860 - DNA, 13 bp, D. melanogaster
aacaaatgctgca

SEQ ID NO: 555861 - DNA, 13 bp, D. melanogaster
aacaaatgctttt

SEQ ID NO: 555862 - DNA, 13 bp, D. melanogaster
aacaaatggaaat

SEQ ID NO: 555863 - DNA, 13 bp, D. melanogaster
aacaaatggaatt

SEQ ID NO: 555864 - DNA, 13 bp, D. melanogaster
aacaaatggcagc

SEQ ID NO: 555865 - DNA, 13 bp, D. melanogaster
aacaaatggccaa

SEQ ID NO: 555866 - DNA, 13 bp, D. melanogaster
aacaaatgggaaa

SEQ ID NO: 555867 - DNA, 13 bp, D. melanogaster
aacaaatggtaaa

SEQ ID NO: 555868 - DNA, 13 bp, D. melanogaster
aacaaatgtatat

SEQ ID NO: 555869 - DNA, 13 bp, D. melanogaster
aacaaatgtgaaa

SEQ ID NO: 555870 - DNA, 13 bp, D. melanogaster
aacaaatgtgcaa

SEQ ID NO: 555871 - DNA, 13 bp, D. melanogaster
aacaaatgttcaa

SEQ ID NO: 555872 - DNA, 13 bp, D. melanogaster
aacaaatgtttat

SEQ ID NO: 555873 - DNA, 13 bp, D. melanogaster
aacaaatgtttga

SEQ ID NO: 555874 - DNA, 13 bp, D. melanogaster
aacaaatgtttgc

SEQ ID NO: 555875 - DNA, 14 bp, D. melanogaster
aacaaattaaaagt

SEQ ID NO: 555876 - DNA, 13 bp, D. melanogaster
aacaaattaaagt

SEQ ID NO: 555877 - DNA, 14 bp, D. melanogaster
aacaaattaaattg

SEQ ID NO: 555878 - DNA, 13 bp, D. melanogaster
aacaaattaatgc

SEQ ID NO: 555879 - DNA, 13 bp, D. melanogaster
aacaaattatgtt

SEQ ID NO: 555880 - DNA, 13 bp, D. melanogaster
aacaaattattcc

SEQ ID NO: 555881 - DNA, 13 bp, D. melanogaster
aacaaattatttg

SEQ ID NO: 555882 - DNA, 13 bp, D. melanogaster
aacaaattccaag

SEQ ID NO: 555883 - DNA, 13 bp, D. melanogaster
aacaaattccaat

SEQ ID NO: 555884 - DNA, 13 bp, D. melanogaster
aacaaattccatt

SEQ ID NO: 555885 - DNA, 13 bp, D. melanogaster
aacaaattcgatt

SEQ ID NO: 555886 - DNA, 13 bp, D. melanogaster
aacaaattcgttt

SEQ ID NO: 555887 - DNA, 13 bp, D. melanogaster
aacaaattcttca

SEQ ID NO: 555888 - DNA, 13 bp, D. melanogaster
aacaaattctttg

SEQ ID NO: 555889 - DNA, 14 bp, D. melanogaster
aacaaattctttga

SEQ ID NO: 555890 - DNA, 14 bp, D. melanogaster
aacaaattgaaaac

SEQ ID NO: 555891 - DNA, 13 bp, D. melanogaster
aacaaattgaaat

SEQ ID NO: 555892 - DNA, 13 bp, D. melanogaster
aacaaattgaatt

SEQ ID NO: 555893 - DNA, 13 bp, D. melanogaster
aacaaattgagaa

SEQ ID NO: 555894 - DNA, 13 bp, D. melanogaster
aacaaattgatta

SEQ ID NO: 555895 - DNA, 13 bp, D. melanogaster
aacaaattgattt

SEQ ID NO: 555896 - DNA, 14 bp, D. melanogaster
aacaaattgcaaaa

SEQ ID NO: 555897 - DNA, 14 bp, D. melanogaster
aacaaattgcaatt

SEQ ID NO: 555898 - DNA, 13 bp, D. melanogaster
aacaaattgcact

SEQ ID NO: 555899 - DNA, 13 bp, D. melanogaster
aacaaattgcagc

SEQ ID NO: 555900 - DNA, 14 bp, D. melanogaster
aacaaattgcattt

SEQ ID NO: 555901 - DNA, 13 bp, D. melanogaster
aacaaattgccaa

SEQ ID NO: 555902 - DNA, 14 bp, D. melanogaster
aacaaattgccaaa

SEQ ID NO: 555903 - DNA, 13 bp, D. melanogaster
aacaaattgccat

SEQ ID NO: 555904 - DNA, 13 bp, D. melanogaster
aacaaattgccca

SEQ ID NO: 555905 - DNA, 13 bp, D. melanogaster
aacaaattgcctt

SEQ ID NO: 555906 - DNA, 13 bp, D. melanogaster
aacaaattgcgaa

SEQ ID NO: 555907 - DNA, 13 bp, D. melanogaster
aacaaattgcgca

SEQ ID NO: 555908 - DNA, 13 bp, D. melanogaster
aacaaattgcttt

SEQ ID NO: 555909 - DNA, 13 bp, D. melanogaster
aacaaattggaaa

SEQ ID NO: 555910 - DNA, 14 bp, D. melanogaster
aacaaattggaaaa

SEQ ID NO: 555911 - DNA, 13 bp, D. melanogaster
aacaaattggatt

SEQ ID NO: 555912 - DNA, 13 bp, D. melanogaster
aacaaattggctt

SEQ ID NO: 555913 - DNA, 13 bp, D. melanogaster
aacaaattgtgaa

SEQ ID NO: 555914 - DNA, 13 bp, D. melanogaster
aacaaattgttga

SEQ ID NO: 555915 - DNA, 13 bp, D. melanogaster
aacaaattgttgt

SEQ ID NO: 555916 - DNA, 13 bp, D. melanogaster
aacaaattgtttt

SEQ ID NO: 555917 - DNA, 14 bp, D. melanogaster
aacaaattgttttt

SEQ ID NO: 555918 - DNA, 14 bp, D. melanogaster
aacaaatttaaatg

SEQ ID NO: 555919 - DNA, 13 bp, D. melanogaster
aacaaatttaact

SEQ ID NO: 555920 - DNA, 14 bp, D. melanogaster
aacaaatttaattg

SEQ ID NO: 555921 - DNA, 13 bp, D. melanogaster
aacaaatttagca

SEQ ID NO: 555922 - DNA, 13 bp, D. melanogaster
aacaaatttatgg

SEQ ID NO: 555923 - DNA, 13 bp, D. melanogaster
aacaaatttattg

SEQ ID NO: 555924 - DNA, 14 bp, D. melanogaster
aacaaatttcaatt

SEQ ID NO: 555925 - DNA, 14 bp, D. melanogaster
aacaaatttcagat

SEQ ID NO: 555926 - DNA, 13 bp, D. melanogaster
aacaaatttcatt

SEQ ID NO: 555927 - DNA, 14 bp, D. melanogaster
aacaaatttcattt

SEQ ID NO: 555928 - DNA, 13 bp, D. melanogaster
aacaaatttccat

SEQ ID NO: 555929 - DNA, 13 bp, D. melanogaster
aacaaatttccga

SEQ ID NO: 555930 - DNA, 13 bp, D. melanogaster
aacaaatttcgct

SEQ ID NO: 555931 - DNA, 13 bp, D. melanogaster
aacaaatttgaag

SEQ ID NO: 555932 - DNA, 13 bp, D. melanogaster
aacaaatttgatt

SEQ ID NO: 555933 - DNA, 14 bp, D. melanogaster
aacaaatttgattt

SEQ ID NO: 555934 - DNA, 13 bp, D. melanogaster
aacaaatttgcac

SEQ ID NO: 555935 - DNA, 13 bp, D. melanogaster
aacaaatttgcag

SEQ ID NO: 555936 - DNA, 13 bp, D. melanogaster
aacaaatttgctt

SEQ ID NO: 555937 - DNA, 13 bp, D. melanogaster
aacaaatttgtga

SEQ ID NO: 555938 - DNA, 13 bp, D. melanogaster
aacaaatttgttt

SEQ ID NO: 555939 - DNA, 14 bp, D. melanogaster
aacaaatttgttta

SEQ ID NO: 555940 - DNA, 13 bp, D. melanogaster
aacaaattttcaa

SEQ ID NO: 555941 - DNA, 13 bp, D. melanogaster
aacaaattttcat

SEQ ID NO: 555942 - DNA, 13 bp, D. melanogaster
aacaaattttcca

SEQ ID NO: 555943 - DNA, 14 bp, D. melanogaster
aacaaattttccaa

SEQ ID NO: 555944 - DNA, 13 bp, D. melanogaster
aacaaattttgta

SEQ ID NO: 555945 - DNA, 14 bp, D. melanogaster
aacaaatttttgtt

SEQ ID NO: 555946 - DNA, 13 bp, D. melanogaster
aacaacaaaactg

SEQ ID NO: 555947 - DNA, 14 bp, D. melanogaster
aacaacaaaagcgg

SEQ ID NO: 555948 - DNA, 13 bp, D. melanogaster
aacaacaaaatcg

SEQ ID NO: 555949 - DNA, 13 bp, D. melanogaster
aacaacaaaattg

SEQ ID NO: 555950 - DNA, 13 bp, D. melanogaster
aacaacaaacttt

SEQ ID NO: 555951 - DNA, 13 bp, D. melanogaster
aacaacaaaggcg

SEQ ID NO: 555952 - DNA, 13 bp, D. melanogaster
aacaacaaagttt

SEQ ID NO: 555953 - DNA, 13 bp, D. melanogaster
aacaacaaatacg

SEQ ID NO: 555954 - DNA, 13 bp, D. melanogaster
aacaacaaatagt

SEQ ID NO: 555955 - DNA, 14 bp, D. melanogaster
aacaacaaatagta

SEQ ID NO: 555956 - DNA, 13 bp, D. melanogaster
aacaacaaatatg

SEQ ID NO: 555957 - DNA, 13 bp, D. melanogaster
aacaacaaatcga

SEQ ID NO: 555958 - DNA, 14 bp, D. melanogaster
aacaacaaatgaat

SEQ ID NO: 555959 - DNA, 14 bp, D. melanogaster
aacaacaaatgcaa

SEQ ID NO: 555960 - DNA, 13 bp, D. melanogaster
aacaacaaatgcc

SEQ ID NO: 555961 - DNA, 13 bp, D. melanogaster
aacaacaaatgct

SEQ ID NO: 555962 - DNA, 13 bp, D. melanogaster
aacaacaaatgtg

SEQ ID NO: 555963 - DNA, 13 bp, D. melanogaster
aacaacaaattgt

SEQ ID NO: 555964 - DNA, 13 bp, D. melanogaster
aacaacaaatttc

SEQ ID NO: 555965 - DNA, 14 bp, D. melanogaster
aacaacaacaaagt

SEQ ID NO: 555966 - DNA, 14 bp, D. melanogaster
aacaacaacaaatg

SEQ ID NO: 555967 - DNA, 14 bp, D. melanogaster
aacaacaacaagtg

SEQ ID NO: 555968 - DNA, 13 bp, D. melanogaster
aacaacaacaatg

SEQ ID NO: 555969 - DNA, 14 bp, D. melanogaster
aacaacaacaatga

SEQ ID NO: 555970 - DNA, 13 bp, D. melanogaster
aacaacaacactg

SEQ ID NO: 555971 - DNA, 13 bp, D. melanogaster
aacaacaacactt

SEQ ID NO: 555972 - DNA, 14 bp, D. melanogaster
aacaacaacagcgg

SEQ ID NO: 555973 - DNA, 13 bp, D. melanogaster
aacaacaacagct

SEQ ID NO: 555974 - DNA, 14 bp, D. melanogaster
aacaacaacagcta

SEQ ID NO: 555975 - DNA, 14 bp, D. melanogaster
aacaacaacagtaa

SEQ ID NO: 555976 - DNA, 13 bp, D. melanogaster
aacaacaacagtt

SEQ ID NO: 555977 - DNA, 14 bp, D. melanogaster
aacaacaacatcga

SEQ ID NO: 555978 - DNA, 13 bp, D. melanogaster
aacaacaacatga

SEQ ID NO: 555979 - DNA, 15 bp, D. melanogaster
aacaacaacattgcc

SEQ ID NO: 555980 - DNA, 13 bp, D. melanogaster
aacaacaacattt

SEQ ID NO: 555981 - DNA, 14 bp, D. melanogaster
aacaacaacatttt

SEQ ID NO: 555982 - DNA, 13 bp, D. melanogaster
aacaacaaccggc

SEQ ID NO: 555983 - DNA, 14 bp, D. melanogaster
aacaacaacgacat

SEQ ID NO: 555984 - DNA, 13 bp, D. melanogaster
aacaacaacgacg

SEQ ID NO: 555985 - DNA, 13 bp, D. melanogaster
aacaacaacgtca

SEQ ID NO: 555986 - DNA, 13 bp, D. melanogaster
aacaacaactatt

SEQ ID NO: 555987 - DNA, 13 bp, D. melanogaster
aacaacaactgaa

SEQ ID NO: 555988 - DNA, 14 bp, D. melanogaster
aacaacaactgcag

SEQ ID NO: 555989 - DNA, 13 bp, D. melanogaster
aacaacaactgcg

SEQ ID NO: 555990 - DNA, 13 bp, D. melanogaster
aacaacaactgct

SEQ ID NO: 555991 - DNA, 13 bp, D. melanogaster
aacaacaactggg

SEQ ID NO: 555992 - DNA, 13 bp, D. melanogaster
aacaacaactgtg

SEQ ID NO: 555993 - DNA, 13 bp, D. melanogaster
aacaacaacttga

SEQ ID NO: 555994 - DNA, 13 bp, D. melanogaster
aacaacaacttgg

SEQ ID NO: 555995 - DNA, 13 bp, D. melanogaster
aacaacaactttt

SEQ ID NO: 555996 - DNA, 13 bp, D. melanogaster
aacaacaagatca

SEQ ID NO: 555997 - DNA, 14 bp, D. melanogaster
aacaacaagatcaa

SEQ ID NO: 555998 - DNA, 13 bp, D. melanogaster
aacaacaagcgca

SEQ ID NO: 555999 - DNA, 13 bp, D. melanogaster
aacaacaagtgaa

SEQ ID NO: 556000 - DNA, 13 bp, D. melanogaster
aacaacaagtggc

SEQ ID NO: 556001 - DNA, 13 bp, D. melanogaster
aacaacaataagc

SEQ ID NO: 556002 - DNA, 13 bp, D. melanogaster
aacaacaataatg

SEQ ID NO: 556003 - DNA, 14 bp, D. melanogaster
aacaacaatagcag

SEQ ID NO: 556004 - DNA, 13 bp, D. melanogaster
aacaacaatagtt

SEQ ID NO: 556005 - DNA, 14 bp, D. melanogaster
aacaacaatagttg

SEQ ID NO: 556006 - DNA, 13 bp, D. melanogaster
aacaacaatattc

SEQ ID NO: 556007 - DNA, 13 bp, D. melanogaster
aacaacaatgaca

SEQ ID NO: 556008 - DNA, 13 bp, D. melanogaster
aacaacaatgaga

SEQ ID NO: 556009 - DNA, 13 bp, D. melanogaster
aacaacaatgata

SEQ ID NO: 556010 - DNA, 13 bp, D. melanogaster
aacaacaatgcgc

SEQ ID NO: 556011 - DNA, 13 bp, D. melanogaster
aacaacaatggct

SEQ ID NO: 556012 - DNA, 13 bp, D. melanogaster
aacaacaatggga

SEQ ID NO: 556013 - DNA, 13 bp, D. melanogaster
aacaacaatgggg

SEQ ID NO: 556014 - DNA, 13 bp, D. melanogaster
aacaacaattagc

SEQ ID NO: 556015 - DNA, 13 bp, D. melanogaster
aacaacaattatg

SEQ ID NO: 556016 - DNA, 13 bp, D. melanogaster
aacaacaattgcc

SEQ ID NO: 556017 - DNA, 13 bp, D. melanogaster
aacaacaattgcg

SEQ ID NO: 556018 - DNA, 13 bp, D. melanogaster
aacaacaatttgc

SEQ ID NO: 556019 - DNA, 13 bp, D. melanogaster
aacaacaatttgg

SEQ ID NO: 556020 - DNA, 13 bp, D. melanogaster
aacaacaatttgt

SEQ ID NO: 556021 - DNA, 13 bp, D. melanogaster
aacaacaatttta

SEQ ID NO: 556022 - DNA, 13 bp, D. melanogaster
aacaacaattttt

SEQ ID NO: 556023 - DNA, 13 bp, D. melanogaster
aacaacacacttc

SEQ ID NO: 556024 - DNA, 13 bp, D. melanogaster
aacaacacagcag

SEQ ID NO: 556025 - DNA, 13 bp, D. melanogaster
aacaacacatgcc

SEQ ID NO: 556026 - DNA, 13 bp, D. melanogaster
aacaacacatttt

SEQ ID NO: 556027 - DNA, 13 bp, D. melanogaster
aacaacactactt

SEQ ID NO: 556028 - DNA, 13 bp, D. melanogaster
aacaacactgttg

SEQ ID NO: 556029 - DNA, 13 bp, D. melanogaster
aacaacacttttg

SEQ ID NO: 556030 - DNA, 13 bp, D. melanogaster
aacaacagaaact

SEQ ID NO: 556031 - DNA, 13 bp, D. melanogaster
aacaacagaaatt

SEQ ID NO: 556032 - DNA, 13 bp, D. melanogaster
aacaacagcaaat

SEQ ID NO: 556033 - DNA, 14 bp, D. melanogaster
aacaacagcaacat

SEQ ID NO: 556034 - DNA, 13 bp, D. melanogaster
aacaacagcaacg

SEQ ID NO: 556035 - DNA, 14 bp, D. melanogaster
aacaacagcaacgg

SEQ ID NO: 556036 - DNA, 13 bp, D. melanogaster
aacaacagcaatg

SEQ ID NO: 556037 - DNA, 13 bp, D. melanogaster
aacaacagcagcg

SEQ ID NO: 556038 - DNA, 14 bp, D. melanogaster
aacaacagcagcga

SEQ ID NO: 556039 - DNA, 13 bp, D. melanogaster
aacaacagcagct

SEQ ID NO: 556040 - DNA, 13 bp, D. melanogaster
aacaacagcgaca

SEQ ID NO: 556041 - DNA, 13 bp, D. melanogaster
aacaacagcggcg

SEQ ID NO: 556042 - DNA, 13 bp, D. melanogaster
aacaacagctgcc

SEQ ID NO: 556043 - DNA, 13 bp, D. melanogaster
aacaacagctgga

SEQ ID NO: 556044 - DNA, 13 bp, D. melanogaster
aacaacagcttat

SEQ ID NO: 556045 - DNA, 13 bp, D. melanogaster
aacaacaggagca

SEQ ID NO: 556046 - DNA, 14 bp, D. melanogaster
aacaacaggcagat

SEQ ID NO: 556047 - DNA, 14 bp, D. melanogaster
aacaacaggtcaag

SEQ ID NO: 556048 - DNA, 13 bp, D. melanogaster
aacaacagtagca

SEQ ID NO: 556049 - DNA, 13 bp, D. melanogaster
aacaacatatgta

SEQ ID NO: 556050 - DNA, 13 bp, D. melanogaster
aacaacatattca

SEQ ID NO: 556051 - DNA, 13 bp, D. melanogaster
aacaacatattta

SEQ ID NO: 556052 - DNA, 14 bp, D. melanogaster
aacaacatattttt

SEQ ID NO: 556053 - DNA, 14 bp, D. melanogaster
aacaacatcatcat

SEQ ID NO: 556054 - DNA, 13 bp, D. melanogaster
aacaacatcatta

SEQ ID NO: 556055 - DNA, 13 bp, D. melanogaster
aacaacatcgcag

SEQ ID NO: 556056 - DNA, 13 bp, D. melanogaster
aacaacatctctt

SEQ ID NO: 556057 - DNA, 14 bp, D. melanogaster
aacaacattaagtc

SEQ ID NO: 556058 - DNA, 13 bp, D. melanogaster
aacaacattgaaa

SEQ ID NO: 556059 - DNA, 15 bp, D. melanogaster
aacaacattgccata

SEQ ID NO: 556060 - DNA, 13 bp, D. melanogaster
aacaacatttaca

SEQ ID NO: 556061 - DNA, 13 bp, D. melanogaster
aacaacatttgtt

SEQ ID NO: 556062 - DNA, 13 bp, D. melanogaster
aacaacattttaa

SEQ ID NO: 556063 - DNA, 13 bp, D. melanogaster
aacaacattttat

SEQ ID NO: 556064 - DNA, 13 bp, D. melanogaster
aacaacattttca

SEQ ID NO: 556065 - DNA, 13 bp, D. melanogaster
aacaacattttgt

SEQ ID NO: 556066 - DNA, 14 bp, D. melanogaster
aacaacattttttt

SEQ ID NO: 556067 - DNA, 13 bp, D. melanogaster
aacaaccagagca

SEQ ID NO: 556068 - DNA, 14 bp, D. melanogaster
aacaaccttttcat

SEQ ID NO: 556069 - DNA, 13 bp, D. melanogaster
aacaacgaaaact

SEQ ID NO: 556070 - DNA, 13 bp, D. melanogaster
aacaacgaaatga

SEQ ID NO: 556071 - DNA, 13 bp, D. melanogaster
aacaacgacaatg

SEQ ID NO: 556072 - DNA, 13 bp, D. melanogaster
aacaacgatatag

SEQ ID NO: 556073 - DNA, 13 bp, D. melanogaster
aacaacgcaaacg

SEQ ID NO: 556074 - DNA, 13 bp, D. melanogaster
aacaacggcaaca

SEQ ID NO: 556075 - DNA, 13 bp, D. melanogaster
aacaacggcgaca

SEQ ID NO: 556076 - DNA, 14 bp, D. melanogaster
aacaactacaacag

SEQ ID NO: 556077 - DNA, 13 bp, D. melanogaster
aacaactacaact

SEQ ID NO: 556078 - DNA, 14 bp, D. melanogaster
aacaactacaacta

SEQ ID NO: 556079 - DNA, 13 bp, D. melanogaster
aacaactattttt

SEQ ID NO: 556080 - DNA, 13 bp, D. melanogaster
aacaactctttcg

SEQ ID NO: 556081 - DNA, 13 bp, D. melanogaster
aacaactgaaact

SEQ ID NO: 556082 - DNA, 13 bp, D. melanogaster
aacaactgaaata

SEQ ID NO: 556083 - DNA, 13 bp, D. melanogaster
aacaactgaacaa

SEQ ID NO: 556084 - DNA, 13 bp, D. melanogaster
aacaactgcaaaa

SEQ ID NO: 556085 - DNA, 13 bp, D. melanogaster
aacaactgcaaat

SEQ ID NO: 556086 - DNA, 14 bp, D. melanogaster
aacaactgcaacaa

SEQ ID NO: 556087 - DNA, 13 bp, D. melanogaster
aacaactgcaata

SEQ ID NO: 556088 - DNA, 13 bp, D. melanogaster
aacaactgtttcc

SEQ ID NO: 556089 - DNA, 13 bp, D. melanogaster
aacaacttaaatt

SEQ ID NO: 556090 - DNA, 13 bp, D. melanogaster
aacaacttcatta

SEQ ID NO: 556091 - DNA, 13 bp, D. melanogaster
aacaacttccaaa

SEQ ID NO: 556092 - DNA, 13 bp, D. melanogaster
aacaacttgaaaa

SEQ ID NO: 556093 - DNA, 13 bp, D. melanogaster
aacaactttaaat

SEQ ID NO: 556094 - DNA, 14 bp, D. melanogaster
aacaactttaaatt

SEQ ID NO: 556095 - DNA, 13 bp, D. melanogaster
aacaactttattt

SEQ ID NO: 556096 - DNA, 13 bp, D. melanogaster
aacaactttgaaa

SEQ ID NO: 556097 - DNA, 13 bp, D. melanogaster
aacaacttttact

SEQ ID NO: 556098 - DNA, 13 bp, D. melanogaster
aacaacttttgac

SEQ ID NO: 556099 - DNA, 13 bp, D. melanogaster
aacaacttttgtt

SEQ ID NO: 556100 - DNA, 13 bp, D. melanogaster
aacaactttttaa

SEQ ID NO: 556101 - DNA, 13 bp, D. melanogaster
aacaactttttgc

SEQ ID NO: 556102 - DNA, 13 bp, D. melanogaster
aacaactttttgg

SEQ ID NO: 556103 - DNA, 13 bp, D. melanogaster
aacaacttttttt

SEQ ID NO: 556104 - DNA, 13 bp, D. melanogaster
aacaagaaaattc

SEQ ID NO: 556105 - DNA, 13 bp, D. melanogaster
aacaagaaatatt

SEQ ID NO: 556106 - DNA, 14 bp, D. melanogaster
aacaagaaatggat

SEQ ID NO: 556107 - DNA, 14 bp, D. melanogaster
aacaagaaatttgt

SEQ ID NO: 556108 - DNA, 13 bp, D. melanogaster
aacaagaacttaa

SEQ ID NO: 556109 - DNA, 13 bp, D. melanogaster
aacaagaagacta

SEQ ID NO: 556110 - DNA, 13 bp, D. melanogaster
aacaagaatacca

SEQ ID NO: 556111 - DNA, 15 bp, D. melanogaster
aacaagaataccagt

SEQ ID NO: 556112 - DNA, 13 bp, D. melanogaster
aacaagaattaac

SEQ ID NO: 556113 - DNA, 13 bp, D. melanogaster
aacaagaatttaa

SEQ ID NO: 556114 - DNA, 13 bp, D. melanogaster
aacaagaattttc

SEQ ID NO: 556115 - DNA, 13 bp, D. melanogaster
aacaagacaacat

SEQ ID NO: 556116 - DNA, 13 bp, D. melanogaster
aacaagacgagcg

SEQ ID NO: 556117 - DNA, 13 bp, D. melanogaster
aacaagagaaatg

SEQ ID NO: 556118 - DNA, 13 bp, D. melanogaster
aacaagagcggag

SEQ ID NO: 556119 - DNA, 13 bp, D. melanogaster
aacaagaggggca

SEQ ID NO: 556120 - DNA, 13 bp, D. melanogaster
aacaagagtcact

SEQ ID NO: 556121 - DNA, 13 bp, D. melanogaster
aacaagatcaaca

SEQ ID NO: 556122 - DNA, 14 bp, D. melanogaster
aacaagatcaacaa

SEQ ID NO: 556123 - DNA, 16 bp, D. melanogaster
aacaagatgcgtaacg

SEQ ID NO: 556124 - DNA, 13 bp, D. melanogaster
aacaagattatgt

SEQ ID NO: 556125 - DNA, 13 bp, D. melanogaster
aacaagatttatt

SEQ ID NO: 556126 - DNA, 13 bp, D. melanogaster
aacaagcaacaat

SEQ ID NO: 556127 - DNA, 13 bp, D. melanogaster
aacaagcatgtgg

SEQ ID NO: 556128 - DNA, 14 bp, D. melanogaster
aacaagcatgtgga

SEQ ID NO: 556129 - DNA, 13 bp, D. melanogaster
aacaagcatttag

SEQ ID NO: 556130 - DNA, 13 bp, D. melanogaster
aacaagcctttta

SEQ ID NO: 556131 - DNA, 13 bp, D. melanogaster
aacaagcgaaata

SEQ ID NO: 556132 - DNA, 14 bp, D. melanogaster
aacaagcgacatta

SEQ ID NO: 556133 - DNA, 13 bp, D. melanogaster
aacaagctagtaa

SEQ ID NO: 556134 - DNA, 13 bp, D. melanogaster
aacaagctgcaaa

SEQ ID NO: 556135 - DNA, 13 bp, D. melanogaster
aacaagctggctg

SEQ ID NO: 556136 - DNA, 13 bp, D. melanogaster
aacaaggcatatc

SEQ ID NO: 556137 - DNA, 13 bp, D. melanogaster
aacaagtgaaaat

SEQ ID NO: 556138 - DNA, 13 bp, D. melanogaster
aacaagtgcaaaa

SEQ ID NO: 556139 - DNA, 13 bp, D. melanogaster
aacaagtgcagct

SEQ ID NO: 556140 - DNA, 13 bp, D. melanogaster
aacaagtgccgtt

SEQ ID NO: 556141 - DNA, 13 bp, D. melanogaster
aacaagtggaaaa

SEQ ID NO: 556142 - DNA, 13 bp, D. melanogaster
aacaagtgggtgg

SEQ ID NO: 556143 - DNA, 13 bp, D. melanogaster
aacaagttaatta

SEQ ID NO: 556144 - DNA, 13 bp, D. melanogaster
aacaagttaattt

SEQ ID NO: 556145 - DNA, 13 bp, D. melanogaster
aacaagttcgctc

SEQ ID NO: 556146 - DNA, 13 bp, D. melanogaster
aacaagttcttac

SEQ ID NO: 556147 - DNA, 14 bp, D. melanogaster
aacaagttcttacc

SEQ ID NO: 556148 - DNA, 13 bp, D. melanogaster
aacaagttgctgc

SEQ ID NO: 556149 - DNA, 13 bp, D. melanogaster
aacaagttgctgg

SEQ ID NO: 556150 - DNA, 13 bp, D. melanogaster
aacaagttggaaa

SEQ ID NO: 556151 - DNA, 13 bp, D. melanogaster
aacaagttggcag

SEQ ID NO: 556152 - DNA, 13 bp, D. melanogaster
aacaagtttaaaa

SEQ ID NO: 556153 - DNA, 13 bp, D. melanogaster
aacaagtttaaat

SEQ ID NO: 556154 - DNA, 13 bp, D. melanogaster
aacaagtttgcca

SEQ ID NO: 556155 - DNA, 13 bp, D. melanogaster
aacaagttttatt

SEQ ID NO: 556156 - DNA, 13 bp, D. melanogaster
aacaagtttttaa

SEQ ID NO: 556157 - DNA, 13 bp, D. melanogaster
aacaagtttttgg

SEQ ID NO: 556158 - DNA, 13 bp, D. melanogaster
aacaataaaacgc

SEQ ID NO: 556159 - DNA, 13 bp, D. melanogaster
aacaataaaactg

SEQ ID NO: 556160 - DNA, 13 bp, D. melanogaster
aacaataaaagtt

SEQ ID NO: 556161 - DNA, 13 bp, D. melanogaster
aacaataaaatgc

SEQ ID NO: 556162 - DNA, 13 bp, D. melanogaster
aacaataaaatgt

SEQ ID NO: 556163 - DNA, 14 bp, D. melanogaster
aacaataaaatgta

SEQ ID NO: 556164 - DNA, 13 bp, D. melanogaster
aacaataaactga

SEQ ID NO: 556165 - DNA, 13 bp, D. melanogaster
aacaataaagttt

SEQ ID NO: 556166 - DNA, 13 bp, D. melanogaster
aacaataaatcga

SEQ ID NO: 556167 - DNA, 13 bp, D. melanogaster
aacaataaatgtg

SEQ ID NO: 556168 - DNA, 13 bp, D. melanogaster
aacaataaattgt

SEQ ID NO: 556169 - DNA, 14 bp, D. melanogaster
aacaataacaaatg

SEQ ID NO: 556170 - DNA, 13 bp, D. melanogaster
aacaataacaagc

SEQ ID NO: 556171 - DNA, 13 bp, D. melanogaster
aacaataacaagg

SEQ ID NO: 556172 - DNA, 13 bp, D. melanogaster
aacaataacagca

SEQ ID NO: 556173 - DNA, 14 bp, D. melanogaster
aacaataacagcaa

SEQ ID NO: 556174 - DNA, 13 bp, D. melanogaster
aacaataaccgaa

SEQ ID NO: 556175 - DNA, 13 bp, D. melanogaster
aacaataacttta

SEQ ID NO: 556176 - DNA, 13 bp, D. melanogaster
aacaataaggcag

SEQ ID NO: 556177 - DNA, 13 bp, D. melanogaster
aacaataagtgtt

SEQ ID NO: 556178 - DNA, 13 bp, D. melanogaster
aacaataagttta

SEQ ID NO: 556179 - DNA, 14 bp, D. melanogaster
aacaataagtttaa

SEQ ID NO: 556180 - DNA, 14 bp, D. melanogaster
aacaataataatag

SEQ ID NO: 556181 - DNA, 13 bp, D. melanogaster
aacaataatagta

SEQ ID NO: 556182 - DNA, 13 bp, D. melanogaster
aacaataatattc

SEQ ID NO: 556183 - DNA, 13 bp, D. melanogaster
aacaataatctta

SEQ ID NO: 556184 - DNA, 13 bp, D. melanogaster
aacaataatgata

SEQ ID NO: 556185 - DNA, 13 bp, D. melanogaster
aacaataattatc

SEQ ID NO: 556186 - DNA, 13 bp, D. melanogaster
aacaataattgca

SEQ ID NO: 556187 - DNA, 13 bp, D. melanogaster
aacaataattgtt

SEQ ID NO: 556188 - DNA, 13 bp, D. melanogaster
aacaataatttag

SEQ ID NO: 556189 - DNA, 13 bp, D. melanogaster
aacaataatttcc

SEQ ID NO: 556190 - DNA, 13 bp, D. melanogaster
aacaataatttga

SEQ ID NO: 556191 - DNA, 13 bp, D. melanogaster
aacaatactttaa

SEQ ID NO: 556192 - DNA, 14 bp, D. melanogaster
aacaatagaaaagc

SEQ ID NO: 556193 - DNA, 14 bp, D. melanogaster
aacaatagcaacaa

SEQ ID NO: 556194 - DNA, 13 bp, D. melanogaster
aacaatagcaata

SEQ ID NO: 556195 - DNA, 13 bp, D. melanogaster
aacaatagtatta

SEQ ID NO: 556196 - DNA, 14 bp, D. melanogaster
aacaatagtattag

SEQ ID NO: 556197 - DNA, 13 bp, D. melanogaster
aacaatagttgat

SEQ ID NO: 556198 - DNA, 13 bp, D. melanogaster
aacaatataaatg

SEQ ID NO: 556199 - DNA, 13 bp, D. melanogaster
aacaatatggaat

SEQ ID NO: 556200 - DNA, 13 bp, D. melanogaster
aacaatatgtaat

SEQ ID NO: 556201 - DNA, 14 bp, D. melanogaster
aacaatattacact

SEQ ID NO: 556202 - DNA, 13 bp, D. melanogaster
aacaatattcaga

SEQ ID NO: 556203 - DNA, 13 bp, D. melanogaster
aacaatattgcta

SEQ ID NO: 556204 - DNA, 13 bp, D. melanogaster
aacaatatttagt

SEQ ID NO: 556205 - DNA, 13 bp, D. melanogaster
aacaatatttgca

SEQ ID NO: 556206 - DNA, 13 bp, D. melanogaster
aacaatatttgta

SEQ ID NO: 556207 - DNA, 13 bp, D. melanogaster
aacaatattttca

SEQ ID NO: 556208 - DNA, 14 bp, D. melanogaster
aacaatattttcaa

SEQ ID NO: 556209 - DNA, 13 bp, D. melanogaster
aacaatattttga

SEQ ID NO: 556210 - DNA, 13 bp, D. melanogaster
aacaatattttgt

SEQ ID NO: 556211 - DNA, 13 bp, D. melanogaster
aacaatcaaatga

SEQ ID NO: 556212 - DNA, 13 bp, D. melanogaster
aacaatcaattta

SEQ ID NO: 556213 - DNA, 13 bp, D. melanogaster
aacaatcagtggt

SEQ ID NO: 556214 - DNA, 13 bp, D. melanogaster
aacaatcatttaa

SEQ ID NO: 556215 - DNA, 13 bp, D. melanogaster
aacaatccagttc

SEQ ID NO: 556216 - DNA, 13 bp, D. melanogaster
aacaatcgaaatg

SEQ ID NO: 556217 - DNA, 13 bp, D. melanogaster
aacaatcgaatat

SEQ ID NO: 556218 - DNA, 13 bp, D. melanogaster
aacaatcgcacac

SEQ ID NO: 556219 - DNA, 13 bp, D. melanogaster
aacaatcgccatc

SEQ ID NO: 556220 - DNA, 13 bp, D. melanogaster
aacaatcgcttcg

SEQ ID NO: 556221 - DNA, 13 bp, D. melanogaster
aacaatcgcttgg

SEQ ID NO: 556222 - DNA, 14 bp, D. melanogaster
aacaatcggagaac

SEQ ID NO: 556223 - DNA, 13 bp, D. melanogaster
aacaatcttttgt

SEQ ID NO: 556224 - DNA, 13 bp, D. melanogaster
aacaatgaaatca

SEQ ID NO: 556225 - DNA, 13 bp, D. melanogaster
aacaatgaaatcc

SEQ ID NO: 556226 - DNA, 13 bp, D. melanogaster
aacaatgaaatcg

SEQ ID NO: 556227 - DNA, 13 bp, D. melanogaster
aacaatgaaattg

SEQ ID NO: 556228 - DNA, 13 bp, D. melanogaster
aacaatgaacaat

SEQ ID NO: 556229 - DNA, 14 bp, D. melanogaster
aacaatgaatcaaa

SEQ ID NO: 556230 - DNA, 13 bp, D. melanogaster
aacaatgacaaat

SEQ ID NO: 556231 - DNA, 13 bp, D. melanogaster
aacaatgacaatg

SEQ ID NO: 556232 - DNA, 13 bp, D. melanogaster
aacaatgacaatt

SEQ ID NO: 556233 - DNA, 13 bp, D. melanogaster
aacaatgacagca

SEQ ID NO: 556234 - DNA, 13 bp, D. melanogaster
aacaatgagaaat

SEQ ID NO: 556235 - DNA, 13 bp, D. melanogaster
aacaatgagcaat

SEQ ID NO: 556236 - DNA, 13 bp, D. melanogaster
aacaatgagtgtg

SEQ ID NO: 556237 - DNA, 13 bp, D. melanogaster
aacaatgcaaact

SEQ ID NO: 556238 - DNA, 13 bp, D. melanogaster
aacaatgcaacaa

SEQ ID NO: 556239 - DNA, 13 bp, D. melanogaster
aacaatgcacagc

SEQ ID NO: 556240 - DNA, 13 bp, D. melanogaster
aacaatgccaaaa

SEQ ID NO: 556241 - DNA, 13 bp, D. melanogaster
aacaatgccaaat

SEQ ID NO: 556242 - DNA, 13 bp, D. melanogaster
aacaatgccaatg

SEQ ID NO: 556243 - DNA, 13 bp, D. melanogaster
aacaatgcctccg

SEQ ID NO: 556244 - DNA, 13 bp, D. melanogaster
aacaatgcgaaat

SEQ ID NO: 556245 - DNA, 13 bp, D. melanogaster
aacaatgcggcaa

SEQ ID NO: 556246 - DNA, 13 bp, D. melanogaster
aacaatgctaaaa

SEQ ID NO: 556247 - DNA, 13 bp, D. melanogaster
aacaatgctactg

SEQ ID NO: 556248 - DNA, 13 bp, D. melanogaster
aacaatggaaaac

SEQ ID NO: 556249 - DNA, 13 bp, D. melanogaster
aacaatggaaata

SEQ ID NO: 556250 - DNA, 13 bp, D. melanogaster
aacaatggaaatg

SEQ ID NO: 556251 - DNA, 13 bp, D. melanogaster
aacaatggaaatt

SEQ ID NO: 556252 - DNA, 14 bp, D. melanogaster
aacaatggcaaaca

SEQ ID NO: 556253 - DNA, 13 bp, D. melanogaster
aacaatggcaaat

SEQ ID NO: 556254 - DNA, 13 bp, D. melanogaster
aacaatggcaaca

SEQ ID NO: 556255 - DNA, 14 bp, D. melanogaster
aacaatggcaacaa

SEQ ID NO: 556256 - DNA, 13 bp, D. melanogaster
aacaatggcaact

SEQ ID NO: 556257 - DNA, 13 bp, D. melanogaster
aacaatggcaatt

SEQ ID NO: 556258 - DNA, 13 bp, D. melanogaster
aacaatggccaaa

SEQ ID NO: 556259 - DNA, 14 bp, D. melanogaster
aacaatggccaaaa

SEQ ID NO: 556260 - DNA, 14 bp, D. melanogaster
aacaatggccaaca

SEQ ID NO: 556261 - DNA, 13 bp, D. melanogaster
aacaatggccaca

SEQ ID NO: 556262 - DNA, 13 bp, D. melanogaster
aacaatggccagc

SEQ ID NO: 556263 - DNA, 13 bp, D. melanogaster
aacaatggctggc

SEQ ID NO: 556264 - DNA, 13 bp, D. melanogaster
aacaatgggaaaa

SEQ ID NO: 556265 - DNA, 14 bp, D. melanogaster
aacaatgtaaaata

SEQ ID NO: 556266 - DNA, 13 bp, D. melanogaster
aacaatgtcgaaa

SEQ ID NO: 556267 - DNA, 13 bp, D. melanogaster
aacaatgtctttt

SEQ ID NO: 556268 - DNA, 13 bp, D. melanogaster
aacaatgtgaaaa

SEQ ID NO: 556269 - DNA, 13 bp, D. melanogaster
aacaatgtggaaa

SEQ ID NO: 556270 - DNA, 13 bp, D. melanogaster
aacaatgtttgtt

SEQ ID NO: 556271 - DNA, 13 bp, D. melanogaster
aacaatgttttgt

SEQ ID NO: 556272 - DNA, 13 bp, D. melanogaster
aacaatgttttta

SEQ ID NO: 556273 - DNA, 14 bp, D. melanogaster
aacaattaaaatgt

SEQ ID NO: 556274 - DNA, 13 bp, D. melanogaster
aacaattaaacga

SEQ ID NO: 556275 - DNA, 13 bp, D. melanogaster
aacaattaaagtt

SEQ ID NO: 556276 - DNA, 13 bp, D. melanogaster
aacaattaaatga

SEQ ID NO: 556277 - DNA, 13 bp, D. melanogaster
aacaattaagcca

SEQ ID NO: 556278 - DNA, 13 bp, D. melanogaster
aacaattaatttg

SEQ ID NO: 556279 - DNA, 13 bp, D. melanogaster
aacaattagcaaa

SEQ ID NO: 556280 - DNA, 13 bp, D. melanogaster
aacaattaggaaa

SEQ ID NO: 556281 - DNA, 13 bp, D. melanogaster
aacaattataatg

SEQ ID NO: 556282 - DNA, 13 bp, D. melanogaster
aacaattattgaa

SEQ ID NO: 556283 - DNA, 13 bp, D. melanogaster
aacaattattgac

SEQ ID NO: 556284 - DNA, 13 bp, D. melanogaster
aacaattatttgt

SEQ ID NO: 556285 - DNA, 13 bp, D. melanogaster
aacaattcaattt

SEQ ID NO: 556286 - DNA, 13 bp, D. melanogaster
aacaattcattta

SEQ ID NO: 556287 - DNA, 15 bp, D. melanogaster
aacaattccaaaata

SEQ ID NO: 556288 - DNA, 13 bp, D. melanogaster
aacaattccaatt

SEQ ID NO: 556289 - DNA, 14 bp, D. melanogaster
aacaattccatctg

SEQ ID NO: 556290 - DNA, 13 bp, D. melanogaster
aacaattccattt

SEQ ID NO: 556291 - DNA, 13 bp, D. melanogaster
aacaattcgattt

SEQ ID NO: 556292 - DNA, 13 bp, D. melanogaster
aacaattcgctta

SEQ ID NO: 556293 - DNA, 13 bp, D. melanogaster
aacaattgaaaat

SEQ ID NO: 556294 - DNA, 13 bp, D. melanogaster
aacaattgaaact

SEQ ID NO: 556295 - DNA, 13 bp, D. melanogaster
aacaattgaaatc

SEQ ID NO: 556296 - DNA, 13 bp, D. melanogaster
aacaattgaacaa

SEQ ID NO: 556297 - DNA, 13 bp, D. melanogaster
aacaattgaagaa

SEQ ID NO: 556298 - DNA, 13 bp, D. melanogaster
aacaattgaatta

SEQ ID NO: 556299 - DNA, 13 bp, D. melanogaster
aacaattgcaaca

SEQ ID NO: 556300 - DNA, 13 bp, D. melanogaster
aacaattgcataa

SEQ ID NO: 556301 - DNA, 13 bp, D. melanogaster
aacaattgccaaa

SEQ ID NO: 556302 - DNA, 13 bp, D. melanogaster
aacaattgccaat

SEQ ID NO: 556303 - DNA, 13 bp, D. melanogaster
aacaattgccatt

SEQ ID NO: 556304 - DNA, 13 bp, D. melanogaster
aacaattgctttt

SEQ ID NO: 556305 - DNA, 13 bp, D. melanogaster
aacaattggccaa

SEQ ID NO: 556306 - DNA, 13 bp, D. melanogaster
aacaattgtgcaa

SEQ ID NO: 556307 - DNA, 13 bp, D. melanogaster
aacaattgttaaa

SEQ ID NO: 556308 - DNA, 13 bp, D. melanogaster
aacaattgtttat

SEQ ID NO: 556309 - DNA, 13 bp, D. melanogaster
aacaattgtttga

SEQ ID NO: 556310 - DNA, 14 bp, D. melanogaster
aacaattgtttgat

SEQ ID NO: 556311 - DNA, 13 bp, D. melanogaster
aacaattgtttgc

SEQ ID NO: 556312 - DNA, 13 bp, D. melanogaster
aacaattgttttc

SEQ ID NO: 556313 - DNA, 13 bp, D. melanogaster
aacaatttaaaga

SEQ ID NO: 556314 - DNA, 13 bp, D. melanogaster
aacaatttaaatg

SEQ ID NO: 556315 - DNA, 13 bp, D. melanogaster
aacaatttaatac

SEQ ID NO: 556316 - DNA, 13 bp, D. melanogaster
aacaatttacaag

SEQ ID NO: 556317 - DNA, 13 bp, D. melanogaster
aacaatttacaat

SEQ ID NO: 556318 - DNA, 13 bp, D. melanogaster
aacaatttagaaa

SEQ ID NO: 556319 - DNA, 13 bp, D. melanogaster
aacaatttatcaa

SEQ ID NO: 556320 - DNA, 13 bp, D. melanogaster
aacaatttatgta

SEQ ID NO: 556321 - DNA, 13 bp, D. melanogaster
aacaatttatgtt

SEQ ID NO: 556322 - DNA, 13 bp, D. melanogaster
aacaatttcaatg

SEQ ID NO: 556323 - DNA, 13 bp, D. melanogaster
aacaatttcaatt

SEQ ID NO: 556324 - DNA, 13 bp, D. melanogaster
aacaatttcactt

SEQ ID NO: 556325 - DNA, 13 bp, D. melanogaster
aacaatttcatct

SEQ ID NO: 556326 - DNA, 14 bp, D. melanogaster
aacaatttcattct

SEQ ID NO: 556327 - DNA, 13 bp, D. melanogaster
aacaatttcattt

SEQ ID NO: 556328 - DNA, 13 bp, D. melanogaster
aacaatttccaaa

SEQ ID NO: 556329 - DNA, 13 bp, D. melanogaster
aacaatttccaca

SEQ ID NO: 556330 - DNA, 13 bp, D. melanogaster
aacaatttccact

SEQ ID NO: 556331 - DNA, 13 bp, D. melanogaster
aacaatttccatt

SEQ ID NO: 556332 - DNA, 13 bp, D. melanogaster
aacaatttcccca

SEQ ID NO: 556333 - DNA, 13 bp, D. melanogaster
aacaatttccttt

SEQ ID NO: 556334 - DNA, 13 bp, D. melanogaster
aacaatttcgaat

SEQ ID NO: 556335 - DNA, 13 bp, D. melanogaster
aacaatttcgaca

SEQ ID NO: 556336 - DNA, 13 bp, D. melanogaster
aacaatttcggtt

SEQ ID NO: 556337 - DNA, 13 bp, D. melanogaster
aacaatttctaaa

SEQ ID NO: 556338 - DNA, 14 bp, D. melanogaster
aacaatttctacaa

SEQ ID NO: 556339 - DNA, 14 bp, D. melanogaster
aacaatttctatgt

SEQ ID NO: 556340 - DNA, 13 bp, D. melanogaster
aacaatttctttc

SEQ ID NO: 556341 - DNA, 13 bp, D. melanogaster
aacaatttgaaaa

SEQ ID NO: 556342 - DNA, 14 bp, D. melanogaster
aacaatttgaaaat

SEQ ID NO: 556343 - DNA, 13 bp, D. melanogaster
aacaatttgaaag

SEQ ID NO: 556344 - DNA, 13 bp, D. melanogaster
aacaatttgaatt

SEQ ID NO: 556345 - DNA, 13 bp, D. melanogaster
aacaatttgcaaa

SEQ ID NO: 556346 - DNA, 13 bp, D. melanogaster
aacaatttgcagc

SEQ ID NO: 556347 - DNA, 13 bp, D. melanogaster
aacaatttgcatt

SEQ ID NO: 556348 - DNA, 13 bp, D. melanogaster
aacaatttgccac

SEQ ID NO: 556349 - DNA, 13 bp, D. melanogaster
aacaatttgccca

SEQ ID NO: 556350 - DNA, 13 bp, D. melanogaster
aacaatttgcttt

SEQ ID NO: 556351 - DNA, 13 bp, D. melanogaster
aacaatttggcaa

SEQ ID NO: 556352 - DNA, 13 bp, D. melanogaster
aacaatttgtaca

SEQ ID NO: 556353 - DNA, 14 bp, D. melanogaster
aacaatttgtacat

SEQ ID NO: 556354 - DNA, 13 bp, D. melanogaster
aacaatttgtata

SEQ ID NO: 556355 - DNA, 13 bp, D. melanogaster
aacaatttgtgaa

SEQ ID NO: 556356 - DNA, 13 bp, D. melanogaster
aacaatttgtggc

SEQ ID NO: 556357 - DNA, 14 bp, D. melanogaster
aacaatttgttaaa

SEQ ID NO: 556358 - DNA, 13 bp, D. melanogaster
aacaatttgttga

SEQ ID NO: 556359 - DNA, 13 bp, D. melanogaster
aacaatttgttgg

SEQ ID NO: 556360 - DNA, 14 bp, D. melanogaster
aacaatttgttgtt

SEQ ID NO: 556361 - DNA, 13 bp, D. melanogaster
aacaatttgtttt

SEQ ID NO: 556362 - DNA, 14 bp, D. melanogaster
aacaattttaattg

SEQ ID NO: 556363 - DNA, 13 bp, D. melanogaster
aacaattttagtt

SEQ ID NO: 556364 - DNA, 13 bp, D. melanogaster
aacaattttatga

SEQ ID NO: 556365 - DNA, 13 bp, D. melanogaster
aacaattttatgg

SEQ ID NO: 556366 - DNA, 13 bp, D. melanogaster
aacaattttattg

SEQ ID NO: 556367 - DNA, 13 bp, D. melanogaster
aacaattttcaaa

SEQ ID NO: 556368 - DNA, 13 bp, D. melanogaster
aacaattttcaac

SEQ ID NO: 556369 - DNA, 13 bp, D. melanogaster
aacaattttcaag

SEQ ID NO: 556370 - DNA, 13 bp, D. melanogaster
aacaattttcaat

SEQ ID NO: 556371 - DNA, 13 bp, D. melanogaster
aacaattttcata

SEQ ID NO: 556372 - DNA, 13 bp, D. melanogaster
aacaattttccct

SEQ ID NO: 556373 - DNA, 13 bp, D. melanogaster
aacaattttcgaa

SEQ ID NO: 556374 - DNA, 14 bp, D. melanogaster
aacaattttctgcc

SEQ ID NO: 556375 - DNA, 14 bp, D. melanogaster
aacaattttgaaat

SEQ ID NO: 556376 - DNA, 13 bp, D. melanogaster
aacaattttgaat

SEQ ID NO: 556377 - DNA, 13 bp, D. melanogaster
aacaattttgaca

SEQ ID NO: 556378 - DNA, 14 bp, D. melanogaster
aacaattttgacaa

SEQ ID NO: 556379 - DNA, 13 bp, D. melanogaster
aacaattttgatt

SEQ ID NO: 556380 - DNA, 14 bp, D. melanogaster
aacaattttgcata

SEQ ID NO: 556381 - DNA, 13 bp, D. melanogaster
aacaattttggaa

SEQ ID NO: 556382 - DNA, 13 bp, D. melanogaster
aacaatttttaca

SEQ ID NO: 556383 - DNA, 13 bp, D. melanogaster
aacaatttttatg

SEQ ID NO: 556384 - DNA, 13 bp, D. melanogaster
aacaatttttctt

SEQ ID NO: 556385 - DNA, 14 bp, D. melanogaster
aacaatttttgtat

SEQ ID NO: 556386 - DNA, 13 bp, D. melanogaster
aacaattttttgc

SEQ ID NO: 556387 - DNA, 13 bp, D. melanogaster
aacaattttttgt

SEQ ID NO: 556388 - DNA, 14 bp, D. melanogaster
aacaattttttgtt

SEQ ID NO: 556389 - DNA, 13 bp, D. melanogaster
aacacaaaaatgg

SEQ ID NO: 556390 - DNA, 13 bp, D. melanogaster
aacacaaaaatgt

SEQ ID NO: 556391 - DNA, 14 bp, D. melanogaster
aacacaaaaatgtt

SEQ ID NO: 556392 - DNA, 13 bp, D. melanogaster
aacacaaaagtta

SEQ ID NO: 556393 - DNA, 13 bp, D. melanogaster
aacacaaaatgcg

SEQ ID NO: 556394 - DNA, 13 bp, D. melanogaster
aacacaaacaatg

SEQ ID NO: 556395 - DNA, 13 bp, D. melanogaster
aacacaaactgaa

SEQ ID NO: 556396 - DNA, 13 bp, D. melanogaster
aacacaaataatg

SEQ ID NO: 556397 - DNA, 13 bp, D. melanogaster
aacacaacaattt

SEQ ID NO: 556398 - DNA, 13 bp, D. melanogaster
aacacaacgttat

SEQ ID NO: 556399 - DNA, 13 bp, D. melanogaster
aacacaactgtac

SEQ ID NO: 556400 - DNA, 13 bp, D. melanogaster
aacacaagtgttt

SEQ ID NO: 556401 - DNA, 13 bp, D. melanogaster
aacacaataaacg

SEQ ID NO: 556402 - DNA, 13 bp, D. melanogaster
aacacaatatttt

SEQ ID NO: 556403 - DNA, 13 bp, D. melanogaster
aacacaatgcaaa

SEQ ID NO: 556404 - DNA, 13 bp, D. melanogaster
aacacaatgccaa

SEQ ID NO: 556405 - DNA, 13 bp, D. melanogaster
aacacaatggcag

SEQ ID NO: 556406 - DNA, 13 bp, D. melanogaster
aacacaattattt

SEQ ID NO: 556407 - DNA, 13 bp, D. melanogaster
aacacaattgtca

SEQ ID NO: 556408 - DNA, 13 bp, D. melanogaster
aacacaattttaa

SEQ ID NO: 556409 - DNA, 13 bp, D. melanogaster
aacacaatttttg

SEQ ID NO: 556410 - DNA, 13 bp, D. melanogaster
aacacaatttttt

SEQ ID NO: 556411 - DNA, 13 bp, D. melanogaster
aacacacaaaatg

SEQ ID NO: 556412 - DNA, 13 bp, D. melanogaster
aacacacaaattt

SEQ ID NO: 556413 - DNA, 14 bp, D. melanogaster
aacacacacacatg

SEQ ID NO: 556414 - DNA, 14 bp, D. melanogaster
aacacacacacatt

SEQ ID NO: 556415 - DNA, 14 bp, D. melanogaster
aacacacacacgcg

SEQ ID NO: 556416 - DNA, 13 bp, D. melanogaster
aacacacacaggc

SEQ ID NO: 556417 - DNA, 13 bp, D. melanogaster
aacacacacatat

SEQ ID NO: 556418 - DNA, 13 bp, D. melanogaster
aacacacacattg

SEQ ID NO: 556419 - DNA, 13 bp, D. melanogaster
aacacacactctc

SEQ ID NO: 556420 - DNA, 13 bp, D. melanogaster
aacacacagacag

SEQ ID NO: 556421 - DNA, 13 bp, D. melanogaster
aacacacagatac

SEQ ID NO: 556422 - DNA, 16 bp, D. melanogaster
aacacacagtataaat

SEQ ID NO: 556423 - DNA, 13 bp, D. melanogaster
aacacacatatat

SEQ ID NO: 556424 - DNA, 13 bp, D. melanogaster
aacacacatgcga

SEQ ID NO: 556425 - DNA, 13 bp, D. melanogaster
aacacacatttaa

SEQ ID NO: 556426 - DNA, 13 bp, D. melanogaster
aacacacatttat

SEQ ID NO: 556427 - DNA, 13 bp, D. melanogaster
aacacacatttca

SEQ ID NO: 556428 - DNA, 13 bp, D. melanogaster
aacacacattttc

SEQ ID NO: 556429 - DNA, 15 bp, D. melanogaster
aacacacgaaatcga

SEQ ID NO: 556430 - DNA, 14 bp, D. melanogaster
aacacacgcacacg

SEQ ID NO: 556431 - DNA, 13 bp, D. melanogaster
aacacacgcacag

SEQ ID NO: 556432 - DNA, 13 bp, D. melanogaster
aacacacgcacat

SEQ ID NO: 556433 - DNA, 13 bp, D. melanogaster
aacacacgcgcac

SEQ ID NO: 556434 - DNA, 14 bp, D. melanogaster
aacacagcagcagc

SEQ ID NO: 556435 - DNA, 13 bp, D. melanogaster
aacacaggcaact

SEQ ID NO: 556436 - DNA, 13 bp, D. melanogaster
aacacagtttgat

SEQ ID NO: 556437 - DNA, 13 bp, D. melanogaster
aacacataatttt

SEQ ID NO: 556438 - DNA, 13 bp, D. melanogaster
aacacatacacat

SEQ ID NO: 556439 - DNA, 13 bp, D. melanogaster
aacacatacatat

SEQ ID NO: 556440 - DNA, 13 bp, D. melanogaster
aacacatacgaaa

SEQ ID NO: 556441 - DNA, 13 bp, D. melanogaster
aacacatatatat

SEQ ID NO: 556442 - DNA, 13 bp, D. melanogaster
aacacatatattt

SEQ ID NO: 556443 - DNA, 13 bp, D. melanogaster
aacacatattttg

SEQ ID NO: 556444 - DNA, 13 bp, D. melanogaster
aacacatcactat

SEQ ID NO: 556445 - DNA, 14 bp, D. melanogaster
aacacatgcacaac

SEQ ID NO: 556446 - DNA, 13 bp, D. melanogaster
aacacatgccaca

SEQ ID NO: 556447 - DNA, 13 bp, D. melanogaster
aacacatggaaaa

SEQ ID NO: 556448 - DNA, 13 bp, D. melanogaster
aacacattcacac

SEQ ID NO: 556449 - DNA, 13 bp, D. melanogaster
aacacattcacat

SEQ ID NO: 556450 - DNA, 13 bp, D. melanogaster
aacacattcattt

SEQ ID NO: 556451 - DNA, 13 bp, D. melanogaster
aacacattcttca

SEQ ID NO: 556452 - DNA, 14 bp, D. melanogaster
aacacattcttcag

SEQ ID NO: 556453 - DNA, 13 bp, D. melanogaster
aacacattgtggc

SEQ ID NO: 556454 - DNA, 13 bp, D. melanogaster
aacacatttataa

SEQ ID NO: 556455 - DNA, 13 bp, D. melanogaster
aacacatttccaa

SEQ ID NO: 556456 - DNA, 13 bp, D. melanogaster
aacacatttccca

SEQ ID NO: 556457 - DNA, 13 bp, D. melanogaster
aacacatttgttt

SEQ ID NO: 556458 - DNA, 14 bp, D. melanogaster
aacacatttgtttg

SEQ ID NO: 556459 - DNA, 13 bp, D. melanogaster
aacacattttaaa

SEQ ID NO: 556460 - DNA, 13 bp, D. melanogaster
aacacattttcct

SEQ ID NO: 556461 - DNA, 13 bp, D. melanogaster
aacacattttctt

SEQ ID NO: 556462 - DNA, 13 bp, D. melanogaster
aacacattttgga

SEQ ID NO: 556463 - DNA, 13 bp, D. melanogaster
aacacattttgta

SEQ ID NO: 556464 - DNA, 15 bp, D. melanogaster
aacacattttgtagg

SEQ ID NO: 556465 - DNA, 13 bp, D. melanogaster
aacaccaatgcaa

SEQ ID NO: 556466 - DNA, 14 bp, D. melanogaster
aacaccaatgcaag

SEQ ID NO: 556467 - DNA, 13 bp, D. melanogaster
aacaccaccactt

SEQ ID NO: 556468 - DNA, 13 bp, D. melanogaster
aacaccagaattt

SEQ ID NO: 556469 - DNA, 14 bp, D. melanogaster
aacaccagaatttc

SEQ ID NO: 556470 - DNA, 13 bp, D. melanogaster
aacaccatcagcc

SEQ ID NO: 556471 - DNA, 13 bp, D. melanogaster
aacacccagatgg

SEQ ID NO: 556472 - DNA, 13 bp, D. melanogaster
aacacccatgtgt

SEQ ID NO: 556473 - DNA, 13 bp, D. melanogaster
aacaccggaaatg

SEQ ID NO: 556474 - DNA, 13 bp, D. melanogaster
aacacctccaatt

SEQ ID NO: 556475 - DNA, 13 bp, D. melanogaster
aacacgaaatgct

SEQ ID NO: 556476 - DNA, 13 bp, D. melanogaster
aacacgaaatttc

SEQ ID NO: 556477 - DNA, 13 bp, D. melanogaster
aacacgaacacga

SEQ ID NO: 556478 - DNA, 13 bp, D. melanogaster
aacacgaatgctc

SEQ ID NO: 556479 - DNA, 13 bp, D. melanogaster
aacacgatgaata

SEQ ID NO: 556480 - DNA, 13 bp, D. melanogaster
aacacgcacacat

SEQ ID NO: 556481 - DNA, 13 bp, D. melanogaster
aacacgcacactc

SEQ ID NO: 556482 - DNA, 13 bp, D. melanogaster
aacacgcacgcac

SEQ ID NO: 556483 - DNA, 13 bp, D. melanogaster
aacacgcatacac

SEQ ID NO: 556484 - DNA, 13 bp, D. melanogaster
aacacgctgaaga

SEQ ID NO: 556485 - DNA, 14 bp, D. melanogaster
aacacgctgaagat

SEQ ID NO: 556486 - DNA, 13 bp, D. melanogaster
aacacggccaaaa

SEQ ID NO: 556487 - DNA, 13 bp, D. melanogaster
aacacggccggca

SEQ ID NO: 556488 - DNA, 13 bp, D. melanogaster
aacacgtatacgc

SEQ ID NO: 556489 - DNA, 13 bp, D. melanogaster
aacacgtttttca

SEQ ID NO: 556490 - DNA, 13 bp, D. melanogaster
aacactattatta

SEQ ID NO: 556491 - DNA, 13 bp, D. melanogaster
aacactcatacgc

SEQ ID NO: 556492 - DNA, 13 bp, D. melanogaster
aacactcgcacac

SEQ ID NO: 556493 - DNA, 14 bp, D. melanogaster
aacactcgcacaca

SEQ ID NO: 556494 - DNA, 13 bp, D. melanogaster
aacactcggaaaa

SEQ ID NO: 556495 - DNA, 13 bp, D. melanogaster
aacactgcaagaa

SEQ ID NO: 556496 - DNA, 13 bp, D. melanogaster
aacactgcaataa

SEQ ID NO: 556497 - DNA, 13 bp, D. melanogaster
aacactgggaaaa

SEQ ID NO: 556498 - DNA, 13 bp, D. melanogaster
aacactgtttcaa

SEQ ID NO: 556499 - DNA, 13 bp, D. melanogaster
aacacttaaaatt

SEQ ID NO: 556500 - DNA, 13 bp, D. melanogaster
aacacttcagttt

SEQ ID NO: 556501 - DNA, 14 bp, D. melanogaster
aacacttcagtttt

SEQ ID NO: 556502 - DNA, 14 bp, D. melanogaster
aacacttcatacac

SEQ ID NO: 556503 - DNA, 13 bp, D. melanogaster
aacacttcccaga

SEQ ID NO: 556504 - DNA, 13 bp, D. melanogaster
aacacttgaaaat

SEQ ID NO: 556505 - DNA, 13 bp, D. melanogaster
aacacttgaaact

SEQ ID NO: 556506 - DNA, 13 bp, D. melanogaster
aacactttataaa

SEQ ID NO: 556507 - DNA, 13 bp, D. melanogaster
aacactttcaatt

SEQ ID NO: 556508 - DNA, 13 bp, D. melanogaster
aacactttcgttt

SEQ ID NO: 556509 - DNA, 13 bp, D. melanogaster
aacactttgaaaa

SEQ ID NO: 556510 - DNA, 14 bp, D. melanogaster
aacactttgaaagt

SEQ ID NO: 556511 - DNA, 13 bp, D. melanogaster
aacactttgaaat

SEQ ID NO: 556512 - DNA, 13 bp, D. melanogaster
aacactttggcca

SEQ ID NO: 556513 - DNA, 13 bp, D. melanogaster
aacacttttaata

SEQ ID NO: 556514 - DNA, 13 bp, D. melanogaster
aacacttttcaaa

SEQ ID NO: 556515 - DNA, 14 bp, D. melanogaster
aacacttttgaaaa

SEQ ID NO: 556516 - DNA, 13 bp, D. melanogaster
aacactttttaaa

SEQ ID NO: 556517 - DNA, 14 bp, D. melanogaster
aacactttttaaaa

SEQ ID NO: 556518 - DNA, 13 bp, D. melanogaster
aacactttttgaa

SEQ ID NO: 556519 - DNA, 13 bp, D. melanogaster
aacactttttgcc

SEQ ID NO: 556520 - DNA, 13 bp, D. melanogaster
aacacttttttaa

SEQ ID NO: 556521 - DNA, 13 bp, D. melanogaster
aacacttttttat

SEQ ID NO: 556522 - DNA, 13 bp, D. melanogaster
aacagaaaacttt

SEQ ID NO: 556523 - DNA, 13 bp, D. melanogaster
aacagaaaagttt

SEQ ID NO: 556524 - DNA, 13 bp, D. melanogaster
aacagaaaatatg

SEQ ID NO: 556525 - DNA, 14 bp, D. melanogaster
aacagaaacaatgc

SEQ ID NO: 556526 - DNA, 13 bp, D. melanogaster
aacagaaacaatt

SEQ ID NO: 556527 - DNA, 13 bp, D. melanogaster
aacagaaacagat

SEQ ID NO: 556528 - DNA, 13 bp, D. melanogaster
aacagaaacaggc

SEQ ID NO: 556529 - DNA, 13 bp, D. melanogaster
aacagaaacattt

SEQ ID NO: 556530 - DNA, 16 bp, D. melanogaster
aacagaaacgccagca

SEQ ID NO: 556531 - DNA, 14 bp, D. melanogaster
aacagaaactgaaa

SEQ ID NO: 556532 - DNA, 13 bp, D. melanogaster
aacagaaactgca

SEQ ID NO: 556533 - DNA, 13 bp, D. melanogaster
aacagaaatatat

SEQ ID NO: 556534 - DNA, 13 bp, D. melanogaster
aacagaaatgaag

SEQ ID NO: 556535 - DNA, 13 bp, D. melanogaster
aacagaaattcaa

SEQ ID NO: 556536 - DNA, 14 bp, D. melanogaster
aacagaaattcaaa

SEQ ID NO: 556537 - DNA, 13 bp, D. melanogaster
aacagaaatttca

SEQ ID NO: 556538 - DNA, 13 bp, D. melanogaster
aacagaaccaata

SEQ ID NO: 556539 - DNA, 13 bp, D. melanogaster
aacagaacggaac

SEQ ID NO: 556540 - DNA, 13 bp, D. melanogaster
aacagaactgaac

SEQ ID NO: 556541 - DNA, 13 bp, D. melanogaster
aacagaagatgtt

SEQ ID NO: 556542 - DNA, 14 bp, D. melanogaster
aacagaagcagcag

SEQ ID NO: 556543 - DNA, 13 bp, D. melanogaster
aacagaagctgaa

SEQ ID NO: 556544 - DNA, 13 bp, D. melanogaster
aacagaagctgca

SEQ ID NO: 556545 - DNA, 13 bp, D. melanogaster
aacagaatagaac

SEQ ID NO: 556546 - DNA, 13 bp, D. melanogaster
aacagaatatata

SEQ ID NO: 556547 - DNA, 13 bp, D. melanogaster
aacagaatcagaa

SEQ ID NO: 556548 - DNA, 14 bp, D. melanogaster
aacagaatggggaa

SEQ ID NO: 556549 - DNA, 13 bp, D. melanogaster
aacagaattaatg

SEQ ID NO: 556550 - DNA, 13 bp, D. melanogaster
aacagaattccta

SEQ ID NO: 556551 - DNA, 13 bp, D. melanogaster
aacagaatttatg

SEQ ID NO: 556552 - DNA, 13 bp, D. melanogaster
aacagaattttaa

SEQ ID NO: 556553 - DNA, 13 bp, D. melanogaster
aacagaatttttt

SEQ ID NO: 556554 - DNA, 13 bp, D. melanogaster
aacagacagacag

SEQ ID NO: 556555 - DNA, 13 bp, D. melanogaster
aacagacagcagc

SEQ ID NO: 556556 - DNA, 13 bp, D. melanogaster
aacagacagccag

SEQ ID NO: 556557 - DNA, 13 bp, D. melanogaster
aacagaggcaaca

SEQ ID NO: 556558 - DNA, 13 bp, D. melanogaster
aacagaggtaatg

SEQ ID NO: 556559 - DNA, 13 bp, D. melanogaster
aacagagtgtttg

SEQ ID NO: 556560 - DNA, 13 bp, D. melanogaster
aacagatacagat

SEQ ID NO: 556561 - DNA, 14 bp, D. melanogaster
aacagatacagata

SEQ ID NO: 556562 - DNA, 13 bp, D. melanogaster
aacagatatatat

SEQ ID NO: 556563 - DNA, 14 bp, D. melanogaster
aacagatatatatg

SEQ ID NO: 556564 - DNA, 13 bp, D. melanogaster
aacagatcaacac

SEQ ID NO: 556565 - DNA, 13 bp, D. melanogaster
aacagatgttcca

SEQ ID NO: 556566 - DNA, 13 bp, D. melanogaster
aacagatttaaaa

SEQ ID NO: 556567 - DNA, 13 bp, D. melanogaster
aacagcaaaaagt

SEQ ID NO: 556568 - DNA, 13 bp, D. melanogaster
aacagcaaaaatt

SEQ ID NO: 556569 - DNA, 13 bp, D. melanogaster
aacagcaaacagc

SEQ ID NO: 556570 - DNA, 13 bp, D. melanogaster
aacagcaaacagt

SEQ ID NO: 556571 - DNA, 13 bp, D. melanogaster
aacagcaaacgga

SEQ ID NO: 556572 - DNA, 13 bp, D. melanogaster
aacagcaaactgc

SEQ ID NO: 556573 - DNA, 13 bp, D. melanogaster
aacagcaaataca

SEQ ID NO: 556574 - DNA, 13 bp, D. melanogaster
aacagcaaatgca

SEQ ID NO: 556575 - DNA, 13 bp, D. melanogaster
aacagcaaatttt

SEQ ID NO: 556576 - DNA, 14 bp, D. melanogaster
aacagcaacaagga

SEQ ID NO: 556577 - DNA, 15 bp, D. melanogaster
aacagcaacaataac

SEQ ID NO: 556578 - DNA, 13 bp, D. melanogaster
aacagcaacaatg

SEQ ID NO: 556579 - DNA, 14 bp, D. melanogaster
aacagcaacagcac

SEQ ID NO: 556580 - DNA, 14 bp, D. melanogaster
aacagcaacagcga

SEQ ID NO: 556581 - DNA, 14 bp, D. melanogaster
aacagcaacatcaa

SEQ ID NO: 556582 - DNA, 14 bp, D. melanogaster
aacagcaacatcat

SEQ ID NO: 556583 - DNA, 13 bp, D. melanogaster
aacagcaacatct

SEQ ID NO: 556584 - DNA, 13 bp, D. melanogaster
aacagcaacatgc

SEQ ID NO: 556585 - DNA, 13 bp, D. melanogaster
aacagcaacattt

SEQ ID NO: 556586 - DNA, 13 bp, D. melanogaster
aacagcaacggaa

SEQ ID NO: 556587 - DNA, 13 bp, D. melanogaster
aacagcaacggca

SEQ ID NO: 556588 - DNA, 14 bp, D. melanogaster
aacagcaacggcaa

SEQ ID NO: 556589 - DNA, 13 bp, D. melanogaster
aacagcaactgaa

SEQ ID NO: 556590 - DNA, 14 bp, D. melanogaster
aacagcaactgcaa

SEQ ID NO: 556591 - DNA, 13 bp, D. melanogaster
aacagcaactgtt

SEQ ID NO: 556592 - DNA, 13 bp, D. melanogaster
aacagcaagggaa

SEQ ID NO: 556593 - DNA, 14 bp, D. melanogaster
aacagcaagggaat

SEQ ID NO: 556594 - DNA, 13 bp, D. melanogaster
aacagcaagtgaa

SEQ ID NO: 556595 - DNA, 14 bp, D. melanogaster
aacagcaatagcaa

SEQ ID NO: 556596 - DNA, 15 bp, D. melanogaster
aacagcaatagcaac

SEQ ID NO: 556597 - DNA, 14 bp, D. melanogaster
aacagcaatattga

SEQ ID NO: 556598 - DNA, 14 bp, D. melanogaster
aacagcaatggcaa

SEQ ID NO: 556599 - DNA, 13 bp, D. melanogaster
aacagcaattaaa

SEQ ID NO: 556600 - DNA, 13 bp, D. melanogaster
aacagcaattgaa

SEQ ID NO: 556601 - DNA, 13 bp, D. melanogaster
aacagcaattgca

SEQ ID NO: 556602 - DNA, 13 bp, D. melanogaster
aacagcaatttaa

SEQ ID NO: 556603 - DNA, 13 bp, D. melanogaster
aacagcaatttca

SEQ ID NO: 556604 - DNA, 13 bp, D. melanogaster
aacagcaccagca

SEQ ID NO: 556605 - DNA, 13 bp, D. melanogaster
aacagcagaatat

SEQ ID NO: 556606 - DNA, 13 bp, D. melanogaster
aacagcagagcac

SEQ ID NO: 556607 - DNA, 13 bp, D. melanogaster
aacagcagcaaac

SEQ ID NO: 556608 - DNA, 14 bp, D. melanogaster
aacagcagcaacac

SEQ ID NO: 556609 - DNA, 14 bp, D. melanogaster
aacagcagcaacag

SEQ ID NO: 556610 - DNA, 14 bp, D. melanogaster
aacagcagcaacat

SEQ ID NO: 556611 - DNA, 14 bp, D. melanogaster
aacagcagcagaaa

SEQ ID NO: 556612 - DNA, 15 bp, D. melanogaster
aacagcagcagcaaa

SEQ ID NO: 556613 - DNA, 19 bp, D. melanogaster
aacagcagcagcagaagca

SEQ ID NO: 556614 - DNA, 13 bp, D. melanogaster
aacagcagcagcc

SEQ ID NO: 556615 - DNA, 13 bp, D. melanogaster
aacagcagcagct

SEQ ID NO: 556616 - DNA, 15 bp, D. melanogaster
aacagcagcagctgc

SEQ ID NO: 556617 - DNA, 14 bp, D. melanogaster
aacagcagcaggag

SEQ ID NO: 556618 - DNA, 13 bp, D. melanogaster
aacagcagcagtt

SEQ ID NO: 556619 - DNA, 13 bp, D. melanogaster
aacagcagcatca

SEQ ID NO: 556620 - DNA, 13 bp, D. melanogaster
aacagcagccaac

SEQ ID NO: 556621 - DNA, 13 bp, D. melanogaster
aacagcagccact

SEQ ID NO: 556622 - DNA, 13 bp, D. melanogaster
aacagcagccatt

SEQ ID NO: 556623 - DNA, 13 bp, D. melanogaster
aacagcagcggca

SEQ ID NO: 556624 - DNA, 14 bp, D. melanogaster
aacagcagcggcaa

SEQ ID NO: 556625 - DNA, 13 bp, D. melanogaster
aacagcagctaca

SEQ ID NO: 556626 - DNA, 13 bp, D. melanogaster
aacagcaggagca

SEQ ID NO: 556627 - DNA, 14 bp, D. melanogaster
aacagcagtagcaa

SEQ ID NO: 556628 - DNA, 13 bp, D. melanogaster
aacagcatactca

SEQ ID NO: 556629 - DNA, 14 bp, D. melanogaster
aacagcatactcat

SEQ ID NO: 556630 - DNA, 13 bp, D. melanogaster
aacagcatcaaaa

SEQ ID NO: 556631 - DNA, 13 bp, D. melanogaster
aacagcatcaaca

SEQ ID NO: 556632 - DNA, 13 bp, D. melanogaster
aacagcatttgat

SEQ ID NO: 556633 - DNA, 13 bp, D. melanogaster
aacagcattttcc

SEQ ID NO: 556634 - DNA, 13 bp, D. melanogaster
aacagccaacagc

SEQ ID NO: 556635 - DNA, 13 bp, D. melanogaster
aacagccaatggc

SEQ ID NO: 556636 - DNA, 13 bp, D. melanogaster
aacagccacgccc

SEQ ID NO: 556637 - DNA, 13 bp, D. melanogaster
aacagccggcaaa

SEQ ID NO: 556638 - DNA, 13 bp, D. melanogaster
aacagcgaacaca

SEQ ID NO: 556639 - DNA, 13 bp, D. melanogaster
aacagcgaatgtc

SEQ ID NO: 556640 - DNA, 13 bp, D. melanogaster
aacagcgcggcaa

SEQ ID NO: 556641 - DNA, 13 bp, D. melanogaster
aacagcggcaaaa

SEQ ID NO: 556642 - DNA, 13 bp, D. melanogaster
aacagcggcaaca

SEQ ID NO: 556643 - DNA, 13 bp, D. melanogaster
aacagctaacagc

SEQ ID NO: 556644 - DNA, 13 bp, D. melanogaster
aacagctacaaaa

SEQ ID NO: 556645 - DNA, 13 bp, D. melanogaster
aacagctcttttc

SEQ ID NO: 556646 - DNA, 14 bp, D. melanogaster
aacagctcttttca

SEQ ID NO: 556647 - DNA, 13 bp, D. melanogaster
aacagctgaaaaa

SEQ ID NO: 556648 - DNA, 13 bp, D. melanogaster
aacagctgcaaca

SEQ ID NO: 556649 - DNA, 13 bp, D. melanogaster
aacagctgccgca

SEQ ID NO: 556650 - DNA, 13 bp, D. melanogaster
aacagctgctgca

SEQ ID NO: 556651 - DNA, 13 bp, D. melanogaster
aacagctggagag

SEQ ID NO: 556652 - DNA, 13 bp, D. melanogaster
aacagctggcagc

SEQ ID NO: 556653 - DNA, 13 bp, D. melanogaster
aacagctgtaaaa

SEQ ID NO: 556654 - DNA, 13 bp, D. melanogaster
aacagctgttcga

SEQ ID NO: 556655 - DNA, 13 bp, D. melanogaster
aacagctgttgca

SEQ ID NO: 556656 - DNA, 13 bp, D. melanogaster
aacagctgttgtt

SEQ ID NO: 556657 - DNA, 13 bp, D. melanogaster
aacagctgtttgc

SEQ ID NO: 556658 - DNA, 13 bp, D. melanogaster
aacagctgttttc

SEQ ID NO: 556659 - DNA, 13 bp, D. melanogaster
aacagcttgatta

SEQ ID NO: 556660 - DNA, 13 bp, D. melanogaster
aacagctttgaaa

SEQ ID NO: 556661 - DNA, 13 bp, D. melanogaster
aacaggaaaatgt

SEQ ID NO: 556662 - DNA, 13 bp, D. melanogaster
aacaggaaattgc

SEQ ID NO: 556663 - DNA, 13 bp, D. melanogaster
aacaggaacagca

SEQ ID NO: 556664 - DNA, 13 bp, D. melanogaster
aacaggaacagga

SEQ ID NO: 556665 - DNA, 13 bp, D. melanogaster
aacaggaagtaag

SEQ ID NO: 556666 - DNA, 13 bp, D. melanogaster
aacaggacacaca

SEQ ID NO: 556667 - DNA, 13 bp, D. melanogaster
aacaggagcaaca

SEQ ID NO: 556668 - DNA, 13 bp, D. melanogaster
aacaggagcagaa

SEQ ID NO: 556669 - DNA, 13 bp, D. melanogaster
aacaggagcagga

SEQ ID NO: 556670 - DNA, 13 bp, D. melanogaster
aacaggagctgaa

SEQ ID NO: 556671 - DNA, 13 bp, D. melanogaster
aacaggcaaaagg

SEQ ID NO: 556672 - DNA, 13 bp, D. melanogaster
aacaggcagaaga

SEQ ID NO: 556673 - DNA, 14 bp, D. melanogaster
aacaggcagaagga

SEQ ID NO: 556674 - DNA, 13 bp, D. melanogaster
aacaggccaaatg

SEQ ID NO: 556675 - DNA, 13 bp, D. melanogaster
aacaggccgaaaa

SEQ ID NO: 556676 - DNA, 13 bp, D. melanogaster
aacagggaaactc

SEQ ID NO: 556677 - DNA, 13 bp, D. melanogaster
aacagggaccagc

SEQ ID NO: 556678 - DNA, 13 bp, D. melanogaster
aacaggtcaaccg

SEQ ID NO: 556679 - DNA, 13 bp, D. melanogaster
aacaggtgaatcg

SEQ ID NO: 556680 - DNA, 13 bp, D. melanogaster
aacaggtggaaaa

SEQ ID NO: 556681 - DNA, 13 bp, D. melanogaster
aacagtaacaaca

SEQ ID NO: 556682 - DNA, 13 bp, D. melanogaster
aacagtaacagca

SEQ ID NO: 556683 - DNA, 14 bp, D. melanogaster
aacagtaacagtaa

SEQ ID NO: 556684 - DNA, 13 bp, D. melanogaster
aacagtagcaaca

SEQ ID NO: 556685 - DNA, 13 bp, D. melanogaster
aacagtatttttt

SEQ ID NO: 556686 - DNA, 13 bp, D. melanogaster
aacagtgcgtttc

SEQ ID NO: 556687 - DNA, 13 bp, D. melanogaster
aacagtggcaaaa

SEQ ID NO: 556688 - DNA, 13 bp, D. melanogaster
aacagtggcagca

SEQ ID NO: 556689 - DNA, 13 bp, D. melanogaster
aacagtgtcaaat

SEQ ID NO: 556690 - DNA, 13 bp, D. melanogaster
aacagtgttcctg

SEQ ID NO: 556691 - DNA, 13 bp, D. melanogaster
aacagtgtttgtt

SEQ ID NO: 556692 - DNA, 13 bp, D. melanogaster
aacagttaaaacc

SEQ ID NO: 556693 - DNA, 13 bp, D. melanogaster
aacagttaacagt

SEQ ID NO: 556694 - DNA, 14 bp, D. melanogaster
aacagttaataatt

SEQ ID NO: 556695 - DNA, 14 bp, D. melanogaster
aacagttcagcaga

SEQ ID NO: 556696 - DNA, 13 bp, D. melanogaster
aacagttcctgcg

SEQ ID NO: 556697 - DNA, 13 bp, D. melanogaster
aacagttggccaa

SEQ ID NO: 556698 - DNA, 14 bp, D. melanogaster
aacagttggcccaa

SEQ ID NO: 556699 - DNA, 13 bp, D. melanogaster
aacagttgttatt

SEQ ID NO: 556700 - DNA, 13 bp, D. melanogaster
aacagtttaaata

SEQ ID NO: 556701 - DNA, 13 bp, D. melanogaster
aacagtttaatta

SEQ ID NO: 556702 - DNA, 13 bp, D. melanogaster
aacagtttcatct

SEQ ID NO: 556703 - DNA, 13 bp, D. melanogaster
aacagtttcattt

SEQ ID NO: 556704 - DNA, 13 bp, D. melanogaster
aacagtttgaaaa

SEQ ID NO: 556705 - DNA, 13 bp, D. melanogaster
aacagttttaata

SEQ ID NO: 556706 - DNA, 13 bp, D. melanogaster
aacagttttacaa

SEQ ID NO: 556707 - DNA, 13 bp, D. melanogaster
aacagttttataa

SEQ ID NO: 556708 - DNA, 13 bp, D. melanogaster
aacagttttgaaa

SEQ ID NO: 556709 - DNA, 13 bp, D. melanogaster
aacagtttttatt

SEQ ID NO: 556710 - DNA, 13 bp, D. melanogaster
aacagtttttcct

SEQ ID NO: 556711 - DNA, 13 bp, D. melanogaster
aacagtttttctt

SEQ ID NO: 556712 - DNA, 13 bp, D. melanogaster
aacagtttttgtt

SEQ ID NO: 556713 - DNA, 13 bp, D. melanogaster
aacataaaagatt

SEQ ID NO: 556714 - DNA, 13 bp, D. melanogaster
aacataaacatag

SEQ ID NO: 556715 - DNA, 13 bp, D. melanogaster
aacataaacattc

SEQ ID NO: 556716 - DNA, 13 bp, D. melanogaster
aacataaactgaa

SEQ ID NO: 556717 - DNA, 13 bp, D. melanogaster
aacataaactttt

SEQ ID NO: 556718 - DNA, 14 bp, D. melanogaster
aacataaataccag

SEQ ID NO: 556719 - DNA, 13 bp, D. melanogaster
aacataaatactt

SEQ ID NO: 556720 - DNA, 13 bp, D. melanogaster
aacataaatccca

SEQ ID NO: 556721 - DNA, 13 bp, D. melanogaster
aacataaatgtaa

SEQ ID NO: 556722 - DNA, 13 bp, D. melanogaster
aacataaattgaa

SEQ ID NO: 556723 - DNA, 14 bp, D. melanogaster
aacataaattgaaa

SEQ ID NO: 556724 - DNA, 13 bp, D. melanogaster
aacataaattgtt

SEQ ID NO: 556725 - DNA, 13 bp, D. melanogaster
aacataaatttca

SEQ ID NO: 556726 - DNA, 13 bp, D. melanogaster
aacataaattttc

SEQ ID NO: 556727 - DNA, 13 bp, D. melanogaster
aacataagcaaca

SEQ ID NO: 556728 - DNA, 13 bp, D. melanogaster
aacataagttttt

SEQ ID NO: 556729 - DNA, 13 bp, D. melanogaster
aacataataaatg

SEQ ID NO: 556730 - DNA, 13 bp, D. melanogaster
aacataataagga

SEQ ID NO: 556731 - DNA, 13 bp, D. melanogaster
aacataataggca

SEQ ID NO: 556732 - DNA, 13 bp, D. melanogaster
aacataatattca

SEQ ID NO: 556733 - DNA, 13 bp, D. melanogaster
aacataatgaaat

SEQ ID NO: 556734 - DNA, 13 bp, D. melanogaster
aacataattgcaa

SEQ ID NO: 556735 - DNA, 13 bp, D. melanogaster
aacatacaaattt

SEQ ID NO: 556736 - DNA, 13 bp, D. melanogaster
aacatacaattcc

SEQ ID NO: 556737 - DNA, 13 bp, D. melanogaster
aacatacacagag

SEQ ID NO: 556738 - DNA, 13 bp, D. melanogaster
aacatacacatac

SEQ ID NO: 556739 - DNA, 15 bp, D. melanogaster
aacatacatacatat

SEQ ID NO: 556740 - DNA, 14 bp, D. melanogaster
aacatacatataca

SEQ ID NO: 556741 - DNA, 14 bp, D. melanogaster
aacatacatatatt

SEQ ID NO: 556742 - DNA, 14 bp, D. melanogaster
aacatacatatgta

SEQ ID NO: 556743 - DNA, 13 bp, D. melanogaster
aacatactacata

SEQ ID NO: 556744 - DNA, 13 bp, D. melanogaster
aacatactgcaaa

SEQ ID NO: 556745 - DNA, 13 bp, D. melanogaster
aacatagaaacac

SEQ ID NO: 556746 - DNA, 13 bp, D. melanogaster
aacatagaaacat

SEQ ID NO: 556747 - DNA, 13 bp, D. melanogaster
aacatagacatta

SEQ ID NO: 556748 - DNA, 13 bp, D. melanogaster
aacatagatttaa

SEQ ID NO: 556749 - DNA, 13 bp, D. melanogaster
aacatagcaacaa

SEQ ID NO: 556750 - DNA, 13 bp, D. melanogaster
aacatataaatgt

SEQ ID NO: 556751 - DNA, 13 bp, D. melanogaster
aacatatacaatt

SEQ ID NO: 556752 - DNA, 14 bp, D. melanogaster
aacatatacataca

SEQ ID NO: 556753 - DNA, 16 bp, D. melanogaster
aacatatacatacata

SEQ ID NO: 556754 - DNA, 14 bp, D. melanogaster
aacatatacatatg

SEQ ID NO: 556755 - DNA, 13 bp, D. melanogaster
aacatatagaaat

SEQ ID NO: 556756 - DNA, 14 bp, D. melanogaster
aacatatatatatg

SEQ ID NO: 556757 - DNA, 13 bp, D. melanogaster
aacatatatattc

SEQ ID NO: 556758 - DNA, 13 bp, D. melanogaster
aacatatatttga

SEQ ID NO: 556759 - DNA, 13 bp, D. melanogaster
aacatatgcaaaa

SEQ ID NO: 556760 - DNA, 13 bp, D. melanogaster
aacatatgcagat

SEQ ID NO: 556761 - DNA, 13 bp, D. melanogaster
aacatatggaaaa

SEQ ID NO: 556762 - DNA, 14 bp, D. melanogaster
aacatatgtacata

SEQ ID NO: 556763 - DNA, 14 bp, D. melanogaster
aacatatgtatgta

SEQ ID NO: 556764 - DNA, 14 bp, D. melanogaster
aacatattcaaaac

SEQ ID NO: 556765 - DNA, 13 bp, D. melanogaster
aacatattcattt

SEQ ID NO: 556766 - DNA, 13 bp, D. melanogaster
aacatattcttta

SEQ ID NO: 556767 - DNA, 14 bp, D. melanogaster
aacatattctttaa

SEQ ID NO: 556768 - DNA, 13 bp, D. melanogaster
aacatattgaaaa

SEQ ID NO: 556769 - DNA, 13 bp, D. melanogaster
aacatattgatat

SEQ ID NO: 556770 - DNA, 13 bp, D. melanogaster
aacatattgttta

SEQ ID NO: 556771 - DNA, 13 bp, D. melanogaster
aacatatttacat

SEQ ID NO: 556772 - DNA, 13 bp, D. melanogaster
aacatatttactt

SEQ ID NO: 556773 - DNA, 13 bp, D. melanogaster
aacatatttgaaa

SEQ ID NO: 556774 - DNA, 13 bp, D. melanogaster
aacatatttgaat

SEQ ID NO: 556775 - DNA, 13 bp, D. melanogaster
aacatatttgtgt

SEQ ID NO: 556776 - DNA, 13 bp, D. melanogaster
aacatattttcaa

SEQ ID NO: 556777 - DNA, 13 bp, D. melanogaster
aacatattttcca

SEQ ID NO: 556778 - DNA, 13 bp, D. melanogaster
aacatattttcta

SEQ ID NO: 556779 - DNA, 13 bp, D. melanogaster
aacatattttctg

SEQ ID NO: 556780 - DNA, 13 bp, D. melanogaster
aacatattttgaa

SEQ ID NO: 556781 - DNA, 13 bp, D. melanogaster
aacatattttgca

SEQ ID NO: 556782 - DNA, 13 bp, D. melanogaster
aacatatttttag

SEQ ID NO: 556783 - DNA, 14 bp, D. melanogaster
aacatatttttagc

SEQ ID NO: 556784 - DNA, 13 bp, D. melanogaster
aacatatttttgt

SEQ ID NO: 556785 - DNA, 13 bp, D. melanogaster
aacatattttttg

SEQ ID NO: 556786 - DNA, 13 bp, D. melanogaster
aacatcaaatggc

SEQ ID NO: 556787 - DNA, 13 bp, D. melanogaster
aacatcaacaatg

SEQ ID NO: 556788 - DNA, 13 bp, D. melanogaster
aacatcaacagct

SEQ ID NO: 556789 - DNA, 14 bp, D. melanogaster
aacatcaacagctc

SEQ ID NO: 556790 - DNA, 13 bp, D. melanogaster
aacatcaatgaaa

SEQ ID NO: 556791 - DNA, 13 bp, D. melanogaster
aacatcatcaaca

SEQ ID NO: 556792 - DNA, 13 bp, D. melanogaster
aacatcatcagca

SEQ ID NO: 556793 - DNA, 13 bp, D. melanogaster
aacatcatcatcg

SEQ ID NO: 556794 - DNA, 13 bp, D. melanogaster
aacatcatcatta

SEQ ID NO: 556795 - DNA, 13 bp, D. melanogaster
aacatcatcattt

SEQ ID NO: 556796 - DNA, 13 bp, D. melanogaster
aacatcatgattt

SEQ ID NO: 556797 - DNA, 13 bp, D. melanogaster
aacatcattatca

SEQ ID NO: 556798 - DNA, 14 bp, D. melanogaster
aacatcccgggaaa

SEQ ID NO: 556799 - DNA, 13 bp, D. melanogaster
aacatccgcagcc

SEQ ID NO: 556800 - DNA, 14 bp, D. melanogaster
aacatcctgaatgc

SEQ ID NO: 556801 - DNA, 13 bp, D. melanogaster
aacatcgaaaaca

SEQ ID NO: 556802 - DNA, 13 bp, D. melanogaster
aacatcgaagatt

SEQ ID NO: 556803 - DNA, 13 bp, D. melanogaster
aacatcgagcagg

SEQ ID NO: 556804 - DNA, 13 bp, D. melanogaster
aacatcgatgaca

SEQ ID NO: 556805 - DNA, 13 bp, D. melanogaster
aacatcgatgcca

SEQ ID NO: 556806 - DNA, 13 bp, D. melanogaster
aacatcgcccaaa

SEQ ID NO: 556807 - DNA, 13 bp, D. melanogaster
aacatctgcagca

SEQ ID NO: 556808 - DNA, 14 bp, D. melanogaster
aacatcttaaactt

SEQ ID NO: 556809 - DNA, 13 bp, D. melanogaster
aacatcttctgtt

SEQ ID NO: 556810 - DNA, 13 bp, D. melanogaster
aacatgaaaagtt

SEQ ID NO: 556811 - DNA, 13 bp, D. melanogaster
aacatgaaaatgg

SEQ ID NO: 556812 - DNA, 13 bp, D. melanogaster
aacatgaaacatt

SEQ ID NO: 556813 - DNA, 13 bp, D. melanogaster
aacatgaaatgaa

SEQ ID NO: 556814 - DNA, 13 bp, D. melanogaster
aacatgaaatgtg

SEQ ID NO: 556815 - DNA, 14 bp, D. melanogaster
aacatgaacatgaa

SEQ ID NO: 556816 - DNA, 13 bp, D. melanogaster
aacatgacaaaca

SEQ ID NO: 556817 - DNA, 13 bp, D. melanogaster
aacatgacctcaa

SEQ ID NO: 556818 - DNA, 13 bp, D. melanogaster
aacatgagcaaca

SEQ ID NO: 556819 - DNA, 13 bp, D. melanogaster
aacatgattaaaa

SEQ ID NO: 556820 - DNA, 13 bp, D. melanogaster
aacatgattgtcg

SEQ ID NO: 556821 - DNA, 13 bp, D. melanogaster
aacatgcaaatat

SEQ ID NO: 556822 - DNA, 13 bp, D. melanogaster
aacatgcaaatga

SEQ ID NO: 556823 - DNA, 13 bp, D. melanogaster
aacatgcaaatgc

SEQ ID NO: 556824 - DNA, 13 bp, D. melanogaster
aacatgcaacaag

SEQ ID NO: 556825 - DNA, 13 bp, D. melanogaster
aacatgcaacaca

SEQ ID NO: 556826 - DNA, 13 bp, D. melanogaster
aacatgcaattaa

SEQ ID NO: 556827 - DNA, 14 bp, D. melanogaster
aacatgcagcagca

SEQ ID NO: 556828 - DNA, 13 bp, D. melanogaster
aacatgccactgg

SEQ ID NO: 556829 - DNA, 14 bp, D. melanogaster
aacatgcccaccac

SEQ ID NO: 556830 - DNA, 13 bp, D. melanogaster
aacatgctaaaca

SEQ ID NO: 556831 - DNA, 13 bp, D. melanogaster
aacatggaaaaca

SEQ ID NO: 556832 - DNA, 13 bp, D. melanogaster
aacatggaaatat

SEQ ID NO: 556833 - DNA, 14 bp, D. melanogaster
aacatggaaatgtt

SEQ ID NO: 556834 - DNA, 13 bp, D. melanogaster
aacatggatgcca

SEQ ID NO: 556835 - DNA, 14 bp, D. melanogaster
aacatggatttgaa

SEQ ID NO: 556836 - DNA, 13 bp, D. melanogaster
aacatggatttgt

SEQ ID NO: 556837 - DNA, 14 bp, D. melanogaster
aacatggatttgta

SEQ ID NO: 556838 - DNA, 13 bp, D. melanogaster
aacatggcaaaca

SEQ ID NO: 556839 - DNA, 13 bp, D. melanogaster
aacatggcaacaa

SEQ ID NO: 556840 - DNA, 13 bp, D. melanogaster
aacatggccaaaa

SEQ ID NO: 556841 - DNA, 13 bp, D. melanogaster
aacatggccaaag

SEQ ID NO: 556842 - DNA, 13 bp, D. melanogaster
aacatggccaaat

SEQ ID NO: 556843 - DNA, 13 bp, D. melanogaster
aacatggccaaca

SEQ ID NO: 556844 - DNA, 13 bp, D. melanogaster
aacatggccaacg

SEQ ID NO: 556845 - DNA, 13 bp, D. melanogaster
aacatggccaaga

SEQ ID NO: 556846 - DNA, 13 bp, D. melanogaster
aacatggccagaa

SEQ ID NO: 556847 - DNA, 13 bp, D. melanogaster
aacatggcccaaa

SEQ ID NO: 556848 - DNA, 13 bp, D. melanogaster
aacatgtaccaaa

SEQ ID NO: 556849 - DNA, 13 bp, D. melanogaster
aacatgtattttt

SEQ ID NO: 556850 - DNA, 13 bp, D. melanogaster
aacatgtgcaaaa

SEQ ID NO: 556851 - DNA, 13 bp, D. melanogaster
aacatgttgcaca

SEQ ID NO: 556852 - DNA, 13 bp, D. melanogaster
aacatgtttattt

SEQ ID NO: 556853 - DNA, 13 bp, D. melanogaster
aacatgtttgtgt

SEQ ID NO: 556854 - DNA, 13 bp, D. melanogaster
aacatgtttttaa

SEQ ID NO: 556855 - DNA, 13 bp, D. melanogaster
aacatgtttttca

SEQ ID NO: 556856 - DNA, 13 bp, D. melanogaster
aacattaaaagtg

SEQ ID NO: 556857 - DNA, 14 bp, D. melanogaster
aacattaaaagtgt

SEQ ID NO: 556858 - DNA, 13 bp, D. melanogaster
aacattaaattct

SEQ ID NO: 556859 - DNA, 13 bp, D. melanogaster
aacattaacatat

SEQ ID NO: 556860 - DNA, 13 bp, D. melanogaster
aacattaacattt

SEQ ID NO: 556861 - DNA, 13 bp, D. melanogaster
aacattaagaaat

SEQ ID NO: 556862 - DNA, 13 bp, D. melanogaster
aacattaatttca

SEQ ID NO: 556863 - DNA, 13 bp, D. melanogaster
aacattaatttcc

SEQ ID NO: 556864 - DNA, 13 bp, D. melanogaster
aacattacatttt

SEQ ID NO: 556865 - DNA, 13 bp, D. melanogaster
aacattataaatc

SEQ ID NO: 556866 - DNA, 13 bp, D. melanogaster
aacattattaaga

SEQ ID NO: 556867 - DNA, 14 bp, D. melanogaster
aacattatttatga

SEQ ID NO: 556868 - DNA, 13 bp, D. melanogaster
aacattatttcat

SEQ ID NO: 556869 - DNA, 13 bp, D. melanogaster
aacattcaaatgg

SEQ ID NO: 556870 - DNA, 13 bp, D. melanogaster
aacattcaacatt

SEQ ID NO: 556871 - DNA, 13 bp, D. melanogaster
aacattcaaggca

SEQ ID NO: 556872 - DNA, 13 bp, D. melanogaster
aacattccatttc

SEQ ID NO: 556873 - DNA, 13 bp, D. melanogaster
aacattcctatta

SEQ ID NO: 556874 - DNA, 13 bp, D. melanogaster
aacattcgcattc

SEQ ID NO: 556875 - DNA, 14 bp, D. melanogaster
aacattctgccaaa

SEQ ID NO: 556876 - DNA, 13 bp, D. melanogaster
aacattcttttta

SEQ ID NO: 556877 - DNA, 13 bp, D. melanogaster
aacattgaaataa

SEQ ID NO: 556878 - DNA, 13 bp, D. melanogaster
aacattgaatata

SEQ ID NO: 556879 - DNA, 13 bp, D. melanogaster
aacattgaatatg

SEQ ID NO: 556880 - DNA, 13 bp, D. melanogaster
aacattgatattt

SEQ ID NO: 556881 - DNA, 13 bp, D. melanogaster
aacattgcataaa

SEQ ID NO: 556882 - DNA, 13 bp, D. melanogaster
aacattgcatgga

SEQ ID NO: 556883 - DNA, 13 bp, D. melanogaster
aacattgccataa

SEQ ID NO: 556884 - DNA, 13 bp, D. melanogaster
aacattggaaata

SEQ ID NO: 556885 - DNA, 14 bp, D. melanogaster
aacattggaaataa

SEQ ID NO: 556886 - DNA, 13 bp, D. melanogaster
aacattggcatat

SEQ ID NO: 556887 - DNA, 13 bp, D. melanogaster
aacattggccaaa

SEQ ID NO: 556888 - DNA, 13 bp, D. melanogaster
aacattgtaaaat

SEQ ID NO: 556889 - DNA, 13 bp, D. melanogaster
aacattgtcatcc

SEQ ID NO: 556890 - DNA, 13 bp, D. melanogaster
aacattgtcgttg

SEQ ID NO: 556891 - DNA, 14 bp, D. melanogaster
aacattgttataaa

SEQ ID NO: 556892 - DNA, 13 bp, D. melanogaster
aacattgttgcca

SEQ ID NO: 556893 - DNA, 13 bp, D. melanogaster
aacattgttttgt

SEQ ID NO: 556894 - DNA, 13 bp, D. melanogaster
aacatttaaaagt

SEQ ID NO: 556895 - DNA, 13 bp, D. melanogaster
aacatttaacata

SEQ ID NO: 556896 - DNA, 14 bp, D. melanogaster
aacatttaacattt

SEQ ID NO: 556897 - DNA, 13 bp, D. melanogaster
aacatttaagaaa

SEQ ID NO: 556898 - DNA, 14 bp, D. melanogaster
aacatttaattgaa

SEQ ID NO: 556899 - DNA, 14 bp, D. melanogaster
aacatttaattgca

SEQ ID NO: 556900 - DNA, 13 bp, D. melanogaster
aacatttaatttg

SEQ ID NO: 556901 - DNA, 13 bp, D. melanogaster
aacatttacaaat

SEQ ID NO: 556902 - DNA, 13 bp, D. melanogaster
aacatttacaaca

SEQ ID NO: 556903 - DNA, 13 bp, D. melanogaster
aacatttacaata

SEQ ID NO: 556904 - DNA, 13 bp, D. melanogaster
aacatttacactt

SEQ ID NO: 556905 - DNA, 13 bp, D. melanogaster
aacatttacattt

SEQ ID NO: 556906 - DNA, 13 bp, D. melanogaster
aacatttacttaa

SEQ ID NO: 556907 - DNA, 13 bp, D. melanogaster
aacatttagttga

SEQ ID NO: 556908 - DNA, 13 bp, D. melanogaster
aacatttatattc

SEQ ID NO: 556909 - DNA, 13 bp, D. melanogaster
aacatttatgaaa

SEQ ID NO: 556910 - DNA, 13 bp, D. melanogaster
aacatttatgcaa

SEQ ID NO: 556911 - DNA, 13 bp, D. melanogaster
aacatttattgaa

SEQ ID NO: 556912 - DNA, 13 bp, D. melanogaster
aacatttattgtt

SEQ ID NO: 556913 - DNA, 13 bp, D. melanogaster
aacatttatttga

SEQ ID NO: 556914 - DNA, 14 bp, D. melanogaster
aacatttatttttg

SEQ ID NO: 556915 - DNA, 13 bp, D. melanogaster
aacatttcaaaat

SEQ ID NO: 556916 - DNA, 13 bp, D. melanogaster
aacatttcaaaca

SEQ ID NO: 556917 - DNA, 13 bp, D. melanogaster
aacatttcaaatt

SEQ ID NO: 556918 - DNA, 13 bp, D. melanogaster
aacatttcaacaa

SEQ ID NO: 556919 - DNA, 13 bp, D. melanogaster
aacatttcacatt

SEQ ID NO: 556920 - DNA, 13 bp, D. melanogaster
aacatttcactgt

SEQ ID NO: 556921 - DNA, 13 bp, D. melanogaster
aacatttccaaaa

SEQ ID NO: 556922 - DNA, 13 bp, D. melanogaster
aacatttccataa

SEQ ID NO: 556923 - DNA, 13 bp, D. melanogaster
aacatttccctgg

SEQ ID NO: 556924 - DNA, 13 bp, D. melanogaster
aacatttcgcaat

SEQ ID NO: 556925 - DNA, 13 bp, D. melanogaster
aacatttcgcttt

SEQ ID NO: 556926 - DNA, 13 bp, D. melanogaster
aacatttcgtttt

SEQ ID NO: 556927 - DNA, 13 bp, D. melanogaster
aacatttctaatt

SEQ ID NO: 556928 - DNA, 13 bp, D. melanogaster
aacatttctctga

SEQ ID NO: 556929 - DNA, 13 bp, D. melanogaster
aacatttctgttt

SEQ ID NO: 556930 - DNA, 13 bp, D. melanogaster
aacatttctttaa

SEQ ID NO: 556931 - DNA, 13 bp, D. melanogaster
aacatttctttat

SEQ ID NO: 556932 - DNA, 14 bp, D. melanogaster
aacatttgaaaaat

SEQ ID NO: 556933 - DNA, 13 bp, D. melanogaster
aacatttgaaaca

SEQ ID NO: 556934 - DNA, 13 bp, D. melanogaster
aacatttgaaagt

SEQ ID NO: 556935 - DNA, 13 bp, D. melanogaster
aacatttgaaata

SEQ ID NO: 556936 - DNA, 13 bp, D. melanogaster
aacatttgaaatt

SEQ ID NO: 556937 - DNA, 13 bp, D. melanogaster
aacatttgaacat

SEQ ID NO: 556938 - DNA, 13 bp, D. melanogaster
aacatttgatttt

SEQ ID NO: 556939 - DNA, 13 bp, D. melanogaster
aacatttgcaaat

SEQ ID NO: 556940 - DNA, 13 bp, D. melanogaster
aacatttgcacaa

SEQ ID NO: 556941 - DNA, 14 bp, D. melanogaster
aacatttgcataaa

SEQ ID NO: 556942 - DNA, 14 bp, D. melanogaster
aacatttgcatttt

SEQ ID NO: 556943 - DNA, 13 bp, D. melanogaster
aacatttgccttt

SEQ ID NO: 556944 - DNA, 13 bp, D. melanogaster
aacatttgcgaaa

SEQ ID NO: 556945 - DNA, 13 bp, D. melanogaster
aacatttgctaac

SEQ ID NO: 556946 - DNA, 13 bp, D. melanogaster
aacatttgcttaa

SEQ ID NO: 556947 - DNA, 13 bp, D. melanogaster
aacatttggaaaa

SEQ ID NO: 556948 - DNA, 13 bp, D. melanogaster
aacatttggaaat

SEQ ID NO: 556949 - DNA, 13 bp, D. melanogaster
aacatttggctta

SEQ ID NO: 556950 - DNA, 13 bp, D. melanogaster
aacatttggtatt

SEQ ID NO: 556951 - DNA, 13 bp, D. melanogaster
aacatttgtaaat

SEQ ID NO: 556952 - DNA, 13 bp, D. melanogaster
aacatttgtaatt

SEQ ID NO: 556953 - DNA, 13 bp, D. melanogaster
aacatttgtatat

SEQ ID NO: 556954 - DNA, 13 bp, D. melanogaster
aacatttgtattg

SEQ ID NO: 556955 - DNA, 13 bp, D. melanogaster
aacatttgtgttt

SEQ ID NO: 556956 - DNA, 13 bp, D. melanogaster
aacatttgttgca

SEQ ID NO: 556957 - DNA, 13 bp, D. melanogaster
aacatttgtttca

SEQ ID NO: 556958 - DNA, 13 bp, D. melanogaster
aacatttgtttta

SEQ ID NO: 556959 - DNA, 13 bp, D. melanogaster
aacattttaaaac

SEQ ID NO: 556960 - DNA, 13 bp, D. melanogaster
aacattttaaagt

SEQ ID NO: 556961 - DNA, 13 bp, D. melanogaster
aacattttaagca

SEQ ID NO: 556962 - DNA, 13 bp, D. melanogaster
aacattttaatca

SEQ ID NO: 556963 - DNA, 13 bp, D. melanogaster
aacattttaatga

SEQ ID NO: 556964 - DNA, 14 bp, D. melanogaster
aacattttaatgaa

SEQ ID NO: 556965 - DNA, 14 bp, D. melanogaster
aacattttaattag

SEQ ID NO: 556966 - DNA, 13 bp, D. melanogaster
aacattttacaat

SEQ ID NO: 556967 - DNA, 13 bp, D. melanogaster
aacattttaccaa

SEQ ID NO: 556968 - DNA, 13 bp, D. melanogaster
aacattttactaa

SEQ ID NO: 556969 - DNA, 13 bp, D. melanogaster
aacattttacttt

SEQ ID NO: 556970 - DNA, 13 bp, D. melanogaster
aacattttagaaa

SEQ ID NO: 556971 - DNA, 13 bp, D. melanogaster
aacattttagttt

SEQ ID NO: 556972 - DNA, 13 bp, D. melanogaster
aacattttatgac

SEQ ID NO: 556973 - DNA, 13 bp, D. melanogaster
aacattttatgca

SEQ ID NO: 556974 - DNA, 13 bp, D. melanogaster
aacattttattgg

SEQ ID NO: 556975 - DNA, 14 bp, D. melanogaster
aacattttattgga

SEQ ID NO: 556976 - DNA, 13 bp, D. melanogaster
aacattttatttc

SEQ ID NO: 556977 - DNA, 13 bp, D. melanogaster
aacattttcaaaa

SEQ ID NO: 556978 - DNA, 13 bp, D. melanogaster
aacattttcaaca

SEQ ID NO: 556979 - DNA, 13 bp, D. melanogaster
aacattttcaact

SEQ ID NO: 556980 - DNA, 13 bp, D. melanogaster
aacattttcaagc

SEQ ID NO: 556981 - DNA, 13 bp, D. melanogaster
aacattttcaatt

SEQ ID NO: 556982 - DNA, 14 bp, D. melanogaster
aacattttcaatta

SEQ ID NO: 556983 - DNA, 13 bp, D. melanogaster
aacattttcacat

SEQ ID NO: 556984 - DNA, 13 bp, D. melanogaster
aacattttcagct

SEQ ID NO: 556985 - DNA, 14 bp, D. melanogaster
aacattttcattaa

SEQ ID NO: 556986 - DNA, 13 bp, D. melanogaster
aacattttcattt

SEQ ID NO: 556987 - DNA, 14 bp, D. melanogaster
aacattttcattta

SEQ ID NO: 556988 - DNA, 13 bp, D. melanogaster
aacattttccaaa

SEQ ID NO: 556989 - DNA, 14 bp, D. melanogaster
aacattttccaaaa

SEQ ID NO: 556990 - DNA, 13 bp, D. melanogaster
aacattttccaac

SEQ ID NO: 556991 - DNA, 13 bp, D. melanogaster
aacattttccact

SEQ ID NO: 556992 - DNA, 13 bp, D. melanogaster
aacattttccatt

SEQ ID NO: 556993 - DNA, 14 bp, D. melanogaster
aacattttccattc

SEQ ID NO: 556994 - DNA, 13 bp, D. melanogaster
aacattttccgca

SEQ ID NO: 556995 - DNA, 13 bp, D. melanogaster
aacattttcgaaa

SEQ ID NO: 556996 - DNA, 14 bp, D. melanogaster
aacattttcgaaaa

SEQ ID NO: 556997 - DNA, 13 bp, D. melanogaster
aacattttcgttt

SEQ ID NO: 556998 - DNA, 13 bp, D. melanogaster
aacattttcttat

SEQ ID NO: 556999 - DNA, 13 bp, D. melanogaster
aacattttgaaat

SEQ ID NO: 557000 - DNA, 13 bp, D. melanogaster
aacattttgaaca

SEQ ID NO: 557001 - DNA, 13 bp, D. melanogaster
aacattttgaata

SEQ ID NO: 557002 - DNA, 14 bp, D. melanogaster
aacattttgaataa

SEQ ID NO: 557003 - DNA, 13 bp, D. melanogaster
aacattttgagga

SEQ ID NO: 557004 - DNA, 14 bp, D. melanogaster
aacattttgaggaa

SEQ ID NO: 557005 - DNA, 13 bp, D. melanogaster
aacattttgatat

SEQ ID NO: 557006 - DNA, 13 bp, D. melanogaster
aacattttgatta

SEQ ID NO: 557007 - DNA, 13 bp, D. melanogaster
aacattttgattg

SEQ ID NO: 557008 - DNA, 13 bp, D. melanogaster
aacattttgcaat

SEQ ID NO: 557009 - DNA, 13 bp, D. melanogaster
aacattttgcaca

SEQ ID NO: 557010 - DNA, 13 bp, D. melanogaster
aacattttgcagt

SEQ ID NO: 557011 - DNA, 13 bp, D. melanogaster
aacattttgcata

SEQ ID NO: 557012 - DNA, 13 bp, D. melanogaster
aacattttgccaa

SEQ ID NO: 557013 - DNA, 13 bp, D. melanogaster
aacattttgccgc

SEQ ID NO: 557014 - DNA, 13 bp, D. melanogaster
aacattttgcggt

SEQ ID NO: 557015 - DNA, 13 bp, D. melanogaster
aacattttgctgc

SEQ ID NO: 557016 - DNA, 13 bp, D. melanogaster
aacattttgcttt

SEQ ID NO: 557017 - DNA, 13 bp, D. melanogaster
aacattttggaat

SEQ ID NO: 557018 - DNA, 13 bp, D. melanogaster
aacattttggcaa

SEQ ID NO: 557019 - DNA, 13 bp, D. melanogaster
aacattttggtgt

SEQ ID NO: 557020 - DNA, 13 bp, D. melanogaster
aacattttgtata

SEQ ID NO: 557021 - DNA, 13 bp, D. melanogaster
aacattttgtcaa

SEQ ID NO: 557022 - DNA, 13 bp, D. melanogaster
aacattttgtggc

SEQ ID NO: 557023 - DNA, 13 bp, D. melanogaster
aacattttgttgg

SEQ ID NO: 557024 - DNA, 14 bp, D. melanogaster
aacattttgtttat

SEQ ID NO: 557025 - DNA, 13 bp, D. melanogaster
aacatttttaaac

SEQ ID NO: 557026 - DNA, 13 bp, D. melanogaster
aacatttttaagt

SEQ ID NO: 557027 - DNA, 14 bp, D. melanogaster
aacatttttaattg

SEQ ID NO: 557028 - DNA, 13 bp, D. melanogaster
aacatttttacag

SEQ ID NO: 557029 - DNA, 14 bp, D. melanogaster
aacatttttacatt

SEQ ID NO: 557030 - DNA, 13 bp, D. melanogaster
aacatttttacga

SEQ ID NO: 557031 - DNA, 13 bp, D. melanogaster
aacatttttagat

SEQ ID NO: 557032 - DNA, 13 bp, D. melanogaster
aacatttttatgg

SEQ ID NO: 557033 - DNA, 13 bp, D. melanogaster
aacatttttatgt

SEQ ID NO: 557034 - DNA, 13 bp, D. melanogaster
aacatttttcaaa

SEQ ID NO: 557035 - DNA, 14 bp, D. melanogaster
aacatttttcaaaa

SEQ ID NO: 557036 - DNA, 14 bp, D. melanogaster
aacatttttcaaag

SEQ ID NO: 557037 - DNA, 14 bp, D. melanogaster
aacatttttcaaat

SEQ ID NO: 557038 - DNA, 14 bp, D. melanogaster
aacatttttcataa

SEQ ID NO: 557039 - DNA, 13 bp, D. melanogaster
aacatttttccaa

SEQ ID NO: 557040 - DNA, 13 bp, D. melanogaster
aacatttttcggg

SEQ ID NO: 557041 - DNA, 13 bp, D. melanogaster
aacatttttgaag

SEQ ID NO: 557042 - DNA, 13 bp, D. melanogaster
aacatttttgagt

SEQ ID NO: 557043 - DNA, 13 bp, D. melanogaster
aacatttttgatt

SEQ ID NO: 557044 - DNA, 13 bp, D. melanogaster
aacatttttgcga

SEQ ID NO: 557045 - DNA, 13 bp, D. melanogaster
aacatttttgctg

SEQ ID NO: 557046 - DNA, 13 bp, D. melanogaster
aacatttttggaa

SEQ ID NO: 557047 - DNA, 13 bp, D. melanogaster
aacatttttggct

SEQ ID NO: 557048 - DNA, 14 bp, D. melanogaster
aacatttttggttt

SEQ ID NO: 557049 - DNA, 13 bp, D. melanogaster
aacatttttgtac

SEQ ID NO: 557050 - DNA, 13 bp, D. melanogaster
aacatttttgtca

SEQ ID NO: 557051 - DNA, 13 bp, D. melanogaster
aacatttttgtgt

SEQ ID NO: 557052 - DNA, 14 bp, D. melanogaster
aacatttttgtgtt

SEQ ID NO: 557053 - DNA, 14 bp, D. melanogaster
aacatttttgtttt

SEQ ID NO: 557054 - DNA, 13 bp, D. melanogaster
aacattttttatg

SEQ ID NO: 557055 - DNA, 13 bp, D. melanogaster
aacattttttcac

SEQ ID NO: 557056 - DNA, 13 bp, D. melanogaster
aacattttttcgt

SEQ ID NO: 557057 - DNA, 13 bp, D. melanogaster
aacattttttctg

SEQ ID NO: 557058 - DNA, 13 bp, D. melanogaster
aacattttttgaa

SEQ ID NO: 557059 - DNA, 13 bp, D. melanogaster
aacattttttgca

SEQ ID NO: 557060 - DNA, 13 bp, D. melanogaster
aacattttttgtg

SEQ ID NO: 557061 - DNA, 13 bp, D. melanogaster
aacattttttgtt

SEQ ID NO: 557062 - DNA, 13 bp, D. melanogaster
aacatttttttga

SEQ ID NO: 557063 - DNA, 13 bp, D. melanogaster
aacatttttttgg

SEQ ID NO: 557064 - DNA, 14 bp, D. melanogaster
aacattttttttcg

SEQ ID NO: 557065 - DNA, 13 bp, D. melanogaster
aaccaaaaaatgc

SEQ ID NO: 557066 - DNA, 13 bp, D. melanogaster
aaccaaaaagttg

SEQ ID NO: 557067 - DNA, 13 bp, D. melanogaster
aaccaaaaatgca

SEQ ID NO: 557068 - DNA, 13 bp, D. melanogaster
aaccaaaaatgta

SEQ ID NO: 557069 - DNA, 14 bp, D. melanogaster
aaccaaaaatgttt

SEQ ID NO: 557070 - DNA, 14 bp, D. melanogaster
aaccaaaacaaatg

SEQ ID NO: 557071 - DNA, 13 bp, D. melanogaster
aaccaaaagccag

SEQ ID NO: 557072 - DNA, 13 bp, D. melanogaster
aaccaaaagtcaa

SEQ ID NO: 557073 - DNA, 13 bp, D. melanogaster
aaccaaaatatcc

SEQ ID NO: 557074 - DNA, 14 bp, D. melanogaster
aaccaaaatcgaaa

SEQ ID NO: 557075 - DNA, 13 bp, D. melanogaster
aaccaaaatttgt

SEQ ID NO: 557076 - DNA, 14 bp, D. melanogaster
aaccaaacaaaatg

SEQ ID NO: 557077 - DNA, 13 bp, D. melanogaster
aaccaaacaaatg

SEQ ID NO: 557078 - DNA, 13 bp, D. melanogaster
aaccaaaccattt

SEQ ID NO: 557079 - DNA, 13 bp, D. melanogaster
aaccaaaccgaag

SEQ ID NO: 557080 - DNA, 13 bp, D. melanogaster
aaccaaactgaac

SEQ ID NO: 557081 - DNA, 13 bp, D. melanogaster
aaccaaagaaatc

SEQ ID NO: 557082 - DNA, 13 bp, D. melanogaster
aaccaaagcaatt

SEQ ID NO: 557083 - DNA, 13 bp, D. melanogaster
aaccaaagccaag

SEQ ID NO: 557084 - DNA, 13 bp, D. melanogaster
aaccaaagccaat

SEQ ID NO: 557085 - DNA, 13 bp, D. melanogaster
aaccaaagtcaaa

SEQ ID NO: 557086 - DNA, 13 bp, D. melanogaster
aaccaaagtcaga

SEQ ID NO: 557087 - DNA, 14 bp, D. melanogaster
aaccaaatacaaga

SEQ ID NO: 557088 - DNA, 13 bp, D. melanogaster
aaccaaatacttt

SEQ ID NO: 557089 - DNA, 13 bp, D. melanogaster
aaccaaatccaat

SEQ ID NO: 557090 - DNA, 13 bp, D. melanogaster
aaccaaatccgaa

SEQ ID NO: 557091 - DNA, 13 bp, D. melanogaster
aaccaaatcgaaa

SEQ ID NO: 557092 - DNA, 13 bp, D. melanogaster
aaccaaatcgaat

SEQ ID NO: 557093 - DNA, 13 bp, D. melanogaster
aaccaaatgaaag

SEQ ID NO: 557094 - DNA, 13 bp, D. melanogaster
aaccaaatgaatg

SEQ ID NO: 557095 - DNA, 14 bp, D. melanogaster
aaccaaatgagaaa

SEQ ID NO: 557096 - DNA, 14 bp, D. melanogaster
aaccaaatgcaatt

SEQ ID NO: 557097 - DNA, 13 bp, D. melanogaster
aaccaaatggaaa

SEQ ID NO: 557098 - DNA, 13 bp, D. melanogaster
aaccaaatggcaa

SEQ ID NO: 557099 - DNA, 13 bp, D. melanogaster
aaccaaatggcat

SEQ ID NO: 557100 - DNA, 13 bp, D. melanogaster
aaccaaattcaat

SEQ ID NO: 557101 - DNA, 13 bp, D. melanogaster
aaccaaattccaa

SEQ ID NO: 557102 - DNA, 13 bp, D. melanogaster
aaccaaattctaa

SEQ ID NO: 557103 - DNA, 13 bp, D. melanogaster
aaccaaattgaaa

SEQ ID NO: 557104 - DNA, 13 bp, D. melanogaster
aaccaaattgaat

SEQ ID NO: 557105 - DNA, 13 bp, D. melanogaster
aaccaaattgtat

SEQ ID NO: 557106 - DNA, 13 bp, D. melanogaster
aaccaaatttaat

SEQ ID NO: 557107 - DNA, 13 bp, D. melanogaster
aaccaaatttatg

SEQ ID NO: 557108 - DNA, 13 bp, D. melanogaster
aaccaacaaaatg

SEQ ID NO: 557109 - DNA, 14 bp, D. melanogaster
aaccaacaacggca

SEQ ID NO: 557110 - DNA, 13 bp, D. melanogaster
aaccaacattact

SEQ ID NO: 557111 - DNA, 13 bp, D. melanogaster
aaccaaccaactg

SEQ ID NO: 557112 - DNA, 14 bp, D. melanogaster
aaccaaccagccag

SEQ ID NO: 557113 - DNA, 13 bp, D. melanogaster
aaccaaccgaccg

SEQ ID NO: 557114 - DNA, 13 bp, D. melanogaster
aaccaactaacta

SEQ ID NO: 557115 - DNA, 13 bp, D. melanogaster
aaccaactacttt

SEQ ID NO: 557116 - DNA, 14 bp, D. melanogaster
aaccaactactttt

SEQ ID NO: 557117 - DNA, 13 bp, D. melanogaster
aaccaactgaaaa

SEQ ID NO: 557118 - DNA, 13 bp, D. melanogaster
aaccaagacacat

SEQ ID NO: 557119 - DNA, 13 bp, D. melanogaster
aaccaagcgaggc

SEQ ID NO: 557120 - DNA, 13 bp, D. melanogaster
aaccaagctcttt

SEQ ID NO: 557121 - DNA, 13 bp, D. melanogaster
aaccaagtactta

SEQ ID NO: 557122 - DNA, 13 bp, D. melanogaster
aaccaagtattaa

SEQ ID NO: 557123 - DNA, 13 bp, D. melanogaster
aaccaagtttggt

SEQ ID NO: 557124 - DNA, 13 bp, D. melanogaster
aaccaataaatgt

SEQ ID NO: 557125 - DNA, 13 bp, D. melanogaster
aaccaatactaac

SEQ ID NO: 557126 - DNA, 13 bp, D. melanogaster
aaccaatatattt

SEQ ID NO: 557127 - DNA, 13 bp, D. melanogaster
aaccaatccaatc

SEQ ID NO: 557128 - DNA, 13 bp, D. melanogaster
aaccaatctagct

SEQ ID NO: 557129 - DNA, 13 bp, D. melanogaster
aaccaatgaaaat

SEQ ID NO: 557130 - DNA, 13 bp, D. melanogaster
aaccaattaaatc

SEQ ID NO: 557131 - DNA, 13 bp, D. melanogaster
aaccaattaattt

SEQ ID NO: 557132 - DNA, 13 bp, D. melanogaster
aaccaattattaa

SEQ ID NO: 557133 - DNA, 13 bp, D. melanogaster
aaccaattcaaat

SEQ ID NO: 557134 - DNA, 13 bp, D. melanogaster
aaccaattcaatt

SEQ ID NO: 557135 - DNA, 13 bp, D. melanogaster
aaccaattgcaaa

SEQ ID NO: 557136 - DNA, 13 bp, D. melanogaster
aaccaattgtttt

SEQ ID NO: 557137 - DNA, 13 bp, D. melanogaster
aaccaatttaatt

SEQ ID NO: 557138 - DNA, 13 bp, D. melanogaster
aaccaatttcaaa

SEQ ID NO: 557139 - DNA, 13 bp, D. melanogaster
aaccaatttcgaa

SEQ ID NO: 557140 - DNA, 13 bp, D. melanogaster
aaccaatttgaat

SEQ ID NO: 557141 - DNA, 13 bp, D. melanogaster
aaccaatttgtaa

SEQ ID NO: 557142 - DNA, 13 bp, D. melanogaster
aaccaatttgttg

SEQ ID NO: 557143 - DNA, 13 bp, D. melanogaster
aaccaattttaat

SEQ ID NO: 557144 - DNA, 13 bp, D. melanogaster
aaccacaatattt

SEQ ID NO: 557145 - DNA, 13 bp, D. melanogaster
aaccacagatgca

SEQ ID NO: 557146 - DNA, 14 bp, D. melanogaster
aaccacagatgcaa

SEQ ID NO: 557147 - DNA, 13 bp, D. melanogaster
aaccacagatgct

SEQ ID NO: 557148 - DNA, 13 bp, D. melanogaster
aaccacatttatt

SEQ ID NO: 557149 - DNA, 14 bp, D. melanogaster
aaccacatttctgg

SEQ ID NO: 557150 - DNA, 13 bp, D. melanogaster
aaccaccaatcat

SEQ ID NO: 557151 - DNA, 13 bp, D. melanogaster
aaccacccactcg

SEQ ID NO: 557152 - DNA, 13 bp, D. melanogaster
aaccacccactga

SEQ ID NO: 557153 - DNA, 13 bp, D. melanogaster
aaccaccgtgccc

SEQ ID NO: 557154 - DNA, 13 bp, D. melanogaster
aaccacgcccact

SEQ ID NO: 557155 - DNA, 14 bp, D. melanogaster
aaccactgaaccac

SEQ ID NO: 557156 - DNA, 13 bp, D. melanogaster
aaccagaaataga

SEQ ID NO: 557157 - DNA, 13 bp, D. melanogaster
aaccagaaatcgc

SEQ ID NO: 557158 - DNA, 16 bp, D. melanogaster
aaccagaaccagaacc

SEQ ID NO: 557159 - DNA, 13 bp, D. melanogaster
aaccagaatatcg

SEQ ID NO: 557160 - DNA, 13 bp, D. melanogaster
aaccagaatgaga

SEQ ID NO: 557161 - DNA, 13 bp, D. melanogaster
aaccagaattcga

SEQ ID NO: 557162 - DNA, 13 bp, D. melanogaster
aaccagacaaact

SEQ ID NO: 557163 - DNA, 13 bp, D. melanogaster
aaccagagctcca

SEQ ID NO: 557164 - DNA, 13 bp, D. melanogaster
aaccagcaaccag

SEQ ID NO: 557165 - DNA, 14 bp, D. melanogaster
aaccagcagcagca

SEQ ID NO: 557166 - DNA, 13 bp, D. melanogaster
aaccagccacttc

SEQ ID NO: 557167 - DNA, 13 bp, D. melanogaster
aaccagctgaaaa

SEQ ID NO: 557168 - DNA, 13 bp, D. melanogaster
aaccaggcagcca

SEQ ID NO: 557169 - DNA, 13 bp, D. melanogaster
aaccaggccaaaa

SEQ ID NO: 557170 - DNA, 13 bp, D. melanogaster
aaccagtcagtca

SEQ ID NO: 557171 - DNA, 13 bp, D. melanogaster
aaccagtcataaa

SEQ ID NO: 557172 - DNA, 13 bp, D. melanogaster
aaccagttgatca

SEQ ID NO: 557173 - DNA, 13 bp, D. melanogaster
aaccataaaccat

SEQ ID NO: 557174 - DNA, 13 bp, D. melanogaster
aaccataccatac

SEQ ID NO: 557175 - DNA, 13 bp, D. melanogaster
aaccatataaagt

SEQ ID NO: 557176 - DNA, 13 bp, D. melanogaster
aaccatatccata

SEQ ID NO: 557177 - DNA, 13 bp, D. melanogaster
aaccatcagtttc

SEQ ID NO: 557178 - DNA, 13 bp, D. melanogaster
aaccatccatcca

SEQ ID NO: 557179 - DNA, 13 bp, D. melanogaster
aaccatccatccc

SEQ ID NO: 557180 - DNA, 13 bp, D. melanogaster
aaccatcgaggga

SEQ ID NO: 557181 - DNA, 13 bp, D. melanogaster
aaccatgaaacaa

SEQ ID NO: 557182 - DNA, 13 bp, D. melanogaster
aaccattgaaatg

SEQ ID NO: 557183 - DNA, 13 bp, D. melanogaster
aaccattgttgag

SEQ ID NO: 557184 - DNA, 13 bp, D. melanogaster
aaccatttaattt

SEQ ID NO: 557185 - DNA, 13 bp, D. melanogaster
aaccatttagacc

SEQ ID NO: 557186 - DNA, 13 bp, D. melanogaster
aaccatttatttg

SEQ ID NO: 557187 - DNA, 13 bp, D. melanogaster
aaccatttccatt

SEQ ID NO: 557188 - DNA, 13 bp, D. melanogaster
aaccatttcgaaa

SEQ ID NO: 557189 - DNA, 13 bp, D. melanogaster
aaccatttctgcc

SEQ ID NO: 557190 - DNA, 13 bp, D. melanogaster
aaccatttggcaa

SEQ ID NO: 557191 - DNA, 13 bp, D. melanogaster
aaccatttgttta

SEQ ID NO: 557192 - DNA, 13 bp, D. melanogaster
aaccattttaaat

SEQ ID NO: 557193 - DNA, 13 bp, D. melanogaster
aaccattttatat

SEQ ID NO: 557194 - DNA, 13 bp, D. melanogaster
aaccattttatgt

SEQ ID NO: 557195 - DNA, 13 bp, D. melanogaster
aaccattttgaat

SEQ ID NO: 557196 - DNA, 13 bp, D. melanogaster
aaccatttttaat

SEQ ID NO: 557197 - DNA, 13 bp, D. melanogaster
aaccatttttcaa

SEQ ID NO: 557198 - DNA, 13 bp, D. melanogaster
aaccattttttaa

SEQ ID NO: 557199 - DNA, 13 bp, D. melanogaster
aaccattttttca

SEQ ID NO: 557200 - DNA, 14 bp, D. melanogaster
aaccattttttgtt

SEQ ID NO: 557201 - DNA, 13 bp, D. melanogaster
aacccaaaactga

SEQ ID NO: 557202 - DNA, 13 bp, D. melanogaster
aacccaaactgaa

SEQ ID NO: 557203 - DNA, 13 bp, D. melanogaster
aacccaaatgaaa

SEQ ID NO: 557204 - DNA, 13 bp, D. melanogaster
aacccaactgaaa

SEQ ID NO: 557205 - DNA, 13 bp, D. melanogaster
aacccaacttcag

SEQ ID NO: 557206 - DNA, 13 bp, D. melanogaster
aacccaagaaaat

SEQ ID NO: 557207 - DNA, 13 bp, D. melanogaster
aacccaatccaga

SEQ ID NO: 557208 - DNA, 14 bp, D. melanogaster
aacccaatcccaat

SEQ ID NO: 557209 - DNA, 13 bp, D. melanogaster
aacccaatggtac

SEQ ID NO: 557210 - DNA, 14 bp, D. melanogaster
aacccaatggtttt

SEQ ID NO: 557211 - DNA, 13 bp, D. melanogaster
aacccaatttgtc

SEQ ID NO: 557212 - DNA, 13 bp, D. melanogaster
aacccaatttgtt

SEQ ID NO: 557213 - DNA, 13 bp, D. melanogaster
aacccaattttca

SEQ ID NO: 557214 - DNA, 14 bp, D. melanogaster
aacccaattttcag

SEQ ID NO: 557215 - DNA, 13 bp, D. melanogaster
aacccagtcaaaa

SEQ ID NO: 557216 - DNA, 13 bp, D. melanogaster
aacccatacccat

SEQ ID NO: 557217 - DNA, 13 bp, D. melanogaster
aacccatagccca

SEQ ID NO: 557218 - DNA, 13 bp, D. melanogaster
aacccattcaaaa

SEQ ID NO: 557219 - DNA, 13 bp, D. melanogaster
aacccattccaaa

SEQ ID NO: 557220 - DNA, 14 bp, D. melanogaster
aacccattccaaaa

SEQ ID NO: 557221 - DNA, 13 bp, D. melanogaster
aacccattccatt

SEQ ID NO: 557222 - DNA, 14 bp, D. melanogaster
aacccattgggtgc

SEQ ID NO: 557223 - DNA, 13 bp, D. melanogaster
aacccatttaaaa

SEQ ID NO: 557224 - DNA, 13 bp, D. melanogaster
aacccatttccat

SEQ ID NO: 557225 - DNA, 13 bp, D. melanogaster
aacccatttgcat

SEQ ID NO: 557226 - DNA, 13 bp, D. melanogaster
aacccatttttcg

SEQ ID NO: 557227 - DNA, 13 bp, D. melanogaster
aaccccaaaaagt

SEQ ID NO: 557228 - DNA, 13 bp, D. melanogaster
aaccccattaaaa

SEQ ID NO: 557229 - DNA, 13 bp, D. melanogaster
aacccgaacccga

SEQ ID NO: 557230 - DNA, 14 bp, D. melanogaster
aacccgaacccgaa

SEQ ID NO: 557231 - DNA, 13 bp, D. melanogaster
aacccgaaccgaa

SEQ ID NO: 557232 - DNA, 13 bp, D. melanogaster
aacccgaatccga

SEQ ID NO: 557233 - DNA, 13 bp, D. melanogaster
aacccgaattgtt

SEQ ID NO: 557234 - DNA, 13 bp, D. melanogaster
aacccgatcagat

SEQ ID NO: 557235 - DNA, 13 bp, D. melanogaster
aacccggtgaccc

SEQ ID NO: 557236 - DNA, 13 bp, D. melanogaster
aaccctaatcaca

SEQ ID NO: 557237 - DNA, 13 bp, D. melanogaster
aaccctgatgcaa

SEQ ID NO: 557238 - DNA, 13 bp, D. melanogaster
aaccctgtttaaa

SEQ ID NO: 557239 - DNA, 13 bp, D. melanogaster
aacccttggctga

SEQ ID NO: 557240 - DNA, 14 bp, D. melanogaster
aacccttggctgag

SEQ ID NO: 557241 - DNA, 13 bp, D. melanogaster
aaccctttgccaa

SEQ ID NO: 557242 - DNA, 13 bp, D. melanogaster
aaccctttgttaa

SEQ ID NO: 557243 - DNA, 13 bp, D. melanogaster
aacccttttcaat

SEQ ID NO: 557244 - DNA, 13 bp, D. melanogaster
aacccttttggcc

SEQ ID NO: 557245 - DNA, 13 bp, D. melanogaster
aaccctttttgtt

SEQ ID NO: 557246 - DNA, 13 bp, D. melanogaster
aacccttttttcc

SEQ ID NO: 557247 - DNA, 13 bp, D. melanogaster
aaccgaaaaaatg

SEQ ID NO: 557248 - DNA, 13 bp, D. melanogaster
aaccgaaaaaccg

SEQ ID NO: 557249 - DNA, 13 bp, D. melanogaster
aaccgaaaaatat

SEQ ID NO: 557250 - DNA, 13 bp, D. melanogaster
aaccgaaaaatca

SEQ ID NO: 557251 - DNA, 13 bp, D. melanogaster
aaccgaaaacatt

SEQ ID NO: 557252 - DNA, 13 bp, D. melanogaster
aaccgaaaaccag

SEQ ID NO: 557253 - DNA, 13 bp, D. melanogaster
aaccgaaaacttt

SEQ ID NO: 557254 - DNA, 13 bp, D. melanogaster
aaccgaaaatata

SEQ ID NO: 557255 - DNA, 13 bp, D. melanogaster
aaccgaaaatgtg

SEQ ID NO: 557256 - DNA, 13 bp, D. melanogaster
aaccgaaaattgt

SEQ ID NO: 557257 - DNA, 14 bp, D. melanogaster
aaccgaaaattttc

SEQ ID NO: 557258 - DNA, 13 bp, D. melanogaster
aaccgaaaccgag

SEQ ID NO: 557259 - DNA, 13 bp, D. melanogaster
aaccgaaacgaac

SEQ ID NO: 557260 - DNA, 13 bp, D. melanogaster
aaccgaaactgaa

SEQ ID NO: 557261 - DNA, 14 bp, D. melanogaster
aaccgaaactgaaa

SEQ ID NO: 557262 - DNA, 13 bp, D. melanogaster
aaccgaaactttt

SEQ ID NO: 557263 - DNA, 13 bp, D. melanogaster
aaccgaaagaaat

SEQ ID NO: 557264 - DNA, 13 bp, D. melanogaster
aaccgaaagccaa

SEQ ID NO: 557265 - DNA, 13 bp, D. melanogaster
aaccgaaagtaaa

SEQ ID NO: 557266 - DNA, 13 bp, D. melanogaster
aaccgaaataaat

SEQ ID NO: 557267 - DNA, 13 bp, D. melanogaster
aaccgaaatagaa

SEQ ID NO: 557268 - DNA, 13 bp, D. melanogaster
aaccgaaatcaaa

SEQ ID NO: 557269 - DNA, 14 bp, D. melanogaster
aaccgaaatcaaaa

SEQ ID NO: 557270 - DNA, 13 bp, D. melanogaster
aaccgaaatcaat

SEQ ID NO: 557271 - DNA, 13 bp, D. melanogaster
aaccgaaatgaaa

SEQ ID NO: 557272 - DNA, 13 bp, D. melanogaster
aaccgaaatgaat

SEQ ID NO: 557273 - DNA, 13 bp, D. melanogaster
aaccgaaatgtgc

SEQ ID NO: 557274 - DNA, 13 bp, D. melanogaster
aaccgaaattaaa

SEQ ID NO: 557275 - DNA, 13 bp, D. melanogaster
aaccgaaccattt

SEQ ID NO: 557276 - DNA, 13 bp, D. melanogaster
aaccgaacccgaa

SEQ ID NO: 557277 - DNA, 13 bp, D. melanogaster
aaccgaaccgaaa

SEQ ID NO: 557278 - DNA, 14 bp, D. melanogaster
aaccgaaccgaaac

SEQ ID NO: 557279 - DNA, 13 bp, D. melanogaster
aaccgaaccgaac

SEQ ID NO: 557280 - DNA, 14 bp, D. melanogaster
aaccgaaccgaaca

SEQ ID NO: 557281 - DNA, 14 bp, D. melanogaster
aaccgaaccgaacc

SEQ ID NO: 557282 - DNA, 14 bp, D. melanogaster
aaccgaaccgaact

SEQ ID NO: 557283 - DNA, 13 bp, D. melanogaster
aaccgaaccgaat

SEQ ID NO: 557284 - DNA, 13 bp, D. melanogaster
aaccgaactgaac

SEQ ID NO: 557285 - DNA, 13 bp, D. melanogaster
aaccgaagatatt

SEQ ID NO: 557286 - DNA, 13 bp, D. melanogaster
aaccgaagccaaa

SEQ ID NO: 557287 - DNA, 13 bp, D. melanogaster
aaccgaaggggta

SEQ ID NO: 557288 - DNA, 13 bp, D. melanogaster
aaccgaataaaac

SEQ ID NO: 557289 - DNA, 13 bp, D. melanogaster
aaccgaatggaaa

SEQ ID NO: 557290 - DNA, 13 bp, D. melanogaster
aaccgaattggaa

SEQ ID NO: 557291 - DNA, 14 bp, D. melanogaster
aaccgagaagttaa

SEQ ID NO: 557292 - DNA, 14 bp, D. melanogaster
aaccgagtcgatct

SEQ ID NO: 557293 - DNA, 13 bp, D. melanogaster
aaccgatccgatc

SEQ ID NO: 557294 - DNA, 14 bp, D. melanogaster
aaccgatccgatcc

SEQ ID NO: 557295 - DNA, 13 bp, D. melanogaster
aaccgattaccat

SEQ ID NO: 557296 - DNA, 13 bp, D. melanogaster
aaccgattttgtg

SEQ ID NO: 557297 - DNA, 13 bp, D. melanogaster
aaccgcaacagca

SEQ ID NO: 557298 - DNA, 13 bp, D. melanogaster
aaccgcactgcaa

SEQ ID NO: 557299 - DNA, 13 bp, D. melanogaster
aaccgcagcaaca

SEQ ID NO: 557300 - DNA, 13 bp, D. melanogaster
aaccgcatcaaaa

SEQ ID NO: 557301 - DNA, 13 bp, D. melanogaster
aaccgcattttac

SEQ ID NO: 557302 - DNA, 13 bp, D. melanogaster
aaccgccaaatcc

SEQ ID NO: 557303 - DNA, 13 bp, D. melanogaster
aaccgcttgaaat

SEQ ID NO: 557304 - DNA, 14 bp, D. melanogaster
aaccggaaacggaa

SEQ ID NO: 557305 - DNA, 13 bp, D. melanogaster
aaccggaaatgca

SEQ ID NO: 557306 - DNA, 13 bp, D. melanogaster
aaccggaagccaa

SEQ ID NO: 557307 - DNA, 14 bp, D. melanogaster
aaccggaagccaaa

SEQ ID NO: 557308 - DNA, 13 bp, D. melanogaster
aaccggagccgga

SEQ ID NO: 557309 - DNA, 13 bp, D. melanogaster
aaccggcaattca

SEQ ID NO: 557310 - DNA, 13 bp, D. melanogaster
aaccgggccaata

SEQ ID NO: 557311 - DNA, 13 bp, D. melanogaster
aaccgtaaacaaa

SEQ ID NO: 557312 - DNA, 13 bp, D. melanogaster
aaccgtcgacatt

SEQ ID NO: 557313 - DNA, 14 bp, D. melanogaster
aaccgtctgtatct

SEQ ID NO: 557314 - DNA, 13 bp, D. melanogaster
aaccgtgactggt

SEQ ID NO: 557315 - DNA, 13 bp, D. melanogaster
aaccgttggacat

SEQ ID NO: 557316 - DNA, 13 bp, D. melanogaster
aacctaacgaccc

SEQ ID NO: 557317 - DNA, 13 bp, D. melanogaster
aacctatatatat

SEQ ID NO: 557318 - DNA, 13 bp, D. melanogaster
aacctatgactat

SEQ ID NO: 557319 - DNA, 13 bp, D. melanogaster
aacctattcaaat

SEQ ID NO: 557320 - DNA, 13 bp, D. melanogaster
aacctcaaaagat

SEQ ID NO: 557321 - DNA, 13 bp, D. melanogaster
aacctcagcggcc

SEQ ID NO: 557322 - DNA, 13 bp, D. melanogaster
aacctccagcaaa

SEQ ID NO: 557323 - DNA, 13 bp, D. melanogaster
aacctctgctctg

SEQ ID NO: 557324 - DNA, 14 bp, D. melanogaster
aacctgaaccagtt

SEQ ID NO: 557325 - DNA, 13 bp, D. melanogaster
aacctgcaacctg

SEQ ID NO: 557326 - DNA, 14 bp, D. melanogaster
aacctggccaaaaa

SEQ ID NO: 557327 - DNA, 13 bp, D. melanogaster
aaccttaaacatc

SEQ ID NO: 557328 - DNA, 13 bp, D. melanogaster
aaccttattcatt

SEQ ID NO: 557329 - DNA, 13 bp, D. melanogaster
aacctttaacaaa

SEQ ID NO: 557330 - DNA, 13 bp, D. melanogaster
aacctttcacact

SEQ ID NO: 557331 - DNA, 13 bp, D. melanogaster
aaccttttcaaaa

SEQ ID NO: 557332 - DNA, 13 bp, D. melanogaster
aacctttttaaag

SEQ ID NO: 557333 - DNA, 13 bp, D. melanogaster
aaccttttttttg

SEQ ID NO: 557334 - DNA, 13 bp, D. melanogaster
aacgaaaaacatt

SEQ ID NO: 557335 - DNA, 13 bp, D. melanogaster
aacgaaaaagttt

SEQ ID NO: 557336 - DNA, 14 bp, D. melanogaster
aacgaaaaagtttg

SEQ ID NO: 557337 - DNA, 13 bp, D. melanogaster
aacgaaaaatcca

SEQ ID NO: 557338 - DNA, 13 bp, D. melanogaster
aacgaaaaatgca

SEQ ID NO: 557339 - DNA, 13 bp, D. melanogaster
aacgaaaaatgcc

SEQ ID NO: 557340 - DNA, 13 bp, D. melanogaster
aacgaaaaattca

SEQ ID NO: 557341 - DNA, 13 bp, D. melanogaster
aacgaaaacaact

SEQ ID NO: 557342 - DNA, 13 bp, D. melanogaster
aacgaaaacaatt

SEQ ID NO: 557343 - DNA, 14 bp, D. melanogaster
aacgaaaacataca

SEQ ID NO: 557344 - DNA, 13 bp, D. melanogaster
aacgaaaacgaat

SEQ ID NO: 557345 - DNA, 13 bp, D. melanogaster
aacgaaaacgtaa

SEQ ID NO: 557346 - DNA, 14 bp, D. melanogaster
aacgaaaacgtaaa

SEQ ID NO: 557347 - DNA, 13 bp, D. melanogaster
aacgaaaactgaa

SEQ ID NO: 557348 - DNA, 14 bp, D. melanogaster
aacgaaaactgaat

SEQ ID NO: 557349 - DNA, 13 bp, D. melanogaster
aacgaaaagcaat

SEQ ID NO: 557350 - DNA, 13 bp, D. melanogaster
aacgaaaagctga

SEQ ID NO: 557351 - DNA, 13 bp, D. melanogaster
aacgaaaagtttt

SEQ ID NO: 557352 - DNA, 13 bp, D. melanogaster
aacgaaaatatat

SEQ ID NO: 557353 - DNA, 13 bp, D. melanogaster
aacgaaaatgcaa

SEQ ID NO: 557354 - DNA, 13 bp, D. melanogaster
aacgaaaatggaa

SEQ ID NO: 557355 - DNA, 13 bp, D. melanogaster
aacgaaaattcaa

SEQ ID NO: 557356 - DNA, 13 bp, D. melanogaster
aacgaaaattgtt

SEQ ID NO: 557357 - DNA, 13 bp, D. melanogaster
aacgaaacaaatt

SEQ ID NO: 557358 - DNA, 13 bp, D. melanogaster
aacgaaacaattt

SEQ ID NO: 557359 - DNA, 13 bp, D. melanogaster
aacgaaaccaaat

SEQ ID NO: 557360 - DNA, 14 bp, D. melanogaster
aacgaaacgaaaat

SEQ ID NO: 557361 - DNA, 13 bp, D. melanogaster
aacgaaacgaaat

SEQ ID NO: 557362 - DNA, 13 bp, D. melanogaster
aacgaaacgaact

SEQ ID NO: 557363 - DNA, 14 bp, D. melanogaster
aacgaaacgaagcg

SEQ ID NO: 557364 - DNA, 13 bp, D. melanogaster
aacgaaacgaatc

SEQ ID NO: 557365 - DNA, 13 bp, D. melanogaster
aacgaaacgaatg

SEQ ID NO: 557366 - DNA, 13 bp, D. melanogaster
aacgaaacgaatt

SEQ ID NO: 557367 - DNA, 13 bp, D. melanogaster
aacgaaacggaac

SEQ ID NO: 557368 - DNA, 14 bp, D. melanogaster
aacgaaacggaacg

SEQ ID NO: 557369 - DNA, 13 bp, D. melanogaster
aacgaaactcaaa

SEQ ID NO: 557370 - DNA, 13 bp, D. melanogaster
aacgaaactgaaa

SEQ ID NO: 557371 - DNA, 14 bp, D. melanogaster
aacgaaactgaaaa

SEQ ID NO: 557372 - DNA, 13 bp, D. melanogaster
aacgaaacttttt

SEQ ID NO: 557373 - DNA, 13 bp, D. melanogaster
aacgaaagcgaat

SEQ ID NO: 557374 - DNA, 13 bp, D. melanogaster
aacgaaaggattg

SEQ ID NO: 557375 - DNA, 13 bp, D. melanogaster
aacgaaataaatc

SEQ ID NO: 557376 - DNA, 13 bp, D. melanogaster
aacgaaatatata

SEQ ID NO: 557377 - DNA, 13 bp, D. melanogaster
aacgaaatatttg

SEQ ID NO: 557378 - DNA, 13 bp, D. melanogaster
aacgaaatcaaat

SEQ ID NO: 557379 - DNA, 13 bp, D. melanogaster
aacgaaatccaaa

SEQ ID NO: 557380 - DNA, 13 bp, D. melanogaster
aacgaaatcgaaa

SEQ ID NO: 557381 - DNA, 14 bp, D. melanogaster
aacgaaatcgaaaa

SEQ ID NO: 557382 - DNA, 14 bp, D. melanogaster
aacgaaatcgaaat

SEQ ID NO: 557383 - DNA, 13 bp, D. melanogaster
aacgaaatctttt

SEQ ID NO: 557384 - DNA, 13 bp, D. melanogaster
aacgaaatgaaac

SEQ ID NO: 557385 - DNA, 14 bp, D. melanogaster
aacgaaatgaaacg

SEQ ID NO: 557386 - DNA, 13 bp, D. melanogaster
aacgaaatgaaag

SEQ ID NO: 557387 - DNA, 14 bp, D. melanogaster
aacgaaatgaaatg

SEQ ID NO: 557388 - DNA, 14 bp, D. melanogaster
aacgaaatgaaatt

SEQ ID NO: 557389 - DNA, 13 bp, D. melanogaster
aacgaaatgcaaa

SEQ ID NO: 557390 - DNA, 14 bp, D. melanogaster
aacgaaatgcaaat

SEQ ID NO: 557391 - DNA, 13 bp, D. melanogaster
aacgaaatggaaa

SEQ ID NO: 557392 - DNA, 13 bp, D. melanogaster
aacgaaatggaat

SEQ ID NO: 557393 - DNA, 13 bp, D. melanogaster
aacgaaatgtttt

SEQ ID NO: 557394 - DNA, 13 bp, D. melanogaster
aacgaaattaaac

SEQ ID NO: 557395 - DNA, 13 bp, D. melanogaster
aacgaaattaaat

SEQ ID NO: 557396 - DNA, 14 bp, D. melanogaster
aacgaaattaattt

SEQ ID NO: 557397 - DNA, 13 bp, D. melanogaster
aacgaaattacaa

SEQ ID NO: 557398 - DNA, 13 bp, D. melanogaster
aacgaaattagaa

SEQ ID NO: 557399 - DNA, 13 bp, D. melanogaster
aacgaaattagtt

SEQ ID NO: 557400 - DNA, 13 bp, D. melanogaster
aacgaaattcaaa

SEQ ID NO: 557401 - DNA, 13 bp, D. melanogaster
aacgaaattcaat

SEQ ID NO: 557402 - DNA, 13 bp, D. melanogaster
aacgaaattgaaa

SEQ ID NO: 557403 - DNA, 14 bp, D. melanogaster
aacgaaattgaaaa

SEQ ID NO: 557404 - DNA, 14 bp, D. melanogaster
aacgaaattgaatt

SEQ ID NO: 557405 - DNA, 13 bp, D. melanogaster
aacgaaattttat

SEQ ID NO: 557406 - DNA, 13 bp, D. melanogaster
aacgaaattttta

SEQ ID NO: 557407 - DNA, 13 bp, D. melanogaster
aacgaacatatcg

SEQ ID NO: 557408 - DNA, 13 bp, D. melanogaster
aacgaacgaaacg

SEQ ID NO: 557409 - DNA, 13 bp, D. melanogaster
aacgaacgaacga

SEQ ID NO: 557410 - DNA, 14 bp, D. melanogaster
aacgaacgaacgaa

SEQ ID NO: 557411 - DNA, 13 bp, D. melanogaster
aacgaacggttaa

SEQ ID NO: 557412 - DNA, 13 bp, D. melanogaster
aacgaactaaatt

SEQ ID NO: 557413 - DNA, 13 bp, D. melanogaster
aacgaactgattt

SEQ ID NO: 557414 - DNA, 13 bp, D. melanogaster
aacgaaggacgaa

SEQ ID NO: 557415 - DNA, 13 bp, D. melanogaster
aacgaagtataac

SEQ ID NO: 557416 - DNA, 13 bp, D. melanogaster
aacgaagtgaaaa

SEQ ID NO: 557417 - DNA, 13 bp, D. melanogaster
aacgaatacagca

SEQ ID NO: 557418 - DNA, 13 bp, D. melanogaster
aacgaatacgaat

SEQ ID NO: 557419 - DNA, 13 bp, D. melanogaster
aacgaatatattt

SEQ ID NO: 557420 - DNA, 13 bp, D. melanogaster
aacgaatattaaa

SEQ ID NO: 557421 - DNA, 13 bp, D. melanogaster
aacgaatatttat

SEQ ID NO: 557422 - DNA, 13 bp, D. melanogaster
aacgaatcgaaaa

SEQ ID NO: 557423 - DNA, 14 bp, D. melanogaster
aacgaatcgaaaac

SEQ ID NO: 557424 - DNA, 13 bp, D. melanogaster
aacgaatcgaaac

SEQ ID NO: 557425 - DNA, 14 bp, D. melanogaster
aacgaatcgaaacg

SEQ ID NO: 557426 - DNA, 13 bp, D. melanogaster
aacgaatcgaatc

SEQ ID NO: 557427 - DNA, 14 bp, D. melanogaster
aacgaatgctgcgc

SEQ ID NO: 557428 - DNA, 13 bp, D. melanogaster
aacgaatggaaaa

SEQ ID NO: 557429 - DNA, 13 bp, D. melanogaster
aacgaattaataa

SEQ ID NO: 557430 - DNA, 13 bp, D. melanogaster
aacgaattgaaaa

SEQ ID NO: 557431 - DNA, 13 bp, D. melanogaster
aacgaatttaaaa

SEQ ID NO: 557432 - DNA, 14 bp, D. melanogaster
aacgaatttaaaaa

SEQ ID NO: 557433 - DNA, 13 bp, D. melanogaster
aacgaatttattt

SEQ ID NO: 557434 - DNA, 13 bp, D. melanogaster
aacgaatttgaat

SEQ ID NO: 557435 - DNA, 13 bp, D. melanogaster
aacgaattttcga

SEQ ID NO: 557436 - DNA, 13 bp, D. melanogaster
aacgacaacaaat

SEQ ID NO: 557437 - DNA, 13 bp, D. melanogaster
aacgacaacagca

SEQ ID NO: 557438 - DNA, 13 bp, D. melanogaster
aacgacaacagtt

SEQ ID NO: 557439 - DNA, 13 bp, D. melanogaster
aacgacaacgaca

SEQ ID NO: 557440 - DNA, 13 bp, D. melanogaster
aacgacagcagca

SEQ ID NO: 557441 - DNA, 13 bp, D. melanogaster
aacgacccaatcc

SEQ ID NO: 557442 - DNA, 13 bp, D. melanogaster
aacgacgacaaca

SEQ ID NO: 557443 - DNA, 13 bp, D. melanogaster
aacgacgacgaca

SEQ ID NO: 557444 - DNA, 14 bp, D. melanogaster
aacgacgacgacaa

SEQ ID NO: 557445 - DNA, 13 bp, D. melanogaster
aacgacgacgacg

SEQ ID NO: 557446 - DNA, 14 bp, D. melanogaster
aacgacgacgacga

SEQ ID NO: 557447 - DNA, 14 bp, D. melanogaster
aacgactgctgctg

SEQ ID NO: 557448 - DNA, 13 bp, D. melanogaster
aacgagaaaaatg

SEQ ID NO: 557449 - DNA, 13 bp, D. melanogaster
aacgagaaaatgg

SEQ ID NO: 557450 - DNA, 13 bp, D. melanogaster
aacgagaaatttc

SEQ ID NO: 557451 - DNA, 13 bp, D. melanogaster
aacgagaacgaga

SEQ ID NO: 557452 - DNA, 13 bp, D. melanogaster
aacgagaagacta

SEQ ID NO: 557453 - DNA, 13 bp, D. melanogaster
aacgagatgaaat

SEQ ID NO: 557454 - DNA, 13 bp, D. melanogaster
aacgagatgataa

SEQ ID NO: 557455 - DNA, 13 bp, D. melanogaster
aacgagcaaaaat

SEQ ID NO: 557456 - DNA, 13 bp, D. melanogaster
aacgagccacaaa

SEQ ID NO: 557457 - DNA, 13 bp, D. melanogaster
aacgagccatttc

SEQ ID NO: 557458 - DNA, 13 bp, D. melanogaster
aacgagcggaaaa

SEQ ID NO: 557459 - DNA, 13 bp, D. melanogaster
aacgagctatcgc

SEQ ID NO: 557460 - DNA, 13 bp, D. melanogaster
aacgaggaaaaat

SEQ ID NO: 557461 - DNA, 13 bp, D. melanogaster
aacgaggctttgt

SEQ ID NO: 557462 - DNA, 17 bp, D. melanogaster
aacgaggtatgacattc

SEQ ID NO: 557463 - DNA, 13 bp, D. melanogaster
aacgagtgcaaaa

SEQ ID NO: 557464 - DNA, 13 bp, D. melanogaster
aacgagtgcagtg

SEQ ID NO: 557465 - DNA, 13 bp, D. melanogaster
aacgagttggtta

SEQ ID NO: 557466 - DNA, 13 bp, D. melanogaster
aacgataataata

SEQ ID NO: 557467 - DNA, 14 bp, D. melanogaster
aacgatacaagcaa

SEQ ID NO: 557468 - DNA, 13 bp, D. melanogaster
aacgatatttttt

SEQ ID NO: 557469 - DNA, 15 bp, D. melanogaster
aacgatcacgaatta

SEQ ID NO: 557470 - DNA, 13 bp, D. melanogaster
aacgatcagagca

SEQ ID NO: 557471 - DNA, 13 bp, D. melanogaster
aacgatccctatc

SEQ ID NO: 557472 - DNA, 13 bp, D. melanogaster
aacgatcctttgt

SEQ ID NO: 557473 - DNA, 13 bp, D. melanogaster
aacgatcgaaaat

SEQ ID NO: 557474 - DNA, 14 bp, D. melanogaster
aacgatctcaagtg

SEQ ID NO: 557475 - DNA, 13 bp, D. melanogaster
aacgatgacgatg

SEQ ID NO: 557476 - DNA, 14 bp, D. melanogaster
aacgatgatgatga

SEQ ID NO: 557477 - DNA, 13 bp, D. melanogaster
aacgatgtggcca

SEQ ID NO: 557478 - DNA, 14 bp, D. melanogaster
aacgatgtggccaa

SEQ ID NO: 557479 - DNA, 13 bp, D. melanogaster
aacgattattatt

SEQ ID NO: 557480 - DNA, 13 bp, D. melanogaster
aacgattccagct

SEQ ID NO: 557481 - DNA, 13 bp, D. melanogaster
aacgatttaatta

SEQ ID NO: 557482 - DNA, 13 bp, D. melanogaster
aacgatttcatta

SEQ ID NO: 557483 - DNA, 13 bp, D. melanogaster
aacgatttcgaaa

SEQ ID NO: 557484 - DNA, 13 bp, D. melanogaster
aacgatttcgatt

SEQ ID NO: 557485 - DNA, 13 bp, D. melanogaster
aacgatttctttt

SEQ ID NO: 557486 - DNA, 13 bp, D. melanogaster
aacgattttaaat

SEQ ID NO: 557487 - DNA, 13 bp, D. melanogaster
aacgattttattt

SEQ ID NO: 557488 - DNA, 14 bp, D. melanogaster
aacgattttatttg

SEQ ID NO: 557489 - DNA, 14 bp, D. melanogaster
aacgattttatttt

SEQ ID NO: 557490 - DNA, 13 bp, D. melanogaster
aacgattttcatt

SEQ ID NO: 557491 - DNA, 13 bp, D. melanogaster
aacgatttttaat

SEQ ID NO: 557492 - DNA, 13 bp, D. melanogaster
aacgattttttaa

SEQ ID NO: 557493 - DNA, 14 bp, D. melanogaster
aacgattttttttt

SEQ ID NO: 557494 - DNA, 14 bp, D. melanogaster
aacgcaaaacagat

SEQ ID NO: 557495 - DNA, 13 bp, D. melanogaster
aacgcaaacaatt

SEQ ID NO: 557496 - DNA, 13 bp, D. melanogaster
aacgcaaacagca

SEQ ID NO: 557497 - DNA, 13 bp, D. melanogaster
aacgcaaacgcaa

SEQ ID NO: 557498 - DNA, 13 bp, D. melanogaster
aacgcaaatatag

SEQ ID NO: 557499 - DNA, 14 bp, D. melanogaster
aacgcaaatataga

SEQ ID NO: 557500 - DNA, 13 bp, D. melanogaster
aacgcaaatcaaa

SEQ ID NO: 557501 - DNA, 13 bp, D. melanogaster
aacgcaaatcgaa

SEQ ID NO: 557502 - DNA, 13 bp, D. melanogaster
aacgcaaatgaaa

SEQ ID NO: 557503 - DNA, 13 bp, D. melanogaster
aacgcaacaatgc

SEQ ID NO: 557504 - DNA, 13 bp, D. melanogaster
aacgcaacacgca

SEQ ID NO: 557505 - DNA, 13 bp, D. melanogaster
aacgcaagttcca

SEQ ID NO: 557506 - DNA, 13 bp, D. melanogaster
aacgcaatcaaaa

SEQ ID NO: 557507 - DNA, 13 bp, D. melanogaster
aacgcaatcaaat

SEQ ID NO: 557508 - DNA, 13 bp, D. melanogaster
aacgcaatgaaaa

SEQ ID NO: 557509 - DNA, 13 bp, D. melanogaster
aacgcaatgaaat

SEQ ID NO: 557510 - DNA, 13 bp, D. melanogaster
aacgcaatttata

SEQ ID NO: 557511 - DNA, 13 bp, D. melanogaster
aacgcacaaaagt

SEQ ID NO: 557512 - DNA, 13 bp, D. melanogaster
aacgcacacacat

SEQ ID NO: 557513 - DNA, 13 bp, D. melanogaster
aacgcacacgcac

SEQ ID NO: 557514 - DNA, 13 bp, D. melanogaster
aacgcacattcca

SEQ ID NO: 557515 - DNA, 14 bp, D. melanogaster
aacgcacattccac

SEQ ID NO: 557516 - DNA, 13 bp, D. melanogaster
aacgcacgcacac

SEQ ID NO: 557517 - DNA, 13 bp, D. melanogaster
aacgcacttttat

SEQ ID NO: 557518 - DNA, 13 bp, D. melanogaster
aacgcagacatcg

SEQ ID NO: 557519 - DNA, 13 bp, D. melanogaster
aacgcagcaaaca

SEQ ID NO: 557520 - DNA, 13 bp, D. melanogaster
aacgcagcagcag

SEQ ID NO: 557521 - DNA, 14 bp, D. melanogaster
aacgcagcagcagc

SEQ ID NO: 557522 - DNA, 13 bp, D. melanogaster
aacgcagccatca

SEQ ID NO: 557523 - DNA, 13 bp, D. melanogaster
aacgcagcccgcc

SEQ ID NO: 557524 - DNA, 13 bp, D. melanogaster
aacgcagcgaaaa

SEQ ID NO: 557525 - DNA, 13 bp, D. melanogaster
aacgcataaatta

SEQ ID NO: 557526 - DNA, 13 bp, D. melanogaster
aacgcatccagaa

SEQ ID NO: 557527 - DNA, 13 bp, D. melanogaster
aacgcatcgccaa

SEQ ID NO: 557528 - DNA, 13 bp, D. melanogaster
aacgcattaatgc

SEQ ID NO: 557529 - DNA, 13 bp, D. melanogaster
aacgcatttaaaa

SEQ ID NO: 557530 - DNA, 13 bp, D. melanogaster
aacgcatttcatt

SEQ ID NO: 557531 - DNA, 13 bp, D. melanogaster
aacgcatttgaaa

SEQ ID NO: 557532 - DNA, 13 bp, D. melanogaster
aacgcatttttat

SEQ ID NO: 557533 - DNA, 13 bp, D. melanogaster
aacgcatttttct

SEQ ID NO: 557534 - DNA, 13 bp, D. melanogaster
aacgccaacgaaa

SEQ ID NO: 557535 - DNA, 13 bp, D. melanogaster
aacgccaacgaac

SEQ ID NO: 557536 - DNA, 14 bp, D. melanogaster
aacgccaacgaacg

SEQ ID NO: 557537 - DNA, 14 bp, D. melanogaster
aacgccaagaaata

SEQ ID NO: 557538 - DNA, 13 bp, D. melanogaster
aacgccaatggcg

SEQ ID NO: 557539 - DNA, 14 bp, D. melanogaster
aacgccaatgtcaa

SEQ ID NO: 557540 - DNA, 13 bp, D. melanogaster
aacgccacactga

SEQ ID NO: 557541 - DNA, 13 bp, D. melanogaster
aacgccagcaaca

SEQ ID NO: 557542 - DNA, 15 bp, D. melanogaster
aacgccagcaacagc

SEQ ID NO: 557543 - DNA, 13 bp, D. melanogaster
aacgccataaaat

SEQ ID NO: 557544 - DNA, 13 bp, D. melanogaster
aacgcccaaaact

SEQ ID NO: 557545 - DNA, 13 bp, D. melanogaster
aacgcccacactt

SEQ ID NO: 557546 - DNA, 13 bp, D. melanogaster
aacgcccactttt

SEQ ID NO: 557547 - DNA, 13 bp, D. melanogaster
aacgccccgaaaa

SEQ ID NO: 557548 - DNA, 13 bp, D. melanogaster
aacgccctaaagc

SEQ ID NO: 557549 - DNA, 14 bp, D. melanogaster
aacgccctaaagcc

SEQ ID NO: 557550 - DNA, 13 bp, D. melanogaster
aacgcctagcact

SEQ ID NO: 557551 - DNA, 13 bp, D. melanogaster
aacgcctgcagtt

SEQ ID NO: 557552 - DNA, 13 bp, D. melanogaster
aacgccttcgcaa

SEQ ID NO: 557553 - DNA, 13 bp, D. melanogaster
aacgcgaaattta

SEQ ID NO: 557554 - DNA, 13 bp, D. melanogaster
aacgcgaagcagt

SEQ ID NO: 557555 - DNA, 13 bp, D. melanogaster
aacgctgaaaatt

SEQ ID NO: 557556 - DNA, 13 bp, D. melanogaster
aacgctggacgaa

SEQ ID NO: 557557 - DNA, 13 bp, D. melanogaster
aacgcttattgaa

SEQ ID NO: 557558 - DNA, 13 bp, D. melanogaster
aacgcttctattg

SEQ ID NO: 557559 - DNA, 14 bp, D. melanogaster
aacgcttctattga

SEQ ID NO: 557560 - DNA, 13 bp, D. melanogaster
aacgctttaaaat

SEQ ID NO: 557561 - DNA, 13 bp, D. melanogaster
aacgctttaaatt

SEQ ID NO: 557562 - DNA, 13 bp, D. melanogaster
aacgcttttgttt

SEQ ID NO: 557563 - DNA, 13 bp, D. melanogaster
aacgcttttttgt

SEQ ID NO: 557564 - DNA, 13 bp, D. melanogaster
aacggaaaactga

SEQ ID NO: 557565 - DNA, 13 bp, D. melanogaster
aacggaaaatcaa

SEQ ID NO: 557566 - DNA, 13 bp, D. melanogaster
aacggaaaatggg

SEQ ID NO: 557567 - DNA, 13 bp, D. melanogaster
aacggaaaattga

SEQ ID NO: 557568 - DNA, 13 bp, D. melanogaster
aacggaaacggaa

SEQ ID NO: 557569 - DNA, 14 bp, D. melanogaster
aacggaaacggaag

SEQ ID NO: 557570 - DNA, 13 bp, D. melanogaster
aacggaaacggat

SEQ ID NO: 557571 - DNA, 13 bp, D. melanogaster
aacggaaactctt

SEQ ID NO: 557572 - DNA, 13 bp, D. melanogaster
aacggaaataaat

SEQ ID NO: 557573 - DNA, 14 bp, D. melanogaster
aacggaaatgaaaa

SEQ ID NO: 557574 - DNA, 14 bp, D. melanogaster
aacggaaatggaaa

SEQ ID NO: 557575 - DNA, 13 bp, D. melanogaster
aacggaaatttaa

SEQ ID NO: 557576 - DNA, 13 bp, D. melanogaster
aacggaaatttat

SEQ ID NO: 557577 - DNA, 13 bp, D. melanogaster
aacggaacaaatt

SEQ ID NO: 557578 - DNA, 14 bp, D. melanogaster
aacggaagcggaaa

SEQ ID NO: 557579 - DNA, 13 bp, D. melanogaster
aacggaagttgca

SEQ ID NO: 557580 - DNA, 13 bp, D. melanogaster
aacggaatataaa

SEQ ID NO: 557581 - DNA, 13 bp, D. melanogaster
aacggaatgaaaa

SEQ ID NO: 557582 - DNA, 13 bp, D. melanogaster
aacggaatggaac

SEQ ID NO: 557583 - DNA, 13 bp, D. melanogaster
aacggaatggaat

SEQ ID NO: 557584 - DNA, 13 bp, D. melanogaster
aacggaattttca

SEQ ID NO: 557585 - DNA, 13 bp, D. melanogaster
aacggacacataa

SEQ ID NO: 557586 - DNA, 13 bp, D. melanogaster
aacggacagacgg

SEQ ID NO: 557587 - DNA, 14 bp, D. melanogaster
aacggacagacgga

SEQ ID NO: 557588 - DNA, 13 bp, D. melanogaster
aacggacatggga

SEQ ID NO: 557589 - DNA, 14 bp, D. melanogaster
aacggagcccaaaa

SEQ ID NO: 557590 - DNA, 13 bp, D. melanogaster
aacggatataaaa

SEQ ID NO: 557591 - DNA, 13 bp, D. melanogaster
aacggatcccagc

SEQ ID NO: 557592 - DNA, 14 bp, D. melanogaster
aacggatgacattc

SEQ ID NO: 557593 - DNA, 13 bp, D. melanogaster
aacggcaaacaac

SEQ ID NO: 557594 - DNA, 14 bp, D. melanogaster
aacggcaaacggca

SEQ ID NO: 557595 - DNA, 13 bp, D. melanogaster
aacggcaaataaa

SEQ ID NO: 557596 - DNA, 13 bp, D. melanogaster
aacggcaaatgca

SEQ ID NO: 557597 - DNA, 13 bp, D. melanogaster
aacggcaacaact

SEQ ID NO: 557598 - DNA, 13 bp, D. melanogaster
aacggcaacaatg

SEQ ID NO: 557599 - DNA, 13 bp, D. melanogaster
aacggcaacagca

SEQ ID NO: 557600 - DNA, 14 bp, D. melanogaster
aacggcaacagcaa

SEQ ID NO: 557601 - DNA, 13 bp, D. melanogaster
aacggcaacggca

SEQ ID NO: 557602 - DNA, 13 bp, D. melanogaster
aacggcaacggcg

SEQ ID NO: 557603 - DNA, 13 bp, D. melanogaster
aacggcaatgaaa

SEQ ID NO: 557604 - DNA, 14 bp, D. melanogaster
aacggcaatggcaa

SEQ ID NO: 557605 - DNA, 13 bp, D. melanogaster
aacggcaattgca

SEQ ID NO: 557606 - DNA, 13 bp, D. melanogaster
aacggcagcaaaa

SEQ ID NO: 557607 - DNA, 14 bp, D. melanogaster
aacggcagcaacaa

SEQ ID NO: 557608 - DNA, 14 bp, D. melanogaster
aacggcagcagcag

SEQ ID NO: 557609 - DNA, 13 bp, D. melanogaster
aacggcagcagcg

SEQ ID NO: 557610 - DNA, 13 bp, D. melanogaster
aacggcagcggca

SEQ ID NO: 557611 - DNA, 13 bp, D. melanogaster
aacggcaggaaaa

SEQ ID NO: 557612 - DNA, 14 bp, D. melanogaster
aacggccagcaact

SEQ ID NO: 557613 - DNA, 16 bp, D. melanogaster
aacggccatacattgg

SEQ ID NO: 557614 - DNA, 13 bp, D. melanogaster
aacggccattcat

SEQ ID NO: 557615 - DNA, 13 bp, D. melanogaster
aacggcggcaaca

SEQ ID NO: 557616 - DNA, 13 bp, D. melanogaster
aacggctatcagc

SEQ ID NO: 557617 - DNA, 13 bp, D. melanogaster
aacgggaacggga

SEQ ID NO: 557618 - DNA, 14 bp, D. melanogaster
aacgggaacgggaa

SEQ ID NO: 557619 - DNA, 13 bp, D. melanogaster
aacgggatgtggg

SEQ ID NO: 557620 - DNA, 13 bp, D. melanogaster
aacgggctcttaa

SEQ ID NO: 557621 - DNA, 13 bp, D. melanogaster
aacggggcgtatg

SEQ ID NO: 557622 - DNA, 14 bp, D. melanogaster
aacggggcgtatgc

SEQ ID NO: 557623 - DNA, 13 bp, D. melanogaster
aacggggcgtggc

SEQ ID NO: 557624 - DNA, 13 bp, D. melanogaster
aacggggtgtctt

SEQ ID NO: 557625 - DNA, 13 bp, D. melanogaster
aacggtatcgatt

SEQ ID NO: 557626 - DNA, 13 bp, D. melanogaster
aacggtcaacagc

SEQ ID NO: 557627 - DNA, 13 bp, D. melanogaster
aacggtcacactg

SEQ ID NO: 557628 - DNA, 13 bp, D. melanogaster
aacggtcgaagga

SEQ ID NO: 557629 - DNA, 13 bp, D. melanogaster
aacggtttgcgcc

SEQ ID NO: 557630 - DNA, 14 bp, D. melanogaster
aacgtaaaaattat

SEQ ID NO: 557631 - DNA, 13 bp, D. melanogaster
aacgtaaacaaag

SEQ ID NO: 557632 - DNA, 13 bp, D. melanogaster
aacgtaaacataa

SEQ ID NO: 557633 - DNA, 14 bp, D. melanogaster
aacgtaaacataaa

SEQ ID NO: 557634 - DNA, 13 bp, D. melanogaster
aacgtaaatttaa

SEQ ID NO: 557635 - DNA, 13 bp, D. melanogaster
aacgtaatattaa

SEQ ID NO: 557636 - DNA, 13 bp, D. melanogaster
aacgtaatattga

SEQ ID NO: 557637 - DNA, 13 bp, D. melanogaster
aacgtaattaaaa

SEQ ID NO: 557638 - DNA, 13 bp, D. melanogaster
aacgtacatacat

SEQ ID NO: 557639 - DNA, 14 bp, D. melanogaster
aacgtacatacata

SEQ ID NO: 557640 - DNA, 13 bp, D. melanogaster
aacgtacatatgt

SEQ ID NO: 557641 - DNA, 13 bp, D. melanogaster
aacgtagagtaaa

SEQ ID NO: 557642 - DNA, 13 bp, D. melanogaster
aacgtagttaaag

SEQ ID NO: 557643 - DNA, 13 bp, D. melanogaster
aacgtatgaattt

SEQ ID NO: 557644 - DNA, 13 bp, D. melanogaster
aacgtatgtatgt

SEQ ID NO: 557645 - DNA, 14 bp, D. melanogaster
aacgtatgtatgta

SEQ ID NO: 557646 - DNA, 14 bp, D. melanogaster
aacgtatttaatat

SEQ ID NO: 557647 - DNA, 13 bp, D. melanogaster
aacgtatttttaa

SEQ ID NO: 557648 - DNA, 13 bp, D. melanogaster
aacgtatttttat

SEQ ID NO: 557649 - DNA, 13 bp, D. melanogaster
aacgtcaagatct

SEQ ID NO: 557650 - DNA, 14 bp, D. melanogaster
aacgtcaagatctc

SEQ ID NO: 557651 - DNA, 13 bp, D. melanogaster
aacgtcgagatct

SEQ ID NO: 557652 - DNA, 14 bp, D. melanogaster
aacgtcgagatctt

SEQ ID NO: 557653 - DNA, 13 bp, D. melanogaster
aacgtctgctggt

SEQ ID NO: 557654 - DNA, 13 bp, D. melanogaster
aacgtctgtaaaa

SEQ ID NO: 557655 - DNA, 13 bp, D. melanogaster
aacgtgaacttta

SEQ ID NO: 557656 - DNA, 13 bp, D. melanogaster
aacgtgatgttac

SEQ ID NO: 557657 - DNA, 13 bp, D. melanogaster
aacgtgcatctcc

SEQ ID NO: 557658 - DNA, 13 bp, D. melanogaster
aacgtgccattta

SEQ ID NO: 557659 - DNA, 13 bp, D. melanogaster
aacgtggccaaca

SEQ ID NO: 557660 - DNA, 13 bp, D. melanogaster
aacgtggcccaaa

SEQ ID NO: 557661 - DNA, 13 bp, D. melanogaster
aacgtgttcaata

SEQ ID NO: 557662 - DNA, 13 bp, D. melanogaster
aacgttaaaaatg

SEQ ID NO: 557663 - DNA, 13 bp, D. melanogaster
aacgttaaggcaa

SEQ ID NO: 557664 - DNA, 13 bp, D. melanogaster
aacgttagcaaat

SEQ ID NO: 557665 - DNA, 13 bp, D. melanogaster
aacgttcagctta

SEQ ID NO: 557666 - DNA, 14 bp, D. melanogaster
aacgttcatacgga

SEQ ID NO: 557667 - DNA, 13 bp, D. melanogaster
aacgttcatatat

SEQ ID NO: 557668 - DNA, 13 bp, D. melanogaster
aacgttgaaatta

SEQ ID NO: 557669 - DNA, 13 bp, D. melanogaster
aacgttgaataaa

SEQ ID NO: 557670 - DNA, 13 bp, D. melanogaster
aacgttgagatct

SEQ ID NO: 557671 - DNA, 13 bp, D. melanogaster
aacgttgccagga

SEQ ID NO: 557672 - DNA, 13 bp, D. melanogaster
aacgttgtggagg

SEQ ID NO: 557673 - DNA, 13 bp, D. melanogaster
aacgtttaaaaaa

SEQ ID NO: 557674 - DNA, 13 bp, D. melanogaster
aacgtttccattt

SEQ ID NO: 557675 - DNA, 13 bp, D. melanogaster
aacgtttgcccaa

SEQ ID NO: 557676 - DNA, 14 bp, D. melanogaster
aacgtttgcccacc

SEQ ID NO: 557677 - DNA, 13 bp, D. melanogaster
aacgtttgttttt

SEQ ID NO: 557678 - DNA, 13 bp, D. melanogaster
aacgttttaaaaa

SEQ ID NO: 557679 - DNA, 13 bp, D. melanogaster
aacgttttaattg

SEQ ID NO: 557680 - DNA, 13 bp, D. melanogaster
aacgtttttaata

SEQ ID NO: 557681 - DNA, 13 bp, D. melanogaster
aacgtttttggtt

SEQ ID NO: 557682 - DNA, 13 bp, D. melanogaster
aacgtttttgttt

SEQ ID NO: 557683 - DNA, 13 bp, D. melanogaster
aactaaaaactga

SEQ ID NO: 557684 - DNA, 13 bp, D. melanogaster
aactaaaactatt

SEQ ID NO: 557685 - DNA, 13 bp, D. melanogaster
aactaaaactgaa

SEQ ID NO: 557686 - DNA, 14 bp, D. melanogaster
aactaaaactgaaa

SEQ ID NO: 557687 - DNA, 13 bp, D. melanogaster
aactaaaactgca

SEQ ID NO: 557688 - DNA, 13 bp, D. melanogaster
aactaaaacttta

SEQ ID NO: 557689 - DNA, 13 bp, D. melanogaster
aactaaaagcaat

SEQ ID NO: 557690 - DNA, 13 bp, D. melanogaster
aactaaaagtaat

SEQ ID NO: 557691 - DNA, 13 bp, D. melanogaster
aactaaaagtgtt

SEQ ID NO: 557692 - DNA, 13 bp, D. melanogaster
aactaaaatgttt

SEQ ID NO: 557693 - DNA, 14 bp, D. melanogaster
aactaaaatgtttt

SEQ ID NO: 557694 - DNA, 13 bp, D. melanogaster
aactaaaattaag

SEQ ID NO: 557695 - DNA, 14 bp, D. melanogaster
aactaaactaaact

SEQ ID NO: 557696 - DNA, 14 bp, D. melanogaster
aactaaactaaatg

SEQ ID NO: 557697 - DNA, 13 bp, D. melanogaster
aactaaactaacg

SEQ ID NO: 557698 - DNA, 13 bp, D. melanogaster
aactaaacttaat

SEQ ID NO: 557699 - DNA, 13 bp, D. melanogaster
aactaaactttat

SEQ ID NO: 557700 - DNA, 13 bp, D. melanogaster
aactaaagcaaat

SEQ ID NO: 557701 - DNA, 13 bp, D. melanogaster
aactaaagcaatt

SEQ ID NO: 557702 - DNA, 13 bp, D. melanogaster
aactaaaggagat

SEQ ID NO: 557703 - DNA, 13 bp, D. melanogaster
aactaaagtgcaa

SEQ ID NO: 557704 - DNA, 13 bp, D. melanogaster
aactaaagttaaa

SEQ ID NO: 557705 - DNA, 13 bp, D. melanogaster
aactaaagtttaa

SEQ ID NO: 557706 - DNA, 13 bp, D. melanogaster
aactaaataagag

SEQ ID NO: 557707 - DNA, 13 bp, D. melanogaster
aactaaatacttt

SEQ ID NO: 557708 - DNA, 13 bp, D. melanogaster
aactaaatatatg

SEQ ID NO: 557709 - DNA, 13 bp, D. melanogaster
aactaaatatgtt

SEQ ID NO: 557710 - DNA, 14 bp, D. melanogaster
aactaaatattttc

SEQ ID NO: 557711 - DNA, 13 bp, D. melanogaster
aactaaatcgaat

SEQ ID NO: 557712 - DNA, 13 bp, D. melanogaster
aactaaatgaaat

SEQ ID NO: 557713 - DNA, 13 bp, D. melanogaster
aactaaatgaata

SEQ ID NO: 557714 - DNA, 13 bp, D. melanogaster
aactaaatgaatt

SEQ ID NO: 557715 - DNA, 13 bp, D. melanogaster
aactaaatggaaa

SEQ ID NO: 557716 - DNA, 13 bp, D. melanogaster
aactaaatggcaa

SEQ ID NO: 557717 - DNA, 13 bp, D. melanogaster
aactaaatgtaaa

SEQ ID NO: 557718 - DNA, 13 bp, D. melanogaster
aactaaatgtata

SEQ ID NO: 557719 - DNA, 13 bp, D. melanogaster
aactaaatgttaa

SEQ ID NO: 557720 - DNA, 13 bp, D. melanogaster
aactaaattagtt

SEQ ID NO: 557721 - DNA, 13 bp, D. melanogaster
aactaaattcttt

SEQ ID NO: 557722 - DNA, 13 bp, D. melanogaster
aactaaattgttt

SEQ ID NO: 557723 - DNA, 13 bp, D. melanogaster
aactaaatttgaa

SEQ ID NO: 557724 - DNA, 13 bp, D. melanogaster
aactaaatttgtt

SEQ ID NO: 557725 - DNA, 14 bp, D. melanogaster
aactaacaataagt

SEQ ID NO: 557726 - DNA, 13 bp, D. melanogaster
aactaaccaaatt

SEQ ID NO: 557727 - DNA, 13 bp, D. melanogaster
aactaaccaacta

SEQ ID NO: 557728 - DNA, 13 bp, D. melanogaster
aactaaccaattt

SEQ ID NO: 557729 - DNA, 13 bp, D. melanogaster
aactaacccaaat

SEQ ID NO: 557730 - DNA, 13 bp, D. melanogaster
aactaactaaact

SEQ ID NO: 557731 - DNA, 13 bp, D. melanogaster
aactaactaacag

SEQ ID NO: 557732 - DNA, 13 bp, D. melanogaster
aactaactaacta

SEQ ID NO: 557733 - DNA, 14 bp, D. melanogaster
aactaactaactaa

SEQ ID NO: 557734 - DNA, 14 bp, D. melanogaster
aactaactaactat

SEQ ID NO: 557735 - DNA, 13 bp, D. melanogaster
aactaactaactg

SEQ ID NO: 557736 - DNA, 13 bp, D. melanogaster
aactaactaattt

SEQ ID NO: 557737 - DNA, 13 bp, D. melanogaster
aactaactcgaaa

SEQ ID NO: 557738 - DNA, 13 bp, D. melanogaster
aactaactttatt

SEQ ID NO: 557739 - DNA, 13 bp, D. melanogaster
aactaagaaaatt

SEQ ID NO: 557740 - DNA, 13 bp, D. melanogaster
aactaagaaatta

SEQ ID NO: 557741 - DNA, 13 bp, D. melanogaster
aactaagcaaaca

SEQ ID NO: 557742 - DNA, 13 bp, D. melanogaster
aactaagcaaata

SEQ ID NO: 557743 - DNA, 13 bp, D. melanogaster
aactaagccaaaa

SEQ ID NO: 557744 - DNA, 13 bp, D. melanogaster
aactaagccaaca

SEQ ID NO: 557745 - DNA, 13 bp, D. melanogaster
aactaagcgaaaa

SEQ ID NO: 557746 - DNA, 13 bp, D. melanogaster
aactaagtaaata

SEQ ID NO: 557747 - DNA, 13 bp, D. melanogaster
aactaataactta

SEQ ID NO: 557748 - DNA, 14 bp, D. melanogaster
aactaataataatg

SEQ ID NO: 557749 - DNA, 13 bp, D. melanogaster
aactaataatagt

SEQ ID NO: 557750 - DNA, 13 bp, D. melanogaster
aactaatacatat

SEQ ID NO: 557751 - DNA, 13 bp, D. melanogaster
aactaatatacta

SEQ ID NO: 557752 - DNA, 13 bp, D. melanogaster
aactaatatttac

SEQ ID NO: 557753 - DNA, 13 bp, D. melanogaster
aactaatcgcgaa

SEQ ID NO: 557754 - DNA, 13 bp, D. melanogaster
aactaatgaaatt

SEQ ID NO: 557755 - DNA, 14 bp, D. melanogaster
aactaatgcagttt

SEQ ID NO: 557756 - DNA, 14 bp, D. melanogaster
aactaattaaaatg

SEQ ID NO: 557757 - DNA, 13 bp, D. melanogaster
aactaattaaact

SEQ ID NO: 557758 - DNA, 13 bp, D. melanogaster
aactaattaaatg

SEQ ID NO: 557759 - DNA, 13 bp, D. melanogaster
aactaattagcaa

SEQ ID NO: 557760 - DNA, 13 bp, D. melanogaster
aactaattagcat

SEQ ID NO: 557761 - DNA, 13 bp, D. melanogaster
aactaattcatat

SEQ ID NO: 557762 - DNA, 13 bp, D. melanogaster
aactaattgaaaa

SEQ ID NO: 557763 - DNA, 13 bp, D. melanogaster
aactaattgaaag

SEQ ID NO: 557764 - DNA, 13 bp, D. melanogaster
aactaattgaatt

SEQ ID NO: 557765 - DNA, 14 bp, D. melanogaster
aactaattgaattt

SEQ ID NO: 557766 - DNA, 13 bp, D. melanogaster
aactaattgcatt

SEQ ID NO: 557767 - DNA, 13 bp, D. melanogaster
aactaattgccaa

SEQ ID NO: 557768 - DNA, 13 bp, D. melanogaster
aactaattgctaa

SEQ ID NO: 557769 - DNA, 13 bp, D. melanogaster
aactaatttactt

SEQ ID NO: 557770 - DNA, 13 bp, D. melanogaster
aactaatttagtt

SEQ ID NO: 557771 - DNA, 13 bp, D. melanogaster
aactaatttcgtt

SEQ ID NO: 557772 - DNA, 13 bp, D. melanogaster
aactaatttgtaa

SEQ ID NO: 557773 - DNA, 13 bp, D. melanogaster
aactaatttgttt

SEQ ID NO: 557774 - DNA, 13 bp, D. melanogaster
aactaattttaag

SEQ ID NO: 557775 - DNA, 13 bp, D. melanogaster
aactaattttatg

SEQ ID NO: 557776 - DNA, 13 bp, D. melanogaster
aactaattttgtt

SEQ ID NO: 557777 - DNA, 14 bp, D. melanogaster
aactacaaactatt

SEQ ID NO: 557778 - DNA, 13 bp, D. melanogaster
aactacaaacttc

SEQ ID NO: 557779 - DNA, 13 bp, D. melanogaster
aactacaaatatt

SEQ ID NO: 557780 - DNA, 13 bp, D. melanogaster
aactacaacagaa

SEQ ID NO: 557781 - DNA, 13 bp, D. melanogaster
aactacaactgca

SEQ ID NO: 557782 - DNA, 13 bp, D. melanogaster
aactacaacttca

SEQ ID NO: 557783 - DNA, 14 bp, D. melanogaster
aactacaagctgag

SEQ ID NO: 557784 - DNA, 13 bp, D. melanogaster
aactacaataatt

SEQ ID NO: 557785 - DNA, 13 bp, D. melanogaster
aactacaatagtt

SEQ ID NO: 557786 - DNA, 13 bp, D. melanogaster
aactacaatatat

SEQ ID NO: 557787 - DNA, 13 bp, D. melanogaster
aactacaatattt

SEQ ID NO: 557788 - DNA, 13 bp, D. melanogaster
aactacaatccaa

SEQ ID NO: 557789 - DNA, 13 bp, D. melanogaster
aactacaatgata

SEQ ID NO: 557790 - DNA, 13 bp, D. melanogaster
aactacaatgtag

SEQ ID NO: 557791 - DNA, 13 bp, D. melanogaster
aactacaattaca

SEQ ID NO: 557792 - DNA, 13 bp, D. melanogaster
aactacacctgga

SEQ ID NO: 557793 - DNA, 13 bp, D. melanogaster
aactacagcaaca

SEQ ID NO: 557794 - DNA, 13 bp, D. melanogaster
aactacatatata

SEQ ID NO: 557795 - DNA, 13 bp, D. melanogaster
aactacatatatt

SEQ ID NO: 557796 - DNA, 13 bp, D. melanogaster
aactacatatgta

SEQ ID NO: 557797 - DNA, 14 bp, D. melanogaster
aactacatatgtat

SEQ ID NO: 557798 - DNA, 13 bp, D. melanogaster
aactacatcagaa

SEQ ID NO: 557799 - DNA, 13 bp, D. melanogaster
aactacattttaa

SEQ ID NO: 557800 - DNA, 13 bp, D. melanogaster
aactacattttat

SEQ ID NO: 557801 - DNA, 13 bp, D. melanogaster
aactactacacat

SEQ ID NO: 557802 - DNA, 13 bp, D. melanogaster
aactactgcagta

SEQ ID NO: 557803 - DNA, 13 bp, D. melanogaster
aactactgtaatt

SEQ ID NO: 557804 - DNA, 14 bp, D. melanogaster
aactactgtaattt

SEQ ID NO: 557805 - DNA, 13 bp, D. melanogaster
aactacttgaaaa

SEQ ID NO: 557806 - DNA, 13 bp, D. melanogaster
aactactttaagc

SEQ ID NO: 557807 - DNA, 13 bp, D. melanogaster
aactactttttaa

SEQ ID NO: 557808 - DNA, 13 bp, D. melanogaster
aactagaaagctt

SEQ ID NO: 557809 - DNA, 13 bp, D. melanogaster
aactagaaatatt

SEQ ID NO: 557810 - DNA, 13 bp, D. melanogaster
aactagacaaatg

SEQ ID NO: 557811 - DNA, 14 bp, D. melanogaster
aactagacaaatgt

SEQ ID NO: 557812 - DNA, 13 bp, D. melanogaster
aactagagcgaca

SEQ ID NO: 557813 - DNA, 13 bp, D. melanogaster
aactagcaactag

SEQ ID NO: 557814 - DNA, 13 bp, D. melanogaster
aactagcaagagt

SEQ ID NO: 557815 - DNA, 13 bp, D. melanogaster
aactagcaatttc

SEQ ID NO: 557816 - DNA, 13 bp, D. melanogaster
aactagctatttt

SEQ ID NO: 557817 - DNA, 13 bp, D. melanogaster
aactagtttaaaa

SEQ ID NO: 557818 - DNA, 13 bp, D. melanogaster
aactagttttacg

SEQ ID NO: 557819 - DNA, 13 bp, D. melanogaster
aactagtttttaa

SEQ ID NO: 557820 - DNA, 13 bp, D. melanogaster
aactagtttttat

SEQ ID NO: 557821 - DNA, 13 bp, D. melanogaster
aactagtttttca

SEQ ID NO: 557822 - DNA, 13 bp, D. melanogaster
aactagtttttct

SEQ ID NO: 557823 - DNA, 13 bp, D. melanogaster
aactataaaagct

SEQ ID NO: 557824 - DNA, 14 bp, D. melanogaster
aactataaaagcta

SEQ ID NO: 557825 - DNA, 14 bp, D. melanogaster
aactataaaagctt

SEQ ID NO: 557826 - DNA, 13 bp, D. melanogaster
aactataaaatct

SEQ ID NO: 557827 - DNA, 13 bp, D. melanogaster
aactataaaatgt

SEQ ID NO: 557828 - DNA, 13 bp, D. melanogaster
aactataaacatt

SEQ ID NO: 557829 - DNA, 13 bp, D. melanogaster
aactataaatttc

SEQ ID NO: 557830 - DNA, 13 bp, D. melanogaster
aactataacaagt

SEQ ID NO: 557831 - DNA, 14 bp, D. melanogaster
aactataaccacca

SEQ ID NO: 557832 - DNA, 13 bp, D. melanogaster
aactataactata

SEQ ID NO: 557833 - DNA, 13 bp, D. melanogaster
aactataactttt

SEQ ID NO: 557834 - DNA, 13 bp, D. melanogaster
aactatacatata

SEQ ID NO: 557835 - DNA, 13 bp, D. melanogaster
aactataccagca

SEQ ID NO: 557836 - DNA, 14 bp, D. melanogaster
aactatagtgtata

SEQ ID NO: 557837 - DNA, 13 bp, D. melanogaster
aactatataacta

SEQ ID NO: 557838 - DNA, 14 bp, D. melanogaster
aactatatatacat

SEQ ID NO: 557839 - DNA, 13 bp, D. melanogaster
aactatatatatg

SEQ ID NO: 557840 - DNA, 13 bp, D. melanogaster
aactatattacca

SEQ ID NO: 557841 - DNA, 13 bp, D. melanogaster
aactatatttctt

SEQ ID NO: 557842 - DNA, 13 bp, D. melanogaster
aactatcgatgca

SEQ ID NO: 557843 - DNA, 13 bp, D. melanogaster
aactatctttaaa

SEQ ID NO: 557844 - DNA, 13 bp, D. melanogaster
aactatgaaaatg

SEQ ID NO: 557845 - DNA, 13 bp, D. melanogaster
aactatgaactat

SEQ ID NO: 557846 - DNA, 13 bp, D. melanogaster
aactatgagtcag

SEQ ID NO: 557847 - DNA, 13 bp, D. melanogaster
aactatgatattt

SEQ ID NO: 557848 - DNA, 13 bp, D. melanogaster
aactatgcaaatt

SEQ ID NO: 557849 - DNA, 13 bp, D. melanogaster
aactatggcaagt

SEQ ID NO: 557850 - DNA, 13 bp, D. melanogaster
aactatggcttta

SEQ ID NO: 557851 - DNA, 14 bp, D. melanogaster
aactatggctttaa

SEQ ID NO: 557852 - DNA, 13 bp, D. melanogaster
aactatgtacata

SEQ ID NO: 557853 - DNA, 13 bp, D. melanogaster
aactatgtatata

SEQ ID NO: 557854 - DNA, 13 bp, D. melanogaster
aactatgtatatg

SEQ ID NO: 557855 - DNA, 13 bp, D. melanogaster
aactatgtattta

SEQ ID NO: 557856 - DNA, 13 bp, D. melanogaster
aactatgtatttt

SEQ ID NO: 557857 - DNA, 13 bp, D. melanogaster
aactatgtgaagg

SEQ ID NO: 557858 - DNA, 13 bp, D. melanogaster
aactatgtttaaa

SEQ ID NO: 557859 - DNA, 13 bp, D. melanogaster
aactattaaaact

SEQ ID NO: 557860 - DNA, 13 bp, D. melanogaster
aactattaaagct

SEQ ID NO: 557861 - DNA, 13 bp, D. melanogaster
aactattaattca

SEQ ID NO: 557862 - DNA, 13 bp, D. melanogaster
aactattacaaat

SEQ ID NO: 557863 - DNA, 13 bp, D. melanogaster
aactattcaaata

SEQ ID NO: 557864 - DNA, 13 bp, D. melanogaster
aactattcaattt

SEQ ID NO: 557865 - DNA, 13 bp, D. melanogaster
aactattccagtt

SEQ ID NO: 557866 - DNA, 13 bp, D. melanogaster
aactattgaaaat

SEQ ID NO: 557867 - DNA, 13 bp, D. melanogaster
aactattgataaa

SEQ ID NO: 557868 - DNA, 13 bp, D. melanogaster
aactattgcaaat

SEQ ID NO: 557869 - DNA, 13 bp, D. melanogaster
aactattgtacaa

SEQ ID NO: 557870 - DNA, 13 bp, D. melanogaster
aactattgttgtt

SEQ ID NO: 557871 - DNA, 14 bp, D. melanogaster
aactattgttgttc

SEQ ID NO: 557872 - DNA, 13 bp, D. melanogaster
aactattgttttt

SEQ ID NO: 557873 - DNA, 13 bp, D. melanogaster
aactatttaacgg

SEQ ID NO: 557874 - DNA, 13 bp, D. melanogaster
aactatttaagct

SEQ ID NO: 557875 - DNA, 13 bp, D. melanogaster
aactatttatgga

SEQ ID NO: 557876 - DNA, 13 bp, D. melanogaster
aactatttattca

SEQ ID NO: 557877 - DNA, 13 bp, D. melanogaster
aactatttcaata

SEQ ID NO: 557878 - DNA, 13 bp, D. melanogaster
aactatttcatta

SEQ ID NO: 557879 - DNA, 13 bp, D. melanogaster
aactatttccatt

SEQ ID NO: 557880 - DNA, 13 bp, D. melanogaster
aactatttctcct

SEQ ID NO: 557881 - DNA, 13 bp, D. melanogaster
aactatttgaatt

SEQ ID NO: 557882 - DNA, 13 bp, D. melanogaster
aactatttgcaat

SEQ ID NO: 557883 - DNA, 13 bp, D. melanogaster
aactatttgcaca

SEQ ID NO: 557884 - DNA, 13 bp, D. melanogaster
aactatttgcata

SEQ ID NO: 557885 - DNA, 13 bp, D. melanogaster
aactatttgcatt

SEQ ID NO: 557886 - DNA, 13 bp, D. melanogaster
aactatttgcttt

SEQ ID NO: 557887 - DNA, 13 bp, D. melanogaster
aactatttgttta

SEQ ID NO: 557888 - DNA, 14 bp, D. melanogaster
aactatttgttttt

SEQ ID NO: 557889 - DNA, 13 bp, D. melanogaster
aactattttaaag

SEQ ID NO: 557890 - DNA, 13 bp, D. melanogaster
aactattttagaa

SEQ ID NO: 557891 - DNA, 13 bp, D. melanogaster
aactattttatgt

SEQ ID NO: 557892 - DNA, 13 bp, D. melanogaster
aactattttcaat

SEQ ID NO: 557893 - DNA, 13 bp, D. melanogaster
aactattttctat

SEQ ID NO: 557894 - DNA, 13 bp, D. melanogaster
aactattttgcaa

SEQ ID NO: 557895 - DNA, 13 bp, D. melanogaster
aactattttggca

SEQ ID NO: 557896 - DNA, 13 bp, D. melanogaster
aactatttttgat

SEQ ID NO: 557897 - DNA, 13 bp, D. melanogaster
aactatttttgct

SEQ ID NO: 557898 - DNA, 13 bp, D. melanogaster
aactcaaaaccga

SEQ ID NO: 557899 - DNA, 13 bp, D. melanogaster
aactcaaaagcaa

SEQ ID NO: 557900 - DNA, 13 bp, D. melanogaster
aactcaaaccgaa

SEQ ID NO: 557901 - DNA, 13 bp, D. melanogaster
aactcaaacgaaa

SEQ ID NO: 557902 - DNA, 13 bp, D. melanogaster
aactcaaactcaa

SEQ ID NO: 557903 - DNA, 13 bp, D. melanogaster
aactcaaacttaa

SEQ ID NO: 557904 - DNA, 13 bp, D. melanogaster
aactcaaagccaa

SEQ ID NO: 557905 - DNA, 14 bp, D. melanogaster
aactcaaatcaaat

SEQ ID NO: 557906 - DNA, 13 bp, D. melanogaster
aactcaaatgaat

SEQ ID NO: 557907 - DNA, 13 bp, D. melanogaster
aactcaaattata

SEQ ID NO: 557908 - DNA, 13 bp, D. melanogaster
aactcaaattcaa

SEQ ID NO: 557909 - DNA, 13 bp, D. melanogaster
aactcaaattggc

SEQ ID NO: 557910 - DNA, 13 bp, D. melanogaster
aactcaaatttaa

SEQ ID NO: 557911 - DNA, 13 bp, D. melanogaster
aactcaacaatca

SEQ ID NO: 557912 - DNA, 13 bp, D. melanogaster
aactcaacgagaa

SEQ ID NO: 557913 - DNA, 13 bp, D. melanogaster
aactcaacgaggt

SEQ ID NO: 557914 - DNA, 13 bp, D. melanogaster
aactcaactaaac

SEQ ID NO: 557915 - DNA, 13 bp, D. melanogaster
aactcaactcaaa

SEQ ID NO: 557916 - DNA, 13 bp, D. melanogaster
aactcaactcaac

SEQ ID NO: 557917 - DNA, 14 bp, D. melanogaster
aactcaactcaact

SEQ ID NO: 557918 - DNA, 13 bp, D. melanogaster
aactcaactcaat

SEQ ID NO: 557919 - DNA, 13 bp, D. melanogaster
aactcaactcgaa

SEQ ID NO: 557920 - DNA, 13 bp, D. melanogaster
aactcaactgaaa

SEQ ID NO: 557921 - DNA, 13 bp, D. melanogaster
aactcaacttaaa

SEQ ID NO: 557922 - DNA, 13 bp, D. melanogaster
aactcaacttaac

SEQ ID NO: 557923 - DNA, 13 bp, D. melanogaster
aactcaacttcaa

SEQ ID NO: 557924 - DNA, 14 bp, D. melanogaster
aactcaacttcaaa

SEQ ID NO: 557925 - DNA, 13 bp, D. melanogaster
aactcaatcaaat

SEQ ID NO: 557926 - DNA, 13 bp, D. melanogaster
aactcaatctacg

SEQ ID NO: 557927 - DNA, 13 bp, D. melanogaster
aactcaattaaag

SEQ ID NO: 557928 - DNA, 13 bp, D. melanogaster
aactcaattaaca

SEQ ID NO: 557929 - DNA, 13 bp, D. melanogaster
aactcaattaatt

SEQ ID NO: 557930 - DNA, 13 bp, D. melanogaster
aactcaattgttt

SEQ ID NO: 557931 - DNA, 13 bp, D. melanogaster
aactcaatttgaa

SEQ ID NO: 557932 - DNA, 14 bp, D. melanogaster
aactcaatttgaat

SEQ ID NO: 557933 - DNA, 13 bp, D. melanogaster
aactcaatttgat

SEQ ID NO: 557934 - DNA, 13 bp, D. melanogaster
aactcaatttgca

SEQ ID NO: 557935 - DNA, 13 bp, D. melanogaster
aactcaatttgcc

SEQ ID NO: 557936 - DNA, 13 bp, D. melanogaster
aactcaattttca

SEQ ID NO: 557937 - DNA, 14 bp, D. melanogaster
aactcaattttcaa

SEQ ID NO: 557938 - DNA, 13 bp, D. melanogaster
aactcacaaaatc

SEQ ID NO: 557939 - DNA, 13 bp, D. melanogaster
aactcactcactc

SEQ ID NO: 557940 - DNA, 14 bp, D. melanogaster
aactcactgaagaa

SEQ ID NO: 557941 - DNA, 13 bp, D. melanogaster
aactcagctgaaa

SEQ ID NO: 557942 - DNA, 14 bp, D. melanogaster
aactcatctacaag

SEQ ID NO: 557943 - DNA, 13 bp, D. melanogaster
aactcatgcccat

SEQ ID NO: 557944 - DNA, 13 bp, D. melanogaster
aactcattaaata

SEQ ID NO: 557945 - DNA, 13 bp, D. melanogaster
aactcattaagtg

SEQ ID NO: 557946 - DNA, 13 bp, D. melanogaster
aactcattaattt

SEQ ID NO: 557947 - DNA, 13 bp, D. melanogaster
aactcattagatg

SEQ ID NO: 557948 - DNA, 14 bp, D. melanogaster
aactcattagatgt

SEQ ID NO: 557949 - DNA, 13 bp, D. melanogaster
aactcatttaata

SEQ ID NO: 557950 - DNA, 13 bp, D. melanogaster
aactcatttattt

SEQ ID NO: 557951 - DNA, 13 bp, D. melanogaster
aactcatttcaaa

SEQ ID NO: 557952 - DNA, 13 bp, D. melanogaster
aactcatttgaat

SEQ ID NO: 557953 - DNA, 13 bp, D. melanogaster
aactcatttgcaa

SEQ ID NO: 557954 - DNA, 13 bp, D. melanogaster
aactccaacaact

SEQ ID NO: 557955 - DNA, 13 bp, D. melanogaster
aactccaactcca

SEQ ID NO: 557956 - DNA, 13 bp, D. melanogaster
aactccaactccc

SEQ ID NO: 557957 - DNA, 14 bp, D. melanogaster
aactccaactccca

SEQ ID NO: 557958 - DNA, 13 bp, D. melanogaster
aactccaactgca

SEQ ID NO: 557959 - DNA, 13 bp, D. melanogaster
aactccacaaatc

SEQ ID NO: 557960 - DNA, 13 bp, D. melanogaster
aactccactccac

SEQ ID NO: 557961 - DNA, 13 bp, D. melanogaster
aactccagctcct

SEQ ID NO: 557962 - DNA, 13 bp, D. melanogaster
aactccagcttcc

SEQ ID NO: 557963 - DNA, 13 bp, D. melanogaster
aactccattacca

SEQ ID NO: 557964 - DNA, 13 bp, D. melanogaster
aactccattttgc

SEQ ID NO: 557965 - DNA, 13 bp, D. melanogaster
aactccgcccctg

SEQ ID NO: 557966 - DNA, 13 bp, D. melanogaster
aactcctccgcct

SEQ ID NO: 557967 - DNA, 13 bp, D. melanogaster
aactcctcctcct

SEQ ID NO: 557968 - DNA, 13 bp, D. melanogaster
aactcgaaccaga

SEQ ID NO: 557969 - DNA, 15 bp, D. melanogaster
aactcgaaccctctt

SEQ ID NO: 557970 - DNA, 13 bp, D. melanogaster
aactcgaactcaa

SEQ ID NO: 557971 - DNA, 13 bp, D. melanogaster
aactcgaactcga

SEQ ID NO: 557972 - DNA, 14 bp, D. melanogaster
aactcgaactcgaa

SEQ ID NO: 557973 - DNA, 13 bp, D. melanogaster
aactcgacttggc

SEQ ID NO: 557974 - DNA, 13 bp, D. melanogaster
aactcgattattt

SEQ ID NO: 557975 - DNA, 13 bp, D. melanogaster
aactcgcaacagc

SEQ ID NO: 557976 - DNA, 13 bp, D. melanogaster
aactcgcacacac

SEQ ID NO: 557977 - DNA, 13 bp, D. melanogaster
aactcgtggccca

SEQ ID NO: 557978 - DNA, 13 bp, D. melanogaster
aactctaactcta

SEQ ID NO: 557979 - DNA, 13 bp, D. melanogaster
aactctacccagt

SEQ ID NO: 557980 - DNA, 13 bp, D. melanogaster
aactctatatata

SEQ ID NO: 557981 - DNA, 13 bp, D. melanogaster
aactctatttcta

SEQ ID NO: 557982 - DNA, 13 bp, D. melanogaster
aactctcaaaatg

SEQ ID NO: 557983 - DNA, 13 bp, D. melanogaster
aactctgaactct

SEQ ID NO: 557984 - DNA, 13 bp, D. melanogaster
aactctgacaaat

SEQ ID NO: 557985 - DNA, 13 bp, D. melanogaster
aactctggccaaa

SEQ ID NO: 557986 - DNA, 14 bp, D. melanogaster
aactctggccaaaa

SEQ ID NO: 557987 - DNA, 13 bp, D. melanogaster
aactctggttctc

SEQ ID NO: 557988 - DNA, 13 bp, D. melanogaster
aactcttagcaat

SEQ ID NO: 557989 - DNA, 13 bp, D. melanogaster
aactcttcaactt

SEQ ID NO: 557990 - DNA, 13 bp, D. melanogaster
aactcttcgccca

SEQ ID NO: 557991 - DNA, 13 bp, D. melanogaster
aactcttgtttcc

SEQ ID NO: 557992 - DNA, 13 bp, D. melanogaster
aactctttaaaat

SEQ ID NO: 557993 - DNA, 13 bp, D. melanogaster
aactctttgagtt

SEQ ID NO: 557994 - DNA, 13 bp, D. melanogaster
aactcttttacca

SEQ ID NO: 557995 - DNA, 14 bp, D. melanogaster
aactcttttatttc

SEQ ID NO: 557996 - DNA, 13 bp, D. melanogaster
aactgaaaaacga

SEQ ID NO: 557997 - DNA, 14 bp, D. melanogaster
aactgaaaaactga

SEQ ID NO: 557998 - DNA, 13 bp, D. melanogaster
aactgaaaaagag

SEQ ID NO: 557999 - DNA, 13 bp, D. melanogaster
aactgaaaaatga

SEQ ID NO: 558000 - DNA, 13 bp, D. melanogaster
aactgaaaaatgt

SEQ ID NO: 558001 - DNA, 13 bp, D. melanogaster
aactgaaaaatta

SEQ ID NO: 558002 - DNA, 13 bp, D. melanogaster
aactgaaaaccaa

SEQ ID NO: 558003 - DNA, 14 bp, D. melanogaster
aactgaaaaccaaa

SEQ ID NO: 558004 - DNA, 14 bp, D. melanogaster
aactgaaaaccgaa

SEQ ID NO: 558005 - DNA, 13 bp, D. melanogaster
aactgaaaacgga

SEQ ID NO: 558006 - DNA, 14 bp, D. melanogaster
aactgaaaactaaa

SEQ ID NO: 558007 - DNA, 13 bp, D. melanogaster
aactgaaaactga

SEQ ID NO: 558008 - DNA, 13 bp, D. melanogaster
aactgaaaactgc

SEQ ID NO: 558009 - DNA, 13 bp, D. melanogaster
aactgaaaagcca

SEQ ID NO: 558010 - DNA, 13 bp, D. melanogaster
aactgaaaaggaa

SEQ ID NO: 558011 - DNA, 13 bp, D. melanogaster
aactgaaaagtgg

SEQ ID NO: 558012 - DNA, 13 bp, D. melanogaster
aactgaaaataat

SEQ ID NO: 558013 - DNA, 13 bp, D. melanogaster
aactgaaaatatt

SEQ ID NO: 558014 - DNA, 14 bp, D. melanogaster
aactgaaaatattt

SEQ ID NO: 558015 - DNA, 13 bp, D. melanogaster
aactgaaaatcaa

SEQ ID NO: 558016 - DNA, 13 bp, D. melanogaster
aactgaaaatcga

SEQ ID NO: 558017 - DNA, 14 bp, D. melanogaster
aactgaaaatgaaa

SEQ ID NO: 558018 - DNA, 13 bp, D. melanogaster
aactgaaaatgtg

SEQ ID NO: 558019 - DNA, 13 bp, D. melanogaster
aactgaaaatgtt

SEQ ID NO: 558020 - DNA, 13 bp, D. melanogaster
aactgaaacaaca

SEQ ID NO: 558021 - DNA, 13 bp, D. melanogaster
aactgaaaccaaa

SEQ ID NO: 558022 - DNA, 14 bp, D. melanogaster
aactgaaaccaaaa

SEQ ID NO: 558023 - DNA, 13 bp, D. melanogaster
aactgaaacccaa

SEQ ID NO: 558024 - DNA, 13 bp, D. melanogaster
aactgaaaccgaa

SEQ ID NO: 558025 - DNA, 13 bp, D. melanogaster
aactgaaacggaa

SEQ ID NO: 558026 - DNA, 13 bp, D. melanogaster
aactgaaactaac

SEQ ID NO: 558027 - DNA, 13 bp, D. melanogaster
aactgaaactcaa

SEQ ID NO: 558028 - DNA, 14 bp, D. melanogaster
aactgaaactcaaa

SEQ ID NO: 558029 - DNA, 13 bp, D. melanogaster
aactgaaactgaa

SEQ ID NO: 558030 - DNA, 14 bp, D. melanogaster
aactgaaactgaaa

SEQ ID NO: 558031 - DNA, 14 bp, D. melanogaster
aactgaaactgaac

SEQ ID NO: 558032 - DNA, 14 bp, D. melanogaster
aactgaaactgaag

SEQ ID NO: 558033 - DNA, 14 bp, D. melanogaster
aactgaaactgaat

SEQ ID NO: 558034 - DNA, 13 bp, D. melanogaster
aactgaaactgca

SEQ ID NO: 558035 - DNA, 14 bp, D. melanogaster
aactgaaactgcaa

SEQ ID NO: 558036 - DNA, 13 bp, D. melanogaster
aactgaaactgct

SEQ ID NO: 558037 - DNA, 14 bp, D. melanogaster
aactgaaactggaa

SEQ ID NO: 558038 - DNA, 13 bp, D. melanogaster
aactgaaactggg

SEQ ID NO: 558039 - DNA, 13 bp, D. melanogaster
aactgaaacttaa

SEQ ID NO: 558040 - DNA, 13 bp, D. melanogaster
aactgaaacttat

SEQ ID NO: 558041 - DNA, 13 bp, D. melanogaster
aactgaaagcaaa

SEQ ID NO: 558042 - DNA, 13 bp, D. melanogaster
aactgaaaggaaa

SEQ ID NO: 558043 - DNA, 13 bp, D. melanogaster
aactgaaagtaaa

SEQ ID NO: 558044 - DNA, 13 bp, D. melanogaster
aactgaaagtatt

SEQ ID NO: 558045 - DNA, 13 bp, D. melanogaster
aactgaaataaac

SEQ ID NO: 558046 - DNA, 13 bp, D. melanogaster
aactgaaatatta

SEQ ID NO: 558047 - DNA, 14 bp, D. melanogaster
aactgaaatattaa

SEQ ID NO: 558048 - DNA, 13 bp, D. melanogaster
aactgaaatattc

SEQ ID NO: 558049 - DNA, 13 bp, D. melanogaster
aactgaaatcgaa

SEQ ID NO: 558050 - DNA, 13 bp, D. melanogaster
aactgaaatgaaa

SEQ ID NO: 558051 - DNA, 13 bp, D. melanogaster
aactgaaatggaa

SEQ ID NO: 558052 - DNA, 14 bp, D. melanogaster
aactgaaatggaaa

SEQ ID NO: 558053 - DNA, 13 bp, D. melanogaster
aactgaaattcaa

SEQ ID NO: 558054 - DNA, 13 bp, D. melanogaster
aactgaaattcga

SEQ ID NO: 558055 - DNA, 13 bp, D. melanogaster
aactgaaatttaa

SEQ ID NO: 558056 - DNA, 13 bp, D. melanogaster
aactgaaatttgt

SEQ ID NO: 558057 - DNA, 13 bp, D. melanogaster
aactgaaccgaaa

SEQ ID NO: 558058 - DNA, 13 bp, D. melanogaster
aactgaactcaac

SEQ ID NO: 558059 - DNA, 14 bp, D. melanogaster
aactgaactcaact

SEQ ID NO: 558060 - DNA, 13 bp, D. melanogaster
aactgaactgaaa

SEQ ID NO: 558061 - DNA, 13 bp, D. melanogaster
aactgaactgaac

SEQ ID NO: 558062 - DNA, 14 bp, D. melanogaster
aactgaactgaaca

SEQ ID NO: 558063 - DNA, 14 bp, D. melanogaster
aactgaactgaacc

SEQ ID NO: 558064 - DNA, 14 bp, D. melanogaster
aactgaactgaact

SEQ ID NO: 558065 - DNA, 13 bp, D. melanogaster
aactgaactgaag

SEQ ID NO: 558066 - DNA, 13 bp, D. melanogaster
aactgaacttgaa

SEQ ID NO: 558067 - DNA, 13 bp, D. melanogaster
aactgaagagttt

SEQ ID NO: 558068 - DNA, 13 bp, D. melanogaster
aactgaagcacaa

SEQ ID NO: 558069 - DNA, 13 bp, D. melanogaster
aactgaagcgaaa

SEQ ID NO: 558070 - DNA, 13 bp, D. melanogaster
aactgaagctgaa

SEQ ID NO: 558071 - DNA, 14 bp, D. melanogaster
aactgaagctgaaa

SEQ ID NO: 558072 - DNA, 14 bp, D. melanogaster
aactgaagctgagt

SEQ ID NO: 558073 - DNA, 13 bp, D. melanogaster
aactgaagtgaac

SEQ ID NO: 558074 - DNA, 13 bp, D. melanogaster
aactgaagtggaa

SEQ ID NO: 558075 - DNA, 13 bp, D. melanogaster
aactgaagtgttc

SEQ ID NO: 558076 - DNA, 13 bp, D. melanogaster
aactgaataaatt

SEQ ID NO: 558077 - DNA, 13 bp, D. melanogaster
aactgaatacaaa

SEQ ID NO: 558078 - DNA, 13 bp, D. melanogaster
aactgaatataat

SEQ ID NO: 558079 - DNA, 13 bp, D. melanogaster
aactgaatatgaa

SEQ ID NO: 558080 - DNA, 13 bp, D. melanogaster
aactgaatcaaaa

SEQ ID NO: 558081 - DNA, 13 bp, D. melanogaster
aactgaatcgaaa

SEQ ID NO: 558082 - DNA, 13 bp, D. melanogaster
aactgaatctgaa

SEQ ID NO: 558083 - DNA, 14 bp, D. melanogaster
aactgaatcttaaa

SEQ ID NO: 558084 - DNA, 13 bp, D. melanogaster
aactgaattaatt

SEQ ID NO: 558085 - DNA, 13 bp, D. melanogaster
aactgaattcaaa

SEQ ID NO: 558086 - DNA, 13 bp, D. melanogaster
aactgaatttaaa

SEQ ID NO: 558087 - DNA, 13 bp, D. melanogaster
aactgaatttata

SEQ ID NO: 558088 - DNA, 13 bp, D. melanogaster
aactgaatttcaa

SEQ ID NO: 558089 - DNA, 13 bp, D. melanogaster
aactgaattttct

SEQ ID NO: 558090 - DNA, 14 bp, D. melanogaster
aactgaattttctt

SEQ ID NO: 558091 - DNA, 13 bp, D. melanogaster
aactgacaactga

SEQ ID NO: 558092 - DNA, 13 bp, D. melanogaster
aactgacattttt

SEQ ID NO: 558093 - DNA, 13 bp, D. melanogaster
aactgactgactg

SEQ ID NO: 558094 - DNA, 14 bp, D. melanogaster
aactgactgactga

SEQ ID NO: 558095 - DNA, 13 bp, D. melanogaster
aactgagaaactg

SEQ ID NO: 558096 - DNA, 13 bp, D. melanogaster
aactgagaactga

SEQ ID NO: 558097 - DNA, 13 bp, D. melanogaster
aactgagaacttt

SEQ ID NO: 558098 - DNA, 14 bp, D. melanogaster
aactgagaactttg

SEQ ID NO: 558099 - DNA, 13 bp, D. melanogaster
aactgagcaactg

SEQ ID NO: 558100 - DNA, 13 bp, D. melanogaster
aactgagcagctg

SEQ ID NO: 558101 - DNA, 13 bp, D. melanogaster
aactgagcgactg

SEQ ID NO: 558102 - DNA, 13 bp, D. melanogaster
aactgagctgagc

SEQ ID NO: 558103 - DNA, 13 bp, D. melanogaster
aactgaggtgtat

SEQ ID NO: 558104 - DNA, 13 bp, D. melanogaster
aactgatatttat

SEQ ID NO: 558105 - DNA, 13 bp, D. melanogaster
aactgatcaacaa

SEQ ID NO: 558106 - DNA, 14 bp, D. melanogaster
aactgatcaacaaa

SEQ ID NO: 558107 - DNA, 13 bp, D. melanogaster
aactgatcataaa

SEQ ID NO: 558108 - DNA, 13 bp, D. melanogaster
aactgatggttca

SEQ ID NO: 558109 - DNA, 13 bp, D. melanogaster
aactgatgtaatg

SEQ ID NO: 558110 - DNA, 14 bp, D. melanogaster
aactgatgtaatgt

SEQ ID NO: 558111 - DNA, 13 bp, D. melanogaster
aactgatgttttt

SEQ ID NO: 558112 - DNA, 13 bp, D. melanogaster
aactgattaattt

SEQ ID NO: 558113 - DNA, 13 bp, D. melanogaster
aactgattgaatt

SEQ ID NO: 558114 - DNA, 13 bp, D. melanogaster
aactgatttcaaa

SEQ ID NO: 558115 - DNA, 13 bp, D. melanogaster
aactgatttgaat

SEQ ID NO: 558116 - DNA, 13 bp, D. melanogaster
aactgattttttg

SEQ ID NO: 558117 - DNA, 13 bp, D. melanogaster
aactgattttttt

SEQ ID NO: 558118 - DNA, 14 bp, D. melanogaster
aactgcaaaaactg

SEQ ID NO: 558119 - DNA, 13 bp, D. melanogaster
aactgcaaaacaa

SEQ ID NO: 558120 - DNA, 14 bp, D. melanogaster
aactgcaaaacaaa

SEQ ID NO: 558121 - DNA, 13 bp, D. melanogaster
aactgcaaaagtt

SEQ ID NO: 558122 - DNA, 13 bp, D. melanogaster
aactgcaaaatgt

SEQ ID NO: 558123 - DNA, 13 bp, D. melanogaster
aactgcaaactgc

SEQ ID NO: 558124 - DNA, 14 bp, D. melanogaster
aactgcaaactgca

SEQ ID NO: 558125 - DNA, 13 bp, D. melanogaster
aactgcaaacttt

SEQ ID NO: 558126 - DNA, 13 bp, D. melanogaster
aactgcaaatcag

SEQ ID NO: 558127 - DNA, 14 bp, D. melanogaster
aactgcaaatcagc

SEQ ID NO: 558128 - DNA, 14 bp, D. melanogaster
aactgcaaatgcaa

SEQ ID NO: 558129 - DNA, 13 bp, D. melanogaster
aactgcaaatggc

SEQ ID NO: 558130 - DNA, 13 bp, D. melanogaster
aactgcaacaaaa

SEQ ID NO: 558131 - DNA, 13 bp, D. melanogaster
aactgcaacaatt

SEQ ID NO: 558132 - DNA, 13 bp, D. melanogaster
aactgcaacacca

SEQ ID NO: 558133 - DNA, 13 bp, D. melanogaster
aactgcaacacgc

SEQ ID NO: 558134 - DNA, 14 bp, D. melanogaster
aactgcaacagcaa

SEQ ID NO: 558135 - DNA, 14 bp, D. melanogaster
aactgcaacatcac

SEQ ID NO: 558136 - DNA, 13 bp, D. melanogaster
aactgcaactcaa

SEQ ID NO: 558137 - DNA, 13 bp, D. melanogaster
aactgcaactgaa

SEQ ID NO: 558138 - DNA, 14 bp, D. melanogaster
aactgcaactgcag

SEQ ID NO: 558139 - DNA, 14 bp, D. melanogaster
aactgcaactgcat

SEQ ID NO: 558140 - DNA, 13 bp, D. melanogaster
aactgcaactgcc

SEQ ID NO: 558141 - DNA, 13 bp, D. melanogaster
aactgcaactgcg

SEQ ID NO: 558142 - DNA, 14 bp, D. melanogaster
aactgcaactgcga

SEQ ID NO: 558143 - DNA, 13 bp, D. melanogaster
aactgcaactgta

SEQ ID NO: 558144 - DNA, 13 bp, D. melanogaster
aactgcaactgtg

SEQ ID NO: 558145 - DNA, 13 bp, D. melanogaster
aactgcaagcaaa

SEQ ID NO: 558146 - DNA, 13 bp, D. melanogaster
aactgcaagctgc

SEQ ID NO: 558147 - DNA, 14 bp, D. melanogaster
aactgcaaggaaaa

SEQ ID NO: 558148 - DNA, 13 bp, D. melanogaster
aactgcaagggtg

SEQ ID NO: 558149 - DNA, 13 bp, D. melanogaster
aactgcaatcaaa

SEQ ID NO: 558150 - DNA, 13 bp, D. melanogaster
aactgcaatgctt

SEQ ID NO: 558151 - DNA, 14 bp, D. melanogaster
aactgcaatggcaa

SEQ ID NO: 558152 - DNA, 13 bp, D. melanogaster
aactgcaattgaa

SEQ ID NO: 558153 - DNA, 13 bp, D. melanogaster
aactgcaattgca

SEQ ID NO: 558154 - DNA, 14 bp, D. melanogaster
aactgcaattgcaa

SEQ ID NO: 558155 - DNA, 14 bp, D. melanogaster
aactgcaattgcat

SEQ ID NO: 558156 - DNA, 13 bp, D. melanogaster
aactgcaattgcc

SEQ ID NO: 558157 - DNA, 13 bp, D. melanogaster
aactgcaatttat

SEQ ID NO: 558158 - DNA, 13 bp, D. melanogaster
aactgcaatttgc

SEQ ID NO: 558159 - DNA, 13 bp, D. melanogaster
aactgcacacaca

SEQ ID NO: 558160 - DNA, 13 bp, D. melanogaster
aactgcacctcga

SEQ ID NO: 558161 - DNA, 13 bp, D. melanogaster
aactgcaccttca

SEQ ID NO: 558162 - DNA, 13 bp, D. melanogaster
aactgcactttac

SEQ ID NO: 558163 - DNA, 13 bp, D. melanogaster
aactgcagaatca

SEQ ID NO: 558164 - DNA, 13 bp, D. melanogaster
aactgcagaatgt

SEQ ID NO: 558165 - DNA, 14 bp, D. melanogaster
aactgcagaatgtg

SEQ ID NO: 558166 - DNA, 13 bp, D. melanogaster
aactgcagcaaac

SEQ ID NO: 558167 - DNA, 13 bp, D. melanogaster
aactgcagcaaca

SEQ ID NO: 558168 - DNA, 14 bp, D. melanogaster
aactgcagcaacaa

SEQ ID NO: 558169 - DNA, 13 bp, D. melanogaster
aactgcagcagca

SEQ ID NO: 558170 - DNA, 13 bp, D. melanogaster
aactgcagcagcc

SEQ ID NO: 558171 - DNA, 13 bp, D. melanogaster
aactgcagcagcg

SEQ ID NO: 558172 - DNA, 13 bp, D. melanogaster
aactgcagcagct

SEQ ID NO: 558173 - DNA, 13 bp, D. melanogaster
aactgcagccaaa

SEQ ID NO: 558174 - DNA, 13 bp, D. melanogaster
aactgcagcgcaa

SEQ ID NO: 558175 - DNA, 13 bp, D. melanogaster
aactgcagctaaa

SEQ ID NO: 558176 - DNA, 13 bp, D. melanogaster
aactgcagctgaa

SEQ ID NO: 558177 - DNA, 13 bp, D. melanogaster
aactgcagctgac

SEQ ID NO: 558178 - DNA, 14 bp, D. melanogaster
aactgcagctgcaa

SEQ ID NO: 558179 - DNA, 13 bp, D. melanogaster
aactgcagctgtg

SEQ ID NO: 558180 - DNA, 13 bp, D. melanogaster
aactgcaggcaaa

SEQ ID NO: 558181 - DNA, 13 bp, D. melanogaster
aactgcaggcgtt

SEQ ID NO: 558182 - DNA, 13 bp, D. melanogaster
aactgcagtccat

SEQ ID NO: 558183 - DNA, 13 bp, D. melanogaster
aactgcagtgaaa

SEQ ID NO: 558184 - DNA, 13 bp, D. melanogaster
aactgcagttgaa

SEQ ID NO: 558185 - DNA, 13 bp, D. melanogaster
aactgcagttgca

SEQ ID NO: 558186 - DNA, 13 bp, D. melanogaster
aactgcagttggc

SEQ ID NO: 558187 - DNA, 13 bp, D. melanogaster
aactgcatcagca

SEQ ID NO: 558188 - DNA, 13 bp, D. melanogaster
aactgcatctgca

SEQ ID NO: 558189 - DNA, 14 bp, D. melanogaster
aactgcatctgcac

SEQ ID NO: 558190 - DNA, 13 bp, D. melanogaster
aactgcatgcaaa

SEQ ID NO: 558191 - DNA, 13 bp, D. melanogaster
aactgcatttaca

SEQ ID NO: 558192 - DNA, 13 bp, D. melanogaster
aactgcatttatt

SEQ ID NO: 558193 - DNA, 13 bp, D. melanogaster
aactgcatttcat

SEQ ID NO: 558194 - DNA, 13 bp, D. melanogaster
aactgcatttccc

SEQ ID NO: 558195 - DNA, 13 bp, D. melanogaster
aactgcatttgaa

SEQ ID NO: 558196 - DNA, 13 bp, D. melanogaster
aactgcatttgca

SEQ ID NO: 558197 - DNA, 14 bp, D. melanogaster
aactgcatttgcat

SEQ ID NO: 558198 - DNA, 13 bp, D. melanogaster
aactgcattttcc

SEQ ID NO: 558199 - DNA, 13 bp, D. melanogaster
aactgcattttta

SEQ ID NO: 558200 - DNA, 13 bp, D. melanogaster
aactgccaaaaac

SEQ ID NO: 558201 - DNA, 13 bp, D. melanogaster
aactgccaaaaag

SEQ ID NO: 558202 - DNA, 13 bp, D. melanogaster
aactgccaaaaat

SEQ ID NO: 558203 - DNA, 13 bp, D. melanogaster
aactgccaactgc

SEQ ID NO: 558204 - DNA, 13 bp, D. melanogaster
aactgccataaaa

SEQ ID NO: 558205 - DNA, 14 bp, D. melanogaster
aactgccccaaaaa

SEQ ID NO: 558206 - DNA, 13 bp, D. melanogaster
aactgccttcgaa

SEQ ID NO: 558207 - DNA, 13 bp, D. melanogaster
aactgcggggaaa

SEQ ID NO: 558208 - DNA, 13 bp, D. melanogaster
aactgctaacaca

SEQ ID NO: 558209 - DNA, 14 bp, D. melanogaster
aactgctacttatt

SEQ ID NO: 558210 - DNA, 14 bp, D. melanogaster
aactgctcgcaaat

SEQ ID NO: 558211 - DNA, 16 bp, D. melanogaster
aactgctcgcaaatcg

SEQ ID NO: 558212 - DNA, 13 bp, D. melanogaster
aactgctgcaact

SEQ ID NO: 558213 - DNA, 13 bp, D. melanogaster
aactgctgcagga

SEQ ID NO: 558214 - DNA, 13 bp, D. melanogaster
aactgctggaaaa

SEQ ID NO: 558215 - DNA, 13 bp, D. melanogaster
aactgctggccaa

SEQ ID NO: 558216 - DNA, 14 bp, D. melanogaster
aactgctggccaaa

SEQ ID NO: 558217 - DNA, 13 bp, D. melanogaster
aactgcttaaata

SEQ ID NO: 558218 - DNA, 13 bp, D. melanogaster
aactgcttttggc

SEQ ID NO: 558219 - DNA, 13 bp, D. melanogaster
aactggaaaaaca

SEQ ID NO: 558220 - DNA, 13 bp, D. melanogaster
aactggaaaaact

SEQ ID NO: 558221 - DNA, 13 bp, D. melanogaster
aactggaaaactg

SEQ ID NO: 558222 - DNA, 13 bp, D. melanogaster
aactggaaaagtt

SEQ ID NO: 558223 - DNA, 13 bp, D. melanogaster
aactggaaaatgc

SEQ ID NO: 558224 - DNA, 13 bp, D. melanogaster
aactggaaaattg

SEQ ID NO: 558225 - DNA, 13 bp, D. melanogaster
aactggaaactga

SEQ ID NO: 558226 - DNA, 13 bp, D. melanogaster
aactggaaactgg

SEQ ID NO: 558227 - DNA, 13 bp, D. melanogaster
aactggaaatata

SEQ ID NO: 558228 - DNA, 14 bp, D. melanogaster
aactggaaatatat

SEQ ID NO: 558229 - DNA, 13 bp, D. melanogaster
aactggaaatgga

SEQ ID NO: 558230 - DNA, 13 bp, D. melanogaster
aactggaactgaa

SEQ ID NO: 558231 - DNA, 13 bp, D. melanogaster
aactggaactgga

SEQ ID NO: 558232 - DNA, 13 bp, D. melanogaster
aactggaactggg

SEQ ID NO: 558233 - DNA, 14 bp, D. melanogaster
aactggaccaattt

SEQ ID NO: 558234 - DNA, 13 bp, D. melanogaster
aactggagaaagc

SEQ ID NO: 558235 - DNA, 13 bp, D. melanogaster
aactggagctgga

SEQ ID NO: 558236 - DNA, 13 bp, D. melanogaster
aactggatgaagg

SEQ ID NO: 558237 - DNA, 15 bp, D. melanogaster
aactggatgtctttg

SEQ ID NO: 558238 - DNA, 13 bp, D. melanogaster
aactggattgttt

SEQ ID NO: 558239 - DNA, 13 bp, D. melanogaster
aactggatttttt

SEQ ID NO: 558240 - DNA, 13 bp, D. melanogaster
aactggcaaactg

SEQ ID NO: 558241 - DNA, 14 bp, D. melanogaster
aactggcaaactgg

SEQ ID NO: 558242 - DNA, 13 bp, D. melanogaster
aactggcaaatac

SEQ ID NO: 558243 - DNA, 13 bp, D. melanogaster
aactggcaactgg

SEQ ID NO: 558244 - DNA, 13 bp, D. melanogaster
aactggcaacttg

SEQ ID NO: 558245 - DNA, 13 bp, D. melanogaster
aactggcagccag

SEQ ID NO: 558246 - DNA, 13 bp, D. melanogaster
aactggccaaaac

SEQ ID NO: 558247 - DNA, 13 bp, D. melanogaster
aactggccaacag

SEQ ID NO: 558248 - DNA, 13 bp, D. melanogaster
aactggccaacgc

SEQ ID NO: 558249 - DNA, 13 bp, D. melanogaster
aactggccaactg

SEQ ID NO: 558250 - DNA, 14 bp, D. melanogaster
aactggccaactgg

SEQ ID NO: 558251 - DNA, 13 bp, D. melanogaster
aactggccaactt

SEQ ID NO: 558252 - DNA, 13 bp, D. melanogaster
aactggccaagaa

SEQ ID NO: 558253 - DNA, 14 bp, D. melanogaster
aactggccatgtcc

SEQ ID NO: 558254 - DNA, 13 bp, D. melanogaster
aactggcgcccga

SEQ ID NO: 558255 - DNA, 13 bp, D. melanogaster
aactggcgctgcg

SEQ ID NO: 558256 - DNA, 13 bp, D. melanogaster
aactggctaaaaa

SEQ ID NO: 558257 - DNA, 13 bp, D. melanogaster
aactggctcaggt

SEQ ID NO: 558258 - DNA, 13 bp, D. melanogaster
aactggctgactg

SEQ ID NO: 558259 - DNA, 13 bp, D. melanogaster
aactgggaaaact

SEQ ID NO: 558260 - DNA, 13 bp, D. melanogaster
aactgggaaaatt

SEQ ID NO: 558261 - DNA, 13 bp, D. melanogaster
aactgggaaatgg

SEQ ID NO: 558262 - DNA, 13 bp, D. melanogaster
aactgggaactga

SEQ ID NO: 558263 - DNA, 13 bp, D. melanogaster
aactgggaactgg

SEQ ID NO: 558264 - DNA, 14 bp, D. melanogaster
aactgggaactggg

SEQ ID NO: 558265 - DNA, 13 bp, D. melanogaster
aactgggagctgg

SEQ ID NO: 558266 - DNA, 13 bp, D. melanogaster
aactgggagttgg

SEQ ID NO: 558267 - DNA, 13 bp, D. melanogaster
aactgggcaaaaa

SEQ ID NO: 558268 - DNA, 13 bp, D. melanogaster
aactgggcaactg

SEQ ID NO: 558269 - DNA, 13 bp, D. melanogaster
aactgggccaaaa

SEQ ID NO: 558270 - DNA, 13 bp, D. melanogaster
aactggggtttct

SEQ ID NO: 558271 - DNA, 13 bp, D. melanogaster
aactggtaaaaaa

SEQ ID NO: 558272 - DNA, 13 bp, D. melanogaster
aactggtaactgg

SEQ ID NO: 558273 - DNA, 13 bp, D. melanogaster
aactggtgtcctg

SEQ ID NO: 558274 - DNA, 13 bp, D. melanogaster
aactggttaagct

SEQ ID NO: 558275 - DNA, 13 bp, D. melanogaster
aactggtttttat

SEQ ID NO: 558276 - DNA, 13 bp, D. melanogaster
aactggtttttgg

SEQ ID NO: 558277 - DNA, 13 bp, D. melanogaster
aactggtttttgt

SEQ ID NO: 558278 - DNA, 13 bp, D. melanogaster
aactgtaaaaaat

SEQ ID NO: 558279 - DNA, 13 bp, D. melanogaster
aactgtaaacaaa

SEQ ID NO: 558280 - DNA, 13 bp, D. melanogaster
aactgtaaactgt

SEQ ID NO: 558281 - DNA, 13 bp, D. melanogaster
aactgtaacactg

SEQ ID NO: 558282 - DNA, 13 bp, D. melanogaster
aactgtaactgaa

SEQ ID NO: 558283 - DNA, 13 bp, D. melanogaster
aactgtaactgta

SEQ ID NO: 558284 - DNA, 14 bp, D. melanogaster
aactgtaactgtaa

SEQ ID NO: 558285 - DNA, 13 bp, D. melanogaster
aactgtaacttgt

SEQ ID NO: 558286 - DNA, 13 bp, D. melanogaster
aactgtaattatt

SEQ ID NO: 558287 - DNA, 15 bp, D. melanogaster
aactgtaattattaa

SEQ ID NO: 558288 - DNA, 13 bp, D. melanogaster
aactgtataaaat

SEQ ID NO: 558289 - DNA, 13 bp, D. melanogaster
aactgtatatatt

SEQ ID NO: 558290 - DNA, 13 bp, D. melanogaster
aactgtatcattt

SEQ ID NO: 558291 - DNA, 13 bp, D. melanogaster
aactgtatctgta

SEQ ID NO: 558292 - DNA, 13 bp, D. melanogaster
aactgtatgtgtg

SEQ ID NO: 558293 - DNA, 13 bp, D. melanogaster
aactgtattcttt

SEQ ID NO: 558294 - DNA, 13 bp, D. melanogaster
aactgtatttaaa

SEQ ID NO: 558295 - DNA, 13 bp, D. melanogaster
aactgtatttgtt

SEQ ID NO: 558296 - DNA, 13 bp, D. melanogaster
aactgtcaaaatg

SEQ ID NO: 558297 - DNA, 13 bp, D. melanogaster
aactgtcaaataa

SEQ ID NO: 558298 - DNA, 13 bp, D. melanogaster
aactgtcaaattg

SEQ ID NO: 558299 - DNA, 13 bp, D. melanogaster
aactgtcataatt

SEQ ID NO: 558300 - DNA, 13 bp, D. melanogaster
aactgtgattttt

SEQ ID NO: 558301 - DNA, 13 bp, D. melanogaster
aactgtggcaaaa

SEQ ID NO: 558302 - DNA, 13 bp, D. melanogaster
aactgtggccaaa

SEQ ID NO: 558303 - DNA, 15 bp, D. melanogaster
aactgtgtccaaaaa

SEQ ID NO: 558304 - DNA, 13 bp, D. melanogaster
aactgtgtgaaaa

SEQ ID NO: 558305 - DNA, 13 bp, D. melanogaster
aactgtgttcaaa

SEQ ID NO: 558306 - DNA, 13 bp, D. melanogaster
aactgttaattga

SEQ ID NO: 558307 - DNA, 13 bp, D. melanogaster
aactgttcaaaaa

SEQ ID NO: 558308 - DNA, 13 bp, D. melanogaster
aactgttgacaaa

SEQ ID NO: 558309 - DNA, 13 bp, D. melanogaster
aactgttggaaaa

SEQ ID NO: 558310 - DNA, 13 bp, D. melanogaster
aactgttggccaa

SEQ ID NO: 558311 - DNA, 13 bp, D. melanogaster
aactgttgttaaa

SEQ ID NO: 558312 - DNA, 13 bp, D. melanogaster
aactgtttaaata

SEQ ID NO: 558313 - DNA, 13 bp, D. melanogaster
aactgtttatttt

SEQ ID NO: 558314 - DNA, 13 bp, D. melanogaster
aactgtttcaact

SEQ ID NO: 558315 - DNA, 14 bp, D. melanogaster
aactgtttcaactt

SEQ ID NO: 558316 - DNA, 13 bp, D. melanogaster
aactgtttccgct

SEQ ID NO: 558317 - DNA, 13 bp, D. melanogaster
aactgtttcggat

SEQ ID NO: 558318 - DNA, 13 bp, D. melanogaster
aactgtttgaatt

SEQ ID NO: 558319 - DNA, 13 bp, D. melanogaster
aactgttttcatt

SEQ ID NO: 558320 - DNA, 13 bp, D. melanogaster
aactgttttgttt

SEQ ID NO: 558321 - DNA, 13 bp, D. melanogaster
aactgtttttaaa

SEQ ID NO: 558322 - DNA, 13 bp, D. melanogaster
aactgtttttcga

SEQ ID NO: 558323 - DNA, 13 bp, D. melanogaster
aactgtttttctt

SEQ ID NO: 558324 - DNA, 13 bp, D. melanogaster
aactgtttttgtt

SEQ ID NO: 558325 - DNA, 14 bp, D. melanogaster
aactgtttttgttt

SEQ ID NO: 558326 - DNA, 13 bp, D. melanogaster
aacttaaaaagag

SEQ ID NO: 558327 - DNA, 14 bp, D. melanogaster
aacttaaaaatgca

SEQ ID NO: 558328 - DNA, 13 bp, D. melanogaster
aacttaaaacgaa

SEQ ID NO: 558329 - DNA, 13 bp, D. melanogaster
aacttaaaatgca

SEQ ID NO: 558330 - DNA, 13 bp, D. melanogaster
aacttaaacattt

SEQ ID NO: 558331 - DNA, 13 bp, D. melanogaster
aacttaaactcaa

SEQ ID NO: 558332 - DNA, 13 bp, D. melanogaster
aacttaaacttaa

SEQ ID NO: 558333 - DNA, 14 bp, D. melanogaster
aacttaaactttaa

SEQ ID NO: 558334 - DNA, 13 bp, D. melanogaster
aacttaaagaaga

SEQ ID NO: 558335 - DNA, 13 bp, D. melanogaster
aacttaaagcaaa

SEQ ID NO: 558336 - DNA, 13 bp, D. melanogaster
aacttaaagcaat

SEQ ID NO: 558337 - DNA, 13 bp, D. melanogaster
aacttaaagccaa

SEQ ID NO: 558338 - DNA, 13 bp, D. melanogaster
aacttaaaggaac

SEQ ID NO: 558339 - DNA, 13 bp, D. melanogaster
aacttaaaggcca

SEQ ID NO: 558340 - DNA, 13 bp, D. melanogaster
aacttaaagtaaa

SEQ ID NO: 558341 - DNA, 13 bp, D. melanogaster
aacttaaataacg

SEQ ID NO: 558342 - DNA, 13 bp, D. melanogaster
aacttaaatatag

SEQ ID NO: 558343 - DNA, 13 bp, D. melanogaster
aacttaaatcatt

SEQ ID NO: 558344 - DNA, 13 bp, D. melanogaster
aacttaaatttga

SEQ ID NO: 558345 - DNA, 13 bp, D. melanogaster
aacttaaattttc

SEQ ID NO: 558346 - DNA, 13 bp, D. melanogaster
aacttaacaattt

SEQ ID NO: 558347 - DNA, 13 bp, D. melanogaster
aacttaacccaaa

SEQ ID NO: 558348 - DNA, 14 bp, D. melanogaster
aacttaacttaatt

SEQ ID NO: 558349 - DNA, 13 bp, D. melanogaster
aacttaactttaa

SEQ ID NO: 558350 - DNA, 13 bp, D. melanogaster
aacttaactttgt

SEQ ID NO: 558351 - DNA, 13 bp, D. melanogaster
aacttaagaaata

SEQ ID NO: 558352 - DNA, 13 bp, D. melanogaster
aacttaagctaat

SEQ ID NO: 558353 - DNA, 13 bp, D. melanogaster
aacttaagcttaa

SEQ ID NO: 558354 - DNA, 13 bp, D. melanogaster
aacttaaggaaat

SEQ ID NO: 558355 - DNA, 13 bp, D. melanogaster
aacttaataactt

SEQ ID NO: 558356 - DNA, 13 bp, D. melanogaster
aacttaatcaatt

SEQ ID NO: 558357 - DNA, 13 bp, D. melanogaster
aacttaatgaaaa

SEQ ID NO: 558358 - DNA, 13 bp, D. melanogaster
aacttaatgaaag

SEQ ID NO: 558359 - DNA, 13 bp, D. melanogaster
aacttaatgccaa

SEQ ID NO: 558360 - DNA, 14 bp, D. melanogaster
aacttaattaaatg

SEQ ID NO: 558361 - DNA, 13 bp, D. melanogaster
aacttaattaaca

SEQ ID NO: 558362 - DNA, 13 bp, D. melanogaster
aacttaattaact

SEQ ID NO: 558363 - DNA, 13 bp, D. melanogaster
aacttaattagaa

SEQ ID NO: 558364 - DNA, 13 bp, D. melanogaster
aacttaattagct

SEQ ID NO: 558365 - DNA, 13 bp, D. melanogaster
aacttaattgaaa

SEQ ID NO: 558366 - DNA, 13 bp, D. melanogaster
aacttaattgaat

SEQ ID NO: 558367 - DNA, 13 bp, D. melanogaster
aacttaattgcaa

SEQ ID NO: 558368 - DNA, 13 bp, D. melanogaster
aacttacaaatta

SEQ ID NO: 558369 - DNA, 13 bp, D. melanogaster
aacttacatatat

SEQ ID NO: 558370 - DNA, 13 bp, D. melanogaster
aacttacatatgt

SEQ ID NO: 558371 - DNA, 13 bp, D. melanogaster
aacttacttaaaa

SEQ ID NO: 558372 - DNA, 13 bp, D. melanogaster
aacttagaaattg

SEQ ID NO: 558373 - DNA, 14 bp, D. melanogaster
aacttataacttat

SEQ ID NO: 558374 - DNA, 14 bp, D. melanogaster
aacttataagtgaa

SEQ ID NO: 558375 - DNA, 13 bp, D. melanogaster
aacttatgcaaca

SEQ ID NO: 558376 - DNA, 13 bp, D. melanogaster
aacttatggaaaa

SEQ ID NO: 558377 - DNA, 13 bp, D. melanogaster
aacttatggcagc

SEQ ID NO: 558378 - DNA, 13 bp, D. melanogaster
aacttatgtatgt

SEQ ID NO: 558379 - DNA, 14 bp, D. melanogaster
aacttatgtatgtg

SEQ ID NO: 558380 - DNA, 13 bp, D. melanogaster
aacttattcattt

SEQ ID NO: 558381 - DNA, 13 bp, D. melanogaster
aacttattgaaaa

SEQ ID NO: 558382 - DNA, 13 bp, D. melanogaster
aacttattgaaca

SEQ ID NO: 558383 - DNA, 13 bp, D. melanogaster
aacttatttaccc

SEQ ID NO: 558384 - DNA, 13 bp, D. melanogaster
aacttatttatag

SEQ ID NO: 558385 - DNA, 13 bp, D. melanogaster
aacttatttcaca

SEQ ID NO: 558386 - DNA, 13 bp, D. melanogaster
aacttatttcatt

SEQ ID NO: 558387 - DNA, 13 bp, D. melanogaster
aacttatttgaat

SEQ ID NO: 558388 - DNA, 13 bp, D. melanogaster
aacttatttgctt

SEQ ID NO: 558389 - DNA, 14 bp, D. melanogaster
aacttattttaaac

SEQ ID NO: 558390 - DNA, 13 bp, D. melanogaster
aacttattttcgt

SEQ ID NO: 558391 - DNA, 13 bp, D. melanogaster
aacttcaaaaagt

SEQ ID NO: 558392 - DNA, 14 bp, D. melanogaster
aacttcaaaaagtg

SEQ ID NO: 558393 - DNA, 13 bp, D. melanogaster
aacttcaaaacta

SEQ ID NO: 558394 - DNA, 13 bp, D. melanogaster
aacttcaaaactt

SEQ ID NO: 558395 - DNA, 13 bp, D. melanogaster
aacttcaaaaggt

SEQ ID NO: 558396 - DNA, 13 bp, D. melanogaster
aacttcaaaagtt

SEQ ID NO: 558397 - DNA, 13 bp, D. melanogaster
aacttcaacggga

SEQ ID NO: 558398 - DNA, 14 bp, D. melanogaster
aacttcaacgggag

SEQ ID NO: 558399 - DNA, 13 bp, D. melanogaster
aacttcaagaaag

SEQ ID NO: 558400 - DNA, 13 bp, D. melanogaster
aacttcaagtttt

SEQ ID NO: 558401 - DNA, 13 bp, D. melanogaster
aacttcaatattt

SEQ ID NO: 558402 - DNA, 13 bp, D. melanogaster
aacttcaattaat

SEQ ID NO: 558403 - DNA, 13 bp, D. melanogaster
aacttcaatttgg

SEQ ID NO: 558404 - DNA, 13 bp, D. melanogaster
aacttcacttcac

SEQ ID NO: 558405 - DNA, 13 bp, D. melanogaster
aacttcagacgca

SEQ ID NO: 558406 - DNA, 13 bp, D. melanogaster
aacttcagggaga

SEQ ID NO: 558407 - DNA, 13 bp, D. melanogaster
aacttcagtgagg

SEQ ID NO: 558408 - DNA, 13 bp, D. melanogaster
aacttcataaatt

SEQ ID NO: 558409 - DNA, 13 bp, D. melanogaster
aacttcatactga

SEQ ID NO: 558410 - DNA, 13 bp, D. melanogaster
aacttcattaaaa

SEQ ID NO: 558411 - DNA, 13 bp, D. melanogaster
aacttcattattt

SEQ ID NO: 558412 - DNA, 14 bp, D. melanogaster
aacttcattcaatt

SEQ ID NO: 558413 - DNA, 13 bp, D. melanogaster
aacttcatttatt

SEQ ID NO: 558414 - DNA, 13 bp, D. melanogaster
aacttcatttcaa

SEQ ID NO: 558415 - DNA, 13 bp, D. melanogaster
aacttcatttgca

SEQ ID NO: 558416 - DNA, 13 bp, D. melanogaster
aacttcattttgt

SEQ ID NO: 558417 - DNA, 14 bp, D. melanogaster
aacttccagtggca

SEQ ID NO: 558418 - DNA, 13 bp, D. melanogaster
aacttccgtttcc

SEQ ID NO: 558419 - DNA, 13 bp, D. melanogaster
aacttcctcccag

SEQ ID NO: 558420 - DNA, 13 bp, D. melanogaster
aacttcctttgca

SEQ ID NO: 558421 - DNA, 13 bp, D. melanogaster
aacttcgatttcc

SEQ ID NO: 558422 - DNA, 13 bp, D. melanogaster
aacttcgccgact

SEQ ID NO: 558423 - DNA, 13 bp, D. melanogaster
aacttctggagaa

SEQ ID NO: 558424 - DNA, 13 bp, D. melanogaster
aacttcttgtatc

SEQ ID NO: 558425 - DNA, 13 bp, D. melanogaster
aacttctttaaaa

SEQ ID NO: 558426 - DNA, 13 bp, D. melanogaster
aacttctttaatt

SEQ ID NO: 558427 - DNA, 13 bp, D. melanogaster
aacttgaaaaact

SEQ ID NO: 558428 - DNA, 13 bp, D. melanogaster
aacttgaaaaatg

SEQ ID NO: 558429 - DNA, 13 bp, D. melanogaster
aacttgaaaaatt

SEQ ID NO: 558430 - DNA, 13 bp, D. melanogaster
aacttgaaaattt

SEQ ID NO: 558431 - DNA, 13 bp, D. melanogaster
aacttgaaacttt

SEQ ID NO: 558432 - DNA, 13 bp, D. melanogaster
aacttgaaattct

SEQ ID NO: 558433 - DNA, 13 bp, D. melanogaster
aacttgaaattga

SEQ ID NO: 558434 - DNA, 13 bp, D. melanogaster
aacttgaacaaaa

SEQ ID NO: 558435 - DNA, 13 bp, D. melanogaster
aacttgaacttca

SEQ ID NO: 558436 - DNA, 14 bp, D. melanogaster
aacttgaacttgaa

SEQ ID NO: 558437 - DNA, 13 bp, D. melanogaster
aacttgaagaaaa

SEQ ID NO: 558438 - DNA, 14 bp, D. melanogaster
aacttgaagaaaac

SEQ ID NO: 558439 - DNA, 13 bp, D. melanogaster
aacttgaagtttt

SEQ ID NO: 558440 - DNA, 13 bp, D. melanogaster
aacttgaatgaaa

SEQ ID NO: 558441 - DNA, 14 bp, D. melanogaster
aacttgaatgcaaa

SEQ ID NO: 558442 - DNA, 13 bp, D. melanogaster
aacttgaatttat

SEQ ID NO: 558443 - DNA, 13 bp, D. melanogaster
aacttgaatttga

SEQ ID NO: 558444 - DNA, 13 bp, D. melanogaster
aacttgacaactt

SEQ ID NO: 558445 - DNA, 13 bp, D. melanogaster
aacttgacaataa

SEQ ID NO: 558446 - DNA, 14 bp, D. melanogaster
aacttgacaataat

SEQ ID NO: 558447 - DNA, 13 bp, D. melanogaster
aacttgacgcgtg

SEQ ID NO: 558448 - DNA, 13 bp, D. melanogaster
aacttgagctgcg

SEQ ID NO: 558449 - DNA, 13 bp, D. melanogaster
aacttgattattt

SEQ ID NO: 558450 - DNA, 13 bp, D. melanogaster
aacttgattgatt

SEQ ID NO: 558451 - DNA, 13 bp, D. melanogaster
aacttgattgctt

SEQ ID NO: 558452 - DNA, 14 bp, D. melanogaster
aacttgatttattt

SEQ ID NO: 558453 - DNA, 13 bp, D. melanogaster
aacttgattttgc

SEQ ID NO: 558454 - DNA, 14 bp, D. melanogaster
aacttgatttttat

SEQ ID NO: 558455 - DNA, 13 bp, D. melanogaster
aacttgcaacatt

SEQ ID NO: 558456 - DNA, 13 bp, D. melanogaster
aacttgcactttt

SEQ ID NO: 558457 - DNA, 13 bp, D. melanogaster
aacttgcccaaaa

SEQ ID NO: 558458 - DNA, 13 bp, D. melanogaster
aacttgcgctgcg

SEQ ID NO: 558459 - DNA, 14 bp, D. melanogaster
aacttgcgctgcgt

SEQ ID NO: 558460 - DNA, 14 bp, D. melanogaster
aacttgctaaattt

SEQ ID NO: 558461 - DNA, 13 bp, D. melanogaster
aacttgctgctgc

SEQ ID NO: 558462 - DNA, 13 bp, D. melanogaster
aacttggaaaaaa

SEQ ID NO: 558463 - DNA, 13 bp, D. melanogaster
aacttggaaatta

SEQ ID NO: 558464 - DNA, 13 bp, D. melanogaster
aacttggaacttg

SEQ ID NO: 558465 - DNA, 13 bp, D. melanogaster
aacttggaatttg

SEQ ID NO: 558466 - DNA, 13 bp, D. melanogaster
aacttggacggac

SEQ ID NO: 558467 - DNA, 13 bp, D. melanogaster
aacttggcaaaaa

SEQ ID NO: 558468 - DNA, 13 bp, D. melanogaster
aacttggcaacaa

SEQ ID NO: 558469 - DNA, 13 bp, D. melanogaster
aacttggcaactt

SEQ ID NO: 558470 - DNA, 13 bp, D. melanogaster
aacttggcatttg

SEQ ID NO: 558471 - DNA, 13 bp, D. melanogaster
aacttggccaaaa

SEQ ID NO: 558472 - DNA, 13 bp, D. melanogaster
aacttggccaaca

SEQ ID NO: 558473 - DNA, 14 bp, D. melanogaster
aacttggccaacaa

SEQ ID NO: 558474 - DNA, 13 bp, D. melanogaster
aacttggccaact

SEQ ID NO: 558475 - DNA, 14 bp, D. melanogaster
aacttggccaactt

SEQ ID NO: 558476 - DNA, 13 bp, D. melanogaster
aacttggccaagt

SEQ ID NO: 558477 - DNA, 13 bp, D. melanogaster
aacttggccagaa

SEQ ID NO: 558478 - DNA, 13 bp, D. melanogaster
aacttggccagca

SEQ ID NO: 558479 - DNA, 14 bp, D. melanogaster
aacttggccataaa

SEQ ID NO: 558480 - DNA, 13 bp, D. melanogaster
aacttggccatta

SEQ ID NO: 558481 - DNA, 13 bp, D. melanogaster
aacttggcccaca

SEQ ID NO: 558482 - DNA, 13 bp, D. melanogaster
aacttggcgaaaa

SEQ ID NO: 558483 - DNA, 13 bp, D. melanogaster
aacttggctaaaa

SEQ ID NO: 558484 - DNA, 13 bp, D. melanogaster
aacttggctaaca

SEQ ID NO: 558485 - DNA, 13 bp, D. melanogaster
aacttggctaact

SEQ ID NO: 558486 - DNA, 13 bp, D. melanogaster
aacttggctcaaa

SEQ ID NO: 558487 - DNA, 13 bp, D. melanogaster
aacttggctgcca

SEQ ID NO: 558488 - DNA, 13 bp, D. melanogaster
aacttggctggct

SEQ ID NO: 558489 - DNA, 13 bp, D. melanogaster
aacttggcttaaa

SEQ ID NO: 558490 - DNA, 13 bp, D. melanogaster
aacttggcttttt

SEQ ID NO: 558491 - DNA, 13 bp, D. melanogaster
aacttggtcgagc

SEQ ID NO: 558492 - DNA, 14 bp, D. melanogaster
aacttggtcgagca

SEQ ID NO: 558493 - DNA, 13 bp, D. melanogaster
aacttggtttttt

SEQ ID NO: 558494 - DNA, 13 bp, D. melanogaster
aacttgtaaatta

SEQ ID NO: 558495 - DNA, 13 bp, D. melanogaster
aacttgtaatttt

SEQ ID NO: 558496 - DNA, 13 bp, D. melanogaster
aacttgtatattt

SEQ ID NO: 558497 - DNA, 13 bp, D. melanogaster
aacttgtatttta

SEQ ID NO: 558498 - DNA, 13 bp, D. melanogaster
aacttgtattttt

SEQ ID NO: 558499 - DNA, 14 bp, D. melanogaster
aacttgtgtgccat

SEQ ID NO: 558500 - DNA, 13 bp, D. melanogaster
aacttgttcaaaa

SEQ ID NO: 558501 - DNA, 13 bp, D. melanogaster
aacttgttgaaaa

SEQ ID NO: 558502 - DNA, 13 bp, D. melanogaster
aacttgttgggcg

SEQ ID NO: 558503 - DNA, 13 bp, D. melanogaster
aacttgttgttgc

SEQ ID NO: 558504 - DNA, 14 bp, D. melanogaster
aacttgttgttgtt

SEQ ID NO: 558505 - DNA, 13 bp, D. melanogaster
aacttgttgtttt

SEQ ID NO: 558506 - DNA, 13 bp, D. melanogaster
aacttgtttaaaa

SEQ ID NO: 558507 - DNA, 13 bp, D. melanogaster
aacttgtttaatt

SEQ ID NO: 558508 - DNA, 13 bp, D. melanogaster
aacttgttttcaa

SEQ ID NO: 558509 - DNA, 13 bp, D. melanogaster
aacttgttttctt

SEQ ID NO: 558510 - DNA, 13 bp, D. melanogaster
aacttgtttttgt

SEQ ID NO: 558511 - DNA, 13 bp, D. melanogaster
aactttaaaactt

SEQ ID NO: 558512 - DNA, 14 bp, D. melanogaster
aactttaaaacttt

SEQ ID NO: 558513 - DNA, 13 bp, D. melanogaster
aactttaaaagcg

SEQ ID NO: 558514 - DNA, 13 bp, D. melanogaster
aactttaaaatag

SEQ ID NO: 558515 - DNA, 13 bp, D. melanogaster
aactttaaactta

SEQ ID NO: 558516 - DNA, 13 bp, D. melanogaster
aactttaaagaaa

SEQ ID NO: 558517 - DNA, 13 bp, D. melanogaster
aactttaaagcaa

SEQ ID NO: 558518 - DNA, 13 bp, D. melanogaster
aactttaaagtat

SEQ ID NO: 558519 - DNA, 13 bp, D. melanogaster
aactttaaatgaa

SEQ ID NO: 558520 - DNA, 13 bp, D. melanogaster
aactttaacaatt

SEQ ID NO: 558521 - DNA, 13 bp, D. melanogaster
aactttaacatta

SEQ ID NO: 558522 - DNA, 13 bp, D. melanogaster
aactttaacttta

SEQ ID NO: 558523 - DNA, 14 bp, D. melanogaster
aactttaactttaa

SEQ ID NO: 558524 - DNA, 13 bp, D. melanogaster
aactttaagatac

SEQ ID NO: 558525 - DNA, 13 bp, D. melanogaster
aactttaagattt

SEQ ID NO: 558526 - DNA, 13 bp, D. melanogaster
aactttaagctta

SEQ ID NO: 558527 - DNA, 13 bp, D. melanogaster
aactttaagcttt

SEQ ID NO: 558528 - DNA, 13 bp, D. melanogaster
aactttaaggaaa

SEQ ID NO: 558529 - DNA, 13 bp, D. melanogaster
aactttaagtgca

SEQ ID NO: 558530 - DNA, 13 bp, D. melanogaster
aactttaatagga

SEQ ID NO: 558531 - DNA, 13 bp, D. melanogaster
aactttaatcaaa

SEQ ID NO: 558532 - DNA, 13 bp, D. melanogaster
aactttaatcaat

SEQ ID NO: 558533 - DNA, 13 bp, D. melanogaster
aactttaatggca

SEQ ID NO: 558534 - DNA, 13 bp, D. melanogaster
aactttaatgtct

SEQ ID NO: 558535 - DNA, 13 bp, D. melanogaster
aactttaattaca

SEQ ID NO: 558536 - DNA, 13 bp, D. melanogaster
aactttaattgaa

SEQ ID NO: 558537 - DNA, 14 bp, D. melanogaster
aactttaattgaaa

SEQ ID NO: 558538 - DNA, 14 bp, D. melanogaster
aactttaattgaat

SEQ ID NO: 558539 - DNA, 13 bp, D. melanogaster
aactttaattgca

SEQ ID NO: 558540 - DNA, 13 bp, D. melanogaster
aactttaatttca

SEQ ID NO: 558541 - DNA, 13 bp, D. melanogaster
aactttaatttga

SEQ ID NO: 558542 - DNA, 13 bp, D. melanogaster
aactttaatttgg

SEQ ID NO: 558543 - DNA, 13 bp, D. melanogaster
aactttacaactt

SEQ ID NO: 558544 - DNA, 14 bp, D. melanogaster
aactttacaacttt

SEQ ID NO: 558545 - DNA, 13 bp, D. melanogaster
aactttacatata

SEQ ID NO: 558546 - DNA, 13 bp, D. melanogaster
aactttactttaa

SEQ ID NO: 558547 - DNA, 13 bp, D. melanogaster
aactttataaaca

SEQ ID NO: 558548 - DNA, 13 bp, D. melanogaster
aactttataaact

SEQ ID NO: 558549 - DNA, 14 bp, D. melanogaster
aactttataacttt

SEQ ID NO: 558550 - DNA, 13 bp, D. melanogaster
aactttatcagtt

SEQ ID NO: 558551 - DNA, 13 bp, D. melanogaster
aactttatgaaat

SEQ ID NO: 558552 - DNA, 13 bp, D. melanogaster
aactttatgataa

SEQ ID NO: 558553 - DNA, 14 bp, D. melanogaster
aactttatgtgtgc

SEQ ID NO: 558554 - DNA, 13 bp, D. melanogaster
aactttattagcc

SEQ ID NO: 558555 - DNA, 13 bp, D. melanogaster
aactttattgaaa

SEQ ID NO: 558556 - DNA, 13 bp, D. melanogaster
aactttattgcca

SEQ ID NO: 558557 - DNA, 14 bp, D. melanogaster
aactttattgccat

SEQ ID NO: 558558 - DNA, 13 bp, D. melanogaster
aactttattgttt

SEQ ID NO: 558559 - DNA, 13 bp, D. melanogaster
aactttatttcct

SEQ ID NO: 558560 - DNA, 13 bp, D. melanogaster
aactttatttgta

SEQ ID NO: 558561 - DNA, 13 bp, D. melanogaster
aactttcaaaatg

SEQ ID NO: 558562 - DNA, 13 bp, D. melanogaster
aactttcaaaatt

SEQ ID NO: 558563 - DNA, 13 bp, D. melanogaster
aactttcaaatat

SEQ ID NO: 558564 - DNA, 13 bp, D. melanogaster
aactttcaacttt

SEQ ID NO: 558565 - DNA, 13 bp, D. melanogaster
aactttcaattaa

SEQ ID NO: 558566 - DNA, 13 bp, D. melanogaster
aactttcaattgc

SEQ ID NO: 558567 - DNA, 13 bp, D. melanogaster
aactttcacattt

SEQ ID NO: 558568 - DNA, 13 bp, D. melanogaster
aactttcaccttt

SEQ ID NO: 558569 - DNA, 13 bp, D. melanogaster
aactttcacttag

SEQ ID NO: 558570 - DNA, 14 bp, D. melanogaster
aactttcacttagt

SEQ ID NO: 558571 - DNA, 13 bp, D. melanogaster
aactttcactttc

SEQ ID NO: 558572 - DNA, 13 bp, D. melanogaster
aactttcataaaa

SEQ ID NO: 558573 - DNA, 13 bp, D. melanogaster
aactttcattttc

SEQ ID NO: 558574 - DNA, 13 bp, D. melanogaster
aactttccaattt

SEQ ID NO: 558575 - DNA, 13 bp, D. melanogaster
aactttccatgca

SEQ ID NO: 558576 - DNA, 13 bp, D. melanogaster
aactttcccaaaa

SEQ ID NO: 558577 - DNA, 13 bp, D. melanogaster
aactttgaaaaat

SEQ ID NO: 558578 - DNA, 13 bp, D. melanogaster
aactttgaaatat

SEQ ID NO: 558579 - DNA, 13 bp, D. melanogaster
aactttgaacttt

SEQ ID NO: 558580 - DNA, 13 bp, D. melanogaster
aactttgaagcat

SEQ ID NO: 558581 - DNA, 13 bp, D. melanogaster
aactttgaagtgc

SEQ ID NO: 558582 - DNA, 13 bp, D. melanogaster
aactttgaataca

SEQ ID NO: 558583 - DNA, 13 bp, D. melanogaster
aactttgacattt

SEQ ID NO: 558584 - DNA, 14 bp, D. melanogaster
aactttgacttggc

SEQ ID NO: 558585 - DNA, 13 bp, D. melanogaster
aactttgatgata

SEQ ID NO: 558586 - DNA, 14 bp, D. melanogaster
aactttgatgatat

SEQ ID NO: 558587 - DNA, 13 bp, D. melanogaster
aactttgattgat

SEQ ID NO: 558588 - DNA, 13 bp, D. melanogaster
aactttgatttgc

SEQ ID NO: 558589 - DNA, 13 bp, D. melanogaster
aactttgattttc

SEQ ID NO: 558590 - DNA, 13 bp, D. melanogaster
aactttgattttg

SEQ ID NO: 558591 - DNA, 13 bp, D. melanogaster
aactttgattttt

SEQ ID NO: 558592 - DNA, 13 bp, D. melanogaster
aactttgcaaatt

SEQ ID NO: 558593 - DNA, 13 bp, D. melanogaster
aactttgccactt

SEQ ID NO: 558594 - DNA, 13 bp, D. melanogaster
aactttgccagct

SEQ ID NO: 558595 - DNA, 13 bp, D. melanogaster
aactttgccattt

SEQ ID NO: 558596 - DNA, 13 bp, D. melanogaster
aactttgctctgg

SEQ ID NO: 558597 - DNA, 13 bp, D. melanogaster
aactttgcttgtt

SEQ ID NO: 558598 - DNA, 13 bp, D. melanogaster
aactttgctttca

SEQ ID NO: 558599 - DNA, 13 bp, D. melanogaster
aactttggaaaaa

SEQ ID NO: 558600 - DNA, 13 bp, D. melanogaster
aactttggccaac

SEQ ID NO: 558601 - DNA, 13 bp, D. melanogaster
aactttggcctcg

SEQ ID NO: 558602 - DNA, 13 bp, D. melanogaster
aactttggctgcc

SEQ ID NO: 558603 - DNA, 13 bp, D. melanogaster
aactttggctttt

SEQ ID NO: 558604 - DNA, 13 bp, D. melanogaster
aactttggtggag

SEQ ID NO: 558605 - DNA, 13 bp, D. melanogaster
aactttgtcaatt

SEQ ID NO: 558606 - DNA, 13 bp, D. melanogaster
aactttgtctttg

SEQ ID NO: 558607 - DNA, 13 bp, D. melanogaster
aactttgtgaaaa

SEQ ID NO: 558608 - DNA, 13 bp, D. melanogaster
aactttgtgaatg

SEQ ID NO: 558609 - DNA, 13 bp, D. melanogaster
aactttgtgccaa

SEQ ID NO: 558610 - DNA, 13 bp, D. melanogaster
aactttgtggcca

SEQ ID NO: 558611 - DNA, 13 bp, D. melanogaster
aactttgtgtgat

SEQ ID NO: 558612 - DNA, 13 bp, D. melanogaster
aactttgtttact

SEQ ID NO: 558613 - DNA, 13 bp, D. melanogaster
aacttttaaaatg

SEQ ID NO: 558614 - DNA, 13 bp, D. melanogaster
aacttttaaactc

SEQ ID NO: 558615 - DNA, 13 bp, D. melanogaster
aacttttaaatgc

SEQ ID NO: 558616 - DNA, 13 bp, D. melanogaster
aacttttaaattg

SEQ ID NO: 558617 - DNA, 13 bp, D. melanogaster
aacttttaagtaa

SEQ ID NO: 558618 - DNA, 13 bp, D. melanogaster
aacttttaagtta

SEQ ID NO: 558619 - DNA, 14 bp, D. melanogaster
aacttttaagttaa

SEQ ID NO: 558620 - DNA, 13 bp, D. melanogaster
aacttttacattt

SEQ ID NO: 558621 - DNA, 14 bp, D. melanogaster
aacttttacattta

SEQ ID NO: 558622 - DNA, 13 bp, D. melanogaster
aacttttactttg

SEQ ID NO: 558623 - DNA, 14 bp, D. melanogaster
aacttttactttgc

SEQ ID NO: 558624 - DNA, 14 bp, D. melanogaster
aacttttagcatag

SEQ ID NO: 558625 - DNA, 13 bp, D. melanogaster
aacttttagtttt

SEQ ID NO: 558626 - DNA, 13 bp, D. melanogaster
aacttttatgaca

SEQ ID NO: 558627 - DNA, 13 bp, D. melanogaster
aacttttatggct

SEQ ID NO: 558628 - DNA, 13 bp, D. melanogaster
aacttttattaac

SEQ ID NO: 558629 - DNA, 13 bp, D. melanogaster
aacttttattgat

SEQ ID NO: 558630 - DNA, 13 bp, D. melanogaster
aacttttatttcg

SEQ ID NO: 558631 - DNA, 13 bp, D. melanogaster
aacttttatttgc

SEQ ID NO: 558632 - DNA, 13 bp, D. melanogaster
aacttttcaaaat

SEQ ID NO: 558633 - DNA, 13 bp, D. melanogaster
aacttttcaactt

SEQ ID NO: 558634 - DNA, 13 bp, D. melanogaster
aacttttcacata

SEQ ID NO: 558635 - DNA, 13 bp, D. melanogaster
aacttttcacatt

SEQ ID NO: 558636 - DNA, 13 bp, D. melanogaster
aacttttcactgc

SEQ ID NO: 558637 - DNA, 13 bp, D. melanogaster
aacttttcattga

SEQ ID NO: 558638 - DNA, 13 bp, D. melanogaster
aacttttcattta

SEQ ID NO: 558639 - DNA, 13 bp, D. melanogaster
aacttttcatttc

SEQ ID NO: 558640 - DNA, 13 bp, D. melanogaster
aacttttccaatt

SEQ ID NO: 558641 - DNA, 13 bp, D. melanogaster
aacttttccacaa

SEQ ID NO: 558642 - DNA, 13 bp, D. melanogaster
aacttttccactt

SEQ ID NO: 558643 - DNA, 13 bp, D. melanogaster
aacttttccagca

SEQ ID NO: 558644 - DNA, 13 bp, D. melanogaster
aacttttccatta

SEQ ID NO: 558645 - DNA, 13 bp, D. melanogaster
aacttttccattc

SEQ ID NO: 558646 - DNA, 13 bp, D. melanogaster
aacttttccattt

SEQ ID NO: 558647 - DNA, 13 bp, D. melanogaster
aacttttccgaaa

SEQ ID NO: 558648 - DNA, 13 bp, D. melanogaster
aacttttcgacat

SEQ ID NO: 558649 - DNA, 13 bp, D. melanogaster
aacttttcgattt

SEQ ID NO: 558650 - DNA, 13 bp, D. melanogaster
aacttttcgcagc

SEQ ID NO: 558651 - DNA, 13 bp, D. melanogaster
aacttttcgcata

SEQ ID NO: 558652 - DNA, 13 bp, D. melanogaster
aacttttcggctt

SEQ ID NO: 558653 - DNA, 13 bp, D. melanogaster
aacttttcgtttt

SEQ ID NO: 558654 - DNA, 13 bp, D. melanogaster
aacttttcttaat

SEQ ID NO: 558655 - DNA, 13 bp, D. melanogaster
aacttttgaaaac

SEQ ID NO: 558656 - DNA, 13 bp, D. melanogaster
aacttttgaaaat

SEQ ID NO: 558657 - DNA, 13 bp, D. melanogaster
aacttttgaatga

SEQ ID NO: 558658 - DNA, 13 bp, D. melanogaster
aacttttgataat

SEQ ID NO: 558659 - DNA, 13 bp, D. melanogaster
aacttttgatata

SEQ ID NO: 558660 - DNA, 13 bp, D. melanogaster
aacttttgattat

SEQ ID NO: 558661 - DNA, 13 bp, D. melanogaster
aacttttgattgc

SEQ ID NO: 558662 - DNA, 13 bp, D. melanogaster
aacttttgatttg

SEQ ID NO: 558663 - DNA, 13 bp, D. melanogaster
aacttttgatttt

SEQ ID NO: 558664 - DNA, 13 bp, D. melanogaster
aacttttgcaaaa

SEQ ID NO: 558665 - DNA, 13 bp, D. melanogaster
aacttttgcaaag

SEQ ID NO: 558666 - DNA, 13 bp, D. melanogaster
aacttttgcaaat

SEQ ID NO: 558667 - DNA, 13 bp, D. melanogaster
aacttttgcacat

SEQ ID NO: 558668 - DNA, 13 bp, D. melanogaster
aacttttgcagca

SEQ ID NO: 558669 - DNA, 13 bp, D. melanogaster
aacttttgcagtt

SEQ ID NO: 558670 - DNA, 13 bp, D. melanogaster
aacttttgcatta

SEQ ID NO: 558671 - DNA, 13 bp, D. melanogaster
aacttttgcattg

SEQ ID NO: 558672 - DNA, 13 bp, D. melanogaster
aacttttgccaaa

SEQ ID NO: 558673 - DNA, 13 bp, D. melanogaster
aacttttgccaat

SEQ ID NO: 558674 - DNA, 13 bp, D. melanogaster
aacttttgccgcc

SEQ ID NO: 558675 - DNA, 13 bp, D. melanogaster
aacttttgccgct

SEQ ID NO: 558676 - DNA, 13 bp, D. melanogaster
aacttttgccggc

SEQ ID NO: 558677 - DNA, 13 bp, D. melanogaster
aacttttgcgcaa

SEQ ID NO: 558678 - DNA, 13 bp, D. melanogaster
aacttttgcggca

SEQ ID NO: 558679 - DNA, 13 bp, D. melanogaster
aacttttgcggtt

SEQ ID NO: 558680 - DNA, 13 bp, D. melanogaster
aacttttgctgca

SEQ ID NO: 558681 - DNA, 13 bp, D. melanogaster
aacttttgctgct

SEQ ID NO: 558682 - DNA, 13 bp, D. melanogaster
aacttttgctttc

SEQ ID NO: 558683 - DNA, 13 bp, D. melanogaster
aacttttgctttt

SEQ ID NO: 558684 - DNA, 13 bp, D. melanogaster
aacttttggaaat

SEQ ID NO: 558685 - DNA, 13 bp, D. melanogaster
aacttttggcatt

SEQ ID NO: 558686 - DNA, 13 bp, D. melanogaster
aacttttggccaa

SEQ ID NO: 558687 - DNA, 13 bp, D. melanogaster
aacttttgggcca

SEQ ID NO: 558688 - DNA, 13 bp, D. melanogaster
aacttttgggcgt

SEQ ID NO: 558689 - DNA, 13 bp, D. melanogaster
aacttttgtcaaa

SEQ ID NO: 558690 - DNA, 13 bp, D. melanogaster
aacttttgtgcaa

SEQ ID NO: 558691 - DNA, 13 bp, D. melanogaster
aacttttgtggca

SEQ ID NO: 558692 - DNA, 13 bp, D. melanogaster
aacttttgtgttt

SEQ ID NO: 558693 - DNA, 13 bp, D. melanogaster
aacttttgttagc

SEQ ID NO: 558694 - DNA, 13 bp, D. melanogaster
aacttttgttgct

SEQ ID NO: 558695 - DNA, 13 bp, D. melanogaster
aacttttgtttac

SEQ ID NO: 558696 - DNA, 13 bp, D. melanogaster
aacttttgtttga

SEQ ID NO: 558697 - DNA, 13 bp, D. melanogaster
aacttttgtttgc

SEQ ID NO: 558698 - DNA, 13 bp, D. melanogaster
aacttttgttttg

SEQ ID NO: 558699 - DNA, 13 bp, D. melanogaster
aactttttaaagt

SEQ ID NO: 558700 - DNA, 13 bp, D. melanogaster
aactttttaaatg

SEQ ID NO: 558701 - DNA, 13 bp, D. melanogaster
aactttttaagtt

SEQ ID NO: 558702 - DNA, 14 bp, D. melanogaster
aactttttaatgaa

SEQ ID NO: 558703 - DNA, 13 bp, D. melanogaster
aactttttaattg

SEQ ID NO: 558704 - DNA, 13 bp, D. melanogaster
aactttttacaat

SEQ ID NO: 558705 - DNA, 13 bp, D. melanogaster
aactttttacaca

SEQ ID NO: 558706 - DNA, 13 bp, D. melanogaster
aactttttactta

SEQ ID NO: 558707 - DNA, 13 bp, D. melanogaster
aactttttagcca

SEQ ID NO: 558708 - DNA, 13 bp, D. melanogaster
aactttttataga

SEQ ID NO: 558709 - DNA, 13 bp, D. melanogaster
aactttttatatg

SEQ ID NO: 558710 - DNA, 13 bp, D. melanogaster
aactttttatcaa

SEQ ID NO: 558711 - DNA, 13 bp, D. melanogaster
aactttttcaaaa

SEQ ID NO: 558712 - DNA, 13 bp, D. melanogaster
aactttttcaaat

SEQ ID NO: 558713 - DNA, 13 bp, D. melanogaster
aactttttcaata

SEQ ID NO: 558714 - DNA, 13 bp, D. melanogaster
aactttttcatat

SEQ ID NO: 558715 - DNA, 13 bp, D. melanogaster
aactttttccaat

SEQ ID NO: 558716 - DNA, 13 bp, D. melanogaster
aactttttcgaaa

SEQ ID NO: 558717 - DNA, 13 bp, D. melanogaster
aactttttcgaat

SEQ ID NO: 558718 - DNA, 13 bp, D. melanogaster
aactttttcgatt

SEQ ID NO: 558719 - DNA, 14 bp, D. melanogaster
aactttttcgattt

SEQ ID NO: 558720 - DNA, 13 bp, D. melanogaster
aactttttcgcac

SEQ ID NO: 558721 - DNA, 13 bp, D. melanogaster
aactttttctaaa

SEQ ID NO: 558722 - DNA, 13 bp, D. melanogaster
aactttttctata

SEQ ID NO: 558723 - DNA, 13 bp, D. melanogaster
aactttttctgcc

SEQ ID NO: 558724 - DNA, 14 bp, D. melanogaster
aactttttgaaaat

SEQ ID NO: 558725 - DNA, 13 bp, D. melanogaster
aactttttgaaat

SEQ ID NO: 558726 - DNA, 13 bp, D. melanogaster
aactttttgaata

SEQ ID NO: 558727 - DNA, 14 bp, D. melanogaster
aactttttgcattt

SEQ ID NO: 558728 - DNA, 13 bp, D. melanogaster
aactttttgccag

SEQ ID NO: 558729 - DNA, 13 bp, D. melanogaster
aactttttgcccc

SEQ ID NO: 558730 - DNA, 13 bp, D. melanogaster
aactttttgcggt

SEQ ID NO: 558731 - DNA, 13 bp, D. melanogaster
aactttttgctca

SEQ ID NO: 558732 - DNA, 13 bp, D. melanogaster
aactttttgcttt

SEQ ID NO: 558733 - DNA, 14 bp, D. melanogaster
aactttttggcaaa

SEQ ID NO: 558734 - DNA, 13 bp, D. melanogaster
aactttttggcca

SEQ ID NO: 558735 - DNA, 14 bp, D. melanogaster
aactttttggccaa

SEQ ID NO: 558736 - DNA, 13 bp, D. melanogaster
aactttttggctt

SEQ ID NO: 558737 - DNA, 13 bp, D. melanogaster
aactttttgtaca

SEQ ID NO: 558738 - DNA, 13 bp, D. melanogaster
aactttttgtatt

SEQ ID NO: 558739 - DNA, 13 bp, D. melanogaster
aactttttgtcac

SEQ ID NO: 558740 - DNA, 13 bp, D. melanogaster
aactttttgtgtg

SEQ ID NO: 558741 - DNA, 13 bp, D. melanogaster
aactttttgtgtt

SEQ ID NO: 558742 - DNA, 13 bp, D. melanogaster
aacttttttaaca

SEQ ID NO: 558743 - DNA, 13 bp, D. melanogaster
aacttttttaatc

SEQ ID NO: 558744 - DNA, 14 bp, D. melanogaster
aacttttttatggc

SEQ ID NO: 558745 - DNA, 13 bp, D. melanogaster
aacttttttctca

SEQ ID NO: 558746 - DNA, 13 bp, D. melanogaster
aacttttttgaca

SEQ ID NO: 558747 - DNA, 14 bp, D. melanogaster
aacttttttgacat

SEQ ID NO: 558748 - DNA, 14 bp, D. melanogaster
aacttttttggcca

SEQ ID NO: 558749 - DNA, 13 bp, D. melanogaster
aacttttttgtgc

SEQ ID NO: 558750 - DNA, 13 bp, D. melanogaster
aacttttttttgc

SEQ ID NO: 558751 - DNA, 14 bp, D. melanogaster
aactttttttttcg

SEQ ID NO: 558752 - DNA, 14 bp, D. melanogaster
aagaaaaacaattt

SEQ ID NO: 558753 - DNA, 13 bp, D. melanogaster
aagaaaaacagtt

SEQ ID NO: 558754 - DNA, 13 bp, D. melanogaster
aagaaaaacattt

SEQ ID NO: 558755 - DNA, 14 bp, D. melanogaster
aagaaaaacatttt

SEQ ID NO: 558756 - DNA, 13 bp, D. melanogaster
aagaaaaaccatt

SEQ ID NO: 558757 - DNA, 13 bp, D. melanogaster
aagaaaaacccta

SEQ ID NO: 558758 - DNA, 13 bp, D. melanogaster
aagaaaaacgttt

SEQ ID NO: 558759 - DNA, 13 bp, D. melanogaster
aagaaaaactatt

SEQ ID NO: 558760 - DNA, 13 bp, D. melanogaster
aagaaaaactgca

SEQ ID NO: 558761 - DNA, 13 bp, D. melanogaster
aagaaaaacttta

SEQ ID NO: 558762 - DNA, 15 bp, D. melanogaster
aagaaaaagaagcta

SEQ ID NO: 558763 - DNA, 13 bp, D. melanogaster
aagaaaaagcatt

SEQ ID NO: 558764 - DNA, 13 bp, D. melanogaster
aagaaaaatccca

SEQ ID NO: 558765 - DNA, 14 bp, D. melanogaster
aagaaaaatcccag

SEQ ID NO: 558766 - DNA, 13 bp, D. melanogaster
aagaaaaatgcat

SEQ ID NO: 558767 - DNA, 13 bp, D. melanogaster
aagaaaaatgctg

SEQ ID NO: 558768 - DNA, 13 bp, D. melanogaster
aagaaaaatggtt

SEQ ID NO: 558769 - DNA, 13 bp, D. melanogaster
aagaaaaatgttg

SEQ ID NO: 558770 - DNA, 13 bp, D. melanogaster
aagaaaaatttcc

SEQ ID NO: 558771 - DNA, 14 bp, D. melanogaster
aagaaaacaaattg

SEQ ID NO: 558772 - DNA, 13 bp, D. melanogaster
aagaaaacaactt

SEQ ID NO: 558773 - DNA, 13 bp, D. melanogaster
aagaaaacaattt

SEQ ID NO: 558774 - DNA, 13 bp, D. melanogaster
aagaaaacattgc

SEQ ID NO: 558775 - DNA, 13 bp, D. melanogaster
aagaaaacatttc

SEQ ID NO: 558776 - DNA, 13 bp, D. melanogaster
aagaaaacatttg

SEQ ID NO: 558777 - DNA, 13 bp, D. melanogaster
aagaaaacctcca

SEQ ID NO: 558778 - DNA, 13 bp, D. melanogaster
aagaaaaccttca

SEQ ID NO: 558779 - DNA, 14 bp, D. melanogaster
aagaaaaccttcag

SEQ ID NO: 558780 - DNA, 13 bp, D. melanogaster
aagaaaacctttt

SEQ ID NO: 558781 - DNA, 13 bp, D. melanogaster
aagaaaacgaatt

SEQ ID NO: 558782 - DNA, 13 bp, D. melanogaster
aagaaaactaatc

SEQ ID NO: 558783 - DNA, 14 bp, D. melanogaster
aagaaaactaatcc

SEQ ID NO: 558784 - DNA, 13 bp, D. melanogaster
aagaaaactgaat

SEQ ID NO: 558785 - DNA, 13 bp, D. melanogaster
aagaaaactgatt

SEQ ID NO: 558786 - DNA, 14 bp, D. melanogaster
aagaaaactgattt

SEQ ID NO: 558787 - DNA, 13 bp, D. melanogaster
aagaaaactggaa

SEQ ID NO: 558788 - DNA, 13 bp, D. melanogaster
aagaaaactgtca

SEQ ID NO: 558789 - DNA, 13 bp, D. melanogaster
aagaaaacttcag

SEQ ID NO: 558790 - DNA, 13 bp, D. melanogaster
aagaaaagacttt

SEQ ID NO: 558791 - DNA, 14 bp, D. melanogaster
aagaaaagcgaggc

SEQ ID NO: 558792 - DNA, 13 bp, D. melanogaster
aagaaaagctgaa

SEQ ID NO: 558793 - DNA, 13 bp, D. melanogaster
aagaaaagctttt

SEQ ID NO: 558794 - DNA, 14 bp, D. melanogaster
aagaaaagctttta

SEQ ID NO: 558795 - DNA, 13 bp, D. melanogaster
aagaaaagtagtt

SEQ ID NO: 558796 - DNA, 13 bp, D. melanogaster
aagaaaagtgcaa

SEQ ID NO: 558797 - DNA, 13 bp, D. melanogaster
aagaaaagtgcag

SEQ ID NO: 558798 - DNA, 13 bp, D. melanogaster
aagaaaagtttat

SEQ ID NO: 558799 - DNA, 13 bp, D. melanogaster
aagaaaagttttg

SEQ ID NO: 558800 - DNA, 13 bp, D. melanogaster
aagaaaagttttt

SEQ ID NO: 558801 - DNA, 14 bp, D. melanogaster
aagaaaagttttta

SEQ ID NO: 558802 - DNA, 13 bp, D. melanogaster
aagaaaatactta

SEQ ID NO: 558803 - DNA, 13 bp, D. melanogaster
aagaaaatagcag

SEQ ID NO: 558804 - DNA, 13 bp, D. melanogaster
aagaaaatagttt

SEQ ID NO: 558805 - DNA, 14 bp, D. melanogaster
aagaaaatcaaatg

SEQ ID NO: 558806 - DNA, 13 bp, D. melanogaster
aagaaaatcacat

SEQ ID NO: 558807 - DNA, 13 bp, D. melanogaster
aagaaaatcactc

SEQ ID NO: 558808 - DNA, 14 bp, D. melanogaster
aagaaaatcactcc

SEQ ID NO: 558809 - DNA, 13 bp, D. melanogaster
aagaaaatcatat

SEQ ID NO: 558810 - DNA, 13 bp, D. melanogaster
aagaaaatcatca

SEQ ID NO: 558811 - DNA, 13 bp, D. melanogaster
aagaaaatcattt

SEQ ID NO: 558812 - DNA, 13 bp, D. melanogaster
aagaaaatccaag

SEQ ID NO: 558813 - DNA, 13 bp, D. melanogaster
aagaaaatccata

SEQ ID NO: 558814 - DNA, 13 bp, D. melanogaster
aagaaaatccatt

SEQ ID NO: 558815 - DNA, 13 bp, D. melanogaster
aagaaaatcgaat

SEQ ID NO: 558816 - DNA, 13 bp, D. melanogaster
aagaaaatcgata

SEQ ID NO: 558817 - DNA, 13 bp, D. melanogaster
aagaaaatcgcct

SEQ ID NO: 558818 - DNA, 13 bp, D. melanogaster
aagaaaatcttat

SEQ ID NO: 558819 - DNA, 14 bp, D. melanogaster
aagaaaatgcattt

SEQ ID NO: 558820 - DNA, 13 bp, D. melanogaster
aagaaaatgctgt

SEQ ID NO: 558821 - DNA, 13 bp, D. melanogaster
aagaaaatggcaa

SEQ ID NO: 558822 - DNA, 13 bp, D. melanogaster
aagaaaatggcca

SEQ ID NO: 558823 - DNA, 14 bp, D. melanogaster
aagaaaatgtattt

SEQ ID NO: 558824 - DNA, 13 bp, D. melanogaster
aagaaaatgtgca

SEQ ID NO: 558825 - DNA, 13 bp, D. melanogaster
aagaaaatgtggc

SEQ ID NO: 558826 - DNA, 13 bp, D. melanogaster
aagaaaatgttga

SEQ ID NO: 558827 - DNA, 13 bp, D. melanogaster
aagaaaatgttgt

SEQ ID NO: 558828 - DNA, 13 bp, D. melanogaster
aagaaaatgtttc

SEQ ID NO: 558829 - DNA, 13 bp, D. melanogaster
aagaaaattagtt

SEQ ID NO: 558830 - DNA, 13 bp, D. melanogaster
aagaaaattattg

SEQ ID NO: 558831 - DNA, 14 bp, D. melanogaster
aagaaaattattgc

SEQ ID NO: 558832 - DNA, 13 bp, D. melanogaster
aagaaaattcttt

SEQ ID NO: 558833 - DNA, 13 bp, D. melanogaster
aagaaaattgtga

SEQ ID NO: 558834 - DNA, 13 bp, D. melanogaster
aagaaaattgttt

SEQ ID NO: 558835 - DNA, 14 bp, D. melanogaster
aagaaaatttcaaa

SEQ ID NO: 558836 - DNA, 13 bp, D. melanogaster
aagaaacatattt

SEQ ID NO: 558837 - DNA, 13 bp, D. melanogaster
aagaaacatggcc

SEQ ID NO: 558838 - DNA, 14 bp, D. melanogaster
aagaaaccaaaatt

SEQ ID NO: 558839 - DNA, 13 bp, D. melanogaster
aagaaaccaaatt

SEQ ID NO: 558840 - DNA, 13 bp, D. melanogaster
aagaaaccgaaat

SEQ ID NO: 558841 - DNA, 13 bp, D. melanogaster
aagaaacgaattt

SEQ ID NO: 558842 - DNA, 14 bp, D. melanogaster
aagaaacgaattta

SEQ ID NO: 558843 - DNA, 15 bp, D. melanogaster
aagaaacgggaatgt

SEQ ID NO: 558844 - DNA, 13 bp, D. melanogaster
aagaaacgttttt

SEQ ID NO: 558845 - DNA, 13 bp, D. melanogaster
aagaaactacttt

SEQ ID NO: 558846 - DNA, 13 bp, D. melanogaster
aagaaactatttt

SEQ ID NO: 558847 - DNA, 14 bp, D. melanogaster
aagaaactccattt

SEQ ID NO: 558848 - DNA, 13 bp, D. melanogaster
aagaaactcttct

SEQ ID NO: 558849 - DNA, 14 bp, D. melanogaster
aagaaactcttctc

SEQ ID NO: 558850 - DNA, 13 bp, D. melanogaster
aagaaactcttta

SEQ ID NO: 558851 - DNA, 13 bp, D. melanogaster
aagaaactgaaac

SEQ ID NO: 558852 - DNA, 13 bp, D. melanogaster
aagaaactgattt

SEQ ID NO: 558853 - DNA, 13 bp, D. melanogaster
aagaaacttaaat

SEQ ID NO: 558854 - DNA, 13 bp, D. melanogaster
aagaaactttaaa

SEQ ID NO: 558855 - DNA, 13 bp, D. melanogaster
aagaaacttttcc

SEQ ID NO: 558856 - DNA, 13 bp, D. melanogaster
aagaaactttttc

SEQ ID NO: 558857 - DNA, 13 bp, D. melanogaster
aagaaagagccag

SEQ ID NO: 558858 - DNA, 13 bp, D. melanogaster
aagaaagatttct

SEQ ID NO: 558859 - DNA, 13 bp, D. melanogaster
aagaaagccattt

SEQ ID NO: 558860 - DNA, 13 bp, D. melanogaster
aagaaagcgaaat

SEQ ID NO: 558861 - DNA, 13 bp, D. melanogaster
aagaaagcgtttc

SEQ ID NO: 558862 - DNA, 14 bp, D. melanogaster
aagaaagcgtttcc

SEQ ID NO: 558863 - DNA, 13 bp, D. melanogaster
aagaaagctgaaa

SEQ ID NO: 558864 - DNA, 13 bp, D. melanogaster
aagaaagtagcta

SEQ ID NO: 558865 - DNA, 13 bp, D. melanogaster
aagaaagtatttt

SEQ ID NO: 558866 - DNA, 13 bp, D. melanogaster
aagaaagtcagtc

SEQ ID NO: 558867 - DNA, 13 bp, D. melanogaster
aagaaagtgaatt

SEQ ID NO: 558868 - DNA, 13 bp, D. melanogaster
aagaaagtgcaaa

SEQ ID NO: 558869 - DNA, 13 bp, D. melanogaster
aagaaagtgcatt

SEQ ID NO: 558870 - DNA, 13 bp, D. melanogaster
aagaaagtggtcc

SEQ ID NO: 558871 - DNA, 13 bp, D. melanogaster
aagaaagttttct

SEQ ID NO: 558872 - DNA, 13 bp, D. melanogaster
aagaaagtttttc

SEQ ID NO: 558873 - DNA, 13 bp, D. melanogaster
aagaaataaattc

SEQ ID NO: 558874 - DNA, 13 bp, D. melanogaster
aagaaataattca

SEQ ID NO: 558875 - DNA, 14 bp, D. melanogaster
aagaaatacaatat

SEQ ID NO: 558876 - DNA, 13 bp, D. melanogaster
aagaaatacaggc

SEQ ID NO: 558877 - DNA, 13 bp, D. melanogaster
aagaaatactttt

SEQ ID NO: 558878 - DNA, 14 bp, D. melanogaster
aagaaatataacat

SEQ ID NO: 558879 - DNA, 13 bp, D. melanogaster
aagaaatatacat

SEQ ID NO: 558880 - DNA, 13 bp, D. melanogaster
aagaaatatactt

SEQ ID NO: 558881 - DNA, 13 bp, D. melanogaster
aagaaatatcacc

SEQ ID NO: 558882 - DNA, 13 bp, D. melanogaster
aagaaatatgcca

SEQ ID NO: 558883 - DNA, 13 bp, D. melanogaster
aagaaatatgttt

SEQ ID NO: 558884 - DNA, 14 bp, D. melanogaster
aagaaatatgtttt

SEQ ID NO: 558885 - DNA, 13 bp, D. melanogaster
aagaaatattact

SEQ ID NO: 558886 - DNA, 13 bp, D. melanogaster
aagaaatattctt

SEQ ID NO: 558887 - DNA, 13 bp, D. melanogaster
aagaaatatttca

SEQ ID NO: 558888 - DNA, 13 bp, D. melanogaster
aagaaatatttga

SEQ ID NO: 558889 - DNA, 13 bp, D. melanogaster
aagaaatatttgt

SEQ ID NO: 558890 - DNA, 13 bp, D. melanogaster
aagaaatattttc

SEQ ID NO: 558891 - DNA, 13 bp, D. melanogaster
aagaaatcaaatc

SEQ ID NO: 558892 - DNA, 13 bp, D. melanogaster
aagaaatcaaatt

SEQ ID NO: 558893 - DNA, 13 bp, D. melanogaster
aagaaatcaatta

SEQ ID NO: 558894 - DNA, 13 bp, D. melanogaster
aagaaatcactgc

SEQ ID NO: 558895 - DNA, 13 bp, D. melanogaster
aagaaatcacttt

SEQ ID NO: 558896 - DNA, 13 bp, D. melanogaster
aagaaatcagcaa

SEQ ID NO: 558897 - DNA, 13 bp, D. melanogaster
aagaaatcatact

SEQ ID NO: 558898 - DNA, 14 bp, D. melanogaster
aagaaatcatactt

SEQ ID NO: 558899 - DNA, 13 bp, D. melanogaster
aagaaatcatttc

SEQ ID NO: 558900 - DNA, 13 bp, D. melanogaster
aagaaatcatttt

SEQ ID NO: 558901 - DNA, 13 bp, D. melanogaster
aagaaatccaaat

SEQ ID NO: 558902 - DNA, 14 bp, D. melanogaster
aagaaatccaggaa

SEQ ID NO: 558903 - DNA, 13 bp, D. melanogaster
aagaaatccattt

SEQ ID NO: 558904 - DNA, 13 bp, D. melanogaster
aagaaatcccaaa

SEQ ID NO: 558905 - DNA, 13 bp, D. melanogaster
aagaaatcgaaac

SEQ ID NO: 558906 - DNA, 13 bp, D. melanogaster
aagaaatctgaaa

SEQ ID NO: 558907 - DNA, 13 bp, D. melanogaster
aagaaatcttgcc

SEQ ID NO: 558908 - DNA, 13 bp, D. melanogaster
aagaaatcttttt

SEQ ID NO: 558909 - DNA, 13 bp, D. melanogaster
aagaaatgaattt

SEQ ID NO: 558910 - DNA, 13 bp, D. melanogaster
aagaaatgatttt

SEQ ID NO: 558911 - DNA, 13 bp, D. melanogaster
aagaaatgcaaac

SEQ ID NO: 558912 - DNA, 14 bp, D. melanogaster
aagaaatgcaaatt

SEQ ID NO: 558913 - DNA, 14 bp, D. melanogaster
aagaaatgcatttt

SEQ ID NO: 558914 - DNA, 13 bp, D. melanogaster
aagaaatggaaac

SEQ ID NO: 558915 - DNA, 13 bp, D. melanogaster
aagaaatggcaaa

SEQ ID NO: 558916 - DNA, 13 bp, D. melanogaster
aagaaatgtcaac

SEQ ID NO: 558917 - DNA, 13 bp, D. melanogaster
aagaaatgtgatt

SEQ ID NO: 558918 - DNA, 13 bp, D. melanogaster
aagaaatgtttaa

SEQ ID NO: 558919 - DNA, 13 bp, D. melanogaster
aagaaattaaagc

SEQ ID NO: 558920 - DNA, 14 bp, D. melanogaster
aagaaattaaattc

SEQ ID NO: 558921 - DNA, 13 bp, D. melanogaster
aagaaattaagtt

SEQ ID NO: 558922 - DNA, 13 bp, D. melanogaster
aagaaattagcga

SEQ ID NO: 558923 - DNA, 13 bp, D. melanogaster
aagaaattcaata

SEQ ID NO: 558924 - DNA, 14 bp, D. melanogaster
aagaaattcaattt

SEQ ID NO: 558925 - DNA, 13 bp, D. melanogaster
aagaaattcatat

SEQ ID NO: 558926 - DNA, 13 bp, D. melanogaster
aagaaattcattt

SEQ ID NO: 558927 - DNA, 13 bp, D. melanogaster
aagaaattccaat

SEQ ID NO: 558928 - DNA, 13 bp, D. melanogaster
aagaaattcgaaa

SEQ ID NO: 558929 - DNA, 13 bp, D. melanogaster
aagaaattctccg

SEQ ID NO: 558930 - DNA, 13 bp, D. melanogaster
aagaaattctttt

SEQ ID NO: 558931 - DNA, 13 bp, D. melanogaster
aagaaattgccaa

SEQ ID NO: 558932 - DNA, 14 bp, D. melanogaster
aagaaattgccaaa

SEQ ID NO: 558933 - DNA, 13 bp, D. melanogaster
aagaaatttcaaa

SEQ ID NO: 558934 - DNA, 13 bp, D. melanogaster
aagaaatttcaca

SEQ ID NO: 558935 - DNA, 13 bp, D. melanogaster
aagaaatttccat

SEQ ID NO: 558936 - DNA, 13 bp, D. melanogaster
aagaaatttgaag

SEQ ID NO: 558937 - DNA, 13 bp, D. melanogaster
aagaaatttgaat

SEQ ID NO: 558938 - DNA, 13 bp, D. melanogaster
aagaaatttgttc

SEQ ID NO: 558939 - DNA, 13 bp, D. melanogaster
aagaaatttgttt

SEQ ID NO: 558940 - DNA, 13 bp, D. melanogaster
aagaaattttcaa

SEQ ID NO: 558941 - DNA, 13 bp, D. melanogaster
aagaacaaaattt

SEQ ID NO: 558942 - DNA, 13 bp, D. melanogaster
aagaacaaacatc

SEQ ID NO: 558943 - DNA, 13 bp, D. melanogaster
aagaacaacaact

SEQ ID NO: 558944 - DNA, 13 bp, D. melanogaster
aagaacaacaatg

SEQ ID NO: 558945 - DNA, 13 bp, D. melanogaster
aagaacaacatca

SEQ ID NO: 558946 - DNA, 13 bp, D. melanogaster
aagaacaactaca

SEQ ID NO: 558947 - DNA, 13 bp, D. melanogaster
aagaacaatttta

SEQ ID NO: 558948 - DNA, 13 bp, D. melanogaster
aagaacacaagtc

SEQ ID NO: 558949 - DNA, 14 bp, D. melanogaster
aagaacaccaagat

SEQ ID NO: 558950 - DNA, 13 bp, D. melanogaster
aagaacatatatt

SEQ ID NO: 558951 - DNA, 13 bp, D. melanogaster
aagaacatatttt

SEQ ID NO: 558952 - DNA, 13 bp, D. melanogaster
aagaacatttttt

SEQ ID NO: 558953 - DNA, 13 bp, D. melanogaster
aagaaccaacatc

SEQ ID NO: 558954 - DNA, 13 bp, D. melanogaster
aagaacccaaatc

SEQ ID NO: 558955 - DNA, 14 bp, D. melanogaster
aagaacccaaatca

SEQ ID NO: 558956 - DNA, 13 bp, D. melanogaster
aagaacgagtaca

SEQ ID NO: 558957 - DNA, 13 bp, D. melanogaster
aagaacgctgttg

SEQ ID NO: 558958 - DNA, 13 bp, D. melanogaster
aagaactaatcaa

SEQ ID NO: 558959 - DNA, 13 bp, D. melanogaster
aagaactcaacaa

SEQ ID NO: 558960 - DNA, 13 bp, D. melanogaster
aagaactcaattt

SEQ ID NO: 558961 - DNA, 13 bp, D. melanogaster
aagaactgaccta

SEQ ID NO: 558962 - DNA, 13 bp, D. melanogaster
aagaactgctaca

SEQ ID NO: 558963 - DNA, 13 bp, D. melanogaster
aagaactggaaaa

SEQ ID NO: 558964 - DNA, 13 bp, D. melanogaster
aagaactgtgggc

SEQ ID NO: 558965 - DNA, 13 bp, D. melanogaster
aagaactgtgttt

SEQ ID NO: 558966 - DNA, 13 bp, D. melanogaster
aagaacttctaag

SEQ ID NO: 558967 - DNA, 13 bp, D. melanogaster
aagaacttgaaaa

SEQ ID NO: 558968 - DNA, 13 bp, D. melanogaster
aagaacttgacaa

SEQ ID NO: 558969 - DNA, 14 bp, D. melanogaster
aagaacttgacaat

SEQ ID NO: 558970 - DNA, 13 bp, D. melanogaster
aagaactttaaat

SEQ ID NO: 558971 - DNA, 13 bp, D. melanogaster
aagaactttattt

SEQ ID NO: 558972 - DNA, 13 bp, D. melanogaster
aagaactttgaaa

SEQ ID NO: 558973 - DNA, 13 bp, D. melanogaster
aagaactttggcc

SEQ ID NO: 558974 - DNA, 13 bp, D. melanogaster
aagaacttttaat

SEQ ID NO: 558975 - DNA, 13 bp, D. melanogaster
aagaactttttaa

SEQ ID NO: 558976 - DNA, 13 bp, D. melanogaster
aagaagaaaattc

SEQ ID NO: 558977 - DNA, 13 bp, D. melanogaster
aagaagaacagat

SEQ ID NO: 558978 - DNA, 13 bp, D. melanogaster
aagaagaacggat

SEQ ID NO: 558979 - DNA, 13 bp, D. melanogaster
aagaagaactttc

SEQ ID NO: 558980 - DNA, 14 bp, D. melanogaster
aagaagaactttca

SEQ ID NO: 558981 - DNA, 13 bp, D. melanogaster
aagaagaagattg

SEQ ID NO: 558982 - DNA, 13 bp, D. melanogaster
aagaagaagcagc

SEQ ID NO: 558983 - DNA, 14 bp, D. melanogaster
aagaagaagcagca

SEQ ID NO: 558984 - DNA, 13 bp, D. melanogaster
aagaagaagctgc

SEQ ID NO: 558985 - DNA, 15 bp, D. melanogaster
aagaagaagtcgaat

SEQ ID NO: 558986 - DNA, 13 bp, D. melanogaster
aagaagaatattc

SEQ ID NO: 558987 - DNA, 14 bp, D. melanogaster
aagaagaatattca

SEQ ID NO: 558988 - DNA, 13 bp, D. melanogaster
aagaagaatattt

SEQ ID NO: 558989 - DNA, 13 bp, D. melanogaster
aagaagaatgtta

SEQ ID NO: 558990 - DNA, 13 bp, D. melanogaster
aagaagaattcaa

SEQ ID NO: 558991 - DNA, 13 bp, D. melanogaster
aagaagaatttcg

SEQ ID NO: 558992 - DNA, 13 bp, D. melanogaster
aagaagaccgaga

SEQ ID NO: 558993 - DNA, 14 bp, D. melanogaster
aagaagaggacgac

SEQ ID NO: 558994 - DNA, 14 bp, D. melanogaster
aagaagatcaaaag

SEQ ID NO: 558995 - DNA, 13 bp, D. melanogaster
aagaagatcttct

SEQ ID NO: 558996 - DNA, 13 bp, D. melanogaster
aagaagattggtt

SEQ ID NO: 558997 - DNA, 13 bp, D. melanogaster
aagaagatttatc

SEQ ID NO: 558998 - DNA, 13 bp, D. melanogaster
aagaagcaagaat

SEQ ID NO: 558999 - DNA, 13 bp, D. melanogaster
aagaagcagaagc

SEQ ID NO: 559000 - DNA, 13 bp, D. melanogaster
aagaagcagaata

SEQ ID NO: 559001 - DNA, 13 bp, D. melanogaster
aagaagcagcaac

SEQ ID NO: 559002 - DNA, 14 bp, D. melanogaster
aagaagcagcagca

SEQ ID NO: 559003 - DNA, 13 bp, D. melanogaster
aagaagcaggagc

SEQ ID NO: 559004 - DNA, 13 bp, D. melanogaster
aagaagccaccga

SEQ ID NO: 559005 - DNA, 13 bp, D. melanogaster
aagaagccagcaa

SEQ ID NO: 559006 - DNA, 13 bp, D. melanogaster
aagaagccatcaa

SEQ ID NO: 559007 - DNA, 13 bp, D. melanogaster
aagaagcgtttcc

SEQ ID NO: 559008 - DNA, 13 bp, D. melanogaster
aagaagctaaaac

SEQ ID NO: 559009 - DNA, 13 bp, D. melanogaster
aagaagctaataa

SEQ ID NO: 559010 - DNA, 13 bp, D. melanogaster
aagaagctgaagc

SEQ ID NO: 559011 - DNA, 13 bp, D. melanogaster
aagaagctttaca

SEQ ID NO: 559012 - DNA, 14 bp, D. melanogaster
aagaagctttacaa

SEQ ID NO: 559013 - DNA, 13 bp, D. melanogaster
aagaaggcagcaa

SEQ ID NO: 559014 - DNA, 13 bp, D. melanogaster
aagaaggcagcag

SEQ ID NO: 559015 - DNA, 13 bp, D. melanogaster
aagaaggccaaga

SEQ ID NO: 559016 - DNA, 13 bp, D. melanogaster
aagaagggcaaat

SEQ ID NO: 559017 - DNA, 14 bp, D. melanogaster
aagaagggcatcct

SEQ ID NO: 559018 - DNA, 13 bp, D. melanogaster
aagaagtaacata

SEQ ID NO: 559019 - DNA, 14 bp, D. melanogaster
aagaagtaacatat

SEQ ID NO: 559020 - DNA, 13 bp, D. melanogaster
aagaagtatatat

SEQ ID NO: 559021 - DNA, 13 bp, D. melanogaster
aagaagtcataga

SEQ ID NO: 559022 - DNA, 13 bp, D. melanogaster
aagaagtcctgcc

SEQ ID NO: 559023 - DNA, 13 bp, D. melanogaster
aagaagtgaaaac

SEQ ID NO: 559024 - DNA, 13 bp, D. melanogaster
aagaagtgcaaat

SEQ ID NO: 559025 - DNA, 13 bp, D. melanogaster
aagaagtgcaatt

SEQ ID NO: 559026 - DNA, 13 bp, D. melanogaster
aagaagtggtctg

SEQ ID NO: 559027 - DNA, 13 bp, D. melanogaster
aagaagttggcca

SEQ ID NO: 559028 - DNA, 13 bp, D. melanogaster
aagaagtttaatt

SEQ ID NO: 559029 - DNA, 13 bp, D. melanogaster
aagaagtttattt

SEQ ID NO: 559030 - DNA, 14 bp, D. melanogaster
aagaagttttaaca

SEQ ID NO: 559031 - DNA, 13 bp, D. melanogaster
aagaagttttttg

SEQ ID NO: 559032 - DNA, 13 bp, D. melanogaster
aagaataactttt

SEQ ID NO: 559033 - DNA, 13 bp, D. melanogaster
aagaatacaatag

SEQ ID NO: 559034 - DNA, 13 bp, D. melanogaster
aagaatacatttt

SEQ ID NO: 559035 - DNA, 13 bp, D. melanogaster
aagaatacttgga

SEQ ID NO: 559036 - DNA, 13 bp, D. melanogaster
aagaatatacata

SEQ ID NO: 559037 - DNA, 13 bp, D. melanogaster
aagaatattcaaa

SEQ ID NO: 559038 - DNA, 13 bp, D. melanogaster
aagaatatttgtc

SEQ ID NO: 559039 - DNA, 14 bp, D. melanogaster
aagaatattttcaa

SEQ ID NO: 559040 - DNA, 13 bp, D. melanogaster
aagaatattttcg

SEQ ID NO: 559041 - DNA, 13 bp, D. melanogaster
aagaatcaaatta

SEQ ID NO: 559042 - DNA, 13 bp, D. melanogaster
aagaatcactcaa

SEQ ID NO: 559043 - DNA, 13 bp, D. melanogaster
aagaatctgacgc

SEQ ID NO: 559044 - DNA, 13 bp, D. melanogaster
aagaatgcaaaat

SEQ ID NO: 559045 - DNA, 15 bp, D. melanogaster
aagaatgcaagcaat

SEQ ID NO: 559046 - DNA, 13 bp, D. melanogaster
aagaatgccattt

SEQ ID NO: 559047 - DNA, 13 bp, D. melanogaster
aagaatggaatgg

SEQ ID NO: 559048 - DNA, 13 bp, D. melanogaster
aagaatgtatata

SEQ ID NO: 559049 - DNA, 13 bp, D. melanogaster
aagaattacattt

SEQ ID NO: 559050 - DNA, 13 bp, D. melanogaster
aagaattcaatta

SEQ ID NO: 559051 - DNA, 13 bp, D. melanogaster
aagaattccatga

SEQ ID NO: 559052 - DNA, 13 bp, D. melanogaster
aagaattccatta

SEQ ID NO: 559053 - DNA, 13 bp, D. melanogaster
aagaattcgaaat

SEQ ID NO: 559054 - DNA, 13 bp, D. melanogaster
aagaattcttttt

SEQ ID NO: 559055 - DNA, 13 bp, D. melanogaster
aagaattgaagag

SEQ ID NO: 559056 - DNA, 13 bp, D. melanogaster
aagaattgagaac

SEQ ID NO: 559057 - DNA, 13 bp, D. melanogaster
aagaattgtagat

SEQ ID NO: 559058 - DNA, 13 bp, D. melanogaster
aagaatttaaatg

SEQ ID NO: 559059 - DNA, 13 bp, D. melanogaster
aagaatttaattg

SEQ ID NO: 559060 - DNA, 13 bp, D. melanogaster
aagaatttaccaa

SEQ ID NO: 559061 - DNA, 13 bp, D. melanogaster
aagaatttatgaa

SEQ ID NO: 559062 - DNA, 13 bp, D. melanogaster
aagaatttcaaaa

SEQ ID NO: 559063 - DNA, 14 bp, D. melanogaster
aagaatttcaaaaa

SEQ ID NO: 559064 - DNA, 13 bp, D. melanogaster
aagaatttcaaat

SEQ ID NO: 559065 - DNA, 13 bp, D. melanogaster
aagaatttgcgga

SEQ ID NO: 559066 - DNA, 14 bp, D. melanogaster
aagaatttggaaaa

SEQ ID NO: 559067 - DNA, 13 bp, D. melanogaster
aagaatttgtatt

SEQ ID NO: 559068 - DNA, 13 bp, D. melanogaster
aagaattttattg

SEQ ID NO: 559069 - DNA, 14 bp, D. melanogaster
aagaattttattga

SEQ ID NO: 559070 - DNA, 14 bp, D. melanogaster
aagaattttctgtt

SEQ ID NO: 559071 - DNA, 13 bp, D. melanogaster
aagaattttgcat

SEQ ID NO: 559072 - DNA, 14 bp, D. melanogaster
aagaattttgcata

SEQ ID NO: 559073 - DNA, 14 bp, D. melanogaster
aagaattttgcatt

SEQ ID NO: 559074 - DNA, 13 bp, D. melanogaster
aagaattttgcca

SEQ ID NO: 559075 - DNA, 13 bp, D. melanogaster
aagacaaacaatt

SEQ ID NO: 559076 - DNA, 13 bp, D. melanogaster
aagacaaacattt

SEQ ID NO: 559077 - DNA, 13 bp, D. melanogaster
aagacaaatcaca

SEQ ID NO: 559078 - DNA, 13 bp, D. melanogaster
aagacaaatcatt

SEQ ID NO: 559079 - DNA, 13 bp, D. melanogaster
aagacaaattttg

SEQ ID NO: 559080 - DNA, 13 bp, D. melanogaster
aagacaacaattt

SEQ ID NO: 559081 - DNA, 13 bp, D. melanogaster
aagacaatcaagg

SEQ ID NO: 559082 - DNA, 13 bp, D. melanogaster
aagacaatctcaa

SEQ ID NO: 559083 - DNA, 14 bp, D. melanogaster
aagacaatctcaaa

SEQ ID NO: 559084 - DNA, 13 bp, D. melanogaster
aagacaatggaaa

SEQ ID NO: 559085 - DNA, 13 bp, D. melanogaster
aagacaattgccc

SEQ ID NO: 559086 - DNA, 13 bp, D. melanogaster
aagacactagaat

SEQ ID NO: 559087 - DNA, 14 bp, D. melanogaster
aagacagacaccca

SEQ ID NO: 559088 - DNA, 13 bp, D. melanogaster
aagacagagaacg

SEQ ID NO: 559089 - DNA, 13 bp, D. melanogaster
aagacagagccaa

SEQ ID NO: 559090 - DNA, 13 bp, D. melanogaster
aagacagttcata

SEQ ID NO: 559091 - DNA, 13 bp, D. melanogaster
aagacagttttat

SEQ ID NO: 559092 - DNA, 13 bp, D. melanogaster
aagacatatatat

SEQ ID NO: 559093 - DNA, 13 bp, D. melanogaster
aagacatgagcac

SEQ ID NO: 559094 - DNA, 13 bp, D. melanogaster
aagacattaaaga

SEQ ID NO: 559095 - DNA, 13 bp, D. melanogaster
aagacattgttgt

SEQ ID NO: 559096 - DNA, 13 bp, D. melanogaster
aagacattttcga

SEQ ID NO: 559097 - DNA, 13 bp, D. melanogaster
aagacatttttaa

SEQ ID NO: 559098 - DNA, 13 bp, D. melanogaster
aagaccaagaaat

SEQ ID NO: 559099 - DNA, 13 bp, D. melanogaster
aagaccaccattc

SEQ ID NO: 559100 - DNA, 13 bp, D. melanogaster
aagaccacttttt

SEQ ID NO: 559101 - DNA, 13 bp, D. melanogaster
aagaccagaaaat

SEQ ID NO: 559102 - DNA, 15 bp, D. melanogaster
aagaccagtggtggg

SEQ ID NO: 559103 - DNA, 13 bp, D. melanogaster
aagacccataagc

SEQ ID NO: 559104 - DNA, 13 bp, D. melanogaster
aagacctaattta

SEQ ID NO: 559105 - DNA, 13 bp, D. melanogaster
aagacgaaaacgg

SEQ ID NO: 559106 - DNA, 14 bp, D. melanogaster
aagacgaactagag

SEQ ID NO: 559107 - DNA, 13 bp, D. melanogaster
aagacgaccaatc

SEQ ID NO: 559108 - DNA, 13 bp, D. melanogaster
aagacgaggacac

SEQ ID NO: 559109 - DNA, 13 bp, D. melanogaster
aagacgataataa

SEQ ID NO: 559110 - DNA, 13 bp, D. melanogaster
aagacgatgatat

SEQ ID NO: 559111 - DNA, 14 bp, D. melanogaster
aagacgcagcgcaa

SEQ ID NO: 559112 - DNA, 13 bp, D. melanogaster
aagacgcggcgct

SEQ ID NO: 559113 - DNA, 13 bp, D. melanogaster
aagacggaaatga

SEQ ID NO: 559114 - DNA, 13 bp, D. melanogaster
aagacggaaatgg

SEQ ID NO: 559115 - DNA, 14 bp, D. melanogaster
aagacggattttca

SEQ ID NO: 559116 - DNA, 13 bp, D. melanogaster
aagacgtttttat

SEQ ID NO: 559117 - DNA, 13 bp, D. melanogaster
aagactaaaaatc

SEQ ID NO: 559118 - DNA, 13 bp, D. melanogaster
aagactaataata

SEQ ID NO: 559119 - DNA, 13 bp, D. melanogaster
aagactcaagcga

SEQ ID NO: 559120 - DNA, 14 bp, D. melanogaster
aagactcaagcgac

SEQ ID NO: 559121 - DNA, 13 bp, D. melanogaster
aagactcacatgg

SEQ ID NO: 559122 - DNA, 13 bp, D. melanogaster
aagactcacggat

SEQ ID NO: 559123 - DNA, 13 bp, D. melanogaster
aagactctgctga

SEQ ID NO: 559124 - DNA, 13 bp, D. melanogaster
aagactctgctgc

SEQ ID NO: 559125 - DNA, 13 bp, D. melanogaster
aagactgaagact

SEQ ID NO: 559126 - DNA, 13 bp, D. melanogaster
aagactggaaaaa

SEQ ID NO: 559127 - DNA, 13 bp, D. melanogaster
aagactgtcaatg

SEQ ID NO: 559128 - DNA, 14 bp, D. melanogaster
aagactgtggaatg

SEQ ID NO: 559129 - DNA, 13 bp, D. melanogaster
aagacttaaaagc

SEQ ID NO: 559130 - DNA, 13 bp, D. melanogaster
aagacttaaagat

SEQ ID NO: 559131 - DNA, 13 bp, D. melanogaster
aagacttacatga

SEQ ID NO: 559132 - DNA, 13 bp, D. melanogaster
aagacttaggcaa

SEQ ID NO: 559133 - DNA, 13 bp, D. melanogaster
aagacttgcagcc

SEQ ID NO: 559134 - DNA, 13 bp, D. melanogaster
aagacttggccaa

SEQ ID NO: 559135 - DNA, 13 bp, D. melanogaster
aagactttatttt

SEQ ID NO: 559136 - DNA, 13 bp, D. melanogaster
aagactttcgtca

SEQ ID NO: 559137 - DNA, 13 bp, D. melanogaster
aagactttttaaa

SEQ ID NO: 559138 - DNA, 13 bp, D. melanogaster
aagagaaaacatt

SEQ ID NO: 559139 - DNA, 13 bp, D. melanogaster
aagagaaaatgct

SEQ ID NO: 559140 - DNA, 13 bp, D. melanogaster
aagagaaacattt

SEQ ID NO: 559141 - DNA, 13 bp, D. melanogaster
aagagaaagctca

SEQ ID NO: 559142 - DNA, 13 bp, D. melanogaster
aagagaaatgcaa

SEQ ID NO: 559143 - DNA, 13 bp, D. melanogaster
aagagaaatgtgt

SEQ ID NO: 559144 - DNA, 13 bp, D. melanogaster
aagagaaatgttt

SEQ ID NO: 559145 - DNA, 13 bp, D. melanogaster
aagagaactctga

SEQ ID NO: 559146 - DNA, 13 bp, D. melanogaster
aagagaagcaaat

SEQ ID NO: 559147 - DNA, 13 bp, D. melanogaster
aagagaataccac

SEQ ID NO: 559148 - DNA, 13 bp, D. melanogaster
aagagaatatttt

SEQ ID NO: 559149 - DNA, 13 bp, D. melanogaster
aagagacatcgaa

SEQ ID NO: 559150 - DNA, 13 bp, D. melanogaster
aagagaccaacca

SEQ ID NO: 559151 - DNA, 13 bp, D. melanogaster
aagagacgagaac

SEQ ID NO: 559152 - DNA, 13 bp, D. melanogaster
aagagacttggac

SEQ ID NO: 559153 - DNA, 13 bp, D. melanogaster
aagagagaatact

SEQ ID NO: 559154 - DNA, 14 bp, D. melanogaster
aagagagaatgcta

SEQ ID NO: 559155 - DNA, 13 bp, D. melanogaster
aagagagccggcg

SEQ ID NO: 559156 - DNA, 13 bp, D. melanogaster
aagagagcgcaaa

SEQ ID NO: 559157 - DNA, 13 bp, D. melanogaster
aagagagcgcgag

SEQ ID NO: 559158 - DNA, 13 bp, D. melanogaster
aagagataaagtg

SEQ ID NO: 559159 - DNA, 13 bp, D. melanogaster
aagagcaaacaat

SEQ ID NO: 559160 - DNA, 14 bp, D. melanogaster
aagagcaaacaata

SEQ ID NO: 559161 - DNA, 13 bp, D. melanogaster
aagagcaaataat

SEQ ID NO: 559162 - DNA, 13 bp, D. melanogaster
aagagcaaatgaa

SEQ ID NO: 559163 - DNA, 13 bp, D. melanogaster
aagagcaaatgca

SEQ ID NO: 559164 - DNA, 13 bp, D. melanogaster
aagagcaaattaa

SEQ ID NO: 559165 - DNA, 13 bp, D. melanogaster
aagagcaacaata

SEQ ID NO: 559166 - DNA, 13 bp, D. melanogaster
aagagcaacagca

SEQ ID NO: 559167 - DNA, 13 bp, D. melanogaster
aagagcaagcctt

SEQ ID NO: 559168 - DNA, 13 bp, D. melanogaster
aagagcaatgctc

SEQ ID NO: 559169 - DNA, 13 bp, D. melanogaster
aagagcacaatat

SEQ ID NO: 559170 - DNA, 13 bp, D. melanogaster
aagagcacacata

SEQ ID NO: 559171 - DNA, 13 bp, D. melanogaster
aagagcagcaaca

SEQ ID NO: 559172 - DNA, 14 bp, D. melanogaster
aagagcagcaacaa

SEQ ID NO: 559173 - DNA, 13 bp, D. melanogaster
aagagcagcagaa

SEQ ID NO: 559174 - DNA, 13 bp, D. melanogaster
aagagcagcagga

SEQ ID NO: 559175 - DNA, 13 bp, D. melanogaster
aagagcagccagc

SEQ ID NO: 559176 - DNA, 13 bp, D. melanogaster
aagagcagcgaaa

SEQ ID NO: 559177 - DNA, 13 bp, D. melanogaster
aagagcatgaaaa

SEQ ID NO: 559178 - DNA, 13 bp, D. melanogaster
aagagcattttta

SEQ ID NO: 559179 - DNA, 13 bp, D. melanogaster
aagagccaaacat

SEQ ID NO: 559180 - DNA, 13 bp, D. melanogaster
aagagccaaataa

SEQ ID NO: 559181 - DNA, 13 bp, D. melanogaster
aagagccattaaa

SEQ ID NO: 559182 - DNA, 13 bp, D. melanogaster
aagagccgtatgg

SEQ ID NO: 559183 - DNA, 13 bp, D. melanogaster
aagagcgaaatgc

SEQ ID NO: 559184 - DNA, 14 bp, D. melanogaster
aagagcgagagagc

SEQ ID NO: 559185 - DNA, 13 bp, D. melanogaster
aagagcgagcgag

SEQ ID NO: 559186 - DNA, 13 bp, D. melanogaster
aagagcgcaagaa

SEQ ID NO: 559187 - DNA, 14 bp, D. melanogaster
aagagcgcaagaag

SEQ ID NO: 559188 - DNA, 13 bp, D. melanogaster
aagagcggaggac

SEQ ID NO: 559189 - DNA, 13 bp, D. melanogaster
aagagctgaaaat

SEQ ID NO: 559190 - DNA, 13 bp, D. melanogaster
aagagctgcaaaa

SEQ ID NO: 559191 - DNA, 13 bp, D. melanogaster
aagagctgctgca

SEQ ID NO: 559192 - DNA, 14 bp, D. melanogaster
aagagctgctgcag

SEQ ID NO: 559193 - DNA, 13 bp, D. melanogaster
aagagctggaaaa

SEQ ID NO: 559194 - DNA, 13 bp, D. melanogaster
aagagctggcaaa

SEQ ID NO: 559195 - DNA, 13 bp, D. melanogaster
aagagctgttcgc

SEQ ID NO: 559196 - DNA, 13 bp, D. melanogaster
aagagcttaaaaa

SEQ ID NO: 559197 - DNA, 13 bp, D. melanogaster
aagagcttaaaat

SEQ ID NO: 559198 - DNA, 13 bp, D. melanogaster
aagagcttggtta

SEQ ID NO: 559199 - DNA, 13 bp, D. melanogaster
aagagctttgaac

SEQ ID NO: 559200 - DNA, 14 bp, D. melanogaster
aagaggaaatttat

SEQ ID NO: 559201 - DNA, 13 bp, D. melanogaster
aagaggaagatct

SEQ ID NO: 559202 - DNA, 13 bp, D. melanogaster
aagagggaaaact

SEQ ID NO: 559203 - DNA, 13 bp, D. melanogaster
aagaggggcaagt

SEQ ID NO: 559204 - DNA, 13 bp, D. melanogaster
aagagtatgactt

SEQ ID NO: 559205 - DNA, 13 bp, D. melanogaster
aagagtattttat

SEQ ID NO: 559206 - DNA, 14 bp, D. melanogaster
aagagtcacttatt

SEQ ID NO: 559207 - DNA, 13 bp, D. melanogaster
aagagtgctccag

SEQ ID NO: 559208 - DNA, 13 bp, D. melanogaster
aagagtggaaaat

SEQ ID NO: 559209 - DNA, 14 bp, D. melanogaster
aagagtgggcaaac

SEQ ID NO: 559210 - DNA, 13 bp, D. melanogaster
aagagtggtggtg

SEQ ID NO: 559211 - DNA, 14 bp, D. melanogaster
aagagttcgaaaag

SEQ ID NO: 559212 - DNA, 14 bp, D. melanogaster
aagagttggaggaa

SEQ ID NO: 559213 - DNA, 13 bp, D. melanogaster
aagagtttaattt

SEQ ID NO: 559214 - DNA, 13 bp, D. melanogaster
aagagtttacaaa

SEQ ID NO: 559215 - DNA, 13 bp, D. melanogaster
aagagtttataaa

SEQ ID NO: 559216 - DNA, 13 bp, D. melanogaster
aagagtttcttga

SEQ ID NO: 559217 - DNA, 13 bp, D. melanogaster
aagagtttgcaaa

SEQ ID NO: 559218 - DNA, 13 bp, D. melanogaster
aagagttttattt

SEQ ID NO: 559219 - DNA, 13 bp, D. melanogaster
aagagtttttaaa

SEQ ID NO: 559220 - DNA, 13 bp, D. melanogaster
aagataaagattt

SEQ ID NO: 559221 - DNA, 13 bp, D. melanogaster
aagataaatgttt

SEQ ID NO: 559222 - DNA, 13 bp, D. melanogaster
aagataagctgca

SEQ ID NO: 559223 - DNA, 13 bp, D. melanogaster
aagataatcatgt

SEQ ID NO: 559224 - DNA, 13 bp, D. melanogaster
aagatacaaatac

SEQ ID NO: 559225 - DNA, 13 bp, D. melanogaster
aagatacaaattg

SEQ ID NO: 559226 - DNA, 13 bp, D. melanogaster
aagatacaagaag

SEQ ID NO: 559227 - DNA, 13 bp, D. melanogaster
aagatacagatac

SEQ ID NO: 559228 - DNA, 14 bp, D. melanogaster
aagatacagataca

SEQ ID NO: 559229 - DNA, 15 bp, D. melanogaster
aagatacagatacaa

SEQ ID NO: 559230 - DNA, 13 bp, D. melanogaster
aagatacataaat

SEQ ID NO: 559231 - DNA, 14 bp, D. melanogaster
aagatacatatata

SEQ ID NO: 559232 - DNA, 13 bp, D. melanogaster
aagatacatttat

SEQ ID NO: 559233 - DNA, 14 bp, D. melanogaster
aagatacatttatt

SEQ ID NO: 559234 - DNA, 14 bp, D. melanogaster
aagatacatttgta

SEQ ID NO: 559235 - DNA, 13 bp, D. melanogaster
aagatacattttt

SEQ ID NO: 559236 - DNA, 13 bp, D. melanogaster
aagatactccact

SEQ ID NO: 559237 - DNA, 13 bp, D. melanogaster
aagatactttatt

SEQ ID NO: 559238 - DNA, 13 bp, D. melanogaster
aagatacttttca

SEQ ID NO: 559239 - DNA, 13 bp, D. melanogaster
aagatagaactag

SEQ ID NO: 559240 - DNA, 13 bp, D. melanogaster
aagataggctaaa

SEQ ID NO: 559241 - DNA, 13 bp, D. melanogaster
aagatatacatat

SEQ ID NO: 559242 - DNA, 13 bp, D. melanogaster
aagatatgcaaaa

SEQ ID NO: 559243 - DNA, 13 bp, D. melanogaster
aagatatgtatat

SEQ ID NO: 559244 - DNA, 13 bp, D. melanogaster
aagatattcattt

SEQ ID NO: 559245 - DNA, 13 bp, D. melanogaster
aagatattctaca

SEQ ID NO: 559246 - DNA, 13 bp, D. melanogaster
aagatattcttga

SEQ ID NO: 559247 - DNA, 13 bp, D. melanogaster
aagatattgattt

SEQ ID NO: 559248 - DNA, 13 bp, D. melanogaster
aagatattgtttt

SEQ ID NO: 559249 - DNA, 14 bp, D. melanogaster
aagatatttccaaa

SEQ ID NO: 559250 - DNA, 13 bp, D. melanogaster
aagatatttgatt

SEQ ID NO: 559251 - DNA, 13 bp, D. melanogaster
aagatattttcaa

SEQ ID NO: 559252 - DNA, 13 bp, D. melanogaster
aagatcaacaaca

SEQ ID NO: 559253 - DNA, 13 bp, D. melanogaster
aagatcacaatgg

SEQ ID NO: 559254 - DNA, 13 bp, D. melanogaster
aagatcataatga

SEQ ID NO: 559255 - DNA, 13 bp, D. melanogaster
aagatcataattt

SEQ ID NO: 559256 - DNA, 14 bp, D. melanogaster
aagatccagatgca

SEQ ID NO: 559257 - DNA, 13 bp, D. melanogaster
aagatccatttac

SEQ ID NO: 559258 - DNA, 13 bp, D. melanogaster
aagatcccattct

SEQ ID NO: 559259 - DNA, 13 bp, D. melanogaster
aagatcgcaagcg

SEQ ID NO: 559260 - DNA, 13 bp, D. melanogaster
aagatcggaccaa

SEQ ID NO: 559261 - DNA, 13 bp, D. melanogaster
aagatcgttaagc

SEQ ID NO: 559262 - DNA, 13 bp, D. melanogaster
aagatcgttgaaa

SEQ ID NO: 559263 - DNA, 14 bp, D. melanogaster
aagatctgaaaaca

SEQ ID NO: 559264 - DNA, 13 bp, D. melanogaster
aagatcttcctct

SEQ ID NO: 559265 - DNA, 16 bp, D. melanogaster
aagatgaagcgactgt

SEQ ID NO: 559266 - DNA, 13 bp, D. melanogaster
aagatgactgcta

SEQ ID NO: 559267 - DNA, 13 bp, D. melanogaster
aagatgatgaacc

SEQ ID NO: 559268 - DNA, 13 bp, D. melanogaster
aagatgatgaaga

SEQ ID NO: 559269 - DNA, 13 bp, D. melanogaster
aagatgcaaaaac

SEQ ID NO: 559270 - DNA, 13 bp, D. melanogaster
aagatgcagcagc

SEQ ID NO: 559271 - DNA, 13 bp, D. melanogaster
aagatgccaaatt

SEQ ID NO: 559272 - DNA, 13 bp, D. melanogaster
aagatggcaaaaa

SEQ ID NO: 559273 - DNA, 13 bp, D. melanogaster
aagatggcaaaat

SEQ ID NO: 559274 - DNA, 13 bp, D. melanogaster
aagatggcaagcg

SEQ ID NO: 559275 - DNA, 13 bp, D. melanogaster
aagatggccaaaa

SEQ ID NO: 559276 - DNA, 13 bp, D. melanogaster
aagatggcccaaa

SEQ ID NO: 559277 - DNA, 13 bp, D. melanogaster
aagatggtcacta

SEQ ID NO: 559278 - DNA, 13 bp, D. melanogaster
aagatgtgcttaa

SEQ ID NO: 559279 - DNA, 13 bp, D. melanogaster
aagatgtggatgc

SEQ ID NO: 559280 - DNA, 13 bp, D. melanogaster
aagatgttatatc

SEQ ID NO: 559281 - DNA, 13 bp, D. melanogaster
aagatgtttttaa

SEQ ID NO: 559282 - DNA, 13 bp, D. melanogaster
aagattatgtaaa

SEQ ID NO: 559283 - DNA, 13 bp, D. melanogaster
aagattcaataaa

SEQ ID NO: 559284 - DNA, 13 bp, D. melanogaster
aagattccagaga

SEQ ID NO: 559285 - DNA, 13 bp, D. melanogaster
aagattctgagaa

SEQ ID NO: 559286 - DNA, 13 bp, D. melanogaster
aagattgatttta

SEQ ID NO: 559287 - DNA, 13 bp, D. melanogaster
aagattgcaaaat

SEQ ID NO: 559288 - DNA, 14 bp, D. melanogaster
aagattgcaaaatt

SEQ ID NO: 559289 - DNA, 13 bp, D. melanogaster
aagattgcagtgg

SEQ ID NO: 559290 - DNA, 14 bp, D. melanogaster
aagattgccattct

SEQ ID NO: 559291 - DNA, 13 bp, D. melanogaster
aagattgtgaaaa

SEQ ID NO: 559292 - DNA, 13 bp, D. melanogaster
aagattgtttcca

SEQ ID NO: 559293 - DNA, 13 bp, D. melanogaster
aagatttacattt

SEQ ID NO: 559294 - DNA, 13 bp, D. melanogaster
aagatttatgtgc

SEQ ID NO: 559295 - DNA, 13 bp, D. melanogaster
aagatttattaag

SEQ ID NO: 559296 - DNA, 14 bp, D. melanogaster
aagatttattaaga

SEQ ID NO: 559297 - DNA, 13 bp, D. melanogaster
aagatttattttg

SEQ ID NO: 559298 - DNA, 13 bp, D. melanogaster
aagatttcaaagt

SEQ ID NO: 559299 - DNA, 13 bp, D. melanogaster
aagatttcaatgg

SEQ ID NO: 559300 - DNA, 13 bp, D. melanogaster
aagatttcaatta

SEQ ID NO: 559301 - DNA, 13 bp, D. melanogaster
aagatttcatttt

SEQ ID NO: 559302 - DNA, 13 bp, D. melanogaster
aagatttccattt

SEQ ID NO: 559303 - DNA, 13 bp, D. melanogaster
aagatttcgaaaa

SEQ ID NO: 559304 - DNA, 13 bp, D. melanogaster
aagatttctaaat

SEQ ID NO: 559305 - DNA, 13 bp, D. melanogaster
aagatttcttttg

SEQ ID NO: 559306 - DNA, 13 bp, D. melanogaster
aagatttgttcac

SEQ ID NO: 559307 - DNA, 13 bp, D. melanogaster
aagattttaaagt

SEQ ID NO: 559308 - DNA, 13 bp, D. melanogaster
aagattttcaaaa

SEQ ID NO: 559309 - DNA, 13 bp, D. melanogaster
aagattttcatat

SEQ ID NO: 559310 - DNA, 13 bp, D. melanogaster
aagattttcattt

SEQ ID NO: 559311 - DNA, 13 bp, D. melanogaster
aagattttccaaa

SEQ ID NO: 559312 - DNA, 13 bp, D. melanogaster
aagattttgaaaa

SEQ ID NO: 559313 - DNA, 13 bp, D. melanogaster
aagattttgaaat

SEQ ID NO: 559314 - DNA, 13 bp, D. melanogaster
aagcaaaaaagtt

SEQ ID NO: 559315 - DNA, 13 bp, D. melanogaster
aagcaaaaaatgt

SEQ ID NO: 559316 - DNA, 13 bp, D. melanogaster
aagcaaaaaattc

SEQ ID NO: 559317 - DNA, 13 bp, D. melanogaster
aagcaaaaactga

SEQ ID NO: 559318 - DNA, 13 bp, D. melanogaster
aagcaaaaatcat

SEQ ID NO: 559319 - DNA, 13 bp, D. melanogaster
aagcaaaaatgct

SEQ ID NO: 559320 - DNA, 13 bp, D. melanogaster
aagcaaaaatgtt

SEQ ID NO: 559321 - DNA, 13 bp, D. melanogaster
aagcaaaaatttg

SEQ ID NO: 559322 - DNA, 13 bp, D. melanogaster
aagcaaaacaatt

SEQ ID NO: 559323 - DNA, 13 bp, D. melanogaster
aagcaaaacattt

SEQ ID NO: 559324 - DNA, 13 bp, D. melanogaster
aagcaaaagatac

SEQ ID NO: 559325 - DNA, 14 bp, D. melanogaster
aagcaaaagataca

SEQ ID NO: 559326 - DNA, 13 bp, D. melanogaster
aagcaaaagcatc

SEQ ID NO: 559327 - DNA, 13 bp, D. melanogaster
aagcaaaagcgga

SEQ ID NO: 559328 - DNA, 13 bp, D. melanogaster
aagcaaaagctaa

SEQ ID NO: 559329 - DNA, 13 bp, D. melanogaster
aagcaaaagtcaa

SEQ ID NO: 559330 - DNA, 13 bp, D. melanogaster
aagcaaaagtgtt

SEQ ID NO: 559331 - DNA, 13 bp, D. melanogaster
aagcaaaagttaa

SEQ ID NO: 559332 - DNA, 13 bp, D. melanogaster
aagcaaaatatat

SEQ ID NO: 559333 - DNA, 13 bp, D. melanogaster
aagcaaaatatta

SEQ ID NO: 559334 - DNA, 13 bp, D. melanogaster
aagcaaaatggaa

SEQ ID NO: 559335 - DNA, 13 bp, D. melanogaster
aagcaaaatgttt

SEQ ID NO: 559336 - DNA, 13 bp, D. melanogaster
aagcaaaattgca

SEQ ID NO: 559337 - DNA, 13 bp, D. melanogaster
aagcaaaattgtt

SEQ ID NO: 559338 - DNA, 13 bp, D. melanogaster
aagcaaaatttgt

SEQ ID NO: 559339 - DNA, 13 bp, D. melanogaster
aagcaaaattttt

SEQ ID NO: 559340 - DNA, 13 bp, D. melanogaster
aagcaaacaaact

SEQ ID NO: 559341 - DNA, 14 bp, D. melanogaster
aagcaaacaaatta

SEQ ID NO: 559342 - DNA, 13 bp, D. melanogaster
aagcaaacaatca

SEQ ID NO: 559343 - DNA, 13 bp, D. melanogaster
aagcaaacaattg

SEQ ID NO: 559344 - DNA, 13 bp, D. melanogaster
aagcaaacacaat

SEQ ID NO: 559345 - DNA, 13 bp, D. melanogaster
aagcaaacacata

SEQ ID NO: 559346 - DNA, 13 bp, D. melanogaster
aagcaaacagttt

SEQ ID NO: 559347 - DNA, 13 bp, D. melanogaster
aagcaaacattaa

SEQ ID NO: 559348 - DNA, 13 bp, D. melanogaster
aagcaaaccaaat

SEQ ID NO: 559349 - DNA, 13 bp, D. melanogaster
aagcaaaccaatt

SEQ ID NO: 559350 - DNA, 13 bp, D. melanogaster
aagcaaacgaaat

SEQ ID NO: 559351 - DNA, 13 bp, D. melanogaster
aagcaaacgcagc

SEQ ID NO: 559352 - DNA, 13 bp, D. melanogaster
aagcaaactaaat

SEQ ID NO: 559353 - DNA, 13 bp, D. melanogaster
aagcaaactattt

SEQ ID NO: 559354 - DNA, 13 bp, D. melanogaster
aagcaaactgctc

SEQ ID NO: 559355 - DNA, 13 bp, D. melanogaster
aagcaaacttcga

SEQ ID NO: 559356 - DNA, 13 bp, D. melanogaster
aagcaaactttaa

SEQ ID NO: 559357 - DNA, 13 bp, D. melanogaster
aagcaaagacact

SEQ ID NO: 559358 - DNA, 13 bp, D. melanogaster
aagcaaagcaatt

SEQ ID NO: 559359 - DNA, 13 bp, D. melanogaster
aagcaaagcagca

SEQ ID NO: 559360 - DNA, 13 bp, D. melanogaster
aagcaaagccaag

SEQ ID NO: 559361 - DNA, 13 bp, D. melanogaster
aagcaaagctttt

SEQ ID NO: 559362 - DNA, 14 bp, D. melanogaster
aagcaaaggaatat

SEQ ID NO: 559363 - DNA, 13 bp, D. melanogaster
aagcaaaggtgaa

SEQ ID NO: 559364 - DNA, 13 bp, D. melanogaster
aagcaaagtaaag

SEQ ID NO: 559365 - DNA, 13 bp, D. melanogaster
aagcaaagtgaaa

SEQ ID NO: 559366 - DNA, 14 bp, D. melanogaster
aagcaaagtgccaa

SEQ ID NO: 559367 - DNA, 13 bp, D. melanogaster
aagcaaagtgttt

SEQ ID NO: 559368 - DNA, 13 bp, D. melanogaster
aagcaaataaacc

SEQ ID NO: 559369 - DNA, 14 bp, D. melanogaster
aagcaaataaatca

SEQ ID NO: 559370 - DNA, 13 bp, D. melanogaster
aagcaaataaatt

SEQ ID NO: 559371 - DNA, 14 bp, D. melanogaster
aagcaaataaattg

SEQ ID NO: 559372 - DNA, 13 bp, D. melanogaster
aagcaaataagtt

SEQ ID NO: 559373 - DNA, 13 bp, D. melanogaster
aagcaaataatat

SEQ ID NO: 559374 - DNA, 13 bp, D. melanogaster
aagcaaataatga

SEQ ID NO: 559375 - DNA, 13 bp, D. melanogaster
aagcaaataatgt

SEQ ID NO: 559376 - DNA, 14 bp, D. melanogaster
aagcaaatacaaat

SEQ ID NO: 559377 - DNA, 14 bp, D. melanogaster
aagcaaatacaatt

SEQ ID NO: 559378 - DNA, 13 bp, D. melanogaster
aagcaaatatttg

SEQ ID NO: 559379 - DNA, 13 bp, D. melanogaster
aagcaaatatttt

SEQ ID NO: 559380 - DNA, 13 bp, D. melanogaster
aagcaaatcaaag

SEQ ID NO: 559381 - DNA, 13 bp, D. melanogaster
aagcaaatcaaca

SEQ ID NO: 559382 - DNA, 13 bp, D. melanogaster
aagcaaatcaata

SEQ ID NO: 559383 - DNA, 13 bp, D. melanogaster
aagcaaatcaatt

SEQ ID NO: 559384 - DNA, 13 bp, D. melanogaster
aagcaaatccaaa

SEQ ID NO: 559385 - DNA, 13 bp, D. melanogaster
aagcaaatcgaaa

SEQ ID NO: 559386 - DNA, 13 bp, D. melanogaster
aagcaaatgaaac

SEQ ID NO: 559387 - DNA, 13 bp, D. melanogaster
aagcaaatgaagc

SEQ ID NO: 559388 - DNA, 13 bp, D. melanogaster
aagcaaatgaatg

SEQ ID NO: 559389 - DNA, 13 bp, D. melanogaster
aagcaaatgaatt

SEQ ID NO: 559390 - DNA, 14 bp, D. melanogaster
aagcaaatgcaaaa

SEQ ID NO: 559391 - DNA, 14 bp, D. melanogaster
aagcaaatgcaaat

SEQ ID NO: 559392 - DNA, 13 bp, D. melanogaster
aagcaaatgcatt

SEQ ID NO: 559393 - DNA, 13 bp, D. melanogaster
aagcaaatgccaa

SEQ ID NO: 559394 - DNA, 13 bp, D. melanogaster
aagcaaatggcaa

SEQ ID NO: 559395 - DNA, 13 bp, D. melanogaster
aagcaaatgtttg

SEQ ID NO: 559396 - DNA, 13 bp, D. melanogaster
aagcaaatgtttt

SEQ ID NO: 559397 - DNA, 14 bp, D. melanogaster
aagcaaattaaatt

SEQ ID NO: 559398 - DNA, 13 bp, D. melanogaster
aagcaaattaagt

SEQ ID NO: 559399 - DNA, 13 bp, D. melanogaster
aagcaaattagag

SEQ ID NO: 559400 - DNA, 13 bp, D. melanogaster
aagcaaattatag

SEQ ID NO: 559401 - DNA, 13 bp, D. melanogaster
aagcaaattattt

SEQ ID NO: 559402 - DNA, 13 bp, D. melanogaster
aagcaaattcaaa

SEQ ID NO: 559403 - DNA, 14 bp, D. melanogaster
aagcaaattctatt

SEQ ID NO: 559404 - DNA, 13 bp, D. melanogaster
aagcaaattgaaa

SEQ ID NO: 559405 - DNA, 13 bp, D. melanogaster
aagcaaattgcat

SEQ ID NO: 559406 - DNA, 13 bp, D. melanogaster
aagcaaattggtt

SEQ ID NO: 559407 - DNA, 13 bp, D. melanogaster
aagcaaattgtat

SEQ ID NO: 559408 - DNA, 13 bp, D. melanogaster
aagcaaattgttg

SEQ ID NO: 559409 - DNA, 13 bp, D. melanogaster
aagcaaatttaaa

SEQ ID NO: 559410 - DNA, 13 bp, D. melanogaster
aagcaaatttaat

SEQ ID NO: 559411 - DNA, 13 bp, D. melanogaster
aagcaaatttaca

SEQ ID NO: 559412 - DNA, 13 bp, D. melanogaster
aagcaaatttatg

SEQ ID NO: 559413 - DNA, 13 bp, D. melanogaster
aagcaaatttatt

SEQ ID NO: 559414 - DNA, 13 bp, D. melanogaster
aagcaaatttttc

SEQ ID NO: 559415 - DNA, 14 bp, D. melanogaster
aagcaaatttttct

SEQ ID NO: 559416 - DNA, 13 bp, D. melanogaster
aagcaacaaaagt

SEQ ID NO: 559417 - DNA, 13 bp, D. melanogaster
aagcaacaacaat

SEQ ID NO: 559418 - DNA, 13 bp, D. melanogaster
aagcaacaagctg

SEQ ID NO: 559419 - DNA, 13 bp, D. melanogaster
aagcaacagaaat

SEQ ID NO: 559420 - DNA, 14 bp, D. melanogaster
aagcaacagcaaca

SEQ ID NO: 559421 - DNA, 14 bp, D. melanogaster
aagcaacagcagca

SEQ ID NO: 559422 - DNA, 15 bp, D. melanogaster
aagcaacagcagcag

SEQ ID NO: 559423 - DNA, 14 bp, D. melanogaster
aagcaacagtgaca

SEQ ID NO: 559424 - DNA, 13 bp, D. melanogaster
aagcaactacaac

SEQ ID NO: 559425 - DNA, 13 bp, D. melanogaster
aagcaactgaaaa

SEQ ID NO: 559426 - DNA, 13 bp, D. melanogaster
aagcaactgaaat

SEQ ID NO: 559427 - DNA, 13 bp, D. melanogaster
aagcaactgcaaa

SEQ ID NO: 559428 - DNA, 13 bp, D. melanogaster
aagcaactgggag

SEQ ID NO: 559429 - DNA, 13 bp, D. melanogaster
aagcaactgtttc

SEQ ID NO: 559430 - DNA, 13 bp, D. melanogaster
aagcaacttaaaa

SEQ ID NO: 559431 - DNA, 13 bp, D. melanogaster
aagcaagaattcg

SEQ ID NO: 559432 - DNA, 14 bp, D. melanogaster
aagcaagatagaaa

SEQ ID NO: 559433 - DNA, 13 bp, D. melanogaster
aagcaagcaaaat

SEQ ID NO: 559434 - DNA, 13 bp, D. melanogaster
aagcaagcaaact

SEQ ID NO: 559435 - DNA, 13 bp, D. melanogaster
aagcaagcaaatt

SEQ ID NO: 559436 - DNA, 13 bp, D. melanogaster
aagcaagcaagca

SEQ ID NO: 559437 - DNA, 13 bp, D. melanogaster
aagcaagcacaga

SEQ ID NO: 559438 - DNA, 13 bp, D. melanogaster
aagcaagcggcta

SEQ ID NO: 559439 - DNA, 13 bp, D. melanogaster
aagcaagcgtgtg

SEQ ID NO: 559440 - DNA, 13 bp, D. melanogaster
aagcaaggcgaat

SEQ ID NO: 559441 - DNA, 13 bp, D. melanogaster
aagcaagtaaatt

SEQ ID NO: 559442 - DNA, 13 bp, D. melanogaster
aagcaataaatac

SEQ ID NO: 559443 - DNA, 13 bp, D. melanogaster
aagcaataaatta

SEQ ID NO: 559444 - DNA, 13 bp, D. melanogaster
aagcaataagtga

SEQ ID NO: 559445 - DNA, 13 bp, D. melanogaster
aagcaataataat

SEQ ID NO: 559446 - DNA, 14 bp, D. melanogaster
aagcaataataata

SEQ ID NO: 559447 - DNA, 13 bp, D. melanogaster
aagcaataattaa

SEQ ID NO: 559448 - DNA, 13 bp, D. melanogaster
aagcaatacaaat

SEQ ID NO: 559449 - DNA, 13 bp, D. melanogaster
aagcaatcaaaat

SEQ ID NO: 559450 - DNA, 13 bp, D. melanogaster
aagcaatcaaaca

SEQ ID NO: 559451 - DNA, 13 bp, D. melanogaster
aagcaatcaaatc

SEQ ID NO: 559452 - DNA, 13 bp, D. melanogaster
aagcaatcaagtt

SEQ ID NO: 559453 - DNA, 13 bp, D. melanogaster
aagcaatccaatt

SEQ ID NO: 559454 - DNA, 13 bp, D. melanogaster
aagcaatcgaaat

SEQ ID NO: 559455 - DNA, 13 bp, D. melanogaster
aagcaatgaaaat

SEQ ID NO: 559456 - DNA, 13 bp, D. melanogaster
aagcaatgaaata

SEQ ID NO: 559457 - DNA, 13 bp, D. melanogaster
aagcaatgaaatg

SEQ ID NO: 559458 - DNA, 13 bp, D. melanogaster
aagcaatgcaaag

SEQ ID NO: 559459 - DNA, 13 bp, D. melanogaster
aagcaatggaaat

SEQ ID NO: 559460 - DNA, 13 bp, D. melanogaster
aagcaatgggaaa

SEQ ID NO: 559461 - DNA, 13 bp, D. melanogaster
aagcaattaaatt

SEQ ID NO: 559462 - DNA, 14 bp, D. melanogaster
aagcaattaaattt

SEQ ID NO: 559463 - DNA, 13 bp, D. melanogaster
aagcaattaatat

SEQ ID NO: 559464 - DNA, 13 bp, D. melanogaster
aagcaattatata

SEQ ID NO: 559465 - DNA, 13 bp, D. melanogaster
aagcaattattat

SEQ ID NO: 559466 - DNA, 13 bp, D. melanogaster
aagcaattatttt

SEQ ID NO: 559467 - DNA, 13 bp, D. melanogaster
aagcaattcaaaa

SEQ ID NO: 559468 - DNA, 13 bp, D. melanogaster
aagcaatttaagt

SEQ ID NO: 559469 - DNA, 13 bp, D. melanogaster
aagcaatttaatt

SEQ ID NO: 559470 - DNA, 13 bp, D. melanogaster
aagcaatttacaa

SEQ ID NO: 559471 - DNA, 13 bp, D. melanogaster
aagcaatttactt

SEQ ID NO: 559472 - DNA, 13 bp, D. melanogaster
aagcaatttatgt

SEQ ID NO: 559473 - DNA, 13 bp, D. melanogaster
aagcaatttattt

SEQ ID NO: 559474 - DNA, 13 bp, D. melanogaster
aagcaatttcaaa

SEQ ID NO: 559475 - DNA, 13 bp, D. melanogaster
aagcaatttcagc

SEQ ID NO: 559476 - DNA, 13 bp, D. melanogaster
aagcaatttccac

SEQ ID NO: 559477 - DNA, 13 bp, D. melanogaster
aagcaatttccca

SEQ ID NO: 559478 - DNA, 13 bp, D. melanogaster
aagcaatttgaaa

SEQ ID NO: 559479 - DNA, 13 bp, D. melanogaster
aagcaatttgatt

SEQ ID NO: 559480 - DNA, 13 bp, D. melanogaster
aagcaatttgcaa

SEQ ID NO: 559481 - DNA, 13 bp, D. melanogaster
aagcaatttgcag

SEQ ID NO: 559482 - DNA, 13 bp, D. melanogaster
aagcaatttgcat

SEQ ID NO: 559483 - DNA, 14 bp, D. melanogaster
aagcaatttgcatt

SEQ ID NO: 559484 - DNA, 13 bp, D. melanogaster
aagcaatttgcca

SEQ ID NO: 559485 - DNA, 13 bp, D. melanogaster
aagcaatttgctt

SEQ ID NO: 559486 - DNA, 13 bp, D. melanogaster
aagcaatttgtgt

SEQ ID NO: 559487 - DNA, 13 bp, D. melanogaster
aagcaatttgttt

SEQ ID NO: 559488 - DNA, 13 bp, D. melanogaster
aagcaattttaaa

SEQ ID NO: 559489 - DNA, 13 bp, D. melanogaster
aagcaattttatt

SEQ ID NO: 559490 - DNA, 13 bp, D. melanogaster
aagcacaaaaact

SEQ ID NO: 559491 - DNA, 13 bp, D. melanogaster
aagcacaaaaatg

SEQ ID NO: 559492 - DNA, 13 bp, D. melanogaster
aagcacaaagcgg

SEQ ID NO: 559493 - DNA, 13 bp, D. melanogaster
aagcacaaatatt

SEQ ID NO: 559494 - DNA, 14 bp, D. melanogaster
aagcacaaatccac

SEQ ID NO: 559495 - DNA, 13 bp, D. melanogaster
aagcacaacattg

SEQ ID NO: 559496 - DNA, 13 bp, D. melanogaster
aagcacaagcaca

SEQ ID NO: 559497 - DNA, 13 bp, D. melanogaster
aagcacacacact

SEQ ID NO: 559498 - DNA, 13 bp, D. melanogaster
aagcacacagata

SEQ ID NO: 559499 - DNA, 14 bp, D. melanogaster
aagcacacggtggc

SEQ ID NO: 559500 - DNA, 13 bp, D. melanogaster
aagcacagaggct

SEQ ID NO: 559501 - DNA, 13 bp, D. melanogaster
aagcacagcaaag

SEQ ID NO: 559502 - DNA, 13 bp, D. melanogaster
aagcacattaaaa

SEQ ID NO: 559503 - DNA, 13 bp, D. melanogaster
aagcactcgagca

SEQ ID NO: 559504 - DNA, 13 bp, D. melanogaster
aagcactgaaaaa

SEQ ID NO: 559505 - DNA, 13 bp, D. melanogaster
aagcactgagaga

SEQ ID NO: 559506 - DNA, 13 bp, D. melanogaster
aagcactgcaaaa

SEQ ID NO: 559507 - DNA, 13 bp, D. melanogaster
aagcacttcattt

SEQ ID NO: 559508 - DNA, 13 bp, D. melanogaster
aagcacttggcca

SEQ ID NO: 559509 - DNA, 13 bp, D. melanogaster
aagcactttaaat

SEQ ID NO: 559510 - DNA, 13 bp, D. melanogaster
aagcagaaaaatg

SEQ ID NO: 559511 - DNA, 13 bp, D. melanogaster
aagcagaaaatat

SEQ ID NO: 559512 - DNA, 13 bp, D. melanogaster
aagcagaaacacg

SEQ ID NO: 559513 - DNA, 13 bp, D. melanogaster
aagcagaaacagc

SEQ ID NO: 559514 - DNA, 14 bp, D. melanogaster
aagcagaaaccgaa

SEQ ID NO: 559515 - DNA, 13 bp, D. melanogaster
aagcagaaagccg

SEQ ID NO: 559516 - DNA, 13 bp, D. melanogaster
aagcagaaattgt

SEQ ID NO: 559517 - DNA, 13 bp, D. melanogaster
aagcagaagaagc

SEQ ID NO: 559518 - DNA, 13 bp, D. melanogaster
aagcagaagtcga

SEQ ID NO: 559519 - DNA, 13 bp, D. melanogaster
aagcagacagaca

SEQ ID NO: 559520 - DNA, 13 bp, D. melanogaster
aagcagaggcaaa

SEQ ID NO: 559521 - DNA, 13 bp, D. melanogaster
aagcagataaagc

SEQ ID NO: 559522 - DNA, 13 bp, D. melanogaster
aagcagatcaaat

SEQ ID NO: 559523 - DNA, 14 bp, D. melanogaster
aagcagatcaaatt

SEQ ID NO: 559524 - DNA, 13 bp, D. melanogaster
aagcagcaaaaat

SEQ ID NO: 559525 - DNA, 13 bp, D. melanogaster
aagcagcaaagca

SEQ ID NO: 559526 - DNA, 13 bp, D. melanogaster
aagcagcaaatgc

SEQ ID NO: 559527 - DNA, 13 bp, D. melanogaster
aagcagcaacaac

SEQ ID NO: 559528 - DNA, 21 bp, D. melanogaster
aagcagcaacaacagcagcag

SEQ ID NO: 559529 - DNA, 13 bp, D. melanogaster
aagcagcaacagc

SEQ ID NO: 559530 - DNA, 14 bp, D. melanogaster
aagcagcaacagca

SEQ ID NO: 559531 - DNA, 13 bp, D. melanogaster
aagcagcagaagc

SEQ ID NO: 559532 - DNA, 13 bp, D. melanogaster
aagcagcagcaaa

SEQ ID NO: 559533 - DNA, 13 bp, D. melanogaster
aagcagcagcaac

SEQ ID NO: 559534 - DNA, 14 bp, D. melanogaster
aagcagcagcaaca

SEQ ID NO: 559535 - DNA, 13 bp, D. melanogaster
aagcagcagcaca

SEQ ID NO: 559536 - DNA, 13 bp, D. melanogaster
aagcagcagcaga

SEQ ID NO: 559537 - DNA, 15 bp, D. melanogaster
aagcagcagcagcaa

SEQ ID NO: 559538 - DNA, 14 bp, D. melanogaster
aagcagcagcagcg

SEQ ID NO: 559539 - DNA, 13 bp, D. melanogaster
aagcagcagcagg

SEQ ID NO: 559540 - DNA, 14 bp, D. melanogaster
aagcagcagcagta

SEQ ID NO: 559541 - DNA, 13 bp, D. melanogaster
aagcagcagcatc

SEQ ID NO: 559542 - DNA, 13 bp, D. melanogaster
aagcagcagccaa

SEQ ID NO: 559543 - DNA, 13 bp, D. melanogaster
aagcagcagccac

SEQ ID NO: 559544 - DNA, 13 bp, D. melanogaster
aagcagcaggaaa

SEQ ID NO: 559545 - DNA, 13 bp, D. melanogaster
aagcagcaggagc

SEQ ID NO: 559546 - DNA, 14 bp, D. melanogaster
aagcagcaggagca

SEQ ID NO: 559547 - DNA, 13 bp, D. melanogaster
aagcagcaggcag

SEQ ID NO: 559548 - DNA, 13 bp, D. melanogaster
aagcagccaaaca

SEQ ID NO: 559549 - DNA, 13 bp, D. melanogaster
aagcagccagcaa

SEQ ID NO: 559550 - DNA, 13 bp, D. melanogaster
aagcagccagcca

SEQ ID NO: 559551 - DNA, 13 bp, D. melanogaster
aagcagccatggt

SEQ ID NO: 559552 - DNA, 13 bp, D. melanogaster
aagcagcggaaaa

SEQ ID NO: 559553 - DNA, 13 bp, D. melanogaster
aagcagcggaaat

SEQ ID NO: 559554 - DNA, 13 bp, D. melanogaster
aagcagcggcaaa

SEQ ID NO: 559555 - DNA, 13 bp, D. melanogaster
aagcagcggcaac

SEQ ID NO: 559556 - DNA, 14 bp, D. melanogaster
aagcagcggcagca

SEQ ID NO: 559557 - DNA, 13 bp, D. melanogaster
aagcagctcgagg

SEQ ID NO: 559558 - DNA, 14 bp, D. melanogaster
aagcagctcgaggc

SEQ ID NO: 559559 - DNA, 13 bp, D. melanogaster
aagcagctgaaaa

SEQ ID NO: 559560 - DNA, 13 bp, D. melanogaster
aagcagctgccaa

SEQ ID NO: 559561 - DNA, 14 bp, D. melanogaster
aagcagctgccatt

SEQ ID NO: 559562 - DNA, 13 bp, D. melanogaster
aagcagctggtca

SEQ ID NO: 559563 - DNA, 14 bp, D. melanogaster
aagcagctggtcat

SEQ ID NO: 559564 - DNA, 13 bp, D. melanogaster
aagcagcttaaat

SEQ ID NO: 559565 - DNA, 13 bp, D. melanogaster
aagcaggaaaaat

SEQ ID NO: 559566 - DNA, 13 bp, D. melanogaster
aagcaggaaaatt

SEQ ID NO: 559567 - DNA, 13 bp, D. melanogaster
aagcaggcaaaca

SEQ ID NO: 559568 - DNA, 13 bp, D. melanogaster
aagcaggcagaga

SEQ ID NO: 559569 - DNA, 13 bp, D. melanogaster
aagcaggcaggca

SEQ ID NO: 559570 - DNA, 13 bp, D. melanogaster
aagcaggcccaaa

SEQ ID NO: 559571 - DNA, 13 bp, D. melanogaster
aagcaggcgaaca

SEQ ID NO: 559572 - DNA, 13 bp, D. melanogaster
aagcagggaaaat

SEQ ID NO: 559573 - DNA, 13 bp, D. melanogaster
aagcagtaaaatt

SEQ ID NO: 559574 - DNA, 13 bp, D. melanogaster
aagcagtggaaaa

SEQ ID NO: 559575 - DNA, 13 bp, D. melanogaster
aagcataaacata

SEQ ID NO: 559576 - DNA, 13 bp, D. melanogaster
aagcataacaaga

SEQ ID NO: 559577 - DNA, 13 bp, D. melanogaster
aagcataatttat

SEQ ID NO: 559578 - DNA, 14 bp, D. melanogaster
aagcatacacacac

SEQ ID NO: 559579 - DNA, 13 bp, D. melanogaster
aagcatacagaaa

SEQ ID NO: 559580 - DNA, 16 bp, D. melanogaster
aagcatacagaaaaat

SEQ ID NO: 559581 - DNA, 13 bp, D. melanogaster
aagcatacatatt

SEQ ID NO: 559582 - DNA, 13 bp, D. melanogaster
aagcatatatatt

SEQ ID NO: 559583 - DNA, 13 bp, D. melanogaster
aagcatatgaaaa

SEQ ID NO: 559584 - DNA, 13 bp, D. melanogaster
aagcatattctat

SEQ ID NO: 559585 - DNA, 13 bp, D. melanogaster
aagcatgaaagac

SEQ ID NO: 559586 - DNA, 13 bp, D. melanogaster
aagcatgcgcaga

SEQ ID NO: 559587 - DNA, 13 bp, D. melanogaster
aagcatgtgctta

SEQ ID NO: 559588 - DNA, 13 bp, D. melanogaster
aagcattaattta

SEQ ID NO: 559589 - DNA, 13 bp, D. melanogaster
aagcattcgacaa

SEQ ID NO: 559590 - DNA, 13 bp, D. melanogaster
aagcattcgcatt

SEQ ID NO: 559591 - DNA, 13 bp, D. melanogaster
aagcattgcaaaa

SEQ ID NO: 559592 - DNA, 13 bp, D. melanogaster
aagcattgcgcca

SEQ ID NO: 559593 - DNA, 13 bp, D. melanogaster
aagcattggactt

SEQ ID NO: 559594 - DNA, 13 bp, D. melanogaster
aagcatttaaaca

SEQ ID NO: 559595 - DNA, 13 bp, D. melanogaster
aagcatttaaata

SEQ ID NO: 559596 - DNA, 13 bp, D. melanogaster
aagcatttaaatg

SEQ ID NO: 559597 - DNA, 13 bp, D. melanogaster
aagcatttaatat

SEQ ID NO: 559598 - DNA, 13 bp, D. melanogaster
aagcatttaatgt

SEQ ID NO: 559599 - DNA, 13 bp, D. melanogaster
aagcatttaattg

SEQ ID NO: 559600 - DNA, 13 bp, D. melanogaster
aagcatttacata

SEQ ID NO: 559601 - DNA, 13 bp, D. melanogaster
aagcatttacatt

SEQ ID NO: 559602 - DNA, 13 bp, D. melanogaster
aagcatttagtga

SEQ ID NO: 559603 - DNA, 13 bp, D. melanogaster
aagcatttataat

SEQ ID NO: 559604 - DNA, 14 bp, D. melanogaster
aagcatttatttat

SEQ ID NO: 559605 - DNA, 13 bp, D. melanogaster
aagcatttcaaag

SEQ ID NO: 559606 - DNA, 13 bp, D. melanogaster
aagcatttgaaaa

SEQ ID NO: 559607 - DNA, 13 bp, D. melanogaster
aagcatttgaata

SEQ ID NO: 559608 - DNA, 13 bp, D. melanogaster
aagcatttgattt

SEQ ID NO: 559609 - DNA, 13 bp, D. melanogaster
aagcatttggaaa

SEQ ID NO: 559610 - DNA, 14 bp, D. melanogaster
aagcatttggccgg

SEQ ID NO: 559611 - DNA, 13 bp, D. melanogaster
aagcatttgtatc

SEQ ID NO: 559612 - DNA, 13 bp, D. melanogaster
aagcatttgtttt

SEQ ID NO: 559613 - DNA, 13 bp, D. melanogaster
aagcattttaaac

SEQ ID NO: 559614 - DNA, 13 bp, D. melanogaster
aagcattttatat

SEQ ID NO: 559615 - DNA, 13 bp, D. melanogaster
aagcattttattt

SEQ ID NO: 559616 - DNA, 13 bp, D. melanogaster
aagcattttcaca

SEQ ID NO: 559617 - DNA, 13 bp, D. melanogaster
aagcattttgcaa

SEQ ID NO: 559618 - DNA, 13 bp, D. melanogaster
aagcattttgcac

SEQ ID NO: 559619 - DNA, 13 bp, D. melanogaster
aagcatttttaaa

SEQ ID NO: 559620 - DNA, 13 bp, D. melanogaster
aagcattttttat

SEQ ID NO: 559621 - DNA, 13 bp, D. melanogaster
aagcatttttttt

SEQ ID NO: 559622 - DNA, 13 bp, D. melanogaster
aagccaaaaaatg

SEQ ID NO: 559623 - DNA, 13 bp, D. melanogaster
aagccaaaaaatt

SEQ ID NO: 559624 - DNA, 13 bp, D. melanogaster
aagccaaaaactg

SEQ ID NO: 559625 - DNA, 13 bp, D. melanogaster
aagccaaaaatgc

SEQ ID NO: 559626 - DNA, 13 bp, D. melanogaster
aagccaaaaattg

SEQ ID NO: 559627 - DNA, 13 bp, D. melanogaster
aagccaaaacaat

SEQ ID NO: 559628 - DNA, 13 bp, D. melanogaster
aagccaaaagctg

SEQ ID NO: 559629 - DNA, 13 bp, D. melanogaster
aagccaaaagttg

SEQ ID NO: 559630 - DNA, 13 bp, D. melanogaster
aagccaaaagttt

SEQ ID NO: 559631 - DNA, 13 bp, D. melanogaster
aagccaaaataat

SEQ ID NO: 559632 - DNA, 13 bp, D. melanogaster
aagccaaaatcaa

SEQ ID NO: 559633 - DNA, 13 bp, D. melanogaster
aagccaaaatgca

SEQ ID NO: 559634 - DNA, 13 bp, D. melanogaster
aagccaaaattta

SEQ ID NO: 559635 - DNA, 14 bp, D. melanogaster
aagccaaacaaatt

SEQ ID NO: 559636 - DNA, 13 bp, D. melanogaster
aagccaaacaagc

SEQ ID NO: 559637 - DNA, 13 bp, D. melanogaster
aagccaaacaata

SEQ ID NO: 559638 - DNA, 13 bp, D. melanogaster
aagccaaaccaat

SEQ ID NO: 559639 - DNA, 13 bp, D. melanogaster
aagccaaaccgaa

SEQ ID NO: 559640 - DNA, 13 bp, D. melanogaster
aagccaaactaaa

SEQ ID NO: 559641 - DNA, 13 bp, D. melanogaster
aagccaaactgaa

SEQ ID NO: 559642 - DNA, 14 bp, D. melanogaster
aagccaaactgaaa

SEQ ID NO: 559643 - DNA, 13 bp, D. melanogaster
aagccaaactttt

SEQ ID NO: 559644 - DNA, 13 bp, D. melanogaster
aagccaaagaaat

SEQ ID NO: 559645 - DNA, 13 bp, D. melanogaster
aagccaaagaact

SEQ ID NO: 559646 - DNA, 14 bp, D. melanogaster
aagccaaagccaca

SEQ ID NO: 559647 - DNA, 13 bp, D. melanogaster
aagccaaagccat

SEQ ID NO: 559648 - DNA, 13 bp, D. melanogaster
aagccaaagccca

SEQ ID NO: 559649 - DNA, 13 bp, D. melanogaster
aagccaaagcgaa

SEQ ID NO: 559650 - DNA, 14 bp, D. melanogaster
aagccaaagctaaa

SEQ ID NO: 559651 - DNA, 13 bp, D. melanogaster
aagccaaaggaag

SEQ ID NO: 559652 - DNA, 13 bp, D. melanogaster
aagccaaaggcag

SEQ ID NO: 559653 - DNA, 13 bp, D. melanogaster
aagccaaaggcga

SEQ ID NO: 559654 - DNA, 13 bp, D. melanogaster
aagccaaagggaa

SEQ ID NO: 559655 - DNA, 14 bp, D. melanogaster
aagccaaagtcaaa

SEQ ID NO: 559656 - DNA, 13 bp, D. melanogaster
aagccaaagtgaa

SEQ ID NO: 559657 - DNA, 13 bp, D. melanogaster
aagccaaagttaa

SEQ ID NO: 559658 - DNA, 13 bp, D. melanogaster
aagccaaataaac

SEQ ID NO: 559659 - DNA, 13 bp, D. melanogaster
aagccaaatattt

SEQ ID NO: 559660 - DNA, 13 bp, D. melanogaster
aagccaaatcaaa

SEQ ID NO: 559661 - DNA, 14 bp, D. melanogaster
aagccaaatcaaaa

SEQ ID NO: 559662 - DNA, 13 bp, D. melanogaster
aagccaaatcaat

SEQ ID NO: 559663 - DNA, 14 bp, D. melanogaster
aagccaaatcgaaa

SEQ ID NO: 559664 - DNA, 13 bp, D. melanogaster
aagccaaatgaaa

SEQ ID NO: 559665 - DNA, 13 bp, D. melanogaster
aagccaaatgcag

SEQ ID NO: 559666 - DNA, 13 bp, D. melanogaster
aagccaaatggaa

SEQ ID NO: 559667 - DNA, 13 bp, D. melanogaster
aagccaaattaaa

SEQ ID NO: 559668 - DNA, 13 bp, D. melanogaster
aagccaaattaat

SEQ ID NO: 559669 - DNA, 13 bp, D. melanogaster
aagccaaattggc

SEQ ID NO: 559670 - DNA, 13 bp, D. melanogaster
aagccaaattgtt

SEQ ID NO: 559671 - DNA, 13 bp, D. melanogaster
aagccaacaaact

SEQ ID NO: 559672 - DNA, 13 bp, D. melanogaster
aagccaacaaata

SEQ ID NO: 559673 - DNA, 13 bp, D. melanogaster
aagccaacaaatg

SEQ ID NO: 559674 - DNA, 13 bp, D. melanogaster
aagccaacaacag

SEQ ID NO: 559675 - DNA, 13 bp, D. melanogaster
aagccaacaacat

SEQ ID NO: 559676 - DNA, 13 bp, D. melanogaster
aagccaacaactt

SEQ ID NO: 559677 - DNA, 14 bp, D. melanogaster
aagccaacaactta

SEQ ID NO: 559678 - DNA, 13 bp, D. melanogaster
aagccaaccaaat

SEQ ID NO: 559679 - DNA, 13 bp, D. melanogaster
aagccaaccagcc

SEQ ID NO: 559680 - DNA, 13 bp, D. melanogaster
aagccaaccgaaa

SEQ ID NO: 559681 - DNA, 13 bp, D. melanogaster
aagccaactgaaa

SEQ ID NO: 559682 - DNA, 13 bp, D. melanogaster
aagccaactgaca

SEQ ID NO: 559683 - DNA, 13 bp, D. melanogaster
aagccaactggaa

SEQ ID NO: 559684 - DNA, 13 bp, D. melanogaster
aagccaactggga

SEQ ID NO: 559685 - DNA, 13 bp, D. melanogaster
aagccaacttaaa

SEQ ID NO: 559686 - DNA, 13 bp, D. melanogaster
aagccaacttcaa

SEQ ID NO: 559687 - DNA, 13 bp, D. melanogaster
aagccaacttttt

SEQ ID NO: 559688 - DNA, 13 bp, D. melanogaster
aagccaagaaata

SEQ ID NO: 559689 - DNA, 13 bp, D. melanogaster
aagccaagaaatt

SEQ ID NO: 559690 - DNA, 13 bp, D. melanogaster
aagccaagaagct

SEQ ID NO: 559691 - DNA, 14 bp, D. melanogaster
aagccaagaagcta

SEQ ID NO: 559692 - DNA, 13 bp, D. melanogaster
aagccaagagcca

SEQ ID NO: 559693 - DNA, 14 bp, D. melanogaster
aagccaagccaaac

SEQ ID NO: 559694 - DNA, 13 bp, D. melanogaster
aagccaagccaag

SEQ ID NO: 559695 - DNA, 14 bp, D. melanogaster
aagccaagccaagt

SEQ ID NO: 559696 - DNA, 13 bp, D. melanogaster
aagccaagcccaa

SEQ ID NO: 559697 - DNA, 13 bp, D. melanogaster
aagccaagcgaaa

SEQ ID NO: 559698 - DNA, 13 bp, D. melanogaster
aagccaagctaaa

SEQ ID NO: 559699 - DNA, 13 bp, D. melanogaster
aagccaaggatgc

SEQ ID NO: 559700 - DNA, 13 bp, D. melanogaster
aagccaagtaaaa

SEQ ID NO: 559701 - DNA, 13 bp, D. melanogaster
aagccaagtcaag

SEQ ID NO: 559702 - DNA, 13 bp, D. melanogaster
aagccaagtccaa

SEQ ID NO: 559703 - DNA, 13 bp, D. melanogaster
aagccaagtcgag

SEQ ID NO: 559704 - DNA, 13 bp, D. melanogaster
aagccaagtgaaa

SEQ ID NO: 559705 - DNA, 13 bp, D. melanogaster
aagccaagtgaat

SEQ ID NO: 559706 - DNA, 13 bp, D. melanogaster
aagccaagttaag

SEQ ID NO: 559707 - DNA, 13 bp, D. melanogaster
aagccaagtttcg

SEQ ID NO: 559708 - DNA, 13 bp, D. melanogaster
aagccaataataa

SEQ ID NO: 559709 - DNA, 13 bp, D. melanogaster
aagccaatcaaaa

SEQ ID NO: 559710 - DNA, 13 bp, D. melanogaster
aagccaatctgca

SEQ ID NO: 559711 - DNA, 13 bp, D. melanogaster
aagccaattaaaa

SEQ ID NO: 559712 - DNA, 14 bp, D. melanogaster
aagccaattaaaaa

SEQ ID NO: 559713 - DNA, 13 bp, D. melanogaster
aagccaattatac

SEQ ID NO: 559714 - DNA, 13 bp, D. melanogaster
aagccaattgcag

SEQ ID NO: 559715 - DNA, 14 bp, D. melanogaster
aagccaattgcagc

SEQ ID NO: 559716 - DNA, 13 bp, D. melanogaster
aagccaatttgaa

SEQ ID NO: 559717 - DNA, 13 bp, D. melanogaster
aagccaatttgca

SEQ ID NO: 559718 - DNA, 13 bp, D. melanogaster
aagccacaaaagt

SEQ ID NO: 559719 - DNA, 13 bp, D. melanogaster
aagccacacaaat

SEQ ID NO: 559720 - DNA, 13 bp, D. melanogaster
aagccacataaat

SEQ ID NO: 559721 - DNA, 13 bp, D. melanogaster
aagccacccactc

SEQ ID NO: 559722 - DNA, 13 bp, D. melanogaster
aagccaccgaaaa

SEQ ID NO: 559723 - DNA, 13 bp, D. melanogaster
aagccaccgaact

SEQ ID NO: 559724 - DNA, 13 bp, D. melanogaster
aagccacttaaat

SEQ ID NO: 559725 - DNA, 13 bp, D. melanogaster
aagccagaagcaa

SEQ ID NO: 559726 - DNA, 13 bp, D. melanogaster
aagccagaagtaa

SEQ ID NO: 559727 - DNA, 13 bp, D. melanogaster
aagccagagccaa

SEQ ID NO: 559728 - DNA, 13 bp, D. melanogaster
aagccagcaaaat

SEQ ID NO: 559729 - DNA, 13 bp, D. melanogaster
aagccagcaagcc

SEQ ID NO: 559730 - DNA, 13 bp, D. melanogaster
aagccagcaatta

SEQ ID NO: 559731 - DNA, 13 bp, D. melanogaster
aagccagcagcaa

SEQ ID NO: 559732 - DNA, 13 bp, D. melanogaster
aagccagcgaaat

SEQ ID NO: 559733 - DNA, 13 bp, D. melanogaster
aagccagcgacaa

SEQ ID NO: 559734 - DNA, 13 bp, D. melanogaster
aagccagctgaaa

SEQ ID NO: 559735 - DNA, 13 bp, D. melanogaster
aagccaggcaaaa

SEQ ID NO: 559736 - DNA, 13 bp, D. melanogaster
aagccaggcaaat

SEQ ID NO: 559737 - DNA, 14 bp, D. melanogaster
aagccaggccaaaa

SEQ ID NO: 559738 - DNA, 13 bp, D. melanogaster
aagccaggccaag

SEQ ID NO: 559739 - DNA, 13 bp, D. melanogaster
aagccagggaaaa

SEQ ID NO: 559740 - DNA, 13 bp, D. melanogaster
aagccagtacaga

SEQ ID NO: 559741 - DNA, 13 bp, D. melanogaster
aagccagtgaaaa

SEQ ID NO: 559742 - DNA, 13 bp, D. melanogaster
aagccataaaaac

SEQ ID NO: 559743 - DNA, 13 bp, D. melanogaster
aagccataaaatc

SEQ ID NO: 559744 - DNA, 13 bp, D. melanogaster
aagccataaacaa

SEQ ID NO: 559745 - DNA, 13 bp, D. melanogaster
aagccataaataa

SEQ ID NO: 559746 - DNA, 13 bp, D. melanogaster
aagccataaatta

SEQ ID NO: 559747 - DNA, 13 bp, D. melanogaster
aagccatacactt

SEQ ID NO: 559748 - DNA, 13 bp, D. melanogaster
aagccatcaaaat

SEQ ID NO: 559749 - DNA, 13 bp, D. melanogaster
aagccatgaaaaa

SEQ ID NO: 559750 - DNA, 13 bp, D. melanogaster
aagccatggccaa

SEQ ID NO: 559751 - DNA, 13 bp, D. melanogaster
aagccattaaatt

SEQ ID NO: 559752 - DNA, 13 bp, D. melanogaster
aagccattcaaat

SEQ ID NO: 559753 - DNA, 13 bp, D. melanogaster
aagccatttgttt

SEQ ID NO: 559754 - DNA, 13 bp, D. melanogaster
aagccattttcat

SEQ ID NO: 559755 - DNA, 13 bp, D. melanogaster
aagcccaaaactc

SEQ ID NO: 559756 - DNA, 13 bp, D. melanogaster
aagcccaaactgg

SEQ ID NO: 559757 - DNA, 14 bp, D. melanogaster
aagcccaaactggt

SEQ ID NO: 559758 - DNA, 13 bp, D. melanogaster
aagcccaagcaaa

SEQ ID NO: 559759 - DNA, 13 bp, D. melanogaster
aagcccaagccaa

SEQ ID NO: 559760 - DNA, 14 bp, D. melanogaster
aagcccaagcccaa

SEQ ID NO: 559761 - DNA, 13 bp, D. melanogaster
aagcccaagtaaa

SEQ ID NO: 559762 - DNA, 13 bp, D. melanogaster
aagcccaagttca

SEQ ID NO: 559763 - DNA, 13 bp, D. melanogaster
aagcccacccact

SEQ ID NO: 559764 - DNA, 13 bp, D. melanogaster
aagcccattaaat

SEQ ID NO: 559765 - DNA, 13 bp, D. melanogaster
aagccccaaaact

SEQ ID NO: 559766 - DNA, 13 bp, D. melanogaster
aagccccagattt

SEQ ID NO: 559767 - DNA, 13 bp, D. melanogaster
aagcccccgaaaa

SEQ ID NO: 559768 - DNA, 13 bp, D. melanogaster
aagccgaaaaacc

SEQ ID NO: 559769 - DNA, 13 bp, D. melanogaster
aagccgaaaaact

SEQ ID NO: 559770 - DNA, 13 bp, D. melanogaster
aagccgaaaaata

SEQ ID NO: 559771 - DNA, 13 bp, D. melanogaster
aagccgaaaagac

SEQ ID NO: 559772 - DNA, 13 bp, D. melanogaster
aagccgaaagcaa

SEQ ID NO: 559773 - DNA, 13 bp, D. melanogaster
aagccgaaagccg

SEQ ID NO: 559774 - DNA, 14 bp, D. melanogaster
aagccgaaagcgaa

SEQ ID NO: 559775 - DNA, 13 bp, D. melanogaster
aagccgaacaaga

SEQ ID NO: 559776 - DNA, 13 bp, D. melanogaster
aagccgaagcaaa

SEQ ID NO: 559777 - DNA, 13 bp, D. melanogaster
aagccgaagccaa

SEQ ID NO: 559778 - DNA, 13 bp, D. melanogaster
aagccgaatcaaa

SEQ ID NO: 559779 - DNA, 13 bp, D. melanogaster
aagccgaggaaaa

SEQ ID NO: 559780 - DNA, 13 bp, D. melanogaster
aagccgcaaaaag

SEQ ID NO: 559781 - DNA, 13 bp, D. melanogaster
aagccgcaaaaca

SEQ ID NO: 559782 - DNA, 13 bp, D. melanogaster
aagccgcaacagc

SEQ ID NO: 559783 - DNA, 13 bp, D. melanogaster
aagccgcacaaaa

SEQ ID NO: 559784 - DNA, 14 bp, D. melanogaster
aagccgcacaaaac

SEQ ID NO: 559785 - DNA, 13 bp, D. melanogaster
aagccgcagcaaa

SEQ ID NO: 559786 - DNA, 13 bp, D. melanogaster
aagccgcataaat

SEQ ID NO: 559787 - DNA, 13 bp, D. melanogaster
aagccgctttaaa

SEQ ID NO: 559788 - DNA, 14 bp, D. melanogaster
aagccggaatgcat

SEQ ID NO: 559789 - DNA, 13 bp, D. melanogaster
aagccgggccaaa

SEQ ID NO: 559790 - DNA, 13 bp, D. melanogaster
aagccggtgcaaa

SEQ ID NO: 559791 - DNA, 13 bp, D. melanogaster
aagcctaaagata

SEQ ID NO: 559792 - DNA, 13 bp, D. melanogaster
aagcctaccaaac

SEQ ID NO: 559793 - DNA, 13 bp, D. melanogaster
aagcctactttca

SEQ ID NO: 559794 - DNA, 13 bp, D. melanogaster
aagcctatttttt

SEQ ID NO: 559795 - DNA, 13 bp, D. melanogaster
aagcctctatata

SEQ ID NO: 559796 - DNA, 13 bp, D. melanogaster
aagcctgaacaat

SEQ ID NO: 559797 - DNA, 13 bp, D. melanogaster
aagccttaaaaca

SEQ ID NO: 559798 - DNA, 13 bp, D. melanogaster
aagccttatattt

SEQ ID NO: 559799 - DNA, 13 bp, D. melanogaster
aagccttcaagaa

SEQ ID NO: 559800 - DNA, 13 bp, D. melanogaster
aagccttggaaaa

SEQ ID NO: 559801 - DNA, 13 bp, D. melanogaster
aagcgaaaaaagt

SEQ ID NO: 559802 - DNA, 13 bp, D. melanogaster
aagcgaaaaagtt

SEQ ID NO: 559803 - DNA, 13 bp, D. melanogaster
aagcgaaaaatat

SEQ ID NO: 559804 - DNA, 13 bp, D. melanogaster
aagcgaaaacatt

SEQ ID NO: 559805 - DNA, 13 bp, D. melanogaster
aagcgaaaacttt

SEQ ID NO: 559806 - DNA, 13 bp, D. melanogaster
aagcgaaaagaat

SEQ ID NO: 559807 - DNA, 13 bp, D. melanogaster
aagcgaaaagcga

SEQ ID NO: 559808 - DNA, 13 bp, D. melanogaster
aagcgaaaagtaa

SEQ ID NO: 559809 - DNA, 13 bp, D. melanogaster
aagcgaaaatcga

SEQ ID NO: 559810 - DNA, 13 bp, D. melanogaster
aagcgaaaattga

SEQ ID NO: 559811 - DNA, 13 bp, D. melanogaster
aagcgaaaattgc

SEQ ID NO: 559812 - DNA, 13 bp, D. melanogaster
aagcgaaacattt

SEQ ID NO: 559813 - DNA, 13 bp, D. melanogaster
aagcgaaacgaac

SEQ ID NO: 559814 - DNA, 13 bp, D. melanogaster
aagcgaaagcagc

SEQ ID NO: 559815 - DNA, 13 bp, D. melanogaster
aagcgaaagccaa

SEQ ID NO: 559816 - DNA, 13 bp, D. melanogaster
aagcgaaagcgaa

SEQ ID NO: 559817 - DNA, 13 bp, D. melanogaster
aagcgaaagctca

SEQ ID NO: 559818 - DNA, 13 bp, D. melanogaster
aagcgaaataatt

SEQ ID NO: 559819 - DNA, 13 bp, D. melanogaster
aagcgaaatatat

SEQ ID NO: 559820 - DNA, 13 bp, D. melanogaster
aagcgaaatattt

SEQ ID NO: 559821 - DNA, 13 bp, D. melanogaster
aagcgaaatcaaa

SEQ ID NO: 559822 - DNA, 13 bp, D. melanogaster
aagcgaaatcaat

SEQ ID NO: 559823 - DNA, 13 bp, D. melanogaster
aagcgaaatgaaa

SEQ ID NO: 559824 - DNA, 13 bp, D. melanogaster
aagcgaaatgaga

SEQ ID NO: 559825 - DNA, 13 bp, D. melanogaster
aagcgaaatgcga

SEQ ID NO: 559826 - DNA, 13 bp, D. melanogaster
aagcgaaattaat

SEQ ID NO: 559827 - DNA, 13 bp, D. melanogaster
aagcgaaattgtt

SEQ ID NO: 559828 - DNA, 13 bp, D. melanogaster
aagcgaaattttt

SEQ ID NO: 559829 - DNA, 13 bp, D. melanogaster
aagcgaaccgaaa

SEQ ID NO: 559830 - DNA, 13 bp, D. melanogaster
aagcgaaccgaac

SEQ ID NO: 559831 - DNA, 13 bp, D. melanogaster
aagcgaactgaaa

SEQ ID NO: 559832 - DNA, 13 bp, D. melanogaster
aagcgaagcaaac

SEQ ID NO: 559833 - DNA, 13 bp, D. melanogaster
aagcgaataaaat

SEQ ID NO: 559834 - DNA, 13 bp, D. melanogaster
aagcgaatcattg

SEQ ID NO: 559835 - DNA, 13 bp, D. melanogaster
aagcgaatcgaaa

SEQ ID NO: 559836 - DNA, 13 bp, D. melanogaster
aagcgaatgaaaa

SEQ ID NO: 559837 - DNA, 14 bp, D. melanogaster
aagcgaatgccaaa

SEQ ID NO: 559838 - DNA, 13 bp, D. melanogaster
aagcgaatgccag

SEQ ID NO: 559839 - DNA, 13 bp, D. melanogaster
aagcgaatttaaa

SEQ ID NO: 559840 - DNA, 13 bp, D. melanogaster
aagcgaatttatt

SEQ ID NO: 559841 - DNA, 13 bp, D. melanogaster
aagcgacaacaac

SEQ ID NO: 559842 - DNA, 13 bp, D. melanogaster
aagcgacagtttg

SEQ ID NO: 559843 - DNA, 13 bp, D. melanogaster
aagcgagcgaaaa

SEQ ID NO: 559844 - DNA, 13 bp, D. melanogaster
aagcgaggaaaac

SEQ ID NO: 559845 - DNA, 13 bp, D. melanogaster
aagcgaggccaac

SEQ ID NO: 559846 - DNA, 13 bp, D. melanogaster
aagcgagtgaaaa

SEQ ID NO: 559847 - DNA, 13 bp, D. melanogaster
aagcgagtgaaag

SEQ ID NO: 559848 - DNA, 13 bp, D. melanogaster
aagcgagtgtaca

SEQ ID NO: 559849 - DNA, 13 bp, D. melanogaster
aagcgatatcgaa

SEQ ID NO: 559850 - DNA, 13 bp, D. melanogaster
aagcgatctaact

SEQ ID NO: 559851 - DNA, 13 bp, D. melanogaster
aagcgatgaaaat

SEQ ID NO: 559852 - DNA, 13 bp, D. melanogaster
aagcgatgaatca

SEQ ID NO: 559853 - DNA, 13 bp, D. melanogaster
aagcgatggaaaa

SEQ ID NO: 559854 - DNA, 13 bp, D. melanogaster
aagcgatggcaaa

SEQ ID NO: 559855 - DNA, 13 bp, D. melanogaster
aagcgattaaaaa

SEQ ID NO: 559856 - DNA, 13 bp, D. melanogaster
aagcgattgtttt

SEQ ID NO: 559857 - DNA, 13 bp, D. melanogaster
aagcgatttaaat

SEQ ID NO: 559858 - DNA, 13 bp, D. melanogaster
aagcgattttcca

SEQ ID NO: 559859 - DNA, 14 bp, D. melanogaster
aagcgcaaaaacag

SEQ ID NO: 559860 - DNA, 13 bp, D. melanogaster
aagcgcaaaagga

SEQ ID NO: 559861 - DNA, 13 bp, D. melanogaster
aagcgcaaaagtt

SEQ ID NO: 559862 - DNA, 13 bp, D. melanogaster
aagcgcagcaaaa

SEQ ID NO: 559863 - DNA, 13 bp, D. melanogaster
aagcgcaggaaaa

SEQ ID NO: 559864 - DNA, 13 bp, D. melanogaster
aagcgcatacata

SEQ ID NO: 559865 - DNA, 13 bp, D. melanogaster
aagcgcattaaaa

SEQ ID NO: 559866 - DNA, 14 bp, D. melanogaster
aagcgcgttgtgtt

SEQ ID NO: 559867 - DNA, 13 bp, D. melanogaster
aagcgctggaaaa

SEQ ID NO: 559868 - DNA, 13 bp, D. melanogaster
aagcgctggcaaa

SEQ ID NO: 559869 - DNA, 13 bp, D. melanogaster
aagcggaaaactt

SEQ ID NO: 559870 - DNA, 13 bp, D. melanogaster
aagcggaaaagtg

SEQ ID NO: 559871 - DNA, 13 bp, D. melanogaster
aagcggaaaatgc

SEQ ID NO: 559872 - DNA, 13 bp, D. melanogaster
aagcggaaaatgt

SEQ ID NO: 559873 - DNA, 13 bp, D. melanogaster
aagcggaaatgcg

SEQ ID NO: 559874 - DNA, 13 bp, D. melanogaster
aagcggaagtgca

SEQ ID NO: 559875 - DNA, 13 bp, D. melanogaster
aagcggaataaaa

SEQ ID NO: 559876 - DNA, 13 bp, D. melanogaster
aagcggaccaaga

SEQ ID NO: 559877 - DNA, 13 bp, D. melanogaster
aagcggagaatat

SEQ ID NO: 559878 - DNA, 13 bp, D. melanogaster
aagcggatagaaa

SEQ ID NO: 559879 - DNA, 14 bp, D. melanogaster
aagcggatagaaaa

SEQ ID NO: 559880 - DNA, 13 bp, D. melanogaster
aagcggcaaaaag

SEQ ID NO: 559881 - DNA, 13 bp, D. melanogaster
aagcggcaaaagg

SEQ ID NO: 559882 - DNA, 13 bp, D. melanogaster
aagcggcaaaagt

SEQ ID NO: 559883 - DNA, 13 bp, D. melanogaster
aagcggcaaaatg

SEQ ID NO: 559884 - DNA, 13 bp, D. melanogaster
aagcggcaacaac

SEQ ID NO: 559885 - DNA, 14 bp, D. melanogaster
aagcggcaacaaca

SEQ ID NO: 559886 - DNA, 13 bp, D. melanogaster
aagcggcaacaat

SEQ ID NO: 559887 - DNA, 13 bp, D. melanogaster
aagcggcagaaac

SEQ ID NO: 559888 - DNA, 14 bp, D. melanogaster
aagcggcagcaaca

SEQ ID NO: 559889 - DNA, 13 bp, D. melanogaster
aagcggcagcagc

SEQ ID NO: 559890 - DNA, 13 bp, D. melanogaster
aagcggcagcagg

SEQ ID NO: 559891 - DNA, 13 bp, D. melanogaster
aagcggcggaaaa

SEQ ID NO: 559892 - DNA, 13 bp, D. melanogaster
aagcgggaaaagc

SEQ ID NO: 559893 - DNA, 13 bp, D. melanogaster
aagcgggaaaatg

SEQ ID NO: 559894 - DNA, 14 bp, D. melanogaster
aagcgggaaagcgg

SEQ ID NO: 559895 - DNA, 13 bp, D. melanogaster
aagcgggcagaac

SEQ ID NO: 559896 - DNA, 13 bp, D. melanogaster
aagcgggccaaaa

SEQ ID NO: 559897 - DNA, 13 bp, D. melanogaster
aagcgggcggaaa

SEQ ID NO: 559898 - DNA, 13 bp, D. melanogaster
aagcggtggaaaa

SEQ ID NO: 559899 - DNA, 13 bp, D. melanogaster
aagcggtgtaacc

SEQ ID NO: 559900 - DNA, 13 bp, D. melanogaster
aagcgtaaacaaa

SEQ ID NO: 559901 - DNA, 13 bp, D. melanogaster
aagcgtaaataaa

SEQ ID NO: 559902 - DNA, 13 bp, D. melanogaster
aagcgtatgcaaa

SEQ ID NO: 559903 - DNA, 13 bp, D. melanogaster
aagcgtcagcttc

SEQ ID NO: 559904 - DNA, 13 bp, D. melanogaster
aagcgtgctcctt

SEQ ID NO: 559905 - DNA, 14 bp, D. melanogaster
aagctaaaaattaa

SEQ ID NO: 559906 - DNA, 13 bp, D. melanogaster
aagctaaaaattt

SEQ ID NO: 559907 - DNA, 13 bp, D. melanogaster
aagctaaaatatt

SEQ ID NO: 559908 - DNA, 13 bp, D. melanogaster
aagctaaacaaac

SEQ ID NO: 559909 - DNA, 13 bp, D. melanogaster
aagctaaactttt

SEQ ID NO: 559910 - DNA, 13 bp, D. melanogaster
aagctaaagctga

SEQ ID NO: 559911 - DNA, 13 bp, D. melanogaster
aagctaaaggaaa

SEQ ID NO: 559912 - DNA, 14 bp, D. melanogaster
aagctaaaggaaac

SEQ ID NO: 559913 - DNA, 13 bp, D. melanogaster
aagctaaaggaca

SEQ ID NO: 559914 - DNA, 13 bp, D. melanogaster
aagctaaataata

SEQ ID NO: 559915 - DNA, 13 bp, D. melanogaster
aagctaaatacaa

SEQ ID NO: 559916 - DNA, 13 bp, D. melanogaster
aagctaaatcaaa

SEQ ID NO: 559917 - DNA, 13 bp, D. melanogaster
aagctaaattgaa

SEQ ID NO: 559918 - DNA, 13 bp, D. melanogaster
aagctaacaaaat

SEQ ID NO: 559919 - DNA, 13 bp, D. melanogaster
aagctaaccaaat

SEQ ID NO: 559920 - DNA, 13 bp, D. melanogaster
aagctaacgaaaa

SEQ ID NO: 559921 - DNA, 13 bp, D. melanogaster
aagctaactaaaa

SEQ ID NO: 559922 - DNA, 13 bp, D. melanogaster
aagctaactttct

SEQ ID NO: 559923 - DNA, 13 bp, D. melanogaster
aagctaagaaaat

SEQ ID NO: 559924 - DNA, 13 bp, D. melanogaster
aagctaagataac

SEQ ID NO: 559925 - DNA, 13 bp, D. melanogaster
aagctaagtcagc

SEQ ID NO: 559926 - DNA, 13 bp, D. melanogaster
aagctaataaatt

SEQ ID NO: 559927 - DNA, 13 bp, D. melanogaster
aagctaatgaaaa

SEQ ID NO: 559928 - DNA, 13 bp, D. melanogaster
aagctaatgaatt

SEQ ID NO: 559929 - DNA, 13 bp, D. melanogaster
aagctaattaaat

SEQ ID NO: 559930 - DNA, 13 bp, D. melanogaster
aagctaatttgca

SEQ ID NO: 559931 - DNA, 13 bp, D. melanogaster
aagctacatacat

SEQ ID NO: 559932 - DNA, 13 bp, D. melanogaster
aagctactgaagt

SEQ ID NO: 559933 - DNA, 13 bp, D. melanogaster
aagctagaaagtt

SEQ ID NO: 559934 - DNA, 13 bp, D. melanogaster
aagctagaatgtt

SEQ ID NO: 559935 - DNA, 13 bp, D. melanogaster
aagctagataaaa

SEQ ID NO: 559936 - DNA, 13 bp, D. melanogaster
aagctataaaaat

SEQ ID NO: 559937 - DNA, 13 bp, D. melanogaster
aagctataaatat

SEQ ID NO: 559938 - DNA, 13 bp, D. melanogaster
aagctataattaa

SEQ ID NO: 559939 - DNA, 13 bp, D. melanogaster
aagctatgatttt

SEQ ID NO: 559940 - DNA, 13 bp, D. melanogaster
aagctatggaaaa

SEQ ID NO: 559941 - DNA, 13 bp, D. melanogaster
aagctattatttt

SEQ ID NO: 559942 - DNA, 13 bp, D. melanogaster
aagctatttaaaa

SEQ ID NO: 559943 - DNA, 13 bp, D. melanogaster
aagctatttaaat

SEQ ID NO: 559944 - DNA, 13 bp, D. melanogaster
aagctatttattt

SEQ ID NO: 559945 - DNA, 13 bp, D. melanogaster
aagctatttcttt

SEQ ID NO: 559946 - DNA, 13 bp, D. melanogaster
aagctatttttaa

SEQ ID NO: 559947 - DNA, 13 bp, D. melanogaster
aagctcaaaaact

SEQ ID NO: 559948 - DNA, 14 bp, D. melanogaster
aagctcaaaaacta

SEQ ID NO: 559949 - DNA, 13 bp, D. melanogaster
aagctcaaagaag

SEQ ID NO: 559950 - DNA, 13 bp, D. melanogaster
aagctcaattcct

SEQ ID NO: 559951 - DNA, 13 bp, D. melanogaster
aagctcaatttaa

SEQ ID NO: 559952 - DNA, 13 bp, D. melanogaster
aagctcacacaca

SEQ ID NO: 559953 - DNA, 14 bp, D. melanogaster
aagctcacacacac

SEQ ID NO: 559954 - DNA, 13 bp, D. melanogaster
aagctcaccttca

SEQ ID NO: 559955 - DNA, 13 bp, D. melanogaster
aagctcagccaaa

SEQ ID NO: 559956 - DNA, 13 bp, D. melanogaster
aagctcataaatt

SEQ ID NO: 559957 - DNA, 13 bp, D. melanogaster
aagctcatgcata

SEQ ID NO: 559958 - DNA, 14 bp, D. melanogaster
aagctcatggaggc

SEQ ID NO: 559959 - DNA, 13 bp, D. melanogaster
aagctcattaagt

SEQ ID NO: 559960 - DNA, 13 bp, D. melanogaster
aagctcatttaat

SEQ ID NO: 559961 - DNA, 13 bp, D. melanogaster
aagctcatttatt

SEQ ID NO: 559962 - DNA, 13 bp, D. melanogaster
aagctcattttaa

SEQ ID NO: 559963 - DNA, 13 bp, D. melanogaster
aagctccacaaat

SEQ ID NO: 559964 - DNA, 14 bp, D. melanogaster
aagctccagaacat

SEQ ID NO: 559965 - DNA, 14 bp, D. melanogaster
aagctcctggagaa

SEQ ID NO: 559966 - DNA, 13 bp, D. melanogaster
aagctcgaaaaat

SEQ ID NO: 559967 - DNA, 13 bp, D. melanogaster
aagctctatggct

SEQ ID NO: 559968 - DNA, 13 bp, D. melanogaster
aagctctttaatg

SEQ ID NO: 559969 - DNA, 13 bp, D. melanogaster
aagctgaaaaaat

SEQ ID NO: 559970 - DNA, 13 bp, D. melanogaster
aagctgaaaaact

SEQ ID NO: 559971 - DNA, 13 bp, D. melanogaster
aagctgaaaaagt

SEQ ID NO: 559972 - DNA, 13 bp, D. melanogaster
aagctgaaaaatt

SEQ ID NO: 559973 - DNA, 13 bp, D. melanogaster
aagctgaaaagca

SEQ ID NO: 559974 - DNA, 13 bp, D. melanogaster
aagctgaaaatgt

SEQ ID NO: 559975 - DNA, 13 bp, D. melanogaster
aagctgaaaattc

SEQ ID NO: 559976 - DNA, 13 bp, D. melanogaster
aagctgaaactga

SEQ ID NO: 559977 - DNA, 14 bp, D. melanogaster
aagctgaaactgaa

SEQ ID NO: 559978 - DNA, 13 bp, D. melanogaster
aagctgaaagaaa

SEQ ID NO: 559979 - DNA, 13 bp, D. melanogaster
aagctgaaataaa

SEQ ID NO: 559980 - DNA, 13 bp, D. melanogaster
aagctgaagaaaa

SEQ ID NO: 559981 - DNA, 14 bp, D. melanogaster
aagctgaagctgaa

SEQ ID NO: 559982 - DNA, 13 bp, D. melanogaster
aagctgaagctgc

SEQ ID NO: 559983 - DNA, 13 bp, D. melanogaster
aagctgaataaac

SEQ ID NO: 559984 - DNA, 13 bp, D. melanogaster
aagctgaattttt

SEQ ID NO: 559985 - DNA, 13 bp, D. melanogaster
aagctgacaaaaa

SEQ ID NO: 559986 - DNA, 13 bp, D. melanogaster
aagctgacaaatt

SEQ ID NO: 559987 - DNA, 13 bp, D. melanogaster
aagctgacatttt

SEQ ID NO: 559988 - DNA, 13 bp, D. melanogaster
aagctgacgctta

SEQ ID NO: 559989 - DNA, 13 bp, D. melanogaster
aagctgagatgta

SEQ ID NO: 559990 - DNA, 13 bp, D. melanogaster
aagctgaggaaaa

SEQ ID NO: 559991 - DNA, 13 bp, D. melanogaster
aagctgatctatg

SEQ ID NO: 559992 - DNA, 13 bp, D. melanogaster
aagctgattttaa

SEQ ID NO: 559993 - DNA, 13 bp, D. melanogaster
aagctgcaaaaac

SEQ ID NO: 559994 - DNA, 13 bp, D. melanogaster
aagctgcaaaagt

SEQ ID NO: 559995 - DNA, 13 bp, D. melanogaster
aagctgcaaacaa

SEQ ID NO: 559996 - DNA, 13 bp, D. melanogaster
aagctgcaactgc

SEQ ID NO: 559997 - DNA, 13 bp, D. melanogaster
aagctgcaagctg

SEQ ID NO: 559998 - DNA, 13 bp, D. melanogaster
aagctgcacaaaa

SEQ ID NO: 559999 - DNA, 13 bp, D. melanogaster
aagctgcagcagc

SEQ ID NO: 560000 - DNA, 14 bp, D. melanogaster
aagctgcagcagca

SEQ ID NO: 560001 - DNA, 13 bp, D. melanogaster
aagctgcagctgc

SEQ ID NO: 560002 - DNA, 14 bp, D. melanogaster
aagctgcagctgca

SEQ ID NO: 560003 - DNA, 13 bp, D. melanogaster
aagctgcatttaa

SEQ ID NO: 560004 - DNA, 13 bp, D. melanogaster
aagctgcatttgc

SEQ ID NO: 560005 - DNA, 13 bp, D. melanogaster
aagctgccaaaaa

SEQ ID NO: 560006 - DNA, 13 bp, D. melanogaster
aagctgccaaagt

SEQ ID NO: 560007 - DNA, 13 bp, D. melanogaster
aagctgccacgcc

SEQ ID NO: 560008 - DNA, 13 bp, D. melanogaster
aagctgccgacgg

SEQ ID NO: 560009 - DNA, 15 bp, D. melanogaster
aagctgccgacgggc

SEQ ID NO: 560010 - DNA, 13 bp, D. melanogaster
aagctgctcaaaa

SEQ ID NO: 560011 - DNA, 13 bp, D. melanogaster
aagctgctcgctt

SEQ ID NO: 560012 - DNA, 13 bp, D. melanogaster
aagctgctgcagc

SEQ ID NO: 560013 - DNA, 13 bp, D. melanogaster
aagctggaaaaaa

SEQ ID NO: 560014 - DNA, 13 bp, D. melanogaster
aagctggaaaagc

SEQ ID NO: 560015 - DNA, 14 bp, D. melanogaster
aagctggaaaagcg

SEQ ID NO: 560016 - DNA, 13 bp, D. melanogaster
aagctggaaaata

SEQ ID NO: 560017 - DNA, 13 bp, D. melanogaster
aagctggaaattt

SEQ ID NO: 560018 - DNA, 13 bp, D. melanogaster
aagctggacaaaa

SEQ ID NO: 560019 - DNA, 13 bp, D. melanogaster
aagctggagtgcc

SEQ ID NO: 560020 - DNA, 13 bp, D. melanogaster
aagctggcaaaag

SEQ ID NO: 560021 - DNA, 13 bp, D. melanogaster
aagctggcaaact

SEQ ID NO: 560022 - DNA, 13 bp, D. melanogaster
aagctggcaacaa

SEQ ID NO: 560023 - DNA, 13 bp, D. melanogaster
aagctggcatttt

SEQ ID NO: 560024 - DNA, 13 bp, D. melanogaster
aagctggccaagt

SEQ ID NO: 560025 - DNA, 13 bp, D. melanogaster
aagctggcgaaaa

SEQ ID NO: 560026 - DNA, 13 bp, D. melanogaster
aagctggctaaat

SEQ ID NO: 560027 - DNA, 13 bp, D. melanogaster
aagctggctgaaa

SEQ ID NO: 560028 - DNA, 13 bp, D. melanogaster
aagctgggaaaat

SEQ ID NO: 560029 - DNA, 13 bp, D. melanogaster
aagctgggaaagc

SEQ ID NO: 560030 - DNA, 13 bp, D. melanogaster
aagctggtgaaaa

SEQ ID NO: 560031 - DNA, 13 bp, D. melanogaster
aagctgtgcaaaa

SEQ ID NO: 560032 - DNA, 13 bp, D. melanogaster
aagctgttcatta

SEQ ID NO: 560033 - DNA, 13 bp, D. melanogaster
aagctgtttaaaa

SEQ ID NO: 560034 - DNA, 13 bp, D. melanogaster
aagctgtttaatt

SEQ ID NO: 560035 - DNA, 13 bp, D. melanogaster
aagctgtttgaaa

SEQ ID NO: 560036 - DNA, 14 bp, D. melanogaster
aagctgtttttttt

SEQ ID NO: 560037 - DNA, 13 bp, D. melanogaster
aagcttaaaaaca

SEQ ID NO: 560038 - DNA, 13 bp, D. melanogaster
aagcttaaaaata

SEQ ID NO: 560039 - DNA, 14 bp, D. melanogaster
aagcttaaaaataa

SEQ ID NO: 560040 - DNA, 13 bp, D. melanogaster
aagcttaaaaatt

SEQ ID NO: 560041 - DNA, 13 bp, D. melanogaster
aagcttaaactaa

SEQ ID NO: 560042 - DNA, 14 bp, D. melanogaster
aagcttaaatagtt

SEQ ID NO: 560043 - DNA, 13 bp, D. melanogaster
aagcttaacaagt

SEQ ID NO: 560044 - DNA, 13 bp, D. melanogaster
aagcttaagctta

SEQ ID NO: 560045 - DNA, 14 bp, D. melanogaster
aagcttaagcttaa

SEQ ID NO: 560046 - DNA, 14 bp, D. melanogaster
aagcttacaaataa

SEQ ID NO: 560047 - DNA, 13 bp, D. melanogaster
aagcttataactt

SEQ ID NO: 560048 - DNA, 13 bp, D. melanogaster
aagcttatattaa

SEQ ID NO: 560049 - DNA, 13 bp, D. melanogaster
aagcttatcggtc

SEQ ID NO: 560050 - DNA, 13 bp, D. melanogaster
aagcttattaatt

SEQ ID NO: 560051 - DNA, 13 bp, D. melanogaster
aagcttattcaaa

SEQ ID NO: 560052 - DNA, 13 bp, D. melanogaster
aagcttatttatt

SEQ ID NO: 560053 - DNA, 13 bp, D. melanogaster
aagcttcaaataa

SEQ ID NO: 560054 - DNA, 13 bp, D. melanogaster
aagcttctaaaag

SEQ ID NO: 560055 - DNA, 13 bp, D. melanogaster
aagcttctggccg

SEQ ID NO: 560056 - DNA, 13 bp, D. melanogaster
aagctttaaaata

SEQ ID NO: 560057 - DNA, 13 bp, D. melanogaster
aagctttaaagtt

SEQ ID NO: 560058 - DNA, 13 bp, D. melanogaster
aagctttaaatat

SEQ ID NO: 560059 - DNA, 13 bp, D. melanogaster
aagctttaaattt

SEQ ID NO: 560060 - DNA, 13 bp, D. melanogaster
aagctttaagttt

SEQ ID NO: 560061 - DNA, 13 bp, D. melanogaster
aagctttaatttt

SEQ ID NO: 560062 - DNA, 13 bp, D. melanogaster
aagctttacaaaa

SEQ ID NO: 560063 - DNA, 13 bp, D. melanogaster
aagctttagagat

SEQ ID NO: 560064 - DNA, 13 bp, D. melanogaster
aagctttataaat

SEQ ID NO: 560065 - DNA, 13 bp, D. melanogaster
aagctttatttaa

SEQ ID NO: 560066 - DNA, 13 bp, D. melanogaster
aagctttcagttt

SEQ ID NO: 560067 - DNA, 13 bp, D. melanogaster
aagcttttaaaaa

SEQ ID NO: 560068 - DNA, 13 bp, D. melanogaster
aagcttttaattg

SEQ ID NO: 560069 - DNA, 13 bp, D. melanogaster
aagcttttatatt

SEQ ID NO: 560070 - DNA, 13 bp, D. melanogaster
aagcttttattat

SEQ ID NO: 560071 - DNA, 13 bp, D. melanogaster
aagcttttccatt

SEQ ID NO: 560072 - DNA, 13 bp, D. melanogaster
aagcttttcttgg

SEQ ID NO: 560073 - DNA, 13 bp, D. melanogaster
aagcttttctttt

SEQ ID NO: 560074 - DNA, 13 bp, D. melanogaster
aagcttttgaaaa

SEQ ID NO: 560075 - DNA, 13 bp, D. melanogaster
aagcttttgttat

SEQ ID NO: 560076 - DNA, 13 bp, D. melanogaster
aagctttttaata

SEQ ID NO: 560077 - DNA, 13 bp, D. melanogaster
aagctttttctct

SEQ ID NO: 560078 - DNA, 13 bp, D. melanogaster
aaggaaaaaactt

SEQ ID NO: 560079 - DNA, 13 bp, D. melanogaster
aaggaaaaaccat

SEQ ID NO: 560080 - DNA, 13 bp, D. melanogaster
aaggaaaaactcg

SEQ ID NO: 560081 - DNA, 13 bp, D. melanogaster
aaggaaaaacttg

SEQ ID NO: 560082 - DNA, 13 bp, D. melanogaster
aaggaaaaacttt

SEQ ID NO: 560083 - DNA, 13 bp, D. melanogaster
aaggaaaaagtgt

SEQ ID NO: 560084 - DNA, 13 bp, D. melanogaster
aaggaaaacaagt

SEQ ID NO: 560085 - DNA, 14 bp, D. melanogaster
aaggaaaacaagta

SEQ ID NO: 560086 - DNA, 13 bp, D. melanogaster
aaggaaaacaatg

SEQ ID NO: 560087 - DNA, 13 bp, D. melanogaster
aaggaaaacacgt

SEQ ID NO: 560088 - DNA, 13 bp, D. melanogaster
aaggaaaacatta

SEQ ID NO: 560089 - DNA, 13 bp, D. melanogaster
aaggaaaacattt

SEQ ID NO: 560090 - DNA, 14 bp, D. melanogaster
aaggaaaacatttt

SEQ ID NO: 560091 - DNA, 13 bp, D. melanogaster
aaggaaaacgaat

SEQ ID NO: 560092 - DNA, 13 bp, D. melanogaster
aaggaaaactcaa

SEQ ID NO: 560093 - DNA, 13 bp, D. melanogaster
aaggaaaactgaa

SEQ ID NO: 560094 - DNA, 13 bp, D. melanogaster
aaggaaaactgca

SEQ ID NO: 560095 - DNA, 13 bp, D. melanogaster
aaggaaaagcaat

SEQ ID NO: 560096 - DNA, 13 bp, D. melanogaster
aaggaaaagccac

SEQ ID NO: 560097 - DNA, 13 bp, D. melanogaster
aaggaaaagcggc

SEQ ID NO: 560098 - DNA, 13 bp, D. melanogaster
aaggaaaagcttc

SEQ ID NO: 560099 - DNA, 13 bp, D. melanogaster
aaggaaaaggtca

SEQ ID NO: 560100 - DNA, 14 bp, D. melanogaster
aaggaaaaggtcac

SEQ ID NO: 560101 - DNA, 13 bp, D. melanogaster
aaggaaaagttta

SEQ ID NO: 560102 - DNA, 13 bp, D. melanogaster
aaggaaaagtttc

SEQ ID NO: 560103 - DNA, 13 bp, D. melanogaster
aaggaaaagtttt

SEQ ID NO: 560104 - DNA, 13 bp, D. melanogaster
aaggaaaataagc

SEQ ID NO: 560105 - DNA, 13 bp, D. melanogaster
aaggaaaatattt

SEQ ID NO: 560106 - DNA, 13 bp, D. melanogaster
aaggaaaatcaac

SEQ ID NO: 560107 - DNA, 13 bp, D. melanogaster
aaggaaaatcaat

SEQ ID NO: 560108 - DNA, 13 bp, D. melanogaster
aaggaaaatcgca

SEQ ID NO: 560109 - DNA, 13 bp, D. melanogaster
aaggaaaatgcaa

SEQ ID NO: 560110 - DNA, 13 bp, D. melanogaster
aaggaaaatgcca

SEQ ID NO: 560111 - DNA, 13 bp, D. melanogaster
aaggaaaatgcta

SEQ ID NO: 560112 - DNA, 13 bp, D. melanogaster
aaggaaaattgtt

SEQ ID NO: 560113 - DNA, 13 bp, D. melanogaster
aaggaaaattttt

SEQ ID NO: 560114 - DNA, 14 bp, D. melanogaster
aaggaaacattgca

SEQ ID NO: 560115 - DNA, 13 bp, D. melanogaster
aaggaaacatttt

SEQ ID NO: 560116 - DNA, 13 bp, D. melanogaster
aaggaaactaaat

SEQ ID NO: 560117 - DNA, 13 bp, D. melanogaster
aaggaaactcaaa

SEQ ID NO: 560118 - DNA, 13 bp, D. melanogaster
aaggaaagcgaca

SEQ ID NO: 560119 - DNA, 13 bp, D. melanogaster
aaggaaatattca

SEQ ID NO: 560120 - DNA, 13 bp, D. melanogaster
aaggaaatatttt

SEQ ID NO: 560121 - DNA, 14 bp, D. melanogaster
aaggaaatattttt

SEQ ID NO: 560122 - DNA, 13 bp, D. melanogaster
aaggaaatcaaag

SEQ ID NO: 560123 - DNA, 13 bp, D. melanogaster
aaggaaatcaaat

SEQ ID NO: 560124 - DNA, 13 bp, D. melanogaster
aaggaaatcaatt

SEQ ID NO: 560125 - DNA, 13 bp, D. melanogaster
aaggaaatcattt

SEQ ID NO: 560126 - DNA, 13 bp, D. melanogaster
aaggaaatcgaaa

SEQ ID NO: 560127 - DNA, 13 bp, D. melanogaster
aaggaaatcgatt

SEQ ID NO: 560128 - DNA, 13 bp, D. melanogaster
aaggaaatctgga

SEQ ID NO: 560129 - DNA, 13 bp, D. melanogaster
aaggaaatgaaac

SEQ ID NO: 560130 - DNA, 13 bp, D. melanogaster
aaggaaatgctgg

SEQ ID NO: 560131 - DNA, 14 bp, D. melanogaster
aaggaaatgctggc

SEQ ID NO: 560132 - DNA, 13 bp, D. melanogaster
aaggaaatgtcaa

SEQ ID NO: 560133 - DNA, 13 bp, D. melanogaster
aaggaaattaaac

SEQ ID NO: 560134 - DNA, 13 bp, D. melanogaster
aaggaaattaatg

SEQ ID NO: 560135 - DNA, 13 bp, D. melanogaster
aaggaaattagtt

SEQ ID NO: 560136 - DNA, 13 bp, D. melanogaster
aaggaaattatta

SEQ ID NO: 560137 - DNA, 13 bp, D. melanogaster
aaggaaattattt

SEQ ID NO: 560138 - DNA, 13 bp, D. melanogaster
aaggaaattcatt

SEQ ID NO: 560139 - DNA, 13 bp, D. melanogaster
aaggaaattgatt

SEQ ID NO: 560140 - DNA, 13 bp, D. melanogaster
aaggaaattggtt

SEQ ID NO: 560141 - DNA, 13 bp, D. melanogaster
aaggaaatttgtg

SEQ ID NO: 560142 - DNA, 13 bp, D. melanogaster
aaggaacctccac

SEQ ID NO: 560143 - DNA, 13 bp, D. melanogaster
aaggaactcagag

SEQ ID NO: 560144 - DNA, 13 bp, D. melanogaster
aaggaactgcaat

SEQ ID NO: 560145 - DNA, 15 bp, D. melanogaster
aaggaactgcaatgc

SEQ ID NO: 560146 - DNA, 13 bp, D. melanogaster
aaggaactttaaa

SEQ ID NO: 560147 - DNA, 13 bp, D. melanogaster
aaggaagacatta

SEQ ID NO: 560148 - DNA, 13 bp, D. melanogaster
aaggaagccatat

SEQ ID NO: 560149 - DNA, 13 bp, D. melanogaster
aaggaagcgtttt

SEQ ID NO: 560150 - DNA, 13 bp, D. melanogaster
aaggaagctaact

SEQ ID NO: 560151 - DNA, 13 bp, D. melanogaster
aaggaatactgcg

SEQ ID NO: 560152 - DNA, 13 bp, D. melanogaster
aaggaatatttat

SEQ ID NO: 560153 - DNA, 13 bp, D. melanogaster
aaggaatattttt

SEQ ID NO: 560154 - DNA, 13 bp, D. melanogaster
aaggaatgcttga

SEQ ID NO: 560155 - DNA, 13 bp, D. melanogaster
aaggaatggaatg

SEQ ID NO: 560156 - DNA, 13 bp, D. melanogaster
aaggaattcatca

SEQ ID NO: 560157 - DNA, 13 bp, D. melanogaster
aaggaattcattt

SEQ ID NO: 560158 - DNA, 13 bp, D. melanogaster
aaggaatttaaat

SEQ ID NO: 560159 - DNA, 13 bp, D. melanogaster
aaggaatttatta

SEQ ID NO: 560160 - DNA, 13 bp, D. melanogaster
aaggaatttcaat

SEQ ID NO: 560161 - DNA, 13 bp, D. melanogaster
aaggaatttgaat

SEQ ID NO: 560162 - DNA, 14 bp, D. melanogaster
aaggaatttgatga

SEQ ID NO: 560163 - DNA, 13 bp, D. melanogaster
aaggaatttgttt

SEQ ID NO: 560164 - DNA, 13 bp, D. melanogaster
aaggaattttaaa

SEQ ID NO: 560165 - DNA, 13 bp, D. melanogaster
aaggaatttttta

SEQ ID NO: 560166 - DNA, 13 bp, D. melanogaster
aaggacaaaggac

SEQ ID NO: 560167 - DNA, 13 bp, D. melanogaster
aaggacaacaatg

SEQ ID NO: 560168 - DNA, 13 bp, D. melanogaster
aaggacaacgcca

SEQ ID NO: 560169 - DNA, 14 bp, D. melanogaster
aaggacaacgccaa

SEQ ID NO: 560170 - DNA, 13 bp, D. melanogaster
aaggacaaggaca

SEQ ID NO: 560171 - DNA, 13 bp, D. melanogaster
aaggacaatcatg

SEQ ID NO: 560172 - DNA, 13 bp, D. melanogaster
aaggacaccagaa

SEQ ID NO: 560173 - DNA, 13 bp, D. melanogaster
aaggacatttgca

SEQ ID NO: 560174 - DNA, 13 bp, D. melanogaster
aaggacattttgg

SEQ ID NO: 560175 - DNA, 13 bp, D. melanogaster
aaggaccaaagga

SEQ ID NO: 560176 - DNA, 14 bp, D. melanogaster
aaggaccaaaggac

SEQ ID NO: 560177 - DNA, 13 bp, D. melanogaster
aaggaccaacaag

SEQ ID NO: 560178 - DNA, 13 bp, D. melanogaster
aaggaccaaggac

SEQ ID NO: 560179 - DNA, 13 bp, D. melanogaster
aaggaccaaggat

SEQ ID NO: 560180 - DNA, 13 bp, D. melanogaster
aaggacgaaggac

SEQ ID NO: 560181 - DNA, 14 bp, D. melanogaster
aaggacgaaggact

SEQ ID NO: 560182 - DNA, 14 bp, D. melanogaster
aaggacgaaggatg

SEQ ID NO: 560183 - DNA, 13 bp, D. melanogaster
aaggacgataagt

SEQ ID NO: 560184 - DNA, 13 bp, D. melanogaster
aaggacgcaggac

SEQ ID NO: 560185 - DNA, 13 bp, D. melanogaster
aaggagatatccg

SEQ ID NO: 560186 - DNA, 14 bp, D. melanogaster
aaggagatcaagaa

SEQ ID NO: 560187 - DNA, 13 bp, D. melanogaster
aaggagcagcagc

SEQ ID NO: 560188 - DNA, 13 bp, D. melanogaster
aaggagcagcagg

SEQ ID NO: 560189 - DNA, 14 bp, D. melanogaster
aaggagcagcagga

SEQ ID NO: 560190 - DNA, 13 bp, D. melanogaster
aaggagcagccta

SEQ ID NO: 560191 - DNA, 14 bp, D. melanogaster
aaggagcagcctac

SEQ ID NO: 560192 - DNA, 13 bp, D. melanogaster
aaggagccaagga

SEQ ID NO: 560193 - DNA, 13 bp, D. melanogaster
aaggagctgaaaa

SEQ ID NO: 560194 - DNA, 13 bp, D. melanogaster
aaggagctgcagg

SEQ ID NO: 560195 - DNA, 14 bp, D. melanogaster
aaggagctgcagga

SEQ ID NO: 560196 - DNA, 16 bp, D. melanogaster
aaggagctggagtttg

SEQ ID NO: 560197 - DNA, 13 bp, D. melanogaster
aaggaggaagatt

SEQ ID NO: 560198 - DNA, 13 bp, D. melanogaster
aaggaggatgtca

SEQ ID NO: 560199 - DNA, 13 bp, D. melanogaster
aaggaggccacac

SEQ ID NO: 560200 - DNA, 13 bp, D. melanogaster
aaggaggtgtata

SEQ ID NO: 560201 - DNA, 14 bp, D. melanogaster
aaggaggttgagaa

SEQ ID NO: 560202 - DNA, 13 bp, D. melanogaster
aaggagtaaccac

SEQ ID NO: 560203 - DNA, 13 bp, D. melanogaster
aaggagtcctttg

SEQ ID NO: 560204 - DNA, 14 bp, D. melanogaster
aaggagtcctttgt

SEQ ID NO: 560205 - DNA, 13 bp, D. melanogaster
aaggagttgaaat

SEQ ID NO: 560206 - DNA, 13 bp, D. melanogaster
aaggataaaggat

SEQ ID NO: 560207 - DNA, 13 bp, D. melanogaster
aaggataacaaca

SEQ ID NO: 560208 - DNA, 13 bp, D. melanogaster
aaggatatacaaa

SEQ ID NO: 560209 - DNA, 13 bp, D. melanogaster
aaggatatatatt

SEQ ID NO: 560210 - DNA, 13 bp, D. melanogaster
aaggatatctata

SEQ ID NO: 560211 - DNA, 13 bp, D. melanogaster
aaggatatgcaaa

SEQ ID NO: 560212 - DNA, 13 bp, D. melanogaster
aaggatattcaaa

SEQ ID NO: 560213 - DNA, 13 bp, D. melanogaster
aaggatatttcaa

SEQ ID NO: 560214 - DNA, 13 bp, D. melanogaster
aaggatattttct

SEQ ID NO: 560215 - DNA, 13 bp, D. melanogaster
aaggatcaattga

SEQ ID NO: 560216 - DNA, 13 bp, D. melanogaster
aaggatcatcaaa

SEQ ID NO: 560217 - DNA, 13 bp, D. melanogaster
aaggatccaggct

SEQ ID NO: 560218 - DNA, 13 bp, D. melanogaster
aaggatcttaagt

SEQ ID NO: 560219 - DNA, 13 bp, D. melanogaster
aaggatgaaggac

SEQ ID NO: 560220 - DNA, 13 bp, D. melanogaster
aaggatgaggatg

SEQ ID NO: 560221 - DNA, 13 bp, D. melanogaster
aaggatgctgaaa

SEQ ID NO: 560222 - DNA, 13 bp, D. melanogaster
aaggatgggcaaa

SEQ ID NO: 560223 - DNA, 13 bp, D. melanogaster
aaggatgtgtgtg

SEQ ID NO: 560224 - DNA, 13 bp, D. melanogaster
aaggatgttcgca

SEQ ID NO: 560225 - DNA, 13 bp, D. melanogaster
aaggattggatag

SEQ ID NO: 560226 - DNA, 13 bp, D. melanogaster
aaggatttaaata

SEQ ID NO: 560227 - DNA, 13 bp, D. melanogaster
aaggatttcaaat

SEQ ID NO: 560228 - DNA, 13 bp, D. melanogaster
aaggatttctgca

SEQ ID NO: 560229 - DNA, 13 bp, D. melanogaster
aaggatttgacaa

SEQ ID NO: 560230 - DNA, 14 bp, D. melanogaster
aaggattttcggtc

SEQ ID NO: 560231 - DNA, 13 bp, D. melanogaster
aaggattttgaaa

SEQ ID NO: 560232 - DNA, 13 bp, D. melanogaster
aaggatttttaaa

SEQ ID NO: 560233 - DNA, 13 bp, D. melanogaster
aaggcaaaaagtg

SEQ ID NO: 560234 - DNA, 13 bp, D. melanogaster
aaggcaaaacttt

SEQ ID NO: 560235 - DNA, 13 bp, D. melanogaster
aaggcaaaagcag

SEQ ID NO: 560236 - DNA, 13 bp, D. melanogaster
aaggcaaaagccg

SEQ ID NO: 560237 - DNA, 13 bp, D. melanogaster
aaggcaaaattat

SEQ ID NO: 560238 - DNA, 14 bp, D. melanogaster
aaggcaaacaaaat

SEQ ID NO: 560239 - DNA, 13 bp, D. melanogaster
aaggcaaacaaat

SEQ ID NO: 560240 - DNA, 14 bp, D. melanogaster
aaggcaaacaaatg

SEQ ID NO: 560241 - DNA, 13 bp, D. melanogaster
aaggcaaacaagc

SEQ ID NO: 560242 - DNA, 13 bp, D. melanogaster
aaggcaaacaatg

SEQ ID NO: 560243 - DNA, 13 bp, D. melanogaster
aaggcaaacacac

SEQ ID NO: 560244 - DNA, 13 bp, D. melanogaster
aaggcaaacagca

SEQ ID NO: 560245 - DNA, 13 bp, D. melanogaster
aaggcaaacgcaa

SEQ ID NO: 560246 - DNA, 13 bp, D. melanogaster
aaggcaaacggaa

SEQ ID NO: 560247 - DNA, 13 bp, D. melanogaster
aaggcaaagtcaa

SEQ ID NO: 560248 - DNA, 13 bp, D. melanogaster
aaggcaaataaat

SEQ ID NO: 560249 - DNA, 13 bp, D. melanogaster
aaggcaaatattt

SEQ ID NO: 560250 - DNA, 14 bp, D. melanogaster
aaggcaaatatttt

SEQ ID NO: 560251 - DNA, 13 bp, D. melanogaster
aaggcaaatcaaa

SEQ ID NO: 560252 - DNA, 14 bp, D. melanogaster
aaggcaaatcaaat

SEQ ID NO: 560253 - DNA, 13 bp, D. melanogaster
aaggcaaatgttt

SEQ ID NO: 560254 - DNA, 13 bp, D. melanogaster
aaggcaaattaaa

SEQ ID NO: 560255 - DNA, 14 bp, D. melanogaster
aaggcaaattgaaa

SEQ ID NO: 560256 - DNA, 13 bp, D. melanogaster
aaggcaaatttaa

SEQ ID NO: 560257 - DNA, 13 bp, D. melanogaster
aaggcaacatttt

SEQ ID NO: 560258 - DNA, 13 bp, D. melanogaster
aaggcaaccgaaa

SEQ ID NO: 560259 - DNA, 13 bp, D. melanogaster
aaggcaaccgagg

SEQ ID NO: 560260 - DNA, 13 bp, D. melanogaster
aaggcaacgataa

SEQ ID NO: 560261 - DNA, 13 bp, D. melanogaster
aaggcaactaagt

SEQ ID NO: 560262 - DNA, 13 bp, D. melanogaster
aaggcaactgcaa

SEQ ID NO: 560263 - DNA, 13 bp, D. melanogaster
aaggcaacttttt

SEQ ID NO: 560264 - DNA, 13 bp, D. melanogaster
aaggcaagaaaat

SEQ ID NO: 560265 - DNA, 13 bp, D. melanogaster
aaggcaagcaaat

SEQ ID NO: 560266 - DNA, 13 bp, D. melanogaster
aaggcaagccaaa

SEQ ID NO: 560267 - DNA, 13 bp, D. melanogaster
aaggcaataaatt

SEQ ID NO: 560268 - DNA, 13 bp, D. melanogaster
aaggcaataacaa

SEQ ID NO: 560269 - DNA, 13 bp, D. melanogaster
aaggcaatcaaaa

SEQ ID NO: 560270 - DNA, 13 bp, D. melanogaster
aaggcaatcaaat

SEQ ID NO: 560271 - DNA, 13 bp, D. melanogaster
aaggcaatgacaa

SEQ ID NO: 560272 - DNA, 13 bp, D. melanogaster
aaggcaatgcaaa

SEQ ID NO: 560273 - DNA, 14 bp, D. melanogaster
aaggcaatgcaaaa

SEQ ID NO: 560274 - DNA, 13 bp, D. melanogaster
aaggcaatggcaa

SEQ ID NO: 560275 - DNA, 13 bp, D. melanogaster
aaggcaattattt

SEQ ID NO: 560276 - DNA, 13 bp, D. melanogaster
aaggcaattcaaa

SEQ ID NO: 560277 - DNA, 13 bp, D. melanogaster
aaggcaatttacg

SEQ ID NO: 560278 - DNA, 13 bp, D. melanogaster
aaggcacacaaat

SEQ ID NO: 560279 - DNA, 13 bp, D. melanogaster
aaggcacttccag

SEQ ID NO: 560280 - DNA, 13 bp, D. melanogaster
aaggcacttttgt

SEQ ID NO: 560281 - DNA, 13 bp, D. melanogaster
aaggcagcaacaa

SEQ ID NO: 560282 - DNA, 14 bp, D. melanogaster
aaggcagcaacaac

SEQ ID NO: 560283 - DNA, 13 bp, D. melanogaster
aaggcagcagaaa

SEQ ID NO: 560284 - DNA, 13 bp, D. melanogaster
aaggcagcaggaa

SEQ ID NO: 560285 - DNA, 13 bp, D. melanogaster
aaggcagccaaat

SEQ ID NO: 560286 - DNA, 13 bp, D. melanogaster
aaggcagccgaaa

SEQ ID NO: 560287 - DNA, 13 bp, D. melanogaster
aaggcagccgtcg

SEQ ID NO: 560288 - DNA, 13 bp, D. melanogaster
aaggcagcggaaa

SEQ ID NO: 560289 - DNA, 13 bp, D. melanogaster
aaggcagcggcaa

SEQ ID NO: 560290 - DNA, 13 bp, D. melanogaster
aaggcagcgttct

SEQ ID NO: 560291 - DNA, 13 bp, D. melanogaster
aaggcaggcaggc

SEQ ID NO: 560292 - DNA, 13 bp, D. melanogaster
aaggcatacaaaa

SEQ ID NO: 560293 - DNA, 13 bp, D. melanogaster
aaggcatacaaat

SEQ ID NO: 560294 - DNA, 13 bp, D. melanogaster
aaggcatacatat

SEQ ID NO: 560295 - DNA, 13 bp, D. melanogaster
aaggcatatcact

SEQ ID NO: 560296 - DNA, 13 bp, D. melanogaster
aaggcatctggat

SEQ ID NO: 560297 - DNA, 14 bp, D. melanogaster
aaggcatctggatc

SEQ ID NO: 560298 - DNA, 13 bp, D. melanogaster
aaggcatgcaaat

SEQ ID NO: 560299 - DNA, 13 bp, D. melanogaster
aaggcattaaaaa

SEQ ID NO: 560300 - DNA, 13 bp, D. melanogaster
aaggcattaaaat

SEQ ID NO: 560301 - DNA, 13 bp, D. melanogaster
aaggcattgaaaa

SEQ ID NO: 560302 - DNA, 13 bp, D. melanogaster
aaggcatttcaaa

SEQ ID NO: 560303 - DNA, 13 bp, D. melanogaster
aaggcattttaat

SEQ ID NO: 560304 - DNA, 13 bp, D. melanogaster
aaggcattttggt

SEQ ID NO: 560305 - DNA, 13 bp, D. melanogaster
aaggccaaaaact

SEQ ID NO: 560306 - DNA, 13 bp, D. melanogaster
aaggccaaaagca

SEQ ID NO: 560307 - DNA, 13 bp, D. melanogaster
aaggccaacaaat

SEQ ID NO: 560308 - DNA, 13 bp, D. melanogaster
aaggccaatcaaa

SEQ ID NO: 560309 - DNA, 13 bp, D. melanogaster
aaggccacaaagt

SEQ ID NO: 560310 - DNA, 13 bp, D. melanogaster
aaggccagtcaaa

SEQ ID NO: 560311 - DNA, 13 bp, D. melanogaster
aaggccagtgcag

SEQ ID NO: 560312 - DNA, 13 bp, D. melanogaster
aaggccatgtcgg

SEQ ID NO: 560313 - DNA, 13 bp, D. melanogaster
aaggccgtggcca

SEQ ID NO: 560314 - DNA, 13 bp, D. melanogaster
aaggcctgaaaac

SEQ ID NO: 560315 - DNA, 13 bp, D. melanogaster
aaggcgaaaaaat

SEQ ID NO: 560316 - DNA, 14 bp, D. melanogaster
aaggcgaaaaaatt

SEQ ID NO: 560317 - DNA, 13 bp, D. melanogaster
aaggcgaaaagcg

SEQ ID NO: 560318 - DNA, 13 bp, D. melanogaster
aaggcgaaaggca

SEQ ID NO: 560319 - DNA, 13 bp, D. melanogaster
aaggcgaaagtaa

SEQ ID NO: 560320 - DNA, 13 bp, D. melanogaster
aaggcgaaggcaa

SEQ ID NO: 560321 - DNA, 13 bp, D. melanogaster
aaggcgaaggcga

SEQ ID NO: 560322 - DNA, 14 bp, D. melanogaster
aaggcgaaggcgaa

SEQ ID NO: 560323 - DNA, 13 bp, D. melanogaster
aaggcggaggagt

SEQ ID NO: 560324 - DNA, 14 bp, D. melanogaster
aaggcggaggagtt

SEQ ID NO: 560325 - DNA, 13 bp, D. melanogaster
aaggcggcaacaa

SEQ ID NO: 560326 - DNA, 13 bp, D. melanogaster
aaggctcggaaaa

SEQ ID NO: 560327 - DNA, 13 bp, D. melanogaster
aaggctggcaaca

SEQ ID NO: 560328 - DNA, 13 bp, D. melanogaster
aaggctgtattag

SEQ ID NO: 560329 - DNA, 13 bp, D. melanogaster
aaggcttaaaaaa

SEQ ID NO: 560330 - DNA, 13 bp, D. melanogaster
aaggcttgggaaa

SEQ ID NO: 560331 - DNA, 13 bp, D. melanogaster
aaggctttaacta

SEQ ID NO: 560332 - DNA, 13 bp, D. melanogaster
aaggctttgataa

SEQ ID NO: 560333 - DNA, 15 bp, D. melanogaster
aaggcttttaagttt

SEQ ID NO: 560334 - DNA, 13 bp, D. melanogaster
aagggaaaacatt

SEQ ID NO: 560335 - DNA, 13 bp, D. melanogaster
aagggaaaactct

SEQ ID NO: 560336 - DNA, 13 bp, D. melanogaster
aagggaaaactgc

SEQ ID NO: 560337 - DNA, 14 bp, D. melanogaster
aagggaaaactttt

SEQ ID NO: 560338 - DNA, 13 bp, D. melanogaster
aagggaaaataca

SEQ ID NO: 560339 - DNA, 13 bp, D. melanogaster
aagggaaaattca

SEQ ID NO: 560340 - DNA, 13 bp, D. melanogaster
aagggaaaattgt

SEQ ID NO: 560341 - DNA, 13 bp, D. melanogaster
aagggaaaattta

SEQ ID NO: 560342 - DNA, 13 bp, D. melanogaster
aagggaaactttt

SEQ ID NO: 560343 - DNA, 13 bp, D. melanogaster
aagggaaatccaa

SEQ ID NO: 560344 - DNA, 14 bp, D. melanogaster
aagggaaattcaaa

SEQ ID NO: 560345 - DNA, 13 bp, D. melanogaster
aagggaaggcagc

SEQ ID NO: 560346 - DNA, 13 bp, D. melanogaster
aagggaataccca

SEQ ID NO: 560347 - DNA, 13 bp, D. melanogaster
aagggaattcaaa

SEQ ID NO: 560348 - DNA, 13 bp, D. melanogaster
aagggacagtgtc

SEQ ID NO: 560349 - DNA, 13 bp, D. melanogaster
aagggacatggaa

SEQ ID NO: 560350 - DNA, 13 bp, D. melanogaster
aagggagtcagga

SEQ ID NO: 560351 - DNA, 15 bp, D. melanogaster
aagggatcaggcaac

SEQ ID NO: 560352 - DNA, 13 bp, D. melanogaster
aagggatctgcca

SEQ ID NO: 560353 - DNA, 13 bp, D. melanogaster
aagggcaaatagt

SEQ ID NO: 560354 - DNA, 13 bp, D. melanogaster
aagggcaaggaca

SEQ ID NO: 560355 - DNA, 14 bp, D. melanogaster
aagggcaaggacaa

SEQ ID NO: 560356 - DNA, 13 bp, D. melanogaster
aagggcaatcaat

SEQ ID NO: 560357 - DNA, 13 bp, D. melanogaster
aagggcgattcca

SEQ ID NO: 560358 - DNA, 13 bp, D. melanogaster
aaggggaatgatg

SEQ ID NO: 560359 - DNA, 13 bp, D. melanogaster
aaggggattcccc

SEQ ID NO: 560360 - DNA, 14 bp, D. melanogaster
aaggggcgtggcag

SEQ ID NO: 560361 - DNA, 13 bp, D. melanogaster
aaggggcgtggcc

SEQ ID NO: 560362 - DNA, 14 bp, D. melanogaster
aaggggcgtggcca

SEQ ID NO: 560363 - DNA, 14 bp, D. melanogaster
aaggggcgtggccg

SEQ ID NO: 560364 - DNA, 13 bp, D. melanogaster
aaggggcgtggct

SEQ ID NO: 560365 - DNA, 13 bp, D. melanogaster
aagggggcggtgc

SEQ ID NO: 560366 - DNA, 13 bp, D. melanogaster
aagggggcgtggc

SEQ ID NO: 560367 - DNA, 14 bp, D. melanogaster
aagggggcgtggca

SEQ ID NO: 560368 - DNA, 14 bp, D. melanogaster
aagggggcgtggcg

SEQ ID NO: 560369 - DNA, 13 bp, D. melanogaster
aagggggcgtggt

SEQ ID NO: 560370 - DNA, 13 bp, D. melanogaster
aaggggtaacatc

SEQ ID NO: 560371 - DNA, 13 bp, D. melanogaster
aaggggttaaggg

SEQ ID NO: 560372 - DNA, 13 bp, D. melanogaster
aaggggtttgatg

SEQ ID NO: 560373 - DNA, 13 bp, D. melanogaster
aagggtaagaact

SEQ ID NO: 560374 - DNA, 13 bp, D. melanogaster
aagggtattaaaa

SEQ ID NO: 560375 - DNA, 13 bp, D. melanogaster
aagggtattcaaa

SEQ ID NO: 560376 - DNA, 13 bp, D. melanogaster
aagggtcaaaacc

SEQ ID NO: 560377 - DNA, 13 bp, D. melanogaster
aagggttaaaggg

SEQ ID NO: 560378 - DNA, 13 bp, D. melanogaster
aagggttaagggt

SEQ ID NO: 560379 - DNA, 13 bp, D. melanogaster
aagggttttttgc

SEQ ID NO: 560380 - DNA, 13 bp, D. melanogaster
aaggtaaaggtaa

SEQ ID NO: 560381 - DNA, 13 bp, D. melanogaster
aaggtaacaacaa

SEQ ID NO: 560382 - DNA, 13 bp, D. melanogaster
aaggtaaggaaca

SEQ ID NO: 560383 - DNA, 13 bp, D. melanogaster
aaggtaattgaaa

SEQ ID NO: 560384 - DNA, 13 bp, D. melanogaster
aaggtagcaaaaa

SEQ ID NO: 560385 - DNA, 13 bp, D. melanogaster
aaggtataaacaa

SEQ ID NO: 560386 - DNA, 13 bp, D. melanogaster
aaggtatcaaaag

SEQ ID NO: 560387 - DNA, 13 bp, D. melanogaster
aaggtatccctaa

SEQ ID NO: 560388 - DNA, 13 bp, D. melanogaster
aaggtattcttaa

SEQ ID NO: 560389 - DNA, 13 bp, D. melanogaster
aaggtatttaaaa

SEQ ID NO: 560390 - DNA, 13 bp, D. melanogaster
aaggtatttaaat

SEQ ID NO: 560391 - DNA, 13 bp, D. melanogaster
aaggtatttattt

SEQ ID NO: 560392 - DNA, 13 bp, D. melanogaster
aaggtattttaaa

SEQ ID NO: 560393 - DNA, 13 bp, D. melanogaster
aaggtcaagaaat

SEQ ID NO: 560394 - DNA, 14 bp, D. melanogaster
aaggtcaagaaata

SEQ ID NO: 560395 - DNA, 13 bp, D. melanogaster
aaggtctcgtttc

SEQ ID NO: 560396 - DNA, 13 bp, D. melanogaster
aaggtgaaagtaa

SEQ ID NO: 560397 - DNA, 13 bp, D. melanogaster
aaggtgacatcct

SEQ ID NO: 560398 - DNA, 13 bp, D. melanogaster
aaggtgcccaaat

SEQ ID NO: 560399 - DNA, 13 bp, D. melanogaster
aaggtgctgcaaa

SEQ ID NO: 560400 - DNA, 14 bp, D. melanogaster
aaggtggcaaaaag

SEQ ID NO: 560401 - DNA, 13 bp, D. melanogaster
aaggtgggcaatc

SEQ ID NO: 560402 - DNA, 13 bp, D. melanogaster
aaggtggtgaaat

SEQ ID NO: 560403 - DNA, 13 bp, D. melanogaster
aaggtgtgaaaat

SEQ ID NO: 560404 - DNA, 13 bp, D. melanogaster
aaggtgtgggcgt

SEQ ID NO: 560405 - DNA, 13 bp, D. melanogaster
aaggttcagagtc

SEQ ID NO: 560406 - DNA, 13 bp, D. melanogaster
aaggttgagatta

SEQ ID NO: 560407 - DNA, 13 bp, D. melanogaster
aaggttgtctaca

SEQ ID NO: 560408 - DNA, 13 bp, D. melanogaster
aaggttttgtaaa

SEQ ID NO: 560409 - DNA, 14 bp, D. melanogaster
aaggttttgtaaag

SEQ ID NO: 560410 - DNA, 13 bp, D. melanogaster
aaggtttttaaaa

SEQ ID NO: 560411 - DNA, 13 bp, D. melanogaster
aaggtttttaaat

SEQ ID NO: 560412 - DNA, 13 bp, D. melanogaster
aaggtttttaagt

SEQ ID NO: 560413 - DNA, 13 bp, D. melanogaster
aaggtttttaatt

SEQ ID NO: 560414 - DNA, 13 bp, D. melanogaster
aaggtttttgaaa

SEQ ID NO: 560415 - DNA, 13 bp, D. melanogaster
aagtaaaaactca

SEQ ID NO: 560416 - DNA, 13 bp, D. melanogaster
aagtaaaaagttt

SEQ ID NO: 560417 - DNA, 13 bp, D. melanogaster
aagtaaaacaatt

SEQ ID NO: 560418 - DNA, 14 bp, D. melanogaster
aagtaaaacatttt

SEQ ID NO: 560419 - DNA, 14 bp, D. melanogaster
aagtaaaaccaaca

SEQ ID NO: 560420 - DNA, 14 bp, D. melanogaster
aagtaaaactgaaa

SEQ ID NO: 560421 - DNA, 13 bp, D. melanogaster
aagtaaaacttat

SEQ ID NO: 560422 - DNA, 13 bp, D. melanogaster
aagtaaaagggta

SEQ ID NO: 560423 - DNA, 14 bp, D. melanogaster
aagtaaaagggtat

SEQ ID NO: 560424 - DNA, 13 bp, D. melanogaster
aagtaaaagtatt

SEQ ID NO: 560425 - DNA, 13 bp, D. melanogaster
aagtaaaagtgtt

SEQ ID NO: 560426 - DNA, 13 bp, D. melanogaster
aagtaaaatacat

SEQ ID NO: 560427 - DNA, 13 bp, D. melanogaster
aagtaaaatattg

SEQ ID NO: 560428 - DNA, 13 bp, D. melanogaster
aagtaaaatgatt

SEQ ID NO: 560429 - DNA, 13 bp, D. melanogaster
aagtaaaatgttt

SEQ ID NO: 560430 - DNA, 13 bp, D. melanogaster
aagtaaacaaacg

SEQ ID NO: 560431 - DNA, 13 bp, D. melanogaster
aagtaaacaaagt

SEQ ID NO: 560432 - DNA, 13 bp, D. melanogaster
aagtaaacaaatg

SEQ ID NO: 560433 - DNA, 13 bp, D. melanogaster
aagtaaacattaa

SEQ ID NO: 560434 - DNA, 13 bp, D. melanogaster
aagtaaacattta

SEQ ID NO: 560435 - DNA, 14 bp, D. melanogaster
aagtaaacattttt

SEQ ID NO: 560436 - DNA, 13 bp, D. melanogaster
aagtaaaccaaat

SEQ ID NO: 560437 - DNA, 13 bp, D. melanogaster
aagtaaacgagca

SEQ ID NO: 560438 - DNA, 13 bp, D. melanogaster
aagtaaactaaat

SEQ ID NO: 560439 - DNA, 13 bp, D. melanogaster
aagtaaacttttc

SEQ ID NO: 560440 - DNA, 13 bp, D. melanogaster
aagtaaagctcaa

SEQ ID NO: 560441 - DNA, 14 bp, D. melanogaster
aagtaaagtaaagt

SEQ ID NO: 560442 - DNA, 13 bp, D. melanogaster
aagtaaagtaatt

SEQ ID NO: 560443 - DNA, 13 bp, D. melanogaster
aagtaaataagct

SEQ ID NO: 560444 - DNA, 13 bp, D. melanogaster
aagtaaatacttt

SEQ ID NO: 560445 - DNA, 13 bp, D. melanogaster
aagtaaatatgca

SEQ ID NO: 560446 - DNA, 13 bp, D. melanogaster
aagtaaatattgt

SEQ ID NO: 560447 - DNA, 13 bp, D. melanogaster
aagtaaatctatt

SEQ ID NO: 560448 - DNA, 13 bp, D. melanogaster
aagtaaatgcatt

SEQ ID NO: 560449 - DNA, 13 bp, D. melanogaster
aagtaaatggttt

SEQ ID NO: 560450 - DNA, 13 bp, D. melanogaster
aagtaaatgttat

SEQ ID NO: 560451 - DNA, 13 bp, D. melanogaster
aagtaaattactt

SEQ ID NO: 560452 - DNA, 13 bp, D. melanogaster
aagtaaatttaac

SEQ ID NO: 560453 - DNA, 14 bp, D. melanogaster
aagtaaatttaaca

SEQ ID NO: 560454 - DNA, 13 bp, D. melanogaster
aagtaaatttaag

SEQ ID NO: 560455 - DNA, 13 bp, D. melanogaster
aagtaacatattt

SEQ ID NO: 560456 - DNA, 13 bp, D. melanogaster
aagtaacatttaa

SEQ ID NO: 560457 - DNA, 13 bp, D. melanogaster
aagtaaccaagtt

SEQ ID NO: 560458 - DNA, 13 bp, D. melanogaster
aagtaacgggtat

SEQ ID NO: 560459 - DNA, 13 bp, D. melanogaster
aagtaactttaaa

SEQ ID NO: 560460 - DNA, 13 bp, D. melanogaster
aagtaagccaaaa

SEQ ID NO: 560461 - DNA, 13 bp, D. melanogaster
aagtaataaacat

SEQ ID NO: 560462 - DNA, 13 bp, D. melanogaster
aagtaatacaaag

SEQ ID NO: 560463 - DNA, 13 bp, D. melanogaster
aagtaatacaaat

SEQ ID NO: 560464 - DNA, 13 bp, D. melanogaster
aagtaatacattt

SEQ ID NO: 560465 - DNA, 13 bp, D. melanogaster
aagtaatagctga

SEQ ID NO: 560466 - DNA, 13 bp, D. melanogaster
aagtaatattttg

SEQ ID NO: 560467 - DNA, 13 bp, D. melanogaster
aagtaatcaaata

SEQ ID NO: 560468 - DNA, 13 bp, D. melanogaster
aagtaattaaaac

SEQ ID NO: 560469 - DNA, 13 bp, D. melanogaster
aagtaattctttt

SEQ ID NO: 560470 - DNA, 13 bp, D. melanogaster
aagtaattgaaat

SEQ ID NO: 560471 - DNA, 13 bp, D. melanogaster
aagtaattgattt

SEQ ID NO: 560472 - DNA, 14 bp, D. melanogaster
aagtaattgcaatt

SEQ ID NO: 560473 - DNA, 13 bp, D. melanogaster
aagtaattgtaat

SEQ ID NO: 560474 - DNA, 13 bp, D. melanogaster
aagtaattgttaa

SEQ ID NO: 560475 - DNA, 13 bp, D. melanogaster
aagtaatttgcaa

SEQ ID NO: 560476 - DNA, 13 bp, D. melanogaster
aagtaatttgcat

SEQ ID NO: 560477 - DNA, 14 bp, D. melanogaster
aagtaatttgcata

SEQ ID NO: 560478 - DNA, 13 bp, D. melanogaster
aagtaattttctc

SEQ ID NO: 560479 - DNA, 13 bp, D. melanogaster
aagtacaaaaatg

SEQ ID NO: 560480 - DNA, 13 bp, D. melanogaster
aagtacaaaagta

SEQ ID NO: 560481 - DNA, 13 bp, D. melanogaster
aagtacaaatgca

SEQ ID NO: 560482 - DNA, 13 bp, D. melanogaster
aagtacaagtaca

SEQ ID NO: 560483 - DNA, 14 bp, D. melanogaster
aagtacaataaaat

SEQ ID NO: 560484 - DNA, 13 bp, D. melanogaster
aagtacaatttat

SEQ ID NO: 560485 - DNA, 13 bp, D. melanogaster
aagtacacaaaat

SEQ ID NO: 560486 - DNA, 14 bp, D. melanogaster
aagtacacaaaatg

SEQ ID NO: 560487 - DNA, 13 bp, D. melanogaster
aagtacacacaaa

SEQ ID NO: 560488 - DNA, 13 bp, D. melanogaster
aagtacacacaca

SEQ ID NO: 560489 - DNA, 13 bp, D. melanogaster
aagtacacagaaa

SEQ ID NO: 560490 - DNA, 13 bp, D. melanogaster
aagtacacataaa

SEQ ID NO: 560491 - DNA, 13 bp, D. melanogaster
aagtacaggaaat

SEQ ID NO: 560492 - DNA, 13 bp, D. melanogaster
aagtacagtgaag

SEQ ID NO: 560493 - DNA, 13 bp, D. melanogaster
aagtacataataa

SEQ ID NO: 560494 - DNA, 13 bp, D. melanogaster
aagtacatacaat

SEQ ID NO: 560495 - DNA, 13 bp, D. melanogaster
aagtacatacata

SEQ ID NO: 560496 - DNA, 14 bp, D. melanogaster
aagtacatacatat

SEQ ID NO: 560497 - DNA, 13 bp, D. melanogaster
aagtacatatata

SEQ ID NO: 560498 - DNA, 13 bp, D. melanogaster
aagtacatatatc

SEQ ID NO: 560499 - DNA, 13 bp, D. melanogaster
aagtacatatttt

SEQ ID NO: 560500 - DNA, 13 bp, D. melanogaster
aagtacattattt

SEQ ID NO: 560501 - DNA, 13 bp, D. melanogaster
aagtacattgaat

SEQ ID NO: 560502 - DNA, 13 bp, D. melanogaster
aagtacatttttc

SEQ ID NO: 560503 - DNA, 13 bp, D. melanogaster
aagtaccaaatga

SEQ ID NO: 560504 - DNA, 13 bp, D. melanogaster
aagtaccgctccg

SEQ ID NO: 560505 - DNA, 13 bp, D. melanogaster
aagtacgaaaagt

SEQ ID NO: 560506 - DNA, 13 bp, D. melanogaster
aagtacgagttcc

SEQ ID NO: 560507 - DNA, 13 bp, D. melanogaster
aagtacgtggcga

SEQ ID NO: 560508 - DNA, 13 bp, D. melanogaster
aagtacttaaaaa

SEQ ID NO: 560509 - DNA, 13 bp, D. melanogaster
aagtacttaaaat

SEQ ID NO: 560510 - DNA, 13 bp, D. melanogaster
aagtacttaaata

SEQ ID NO: 560511 - DNA, 13 bp, D. melanogaster
aagtacttaaatt

SEQ ID NO: 560512 - DNA, 13 bp, D. melanogaster
aagtacttaatat

SEQ ID NO: 560513 - DNA, 13 bp, D. melanogaster
aagtacttggtta

SEQ ID NO: 560514 - DNA, 14 bp, D. melanogaster
aagtacttggttaa

SEQ ID NO: 560515 - DNA, 13 bp, D. melanogaster
aagtactttaaat

SEQ ID NO: 560516 - DNA, 13 bp, D. melanogaster
aagtactttttta

SEQ ID NO: 560517 - DNA, 13 bp, D. melanogaster
aagtagaaatatt

SEQ ID NO: 560518 - DNA, 13 bp, D. melanogaster
aagtagaagtaga

SEQ ID NO: 560519 - DNA, 13 bp, D. melanogaster
aagtagatttaaa

SEQ ID NO: 560520 - DNA, 13 bp, D. melanogaster
aagtagcagcagc

SEQ ID NO: 560521 - DNA, 13 bp, D. melanogaster
aagtagctattga

SEQ ID NO: 560522 - DNA, 13 bp, D. melanogaster
aagtaggcaacga

SEQ ID NO: 560523 - DNA, 13 bp, D. melanogaster
aagtaggcaataa

SEQ ID NO: 560524 - DNA, 13 bp, D. melanogaster
aagtagtagtagt

SEQ ID NO: 560525 - DNA, 14 bp, D. melanogaster
aagtagtagtagta

SEQ ID NO: 560526 - DNA, 13 bp, D. melanogaster
aagtataaagttt

SEQ ID NO: 560527 - DNA, 13 bp, D. melanogaster
aagtatacaattt

SEQ ID NO: 560528 - DNA, 13 bp, D. melanogaster
aagtatacataat

SEQ ID NO: 560529 - DNA, 13 bp, D. melanogaster
aagtatacatttt

SEQ ID NO: 560530 - DNA, 13 bp, D. melanogaster
aagtataccaaaa

SEQ ID NO: 560531 - DNA, 13 bp, D. melanogaster
aagtatacgcacc

SEQ ID NO: 560532 - DNA, 13 bp, D. melanogaster
aagtatacgccgc

SEQ ID NO: 560533 - DNA, 13 bp, D. melanogaster
aagtataggcttc

SEQ ID NO: 560534 - DNA, 13 bp, D. melanogaster
aagtatatacaaa

SEQ ID NO: 560535 - DNA, 14 bp, D. melanogaster
aagtatatacaaag

SEQ ID NO: 560536 - DNA, 14 bp, D. melanogaster
aagtatatatacat

SEQ ID NO: 560537 - DNA, 13 bp, D. melanogaster
aagtatatattct

SEQ ID NO: 560538 - DNA, 13 bp, D. melanogaster
aagtatatgtaca

SEQ ID NO: 560539 - DNA, 13 bp, D. melanogaster
aagtatatttaca

SEQ ID NO: 560540 - DNA, 13 bp, D. melanogaster
aagtatatttgaa

SEQ ID NO: 560541 - DNA, 13 bp, D. melanogaster
aagtatcaaaaca

SEQ ID NO: 560542 - DNA, 13 bp, D. melanogaster
aagtatccgaaaa

SEQ ID NO: 560543 - DNA, 14 bp, D. melanogaster
aagtatccgaaaaa

SEQ ID NO: 560544 - DNA, 13 bp, D. melanogaster
aagtatctaaaag

SEQ ID NO: 560545 - DNA, 13 bp, D. melanogaster
aagtatctatcta

SEQ ID NO: 560546 - DNA, 13 bp, D. melanogaster
aagtatctgaaag

SEQ ID NO: 560547 - DNA, 13 bp, D. melanogaster
aagtatcttaaag

SEQ ID NO: 560548 - DNA, 13 bp, D. melanogaster
aagtatctttaaa

SEQ ID NO: 560549 - DNA, 13 bp, D. melanogaster
aagtatgcaaata

SEQ ID NO: 560550 - DNA, 13 bp, D. melanogaster
aagtatgcaacga

SEQ ID NO: 560551 - DNA, 14 bp, D. melanogaster
aagtatgcaacgaa

SEQ ID NO: 560552 - DNA, 13 bp, D. melanogaster
aagtatgcaacgt

SEQ ID NO: 560553 - DNA, 13 bp, D. melanogaster
aagtatgcaatta

SEQ ID NO: 560554 - DNA, 13 bp, D. melanogaster
aagtatgccaaaa

SEQ ID NO: 560555 - DNA, 13 bp, D. melanogaster
aagtatgccataa

SEQ ID NO: 560556 - DNA, 13 bp, D. melanogaster
aagtatgctaaat

SEQ ID NO: 560557 - DNA, 13 bp, D. melanogaster
aagtatgctacac

SEQ ID NO: 560558 - DNA, 13 bp, D. melanogaster
aagtatgctacat

SEQ ID NO: 560559 - DNA, 14 bp, D. melanogaster
aagtatgctacgaa

SEQ ID NO: 560560 - DNA, 13 bp, D. melanogaster
aagtatgtaacaa

SEQ ID NO: 560561 - DNA, 13 bp, D. melanogaster
aagtatgtatata

SEQ ID NO: 560562 - DNA, 13 bp, D. melanogaster
aagtatgttacag

SEQ ID NO: 560563 - DNA, 13 bp, D. melanogaster
aagtattaaaagt

SEQ ID NO: 560564 - DNA, 13 bp, D. melanogaster
aagtattaaagta

SEQ ID NO: 560565 - DNA, 13 bp, D. melanogaster
aagtattaagtat

SEQ ID NO: 560566 - DNA, 14 bp, D. melanogaster
aagtattaagtatt

SEQ ID NO: 560567 - DNA, 13 bp, D. melanogaster
aagtattaatcat

SEQ ID NO: 560568 - DNA, 13 bp, D. melanogaster
aagtattacttag

SEQ ID NO: 560569 - DNA, 13 bp, D. melanogaster
aagtattagaaat

SEQ ID NO: 560570 - DNA, 13 bp, D. melanogaster
aagtattcaaata

SEQ ID NO: 560571 - DNA, 13 bp, D. melanogaster
aagtattcaaatt

SEQ ID NO: 560572 - DNA, 13 bp, D. melanogaster
aagtattgatttt

SEQ ID NO: 560573 - DNA, 13 bp, D. melanogaster
aagtattgtaaat

SEQ ID NO: 560574 - DNA, 13 bp, D. melanogaster
aagtatttaaaca

SEQ ID NO: 560575 - DNA, 13 bp, D. melanogaster
aagtatttaatga

SEQ ID NO: 560576 - DNA, 13 bp, D. melanogaster
aagtatttacata

SEQ ID NO: 560577 - DNA, 13 bp, D. melanogaster
aagtatttagaca

SEQ ID NO: 560578 - DNA, 13 bp, D. melanogaster
aagtatttagttt

SEQ ID NO: 560579 - DNA, 13 bp, D. melanogaster
aagtatttatcaa

SEQ ID NO: 560580 - DNA, 13 bp, D. melanogaster
aagtatttcaaag

SEQ ID NO: 560581 - DNA, 13 bp, D. melanogaster
aagtatttcaaat

SEQ ID NO: 560582 - DNA, 13 bp, D. melanogaster
aagtatttcaata

SEQ ID NO: 560583 - DNA, 14 bp, D. melanogaster
aagtatttcaattt

SEQ ID NO: 560584 - DNA, 13 bp, D. melanogaster
aagtatttcactt

SEQ ID NO: 560585 - DNA, 13 bp, D. melanogaster
aagtatttcattt

SEQ ID NO: 560586 - DNA, 13 bp, D. melanogaster
aagtatttccaaa

SEQ ID NO: 560587 - DNA, 13 bp, D. melanogaster
aagtatttctttt

SEQ ID NO: 560588 - DNA, 13 bp, D. melanogaster
aagtatttgaaaa

SEQ ID NO: 560589 - DNA, 13 bp, D. melanogaster
aagtattttaaag

SEQ ID NO: 560590 - DNA, 13 bp, D. melanogaster
aagtattttagta

SEQ ID NO: 560591 - DNA, 13 bp, D. melanogaster
aagtattttcaat

SEQ ID NO: 560592 - DNA, 13 bp, D. melanogaster
aagtattttcatt

SEQ ID NO: 560593 - DNA, 13 bp, D. melanogaster
aagtattttctat

SEQ ID NO: 560594 - DNA, 13 bp, D. melanogaster
aagtatttttgat

SEQ ID NO: 560595 - DNA, 13 bp, D. melanogaster
aagtattttttga

SEQ ID NO: 560596 - DNA, 13 bp, D. melanogaster
aagtcaaaagtca

SEQ ID NO: 560597 - DNA, 13 bp, D. melanogaster
aagtcaaaatgaa

SEQ ID NO: 560598 - DNA, 13 bp, D. melanogaster
aagtcaaacaaat

SEQ ID NO: 560599 - DNA, 13 bp, D. melanogaster
aagtcaaacattt

SEQ ID NO: 560600 - DNA, 13 bp, D. melanogaster
aagtcaaaccaaa

SEQ ID NO: 560601 - DNA, 13 bp, D. melanogaster
aagtcaaagaact

SEQ ID NO: 560602 - DNA, 14 bp, D. melanogaster
aagtcaaagccaaa

SEQ ID NO: 560603 - DNA, 13 bp, D. melanogaster
aagtcaaaggaaa

SEQ ID NO: 560604 - DNA, 13 bp, D. melanogaster
aagtcaaagtcaa

SEQ ID NO: 560605 - DNA, 14 bp, D. melanogaster
aagtcaaagtcaaa

SEQ ID NO: 560606 - DNA, 13 bp, D. melanogaster
aagtcaaagtcat

SEQ ID NO: 560607 - DNA, 13 bp, D. melanogaster
aagtcaaataata

SEQ ID NO: 560608 - DNA, 13 bp, D. melanogaster
aagtcaaatatta

SEQ ID NO: 560609 - DNA, 13 bp, D. melanogaster
aagtcaaatattt

SEQ ID NO: 560610 - DNA, 13 bp, D. melanogaster
aagtcaaatcaaa

SEQ ID NO: 560611 - DNA, 13 bp, D. melanogaster
aagtcaaatggaa

SEQ ID NO: 560612 - DNA, 13 bp, D. melanogaster
aagtcaaattact

SEQ ID NO: 560613 - DNA, 13 bp, D. melanogaster
aagtcaaattcaa

SEQ ID NO: 560614 - DNA, 14 bp, D. melanogaster
aagtcaaattcaaa

SEQ ID NO: 560615 - DNA, 13 bp, D. melanogaster
aagtcaaattgaa

SEQ ID NO: 560616 - DNA, 13 bp, D. melanogaster
aagtcaacaacaa

SEQ ID NO: 560617 - DNA, 13 bp, D. melanogaster
aagtcaacaataa

SEQ ID NO: 560618 - DNA, 13 bp, D. melanogaster
aagtcaacacaca

SEQ ID NO: 560619 - DNA, 13 bp, D. melanogaster
aagtcaacggaaa

SEQ ID NO: 560620 - DNA, 13 bp, D. melanogaster
aagtcaactaata

SEQ ID NO: 560621 - DNA, 13 bp, D. melanogaster
aagtcaagccaaa

SEQ ID NO: 560622 - DNA, 13 bp, D. melanogaster
aagtcaagtcaaa

SEQ ID NO: 560623 - DNA, 13 bp, D. melanogaster
aagtcaagtcaag

SEQ ID NO: 560624 - DNA, 14 bp, D. melanogaster
aagtcaagtcaagt

SEQ ID NO: 560625 - DNA, 13 bp, D. melanogaster
aagtcaagtcaat

SEQ ID NO: 560626 - DNA, 13 bp, D. melanogaster
aagtcaatcaaaa

SEQ ID NO: 560627 - DNA, 13 bp, D. melanogaster
aagtcaatgaaat

SEQ ID NO: 560628 - DNA, 13 bp, D. melanogaster
aagtcaatgtcaa

SEQ ID NO: 560629 - DNA, 13 bp, D. melanogaster
aagtcaattgaat

SEQ ID NO: 560630 - DNA, 13 bp, D. melanogaster
aagtcaatttaaa

SEQ ID NO: 560631 - DNA, 13 bp, D. melanogaster
aagtcaatttcta

SEQ ID NO: 560632 - DNA, 13 bp, D. melanogaster
aagtcacaaaaat

SEQ ID NO: 560633 - DNA, 13 bp, D. melanogaster
aagtcagaaaatg

SEQ ID NO: 560634 - DNA, 14 bp, D. melanogaster
aagtcagaggataa

SEQ ID NO: 560635 - DNA, 13 bp, D. melanogaster
aagtcagccagcc

SEQ ID NO: 560636 - DNA, 13 bp, D. melanogaster
aagtcagcgaaag

SEQ ID NO: 560637 - DNA, 14 bp, D. melanogaster
aagtcagcgttgca

SEQ ID NO: 560638 - DNA, 14 bp, D. melanogaster
aagtcagtcagtca

SEQ ID NO: 560639 - DNA, 13 bp, D. melanogaster
aagtcagtggaaa

SEQ ID NO: 560640 - DNA, 13 bp, D. melanogaster
aagtcataaaatc

SEQ ID NO: 560641 - DNA, 13 bp, D. melanogaster
aagtcataacaaa

SEQ ID NO: 560642 - DNA, 14 bp, D. melanogaster
aagtcataacaaat

SEQ ID NO: 560643 - DNA, 13 bp, D. melanogaster
aagtcataatttt

SEQ ID NO: 560644 - DNA, 13 bp, D. melanogaster
aagtcatataaat

SEQ ID NO: 560645 - DNA, 13 bp, D. melanogaster
aagtcatatcaaa

SEQ ID NO: 560646 - DNA, 13 bp, D. melanogaster
aagtcatcattga

SEQ ID NO: 560647 - DNA, 13 bp, D. melanogaster
aagtcattaaaat

SEQ ID NO: 560648 - DNA, 14 bp, D. melanogaster
aagtcattattttt

SEQ ID NO: 560649 - DNA, 13 bp, D. melanogaster
aagtcatttttat

SEQ ID NO: 560650 - DNA, 13 bp, D. melanogaster
aagtcatttttga

SEQ ID NO: 560651 - DNA, 13 bp, D. melanogaster
aagtccaaatata

SEQ ID NO: 560652 - DNA, 14 bp, D. melanogaster
aagtccaaatatat

SEQ ID NO: 560653 - DNA, 14 bp, D. melanogaster
aagtccaactcaca

SEQ ID NO: 560654 - DNA, 13 bp, D. melanogaster
aagtccaatctgt

SEQ ID NO: 560655 - DNA, 13 bp, D. melanogaster
aagtccatcaaat

SEQ ID NO: 560656 - DNA, 13 bp, D. melanogaster
aagtcccaagtcc

SEQ ID NO: 560657 - DNA, 13 bp, D. melanogaster
aagtcccaatttt

SEQ ID NO: 560658 - DNA, 13 bp, D. melanogaster
aagtccccaggca

SEQ ID NO: 560659 - DNA, 13 bp, D. melanogaster
aagtccctgcttc

SEQ ID NO: 560660 - DNA, 13 bp, D. melanogaster
aagtccgtctgca

SEQ ID NO: 560661 - DNA, 13 bp, D. melanogaster
aagtcctctttaa

SEQ ID NO: 560662 - DNA, 13 bp, D. melanogaster
aagtccttttcag

SEQ ID NO: 560663 - DNA, 13 bp, D. melanogaster
aagtcgaaacaaa

SEQ ID NO: 560664 - DNA, 13 bp, D. melanogaster
aagtcgaacgtca

SEQ ID NO: 560665 - DNA, 13 bp, D. melanogaster
aagtcgaagagaa

SEQ ID NO: 560666 - DNA, 14 bp, D. melanogaster
aagtcgaagagaaa

SEQ ID NO: 560667 - DNA, 13 bp, D. melanogaster
aagtcgaagtcga

SEQ ID NO: 560668 - DNA, 14 bp, D. melanogaster
aagtcgaagtcgaa

SEQ ID NO: 560669 - DNA, 13 bp, D. melanogaster
aagtcgaataaag

SEQ ID NO: 560670 - DNA, 13 bp, D. melanogaster
aagtcgaatctaa

SEQ ID NO: 560671 - DNA, 14 bp, D. melanogaster
aagtcgaatctaat

SEQ ID NO: 560672 - DNA, 13 bp, D. melanogaster
aagtcgagaaaaa

SEQ ID NO: 560673 - DNA, 13 bp, D. melanogaster
aagtcgagatccc

SEQ ID NO: 560674 - DNA, 13 bp, D. melanogaster
aagtcgcactgca

SEQ ID NO: 560675 - DNA, 13 bp, D. melanogaster
aagtcgcctgcac

SEQ ID NO: 560676 - DNA, 13 bp, D. melanogaster
aagtcggaaaagc

SEQ ID NO: 560677 - DNA, 13 bp, D. melanogaster
aagtcggaaaatg

SEQ ID NO: 560678 - DNA, 13 bp, D. melanogaster
aagtcgggaaagc

SEQ ID NO: 560679 - DNA, 13 bp, D. melanogaster
aagtcgtaaaaat

SEQ ID NO: 560680 - DNA, 13 bp, D. melanogaster
aagtcgtcggcag

SEQ ID NO: 560681 - DNA, 13 bp, D. melanogaster
aagtctatatata

SEQ ID NO: 560682 - DNA, 13 bp, D. melanogaster
aagtctcaaggaa

SEQ ID NO: 560683 - DNA, 15 bp, D. melanogaster
aagtctctttggatg

SEQ ID NO: 560684 - DNA, 13 bp, D. melanogaster
aagtctgcatttt

SEQ ID NO: 560685 - DNA, 13 bp, D. melanogaster
aagtctgcctgct

SEQ ID NO: 560686 - DNA, 13 bp, D. melanogaster
aagtctgtaatat

SEQ ID NO: 560687 - DNA, 13 bp, D. melanogaster
aagtctgtgaaga

SEQ ID NO: 560688 - DNA, 13 bp, D. melanogaster
aagtcttaaaaat

SEQ ID NO: 560689 - DNA, 13 bp, D. melanogaster
aagtcttacctct

SEQ ID NO: 560690 - DNA, 13 bp, D. melanogaster
aagtcttagtttt

SEQ ID NO: 560691 - DNA, 15 bp, D. melanogaster
aagtcttagttttaa

SEQ ID NO: 560692 - DNA, 13 bp, D. melanogaster
aagtctttaaaaa

SEQ ID NO: 560693 - DNA, 14 bp, D. melanogaster
aagtctttaaaaat

SEQ ID NO: 560694 - DNA, 13 bp, D. melanogaster
aagtctttcgttt

SEQ ID NO: 560695 - DNA, 13 bp, D. melanogaster
aagtcttttaaaa

SEQ ID NO: 560696 - DNA, 13 bp, D. melanogaster
aagtcttttgttt

SEQ ID NO: 560697 - DNA, 13 bp, D. melanogaster
aagtgaaaaacat

SEQ ID NO: 560698 - DNA, 13 bp, D. melanogaster
aagtgaaaaactg

SEQ ID NO: 560699 - DNA, 13 bp, D. melanogaster
aagtgaaaaagtg

SEQ ID NO: 560700 - DNA, 13 bp, D. melanogaster
aagtgaaaaagtt

SEQ ID NO: 560701 - DNA, 13 bp, D. melanogaster
aagtgaaaaatac

SEQ ID NO: 560702 - DNA, 13 bp, D. melanogaster
aagtgaaaaattc

SEQ ID NO: 560703 - DNA, 13 bp, D. melanogaster
aagtgaaaacatt

SEQ ID NO: 560704 - DNA, 13 bp, D. melanogaster
aagtgaaaacgaa

SEQ ID NO: 560705 - DNA, 14 bp, D. melanogaster
aagtgaaaacgaaa

SEQ ID NO: 560706 - DNA, 13 bp, D. melanogaster
aagtgaaaacttt

SEQ ID NO: 560707 - DNA, 14 bp, D. melanogaster
aagtgaaaactttt

SEQ ID NO: 560708 - DNA, 13 bp, D. melanogaster
aagtgaaaagaac

SEQ ID NO: 560709 - DNA, 13 bp, D. melanogaster
aagtgaaaagtgg

SEQ ID NO: 560710 - DNA, 13 bp, D. melanogaster
aagtgaaaagtta

SEQ ID NO: 560711 - DNA, 13 bp, D. melanogaster
aagtgaaaagttg

SEQ ID NO: 560712 - DNA, 13 bp, D. melanogaster
aagtgaaaagttt

SEQ ID NO: 560713 - DNA, 13 bp, D. melanogaster
aagtgaaaatctg

SEQ ID NO: 560714 - DNA, 13 bp, D. melanogaster
aagtgaaaatgga

SEQ ID NO: 560715 - DNA, 13 bp, D. melanogaster
aagtgaaaatgtt

SEQ ID NO: 560716 - DNA, 13 bp, D. melanogaster
aagtgaaaattca

SEQ ID NO: 560717 - DNA, 13 bp, D. melanogaster
aagtgaaaattcc

SEQ ID NO: 560718 - DNA, 13 bp, D. melanogaster
aagtgaaaattgt

SEQ ID NO: 560719 - DNA, 13 bp, D. melanogaster
aagtgaaacaaat

SEQ ID NO: 560720 - DNA, 13 bp, D. melanogaster
aagtgaaacaata

SEQ ID NO: 560721 - DNA, 13 bp, D. melanogaster
aagtgaaacagca

SEQ ID NO: 560722 - DNA, 14 bp, D. melanogaster
aagtgaaacagcag

SEQ ID NO: 560723 - DNA, 13 bp, D. melanogaster
aagtgaaacattt

SEQ ID NO: 560724 - DNA, 13 bp, D. melanogaster
aagtgaaaccgaa

SEQ ID NO: 560725 - DNA, 15 bp, D. melanogaster
aagtgaaactagaaa

SEQ ID NO: 560726 - DNA, 13 bp, D. melanogaster
aagtgaaactttt

SEQ ID NO: 560727 - DNA, 13 bp, D. melanogaster
aagtgaaagtaat

SEQ ID NO: 560728 - DNA, 13 bp, D. melanogaster
aagtgaaagtgat

SEQ ID NO: 560729 - DNA, 13 bp, D. melanogaster
aagtgaaagtgga

SEQ ID NO: 560730 - DNA, 13 bp, D. melanogaster
aagtgaaagtgtt

SEQ ID NO: 560731 - DNA, 13 bp, D. melanogaster
aagtgaaagttaa

SEQ ID NO: 560732 - DNA, 13 bp, D. melanogaster
aagtgaaagtttt

SEQ ID NO: 560733 - DNA, 13 bp, D. melanogaster
aagtgaaataaac

SEQ ID NO: 560734 - DNA, 14 bp, D. melanogaster
aagtgaaataaatg

SEQ ID NO: 560735 - DNA, 13 bp, D. melanogaster
aagtgaaatacaa

SEQ ID NO: 560736 - DNA, 13 bp, D. melanogaster
aagtgaaatatat

SEQ ID NO: 560737 - DNA, 13 bp, D. melanogaster
aagtgaaatatta

SEQ ID NO: 560738 - DNA, 13 bp, D. melanogaster
aagtgaaatcaaa

SEQ ID NO: 560739 - DNA, 14 bp, D. melanogaster
aagtgaaatcaaat

SEQ ID NO: 560740 - DNA, 13 bp, D. melanogaster
aagtgaaatcatt

SEQ ID NO: 560741 - DNA, 13 bp, D. melanogaster
aagtgaaatcgaa

SEQ ID NO: 560742 - DNA, 13 bp, D. melanogaster
aagtgaaatgaag

SEQ ID NO: 560743 - DNA, 13 bp, D. melanogaster
aagtgaaatgcca

SEQ ID NO: 560744 - DNA, 13 bp, D. melanogaster
aagtgaaatggat

SEQ ID NO: 560745 - DNA, 13 bp, D. melanogaster
aagtgaaatgtgc

SEQ ID NO: 560746 - DNA, 13 bp, D. melanogaster
aagtgaaatgttt

SEQ ID NO: 560747 - DNA, 14 bp, D. melanogaster
aagtgaaattgaaa

SEQ ID NO: 560748 - DNA, 13 bp, D. melanogaster
aagtgaaattgat

SEQ ID NO: 560749 - DNA, 13 bp, D. melanogaster
aagtgaaatttac

SEQ ID NO: 560750 - DNA, 13 bp, D. melanogaster
aagtgaaatttat

SEQ ID NO: 560751 - DNA, 13 bp, D. melanogaster
aagtgaaatttgt

SEQ ID NO: 560752 - DNA, 13 bp, D. melanogaster
aagtgaaattttc

SEQ ID NO: 560753 - DNA, 13 bp, D. melanogaster
aagtgaaattttt

SEQ ID NO: 560754 - DNA, 13 bp, D. melanogaster
aagtgaacaattt

SEQ ID NO: 560755 - DNA, 14 bp, D. melanogaster
aagtgaacataaaa

SEQ ID NO: 560756 - DNA, 13 bp, D. melanogaster
aagtgaacttaaa

SEQ ID NO: 560757 - DNA, 13 bp, D. melanogaster
aagtgaacttttt

SEQ ID NO: 560758 - DNA, 13 bp, D. melanogaster
aagtgaagaattt

SEQ ID NO: 560759 - DNA, 13 bp, D. melanogaster
aagtgaagactgg

SEQ ID NO: 560760 - DNA, 13 bp, D. melanogaster
aagtgaagccaaa

SEQ ID NO: 560761 - DNA, 13 bp, D. melanogaster
aagtgaaggcaaa

SEQ ID NO: 560762 - DNA, 13 bp, D. melanogaster
aagtgaagtgaag

SEQ ID NO: 560763 - DNA, 14 bp, D. melanogaster
aagtgaagtgaagt

SEQ ID NO: 560764 - DNA, 13 bp, D. melanogaster
aagtgaagtgaat

SEQ ID NO: 560765 - DNA, 13 bp, D. melanogaster
aagtgaagtgcaa

SEQ ID NO: 560766 - DNA, 13 bp, D. melanogaster
aagtgaagtggag

SEQ ID NO: 560767 - DNA, 13 bp, D. melanogaster
aagtgaagttttt

SEQ ID NO: 560768 - DNA, 13 bp, D. melanogaster
aagtgaataaaac

SEQ ID NO: 560769 - DNA, 13 bp, D. melanogaster
aagtgaataaatt

SEQ ID NO: 560770 - DNA, 13 bp, D. melanogaster
aagtgaataatac

SEQ ID NO: 560771 - DNA, 13 bp, D. melanogaster
aagtgaataattt

SEQ ID NO: 560772 - DNA, 13 bp, D. melanogaster
aagtgaatattaa

SEQ ID NO: 560773 - DNA, 13 bp, D. melanogaster
aagtgaatatttg

SEQ ID NO: 560774 - DNA, 14 bp, D. melanogaster
aagtgaatatttgc

SEQ ID NO: 560775 - DNA, 13 bp, D. melanogaster
aagtgaatatttt

SEQ ID NO: 560776 - DNA, 13 bp, D. melanogaster
aagtgaatcaaaa

SEQ ID NO: 560777 - DNA, 13 bp, D. melanogaster
aagtgaatgtgaa

SEQ ID NO: 560778 - DNA, 13 bp, D. melanogaster
aagtgaattaaag

SEQ ID NO: 560779 - DNA, 14 bp, D. melanogaster
aagtgaattaaatt

SEQ ID NO: 560780 - DNA, 13 bp, D. melanogaster
aagtgaattggaa

SEQ ID NO: 560781 - DNA, 13 bp, D. melanogaster
aagtgaattgttg

SEQ ID NO: 560782 - DNA, 13 bp, D. melanogaster
aagtgaatttaaa

SEQ ID NO: 560783 - DNA, 13 bp, D. melanogaster
aagtgaatttaat

SEQ ID NO: 560784 - DNA, 13 bp, D. melanogaster
aagtgaatttatt

SEQ ID NO: 560785 - DNA, 13 bp, D. melanogaster
aagtgaatttcaa

SEQ ID NO: 560786 - DNA, 13 bp, D. melanogaster
aagtgaattttat

SEQ ID NO: 560787 - DNA, 13 bp, D. melanogaster
aagtgaattttgt

SEQ ID NO: 560788 - DNA, 13 bp, D. melanogaster
aagtgacattcct

SEQ ID NO: 560789 - DNA, 14 bp, D. melanogaster
aagtgacattccta

SEQ ID NO: 560790 - DNA, 13 bp, D. melanogaster
aagtgagcaaaaa

SEQ ID NO: 560791 - DNA, 13 bp, D. melanogaster
aagtgagccaaaa

SEQ ID NO: 560792 - DNA, 13 bp, D. melanogaster
aagtgaggaaaac

SEQ ID NO: 560793 - DNA, 15 bp, D. melanogaster
aagtgatctgaccga

SEQ ID NO: 560794 - DNA, 13 bp, D. melanogaster
aagtgatgaagaa

SEQ ID NO: 560795 - DNA, 13 bp, D. melanogaster
aagtgattataat

SEQ ID NO: 560796 - DNA, 13 bp, D. melanogaster
aagtgattcgaaa

SEQ ID NO: 560797 - DNA, 14 bp, D. melanogaster
aagtgattcgaaag

SEQ ID NO: 560798 - DNA, 13 bp, D. melanogaster
aagtgattgtttt

SEQ ID NO: 560799 - DNA, 13 bp, D. melanogaster
aagtgatttaatt

SEQ ID NO: 560800 - DNA, 13 bp, D. melanogaster
aagtgatttatgc

SEQ ID NO: 560801 - DNA, 13 bp, D. melanogaster
aagtgatttcaat

SEQ ID NO: 560802 - DNA, 13 bp, D. melanogaster
aagtgatttgaaa

SEQ ID NO: 560803 - DNA, 13 bp, D. melanogaster
aagtgattttaaa

SEQ ID NO: 560804 - DNA, 13 bp, D. melanogaster
aagtgcaaaaagc

SEQ ID NO: 560805 - DNA, 13 bp, D. melanogaster
aagtgcaaaaata

SEQ ID NO: 560806 - DNA, 14 bp, D. melanogaster
aagtgcaaaaataa

SEQ ID NO: 560807 - DNA, 13 bp, D. melanogaster
aagtgcaaaacaa

SEQ ID NO: 560808 - DNA, 13 bp, D. melanogaster
aagtgcaaaagtg

SEQ ID NO: 560809 - DNA, 13 bp, D. melanogaster
aagtgcaaaatgc

SEQ ID NO: 560810 - DNA, 14 bp, D. melanogaster
aagtgcaaaatgca

SEQ ID NO: 560811 - DNA, 13 bp, D. melanogaster
aagtgcaaaatgt

SEQ ID NO: 560812 - DNA, 13 bp, D. melanogaster
aagtgcaaacaaa

SEQ ID NO: 560813 - DNA, 13 bp, D. melanogaster
aagtgcaaagaaa

SEQ ID NO: 560814 - DNA, 13 bp, D. melanogaster
aagtgcaaagcaa

SEQ ID NO: 560815 - DNA, 13 bp, D. melanogaster
aagtgcaaagtgc

SEQ ID NO: 560816 - DNA, 13 bp, D. melanogaster
aagtgcaaagtgt

SEQ ID NO: 560817 - DNA, 13 bp, D. melanogaster
aagtgcaaagttt

SEQ ID NO: 560818 - DNA, 14 bp, D. melanogaster
aagtgcaaataaaa

SEQ ID NO: 560819 - DNA, 13 bp, D. melanogaster
aagtgcaaataga

SEQ ID NO: 560820 - DNA, 13 bp, D. melanogaster
aagtgcaaatatg

SEQ ID NO: 560821 - DNA, 13 bp, D. melanogaster
aagtgcaaatatt

SEQ ID NO: 560822 - DNA, 13 bp, D. melanogaster
aagtgcaaatgaa

SEQ ID NO: 560823 - DNA, 13 bp, D. melanogaster
aagtgcaaatgca

SEQ ID NO: 560824 - DNA, 13 bp, D. melanogaster
aagtgcaaattaa

SEQ ID NO: 560825 - DNA, 13 bp, D. melanogaster
aagtgcaaattgt

SEQ ID NO: 560826 - DNA, 13 bp, D. melanogaster
aagtgcaacaaaa

SEQ ID NO: 560827 - DNA, 13 bp, D. melanogaster
aagtgcaacaaga

SEQ ID NO: 560828 - DNA, 13 bp, D. melanogaster
aagtgcaacaatg

SEQ ID NO: 560829 - DNA, 13 bp, D. melanogaster
aagtgcaacaatt

SEQ ID NO: 560830 - DNA, 13 bp, D. melanogaster
aagtgcaacattt

SEQ ID NO: 560831 - DNA, 13 bp, D. melanogaster
aagtgcaactgca

SEQ ID NO: 560832 - DNA, 13 bp, D. melanogaster
aagtgcaacttta

SEQ ID NO: 560833 - DNA, 13 bp, D. melanogaster
aagtgcaagaaaa

SEQ ID NO: 560834 - DNA, 13 bp, D. melanogaster
aagtgcaagtgat

SEQ ID NO: 560835 - DNA, 13 bp, D. melanogaster
aagtgcaagtgca

SEQ ID NO: 560836 - DNA, 14 bp, D. melanogaster
aagtgcaagtgcaa

SEQ ID NO: 560837 - DNA, 13 bp, D. melanogaster
aagtgcaagtgct

SEQ ID NO: 560838 - DNA, 13 bp, D. melanogaster
aagtgcaagtgta

SEQ ID NO: 560839 - DNA, 13 bp, D. melanogaster
aagtgcaataata

SEQ ID NO: 560840 - DNA, 13 bp, D. melanogaster
aagtgcaataatt

SEQ ID NO: 560841 - DNA, 13 bp, D. melanogaster
aagtgcaatcaat

SEQ ID NO: 560842 - DNA, 13 bp, D. melanogaster
aagtgcaatggaa

SEQ ID NO: 560843 - DNA, 13 bp, D. melanogaster
aagtgcaattgaa

SEQ ID NO: 560844 - DNA, 13 bp, D. melanogaster
aagtgcaattgca

SEQ ID NO: 560845 - DNA, 13 bp, D. melanogaster
aagtgcaatttgt

SEQ ID NO: 560846 - DNA, 13 bp, D. melanogaster
aagtgcacaaaaa

SEQ ID NO: 560847 - DNA, 13 bp, D. melanogaster
aagtgcacaaaat

SEQ ID NO: 560848 - DNA, 13 bp, D. melanogaster
aagtgcacaaatg

SEQ ID NO: 560849 - DNA, 13 bp, D. melanogaster
aagtgcacaaatt

SEQ ID NO: 560850 - DNA, 13 bp, D. melanogaster
aagtgcacaattt

SEQ ID NO: 560851 - DNA, 13 bp, D. melanogaster
aagtgcacacaaa

SEQ ID NO: 560852 - DNA, 13 bp, D. melanogaster
aagtgcacagaaa

SEQ ID NO: 560853 - DNA, 13 bp, D. melanogaster
aagtgcacataaa

SEQ ID NO: 560854 - DNA, 13 bp, D. melanogaster
aagtgcacatttt

SEQ ID NO: 560855 - DNA, 13 bp, D. melanogaster
aagtgcacccaat

SEQ ID NO: 560856 - DNA, 13 bp, D. melanogaster
aagtgcacttcaa

SEQ ID NO: 560857 - DNA, 13 bp, D. melanogaster
aagtgcacttgaa

SEQ ID NO: 560858 - DNA, 13 bp, D. melanogaster
aagtgcactttaa

SEQ ID NO: 560859 - DNA, 13 bp, D. melanogaster
aagtgcactttgc

SEQ ID NO: 560860 - DNA, 13 bp, D. melanogaster
aagtgcactttgt

SEQ ID NO: 560861 - DNA, 13 bp, D. melanogaster
aagtgcacttttc

SEQ ID NO: 560862 - DNA, 13 bp, D. melanogaster
aagtgcacttttt

SEQ ID NO: 560863 - DNA, 13 bp, D. melanogaster
aagtgcagaaaat

SEQ ID NO: 560864 - DNA, 13 bp, D. melanogaster
aagtgcagagaaa

SEQ ID NO: 560865 - DNA, 13 bp, D. melanogaster
aagtgcagcaaac

SEQ ID NO: 560866 - DNA, 13 bp, D. melanogaster
aagtgcagcaaat

SEQ ID NO: 560867 - DNA, 13 bp, D. melanogaster
aagtgcagcagaa

SEQ ID NO: 560868 - DNA, 13 bp, D. melanogaster
aagtgcagcagca

SEQ ID NO: 560869 - DNA, 14 bp, D. melanogaster
aagtgcagcagcag

SEQ ID NO: 560870 - DNA, 13 bp, D. melanogaster
aagtgcagcagcc

SEQ ID NO: 560871 - DNA, 13 bp, D. melanogaster
aagtgcagccaac

SEQ ID NO: 560872 - DNA, 13 bp, D. melanogaster
aagtgcagctcga

SEQ ID NO: 560873 - DNA, 13 bp, D. melanogaster
aagtgcagctgca

SEQ ID NO: 560874 - DNA, 13 bp, D. melanogaster
aagtgcaggaaaa

SEQ ID NO: 560875 - DNA, 13 bp, D. melanogaster
aagtgcagtaaaa

SEQ ID NO: 560876 - DNA, 13 bp, D. melanogaster
aagtgcagtattt

SEQ ID NO: 560877 - DNA, 13 bp, D. melanogaster
aagtgcagtgaaa

SEQ ID NO: 560878 - DNA, 14 bp, D. melanogaster
aagtgcagtgcaaa

SEQ ID NO: 560879 - DNA, 13 bp, D. melanogaster
aagtgcagtggaa

SEQ ID NO: 560880 - DNA, 13 bp, D. melanogaster
aagtgcagttgca

SEQ ID NO: 560881 - DNA, 13 bp, D. melanogaster
aagtgcagtttgc

SEQ ID NO: 560882 - DNA, 13 bp, D. melanogaster
aagtgcagtttta

SEQ ID NO: 560883 - DNA, 14 bp, D. melanogaster
aagtgcataaaaat

SEQ ID NO: 560884 - DNA, 13 bp, D. melanogaster
aagtgcataaatt

SEQ ID NO: 560885 - DNA, 13 bp, D. melanogaster
aagtgcatacata

SEQ ID NO: 560886 - DNA, 13 bp, D. melanogaster
aagtgcatcatat

SEQ ID NO: 560887 - DNA, 13 bp, D. melanogaster
aagtgcatgaaaa

SEQ ID NO: 560888 - DNA, 13 bp, D. melanogaster
aagtgcatgctca

SEQ ID NO: 560889 - DNA, 13 bp, D. melanogaster
aagtgcatggtca

SEQ ID NO: 560890 - DNA, 13 bp, D. melanogaster
aagtgcatgtgtg

SEQ ID NO: 560891 - DNA, 14 bp, D. melanogaster
aagtgcattgccca

SEQ ID NO: 560892 - DNA, 13 bp, D. melanogaster
aagtgcatttatt

SEQ ID NO: 560893 - DNA, 13 bp, D. melanogaster
aagtgcatttcaa

SEQ ID NO: 560894 - DNA, 13 bp, D. melanogaster
aagtgcatttgca

SEQ ID NO: 560895 - DNA, 13 bp, D. melanogaster
aagtgcatttggt

SEQ ID NO: 560896 - DNA, 13 bp, D. melanogaster
aagtgcatttgta

SEQ ID NO: 560897 - DNA, 13 bp, D. melanogaster
aagtgcattttga

SEQ ID NO: 560898 - DNA, 13 bp, D. melanogaster
aagtgcatttttc

SEQ ID NO: 560899 - DNA, 14 bp, D. melanogaster
aagtgcatttttct

SEQ ID NO: 560900 - DNA, 13 bp, D. melanogaster
aagtgccaaaaag

SEQ ID NO: 560901 - DNA, 13 bp, D. melanogaster
aagtgccaaaaat

SEQ ID NO: 560902 - DNA, 13 bp, D. melanogaster
aagtgccaaacaa

SEQ ID NO: 560903 - DNA, 13 bp, D. melanogaster
aagtgccaaataa

SEQ ID NO: 560904 - DNA, 13 bp, D. melanogaster
aagtgccaacaaa

SEQ ID NO: 560905 - DNA, 13 bp, D. melanogaster
aagtgccaataaa

SEQ ID NO: 560906 - DNA, 13 bp, D. melanogaster
aagtgccaattac

SEQ ID NO: 560907 - DNA, 13 bp, D. melanogaster
aagtgccacaaaa

SEQ ID NO: 560908 - DNA, 14 bp, D. melanogaster
aagtgccacgcccc

SEQ ID NO: 560909 - DNA, 13 bp, D. melanogaster
aagtgccactcga

SEQ ID NO: 560910 - DNA, 13 bp, D. melanogaster
aagtgccataaaa

SEQ ID NO: 560911 - DNA, 14 bp, D. melanogaster
aagtgccataaaaa

SEQ ID NO: 560912 - DNA, 13 bp, D. melanogaster
aagtgccataaat

SEQ ID NO: 560913 - DNA, 13 bp, D. melanogaster
aagtgccattaaa

SEQ ID NO: 560914 - DNA, 13 bp, D. melanogaster
aagtgcccaaaat

SEQ ID NO: 560915 - DNA, 13 bp, D. melanogaster
aagtgccgaaaaa

SEQ ID NO: 560916 - DNA, 13 bp, D. melanogaster
aagtgcctgaaaa

SEQ ID NO: 560917 - DNA, 13 bp, D. melanogaster
aagtgcgataaaa

SEQ ID NO: 560918 - DNA, 13 bp, D. melanogaster
aagtgcgcaaaaa

SEQ ID NO: 560919 - DNA, 13 bp, D. melanogaster
aagtgcgcgaaat

SEQ ID NO: 560920 - DNA, 13 bp, D. melanogaster
aagtgcggaaaaa

SEQ ID NO: 560921 - DNA, 13 bp, D. melanogaster
aagtgcggaaaag

SEQ ID NO: 560922 - DNA, 13 bp, D. melanogaster
aagtgcggaaaat

SEQ ID NO: 560923 - DNA, 13 bp, D. melanogaster
aagtgcggacaca

SEQ ID NO: 560924 - DNA, 13 bp, D. melanogaster
aagtgctaaaaat

SEQ ID NO: 560925 - DNA, 13 bp, D. melanogaster
aagtgctgacact

SEQ ID NO: 560926 - DNA, 13 bp, D. melanogaster
aagtgctggcaaa

SEQ ID NO: 560927 - DNA, 13 bp, D. melanogaster
aagtgctggccaa

SEQ ID NO: 560928 - DNA, 13 bp, D. melanogaster
aagtgctgggaaa

SEQ ID NO: 560929 - DNA, 13 bp, D. melanogaster
aagtgcttaaaat

SEQ ID NO: 560930 - DNA, 13 bp, D. melanogaster
aagtgcttaaagt

SEQ ID NO: 560931 - DNA, 14 bp, D. melanogaster
aagtgcttaacgca

SEQ ID NO: 560932 - DNA, 13 bp, D. melanogaster
aagtgcttataaa

SEQ ID NO: 560933 - DNA, 13 bp, D. melanogaster
aagtgcttcaaaa

SEQ ID NO: 560934 - DNA, 13 bp, D. melanogaster
aagtgctttaaat

SEQ ID NO: 560935 - DNA, 13 bp, D. melanogaster
aagtggaaaaagt

SEQ ID NO: 560936 - DNA, 13 bp, D. melanogaster
aagtggaaaaatt

SEQ ID NO: 560937 - DNA, 13 bp, D. melanogaster
aagtggaaaacaa

SEQ ID NO: 560938 - DNA, 14 bp, D. melanogaster
aagtggaaaacaaa

SEQ ID NO: 560939 - DNA, 13 bp, D. melanogaster
aagtggaaaagca

SEQ ID NO: 560940 - DNA, 13 bp, D. melanogaster
aagtggaaaagcg

SEQ ID NO: 560941 - DNA, 13 bp, D. melanogaster
aagtggaaaagtc

SEQ ID NO: 560942 - DNA, 13 bp, D. melanogaster
aagtggaaaagtg

SEQ ID NO: 560943 - DNA, 13 bp, D. melanogaster
aagtggaaaatac

SEQ ID NO: 560944 - DNA, 13 bp, D. melanogaster
aagtggaaaatga

SEQ ID NO: 560945 - DNA, 13 bp, D. melanogaster
aagtggaaaatgt

SEQ ID NO: 560946 - DNA, 13 bp, D. melanogaster
aagtggaaaatta

SEQ ID NO: 560947 - DNA, 13 bp, D. melanogaster
aagtggaaaattg

SEQ ID NO: 560948 - DNA, 13 bp, D. melanogaster
aagtggaaaattt

SEQ ID NO: 560949 - DNA, 13 bp, D. melanogaster
aagtggaaaccaa

SEQ ID NO: 560950 - DNA, 13 bp, D. melanogaster
aagtggaaagtgg

SEQ ID NO: 560951 - DNA, 13 bp, D. melanogaster
aagtggaaatatt

SEQ ID NO: 560952 - DNA, 13 bp, D. melanogaster
aagtggaaatgca

SEQ ID NO: 560953 - DNA, 14 bp, D. melanogaster
aagtggaaatggaa

SEQ ID NO: 560954 - DNA, 13 bp, D. melanogaster
aagtggaaattaa

SEQ ID NO: 560955 - DNA, 13 bp, D. melanogaster
aagtggaaattgt

SEQ ID NO: 560956 - DNA, 13 bp, D. melanogaster
aagtggaacaaaa

SEQ ID NO: 560957 - DNA, 13 bp, D. melanogaster
aagtggaacttgc

SEQ ID NO: 560958 - DNA, 13 bp, D. melanogaster
aagtggaagaaat

SEQ ID NO: 560959 - DNA, 14 bp, D. melanogaster
aagtggaagtgaaa

SEQ ID NO: 560960 - DNA, 13 bp, D. melanogaster
aagtggaagtgca

SEQ ID NO: 560961 - DNA, 14 bp, D. melanogaster
aagtggaagtggag

SEQ ID NO: 560962 - DNA, 13 bp, D. melanogaster
aagtggaagtggg

SEQ ID NO: 560963 - DNA, 13 bp, D. melanogaster
aagtggaagtggt

SEQ ID NO: 560964 - DNA, 13 bp, D. melanogaster
aagtggacaaaaa

SEQ ID NO: 560965 - DNA, 13 bp, D. melanogaster
aagtggagcactt

SEQ ID NO: 560966 - DNA, 13 bp, D. melanogaster
aagtggagtatct

SEQ ID NO: 560967 - DNA, 13 bp, D. melanogaster
aagtggagtggag

SEQ ID NO: 560968 - DNA, 13 bp, D. melanogaster
aagtggatgtgga

SEQ ID NO: 560969 - DNA, 13 bp, D. melanogaster
aagtggcaaaaat

SEQ ID NO: 560970 - DNA, 13 bp, D. melanogaster
aagtggcaacaac

SEQ ID NO: 560971 - DNA, 13 bp, D. melanogaster
aagtggcaagagg

SEQ ID NO: 560972 - DNA, 13 bp, D. melanogaster
aagtggcaagcaa

SEQ ID NO: 560973 - DNA, 13 bp, D. melanogaster
aagtggcaagttg

SEQ ID NO: 560974 - DNA, 13 bp, D. melanogaster
aagtggcaataaa

SEQ ID NO: 560975 - DNA, 13 bp, D. melanogaster
aagtggcagcagc

SEQ ID NO: 560976 - DNA, 13 bp, D. melanogaster
aagtggcattaaa

SEQ ID NO: 560977 - DNA, 13 bp, D. melanogaster
aagtggccaaaaa

SEQ ID NO: 560978 - DNA, 13 bp, D. melanogaster
aagtggccaagaa

SEQ ID NO: 560979 - DNA, 13 bp, D. melanogaster
aagtggccagcaa

SEQ ID NO: 560980 - DNA, 13 bp, D. melanogaster
aagtggccataaa

SEQ ID NO: 560981 - DNA, 13 bp, D. melanogaster
aagtggcccaaaa

SEQ ID NO: 560982 - DNA, 13 bp, D. melanogaster
aagtggcgaaaaa

SEQ ID NO: 560983 - DNA, 13 bp, D. melanogaster
aagtggcgcccaa

SEQ ID NO: 560984 - DNA, 13 bp, D. melanogaster
aagtggctaaaaa

SEQ ID NO: 560985 - DNA, 14 bp, D. melanogaster
aagtggctgcatag

SEQ ID NO: 560986 - DNA, 13 bp, D. melanogaster
aagtggctggaaa

SEQ ID NO: 560987 - DNA, 13 bp, D. melanogaster
aagtggcttaaat

SEQ ID NO: 560988 - DNA, 13 bp, D. melanogaster
aagtggcttcata

SEQ ID NO: 560989 - DNA, 13 bp, D. melanogaster
aagtggctttaaa

SEQ ID NO: 560990 - DNA, 13 bp, D. melanogaster
aagtgggaaaact

SEQ ID NO: 560991 - DNA, 13 bp, D. melanogaster
aagtgggaaaagc

SEQ ID NO: 560992 - DNA, 13 bp, D. melanogaster
aagtgggaaaagt

SEQ ID NO: 560993 - DNA, 13 bp, D. melanogaster
aagtgggaaaata

SEQ ID NO: 560994 - DNA, 13 bp, D. melanogaster
aagtgggaaaatg

SEQ ID NO: 560995 - DNA, 13 bp, D. melanogaster
aagtgggaaaatt

SEQ ID NO: 560996 - DNA, 13 bp, D. melanogaster
aagtgggaagtgg

SEQ ID NO: 560997 - DNA, 14 bp, D. melanogaster
aagtgggagtggca

SEQ ID NO: 560998 - DNA, 13 bp, D. melanogaster
aagtgggcaaaaa

SEQ ID NO: 560999 - DNA, 14 bp, D. melanogaster
aagtgggcaaaaaa

SEQ ID NO: 561000 - DNA, 13 bp, D. melanogaster
aagtgggcagtgg

SEQ ID NO: 561001 - DNA, 13 bp, D. melanogaster
aagtgggccaaaa

SEQ ID NO: 561002 - DNA, 13 bp, D. melanogaster
aagtgggcgaaaa

SEQ ID NO: 561003 - DNA, 14 bp, D. melanogaster
aagtgggcggaaaa

SEQ ID NO: 561004 - DNA, 13 bp, D. melanogaster
aagtgggcggcaa

SEQ ID NO: 561005 - DNA, 13 bp, D. melanogaster
aagtgggcggcgg

SEQ ID NO: 561006 - DNA, 13 bp, D. melanogaster
aagtgggcggggc

SEQ ID NO: 561007 - DNA, 14 bp, D. melanogaster
aagtgggcggggca

SEQ ID NO: 561008 - DNA, 13 bp, D. melanogaster
aagtgggcggtgc

SEQ ID NO: 561009 - DNA, 13 bp, D. melanogaster
aagtgggcggtgg

SEQ ID NO: 561010 - DNA, 13 bp, D. melanogaster
aagtgggcgtgcc

SEQ ID NO: 561011 - DNA, 13 bp, D. melanogaster
aagtgggcgtgga

SEQ ID NO: 561012 - DNA, 13 bp, D. melanogaster
aagtgggcgtggc

SEQ ID NO: 561013 - DNA, 14 bp, D. melanogaster
aagtgggcgtggca

SEQ ID NO: 561014 - DNA, 14 bp, D. melanogaster
aagtgggcgtggcc

SEQ ID NO: 561015 - DNA, 13 bp, D. melanogaster
aagtgggtattgt

SEQ ID NO: 561016 - DNA, 13 bp, D. melanogaster
aagtgggtgaaag

SEQ ID NO: 561017 - DNA, 14 bp, D. melanogaster
aagtgggtggaaaa

SEQ ID NO: 561018 - DNA, 13 bp, D. melanogaster
aagtgggtggcaa

SEQ ID NO: 561019 - DNA, 14 bp, D. melanogaster
aagtgggtggcaaa

SEQ ID NO: 561020 - DNA, 13 bp, D. melanogaster
aagtgggtggcac

SEQ ID NO: 561021 - DNA, 13 bp, D. melanogaster
aagtgggtggctg

SEQ ID NO: 561022 - DNA, 13 bp, D. melanogaster
aagtgggtggtgc

SEQ ID NO: 561023 - DNA, 13 bp, D. melanogaster
aagtgggtggttg

SEQ ID NO: 561024 - DNA, 13 bp, D. melanogaster
aagtggtcaatgc

SEQ ID NO: 561025 - DNA, 13 bp, D. melanogaster
aagtggtctggag

SEQ ID NO: 561026 - DNA, 13 bp, D. melanogaster
aagtggtgccaaa

SEQ ID NO: 561027 - DNA, 13 bp, D. melanogaster
aagtggtgcttca

SEQ ID NO: 561028 - DNA, 13 bp, D. melanogaster
aagtggtgtggaa

SEQ ID NO: 561029 - DNA, 13 bp, D. melanogaster
aagtgtaaaaaca

SEQ ID NO: 561030 - DNA, 13 bp, D. melanogaster
aagtgtaaaaatt

SEQ ID NO: 561031 - DNA, 13 bp, D. melanogaster
aagtgtaaaatgt

SEQ ID NO: 561032 - DNA, 13 bp, D. melanogaster
aagtgtaaacaaa

SEQ ID NO: 561033 - DNA, 14 bp, D. melanogaster
aagtgtaaactttt

SEQ ID NO: 561034 - DNA, 13 bp, D. melanogaster
aagtgtaatattt

SEQ ID NO: 561035 - DNA, 13 bp, D. melanogaster
aagtgtaatcaaa

SEQ ID NO: 561036 - DNA, 13 bp, D. melanogaster
aagtgtaattaat

SEQ ID NO: 561037 - DNA, 13 bp, D. melanogaster
aagtgtaatttat

SEQ ID NO: 561038 - DNA, 13 bp, D. melanogaster
aagtgtaatttta

SEQ ID NO: 561039 - DNA, 13 bp, D. melanogaster
aagtgtacatata

SEQ ID NO: 561040 - DNA, 14 bp, D. melanogaster
aagtgtacatcctg

SEQ ID NO: 561041 - DNA, 13 bp, D. melanogaster
aagtgtagaacta

SEQ ID NO: 561042 - DNA, 13 bp, D. melanogaster
aagtgtagcgaat

SEQ ID NO: 561043 - DNA, 13 bp, D. melanogaster
aagtgtagttttt

SEQ ID NO: 561044 - DNA, 13 bp, D. melanogaster
aagtgtatataga

SEQ ID NO: 561045 - DNA, 14 bp, D. melanogaster
aagtgtatatagag

SEQ ID NO: 561046 - DNA, 13 bp, D. melanogaster
aagtgtatatttt

SEQ ID NO: 561047 - DNA, 13 bp, D. melanogaster
aagtgtatgaagt

SEQ ID NO: 561048 - DNA, 13 bp, D. melanogaster
aagtgtatggctt

SEQ ID NO: 561049 - DNA, 13 bp, D. melanogaster
aagtgtcaaagtg

SEQ ID NO: 561050 - DNA, 14 bp, D. melanogaster
aagtgtctggttgt

SEQ ID NO: 561051 - DNA, 13 bp, D. melanogaster
aagtgtgaaaaat

SEQ ID NO: 561052 - DNA, 13 bp, D. melanogaster
aagtgtgaaaatg

SEQ ID NO: 561053 - DNA, 13 bp, D. melanogaster
aagtgtgaaaatt

SEQ ID NO: 561054 - DNA, 13 bp, D. melanogaster
aagtgtgagtgtg

SEQ ID NO: 561055 - DNA, 13 bp, D. melanogaster
aagtgtgcaaaat

SEQ ID NO: 561056 - DNA, 13 bp, D. melanogaster
aagtgtgcaaaca

SEQ ID NO: 561057 - DNA, 13 bp, D. melanogaster
aagtgtgccaaat

SEQ ID NO: 561058 - DNA, 13 bp, D. melanogaster
aagtgtgccaatg

SEQ ID NO: 561059 - DNA, 14 bp, D. melanogaster
aagtgtgccaatgt

SEQ ID NO: 561060 - DNA, 13 bp, D. melanogaster
aagtgtgcgaaaa

SEQ ID NO: 561061 - DNA, 13 bp, D. melanogaster
aagtgtgcgagtg

SEQ ID NO: 561062 - DNA, 13 bp, D. melanogaster
aagtgtgctattc

SEQ ID NO: 561063 - DNA, 13 bp, D. melanogaster
aagtgtgctgaag

SEQ ID NO: 561064 - DNA, 13 bp, D. melanogaster
aagtgtggaaaag

SEQ ID NO: 561065 - DNA, 13 bp, D. melanogaster
aagtgtggacgtg

SEQ ID NO: 561066 - DNA, 13 bp, D. melanogaster
aagtgtggcaaaa

SEQ ID NO: 561067 - DNA, 13 bp, D. melanogaster
aagtgtggcaaca

SEQ ID NO: 561068 - DNA, 13 bp, D. melanogaster
aagtgtggcaagt

SEQ ID NO: 561069 - DNA, 13 bp, D. melanogaster
aagtgtgggagtg

SEQ ID NO: 561070 - DNA, 13 bp, D. melanogaster
aagtgtgtaaata

SEQ ID NO: 561071 - DNA, 13 bp, D. melanogaster
aagtgtgtaatta

SEQ ID NO: 561072 - DNA, 13 bp, D. melanogaster
aagtgtgtgcgtg

SEQ ID NO: 561073 - DNA, 14 bp, D. melanogaster
aagtgtgtgcgtgt

SEQ ID NO: 561074 - DNA, 14 bp, D. melanogaster
aagtgtgtgtgcgt

SEQ ID NO: 561075 - DNA, 13 bp, D. melanogaster
aagtgtgtgtgta

SEQ ID NO: 561076 - DNA, 14 bp, D. melanogaster
aagtgtgtgtgtgg

SEQ ID NO: 561077 - DNA, 14 bp, D. melanogaster
aagtgtgtgtgtgt

SEQ ID NO: 561078 - DNA, 13 bp, D. melanogaster
aagtgtgtgtttt

SEQ ID NO: 561079 - DNA, 13 bp, D. melanogaster
aagtgttaataat

SEQ ID NO: 561080 - DNA, 13 bp, D. melanogaster
aagtgttaatttt

SEQ ID NO: 561081 - DNA, 13 bp, D. melanogaster
aagtgttacctgc

SEQ ID NO: 561082 - DNA, 13 bp, D. melanogaster
aagtgttattaaa

SEQ ID NO: 561083 - DNA, 14 bp, D. melanogaster
aagtgttattattg

SEQ ID NO: 561084 - DNA, 13 bp, D. melanogaster
aagtgttcttgcc

SEQ ID NO: 561085 - DNA, 13 bp, D. melanogaster
aagtgttgaaaag

SEQ ID NO: 561086 - DNA, 13 bp, D. melanogaster
aagtgttgcataa

SEQ ID NO: 561087 - DNA, 13 bp, D. melanogaster
aagtgttggcaaa

SEQ ID NO: 561088 - DNA, 13 bp, D. melanogaster
aagtgttggccaa

SEQ ID NO: 561089 - DNA, 14 bp, D. melanogaster
aagtgttggccaaa

SEQ ID NO: 561090 - DNA, 13 bp, D. melanogaster
aagtgttggccat

SEQ ID NO: 561091 - DNA, 13 bp, D. melanogaster
aagtgttggccca

SEQ ID NO: 561092 - DNA, 13 bp, D. melanogaster
aagtgtttaaagt

SEQ ID NO: 561093 - DNA, 14 bp, D. melanogaster
aagtgtttaaagta

SEQ ID NO: 561094 - DNA, 13 bp, D. melanogaster
aagtgtttaaatt

SEQ ID NO: 561095 - DNA, 13 bp, D. melanogaster
aagtgtttaataa

SEQ ID NO: 561096 - DNA, 14 bp, D. melanogaster
aagtgtttaataat

SEQ ID NO: 561097 - DNA, 13 bp, D. melanogaster
aagtgtttattaa

SEQ ID NO: 561098 - DNA, 14 bp, D. melanogaster
aagtgtttattaaa

SEQ ID NO: 561099 - DNA, 13 bp, D. melanogaster
aagtgtttattta

SEQ ID NO: 561100 - DNA, 13 bp, D. melanogaster
aagtgtttcattt

SEQ ID NO: 561101 - DNA, 13 bp, D. melanogaster
aagtgtttgccaa

SEQ ID NO: 561102 - DNA, 13 bp, D. melanogaster
aagtgtttgccca

SEQ ID NO: 561103 - DNA, 13 bp, D. melanogaster
aagtgttttaaaa

SEQ ID NO: 561104 - DNA, 13 bp, D. melanogaster
aagtgtttttcaa

SEQ ID NO: 561105 - DNA, 13 bp, D. melanogaster
aagtgtttttgtg

SEQ ID NO: 561106 - DNA, 13 bp, D. melanogaster
aagttaaaaaggc

SEQ ID NO: 561107 - DNA, 13 bp, D. melanogaster
aagttaaaaattg

SEQ ID NO: 561108 - DNA, 13 bp, D. melanogaster
aagttaaaagcaa

SEQ ID NO: 561109 - DNA, 13 bp, D. melanogaster
aagttaaaattga

SEQ ID NO: 561110 - DNA, 13 bp, D. melanogaster
aagttaaacaaag

SEQ ID NO: 561111 - DNA, 13 bp, D. melanogaster
aagttaaacaaat

SEQ ID NO: 561112 - DNA, 13 bp, D. melanogaster
aagttaaacaaca

SEQ ID NO: 561113 - DNA, 13 bp, D. melanogaster
aagttaaacaatt

SEQ ID NO: 561114 - DNA, 14 bp, D. melanogaster
aagttaaacttgaa

SEQ ID NO: 561115 - DNA, 13 bp, D. melanogaster
aagttaaagcttt

SEQ ID NO: 561116 - DNA, 13 bp, D. melanogaster
aagttaaagttaa

SEQ ID NO: 561117 - DNA, 13 bp, D. melanogaster
aagttaaagttat

SEQ ID NO: 561118 - DNA, 13 bp, D. melanogaster
aagttaaagtttt

SEQ ID NO: 561119 - DNA, 13 bp, D. melanogaster
aagttaaataaac

SEQ ID NO: 561120 - DNA, 13 bp, D. melanogaster
aagttaaatacaa

SEQ ID NO: 561121 - DNA, 13 bp, D. melanogaster
aagttaaatcaaa

SEQ ID NO: 561122 - DNA, 13 bp, D. melanogaster
aagttaaatgttt

SEQ ID NO: 561123 - DNA, 14 bp, D. melanogaster
aagttaaatttttc

SEQ ID NO: 561124 - DNA, 13 bp, D. melanogaster
aagttaactaaaa

SEQ ID NO: 561125 - DNA, 13 bp, D. melanogaster
aagttaagattaa

SEQ ID NO: 561126 - DNA, 13 bp, D. melanogaster
aagttaagcaaat

SEQ ID NO: 561127 - DNA, 13 bp, D. melanogaster
aagttaagcaatt

SEQ ID NO: 561128 - DNA, 13 bp, D. melanogaster
aagttaagctaaa

SEQ ID NO: 561129 - DNA, 14 bp, D. melanogaster
aagttaagctaaat

SEQ ID NO: 561130 - DNA, 13 bp, D. melanogaster
aagttaagctttt

SEQ ID NO: 561131 - DNA, 13 bp, D. melanogaster
aagttaagttaag

SEQ ID NO: 561132 - DNA, 13 bp, D. melanogaster
aagttaagtttaa

SEQ ID NO: 561133 - DNA, 13 bp, D. melanogaster
aagttaataaact

SEQ ID NO: 561134 - DNA, 13 bp, D. melanogaster
aagttaataaatg

SEQ ID NO: 561135 - DNA, 13 bp, D. melanogaster
aagttaatattct

SEQ ID NO: 561136 - DNA, 13 bp, D. melanogaster
aagttaatcaaat

SEQ ID NO: 561137 - DNA, 13 bp, D. melanogaster
aagttaatcaatt

SEQ ID NO: 561138 - DNA, 13 bp, D. melanogaster
aagttaatgcaaa

SEQ ID NO: 561139 - DNA, 13 bp, D. melanogaster
aagttaatgtaaa

SEQ ID NO: 561140 - DNA, 13 bp, D. melanogaster
aagttaattccaa

SEQ ID NO: 561141 - DNA, 13 bp, D. melanogaster
aagttaattgaat

SEQ ID NO: 561142 - DNA, 13 bp, D. melanogaster
aagttaattgagt

SEQ ID NO: 561143 - DNA, 13 bp, D. melanogaster
aagttaattgcat

SEQ ID NO: 561144 - DNA, 13 bp, D. melanogaster
aagttaatttact

SEQ ID NO: 561145 - DNA, 13 bp, D. melanogaster
aagttaatttctt

SEQ ID NO: 561146 - DNA, 13 bp, D. melanogaster
aagttaatttgaa

SEQ ID NO: 561147 - DNA, 13 bp, D. melanogaster
aagttaattttcc

SEQ ID NO: 561148 - DNA, 13 bp, D. melanogaster
aagttacaaaaat

SEQ ID NO: 561149 - DNA, 14 bp, D. melanogaster
aagttacaactaaa

SEQ ID NO: 561150 - DNA, 13 bp, D. melanogaster
aagttacacaata

SEQ ID NO: 561151 - DNA, 13 bp, D. melanogaster
aagttagaaatat

SEQ ID NO: 561152 - DNA, 13 bp, D. melanogaster
aagttagctgcgc

SEQ ID NO: 561153 - DNA, 13 bp, D. melanogaster
aagttagtaattt

SEQ ID NO: 561154 - DNA, 13 bp, D. melanogaster
aagttagttagtt

SEQ ID NO: 561155 - DNA, 13 bp, D. melanogaster
aagttataaaaca

SEQ ID NO: 561156 - DNA, 13 bp, D. melanogaster
aagttatagccaa

SEQ ID NO: 561157 - DNA, 13 bp, D. melanogaster
aagttatatatgt

SEQ ID NO: 561158 - DNA, 13 bp, D. melanogaster
aagttatcaattt

SEQ ID NO: 561159 - DNA, 13 bp, D. melanogaster
aagttatcgacaa

SEQ ID NO: 561160 - DNA, 13 bp, D. melanogaster
aagttatgacgaa

SEQ ID NO: 561161 - DNA, 13 bp, D. melanogaster
aagttatgataaa

SEQ ID NO: 561162 - DNA, 14 bp, D. melanogaster
aagttatgatgaaa

SEQ ID NO: 561163 - DNA, 13 bp, D. melanogaster
aagttatgcaaat

SEQ ID NO: 561164 - DNA, 14 bp, D. melanogaster
aagttatgcaccga

SEQ ID NO: 561165 - DNA, 13 bp, D. melanogaster
aagttatggaaaa

SEQ ID NO: 561166 - DNA, 13 bp, D. melanogaster
aagttatgtgtaa

SEQ ID NO: 561167 - DNA, 13 bp, D. melanogaster
aagttattaaagt

SEQ ID NO: 561168 - DNA, 13 bp, D. melanogaster
aagttattaacaa

SEQ ID NO: 561169 - DNA, 13 bp, D. melanogaster
aagttattaagtt

SEQ ID NO: 561170 - DNA, 14 bp, D. melanogaster
aagttattaagtta

SEQ ID NO: 561171 - DNA, 13 bp, D. melanogaster
aagttattacaaa

SEQ ID NO: 561172 - DNA, 13 bp, D. melanogaster
aagttattgacca

SEQ ID NO: 561173 - DNA, 14 bp, D. melanogaster
aagttattgaccac

SEQ ID NO: 561174 - DNA, 13 bp, D. melanogaster
aagttattgattt

SEQ ID NO: 561175 - DNA, 14 bp, D. melanogaster
aagttatttaagat

SEQ ID NO: 561176 - DNA, 13 bp, D. melanogaster
aagttatttacaa

SEQ ID NO: 561177 - DNA, 13 bp, D. melanogaster
aagttatttcttt

SEQ ID NO: 561178 - DNA, 13 bp, D. melanogaster
aagttatttgaat

SEQ ID NO: 561179 - DNA, 13 bp, D. melanogaster
aagttatttgatt

SEQ ID NO: 561180 - DNA, 13 bp, D. melanogaster
aagttattttcaa

SEQ ID NO: 561181 - DNA, 14 bp, D. melanogaster
aagttattttcaag

SEQ ID NO: 561182 - DNA, 13 bp, D. melanogaster
aagttattttcta

SEQ ID NO: 561183 - DNA, 13 bp, D. melanogaster
aagttattttgat

SEQ ID NO: 561184 - DNA, 13 bp, D. melanogaster
aagttatttttct

SEQ ID NO: 561185 - DNA, 13 bp, D. melanogaster
aagttcaaaatca

SEQ ID NO: 561186 - DNA, 13 bp, D. melanogaster
aagttcaaaatta

SEQ ID NO: 561187 - DNA, 13 bp, D. melanogaster
aagttcaaactgc

SEQ ID NO: 561188 - DNA, 13 bp, D. melanogaster
aagttcaaagtaa

SEQ ID NO: 561189 - DNA, 13 bp, D. melanogaster
aagttcaaagtca

SEQ ID NO: 561190 - DNA, 13 bp, D. melanogaster
aagttcaaagttg

SEQ ID NO: 561191 - DNA, 13 bp, D. melanogaster
aagttcaaataaa

SEQ ID NO: 561192 - DNA, 13 bp, D. melanogaster
aagttcaaattca

SEQ ID NO: 561193 - DNA, 13 bp, D. melanogaster
aagttcaacaaaa

SEQ ID NO: 561194 - DNA, 14 bp, D. melanogaster
aagttcaacaaaaa

SEQ ID NO: 561195 - DNA, 13 bp, D. melanogaster
aagttcaacaaac

SEQ ID NO: 561196 - DNA, 13 bp, D. melanogaster
aagttcaacattg

SEQ ID NO: 561197 - DNA, 13 bp, D. melanogaster
aagttcaagtgca

SEQ ID NO: 561198 - DNA, 13 bp, D. melanogaster
aagttcaagtggc

SEQ ID NO: 561199 - DNA, 13 bp, D. melanogaster
aagttcaagttca

SEQ ID NO: 561200 - DNA, 14 bp, D. melanogaster
aagttcaagttcaa

SEQ ID NO: 561201 - DNA, 13 bp, D. melanogaster
aagttcaagttga

SEQ ID NO: 561202 - DNA, 13 bp, D. melanogaster
aagttcaataaat

SEQ ID NO: 561203 - DNA, 13 bp, D. melanogaster
aagttcaatattt

SEQ ID NO: 561204 - DNA, 13 bp, D. melanogaster
aagttcaatcgca

SEQ ID NO: 561205 - DNA, 13 bp, D. melanogaster
aagttcaatgaca

SEQ ID NO: 561206 - DNA, 13 bp, D. melanogaster
aagttcaatggaa

SEQ ID NO: 561207 - DNA, 14 bp, D. melanogaster
aagttcaattaaaa

SEQ ID NO: 561208 - DNA, 13 bp, D. melanogaster
aagttcaattgaa

SEQ ID NO: 561209 - DNA, 13 bp, D. melanogaster
aagttcaatttaa

SEQ ID NO: 561210 - DNA, 13 bp, D. melanogaster
aagttcacatatt

SEQ ID NO: 561211 - DNA, 13 bp, D. melanogaster
aagttcacatttt

SEQ ID NO: 561212 - DNA, 14 bp, D. melanogaster
aagttcacgttcac

SEQ ID NO: 561213 - DNA, 13 bp, D. melanogaster
aagttcagaaatt

SEQ ID NO: 561214 - DNA, 14 bp, D. melanogaster
aagttcagcgtaaa

SEQ ID NO: 561215 - DNA, 13 bp, D. melanogaster
aagttcagttttg

SEQ ID NO: 561216 - DNA, 13 bp, D. melanogaster
aagttcataaaaa

SEQ ID NO: 561217 - DNA, 13 bp, D. melanogaster
aagttcatgaaaa

SEQ ID NO: 561218 - DNA, 13 bp, D. melanogaster
aagttcattaaaa

SEQ ID NO: 561219 - DNA, 13 bp, D. melanogaster
aagttcattgcca

SEQ ID NO: 561220 - DNA, 13 bp, D. melanogaster
aagttccaagttc

SEQ ID NO: 561221 - DNA, 13 bp, D. melanogaster
aagttccacatta

SEQ ID NO: 561222 - DNA, 13 bp, D. melanogaster
aagttccacttgc

SEQ ID NO: 561223 - DNA, 13 bp, D. melanogaster
aagttccagtttg

SEQ ID NO: 561224 - DNA, 13 bp, D. melanogaster
aagttcgaaaaaa

SEQ ID NO: 561225 - DNA, 13 bp, D. melanogaster
aagttcgactgta

SEQ ID NO: 561226 - DNA, 13 bp, D. melanogaster
aagttcgctaatt

SEQ ID NO: 561227 - DNA, 13 bp, D. melanogaster
aagttcggtttct

SEQ ID NO: 561228 - DNA, 14 bp, D. melanogaster
aagttcgtcaaaaa

SEQ ID NO: 561229 - DNA, 13 bp, D. melanogaster
aagttctaaaaac

SEQ ID NO: 561230 - DNA, 13 bp, D. melanogaster
aagttctcaaaaa

SEQ ID NO: 561231 - DNA, 14 bp, D. melanogaster
aagttctcagttca

SEQ ID NO: 561232 - DNA, 13 bp, D. melanogaster
aagttctccgatt

SEQ ID NO: 561233 - DNA, 13 bp, D. melanogaster
aagttctcgctga

SEQ ID NO: 561234 - DNA, 16 bp, D. melanogaster
aagttcttaaagaaaa

SEQ ID NO: 561235 - DNA, 13 bp, D. melanogaster
aagttcttccatt

SEQ ID NO: 561236 - DNA, 14 bp, D. melanogaster
aagttcttcttcaa

SEQ ID NO: 561237 - DNA, 13 bp, D. melanogaster
aagttctttaaaa

SEQ ID NO: 561238 - DNA, 13 bp, D. melanogaster
aagttctttaaat

SEQ ID NO: 561239 - DNA, 14 bp, D. melanogaster
aagttctttggctt

SEQ ID NO: 561240 - DNA, 13 bp, D. melanogaster
aagttctttgtgc

SEQ ID NO: 561241 - DNA, 13 bp, D. melanogaster
aagttcttttaaa

SEQ ID NO: 561242 - DNA, 13 bp, D. melanogaster
aagttctttttaa

SEQ ID NO: 561243 - DNA, 14 bp, D. melanogaster
aagttctttttaaa

SEQ ID NO: 561244 - DNA, 14 bp, D. melanogaster
aagttgaaaatgaa

SEQ ID NO: 561245 - DNA, 13 bp, D. melanogaster
aagttgaaaatgt

SEQ ID NO: 561246 - DNA, 13 bp, D. melanogaster
aagttgaaaattg

SEQ ID NO: 561247 - DNA, 13 bp, D. melanogaster
aagttgaaacttt

SEQ ID NO: 561248 - DNA, 13 bp, D. melanogaster
aagttgaaagtta

SEQ ID NO: 561249 - DNA, 13 bp, D. melanogaster
aagttgaaagttg

SEQ ID NO: 561250 - DNA, 13 bp, D. melanogaster
aagttgaaattat

SEQ ID NO: 561251 - DNA, 13 bp, D. melanogaster
aagttgaaattga

SEQ ID NO: 561252 - DNA, 14 bp, D. melanogaster
aagttgaaattgaa

SEQ ID NO: 561253 - DNA, 13 bp, D. melanogaster
aagttgaaattgt

SEQ ID NO: 561254 - DNA, 13 bp, D. melanogaster
aagttgaacaaaa

SEQ ID NO: 561255 - DNA, 13 bp, D. melanogaster
aagttgaacaaat

SEQ ID NO: 561256 - DNA, 13 bp, D. melanogaster
aagttgaacattt

SEQ ID NO: 561257 - DNA, 15 bp, D. melanogaster
aagttgaagagtttt

SEQ ID NO: 561258 - DNA, 13 bp, D. melanogaster
aagttgaaggcag

SEQ ID NO: 561259 - DNA, 13 bp, D. melanogaster
aagttgaagtttt

SEQ ID NO: 561260 - DNA, 13 bp, D. melanogaster
aagttgaataaat

SEQ ID NO: 561261 - DNA, 13 bp, D. melanogaster
aagttgaatcaac

SEQ ID NO: 561262 - DNA, 13 bp, D. melanogaster
aagttgaatccaa

SEQ ID NO: 561263 - DNA, 13 bp, D. melanogaster
aagttgaattaaa

SEQ ID NO: 561264 - DNA, 13 bp, D. melanogaster
aagttgaattttg

SEQ ID NO: 561265 - DNA, 13 bp, D. melanogaster
aagttgaattttt

SEQ ID NO: 561266 - DNA, 13 bp, D. melanogaster
aagttgacaattt

SEQ ID NO: 561267 - DNA, 13 bp, D. melanogaster
aagttgagaaatt

SEQ ID NO: 561268 - DNA, 13 bp, D. melanogaster
aagttgagcaaat

SEQ ID NO: 561269 - DNA, 13 bp, D. melanogaster
aagttgataattt

SEQ ID NO: 561270 - DNA, 13 bp, D. melanogaster
aagttgatgaaaa

SEQ ID NO: 561271 - DNA, 13 bp, D. melanogaster
aagttgattaaaa

SEQ ID NO: 561272 - DNA, 13 bp, D. melanogaster
aagttgattaaat

SEQ ID NO: 561273 - DNA, 14 bp, D. melanogaster
aagttgattaaatt

SEQ ID NO: 561274 - DNA, 13 bp, D. melanogaster
aagttgattaatt

SEQ ID NO: 561275 - DNA, 13 bp, D. melanogaster
aagttgatttcaa

SEQ ID NO: 561276 - DNA, 13 bp, D. melanogaster
aagttgatttgtt

SEQ ID NO: 561277 - DNA, 13 bp, D. melanogaster
aagttgattttcc

SEQ ID NO: 561278 - DNA, 13 bp, D. melanogaster
aagttgattttgt

SEQ ID NO: 561279 - DNA, 13 bp, D. melanogaster
aagttgcaaaaat

SEQ ID NO: 561280 - DNA, 13 bp, D. melanogaster
aagttgcaaaggg

SEQ ID NO: 561281 - DNA, 13 bp, D. melanogaster
aagttgcaaagtt

SEQ ID NO: 561282 - DNA, 13 bp, D. melanogaster
aagttgcaacaaa

SEQ ID NO: 561283 - DNA, 13 bp, D. melanogaster
aagttgcaacaat

SEQ ID NO: 561284 - DNA, 13 bp, D. melanogaster
aagttgcaactgc

SEQ ID NO: 561285 - DNA, 14 bp, D. melanogaster
aagttgcaactgca

SEQ ID NO: 561286 - DNA, 13 bp, D. melanogaster
aagttgcaacttt

SEQ ID NO: 561287 - DNA, 13 bp, D. melanogaster
aagttgcaagttg

SEQ ID NO: 561288 - DNA, 14 bp, D. melanogaster
aagttgcaagttgc

SEQ ID NO: 561289 - DNA, 13 bp, D. melanogaster
aagttgcaattgc

SEQ ID NO: 561290 - DNA, 13 bp, D. melanogaster
aagttgcagcaac

SEQ ID NO: 561291 - DNA, 13 bp, D. melanogaster
aagttgcagccaa

SEQ ID NO: 561292 - DNA, 13 bp, D. melanogaster
aagttgcagttgc

SEQ ID NO: 561293 - DNA, 14 bp, D. melanogaster
aagttgcagttgca

SEQ ID NO: 561294 - DNA, 13 bp, D. melanogaster
aagttgcataatt

SEQ ID NO: 561295 - DNA, 13 bp, D. melanogaster
aagttgccaaata

SEQ ID NO: 561296 - DNA, 13 bp, D. melanogaster
aagttgccaacaa

SEQ ID NO: 561297 - DNA, 13 bp, D. melanogaster
aagttgccaagtt

SEQ ID NO: 561298 - DNA, 13 bp, D. melanogaster
aagttgccacaat

SEQ ID NO: 561299 - DNA, 13 bp, D. melanogaster
aagttgccactgc

SEQ ID NO: 561300 - DNA, 13 bp, D. melanogaster
aagttgccagcca

SEQ ID NO: 561301 - DNA, 13 bp, D. melanogaster
aagttgccgctaa

SEQ ID NO: 561302 - DNA, 13 bp, D. melanogaster
aagttgctgctgc

SEQ ID NO: 561303 - DNA, 13 bp, D. melanogaster
aagttgctggccg

SEQ ID NO: 561304 - DNA, 13 bp, D. melanogaster
aagttgctggctg

SEQ ID NO: 561305 - DNA, 13 bp, D. melanogaster
aagttggaaaaat

SEQ ID NO: 561306 - DNA, 14 bp, D. melanogaster
aagttggaaaaatc

SEQ ID NO: 561307 - DNA, 13 bp, D. melanogaster
aagttggaagttg

SEQ ID NO: 561308 - DNA, 13 bp, D. melanogaster
aagttggaatgca

SEQ ID NO: 561309 - DNA, 13 bp, D. melanogaster
aagttggagacga

SEQ ID NO: 561310 - DNA, 13 bp, D. melanogaster
aagttggcaaaac

SEQ ID NO: 561311 - DNA, 13 bp, D. melanogaster
aagttggcaaaag

SEQ ID NO: 561312 - DNA, 13 bp, D. melanogaster
aagttggcaaaat

SEQ ID NO: 561313 - DNA, 13 bp, D. melanogaster
aagttggcattaa

SEQ ID NO: 561314 - DNA, 13 bp, D. melanogaster
aagttggccaaaa

SEQ ID NO: 561315 - DNA, 14 bp, D. melanogaster
aagttggccaaaaa

SEQ ID NO: 561316 - DNA, 14 bp, D. melanogaster
aagttggccaaaac

SEQ ID NO: 561317 - DNA, 14 bp, D. melanogaster
aagttggccaaaag

SEQ ID NO: 561318 - DNA, 13 bp, D. melanogaster
aagttggccaaag

SEQ ID NO: 561319 - DNA, 13 bp, D. melanogaster
aagttggccaaat

SEQ ID NO: 561320 - DNA, 13 bp, D. melanogaster
aagttggccaaca

SEQ ID NO: 561321 - DNA, 14 bp, D. melanogaster
aagttggccaacaa

SEQ ID NO: 561322 - DNA, 13 bp, D. melanogaster
aagttggccaatt

SEQ ID NO: 561323 - DNA, 13 bp, D. melanogaster
aagttggccagaa

SEQ ID NO: 561324 - DNA, 13 bp, D. melanogaster
aagttggcccaaa

SEQ ID NO: 561325 - DNA, 14 bp, D. melanogaster
aagttggccctgga

SEQ ID NO: 561326 - DNA, 13 bp, D. melanogaster
aagttggctaaaa

SEQ ID NO: 561327 - DNA, 13 bp, D. melanogaster
aagttggcttggc

SEQ ID NO: 561328 - DNA, 13 bp, D. melanogaster
aagttggctttaa

SEQ ID NO: 561329 - DNA, 13 bp, D. melanogaster
aagttgggcaaat

SEQ ID NO: 561330 - DNA, 13 bp, D. melanogaster
aagttggtgatgc

SEQ ID NO: 561331 - DNA, 13 bp, D. melanogaster
aagttggttaaaa

SEQ ID NO: 561332 - DNA, 13 bp, D. melanogaster
aagttgtaaacaa

SEQ ID NO: 561333 - DNA, 13 bp, D. melanogaster
aagttgtaaagtt

SEQ ID NO: 561334 - DNA, 13 bp, D. melanogaster
aagttgtaaattt

SEQ ID NO: 561335 - DNA, 13 bp, D. melanogaster
aagttgtaattta

SEQ ID NO: 561336 - DNA, 13 bp, D. melanogaster
aagttgtataaat

SEQ ID NO: 561337 - DNA, 13 bp, D. melanogaster
aagttgtattatt

SEQ ID NO: 561338 - DNA, 13 bp, D. melanogaster
aagttgtcaataa

SEQ ID NO: 561339 - DNA, 14 bp, D. melanogaster
aagttgtcaataat

SEQ ID NO: 561340 - DNA, 13 bp, D. melanogaster
aagttgtgaagta

SEQ ID NO: 561341 - DNA, 13 bp, D. melanogaster
aagttgtgcaaaa

SEQ ID NO: 561342 - DNA, 13 bp, D. melanogaster
aagttgtggcaaa

SEQ ID NO: 561343 - DNA, 14 bp, D. melanogaster
aagttgtggcaaaa

SEQ ID NO: 561344 - DNA, 14 bp, D. melanogaster
aagttgtggccaaa

SEQ ID NO: 561345 - DNA, 13 bp, D. melanogaster
aagttgtggctat

SEQ ID NO: 561346 - DNA, 13 bp, D. melanogaster
aagttgttaagtt

SEQ ID NO: 561347 - DNA, 13 bp, D. melanogaster
aagttgttaatta

SEQ ID NO: 561348 - DNA, 13 bp, D. melanogaster
aagttgttgaatt

SEQ ID NO: 561349 - DNA, 14 bp, D. melanogaster
aagttgttgattga

SEQ ID NO: 561350 - DNA, 13 bp, D. melanogaster
aagttgttgcaaa

SEQ ID NO: 561351 - DNA, 13 bp, D. melanogaster
aagttgttgcagc

SEQ ID NO: 561352 - DNA, 13 bp, D. melanogaster
aagttgttgctgt

SEQ ID NO: 561353 - DNA, 13 bp, D. melanogaster
aagttgttggctt

SEQ ID NO: 561354 - DNA, 13 bp, D. melanogaster
aagttgtttagaa

SEQ ID NO: 561355 - DNA, 13 bp, D. melanogaster
aagttgtttcttt

SEQ ID NO: 561356 - DNA, 13 bp, D. melanogaster
aagttgtttgcct

SEQ ID NO: 561357 - DNA, 13 bp, D. melanogaster
aagttgtttggcc

SEQ ID NO: 561358 - DNA, 13 bp, D. melanogaster
aagttgttttctt

SEQ ID NO: 561359 - DNA, 13 bp, D. melanogaster
aagtttaaaaagt

SEQ ID NO: 561360 - DNA, 13 bp, D. melanogaster
aagtttaaaatgc

SEQ ID NO: 561361 - DNA, 13 bp, D. melanogaster
aagtttaaaattg

SEQ ID NO: 561362 - DNA, 13 bp, D. melanogaster
aagtttaaattca

SEQ ID NO: 561363 - DNA, 13 bp, D. melanogaster
aagtttaaattga

SEQ ID NO: 561364 - DNA, 14 bp, D. melanogaster
aagtttaaattgaa

SEQ ID NO: 561365 - DNA, 13 bp, D. melanogaster
aagtttaagaaat

SEQ ID NO: 561366 - DNA, 13 bp, D. melanogaster
aagtttaagatgt

SEQ ID NO: 561367 - DNA, 14 bp, D. melanogaster
aagtttaagatgtt

SEQ ID NO: 561368 - DNA, 13 bp, D. melanogaster
aagtttaagcaaa

SEQ ID NO: 561369 - DNA, 13 bp, D. melanogaster
aagtttaagttaa

SEQ ID NO: 561370 - DNA, 13 bp, D. melanogaster
aagtttaatgttt

SEQ ID NO: 561371 - DNA, 13 bp, D. melanogaster
aagtttaattccc

SEQ ID NO: 561372 - DNA, 13 bp, D. melanogaster
aagtttaattgaa

SEQ ID NO: 561373 - DNA, 13 bp, D. melanogaster
aagtttaatttag

SEQ ID NO: 561374 - DNA, 13 bp, D. melanogaster
aagtttacaaaat

SEQ ID NO: 561375 - DNA, 13 bp, D. melanogaster
aagtttacttttg

SEQ ID NO: 561376 - DNA, 13 bp, D. melanogaster
aagtttacttttt

SEQ ID NO: 561377 - DNA, 13 bp, D. melanogaster
aagtttaggatga

SEQ ID NO: 561378 - DNA, 13 bp, D. melanogaster
aagtttagtagtt

SEQ ID NO: 561379 - DNA, 13 bp, D. melanogaster
aagtttataaaca

SEQ ID NO: 561380 - DNA, 15 bp, D. melanogaster
aagtttataataccg

SEQ ID NO: 561381 - DNA, 13 bp, D. melanogaster
aagtttatatgta

SEQ ID NO: 561382 - DNA, 13 bp, D. melanogaster
aagtttatcaata

SEQ ID NO: 561383 - DNA, 13 bp, D. melanogaster
aagtttatgaaaa

SEQ ID NO: 561384 - DNA, 13 bp, D. melanogaster
aagtttatgcaaa

SEQ ID NO: 561385 - DNA, 13 bp, D. melanogaster
aagtttatgcaat

SEQ ID NO: 561386 - DNA, 13 bp, D. melanogaster
aagtttatggcaa

SEQ ID NO: 561387 - DNA, 13 bp, D. melanogaster
aagtttattattg

SEQ ID NO: 561388 - DNA, 13 bp, D. melanogaster
aagtttattgaat

SEQ ID NO: 561389 - DNA, 13 bp, D. melanogaster
aagtttattgcaa

SEQ ID NO: 561390 - DNA, 13 bp, D. melanogaster
aagtttattgctg

SEQ ID NO: 561391 - DNA, 13 bp, D. melanogaster
aagtttattttca

SEQ ID NO: 561392 - DNA, 14 bp, D. melanogaster
aagtttattttcaa

SEQ ID NO: 561393 - DNA, 13 bp, D. melanogaster
aagtttattttgc

SEQ ID NO: 561394 - DNA, 13 bp, D. melanogaster
aagtttcaaaatg

SEQ ID NO: 561395 - DNA, 13 bp, D. melanogaster
aagtttcaagttt

SEQ ID NO: 561396 - DNA, 13 bp, D. melanogaster
aagtttcactttc

SEQ ID NO: 561397 - DNA, 13 bp, D. melanogaster
aagtttcagcaga

SEQ ID NO: 561398 - DNA, 13 bp, D. melanogaster
aagtttcatttga

SEQ ID NO: 561399 - DNA, 13 bp, D. melanogaster
aagtttcattttt

SEQ ID NO: 561400 - DNA, 13 bp, D. melanogaster
aagtttccacctc

SEQ ID NO: 561401 - DNA, 13 bp, D. melanogaster
aagtttccccttt

SEQ ID NO: 561402 - DNA, 13 bp, D. melanogaster
aagtttccctttg

SEQ ID NO: 561403 - DNA, 13 bp, D. melanogaster
aagtttccgattt

SEQ ID NO: 561404 - DNA, 14 bp, D. melanogaster
aagtttccgattta

SEQ ID NO: 561405 - DNA, 13 bp, D. melanogaster
aagtttccttttg

SEQ ID NO: 561406 - DNA, 13 bp, D. melanogaster
aagtttcgaaaaa

SEQ ID NO: 561407 - DNA, 13 bp, D. melanogaster
aagtttcgctttt

SEQ ID NO: 561408 - DNA, 13 bp, D. melanogaster
aagtttcggtttc

SEQ ID NO: 561409 - DNA, 13 bp, D. melanogaster
aagtttctggcca

SEQ ID NO: 561410 - DNA, 13 bp, D. melanogaster
aagtttcttaaaa

SEQ ID NO: 561411 - DNA, 13 bp, D. melanogaster
aagtttctttgtt

SEQ ID NO: 561412 - DNA, 13 bp, D. melanogaster
aagtttcttttaa

SEQ ID NO: 561413 - DNA, 13 bp, D. melanogaster
aagtttgaaaagt

SEQ ID NO: 561414 - DNA, 13 bp, D. melanogaster
aagtttgaaatat

SEQ ID NO: 561415 - DNA, 13 bp, D. melanogaster
aagtttgagtttt

SEQ ID NO: 561416 - DNA, 13 bp, D. melanogaster
aagtttgatgata

SEQ ID NO: 561417 - DNA, 13 bp, D. melanogaster
aagtttgatttcg

SEQ ID NO: 561418 - DNA, 13 bp, D. melanogaster
aagtttgcaacaa

SEQ ID NO: 561419 - DNA, 13 bp, D. melanogaster
aagtttgcacttt

SEQ ID NO: 561420 - DNA, 13 bp, D. melanogaster
aagtttgcattta

SEQ ID NO: 561421 - DNA, 13 bp, D. melanogaster
aagtttgccaaaa

SEQ ID NO: 561422 - DNA, 13 bp, D. melanogaster
aagtttgccaaat

SEQ ID NO: 561423 - DNA, 13 bp, D. melanogaster
aagtttgccaact

SEQ ID NO: 561424 - DNA, 13 bp, D. melanogaster
aagtttgccaagt

SEQ ID NO: 561425 - DNA, 13 bp, D. melanogaster
aagtttgcgaaag

SEQ ID NO: 561426 - DNA, 13 bp, D. melanogaster
aagtttgcggcaa

SEQ ID NO: 561427 - DNA, 13 bp, D. melanogaster
aagtttgctttaa

SEQ ID NO: 561428 - DNA, 13 bp, D. melanogaster
aagtttgcttttg

SEQ ID NO: 561429 - DNA, 13 bp, D. melanogaster
aagtttgcttttt

SEQ ID NO: 561430 - DNA, 13 bp, D. melanogaster
aagtttggcaaaa

SEQ ID NO: 561431 - DNA, 13 bp, D. melanogaster
aagtttgtaaaaa

SEQ ID NO: 561432 - DNA, 14 bp, D. melanogaster
aagtttgtgtttaa

SEQ ID NO: 561433 - DNA, 13 bp, D. melanogaster
aagtttgttgatc

SEQ ID NO: 561434 - DNA, 13 bp, D. melanogaster
aagtttgttgcca

SEQ ID NO: 561435 - DNA, 13 bp, D. melanogaster
aagtttgttgcct

SEQ ID NO: 561436 - DNA, 13 bp, D. melanogaster
aagtttgttgtgt

SEQ ID NO: 561437 - DNA, 13 bp, D. melanogaster
aagtttgtttaaa

SEQ ID NO: 561438 - DNA, 13 bp, D. melanogaster
aagttttaaaact

SEQ ID NO: 561439 - DNA, 13 bp, D. melanogaster
aagttttaaaatg

SEQ ID NO: 561440 - DNA, 13 bp, D. melanogaster
aagttttaaacat

SEQ ID NO: 561441 - DNA, 13 bp, D. melanogaster
aagttttaaactt

SEQ ID NO: 561442 - DNA, 13 bp, D. melanogaster
aagttttaaagtt

SEQ ID NO: 561443 - DNA, 13 bp, D. melanogaster
aagttttaaattg

SEQ ID NO: 561444 - DNA, 13 bp, D. melanogaster
aagttttaacatc

SEQ ID NO: 561445 - DNA, 13 bp, D. melanogaster
aagttttaagcaa

SEQ ID NO: 561446 - DNA, 13 bp, D. melanogaster
aagttttaagtta

SEQ ID NO: 561447 - DNA, 13 bp, D. melanogaster
aagttttaatttg

SEQ ID NO: 561448 - DNA, 13 bp, D. melanogaster
aagttttacaaat

SEQ ID NO: 561449 - DNA, 13 bp, D. melanogaster
aagttttacctta

SEQ ID NO: 561450 - DNA, 13 bp, D. melanogaster
aagttttagtttg

SEQ ID NO: 561451 - DNA, 13 bp, D. melanogaster
aagttttatgaat

SEQ ID NO: 561452 - DNA, 14 bp, D. melanogaster
aagttttcaaaaat

SEQ ID NO: 561453 - DNA, 13 bp, D. melanogaster
aagttttcaaaag

SEQ ID NO: 561454 - DNA, 13 bp, D. melanogaster
aagttttcaaagt

SEQ ID NO: 561455 - DNA, 13 bp, D. melanogaster
aagttttcaaatc

SEQ ID NO: 561456 - DNA, 13 bp, D. melanogaster
aagttttcaataa

SEQ ID NO: 561457 - DNA, 13 bp, D. melanogaster
aagttttcaatta

SEQ ID NO: 561458 - DNA, 13 bp, D. melanogaster
aagttttcattat

SEQ ID NO: 561459 - DNA, 13 bp, D. melanogaster
aagttttccaaaa

SEQ ID NO: 561460 - DNA, 13 bp, D. melanogaster
aagttttccaaat

SEQ ID NO: 561461 - DNA, 13 bp, D. melanogaster
aagttttccactc

SEQ ID NO: 561462 - DNA, 13 bp, D. melanogaster
aagttttccactt

SEQ ID NO: 561463 - DNA, 13 bp, D. melanogaster
aagttttccagca

SEQ ID NO: 561464 - DNA, 13 bp, D. melanogaster
aagttttccagct

SEQ ID NO: 561465 - DNA, 13 bp, D. melanogaster
aagttttccattt

SEQ ID NO: 561466 - DNA, 14 bp, D. melanogaster
aagttttccatttc

SEQ ID NO: 561467 - DNA, 13 bp, D. melanogaster
aagttttccgctt

SEQ ID NO: 561468 - DNA, 13 bp, D. melanogaster
aagttttcctttt

SEQ ID NO: 561469 - DNA, 13 bp, D. melanogaster
aagttttcgattt

SEQ ID NO: 561470 - DNA, 13 bp, D. melanogaster
aagttttcgttgc

SEQ ID NO: 561471 - DNA, 13 bp, D. melanogaster
aagttttcgtttt

SEQ ID NO: 561472 - DNA, 14 bp, D. melanogaster
aagttttcgttttg

SEQ ID NO: 561473 - DNA, 13 bp, D. melanogaster
aagttttctaatt

SEQ ID NO: 561474 - DNA, 13 bp, D. melanogaster
aagttttctttaa

SEQ ID NO: 561475 - DNA, 13 bp, D. melanogaster
aagttttctttta

SEQ ID NO: 561476 - DNA, 14 bp, D. melanogaster
aagttttcttttaa

SEQ ID NO: 561477 - DNA, 13 bp, D. melanogaster
aagttttgaagtt

SEQ ID NO: 561478 - DNA, 13 bp, D. melanogaster
aagttttgaattt

SEQ ID NO: 561479 - DNA, 13 bp, D. melanogaster
aagttttgagttt

SEQ ID NO: 561480 - DNA, 13 bp, D. melanogaster
aagttttgatata

SEQ ID NO: 561481 - DNA, 14 bp, D. melanogaster
aagttttgcaaaaa

SEQ ID NO: 561482 - DNA, 13 bp, D. melanogaster
aagttttgccatt

SEQ ID NO: 561483 - DNA, 13 bp, D. melanogaster
aagttttgcttaa

SEQ ID NO: 561484 - DNA, 13 bp, D. melanogaster
aagttttggcaaa

SEQ ID NO: 561485 - DNA, 13 bp, D. melanogaster
aagttttggcatt

SEQ ID NO: 561486 - DNA, 14 bp, D. melanogaster
aagttttggccaaa

SEQ ID NO: 561487 - DNA, 13 bp, D. melanogaster
aagtttttaaagt

SEQ ID NO: 561488 - DNA, 13 bp, D. melanogaster
aagtttttaatca

SEQ ID NO: 561489 - DNA, 13 bp, D. melanogaster
aagtttttaatgt

SEQ ID NO: 561490 - DNA, 13 bp, D. melanogaster
aagtttttaattg

SEQ ID NO: 561491 - DNA, 13 bp, D. melanogaster
aagtttttacaaa

SEQ ID NO: 561492 - DNA, 13 bp, D. melanogaster
aagtttttacatt

SEQ ID NO: 561493 - DNA, 13 bp, D. melanogaster
aagtttttagaaa

SEQ ID NO: 561494 - DNA, 13 bp, D. melanogaster
aagtttttcatta

SEQ ID NO: 561495 - DNA, 13 bp, D. melanogaster
aagtttttcattt

SEQ ID NO: 561496 - DNA, 13 bp, D. melanogaster
aagtttttccaat

SEQ ID NO: 561497 - DNA, 14 bp, D. melanogaster
aagtttttccagct

SEQ ID NO: 561498 - DNA, 13 bp, D. melanogaster
aagtttttcctac

SEQ ID NO: 561499 - DNA, 13 bp, D. melanogaster
aagtttttcgatt

SEQ ID NO: 561500 - DNA, 13 bp, D. melanogaster
aagtttttcgctt

SEQ ID NO: 561501 - DNA, 13 bp, D. melanogaster
aagtttttcggca

SEQ ID NO: 561502 - DNA, 13 bp, D. melanogaster
aagtttttgaaaa

SEQ ID NO: 561503 - DNA, 13 bp, D. melanogaster
aagtttttgaaat

SEQ ID NO: 561504 - DNA, 13 bp, D. melanogaster
aagtttttgataa

SEQ ID NO: 561505 - DNA, 14 bp, D. melanogaster
aagtttttgatcaa

SEQ ID NO: 561506 - DNA, 13 bp, D. melanogaster
aagtttttgcaat

SEQ ID NO: 561507 - DNA, 13 bp, D. melanogaster
aagtttttgcagg

SEQ ID NO: 561508 - DNA, 13 bp, D. melanogaster
aagtttttgcatt

SEQ ID NO: 561509 - DNA, 13 bp, D. melanogaster
aagtttttgccat

SEQ ID NO: 561510 - DNA, 13 bp, D. melanogaster
aagtttttggcag

SEQ ID NO: 561511 - DNA, 13 bp, D. melanogaster
aagtttttggcct

SEQ ID NO: 561512 - DNA, 14 bp, D. melanogaster
aagtttttggcctt

SEQ ID NO: 561513 - DNA, 13 bp, D. melanogaster
aagtttttgtgta

SEQ ID NO: 561514 - DNA, 13 bp, D. melanogaster
aagtttttgttcg

SEQ ID NO: 561515 - DNA, 13 bp, D. melanogaster
aagttttttaagt

SEQ ID NO: 561516 - DNA, 13 bp, D. melanogaster
aagttttttctca

SEQ ID NO: 561517 - DNA, 13 bp, D. melanogaster
aagttttttggca

SEQ ID NO: 561518 - DNA, 13 bp, D. melanogaster
aagttttttgtag

SEQ ID NO: 561519 - DNA, 14 bp, D. melanogaster
aataaaaaacgttt

SEQ ID NO: 561520 - DNA, 13 bp, D. melanogaster
aataaaaaactgt

SEQ ID NO: 561521 - DNA, 13 bp, D. melanogaster
aataaaaaatctg

SEQ ID NO: 561522 - DNA, 13 bp, D. melanogaster
aataaaaaatgct

SEQ ID NO: 561523 - DNA, 14 bp, D. melanogaster
aataaaaaatgctc

SEQ ID NO: 561524 - DNA, 13 bp, D. melanogaster
aataaaaaccgca

SEQ ID NO: 561525 - DNA, 13 bp, D. melanogaster
aataaaaacgcca

SEQ ID NO: 561526 - DNA, 13 bp, D. melanogaster
aataaaaactgca

SEQ ID NO: 561527 - DNA, 14 bp, D. melanogaster
aataaaaagcaatg

SEQ ID NO: 561528 - DNA, 14 bp, D. melanogaster
aataaaaagcaatt

SEQ ID NO: 561529 - DNA, 13 bp, D. melanogaster
aataaaaagccat

SEQ ID NO: 561530 - DNA, 13 bp, D. melanogaster
aataaaaagccga

SEQ ID NO: 561531 - DNA, 13 bp, D. melanogaster
aataaaaagctat

SEQ ID NO: 561532 - DNA, 13 bp, D. melanogaster
aataaaaatagct

SEQ ID NO: 561533 - DNA, 13 bp, D. melanogaster
aataaaaatatgc

SEQ ID NO: 561534 - DNA, 13 bp, D. melanogaster
aataaaaatcagc

SEQ ID NO: 561535 - DNA, 13 bp, D. melanogaster
aataaaaatgcca

SEQ ID NO: 561536 - DNA, 14 bp, D. melanogaster
aataaaaatgccaa

SEQ ID NO: 561537 - DNA, 14 bp, D. melanogaster
aataaaaatgtcac

SEQ ID NO: 561538 - DNA, 14 bp, D. melanogaster
aataaaaatgttca

SEQ ID NO: 561539 - DNA, 13 bp, D. melanogaster
aataaaaattctc

SEQ ID NO: 561540 - DNA, 14 bp, D. melanogaster
aataaaaattgcat

SEQ ID NO: 561541 - DNA, 13 bp, D. melanogaster
aataaaaattgcc

SEQ ID NO: 561542 - DNA, 13 bp, D. melanogaster
aataaaacaagtc

SEQ ID NO: 561543 - DNA, 13 bp, D. melanogaster
aataaaacaatgc

SEQ ID NO: 561544 - DNA, 13 bp, D. melanogaster
aataaaacaattg

SEQ ID NO: 561545 - DNA, 13 bp, D. melanogaster
aataaaacagcac

SEQ ID NO: 561546 - DNA, 13 bp, D. melanogaster
aataaaacagttt

SEQ ID NO: 561547 - DNA, 14 bp, D. melanogaster
aataaaacattttg

SEQ ID NO: 561548 - DNA, 13 bp, D. melanogaster
aataaaacccatt

SEQ ID NO: 561549 - DNA, 13 bp, D. melanogaster
aataaaaccgaat

SEQ ID NO: 561550 - DNA, 13 bp, D. melanogaster
aataaaacctttt

SEQ ID NO: 561551 - DNA, 14 bp, D. melanogaster
aataaaacgaaatt

SEQ ID NO: 561552 - DNA, 13 bp, D. melanogaster
aataaaacgaatg

SEQ ID NO: 561553 - DNA, 13 bp, D. melanogaster
aataaaacgatat

SEQ ID NO: 561554 - DNA, 13 bp, D. melanogaster
aataaaacgatta

SEQ ID NO: 561555 - DNA, 14 bp, D. melanogaster
aataaaacgattaa

SEQ ID NO: 561556 - DNA, 13 bp, D. melanogaster
aataaaacggaat

SEQ ID NO: 561557 - DNA, 13 bp, D. melanogaster
aataaaacgtaat

SEQ ID NO: 561558 - DNA, 13 bp, D. melanogaster
aataaaacgtgcc

SEQ ID NO: 561559 - DNA, 13 bp, D. melanogaster
aataaaacgtttc

SEQ ID NO: 561560 - DNA, 15 bp, D. melanogaster
aataaaactacagat

SEQ ID NO: 561561 - DNA, 13 bp, D. melanogaster
aataaaactgcaa

SEQ ID NO: 561562 - DNA, 13 bp, D. melanogaster
aataaaactggaa

SEQ ID NO: 561563 - DNA, 13 bp, D. melanogaster
aataaaactgtca

SEQ ID NO: 561564 - DNA, 13 bp, D. melanogaster
aataaaactttcc

SEQ ID NO: 561565 - DNA, 13 bp, D. melanogaster
aataaaagagcca

SEQ ID NO: 561566 - DNA, 13 bp, D. melanogaster
aataaaagagttt

SEQ ID NO: 561567 - DNA, 13 bp, D. melanogaster
aataaaagattca

SEQ ID NO: 561568 - DNA, 14 bp, D. melanogaster
aataaaagcaaatt

SEQ ID NO: 561569 - DNA, 13 bp, D. melanogaster
aataaaagcaatt

SEQ ID NO: 561570 - DNA, 14 bp, D. melanogaster
aataaaagcaattt

SEQ ID NO: 561571 - DNA, 13 bp, D. melanogaster
aataaaagcagct

SEQ ID NO: 561572 - DNA, 14 bp, D. melanogaster
aataaaagcatttt

SEQ ID NO: 561573 - DNA, 13 bp, D. melanogaster
aataaaagccaac

SEQ ID NO: 561574 - DNA, 13 bp, D. melanogaster
aataaaagccaag

SEQ ID NO: 561575 - DNA, 13 bp, D. melanogaster
aataaaagccacg

SEQ ID NO: 561576 - DNA, 13 bp, D. melanogaster
aataaaagccatt

SEQ ID NO: 561577 - DNA, 14 bp, D. melanogaster
aataaaagcgaaac

SEQ ID NO: 561578 - DNA, 13 bp, D. melanogaster
aataaaagcgaac

SEQ ID NO: 561579 - DNA, 13 bp, D. melanogaster
aataaaagcggaa

SEQ ID NO: 561580 - DNA, 13 bp, D. melanogaster
aataaaagcttaa

SEQ ID NO: 561581 - DNA, 13 bp, D. melanogaster
aataaaagctttt

SEQ ID NO: 561582 - DNA, 13 bp, D. melanogaster
aataaaagggtat

SEQ ID NO: 561583 - DNA, 13 bp, D. melanogaster
aataaaaggtgta

SEQ ID NO: 561584 - DNA, 13 bp, D. melanogaster
aataaaagtgcat

SEQ ID NO: 561585 - DNA, 13 bp, D. melanogaster
aataaaagttatg

SEQ ID NO: 561586 - DNA, 13 bp, D. melanogaster
aataaaagttcat

SEQ ID NO: 561587 - DNA, 13 bp, D. melanogaster
aataaaagttggc

SEQ ID NO: 561588 - DNA, 13 bp, D. melanogaster
aataaaagttttg

SEQ ID NO: 561589 - DNA, 13 bp, D. melanogaster
aataaaatagcat

SEQ ID NO: 561590 - DNA, 13 bp, D. melanogaster
aataaaatatgtc

SEQ ID NO: 561591 - DNA, 13 bp, D. melanogaster
aataaaatatgtg

SEQ ID NO: 561592 - DNA, 13 bp, D. melanogaster
aataaaatattcc

SEQ ID NO: 561593 - DNA, 13 bp, D. melanogaster
aataaaatcaatg

SEQ ID NO: 561594 - DNA, 13 bp, D. melanogaster
aataaaatcagtt

SEQ ID NO: 561595 - DNA, 13 bp, D. melanogaster
aataaaatccgaa

SEQ ID NO: 561596 - DNA, 14 bp, D. melanogaster
aataaaatcgaaat

SEQ ID NO: 561597 - DNA, 13 bp, D. melanogaster
aataaaatcgatg

SEQ ID NO: 561598 - DNA, 13 bp, D. melanogaster
aataaaatcgcaa

SEQ ID NO: 561599 - DNA, 13 bp, D. melanogaster
aataaaatcggaa

SEQ ID NO: 561600 - DNA, 13 bp, D. melanogaster
aataaaatcgttt

SEQ ID NO: 561601 - DNA, 14 bp, D. melanogaster
aataaaatgaaatc

SEQ ID NO: 561602 - DNA, 13 bp, D. melanogaster
aataaaatgaact

SEQ ID NO: 561603 - DNA, 14 bp, D. melanogaster
aataaaatgcaaat

SEQ ID NO: 561604 - DNA, 14 bp, D. melanogaster
aataaaatgcaatt

SEQ ID NO: 561605 - DNA, 13 bp, D. melanogaster
aataaaatgcaga

SEQ ID NO: 561606 - DNA, 14 bp, D. melanogaster
aataaaatgcattt

SEQ ID NO: 561607 - DNA, 13 bp, D. melanogaster
aataaaatgccaa

SEQ ID NO: 561608 - DNA, 13 bp, D. melanogaster
aataaaatgcttt

SEQ ID NO: 561609 - DNA, 13 bp, D. melanogaster
aataaaatggcaa

SEQ ID NO: 561610 - DNA, 14 bp, D. melanogaster
aataaaatggcaaa

SEQ ID NO: 561611 - DNA, 13 bp, D. melanogaster
aataaaatgtact

SEQ ID NO: 561612 - DNA, 13 bp, D. melanogaster
aataaaatgtcat

SEQ ID NO: 561613 - DNA, 14 bp, D. melanogaster
aataaaatgtgttt

SEQ ID NO: 561614 - DNA, 13 bp, D. melanogaster
aataaaatgttga

SEQ ID NO: 561615 - DNA, 13 bp, D. melanogaster
aataaaattatgc

SEQ ID NO: 561616 - DNA, 14 bp, D. melanogaster
aataaaattatgca

SEQ ID NO: 561617 - DNA, 14 bp, D. melanogaster
aataaaattattgg

SEQ ID NO: 561618 - DNA, 13 bp, D. melanogaster
aataaaattccca

SEQ ID NO: 561619 - DNA, 13 bp, D. melanogaster
aataaaattcgaa

SEQ ID NO: 561620 - DNA, 13 bp, D. melanogaster
aataaaattgatg

SEQ ID NO: 561621 - DNA, 13 bp, D. melanogaster
aataaaattggat

SEQ ID NO: 561622 - DNA, 13 bp, D. melanogaster
aataaaattggta

SEQ ID NO: 561623 - DNA, 14 bp, D. melanogaster
aataaaattgtttg

SEQ ID NO: 561624 - DNA, 13 bp, D. melanogaster
aataaaatttcag

SEQ ID NO: 561625 - DNA, 14 bp, D. melanogaster
aataaacaaaatgc

SEQ ID NO: 561626 - DNA, 14 bp, D. melanogaster
aataaacaaaatgt

SEQ ID NO: 561627 - DNA, 13 bp, D. melanogaster
aataaacaaaccg

SEQ ID NO: 561628 - DNA, 13 bp, D. melanogaster
aataaacaaagtg

SEQ ID NO: 561629 - DNA, 13 bp, D. melanogaster
aataaacaaagtt

SEQ ID NO: 561630 - DNA, 13 bp, D. melanogaster
aataaacaacttt

SEQ ID NO: 561631 - DNA, 13 bp, D. melanogaster
aataaacaagatt

SEQ ID NO: 561632 - DNA, 13 bp, D. melanogaster
aataaacaagtta

SEQ ID NO: 561633 - DNA, 13 bp, D. melanogaster
aataaacaagttt

SEQ ID NO: 561634 - DNA, 13 bp, D. melanogaster
aataaacaatctt

SEQ ID NO: 561635 - DNA, 13 bp, D. melanogaster
aataaacaattag

SEQ ID NO: 561636 - DNA, 13 bp, D. melanogaster
aataaacaattgt

SEQ ID NO: 561637 - DNA, 13 bp, D. melanogaster
aataaacaatttc

SEQ ID NO: 561638 - DNA, 13 bp, D. melanogaster
aataaacaatttg

SEQ ID NO: 561639 - DNA, 13 bp, D. melanogaster
aataaacacaagt

SEQ ID NO: 561640 - DNA, 13 bp, D. melanogaster
aataaacacattt

SEQ ID NO: 561641 - DNA, 14 bp, D. melanogaster
aataaacacatttt

SEQ ID NO: 561642 - DNA, 13 bp, D. melanogaster
aataaacactttt

SEQ ID NO: 561643 - DNA, 13 bp, D. melanogaster
aataaacagaatt

SEQ ID NO: 561644 - DNA, 13 bp, D. melanogaster
aataaacagcaac

SEQ ID NO: 561645 - DNA, 13 bp, D. melanogaster
aataaacagtttt

SEQ ID NO: 561646 - DNA, 13 bp, D. melanogaster
aataaacataatg

SEQ ID NO: 561647 - DNA, 14 bp, D. melanogaster
aataaacatatcga

SEQ ID NO: 561648 - DNA, 13 bp, D. melanogaster
aataaacatggcc

SEQ ID NO: 561649 - DNA, 13 bp, D. melanogaster
aataaacattcta

SEQ ID NO: 561650 - DNA, 13 bp, D. melanogaster
aataaacattgaa

SEQ ID NO: 561651 - DNA, 13 bp, D. melanogaster
aataaacatttct

SEQ ID NO: 561652 - DNA, 13 bp, D. melanogaster
aataaacatttgg

SEQ ID NO: 561653 - DNA, 13 bp, D. melanogaster
aataaaccgaaat

SEQ ID NO: 561654 - DNA, 13 bp, D. melanogaster
aataaacgaaacg

SEQ ID NO: 561655 - DNA, 13 bp, D. melanogaster
aataaacgattaa

SEQ ID NO: 561656 - DNA, 13 bp, D. melanogaster
aataaacgcaaag

SEQ ID NO: 561657 - DNA, 13 bp, D. melanogaster
aataaacgcacac

SEQ ID NO: 561658 - DNA, 13 bp, D. melanogaster
aataaacgttaac

SEQ ID NO: 561659 - DNA, 13 bp, D. melanogaster
aataaactcaatt

SEQ ID NO: 561660 - DNA, 13 bp, D. melanogaster
aataaactcattt

SEQ ID NO: 561661 - DNA, 13 bp, D. melanogaster
aataaactcgaaa

SEQ ID NO: 561662 - DNA, 13 bp, D. melanogaster
aataaactgaaat

SEQ ID NO: 561663 - DNA, 13 bp, D. melanogaster
aataaactgaata

SEQ ID NO: 561664 - DNA, 13 bp, D. melanogaster
aataaactgataa

SEQ ID NO: 561665 - DNA, 13 bp, D. melanogaster
aataaactgcaaa

SEQ ID NO: 561666 - DNA, 13 bp, D. melanogaster
aataaactgcaat

SEQ ID NO: 561667 - DNA, 13 bp, D. melanogaster
aataaactgtaaa

SEQ ID NO: 561668 - DNA, 13 bp, D. melanogaster
aataaactgtctg

SEQ ID NO: 561669 - DNA, 13 bp, D. melanogaster
aataaactgttta

SEQ ID NO: 561670 - DNA, 13 bp, D. melanogaster
aataaacttcaat

SEQ ID NO: 561671 - DNA, 13 bp, D. melanogaster
aataaacttgttt

SEQ ID NO: 561672 - DNA, 13 bp, D. melanogaster
aataaactttaag

SEQ ID NO: 561673 - DNA, 13 bp, D. melanogaster
aataaactttcca

SEQ ID NO: 561674 - DNA, 13 bp, D. melanogaster
aataaacttttcc

SEQ ID NO: 561675 - DNA, 13 bp, D. melanogaster
aataaactttttc

SEQ ID NO: 561676 - DNA, 13 bp, D. melanogaster
aataaactttttg

SEQ ID NO: 561677 - DNA, 13 bp, D. melanogaster
aataaagaaatcc

SEQ ID NO: 561678 - DNA, 13 bp, D. melanogaster
aataaagaactta

SEQ ID NO: 561679 - DNA, 13 bp, D. melanogaster
aataaagacgcta

SEQ ID NO: 561680 - DNA, 13 bp, D. melanogaster
aataaagatttac

SEQ ID NO: 561681 - DNA, 13 bp, D. melanogaster
aataaagcaaagc

SEQ ID NO: 561682 - DNA, 13 bp, D. melanogaster
aataaagcaatta

SEQ ID NO: 561683 - DNA, 13 bp, D. melanogaster
aataaagcatttg

SEQ ID NO: 561684 - DNA, 13 bp, D. melanogaster
aataaagcgaaag

SEQ ID NO: 561685 - DNA, 13 bp, D. melanogaster
aataaagctgaaa

SEQ ID NO: 561686 - DNA, 13 bp, D. melanogaster
aataaagctgcaa

SEQ ID NO: 561687 - DNA, 13 bp, D. melanogaster
aataaagctttta

SEQ ID NO: 561688 - DNA, 13 bp, D. melanogaster
aataaaggcaaat

SEQ ID NO: 561689 - DNA, 13 bp, D. melanogaster
aataaagggcaac

SEQ ID NO: 561690 - DNA, 13 bp, D. melanogaster
aataaagtatctt

SEQ ID NO: 561691 - DNA, 13 bp, D. melanogaster
aataaagtcaaca

SEQ ID NO: 561692 - DNA, 14 bp, D. melanogaster
aataaagtcaatgc

SEQ ID NO: 561693 - DNA, 13 bp, D. melanogaster
aataaagtgattt

SEQ ID NO: 561694 - DNA, 14 bp, D. melanogaster
aataaagtgcaaaa

SEQ ID NO: 561695 - DNA, 13 bp, D. melanogaster
aataaagtggtat

SEQ ID NO: 561696 - DNA, 13 bp, D. melanogaster
aataaagtgttaa

SEQ ID NO: 561697 - DNA, 13 bp, D. melanogaster
aataaagtgtttt

SEQ ID NO: 561698 - DNA, 13 bp, D. melanogaster
aataaagttagtt

SEQ ID NO: 561699 - DNA, 13 bp, D. melanogaster
aataaagttcaaa

SEQ ID NO: 561700 - DNA, 13 bp, D. melanogaster
aataaagttcatt

SEQ ID NO: 561701 - DNA, 13 bp, D. melanogaster
aataaagttgcat

SEQ ID NO: 561702 - DNA, 13 bp, D. melanogaster
aataaagttgcca

SEQ ID NO: 561703 - DNA, 13 bp, D. melanogaster
aataaagttggca

SEQ ID NO: 561704 - DNA, 13 bp, D. melanogaster
aataaagttgttc

SEQ ID NO: 561705 - DNA, 13 bp, D. melanogaster
aataaagtttcaa

SEQ ID NO: 561706 - DNA, 13 bp, D. melanogaster
aataaagttttgc

SEQ ID NO: 561707 - DNA, 13 bp, D. melanogaster
aataaagtttttg

SEQ ID NO: 561708 - DNA, 13 bp, D. melanogaster
aataaataaagcc

SEQ ID NO: 561709 - DNA, 13 bp, D. melanogaster
aataaataaagct

SEQ ID NO: 561710 - DNA, 14 bp, D. melanogaster
aataaataaatcag

SEQ ID NO: 561711 - DNA, 14 bp, D. melanogaster
aataaataaatctg

SEQ ID NO: 561712 - DNA, 14 bp, D. melanogaster
aataaataaattgc

SEQ ID NO: 561713 - DNA, 13 bp, D. melanogaster
aataaataagcca

SEQ ID NO: 561714 - DNA, 13 bp, D. melanogaster
aataaataagcgc

SEQ ID NO: 561715 - DNA, 13 bp, D. melanogaster
aataaataagctg

SEQ ID NO: 561716 - DNA, 13 bp, D. melanogaster
aataaataagctt

SEQ ID NO: 561717 - DNA, 13 bp, D. melanogaster
aataaataagtgt

SEQ ID NO: 561718 - DNA, 13 bp, D. melanogaster
aataaataagttc

SEQ ID NO: 561719 - DNA, 13 bp, D. melanogaster
aataaataagttg

SEQ ID NO: 561720 - DNA, 13 bp, D. melanogaster
aataaataatcag

SEQ ID NO: 561721 - DNA, 13 bp, D. melanogaster
aataaataatggc

SEQ ID NO: 561722 - DNA, 14 bp, D. melanogaster
aataaataatggct

SEQ ID NO: 561723 - DNA, 14 bp, D. melanogaster
aataaataatttgc

SEQ ID NO: 561724 - DNA, 13 bp, D. melanogaster
aataaatacaagc

SEQ ID NO: 561725 - DNA, 13 bp, D. melanogaster
aataaatacagca

SEQ ID NO: 561726 - DNA, 13 bp, D. melanogaster
aataaatacagta

SEQ ID NO: 561727 - DNA, 13 bp, D. melanogaster
aataaatacagtt

SEQ ID NO: 561728 - DNA, 13 bp, D. melanogaster
aataaatacatgt

SEQ ID NO: 561729 - DNA, 13 bp, D. melanogaster
aataaatacattg

SEQ ID NO: 561730 - DNA, 13 bp, D. melanogaster
aataaatacgatt

SEQ ID NO: 561731 - DNA, 13 bp, D. melanogaster
aataaatacgttt

SEQ ID NO: 561732 - DNA, 13 bp, D. melanogaster
aataaatagcttt

SEQ ID NO: 561733 - DNA, 13 bp, D. melanogaster
aataaatatatgg

SEQ ID NO: 561734 - DNA, 13 bp, D. melanogaster
aataaatatcgaa

SEQ ID NO: 561735 - DNA, 13 bp, D. melanogaster
aataaatatgaca

SEQ ID NO: 561736 - DNA, 14 bp, D. melanogaster
aataaatatgcaaa

SEQ ID NO: 561737 - DNA, 13 bp, D. melanogaster
aataaatatgcag

SEQ ID NO: 561738 - DNA, 13 bp, D. melanogaster
aataaatatgcat

SEQ ID NO: 561739 - DNA, 14 bp, D. melanogaster
aataaatatgcatg

SEQ ID NO: 561740 - DNA, 13 bp, D. melanogaster
aataaatatgcca

SEQ ID NO: 561741 - DNA, 13 bp, D. melanogaster
aataaatatggtt

SEQ ID NO: 561742 - DNA, 13 bp, D. melanogaster
aataaatatgtag

SEQ ID NO: 561743 - DNA, 14 bp, D. melanogaster
aataaatatgtatg

SEQ ID NO: 561744 - DNA, 13 bp, D. melanogaster
aataaatatgtca

SEQ ID NO: 561745 - DNA, 13 bp, D. melanogaster
aataaatatgtgt

SEQ ID NO: 561746 - DNA, 13 bp, D. melanogaster
aataaatatgttc

SEQ ID NO: 561747 - DNA, 13 bp, D. melanogaster
aataaatattgca

SEQ ID NO: 561748 - DNA, 13 bp, D. melanogaster
aataaatattgct

SEQ ID NO: 561749 - DNA, 13 bp, D. melanogaster
aataaatatttcc

SEQ ID NO: 561750 - DNA, 14 bp, D. melanogaster
aataaatatttgtg

SEQ ID NO: 561751 - DNA, 13 bp, D. melanogaster
aataaatcaaatg

SEQ ID NO: 561752 - DNA, 14 bp, D. melanogaster
aataaatcaaatgc

SEQ ID NO: 561753 - DNA, 14 bp, D. melanogaster
aataaatcaaattg

SEQ ID NO: 561754 - DNA, 13 bp, D. melanogaster
aataaatcaatgt

SEQ ID NO: 561755 - DNA, 13 bp, D. melanogaster
aataaatcacagc

SEQ ID NO: 561756 - DNA, 13 bp, D. melanogaster
aataaatcacatt

SEQ ID NO: 561757 - DNA, 13 bp, D. melanogaster
aataaatcacttc

SEQ ID NO: 561758 - DNA, 14 bp, D. melanogaster
aataaatcagaaat

SEQ ID NO: 561759 - DNA, 13 bp, D. melanogaster
aataaatcagatt

SEQ ID NO: 561760 - DNA, 13 bp, D. melanogaster
aataaatcatttc

SEQ ID NO: 561761 - DNA, 14 bp, D. melanogaster
aataaatcatttca

SEQ ID NO: 561762 - DNA, 13 bp, D. melanogaster
aataaatccaatt

SEQ ID NO: 561763 - DNA, 13 bp, D. melanogaster
aataaatccattt

SEQ ID NO: 561764 - DNA, 13 bp, D. melanogaster
aataaatccgaaa

SEQ ID NO: 561765 - DNA, 14 bp, D. melanogaster
aataaatccttttg

SEQ ID NO: 561766 - DNA, 13 bp, D. melanogaster
aataaatcgatca

SEQ ID NO: 561767 - DNA, 13 bp, D. melanogaster
aataaatcgcaaa

SEQ ID NO: 561768 - DNA, 13 bp, D. melanogaster
aataaatcgcatt

SEQ ID NO: 561769 - DNA, 13 bp, D. melanogaster
aataaatcgtaaa

SEQ ID NO: 561770 - DNA, 13 bp, D. melanogaster
aataaatcgtttt

SEQ ID NO: 561771 - DNA, 13 bp, D. melanogaster
aataaatctgcaa

SEQ ID NO: 561772 - DNA, 13 bp, D. melanogaster
aataaatcttctg

SEQ ID NO: 561773 - DNA, 14 bp, D. melanogaster
aataaatcttctga

SEQ ID NO: 561774 - DNA, 13 bp, D. melanogaster
aataaatgaaacg

SEQ ID NO: 561775 - DNA, 13 bp, D. melanogaster
aataaatgaaact

SEQ ID NO: 561776 - DNA, 13 bp, D. melanogaster
aataaatgaagtt

SEQ ID NO: 561777 - DNA, 13 bp, D. melanogaster
aataaatgaatgt

SEQ ID NO: 561778 - DNA, 13 bp, D. melanogaster
aataaatgacaat

SEQ ID NO: 561779 - DNA, 14 bp, D. melanogaster
aataaatgacaata

SEQ ID NO: 561780 - DNA, 13 bp, D. melanogaster
aataaatgatttg

SEQ ID NO: 561781 - DNA, 14 bp, D. melanogaster
aataaatgcaaata

SEQ ID NO: 561782 - DNA, 14 bp, D. melanogaster
aataaatgcaaatg

SEQ ID NO: 561783 - DNA, 13 bp, D. melanogaster
aataaatgcaata

SEQ ID NO: 561784 - DNA, 13 bp, D. melanogaster
aataaatgcacaa

SEQ ID NO: 561785 - DNA, 13 bp, D. melanogaster
aataaatgcatat

SEQ ID NO: 561786 - DNA, 14 bp, D. melanogaster
aataaatgcatttt

SEQ ID NO: 561787 - DNA, 13 bp, D. melanogaster
aataaatgccaaa

SEQ ID NO: 561788 - DNA, 14 bp, D. melanogaster
aataaatgcgaaat

SEQ ID NO: 561789 - DNA, 13 bp, D. melanogaster
aataaatgcgaca

SEQ ID NO: 561790 - DNA, 13 bp, D. melanogaster
aataaatgcgaga

SEQ ID NO: 561791 - DNA, 13 bp, D. melanogaster
aataaatgcgatt

SEQ ID NO: 561792 - DNA, 13 bp, D. melanogaster
aataaatgcttaa

SEQ ID NO: 561793 - DNA, 13 bp, D. melanogaster
aataaatgctttg

SEQ ID NO: 561794 - DNA, 13 bp, D. melanogaster
aataaatgctttt

SEQ ID NO: 561795 - DNA, 13 bp, D. melanogaster
aataaatggaatt

SEQ ID NO: 561796 - DNA, 13 bp, D. melanogaster
aataaatggcaaa

SEQ ID NO: 561797 - DNA, 13 bp, D. melanogaster
aataaatggcaac

SEQ ID NO: 561798 - DNA, 13 bp, D. melanogaster
aataaatggctaa

SEQ ID NO: 561799 - DNA, 13 bp, D. melanogaster
aataaatggttat

SEQ ID NO: 561800 - DNA, 13 bp, D. melanogaster
aataaatgtaatg

SEQ ID NO: 561801 - DNA, 13 bp, D. melanogaster
aataaatgtattc

SEQ ID NO: 561802 - DNA, 14 bp, D. melanogaster
aataaatgtcaaaa

SEQ ID NO: 561803 - DNA, 13 bp, D. melanogaster
aataaatgtcaat

SEQ ID NO: 561804 - DNA, 13 bp, D. melanogaster
aataaatgtcatt

SEQ ID NO: 561805 - DNA, 13 bp, D. melanogaster
aataaatgtcttt

SEQ ID NO: 561806 - DNA, 13 bp, D. melanogaster
aataaatgtgatt

SEQ ID NO: 561807 - DNA, 13 bp, D. melanogaster
aataaatgtgttg

SEQ ID NO: 561808 - DNA, 13 bp, D. melanogaster
aataaatgtgttt

SEQ ID NO: 561809 - DNA, 13 bp, D. melanogaster
aataaatgttgaa

SEQ ID NO: 561810 - DNA, 13 bp, D. melanogaster
aataaatgttgag

SEQ ID NO: 561811 - DNA, 13 bp, D. melanogaster
aataaattaaagc

SEQ ID NO: 561812 - DNA, 14 bp, D. melanogaster
aataaattaagcaa

SEQ ID NO: 561813 - DNA, 13 bp, D. melanogaster
aataaattaagcg

SEQ ID NO: 561814 - DNA, 13 bp, D. melanogaster
aataaattaatgc

SEQ ID NO: 561815 - DNA, 13 bp, D. melanogaster
aataaattacatg

SEQ ID NO: 561816 - DNA, 13 bp, D. melanogaster
aataaattagcaa

SEQ ID NO: 561817 - DNA, 14 bp, D. melanogaster
aataaattagcaaa

SEQ ID NO: 561818 - DNA, 13 bp, D. melanogaster
aataaattagcat

SEQ ID NO: 561819 - DNA, 13 bp, D. melanogaster
aataaattatgcg

SEQ ID NO: 561820 - DNA, 13 bp, D. melanogaster
aataaattatgtg

SEQ ID NO: 561821 - DNA, 14 bp, D. melanogaster
aataaattattagg

SEQ ID NO: 561822 - DNA, 13 bp, D. melanogaster
aataaattcaagt

SEQ ID NO: 561823 - DNA, 13 bp, D. melanogaster
aataaattcagca

SEQ ID NO: 561824 - DNA, 13 bp, D. melanogaster
aataaattcattg

SEQ ID NO: 561825 - DNA, 14 bp, D. melanogaster
aataaattccattt

SEQ ID NO: 561826 - DNA, 13 bp, D. melanogaster
aataaattccttt

SEQ ID NO: 561827 - DNA, 13 bp, D. melanogaster
aataaattcgaat

SEQ ID NO: 561828 - DNA, 13 bp, D. melanogaster
aataaattcgatt

SEQ ID NO: 561829 - DNA, 13 bp, D. melanogaster
aataaattcgctt

SEQ ID NO: 561830 - DNA, 13 bp, D. melanogaster
aataaattcgtta

SEQ ID NO: 561831 - DNA, 13 bp, D. melanogaster
aataaattgagat

SEQ ID NO: 561832 - DNA, 13 bp, D. melanogaster
aataaattgattg

SEQ ID NO: 561833 - DNA, 13 bp, D. melanogaster
aataaattgcaaa

SEQ ID NO: 561834 - DNA, 14 bp, D. melanogaster
aataaattgcaaaa

SEQ ID NO: 561835 - DNA, 13 bp, D. melanogaster
aataaattgcata

SEQ ID NO: 561836 - DNA, 13 bp, D. melanogaster
aataaattgccat

SEQ ID NO: 561837 - DNA, 13 bp, D. melanogaster
aataaattgctta

SEQ ID NO: 561838 - DNA, 13 bp, D. melanogaster
aataaattgcttt

SEQ ID NO: 561839 - DNA, 13 bp, D. melanogaster
aataaattggaat

SEQ ID NO: 561840 - DNA, 13 bp, D. melanogaster
aataaattggatt

SEQ ID NO: 561841 - DNA, 13 bp, D. melanogaster
aataaattggcca

SEQ ID NO: 561842 - DNA, 13 bp, D. melanogaster
aataaattgtatc

SEQ ID NO: 561843 - DNA, 13 bp, D. melanogaster
aataaattgtcaa

SEQ ID NO: 561844 - DNA, 13 bp, D. melanogaster
aataaattgtgat

SEQ ID NO: 561845 - DNA, 13 bp, D. melanogaster
aataaattgtgtt

SEQ ID NO: 561846 - DNA, 13 bp, D. melanogaster
aataaatttaagg

SEQ ID NO: 561847 - DNA, 13 bp, D. melanogaster
aataaatttagca

SEQ ID NO: 561848 - DNA, 14 bp, D. melanogaster
aataaatttagcaa

SEQ ID NO: 561849 - DNA, 14 bp, D. melanogaster
aataaatttatgac

SEQ ID NO: 561850 - DNA, 13 bp, D. melanogaster
aataaatttatgc

SEQ ID NO: 561851 - DNA, 13 bp, D. melanogaster
aataaatttccat

SEQ ID NO: 561852 - DNA, 13 bp, D. melanogaster
aataaatttcgaa

SEQ ID NO: 561853 - DNA, 13 bp, D. melanogaster
aataaatttctga

SEQ ID NO: 561854 - DNA, 13 bp, D. melanogaster
aataaatttctgt

SEQ ID NO: 561855 - DNA, 13 bp, D. melanogaster
aataaatttgcaa

SEQ ID NO: 561856 - DNA, 14 bp, D. melanogaster
aataaatttgcaaa

SEQ ID NO: 561857 - DNA, 13 bp, D. melanogaster
aataaatttgcat

SEQ ID NO: 561858 - DNA, 13 bp, D. melanogaster
aataaatttgctt

SEQ ID NO: 561859 - DNA, 13 bp, D. melanogaster
aataaatttggaa

SEQ ID NO: 561860 - DNA, 13 bp, D. melanogaster
aataaatttgtga

SEQ ID NO: 561861 - DNA, 13 bp, D. melanogaster
aataaatttgttg

SEQ ID NO: 561862 - DNA, 13 bp, D. melanogaster
aataaattttcag

SEQ ID NO: 561863 - DNA, 13 bp, D. melanogaster
aataaatttttgg

SEQ ID NO: 561864 - DNA, 14 bp, D. melanogaster
aataacaaaaatgt

SEQ ID NO: 561865 - DNA, 13 bp, D. melanogaster
aataacaaaagtt

SEQ ID NO: 561866 - DNA, 13 bp, D. melanogaster
aataacaaaatgt

SEQ ID NO: 561867 - DNA, 13 bp, D. melanogaster
aataacaaagact

SEQ ID NO: 561868 - DNA, 14 bp, D. melanogaster
aataacaaagactg

SEQ ID NO: 561869 - DNA, 13 bp, D. melanogaster
aataacaaagcat

SEQ ID NO: 561870 - DNA, 13 bp, D. melanogaster
aataacaaagcca

SEQ ID NO: 561871 - DNA, 13 bp, D. melanogaster
aataacaaagcga

SEQ ID NO: 561872 - DNA, 13 bp, D. melanogaster
aataacaaatgta

SEQ ID NO: 561873 - DNA, 13 bp, D. melanogaster
aataacaaatgtg

SEQ ID NO: 561874 - DNA, 13 bp, D. melanogaster
aataacaaattgt

SEQ ID NO: 561875 - DNA, 13 bp, D. melanogaster
aataacaacaacg

SEQ ID NO: 561876 - DNA, 13 bp, D. melanogaster
aataacaacaagc

SEQ ID NO: 561877 - DNA, 13 bp, D. melanogaster
aataacaacagag

SEQ ID NO: 561878 - DNA, 13 bp, D. melanogaster
aataacaacagca

SEQ ID NO: 561879 - DNA, 14 bp, D. melanogaster
aataacaacagcaa

SEQ ID NO: 561880 - DNA, 13 bp, D. melanogaster
aataacaacagtt

SEQ ID NO: 561881 - DNA, 13 bp, D. melanogaster
aataacaaccgaa

SEQ ID NO: 561882 - DNA, 14 bp, D. melanogaster
aataacaactatag

SEQ ID NO: 561883 - DNA, 13 bp, D. melanogaster
aataacaactgca

SEQ ID NO: 561884 - DNA, 14 bp, D. melanogaster
aataacaactgttt

SEQ ID NO: 561885 - DNA, 13 bp, D. melanogaster
aataacaagatgc

SEQ ID NO: 561886 - DNA, 13 bp, D. melanogaster
aataacaaggcaa

SEQ ID NO: 561887 - DNA, 13 bp, D. melanogaster
aataacaagtttt

SEQ ID NO: 561888 - DNA, 13 bp, D. melanogaster
aataacaataagc

SEQ ID NO: 561889 - DNA, 13 bp, D. melanogaster
aataacaataatg

SEQ ID NO: 561890 - DNA, 13 bp, D. melanogaster
aataacaatagta

SEQ ID NO: 561891 - DNA, 13 bp, D. melanogaster
aataacaatcgct

SEQ ID NO: 561892 - DNA, 13 bp, D. melanogaster
aataacaatcgga

SEQ ID NO: 561893 - DNA, 13 bp, D. melanogaster
aataacaatctta

SEQ ID NO: 561894 - DNA, 13 bp, D. melanogaster
aataacaatgatt

SEQ ID NO: 561895 - DNA, 13 bp, D. melanogaster
aataacaatggca

SEQ ID NO: 561896 - DNA, 13 bp, D. melanogaster
aataacaatgtaa

SEQ ID NO: 561897 - DNA, 13 bp, D. melanogaster
aataacaattagc

SEQ ID NO: 561898 - DNA, 13 bp, D. melanogaster
aataacaatttga

SEQ ID NO: 561899 - DNA, 13 bp, D. melanogaster
aataacaatttgt

SEQ ID NO: 561900 - DNA, 14 bp, D. melanogaster
aataacaatttgtt

SEQ ID NO: 561901 - DNA, 13 bp, D. melanogaster
aataacacaaatg

SEQ ID NO: 561902 - DNA, 13 bp, D. melanogaster
aataacacaattt

SEQ ID NO: 561903 - DNA, 14 bp, D. melanogaster
aataacacatattt

SEQ ID NO: 561904 - DNA, 13 bp, D. melanogaster
aataacacatttt

SEQ ID NO: 561905 - DNA, 13 bp, D. melanogaster
aataacagagacg

SEQ ID NO: 561906 - DNA, 13 bp, D. melanogaster
aataacagcaaat

SEQ ID NO: 561907 - DNA, 13 bp, D. melanogaster
aataacagcaaca

SEQ ID NO: 561908 - DNA, 13 bp, D. melanogaster
aataacagcaata

SEQ ID NO: 561909 - DNA, 13 bp, D. melanogaster
aataacagctgtt

SEQ ID NO: 561910 - DNA, 13 bp, D. melanogaster
aataacatatgta

SEQ ID NO: 561911 - DNA, 13 bp, D. melanogaster
aataacatatttc

SEQ ID NO: 561912 - DNA, 13 bp, D. melanogaster
aataacatgaagt

SEQ ID NO: 561913 - DNA, 13 bp, D. melanogaster
aataacattatac

SEQ ID NO: 561914 - DNA, 13 bp, D. melanogaster
aataacattccaa

SEQ ID NO: 561915 - DNA, 13 bp, D. melanogaster
aataacattgttt

SEQ ID NO: 561916 - DNA, 13 bp, D. melanogaster
aataacatttgca

SEQ ID NO: 561917 - DNA, 13 bp, D. melanogaster
aataacattttca

SEQ ID NO: 561918 - DNA, 13 bp, D. melanogaster
aataacattttga

SEQ ID NO: 561919 - DNA, 13 bp, D. melanogaster
aataacatttttg

SEQ ID NO: 561920 - DNA, 14 bp, D. melanogaster
aataacatttttgt

SEQ ID NO: 561921 - DNA, 13 bp, D. melanogaster
aataaccaaatgc

SEQ ID NO: 561922 - DNA, 13 bp, D. melanogaster
aataaccccagat

SEQ ID NO: 561923 - DNA, 13 bp, D. melanogaster
aataaccctgaaa

SEQ ID NO: 561924 - DNA, 13 bp, D. melanogaster
aataaccgaaata

SEQ ID NO: 561925 - DNA, 14 bp, D. melanogaster
aataacctttgcag

SEQ ID NO: 561926 - DNA, 13 bp, D. melanogaster
aataacgaaagta

SEQ ID NO: 561927 - DNA, 13 bp, D. melanogaster
aataacgaataac

SEQ ID NO: 561928 - DNA, 13 bp, D. melanogaster
aataacgcagccg

SEQ ID NO: 561929 - DNA, 13 bp, D. melanogaster
aataactcaaatg

SEQ ID NO: 561930 - DNA, 13 bp, D. melanogaster
aataactcaattt

SEQ ID NO: 561931 - DNA, 13 bp, D. melanogaster
aataactcagtta

SEQ ID NO: 561932 - DNA, 14 bp, D. melanogaster
aataactcagttaa

SEQ ID NO: 561933 - DNA, 13 bp, D. melanogaster
aataactgatccc

SEQ ID NO: 561934 - DNA, 13 bp, D. melanogaster
aataactgattcg

SEQ ID NO: 561935 - DNA, 14 bp, D. melanogaster
aataacttcaaaag

SEQ ID NO: 561936 - DNA, 13 bp, D. melanogaster
aataacttcaatt

SEQ ID NO: 561937 - DNA, 13 bp, D. melanogaster
aataacttcagta

SEQ ID NO: 561938 - DNA, 13 bp, D. melanogaster
aataacttcatgt

SEQ ID NO: 561939 - DNA, 13 bp, D. melanogaster
aataacttcattt

SEQ ID NO: 561940 - DNA, 13 bp, D. melanogaster
aataacttgaaaa

SEQ ID NO: 561941 - DNA, 13 bp, D. melanogaster
aataacttgtaaa

SEQ ID NO: 561942 - DNA, 13 bp, D. melanogaster
aataacttgtttt

SEQ ID NO: 561943 - DNA, 13 bp, D. melanogaster
aataactttaaag

SEQ ID NO: 561944 - DNA, 13 bp, D. melanogaster
aataactttaact

SEQ ID NO: 561945 - DNA, 13 bp, D. melanogaster
aataactttactt

SEQ ID NO: 561946 - DNA, 13 bp, D. melanogaster
aataactttgaaa

SEQ ID NO: 561947 - DNA, 13 bp, D. melanogaster
aataactttgatt

SEQ ID NO: 561948 - DNA, 13 bp, D. melanogaster
aataactttgtaa

SEQ ID NO: 561949 - DNA, 14 bp, D. melanogaster
aataagaaactttt

SEQ ID NO: 561950 - DNA, 13 bp, D. melanogaster
aataagaaatttc

SEQ ID NO: 561951 - DNA, 13 bp, D. melanogaster
aataagaacattt

SEQ ID NO: 561952 - DNA, 13 bp, D. melanogaster
aataagaacccaa

SEQ ID NO: 561953 - DNA, 14 bp, D. melanogaster
aataagaaggattt

SEQ ID NO: 561954 - DNA, 13 bp, D. melanogaster
aataagacccaat

SEQ ID NO: 561955 - DNA, 13 bp, D. melanogaster
aataagagtacaa

SEQ ID NO: 561956 - DNA, 14 bp, D. melanogaster
aataagagtacaac

SEQ ID NO: 561957 - DNA, 13 bp, D. melanogaster
aataagagtgtgt

SEQ ID NO: 561958 - DNA, 13 bp, D. melanogaster
aataagatcgaag

SEQ ID NO: 561959 - DNA, 13 bp, D. melanogaster
aataagatgcgat

SEQ ID NO: 561960 - DNA, 13 bp, D. melanogaster
aataagcaaacat

SEQ ID NO: 561961 - DNA, 13 bp, D. melanogaster
aataagcaataag

SEQ ID NO: 561962 - DNA, 13 bp, D. melanogaster
aataagcaatata

SEQ ID NO: 561963 - DNA, 13 bp, D. melanogaster
aataagcaattaa

SEQ ID NO: 561964 - DNA, 14 bp, D. melanogaster
aataagcaattaaa

SEQ ID NO: 561965 - DNA, 13 bp, D. melanogaster
aataagcagcaaa

SEQ ID NO: 561966 - DNA, 13 bp, D. melanogaster
aataagcatttta

SEQ ID NO: 561967 - DNA, 13 bp, D. melanogaster
aataagccaaatt

SEQ ID NO: 561968 - DNA, 13 bp, D. melanogaster
aataagccaacaa

SEQ ID NO: 561969 - DNA, 13 bp, D. melanogaster
aataagccgaaaa

SEQ ID NO: 561970 - DNA, 13 bp, D. melanogaster
aataagcgacaaa

SEQ ID NO: 561971 - DNA, 13 bp, D. melanogaster
aataagctgccag

SEQ ID NO: 561972 - DNA, 13 bp, D. melanogaster
aataagctggcca

SEQ ID NO: 561973 - DNA, 13 bp, D. melanogaster
aataagcttaaaa

SEQ ID NO: 561974 - DNA, 13 bp, D. melanogaster
aataagcttaaat

SEQ ID NO: 561975 - DNA, 13 bp, D. melanogaster
aataagcttacaa

SEQ ID NO: 561976 - DNA, 13 bp, D. melanogaster
aataagcttttat

SEQ ID NO: 561977 - DNA, 13 bp, D. melanogaster
aataagctttttt

SEQ ID NO: 561978 - DNA, 13 bp, D. melanogaster
aataaggcaatga

SEQ ID NO: 561979 - DNA, 13 bp, D. melanogaster
aataagggaaaac

SEQ ID NO: 561980 - DNA, 13 bp, D. melanogaster
aataagtaaattg

SEQ ID NO: 561981 - DNA, 13 bp, D. melanogaster
aataagtacatat

SEQ ID NO: 561982 - DNA, 13 bp, D. melanogaster
aataagtattagt

SEQ ID NO: 561983 - DNA, 13 bp, D. melanogaster
aataagtgttcaa

SEQ ID NO: 561984 - DNA, 13 bp, D. melanogaster
aataagttaagtt

SEQ ID NO: 561985 - DNA, 13 bp, D. melanogaster
aataagttaattg

SEQ ID NO: 561986 - DNA, 13 bp, D. melanogaster
aataagttacaca

SEQ ID NO: 561987 - DNA, 13 bp, D. melanogaster
aataagttgattt

SEQ ID NO: 561988 - DNA, 13 bp, D. melanogaster
aataagtttattg

SEQ ID NO: 561989 - DNA, 14 bp, D. melanogaster
aataagtttattgc

SEQ ID NO: 561990 - DNA, 13 bp, D. melanogaster
aataagtttgaaa

SEQ ID NO: 561991 - DNA, 13 bp, D. melanogaster
aataagtttgttt

SEQ ID NO: 561992 - DNA, 13 bp, D. melanogaster
aataagttttaag

SEQ ID NO: 561993 - DNA, 13 bp, D. melanogaster
aataagttttctt

SEQ ID NO: 561994 - DNA, 13 bp, D. melanogaster
aataagtttttgt

SEQ ID NO: 561995 - DNA, 14 bp, D. melanogaster
aataataaaaatgc

SEQ ID NO: 561996 - DNA, 13 bp, D. melanogaster
aataataaaacgg

SEQ ID NO: 561997 - DNA, 13 bp, D. melanogaster
aataataaaacgt

SEQ ID NO: 561998 - DNA, 14 bp, D. melanogaster
aataataaaactga

SEQ ID NO: 561999 - DNA, 13 bp, D. melanogaster
aataataaatgca

SEQ ID NO: 562000 - DNA, 14 bp, D. melanogaster
aataataaatgcaa

SEQ ID NO: 562001 - DNA, 13 bp, D. melanogaster
aataataacaatg

SEQ ID NO: 562002 - DNA, 13 bp, D. melanogaster
aataataaccatt

SEQ ID NO: 562003 - DNA, 13 bp, D. melanogaster
aataataactttg

SEQ ID NO: 562004 - DNA, 13 bp, D. melanogaster
aataataagtaca

SEQ ID NO: 562005 - DNA, 13 bp, D. melanogaster
aataataagtcga

SEQ ID NO: 562006 - DNA, 13 bp, D. melanogaster
aataataagtgga

SEQ ID NO: 562007 - DNA, 13 bp, D. melanogaster
aataataatacga

SEQ ID NO: 562008 - DNA, 13 bp, D. melanogaster
aataataatagca

SEQ ID NO: 562009 - DNA, 14 bp, D. melanogaster
aataataatagcaa

SEQ ID NO: 562010 - DNA, 13 bp, D. melanogaster
aataataatcgta

SEQ ID NO: 562011 - DNA, 14 bp, D. melanogaster
aataataatcgtaa

SEQ ID NO: 562012 - DNA, 13 bp, D. melanogaster
aataataatcttc

SEQ ID NO: 562013 - DNA, 13 bp, D. melanogaster
aataataatgaca

SEQ ID NO: 562014 - DNA, 13 bp, D. melanogaster
aataataatgcag

SEQ ID NO: 562015 - DNA, 13 bp, D. melanogaster
aataataatgcga

SEQ ID NO: 562016 - DNA, 13 bp, D. melanogaster
aataataatggca

SEQ ID NO: 562017 - DNA, 13 bp, D. melanogaster
aataataatgtga

SEQ ID NO: 562018 - DNA, 13 bp, D. melanogaster
aataataatgttg

SEQ ID NO: 562019 - DNA, 13 bp, D. melanogaster
aataataattcca

SEQ ID NO: 562020 - DNA, 14 bp, D. melanogaster
aataataattgcaa

SEQ ID NO: 562021 - DNA, 13 bp, D. melanogaster
aataataattgcc

SEQ ID NO: 562022 - DNA, 13 bp, D. melanogaster
aataataattgct

SEQ ID NO: 562023 - DNA, 13 bp, D. melanogaster
aataataattgga

SEQ ID NO: 562024 - DNA, 13 bp, D. melanogaster
aataataatttcc

SEQ ID NO: 562025 - DNA, 14 bp, D. melanogaster
aataatacaaaatg

SEQ ID NO: 562026 - DNA, 14 bp, D. melanogaster
aataatacaaacag

SEQ ID NO: 562027 - DNA, 14 bp, D. melanogaster
aataatacaaattg

SEQ ID NO: 562028 - DNA, 13 bp, D. melanogaster
aataatacaactg

SEQ ID NO: 562029 - DNA, 13 bp, D. melanogaster
aataatacagaat

SEQ ID NO: 562030 - DNA, 13 bp, D. melanogaster
aataatacatttc

SEQ ID NO: 562031 - DNA, 14 bp, D. melanogaster
aataatacatttca

SEQ ID NO: 562032 - DNA, 13 bp, D. melanogaster
aataatacccatt

SEQ ID NO: 562033 - DNA, 13 bp, D. melanogaster
aataatacgaaat

SEQ ID NO: 562034 - DNA, 13 bp, D. melanogaster
aataatacgattt

SEQ ID NO: 562035 - DNA, 13 bp, D. melanogaster
aataatactgaat

SEQ ID NO: 562036 - DNA, 13 bp, D. melanogaster
aataatagacgct

SEQ ID NO: 562037 - DNA, 14 bp, D. melanogaster
aataatagacgctt

SEQ ID NO: 562038 - DNA, 13 bp, D. melanogaster
aataatagagtac

SEQ ID NO: 562039 - DNA, 13 bp, D. melanogaster
aataatagcaaat

SEQ ID NO: 562040 - DNA, 14 bp, D. melanogaster
aataatagcaataa

SEQ ID NO: 562041 - DNA, 13 bp, D. melanogaster
aataatagcacta

SEQ ID NO: 562042 - DNA, 13 bp, D. melanogaster
aataatagcgaaa

SEQ ID NO: 562043 - DNA, 13 bp, D. melanogaster
aataatagtagta

SEQ ID NO: 562044 - DNA, 13 bp, D. melanogaster
aataatatcacat

SEQ ID NO: 562045 - DNA, 13 bp, D. melanogaster
aataatatgtaag

SEQ ID NO: 562046 - DNA, 13 bp, D. melanogaster
aataatattggaa

SEQ ID NO: 562047 - DNA, 13 bp, D. melanogaster
aataatattggtg

SEQ ID NO: 562048 - DNA, 13 bp, D. melanogaster
aataatattgtac

SEQ ID NO: 562049 - DNA, 13 bp, D. melanogaster
aataatatttcag

SEQ ID NO: 562050 - DNA, 13 bp, D. melanogaster
aataatatttgct

SEQ ID NO: 562051 - DNA, 13 bp, D. melanogaster
aataatcaaaagt

SEQ ID NO: 562052 - DNA, 13 bp, D. melanogaster
aataatcaaaatg

SEQ ID NO: 562053 - DNA, 13 bp, D. melanogaster
aataatcaagctg

SEQ ID NO: 562054 - DNA, 13 bp, D. melanogaster
aataatcgaaata

SEQ ID NO: 562055 - DNA, 13 bp, D. melanogaster
aataatcgaaatg

SEQ ID NO: 562056 - DNA, 13 bp, D. melanogaster
aataatcgaataa

SEQ ID NO: 562057 - DNA, 13 bp, D. melanogaster
aataatcgtaaaa

SEQ ID NO: 562058 - DNA, 13 bp, D. melanogaster
aataatcgtaata

SEQ ID NO: 562059 - DNA, 13 bp, D. melanogaster
aataatcttcggc

SEQ ID NO: 562060 - DNA, 14 bp, D. melanogaster
aataatcttcggca

SEQ ID NO: 562061 - DNA, 13 bp, D. melanogaster
aataatgaaaatc

SEQ ID NO: 562062 - DNA, 13 bp, D. melanogaster
aataatgaacatt

SEQ ID NO: 562063 - DNA, 13 bp, D. melanogaster
aataatgaactaa

SEQ ID NO: 562064 - DNA, 15 bp, D. melanogaster
aataatgaactaact

SEQ ID NO: 562065 - DNA, 13 bp, D. melanogaster
aataatgacattt

SEQ ID NO: 562066 - DNA, 13 bp, D. melanogaster
aataatgagtgaa

SEQ ID NO: 562067 - DNA, 13 bp, D. melanogaster
aataatgataaac

SEQ ID NO: 562068 - DNA, 13 bp, D. melanogaster
aataatgataatg

SEQ ID NO: 562069 - DNA, 13 bp, D. melanogaster
aataatgatcaaa

SEQ ID NO: 562070 - DNA, 13 bp, D. melanogaster
aataatgcaaata

SEQ ID NO: 562071 - DNA, 14 bp, D. melanogaster
aataatgcaaataa

SEQ ID NO: 562072 - DNA, 13 bp, D. melanogaster
aataatgcaataa

SEQ ID NO: 562073 - DNA, 13 bp, D. melanogaster
aataatgcacaaa

SEQ ID NO: 562074 - DNA, 13 bp, D. melanogaster
aataatgcacatt

SEQ ID NO: 562075 - DNA, 13 bp, D. melanogaster
aataatgcagaaa

SEQ ID NO: 562076 - DNA, 13 bp, D. melanogaster
aataatgccctgg

SEQ ID NO: 562077 - DNA, 13 bp, D. melanogaster
aataatgcgaaaa

SEQ ID NO: 562078 - DNA, 13 bp, D. melanogaster
aataatgcgaaat

SEQ ID NO: 562079 - DNA, 14 bp, D. melanogaster
aataatggaagtgg

SEQ ID NO: 562080 - DNA, 13 bp, D. melanogaster
aataatggcaaaa

SEQ ID NO: 562081 - DNA, 13 bp, D. melanogaster
aataatggccaaa

SEQ ID NO: 562082 - DNA, 13 bp, D. melanogaster
aataatggggtca

SEQ ID NO: 562083 - DNA, 13 bp, D. melanogaster
aataatggttatt

SEQ ID NO: 562084 - DNA, 13 bp, D. melanogaster
aataatgtaatgt

SEQ ID NO: 562085 - DNA, 13 bp, D. melanogaster
aataatgtacaaa

SEQ ID NO: 562086 - DNA, 13 bp, D. melanogaster
aataatgtcaaaa

SEQ ID NO: 562087 - DNA, 13 bp, D. melanogaster
aataatgtcataa

SEQ ID NO: 562088 - DNA, 13 bp, D. melanogaster
aataatgtcgaaa

SEQ ID NO: 562089 - DNA, 14 bp, D. melanogaster
aataatgtcgaaaa

SEQ ID NO: 562090 - DNA, 14 bp, D. melanogaster
aataatgtctatgt

SEQ ID NO: 562091 - DNA, 13 bp, D. melanogaster
aataatgtgtaaa

SEQ ID NO: 562092 - DNA, 13 bp, D. melanogaster
aataatgttaaag

SEQ ID NO: 562093 - DNA, 13 bp, D. melanogaster
aataatgttcata

SEQ ID NO: 562094 - DNA, 13 bp, D. melanogaster
aataatgttgatt

SEQ ID NO: 562095 - DNA, 13 bp, D. melanogaster
aataatgttggcc

SEQ ID NO: 562096 - DNA, 13 bp, D. melanogaster
aataattagcatt

SEQ ID NO: 562097 - DNA, 13 bp, D. melanogaster
aataattaggaat

SEQ ID NO: 562098 - DNA, 13 bp, D. melanogaster
aataattatgctt

SEQ ID NO: 562099 - DNA, 13 bp, D. melanogaster
aataattcaaaag

SEQ ID NO: 562100 - DNA, 13 bp, D. melanogaster
aataattcaaatg

SEQ ID NO: 562101 - DNA, 13 bp, D. melanogaster
aataattcaatca

SEQ ID NO: 562102 - DNA, 13 bp, D. melanogaster
aataattcacatt

SEQ ID NO: 562103 - DNA, 14 bp, D. melanogaster
aataattcagcagc

SEQ ID NO: 562104 - DNA, 13 bp, D. melanogaster
aataattccactt

SEQ ID NO: 562105 - DNA, 13 bp, D. melanogaster
aataattcgattc

SEQ ID NO: 562106 - DNA, 13 bp, D. melanogaster
aataattgacaaa

SEQ ID NO: 562107 - DNA, 13 bp, D. melanogaster
aataattgagcaa

SEQ ID NO: 562108 - DNA, 13 bp, D. melanogaster
aataattgatgaa

SEQ ID NO: 562109 - DNA, 13 bp, D. melanogaster
aataattgcaaaa

SEQ ID NO: 562110 - DNA, 14 bp, D. melanogaster
aataattgcaaaat

SEQ ID NO: 562111 - DNA, 13 bp, D. melanogaster
aataattgcaaat

SEQ ID NO: 562112 - DNA, 13 bp, D. melanogaster
aataattgcaatt

SEQ ID NO: 562113 - DNA, 14 bp, D. melanogaster
aataattgcaattt

SEQ ID NO: 562114 - DNA, 13 bp, D. melanogaster
aataattgcattg

SEQ ID NO: 562115 - DNA, 13 bp, D. melanogaster
aataattgccaag

SEQ ID NO: 562116 - DNA, 13 bp, D. melanogaster
aataattgcgaaa

SEQ ID NO: 562117 - DNA, 13 bp, D. melanogaster
aataattgctaat

SEQ ID NO: 562118 - DNA, 13 bp, D. melanogaster
aataattgtattg

SEQ ID NO: 562119 - DNA, 13 bp, D. melanogaster
aataattgtcaaa

SEQ ID NO: 562120 - DNA, 13 bp, D. melanogaster
aataattgtccaa

SEQ ID NO: 562121 - DNA, 13 bp, D. melanogaster
aataattgttagt

SEQ ID NO: 562122 - DNA, 14 bp, D. melanogaster
aataattgttagtt

SEQ ID NO: 562123 - DNA, 13 bp, D. melanogaster
aataattgttcaa

SEQ ID NO: 562124 - DNA, 13 bp, D. melanogaster
aataattgttttg

SEQ ID NO: 562125 - DNA, 13 bp, D. melanogaster
aataatttaagca

SEQ ID NO: 562126 - DNA, 13 bp, D. melanogaster
aataatttacaca

SEQ ID NO: 562127 - DNA, 13 bp, D. melanogaster
aataatttagagc

SEQ ID NO: 562128 - DNA, 13 bp, D. melanogaster
aataatttagcca

SEQ ID NO: 562129 - DNA, 14 bp, D. melanogaster
aataatttatgcaa

SEQ ID NO: 562130 - DNA, 13 bp, D. melanogaster
aataatttattgc

SEQ ID NO: 562131 - DNA, 13 bp, D. melanogaster
aataatttattgg

SEQ ID NO: 562132 - DNA, 13 bp, D. melanogaster
aataatttcaagt

SEQ ID NO: 562133 - DNA, 13 bp, D. melanogaster
aataatttcacaa

SEQ ID NO: 562134 - DNA, 13 bp, D. melanogaster
aataatttcagtt

SEQ ID NO: 562135 - DNA, 13 bp, D. melanogaster
aataatttccaca

SEQ ID NO: 562136 - DNA, 13 bp, D. melanogaster
aataatttcgaat

SEQ ID NO: 562137 - DNA, 14 bp, D. melanogaster
aataatttcgaatt

SEQ ID NO: 562138 - DNA, 13 bp, D. melanogaster
aataatttctcaa

SEQ ID NO: 562139 - DNA, 13 bp, D. melanogaster
aataatttctttg

SEQ ID NO: 562140 - DNA, 14 bp, D. melanogaster
aataatttgcaaaa

SEQ ID NO: 562141 - DNA, 13 bp, D. melanogaster
aataatttgcata

SEQ ID NO: 562142 - DNA, 14 bp, D. melanogaster
aataatttgcatat

SEQ ID NO: 562143 - DNA, 13 bp, D. melanogaster
aataatttgcttg

SEQ ID NO: 562144 - DNA, 13 bp, D. melanogaster
aataatttggttc

SEQ ID NO: 562145 - DNA, 14 bp, D. melanogaster
aataatttgtaatg

SEQ ID NO: 562146 - DNA, 13 bp, D. melanogaster
aataatttgtggc

SEQ ID NO: 562147 - DNA, 14 bp, D. melanogaster
aataatttgtgtaa

SEQ ID NO: 562148 - DNA, 14 bp, D. melanogaster
aataatttgttctg

SEQ ID NO: 562149 - DNA, 13 bp, D. melanogaster
aataatttgtttc

SEQ ID NO: 562150 - DNA, 14 bp, D. melanogaster
aataattttcgttt

SEQ ID NO: 562151 - DNA, 13 bp, D. melanogaster
aataattttgaag

SEQ ID NO: 562152 - DNA, 13 bp, D. melanogaster
aataattttgcca

SEQ ID NO: 562153 - DNA, 13 bp, D. melanogaster
aataatttttgtg

SEQ ID NO: 562154 - DNA, 14 bp, D. melanogaster
aatacaaaaaatgt

SEQ ID NO: 562155 - DNA, 14 bp, D. melanogaster
aatacaaaaatgtt

SEQ ID NO: 562156 - DNA, 13 bp, D. melanogaster
aatacaaaacgag

SEQ ID NO: 562157 - DNA, 13 bp, D. melanogaster
aatacaaaacttt

SEQ ID NO: 562158 - DNA, 14 bp, D. melanogaster
aatacaaaactttt

SEQ ID NO: 562159 - DNA, 13 bp, D. melanogaster
aatacaaaagcca

SEQ ID NO: 562160 - DNA, 13 bp, D. melanogaster
aatacaaaaggca

SEQ ID NO: 562161 - DNA, 13 bp, D. melanogaster
aatacaaactgaa

SEQ ID NO: 562162 - DNA, 13 bp, D. melanogaster
aatacaaatacga

SEQ ID NO: 562163 - DNA, 14 bp, D. melanogaster
aatacaaatacgaa

SEQ ID NO: 562164 - DNA, 13 bp, D. melanogaster
aatacaaatatag

SEQ ID NO: 562165 - DNA, 14 bp, D. melanogaster
aatacaaatatttc

SEQ ID NO: 562166 - DNA, 13 bp, D. melanogaster
aatacaaatcagt

SEQ ID NO: 562167 - DNA, 13 bp, D. melanogaster
aatacaaatcatt

SEQ ID NO: 562168 - DNA, 13 bp, D. melanogaster
aatacaaatcttt

SEQ ID NO: 562169 - DNA, 13 bp, D. melanogaster
aatacaaatgaat

SEQ ID NO: 562170 - DNA, 13 bp, D. melanogaster
aatacaaatgata

SEQ ID NO: 562171 - DNA, 13 bp, D. melanogaster
aatacaaatgatt

SEQ ID NO: 562172 - DNA, 13 bp, D. melanogaster
aatacaaatgcga

SEQ ID NO: 562173 - DNA, 13 bp, D. melanogaster
aatacaaattaag

SEQ ID NO: 562174 - DNA, 13 bp, D. melanogaster
aatacaaattcca

SEQ ID NO: 562175 - DNA, 13 bp, D. melanogaster
aatacaaattgaa

SEQ ID NO: 562176 - DNA, 14 bp, D. melanogaster
aatacaaattgaaa

SEQ ID NO: 562177 - DNA, 13 bp, D. melanogaster
aatacaaattgct

SEQ ID NO: 562178 - DNA, 13 bp, D. melanogaster
aatacaacaattt

SEQ ID NO: 562179 - DNA, 13 bp, D. melanogaster
aatacaactgaaa

SEQ ID NO: 562180 - DNA, 13 bp, D. melanogaster
aatacaacttttt

SEQ ID NO: 562181 - DNA, 14 bp, D. melanogaster
aatacaagaggaaa

SEQ ID NO: 562182 - DNA, 13 bp, D. melanogaster
aatacaagtttta

SEQ ID NO: 562183 - DNA, 13 bp, D. melanogaster
aatacaataaatg

SEQ ID NO: 562184 - DNA, 13 bp, D. melanogaster
aatacaatacaag

SEQ ID NO: 562185 - DNA, 13 bp, D. melanogaster
aatacaatacatt

SEQ ID NO: 562186 - DNA, 13 bp, D. melanogaster
aatacaatacttt

SEQ ID NO: 562187 - DNA, 13 bp, D. melanogaster
aatacaatcgcaa

SEQ ID NO: 562188 - DNA, 13 bp, D. melanogaster
aatacaatgaaat

SEQ ID NO: 562189 - DNA, 13 bp, D. melanogaster
aatacaatgcaaa

SEQ ID NO: 562190 - DNA, 13 bp, D. melanogaster
aatacaatgtaaa

SEQ ID NO: 562191 - DNA, 13 bp, D. melanogaster
aatacaattaaag

SEQ ID NO: 562192 - DNA, 13 bp, D. melanogaster
aatacaattaact

SEQ ID NO: 562193 - DNA, 13 bp, D. melanogaster
aatacaattaaga

SEQ ID NO: 562194 - DNA, 14 bp, D. melanogaster
aatacaattaattc

SEQ ID NO: 562195 - DNA, 13 bp, D. melanogaster
aatacaattatgt

SEQ ID NO: 562196 - DNA, 13 bp, D. melanogaster
aatacaattattc

SEQ ID NO: 562197 - DNA, 13 bp, D. melanogaster
aatacaattcaat

SEQ ID NO: 562198 - DNA, 13 bp, D. melanogaster
aatacaattgatt

SEQ ID NO: 562199 - DNA, 13 bp, D. melanogaster
aatacaattgcaa

SEQ ID NO: 562200 - DNA, 13 bp, D. melanogaster
aatacaattgttt

SEQ ID NO: 562201 - DNA, 15 bp, D. melanogaster
aatacaatttcacgt

SEQ ID NO: 562202 - DNA, 13 bp, D. melanogaster
aatacaatttctt

SEQ ID NO: 562203 - DNA, 13 bp, D. melanogaster
aatacaatttgta

SEQ ID NO: 562204 - DNA, 14 bp, D. melanogaster
aatacaatttgtaa

SEQ ID NO: 562205 - DNA, 13 bp, D. melanogaster
aatacaattttca

SEQ ID NO: 562206 - DNA, 13 bp, D. melanogaster
aatacaattttgt

SEQ ID NO: 562207 - DNA, 13 bp, D. melanogaster
aatacaatttttg

SEQ ID NO: 562208 - DNA, 13 bp, D. melanogaster
aatacacacattt

SEQ ID NO: 562209 - DNA, 13 bp, D. melanogaster
aatacacactttt

SEQ ID NO: 562210 - DNA, 13 bp, D. melanogaster
aatacacagacac

SEQ ID NO: 562211 - DNA, 13 bp, D. melanogaster
aatacacatacac

SEQ ID NO: 562212 - DNA, 13 bp, D. melanogaster
aatacacatatgt

SEQ ID NO: 562213 - DNA, 13 bp, D. melanogaster
aatacactgcaaa

SEQ ID NO: 562214 - DNA, 13 bp, D. melanogaster
aatacacttaaat

SEQ ID NO: 562215 - DNA, 13 bp, D. melanogaster
aatacacttttaa

SEQ ID NO: 562216 - DNA, 13 bp, D. melanogaster
aatacagaaaact

SEQ ID NO: 562217 - DNA, 13 bp, D. melanogaster
aatacagaaatat

SEQ ID NO: 562218 - DNA, 14 bp, D. melanogaster
aatacagatacaga

SEQ ID NO: 562219 - DNA, 13 bp, D. melanogaster
aatacagcaacaa

SEQ ID NO: 562220 - DNA, 13 bp, D. melanogaster
aatacagcacaat

SEQ ID NO: 562221 - DNA, 13 bp, D. melanogaster
aatacaggtcgat

SEQ ID NO: 562222 - DNA, 14 bp, D. melanogaster
aatacataaaccca

SEQ ID NO: 562223 - DNA, 13 bp, D. melanogaster
aatacataaatag

SEQ ID NO: 562224 - DNA, 13 bp, D. melanogaster
aatacatacaatt

SEQ ID NO: 562225 - DNA, 13 bp, D. melanogaster
aatacatacacac

SEQ ID NO: 562226 - DNA, 13 bp, D. melanogaster
aatacatagaata

SEQ ID NO: 562227 - DNA, 13 bp, D. melanogaster
aatacatagatat

SEQ ID NO: 562228 - DNA, 14 bp, D. melanogaster
aatacatagatata

SEQ ID NO: 562229 - DNA, 13 bp, D. melanogaster
aatacatagtgaa

SEQ ID NO: 562230 - DNA, 13 bp, D. melanogaster
aatacatatacac

SEQ ID NO: 562231 - DNA, 13 bp, D. melanogaster
aatacatatacat

SEQ ID NO: 562232 - DNA, 13 bp, D. melanogaster
aatacatatatct

SEQ ID NO: 562233 - DNA, 13 bp, D. melanogaster
aatacatatatgt

SEQ ID NO: 562234 - DNA, 14 bp, D. melanogaster
aatacatatatgta

SEQ ID NO: 562235 - DNA, 13 bp, D. melanogaster
aatacatatgcaa

SEQ ID NO: 562236 - DNA, 13 bp, D. melanogaster
aatacatatgtac

SEQ ID NO: 562237 - DNA, 14 bp, D. melanogaster
aatacatatgtaca

SEQ ID NO: 562238 - DNA, 14 bp, D. melanogaster
aatacatatgtata

SEQ ID NO: 562239 - DNA, 13 bp, D. melanogaster
aatacatattttg

SEQ ID NO: 562240 - DNA, 13 bp, D. melanogaster
aatacatgtatgt

SEQ ID NO: 562241 - DNA, 13 bp, D. melanogaster
aatacatgttttt

SEQ ID NO: 562242 - DNA, 13 bp, D. melanogaster
aatacattaaaag

SEQ ID NO: 562243 - DNA, 13 bp, D. melanogaster
aatacattcaaat

SEQ ID NO: 562244 - DNA, 13 bp, D. melanogaster
aatacattcaata

SEQ ID NO: 562245 - DNA, 13 bp, D. melanogaster
aatacattcataa

SEQ ID NO: 562246 - DNA, 13 bp, D. melanogaster
aatacattcattt

SEQ ID NO: 562247 - DNA, 13 bp, D. melanogaster
aatacattgaaat

SEQ ID NO: 562248 - DNA, 13 bp, D. melanogaster
aatacattgtgac

SEQ ID NO: 562249 - DNA, 13 bp, D. melanogaster
aatacatttaaga

SEQ ID NO: 562250 - DNA, 13 bp, D. melanogaster
aatacatttaatc

SEQ ID NO: 562251 - DNA, 13 bp, D. melanogaster
aatacatttcaaa

SEQ ID NO: 562252 - DNA, 13 bp, D. melanogaster
aatacatttcatt

SEQ ID NO: 562253 - DNA, 14 bp, D. melanogaster
aatacatttcattt

SEQ ID NO: 562254 - DNA, 13 bp, D. melanogaster
aatacatttcgca

SEQ ID NO: 562255 - DNA, 13 bp, D. melanogaster
aatacatttcgtt

SEQ ID NO: 562256 - DNA, 13 bp, D. melanogaster
aatacatttctta

SEQ ID NO: 562257 - DNA, 13 bp, D. melanogaster
aatacatttcttt

SEQ ID NO: 562258 - DNA, 13 bp, D. melanogaster
aatacatttgaaa

SEQ ID NO: 562259 - DNA, 13 bp, D. melanogaster
aatacatttgaat

SEQ ID NO: 562260 - DNA, 13 bp, D. melanogaster
aatacatttgcaa

SEQ ID NO: 562261 - DNA, 13 bp, D. melanogaster
aatacatttgcca

SEQ ID NO: 562262 - DNA, 14 bp, D. melanogaster
aatacattttcaat

SEQ ID NO: 562263 - DNA, 13 bp, D. melanogaster
aatacattttcct

SEQ ID NO: 562264 - DNA, 13 bp, D. melanogaster
aatacattttctg

SEQ ID NO: 562265 - DNA, 13 bp, D. melanogaster
aatacattttgaa

SEQ ID NO: 562266 - DNA, 13 bp, D. melanogaster
aatacattttgat

SEQ ID NO: 562267 - DNA, 14 bp, D. melanogaster
aatacattttggat

SEQ ID NO: 562268 - DNA, 13 bp, D. melanogaster
aatacattttgta

SEQ ID NO: 562269 - DNA, 14 bp, D. melanogaster
aatacattttgtaa

SEQ ID NO: 562270 - DNA, 13 bp, D. melanogaster
aatacattttgtt

SEQ ID NO: 562271 - DNA, 14 bp, D. melanogaster
aatacatttttgaa

SEQ ID NO: 562272 - DNA, 13 bp, D. melanogaster
aatacatttttgt

SEQ ID NO: 562273 - DNA, 14 bp, D. melanogaster
aatacatttttgtt

SEQ ID NO: 562274 - DNA, 13 bp, D. melanogaster
aataccaaaattg

SEQ ID NO: 562275 - DNA, 13 bp, D. melanogaster
aataccaaaattt

SEQ ID NO: 562276 - DNA, 13 bp, D. melanogaster
aataccaaacgaa

SEQ ID NO: 562277 - DNA, 13 bp, D. melanogaster
aataccaaatacc

SEQ ID NO: 562278 - DNA, 13 bp, D. melanogaster
aataccaaatact

SEQ ID NO: 562279 - DNA, 13 bp, D. melanogaster
aataccaagttct

SEQ ID NO: 562280 - DNA, 13 bp, D. melanogaster
aataccaatattt

SEQ ID NO: 562281 - DNA, 13 bp, D. melanogaster
aataccaatcaca

SEQ ID NO: 562282 - DNA, 13 bp, D. melanogaster
aataccaattaat

SEQ ID NO: 562283 - DNA, 13 bp, D. melanogaster
aataccaatttaa

SEQ ID NO: 562284 - DNA, 13 bp, D. melanogaster
aataccaatttgt

SEQ ID NO: 562285 - DNA, 13 bp, D. melanogaster
aataccacagata

SEQ ID NO: 562286 - DNA, 13 bp, D. melanogaster
aataccacctaca

SEQ ID NO: 562287 - DNA, 13 bp, D. melanogaster
aataccagagctg

SEQ ID NO: 562288 - DNA, 13 bp, D. melanogaster
aataccagcgtta

SEQ ID NO: 562289 - DNA, 13 bp, D. melanogaster
aataccataaatc

SEQ ID NO: 562290 - DNA, 13 bp, D. melanogaster
aataccatatata

SEQ ID NO: 562291 - DNA, 13 bp, D. melanogaster
aataccatcaggg

SEQ ID NO: 562292 - DNA, 13 bp, D. melanogaster
aataccattaaat

SEQ ID NO: 562293 - DNA, 13 bp, D. melanogaster
aatacccaagaaa

SEQ ID NO: 562294 - DNA, 13 bp, D. melanogaster
aatacccaatacc

SEQ ID NO: 562295 - DNA, 13 bp, D. melanogaster
aataccctttcct

SEQ ID NO: 562296 - DNA, 13 bp, D. melanogaster
aatacctaattat

SEQ ID NO: 562297 - DNA, 13 bp, D. melanogaster
aatacctacatat

SEQ ID NO: 562298 - DNA, 13 bp, D. melanogaster
aatacctatttgg

SEQ ID NO: 562299 - DNA, 13 bp, D. melanogaster
aatacctgagttt

SEQ ID NO: 562300 - DNA, 13 bp, D. melanogaster
aatacctttatgt

SEQ ID NO: 562301 - DNA, 13 bp, D. melanogaster
aatacgaaaattt

SEQ ID NO: 562302 - DNA, 13 bp, D. melanogaster
aatacgaaataca

SEQ ID NO: 562303 - DNA, 14 bp, D. melanogaster
aatacgaaatacaa

SEQ ID NO: 562304 - DNA, 14 bp, D. melanogaster
aatacgaaatacga

SEQ ID NO: 562305 - DNA, 13 bp, D. melanogaster
aatacgaaatgaa

SEQ ID NO: 562306 - DNA, 13 bp, D. melanogaster
aatacgaaattaa

SEQ ID NO: 562307 - DNA, 13 bp, D. melanogaster
aatacgaataaat

SEQ ID NO: 562308 - DNA, 13 bp, D. melanogaster
aatacgaatataa

SEQ ID NO: 562309 - DNA, 13 bp, D. melanogaster
aatacgaatattt

SEQ ID NO: 562310 - DNA, 13 bp, D. melanogaster
aatacgaatttaa

SEQ ID NO: 562311 - DNA, 13 bp, D. melanogaster
aatacgacttcga

SEQ ID NO: 562312 - DNA, 13 bp, D. melanogaster
aatacgagtacga

SEQ ID NO: 562313 - DNA, 42 bp, D. melanogaster
aatacgatctaacgcttatacataagccgatcgcggagcgtg

SEQ ID NO: 562314 - DNA, 13 bp, D. melanogaster
aatacgattttat

SEQ ID NO: 562315 - DNA, 13 bp, D. melanogaster
aatacgcatacgc

SEQ ID NO: 562316 - DNA, 13 bp, D. melanogaster
aatacggccacac

SEQ ID NO: 562317 - DNA, 13 bp, D. melanogaster
aatacgtacatat

SEQ ID NO: 562318 - DNA, 14 bp, D. melanogaster
aatacgtacatata

SEQ ID NO: 562319 - DNA, 13 bp, D. melanogaster
aatacgtatacgc

SEQ ID NO: 562320 - DNA, 14 bp, D. melanogaster
aatacgtatacgta

SEQ ID NO: 562321 - DNA, 13 bp, D. melanogaster
aatacgtatttaa

SEQ ID NO: 562322 - DNA, 13 bp, D. melanogaster
aatactaaaccta

SEQ ID NO: 562323 - DNA, 13 bp, D. melanogaster
aatactaaatact

SEQ ID NO: 562324 - DNA, 13 bp, D. melanogaster
aatactaaatgtt

SEQ ID NO: 562325 - DNA, 14 bp, D. melanogaster
aatactaataccaa

SEQ ID NO: 562326 - DNA, 13 bp, D. melanogaster
aatactaatacta

SEQ ID NO: 562327 - DNA, 13 bp, D. melanogaster
aatactaatgata

SEQ ID NO: 562328 - DNA, 13 bp, D. melanogaster
aatactaattcat

SEQ ID NO: 562329 - DNA, 14 bp, D. melanogaster
aatactaattgtaa

SEQ ID NO: 562330 - DNA, 14 bp, D. melanogaster
aatactagttaata

SEQ ID NO: 562331 - DNA, 13 bp, D. melanogaster
aatactatagtcg

SEQ ID NO: 562332 - DNA, 13 bp, D. melanogaster
aatactattgtta

SEQ ID NO: 562333 - DNA, 14 bp, D. melanogaster
aatacttaatactt

SEQ ID NO: 562334 - DNA, 13 bp, D. melanogaster
aatacttatactt

SEQ ID NO: 562335 - DNA, 13 bp, D. melanogaster
aatacttcagtga

SEQ ID NO: 562336 - DNA, 13 bp, D. melanogaster
aatacttgaaatt

SEQ ID NO: 562337 - DNA, 13 bp, D. melanogaster
aatacttggacaa

SEQ ID NO: 562338 - DNA, 13 bp, D. melanogaster
aatacttgtaaat

SEQ ID NO: 562339 - DNA, 13 bp, D. melanogaster
aatactttaaaga

SEQ ID NO: 562340 - DNA, 13 bp, D. melanogaster
aatactttaaatg

SEQ ID NO: 562341 - DNA, 13 bp, D. melanogaster
aatactttaatac

SEQ ID NO: 562342 - DNA, 13 bp, D. melanogaster
aatactttcagtt

SEQ ID NO: 562343 - DNA, 13 bp, D. melanogaster
aatactttcgaaa

SEQ ID NO: 562344 - DNA, 13 bp, D. melanogaster
aatactttgaaaa

SEQ ID NO: 562345 - DNA, 13 bp, D. melanogaster
aatactttgaaat

SEQ ID NO: 562346 - DNA, 13 bp, D. melanogaster
aatactttgattg

SEQ ID NO: 562347 - DNA, 13 bp, D. melanogaster
aatactttgcata

SEQ ID NO: 562348 - DNA, 13 bp, D. melanogaster
aatactttgttta

SEQ ID NO: 562349 - DNA, 13 bp, D. melanogaster
aatacttttaagt

SEQ ID NO: 562350 - DNA, 13 bp, D. melanogaster
aatacttttagtt

SEQ ID NO: 562351 - DNA, 13 bp, D. melanogaster
aatacttttcaaa

SEQ ID NO: 562352 - DNA, 14 bp, D. melanogaster
aatacttttcaaat

SEQ ID NO: 562353 - DNA, 13 bp, D. melanogaster
aatacttttctaa

SEQ ID NO: 562354 - DNA, 13 bp, D. melanogaster
aatacttttctta

SEQ ID NO: 562355 - DNA, 13 bp, D. melanogaster
aatacttttgaag

SEQ ID NO: 562356 - DNA, 13 bp, D. melanogaster
aatacttttgcca

SEQ ID NO: 562357 - DNA, 13 bp, D. melanogaster
aatactttttaca

SEQ ID NO: 562358 - DNA, 13 bp, D. melanogaster
aatactttttgaa

SEQ ID NO: 562359 - DNA, 14 bp, D. melanogaster
aatactttttgaaa

SEQ ID NO: 562360 - DNA, 13 bp, D. melanogaster
aatactttttggc

SEQ ID NO: 562361 - DNA, 13 bp, D. melanogaster
aatagaaaagccc

SEQ ID NO: 562362 - DNA, 14 bp, D. melanogaster
aatagaaaatgtac

SEQ ID NO: 562363 - DNA, 13 bp, D. melanogaster
aatagaaaatgtt

SEQ ID NO: 562364 - DNA, 13 bp, D. melanogaster
aatagaaaccgaa

SEQ ID NO: 562365 - DNA, 13 bp, D. melanogaster
aatagaaactaat

SEQ ID NO: 562366 - DNA, 13 bp, D. melanogaster
aatagaaactaca

SEQ ID NO: 562367 - DNA, 13 bp, D. melanogaster
aatagaaatcgaa

SEQ ID NO: 562368 - DNA, 13 bp, D. melanogaster
aatagaaatgcca

SEQ ID NO: 562369 - DNA, 13 bp, D. melanogaster
aatagaaccactg

SEQ ID NO: 562370 - DNA, 13 bp, D. melanogaster
aatagaaccatta

SEQ ID NO: 562371 - DNA, 13 bp, D. melanogaster
aatagaactcgaa

SEQ ID NO: 562372 - DNA, 13 bp, D. melanogaster
aatagaactgaag

SEQ ID NO: 562373 - DNA, 13 bp, D. melanogaster
aatagaagagatg

SEQ ID NO: 562374 - DNA, 13 bp, D. melanogaster
aatagaagcatgc

SEQ ID NO: 562375 - DNA, 13 bp, D. melanogaster
aatagaatgtgta

SEQ ID NO: 562376 - DNA, 13 bp, D. melanogaster
aatagaatgttta

SEQ ID NO: 562377 - DNA, 13 bp, D. melanogaster
aatagaatttcaa

SEQ ID NO: 562378 - DNA, 13 bp, D. melanogaster
aatagaatttgaa

SEQ ID NO: 562379 - DNA, 13 bp, D. melanogaster
aatagaattttcc

SEQ ID NO: 562380 - DNA, 13 bp, D. melanogaster
aatagacagcagc

SEQ ID NO: 562381 - DNA, 13 bp, D. melanogaster
aatagaccattta

SEQ ID NO: 562382 - DNA, 13 bp, D. melanogaster
aatagacgaaata

SEQ ID NO: 562383 - DNA, 13 bp, D. melanogaster
aatagactcaaaa

SEQ ID NO: 562384 - DNA, 13 bp, D. melanogaster
aatagaggacact

SEQ ID NO: 562385 - DNA, 14 bp, D. melanogaster
aatagaggacacta

SEQ ID NO: 562386 - DNA, 13 bp, D. melanogaster
aatagatatagcc

SEQ ID NO: 562387 - DNA, 13 bp, D. melanogaster
aatagatattaag

SEQ ID NO: 562388 - DNA, 13 bp, D. melanogaster
aatagatcaccaa

SEQ ID NO: 562389 - DNA, 13 bp, D. melanogaster
aatagatctggaa

SEQ ID NO: 562390 - DNA, 13 bp, D. melanogaster
aatagatgatgga

SEQ ID NO: 562391 - DNA, 13 bp, D. melanogaster
aatagattacgca

SEQ ID NO: 562392 - DNA, 13 bp, D. melanogaster
aatagattagaag

SEQ ID NO: 562393 - DNA, 13 bp, D. melanogaster
aatagattggtac

SEQ ID NO: 562394 - DNA, 13 bp, D. melanogaster
aatagatttcata

SEQ ID NO: 562395 - DNA, 13 bp, D. melanogaster
aatagatttgcca

SEQ ID NO: 562396 - DNA, 13 bp, D. melanogaster
aatagattttatc

SEQ ID NO: 562397 - DNA, 13 bp, D. melanogaster
aatagattttcca

SEQ ID NO: 562398 - DNA, 13 bp, D. melanogaster
aatagattttcct

SEQ ID NO: 562399 - DNA, 13 bp, D. melanogaster
aatagcaaaacat

SEQ ID NO: 562400 - DNA, 13 bp, D. melanogaster
aatagcaaaagca

SEQ ID NO: 562401 - DNA, 14 bp, D. melanogaster
aatagcaaaagcaa

SEQ ID NO: 562402 - DNA, 13 bp, D. melanogaster
aatagcaaattta

SEQ ID NO: 562403 - DNA, 13 bp, D. melanogaster
aatagcaacaaag

SEQ ID NO: 562404 - DNA, 13 bp, D. melanogaster
aatagcaacaact

SEQ ID NO: 562405 - DNA, 13 bp, D. melanogaster
aatagcaacaata

SEQ ID NO: 562406 - DNA, 14 bp, D. melanogaster
aatagcaacaataa

SEQ ID NO: 562407 - DNA, 13 bp, D. melanogaster
aatagcaacagaa

SEQ ID NO: 562408 - DNA, 13 bp, D. melanogaster
aatagcaacattt

SEQ ID NO: 562409 - DNA, 14 bp, D. melanogaster
aatagcaataataa

SEQ ID NO: 562410 - DNA, 14 bp, D. melanogaster
aatagcaatagcaa

SEQ ID NO: 562411 - DNA, 13 bp, D. melanogaster
aatagcaatattt

SEQ ID NO: 562412 - DNA, 13 bp, D. melanogaster
aatagcaatcaat

SEQ ID NO: 562413 - DNA, 13 bp, D. melanogaster
aatagcaattacc

SEQ ID NO: 562414 - DNA, 13 bp, D. melanogaster
aatagcaattgca

SEQ ID NO: 562415 - DNA, 13 bp, D. melanogaster
aatagcaatttaa

SEQ ID NO: 562416 - DNA, 13 bp, D. melanogaster
aatagcaatttgt

SEQ ID NO: 562417 - DNA, 13 bp, D. melanogaster
aatagcaattttt

SEQ ID NO: 562418 - DNA, 13 bp, D. melanogaster
aatagcagcaaaa

SEQ ID NO: 562419 - DNA, 14 bp, D. melanogaster
aatagcagcaacaa

SEQ ID NO: 562420 - DNA, 13 bp, D. melanogaster
aatagcagccaat

SEQ ID NO: 562421 - DNA, 13 bp, D. melanogaster
aatagcagtgcta

SEQ ID NO: 562422 - DNA, 13 bp, D. melanogaster
aatagcatacata

SEQ ID NO: 562423 - DNA, 14 bp, D. melanogaster
aatagcatcattca

SEQ ID NO: 562424 - DNA, 13 bp, D. melanogaster
aatagcattaaaa

SEQ ID NO: 562425 - DNA, 14 bp, D. melanogaster
aatagcattaaaaa

SEQ ID NO: 562426 - DNA, 13 bp, D. melanogaster
aatagcattgaaa

SEQ ID NO: 562427 - DNA, 13 bp, D. melanogaster
aatagcatttatt

SEQ ID NO: 562428 - DNA, 13 bp, D. melanogaster
aatagcatttttt

SEQ ID NO: 562429 - DNA, 13 bp, D. melanogaster
aatagccaaaaat

SEQ ID NO: 562430 - DNA, 13 bp, D. melanogaster
aatagccaaaagc

SEQ ID NO: 562431 - DNA, 13 bp, D. melanogaster
aatagccaactat

SEQ ID NO: 562432 - DNA, 13 bp, D. melanogaster
aatagccaagctg

SEQ ID NO: 562433 - DNA, 13 bp, D. melanogaster
aatagccacaaat

SEQ ID NO: 562434 - DNA, 13 bp, D. melanogaster
aatagccataaaa

SEQ ID NO: 562435 - DNA, 13 bp, D. melanogaster
aatagccccaaat

SEQ ID NO: 562436 - DNA, 13 bp, D. melanogaster
aatagccgagttg

SEQ ID NO: 562437 - DNA, 13 bp, D. melanogaster
aatagcgaaaata

SEQ ID NO: 562438 - DNA, 13 bp, D. melanogaster
aatagcgctatta

SEQ ID NO: 562439 - DNA, 14 bp, D. melanogaster
aatagcgctattaa

SEQ ID NO: 562440 - DNA, 13 bp, D. melanogaster
aatagcgtgattg

SEQ ID NO: 562441 - DNA, 13 bp, D. melanogaster
aatagctaaatat

SEQ ID NO: 562442 - DNA, 13 bp, D. melanogaster
aatagctaataaa

SEQ ID NO: 562443 - DNA, 13 bp, D. melanogaster
aatagctattgac

SEQ ID NO: 562444 - DNA, 13 bp, D. melanogaster
aatagctgaaaaa

SEQ ID NO: 562445 - DNA, 13 bp, D. melanogaster
aatagctgaaaat

SEQ ID NO: 562446 - DNA, 13 bp, D. melanogaster
aatagctgaaata

SEQ ID NO: 562447 - DNA, 13 bp, D. melanogaster
aatagctgagaaa

SEQ ID NO: 562448 - DNA, 13 bp, D. melanogaster
aataggaaaagac

SEQ ID NO: 562449 - DNA, 13 bp, D. melanogaster
aataggaaaatca

SEQ ID NO: 562450 - DNA, 13 bp, D. melanogaster
aataggaaaattc

SEQ ID NO: 562451 - DNA, 13 bp, D. melanogaster
aataggaatgccc

SEQ ID NO: 562452 - DNA, 13 bp, D. melanogaster
aataggaattgca

SEQ ID NO: 562453 - DNA, 13 bp, D. melanogaster
aataggaatttaa

SEQ ID NO: 562454 - DNA, 13 bp, D. melanogaster
aatagggaaatgg

SEQ ID NO: 562455 - DNA, 13 bp, D. melanogaster
aataggtattaaa

SEQ ID NO: 562456 - DNA, 13 bp, D. melanogaster
aataggtatttaa

SEQ ID NO: 562457 - DNA, 14 bp, D. melanogaster
aataggtatttaaa

SEQ ID NO: 562458 - DNA, 13 bp, D. melanogaster
aataggttgttca

SEQ ID NO: 562459 - DNA, 13 bp, D. melanogaster
aataggtttcttc

SEQ ID NO: 562460 - DNA, 13 bp, D. melanogaster
aataggttttaaa

SEQ ID NO: 562461 - DNA, 16 bp, D. melanogaster
aatagtaaataaacaa

SEQ ID NO: 562462 - DNA, 13 bp, D. melanogaster
aatagtaactaaa

SEQ ID NO: 562463 - DNA, 13 bp, D. melanogaster
aatagtaatagta

SEQ ID NO: 562464 - DNA, 13 bp, D. melanogaster
aatagtatacaaa

SEQ ID NO: 562465 - DNA, 13 bp, D. melanogaster
aatagtatcatca

SEQ ID NO: 562466 - DNA, 13 bp, D. melanogaster
aatagtcaagata

SEQ ID NO: 562467 - DNA, 14 bp, D. melanogaster
aatagtcgaaatat

SEQ ID NO: 562468 - DNA, 13 bp, D. melanogaster
aatagtctaaata

SEQ ID NO: 562469 - DNA, 14 bp, D. melanogaster
aatagtctaaataa

SEQ ID NO: 562470 - DNA, 13 bp, D. melanogaster
aatagtgaataat

SEQ ID NO: 562471 - DNA, 13 bp, D. melanogaster
aatagtgaatagt

SEQ ID NO: 562472 - DNA, 14 bp, D. melanogaster
aatagtgacatctc

SEQ ID NO: 562473 - DNA, 13 bp, D. melanogaster
aatagtgattgcg

SEQ ID NO: 562474 - DNA, 13 bp, D. melanogaster
aatagtggaaaat

SEQ ID NO: 562475 - DNA, 13 bp, D. melanogaster
aatagttaaacaa

SEQ ID NO: 562476 - DNA, 13 bp, D. melanogaster
aatagttgaaata

SEQ ID NO: 562477 - DNA, 14 bp, D. melanogaster
aatagttgatataa

SEQ ID NO: 562478 - DNA, 13 bp, D. melanogaster
aatagttgcaaat

SEQ ID NO: 562479 - DNA, 13 bp, D. melanogaster
aatagttgcaata

SEQ ID NO: 562480 - DNA, 13 bp, D. melanogaster
aatagttgcagaa

SEQ ID NO: 562481 - DNA, 14 bp, D. melanogaster
aatagttgcagaat

SEQ ID NO: 562482 - DNA, 13 bp, D. melanogaster
aatagttggaaat

SEQ ID NO: 562483 - DNA, 13 bp, D. melanogaster
aatagttggctat

SEQ ID NO: 562484 - DNA, 13 bp, D. melanogaster
aatagttgtaaaa

SEQ ID NO: 562485 - DNA, 13 bp, D. melanogaster
aatagttgtccaa

SEQ ID NO: 562486 - DNA, 14 bp, D. melanogaster
aatagttgtccaaa

SEQ ID NO: 562487 - DNA, 13 bp, D. melanogaster
aatagttgtttaa

SEQ ID NO: 562488 - DNA, 13 bp, D. melanogaster
aatagtttaaaag

SEQ ID NO: 562489 - DNA, 14 bp, D. melanogaster
aatagtttacaaaa

SEQ ID NO: 562490 - DNA, 13 bp, D. melanogaster
aatagtttactta

SEQ ID NO: 562491 - DNA, 13 bp, D. melanogaster
aatagtttattgt

SEQ ID NO: 562492 - DNA, 13 bp, D. melanogaster
aatagtttcatat

SEQ ID NO: 562493 - DNA, 13 bp, D. melanogaster
aatagtttccttt

SEQ ID NO: 562494 - DNA, 13 bp, D. melanogaster
aatagtttcgaaa

SEQ ID NO: 562495 - DNA, 14 bp, D. melanogaster
aatagtttcgaaaa

SEQ ID NO: 562496 - DNA, 13 bp, D. melanogaster
aatagtttcgatt

SEQ ID NO: 562497 - DNA, 13 bp, D. melanogaster
aatagtttgcaaa

SEQ ID NO: 562498 - DNA, 13 bp, D. melanogaster
aatagtttggaaa

SEQ ID NO: 562499 - DNA, 13 bp, D. melanogaster
aatagtttggata

SEQ ID NO: 562500 - DNA, 14 bp, D. melanogaster
aatagtttggataa

SEQ ID NO: 562501 - DNA, 13 bp, D. melanogaster
aatagtttgtagt

SEQ ID NO: 562502 - DNA, 14 bp, D. melanogaster
aatagtttgtagtt

SEQ ID NO: 562503 - DNA, 13 bp, D. melanogaster
aatagttttagtt

SEQ ID NO: 562504 - DNA, 13 bp, D. melanogaster
aatagttttcata

SEQ ID NO: 562505 - DNA, 13 bp, D. melanogaster
aatagttttgcat

SEQ ID NO: 562506 - DNA, 13 bp, D. melanogaster
aatagttttgtat

SEQ ID NO: 562507 - DNA, 13 bp, D. melanogaster
aatagtttttcca

SEQ ID NO: 562508 - DNA, 13 bp, D. melanogaster
aatagtttttctt

SEQ ID NO: 562509 - DNA, 13 bp, D. melanogaster
aatataaaaatcg

SEQ ID NO: 562510 - DNA, 13 bp, D. melanogaster
aatataaaacgta

SEQ ID NO: 562511 - DNA, 13 bp, D. melanogaster
aatataaaacttg

SEQ ID NO: 562512 - DNA, 13 bp, D. melanogaster
aatataaaagtgg

SEQ ID NO: 562513 - DNA, 14 bp, D. melanogaster
aatataaaatagct

SEQ ID NO: 562514 - DNA, 13 bp, D. melanogaster
aatataaacaatg

SEQ ID NO: 562515 - DNA, 13 bp, D. melanogaster
aatataaacgaat

SEQ ID NO: 562516 - DNA, 13 bp, D. melanogaster
aatataaactgaa

SEQ ID NO: 562517 - DNA, 13 bp, D. melanogaster
aatataaagccaa

SEQ ID NO: 562518 - DNA, 13 bp, D. melanogaster
aatataaatacga

SEQ ID NO: 562519 - DNA, 13 bp, D. melanogaster
aatataaatatgg

SEQ ID NO: 562520 - DNA, 14 bp, D. melanogaster
aatataaatctgat

SEQ ID NO: 562521 - DNA, 13 bp, D. melanogaster
aatataaatgcat

SEQ ID NO: 562522 - DNA, 13 bp, D. melanogaster
aatataaatggat

SEQ ID NO: 562523 - DNA, 14 bp, D. melanogaster
aatataaatgtgta

SEQ ID NO: 562524 - DNA, 13 bp, D. melanogaster
aatataaatgttg

SEQ ID NO: 562525 - DNA, 13 bp, D. melanogaster
aatataaattcca

SEQ ID NO: 562526 - DNA, 13 bp, D. melanogaster
aatataaattggt

SEQ ID NO: 562527 - DNA, 13 bp, D. melanogaster
aatataacaactt

SEQ ID NO: 562528 - DNA, 14 bp, D. melanogaster
aatataacatcttt

SEQ ID NO: 562529 - DNA, 13 bp, D. melanogaster
aatataactgaat

SEQ ID NO: 562530 - DNA, 13 bp, D. melanogaster
aatataagcaaat

SEQ ID NO: 562531 - DNA, 13 bp, D. melanogaster
aatataagcaata

SEQ ID NO: 562532 - DNA, 13 bp, D. melanogaster
aatataagcatat

SEQ ID NO: 562533 - DNA, 13 bp, D. melanogaster
aatataagtgttt

SEQ ID NO: 562534 - DNA, 13 bp, D. melanogaster
aatataatagcta

SEQ ID NO: 562535 - DNA, 13 bp, D. melanogaster
aatataatcccag

SEQ ID NO: 562536 - DNA, 13 bp, D. melanogaster
aatataatgaact

SEQ ID NO: 562537 - DNA, 14 bp, D. melanogaster
aatataatgaactt

SEQ ID NO: 562538 - DNA, 13 bp, D. melanogaster
aatataatgcagc

SEQ ID NO: 562539 - DNA, 13 bp, D. melanogaster
aatataatggaat

SEQ ID NO: 562540 - DNA, 13 bp, D. melanogaster
aatataattgcca

SEQ ID NO: 562541 - DNA, 13 bp, D. melanogaster
aatataatttcga

SEQ ID NO: 562542 - DNA, 13 bp, D. melanogaster
aatataattttcc

SEQ ID NO: 562543 - DNA, 13 bp, D. melanogaster
aatatacaaaagt

SEQ ID NO: 562544 - DNA, 14 bp, D. melanogaster
aatatacaaatatg

SEQ ID NO: 562545 - DNA, 13 bp, D. melanogaster
aatatacaaatgt

SEQ ID NO: 562546 - DNA, 14 bp, D. melanogaster
aatatacaaatgta

SEQ ID NO: 562547 - DNA, 13 bp, D. melanogaster
aatatacaacatt

SEQ ID NO: 562548 - DNA, 13 bp, D. melanogaster
aatatacaactta

SEQ ID NO: 562549 - DNA, 13 bp, D. melanogaster
aatatacaagttt

SEQ ID NO: 562550 - DNA, 13 bp, D. melanogaster
aatatacaatgca

SEQ ID NO: 562551 - DNA, 13 bp, D. melanogaster
aatatacacacat

SEQ ID NO: 562552 - DNA, 14 bp, D. melanogaster
aatatacacacata

SEQ ID NO: 562553 - DNA, 14 bp, D. melanogaster
aatatacatatatg

SEQ ID NO: 562554 - DNA, 13 bp, D. melanogaster
aatatacatatgt

SEQ ID NO: 562555 - DNA, 14 bp, D. melanogaster
aatatacatatgta

SEQ ID NO: 562556 - DNA, 13 bp, D. melanogaster
aatatacatttga

SEQ ID NO: 562557 - DNA, 13 bp, D. melanogaster
aatatacattttc

SEQ ID NO: 562558 - DNA, 13 bp, D. melanogaster
aatatacccacaa

SEQ ID NO: 562559 - DNA, 13 bp, D. melanogaster
aatataccctttt

SEQ ID NO: 562560 - DNA, 13 bp, D. melanogaster
aatatacgaattt

SEQ ID NO: 562561 - DNA, 13 bp, D. melanogaster
aatatactaagta

SEQ ID NO: 562562 - DNA, 13 bp, D. melanogaster
aatatactcaaga

SEQ ID NO: 562563 - DNA, 13 bp, D. melanogaster
aatatagaaatac

SEQ ID NO: 562564 - DNA, 13 bp, D. melanogaster
aatatagaggaga

SEQ ID NO: 562565 - DNA, 13 bp, D. melanogaster
aatatagccttag

SEQ ID NO: 562566 - DNA, 13 bp, D. melanogaster
aatatagcgatat

SEQ ID NO: 562567 - DNA, 14 bp, D. melanogaster
aatatagcttcttt

SEQ ID NO: 562568 - DNA, 13 bp, D. melanogaster
aatatagtatagt

SEQ ID NO: 562569 - DNA, 13 bp, D. melanogaster
aatatagttgata

SEQ ID NO: 562570 - DNA, 13 bp, D. melanogaster
aatatagtttttg

SEQ ID NO: 562571 - DNA, 13 bp, D. melanogaster
aatatataaagct

SEQ ID NO: 562572 - DNA, 13 bp, D. melanogaster
aatatataaatgc

SEQ ID NO: 562573 - DNA, 13 bp, D. melanogaster
aatatataagcaa

SEQ ID NO: 562574 - DNA, 13 bp, D. melanogaster
aatatatacaact

SEQ ID NO: 562575 - DNA, 13 bp, D. melanogaster
aatatatacaaga

SEQ ID NO: 562576 - DNA, 14 bp, D. melanogaster
aatatatacacaca

SEQ ID NO: 562577 - DNA, 13 bp, D. melanogaster
aatatatacatac

SEQ ID NO: 562578 - DNA, 14 bp, D. melanogaster
aatatatacatatc

SEQ ID NO: 562579 - DNA, 13 bp, D. melanogaster
aatatatacatgt

SEQ ID NO: 562580 - DNA, 14 bp, D. melanogaster
aatatatacatgta

SEQ ID NO: 562581 - DNA, 13 bp, D. melanogaster
aatatatacgtat

SEQ ID NO: 562582 - DNA, 13 bp, D. melanogaster
aatatatagaact

SEQ ID NO: 562583 - DNA, 13 bp, D. melanogaster
aatatataggtat

SEQ ID NO: 562584 - DNA, 14 bp, D. melanogaster
aatatatatatgca

SEQ ID NO: 562585 - DNA, 13 bp, D. melanogaster
aatatatatatgg

SEQ ID NO: 562586 - DNA, 15 bp, D. melanogaster
aatatatatatgtgt

SEQ ID NO: 562587 - DNA, 13 bp, D. melanogaster
aatatatatcgaa

SEQ ID NO: 562588 - DNA, 13 bp, D. melanogaster
aatatatatgaac

SEQ ID NO: 562589 - DNA, 13 bp, D. melanogaster
aatatatatgaag

SEQ ID NO: 562590 - DNA, 14 bp, D. melanogaster
aatatatatgcaaa

SEQ ID NO: 562591 - DNA, 13 bp, D. melanogaster
aatatatatggaa

SEQ ID NO: 562592 - DNA, 14 bp, D. melanogaster
aatatatatgtaca

SEQ ID NO: 562593 - DNA, 13 bp, D. melanogaster
aatatatattcag

SEQ ID NO: 562594 - DNA, 13 bp, D. melanogaster
aatatatattcct

SEQ ID NO: 562595 - DNA, 13 bp, D. melanogaster
aatatatattgga

SEQ ID NO: 562596 - DNA, 14 bp, D. melanogaster
aatatatattgtac

SEQ ID NO: 562597 - DNA, 13 bp, D. melanogaster
aatatatattgtg

SEQ ID NO: 562598 - DNA, 13 bp, D. melanogaster
aatatatatttgg

SEQ ID NO: 562599 - DNA, 13 bp, D. melanogaster
aatatatcaaagt

SEQ ID NO: 562600 - DNA, 13 bp, D. melanogaster
aatatatcaaatg

SEQ ID NO: 562601 - DNA, 13 bp, D. melanogaster
aatatatcaatgt

SEQ ID NO: 562602 - DNA, 13 bp, D. melanogaster
aatatatcaggaa

SEQ ID NO: 562603 - DNA, 13 bp, D. melanogaster
aatatatccattt

SEQ ID NO: 562604 - DNA, 13 bp, D. melanogaster
aatatatctacat

SEQ ID NO: 562605 - DNA, 13 bp, D. melanogaster
aatatatctagac

SEQ ID NO: 562606 - DNA, 13 bp, D. melanogaster
aatatatcttgct

SEQ ID NO: 562607 - DNA, 14 bp, D. melanogaster
aatatatgaatatg

SEQ ID NO: 562608 - DNA, 13 bp, D. melanogaster
aatatatgcacat

SEQ ID NO: 562609 - DNA, 13 bp, D. melanogaster
aatatatgcagcg

SEQ ID NO: 562610 - DNA, 13 bp, D. melanogaster
aatatatgcatat

SEQ ID NO: 562611 - DNA, 13 bp, D. melanogaster
aatatatgcatta

SEQ ID NO: 562612 - DNA, 13 bp, D. melanogaster
aatatatgcttaa

SEQ ID NO: 562613 - DNA, 13 bp, D. melanogaster
aatatatgctttt

SEQ ID NO: 562614 - DNA, 13 bp, D. melanogaster
aatatatggaaag

SEQ ID NO: 562615 - DNA, 13 bp, D. melanogaster
aatatatggaaat

SEQ ID NO: 562616 - DNA, 13 bp, D. melanogaster
aatatatggcata

SEQ ID NO: 562617 - DNA, 14 bp, D. melanogaster
aatatatggtatat

SEQ ID NO: 562618 - DNA, 13 bp, D. melanogaster
aatatatgtaagt

SEQ ID NO: 562619 - DNA, 14 bp, D. melanogaster
aatatatgtacaca

SEQ ID NO: 562620 - DNA, 13 bp, D. melanogaster
aatatatgtacat

SEQ ID NO: 562621 - DNA, 14 bp, D. melanogaster
aatatatgtacata

SEQ ID NO: 562622 - DNA, 13 bp, D. melanogaster
aatatatgtacgt

SEQ ID NO: 562623 - DNA, 14 bp, D. melanogaster
aatatatgtatatc

SEQ ID NO: 562624 - DNA, 14 bp, D. melanogaster
aatatatgtatgtg

SEQ ID NO: 562625 - DNA, 13 bp, D. melanogaster
aatatatgtgaaa

SEQ ID NO: 562626 - DNA, 13 bp, D. melanogaster
aatatatgtgtat

SEQ ID NO: 562627 - DNA, 13 bp, D. melanogaster
aatatatgtttga

SEQ ID NO: 562628 - DNA, 13 bp, D. melanogaster
aatatattcaaca

SEQ ID NO: 562629 - DNA, 13 bp, D. melanogaster
aatatattcaagt

SEQ ID NO: 562630 - DNA, 13 bp, D. melanogaster
aatatattcaatc

SEQ ID NO: 562631 - DNA, 13 bp, D. melanogaster
aatatattcgatt

SEQ ID NO: 562632 - DNA, 13 bp, D. melanogaster
aatatattcgtaa

SEQ ID NO: 562633 - DNA, 13 bp, D. melanogaster
aatatattcttgt

SEQ ID NO: 562634 - DNA, 13 bp, D. melanogaster
aatatattgcaaa

SEQ ID NO: 562635 - DNA, 13 bp, D. melanogaster
aatatattgcatt

SEQ ID NO: 562636 - DNA, 13 bp, D. melanogaster
aatatattgccaa

SEQ ID NO: 562637 - DNA, 13 bp, D. melanogaster
aatatattgctaa

SEQ ID NO: 562638 - DNA, 13 bp, D. melanogaster
aatatattgtaca

SEQ ID NO: 562639 - DNA, 13 bp, D. melanogaster
aatatatttaagc

SEQ ID NO: 562640 - DNA, 13 bp, D. melanogaster
aatatatttcaac

SEQ ID NO: 562641 - DNA, 13 bp, D. melanogaster
aatatatttcatg

SEQ ID NO: 562642 - DNA, 13 bp, D. melanogaster
aatatatttccag

SEQ ID NO: 562643 - DNA, 13 bp, D. melanogaster
aatatatttcctt

SEQ ID NO: 562644 - DNA, 13 bp, D. melanogaster
aatatatttcgaa

SEQ ID NO: 562645 - DNA, 13 bp, D. melanogaster
aatatatttgcat

SEQ ID NO: 562646 - DNA, 14 bp, D. melanogaster
aatatatttgcatt

SEQ ID NO: 562647 - DNA, 13 bp, D. melanogaster
aatatatttggaa

SEQ ID NO: 562648 - DNA, 13 bp, D. melanogaster
aatatattttacg

SEQ ID NO: 562649 - DNA, 14 bp, D. melanogaster
aatatattttccat

SEQ ID NO: 562650 - DNA, 13 bp, D. melanogaster
aatatattttcgt

SEQ ID NO: 562651 - DNA, 13 bp, D. melanogaster
aatatattttctc

SEQ ID NO: 562652 - DNA, 13 bp, D. melanogaster
aatatattttgtc

SEQ ID NO: 562653 - DNA, 13 bp, D. melanogaster
aatatcaaaactt

SEQ ID NO: 562654 - DNA, 13 bp, D. melanogaster
aatatcaaaagat

SEQ ID NO: 562655 - DNA, 13 bp, D. melanogaster
aatatcaaaatga

SEQ ID NO: 562656 - DNA, 13 bp, D. melanogaster
aatatcaaacttt

SEQ ID NO: 562657 - DNA, 13 bp, D. melanogaster
aatatcaaagatt

SEQ ID NO: 562658 - DNA, 13 bp, D. melanogaster
aatatcaaattgt

SEQ ID NO: 562659 - DNA, 13 bp, D. melanogaster
aatatcaacacat

SEQ ID NO: 562660 - DNA, 13 bp, D. melanogaster
aatatcaacattt

SEQ ID NO: 562661 - DNA, 13 bp, D. melanogaster
aatatcaactttt

SEQ ID NO: 562662 - DNA, 13 bp, D. melanogaster
aatatcaagaaag

SEQ ID NO: 562663 - DNA, 13 bp, D. melanogaster
aatatcaatcaac

SEQ ID NO: 562664 - DNA, 13 bp, D. melanogaster
aatatcaatgtta

SEQ ID NO: 562665 - DNA, 13 bp, D. melanogaster
aatatcaattaca

SEQ ID NO: 562666 - DNA, 13 bp, D. melanogaster
aatatcaattgca

SEQ ID NO: 562667 - DNA, 13 bp, D. melanogaster
aatatcaatttga

SEQ ID NO: 562668 - DNA, 13 bp, D. melanogaster
aatatcacatttt

SEQ ID NO: 562669 - DNA, 13 bp, D. melanogaster
aatatcacgtata

SEQ ID NO: 562670 - DNA, 13 bp, D. melanogaster
aatatcagaaaat

SEQ ID NO: 562671 - DNA, 14 bp, D. melanogaster
aatatcagataccc

SEQ ID NO: 562672 - DNA, 13 bp, D. melanogaster
aatatcatatatc

SEQ ID NO: 562673 - DNA, 13 bp, D. melanogaster
aatatcatatcat

SEQ ID NO: 562674 - DNA, 14 bp, D. melanogaster
aatatcatcaaagt

SEQ ID NO: 562675 - DNA, 13 bp, D. melanogaster
aatatcatccaga

SEQ ID NO: 562676 - DNA, 13 bp, D. melanogaster
aatatcattaggt

SEQ ID NO: 562677 - DNA, 13 bp, D. melanogaster
aatatcattatca

SEQ ID NO: 562678 - DNA, 13 bp, D. melanogaster
aatatcattgaaa

SEQ ID NO: 562679 - DNA, 13 bp, D. melanogaster
aatatccaaatat

SEQ ID NO: 562680 - DNA, 13 bp, D. melanogaster
aatatccaaattt

SEQ ID NO: 562681 - DNA, 13 bp, D. melanogaster
aatatccataaat

SEQ ID NO: 562682 - DNA, 13 bp, D. melanogaster
aatatccgatttt

SEQ ID NO: 562683 - DNA, 13 bp, D. melanogaster
aatatccttaaaa

SEQ ID NO: 562684 - DNA, 13 bp, D. melanogaster
aatatccttcgac

SEQ ID NO: 562685 - DNA, 13 bp, D. melanogaster
aatatccttttat

SEQ ID NO: 562686 - DNA, 13 bp, D. melanogaster
aatatcgaaaaat

SEQ ID NO: 562687 - DNA, 13 bp, D. melanogaster
aatatcgaattaa

SEQ ID NO: 562688 - DNA, 13 bp, D. melanogaster
aatatcgatattt

SEQ ID NO: 562689 - DNA, 13 bp, D. melanogaster
aatatcgatgttt

SEQ ID NO: 562690 - DNA, 13 bp, D. melanogaster
aatatcgctatat

SEQ ID NO: 562691 - DNA, 13 bp, D. melanogaster
aatatcgctttaa

SEQ ID NO: 562692 - DNA, 13 bp, D. melanogaster
aatatcgtaaaaa

SEQ ID NO: 562693 - DNA, 13 bp, D. melanogaster
aatatcgtaataa

SEQ ID NO: 562694 - DNA, 13 bp, D. melanogaster
aatatcgttttat

SEQ ID NO: 562695 - DNA, 13 bp, D. melanogaster
aatatctacaatt

SEQ ID NO: 562696 - DNA, 13 bp, D. melanogaster
aatatctatagat

SEQ ID NO: 562697 - DNA, 13 bp, D. melanogaster
aatatctatatct

SEQ ID NO: 562698 - DNA, 13 bp, D. melanogaster
aatatctatcagg

SEQ ID NO: 562699 - DNA, 13 bp, D. melanogaster
aatatctatcgat

SEQ ID NO: 562700 - DNA, 14 bp, D. melanogaster
aatatctatcgata

SEQ ID NO: 562701 - DNA, 13 bp, D. melanogaster
aatatctattgcc

SEQ ID NO: 562702 - DNA, 13 bp, D. melanogaster
aatatctcaaggg

SEQ ID NO: 562703 - DNA, 13 bp, D. melanogaster
aatatctcaattt

SEQ ID NO: 562704 - DNA, 13 bp, D. melanogaster
aatatcttatctt

SEQ ID NO: 562705 - DNA, 13 bp, D. melanogaster
aatatcttcaaat

SEQ ID NO: 562706 - DNA, 13 bp, D. melanogaster
aatatcttcatta

SEQ ID NO: 562707 - DNA, 13 bp, D. melanogaster
aatatcttcggtt

SEQ ID NO: 562708 - DNA, 13 bp, D. melanogaster
aatatcttctatt

SEQ ID NO: 562709 - DNA, 14 bp, D. melanogaster
aatatcttctattc

SEQ ID NO: 562710 - DNA, 15 bp, D. melanogaster
aatatcttggtgcta

SEQ ID NO: 562711 - DNA, 13 bp, D. melanogaster
aatatctttatct

SEQ ID NO: 562712 - DNA, 13 bp, D. melanogaster
aatatctttgaat

SEQ ID NO: 562713 - DNA, 13 bp, D. melanogaster
aatatctttttga

SEQ ID NO: 562714 - DNA, 13 bp, D. melanogaster
aatatgaaaacca

SEQ ID NO: 562715 - DNA, 13 bp, D. melanogaster
aatatgaaaactg

SEQ ID NO: 562716 - DNA, 13 bp, D. melanogaster
aatatgaaaagcc

SEQ ID NO: 562717 - DNA, 13 bp, D. melanogaster
aatatgaaaagtt

SEQ ID NO: 562718 - DNA, 13 bp, D. melanogaster
aatatgaaaatca

SEQ ID NO: 562719 - DNA, 13 bp, D. melanogaster
aatatgaaaatct

SEQ ID NO: 562720 - DNA, 13 bp, D. melanogaster
aatatgaaaatgg

SEQ ID NO: 562721 - DNA, 13 bp, D. melanogaster
aatatgaaatgca

SEQ ID NO: 562722 - DNA, 13 bp, D. melanogaster
aatatgaaatgtg

SEQ ID NO: 562723 - DNA, 13 bp, D. melanogaster
aatatgaacaaat

SEQ ID NO: 562724 - DNA, 13 bp, D. melanogaster
aatatgaacacaa

SEQ ID NO: 562725 - DNA, 13 bp, D. melanogaster
aatatgaacataa

SEQ ID NO: 562726 - DNA, 13 bp, D. melanogaster
aatatgaacattt

SEQ ID NO: 562727 - DNA, 13 bp, D. melanogaster
aatatgaagaagt

SEQ ID NO: 562728 - DNA, 14 bp, D. melanogaster
aatatgaagaagta

SEQ ID NO: 562729 - DNA, 13 bp, D. melanogaster
aatatgaagtgaa

SEQ ID NO: 562730 - DNA, 13 bp, D. melanogaster
aatatgaatatac

SEQ ID NO: 562731 - DNA, 13 bp, D. melanogaster
aatatgaatatga

SEQ ID NO: 562732 - DNA, 13 bp, D. melanogaster
aatatgaatcaat

SEQ ID NO: 562733 - DNA, 14 bp, D. melanogaster
aatatgaatcataa

SEQ ID NO: 562734 - DNA, 13 bp, D. melanogaster
aatatgaatgcaa

SEQ ID NO: 562735 - DNA, 13 bp, D. melanogaster
aatatgaatgcga

SEQ ID NO: 562736 - DNA, 13 bp, D. melanogaster
aatatgaattatg

SEQ ID NO: 562737 - DNA, 13 bp, D. melanogaster
aatatgaatttgt

SEQ ID NO: 562738 - DNA, 13 bp, D. melanogaster
aatatgaattttg

SEQ ID NO: 562739 - DNA, 13 bp, D. melanogaster
aatatgacaacaa

SEQ ID NO: 562740 - DNA, 13 bp, D. melanogaster
aatatgacagaaa

SEQ ID NO: 562741 - DNA, 13 bp, D. melanogaster
aatatgagatata

SEQ ID NO: 562742 - DNA, 13 bp, D. melanogaster
aatatgagtacaa

SEQ ID NO: 562743 - DNA, 13 bp, D. melanogaster
aatatgataactg

SEQ ID NO: 562744 - DNA, 13 bp, D. melanogaster
aatatgatatcat

SEQ ID NO: 562745 - DNA, 13 bp, D. melanogaster
aatatgatatgat

SEQ ID NO: 562746 - DNA, 13 bp, D. melanogaster
aatatgatcaaaa

SEQ ID NO: 562747 - DNA, 13 bp, D. melanogaster
aatatgatcaatg

SEQ ID NO: 562748 - DNA, 13 bp, D. melanogaster
aatatgatgaagc

SEQ ID NO: 562749 - DNA, 14 bp, D. melanogaster
aatatgatgaagcg

SEQ ID NO: 562750 - DNA, 13 bp, D. melanogaster
aatatgatggaaa

SEQ ID NO: 562751 - DNA, 13 bp, D. melanogaster
aatatgatgtaat

SEQ ID NO: 562752 - DNA, 13 bp, D. melanogaster
aatatgatttcaa

SEQ ID NO: 562753 - DNA, 13 bp, D. melanogaster
aatatgatttcat

SEQ ID NO: 562754 - DNA, 14 bp, D. melanogaster
aatatgcaaaaatg

SEQ ID NO: 562755 - DNA, 13 bp, D. melanogaster
aatatgcaaaagc

SEQ ID NO: 562756 - DNA, 13 bp, D. melanogaster
aatatgcaaaatg

SEQ ID NO: 562757 - DNA, 13 bp, D. melanogaster
aatatgcaaacaa

SEQ ID NO: 562758 - DNA, 13 bp, D. melanogaster
aatatgcaaacga

SEQ ID NO: 562759 - DNA, 13 bp, D. melanogaster
aatatgcaaactt

SEQ ID NO: 562760 - DNA, 13 bp, D. melanogaster
aatatgcaaagca

SEQ ID NO: 562761 - DNA, 14 bp, D. melanogaster
aatatgcaaaggaa

SEQ ID NO: 562762 - DNA, 13 bp, D. melanogaster
aatatgcaaagtc

SEQ ID NO: 562763 - DNA, 13 bp, D. melanogaster
aatatgcaaagtg

SEQ ID NO: 562764 - DNA, 13 bp, D. melanogaster
aatatgcaaataa

SEQ ID NO: 562765 - DNA, 14 bp, D. melanogaster
aatatgcaaataaa

SEQ ID NO: 562766 - DNA, 13 bp, D. melanogaster
aatatgcaaatat

SEQ ID NO: 562767 - DNA, 14 bp, D. melanogaster
aatatgcaaatatt

SEQ ID NO: 562768 - DNA, 13 bp, D. melanogaster
aatatgcaaatcg

SEQ ID NO: 562769 - DNA, 13 bp, D. melanogaster
aatatgcaaatga

SEQ ID NO: 562770 - DNA, 14 bp, D. melanogaster
aatatgcaaatgca

SEQ ID NO: 562771 - DNA, 13 bp, D. melanogaster
aatatgcaaattc

SEQ ID NO: 562772 - DNA, 13 bp, D. melanogaster
aatatgcaaattg

SEQ ID NO: 562773 - DNA, 14 bp, D. melanogaster
aatatgcaaattga

SEQ ID NO: 562774 - DNA, 13 bp, D. melanogaster
aatatgcaacaat

SEQ ID NO: 562775 - DNA, 13 bp, D. melanogaster
aatatgcaacttt

SEQ ID NO: 562776 - DNA, 13 bp, D. melanogaster
aatatgcaagaca

SEQ ID NO: 562777 - DNA, 14 bp, D. melanogaster
aatatgcaataaaa

SEQ ID NO: 562778 - DNA, 13 bp, D. melanogaster
aatatgcaataat

SEQ ID NO: 562779 - DNA, 13 bp, D. melanogaster
aatatgcaatatt

SEQ ID NO: 562780 - DNA, 13 bp, D. melanogaster
aatatgcaattaa

SEQ ID NO: 562781 - DNA, 14 bp, D. melanogaster
aatatgcaattaaa

SEQ ID NO: 562782 - DNA, 13 bp, D. melanogaster
aatatgcaatttt

SEQ ID NO: 562783 - DNA, 14 bp, D. melanogaster
aatatgcaatttta

SEQ ID NO: 562784 - DNA, 13 bp, D. melanogaster
aatatgcacaaca

SEQ ID NO: 562785 - DNA, 13 bp, D. melanogaster
aatatgcacacac

SEQ ID NO: 562786 - DNA, 13 bp, D. melanogaster
aatatgcacagaa

SEQ ID NO: 562787 - DNA, 14 bp, D. melanogaster
aatatgcacataaa

SEQ ID NO: 562788 - DNA, 13 bp, D. melanogaster
aatatgcacattt

SEQ ID NO: 562789 - DNA, 13 bp, D. melanogaster
aatatgcactttt

SEQ ID NO: 562790 - DNA, 13 bp, D. melanogaster
aatatgcagcaca

SEQ ID NO: 562791 - DNA, 13 bp, D. melanogaster
aatatgcagtttt

SEQ ID NO: 562792 - DNA, 13 bp, D. melanogaster
aatatgcataata

SEQ ID NO: 562793 - DNA, 13 bp, D. melanogaster
aatatgcatacaa

SEQ ID NO: 562794 - DNA, 13 bp, D. melanogaster
aatatgcatagaa

SEQ ID NO: 562795 - DNA, 13 bp, D. melanogaster
aatatgcatataa

SEQ ID NO: 562796 - DNA, 14 bp, D. melanogaster
aatatgcatatttt

SEQ ID NO: 562797 - DNA, 13 bp, D. melanogaster
aatatgcatgaaa

SEQ ID NO: 562798 - DNA, 14 bp, D. melanogaster
aatatgcatgaaaa

SEQ ID NO: 562799 - DNA, 13 bp, D. melanogaster
aatatgcattaaa

SEQ ID NO: 562800 - DNA, 13 bp, D. melanogaster
aatatgcatttgg

SEQ ID NO: 562801 - DNA, 13 bp, D. melanogaster
aatatgcatttta

SEQ ID NO: 562802 - DNA, 13 bp, D. melanogaster
aatatgccaaatt

SEQ ID NO: 562803 - DNA, 13 bp, D. melanogaster
aatatgccacaaa

SEQ ID NO: 562804 - DNA, 13 bp, D. melanogaster
aatatgccacaca

SEQ ID NO: 562805 - DNA, 13 bp, D. melanogaster
aatatgccagcaa

SEQ ID NO: 562806 - DNA, 14 bp, D. melanogaster
aatatgcccttaaa

SEQ ID NO: 562807 - DNA, 13 bp, D. melanogaster
aatatgcccttca

SEQ ID NO: 562808 - DNA, 13 bp, D. melanogaster
aatatgccttaaa

SEQ ID NO: 562809 - DNA, 13 bp, D. melanogaster
aatatgcgaaaat

SEQ ID NO: 562810 - DNA, 13 bp, D. melanogaster
aatatgctaaata

SEQ ID NO: 562811 - DNA, 13 bp, D. melanogaster
aatatgctaaatg

SEQ ID NO: 562812 - DNA, 13 bp, D. melanogaster
aatatgctaataa

SEQ ID NO: 562813 - DNA, 13 bp, D. melanogaster
aatatgctgcaaa

SEQ ID NO: 562814 - DNA, 13 bp, D. melanogaster
aatatgcttaaaa

SEQ ID NO: 562815 - DNA, 13 bp, D. melanogaster
aatatgcttttat

SEQ ID NO: 562816 - DNA, 13 bp, D. melanogaster
aatatggaaatgg

SEQ ID NO: 562817 - DNA, 14 bp, D. melanogaster
aatatggaatgtca

SEQ ID NO: 562818 - DNA, 13 bp, D. melanogaster
aatatggactcgg

SEQ ID NO: 562819 - DNA, 13 bp, D. melanogaster
aatatggacttgt

SEQ ID NO: 562820 - DNA, 13 bp, D. melanogaster
aatatggcaaatt

SEQ ID NO: 562821 - DNA, 13 bp, D. melanogaster
aatatggcaacga

SEQ ID NO: 562822 - DNA, 13 bp, D. melanogaster
aatatggccaaaa

SEQ ID NO: 562823 - DNA, 13 bp, D. melanogaster
aatatggccaaca

SEQ ID NO: 562824 - DNA, 13 bp, D. melanogaster
aatatggccagaa

SEQ ID NO: 562825 - DNA, 13 bp, D. melanogaster
aatatggcgcaat

SEQ ID NO: 562826 - DNA, 13 bp, D. melanogaster
aatatgggcaata

SEQ ID NO: 562827 - DNA, 13 bp, D. melanogaster
aatatgggccaat

SEQ ID NO: 562828 - DNA, 13 bp, D. melanogaster
aatatggtgcaga

SEQ ID NO: 562829 - DNA, 13 bp, D. melanogaster
aatatggtgccgt

SEQ ID NO: 562830 - DNA, 13 bp, D. melanogaster
aatatggttaaaa

SEQ ID NO: 562831 - DNA, 13 bp, D. melanogaster
aatatggtttaaa

SEQ ID NO: 562832 - DNA, 13 bp, D. melanogaster
aatatgtaaatca

SEQ ID NO: 562833 - DNA, 13 bp, D. melanogaster
aatatgtaaatgc

SEQ ID NO: 562834 - DNA, 13 bp, D. melanogaster
aatatgtaaattc

SEQ ID NO: 562835 - DNA, 13 bp, D. melanogaster
aatatgtaatatg

SEQ ID NO: 562836 - DNA, 13 bp, D. melanogaster
aatatgtacaaaa

SEQ ID NO: 562837 - DNA, 13 bp, D. melanogaster
aatatgtacaaca

SEQ ID NO: 562838 - DNA, 13 bp, D. melanogaster
aatatgtacacac

SEQ ID NO: 562839 - DNA, 13 bp, D. melanogaster
aatatgtacatag

SEQ ID NO: 562840 - DNA, 13 bp, D. melanogaster
aatatgtactttt

SEQ ID NO: 562841 - DNA, 14 bp, D. melanogaster
aatatgtatatgta

SEQ ID NO: 562842 - DNA, 13 bp, D. melanogaster
aatatgtatgaaa

SEQ ID NO: 562843 - DNA, 13 bp, D. melanogaster
aatatgtatgtat

SEQ ID NO: 562844 - DNA, 15 bp, D. melanogaster
aatatgtatgtatgt

SEQ ID NO: 562845 - DNA, 13 bp, D. melanogaster
aatatgtatgtgc

SEQ ID NO: 562846 - DNA, 13 bp, D. melanogaster
aatatgtatgttt

SEQ ID NO: 562847 - DNA, 13 bp, D. melanogaster
aatatgtattcaa

SEQ ID NO: 562848 - DNA, 13 bp, D. melanogaster
aatatgtatttac

SEQ ID NO: 562849 - DNA, 13 bp, D. melanogaster
aatatgtatttgg

SEQ ID NO: 562850 - DNA, 13 bp, D. melanogaster
aatatgtatttgt

SEQ ID NO: 562851 - DNA, 13 bp, D. melanogaster
aatatgtcaaaaa

SEQ ID NO: 562852 - DNA, 13 bp, D. melanogaster
aatatgtcaaccc

SEQ ID NO: 562853 - DNA, 13 bp, D. melanogaster
aatatgtgatatt

SEQ ID NO: 562854 - DNA, 13 bp, D. melanogaster
aatatgtgcaaaa

SEQ ID NO: 562855 - DNA, 13 bp, D. melanogaster
aatatgtgcaata

SEQ ID NO: 562856 - DNA, 13 bp, D. melanogaster
aatatgtgcgaca

SEQ ID NO: 562857 - DNA, 14 bp, D. melanogaster
aatatgtgcgacaa

SEQ ID NO: 562858 - DNA, 13 bp, D. melanogaster
aatatgtggaaaa

SEQ ID NO: 562859 - DNA, 13 bp, D. melanogaster
aatatgtgtaaaa

SEQ ID NO: 562860 - DNA, 13 bp, D. melanogaster
aatatgtgtaata

SEQ ID NO: 562861 - DNA, 13 bp, D. melanogaster
aatatgtgtacaa

SEQ ID NO: 562862 - DNA, 13 bp, D. melanogaster
aatatgtgtatta

SEQ ID NO: 562863 - DNA, 13 bp, D. melanogaster
aatatgtgtgttt

SEQ ID NO: 562864 - DNA, 13 bp, D. melanogaster
aatatgttaaaac

SEQ ID NO: 562865 - DNA, 13 bp, D. melanogaster
aatatgttaaaag

SEQ ID NO: 562866 - DNA, 13 bp, D. melanogaster
aatatgttaacaa

SEQ ID NO: 562867 - DNA, 13 bp, D. melanogaster
aatatgttatgtt

SEQ ID NO: 562868 - DNA, 13 bp, D. melanogaster
aatatgttcaaat

SEQ ID NO: 562869 - DNA, 13 bp, D. melanogaster
aatatgttcaatt

SEQ ID NO: 562870 - DNA, 13 bp, D. melanogaster
aatatgttgacaa

SEQ ID NO: 562871 - DNA, 13 bp, D. melanogaster
aatatgttgagat

SEQ ID NO: 562872 - DNA, 13 bp, D. melanogaster
aatatgttgtaat

SEQ ID NO: 562873 - DNA, 13 bp, D. melanogaster
aatatgttgtaca

SEQ ID NO: 562874 - DNA, 13 bp, D. melanogaster
aatatgttgtatt

SEQ ID NO: 562875 - DNA, 14 bp, D. melanogaster
aatatgtttaacaa

SEQ ID NO: 562876 - DNA, 13 bp, D. melanogaster
aatatgtttagct

SEQ ID NO: 562877 - DNA, 13 bp, D. melanogaster
aatatgtttcaaa

SEQ ID NO: 562878 - DNA, 13 bp, D. melanogaster
aatatgtttgcat

SEQ ID NO: 562879 - DNA, 13 bp, D. melanogaster
aatatgtttgctg

SEQ ID NO: 562880 - DNA, 14 bp, D. melanogaster
aatatgtttgctgt

SEQ ID NO: 562881 - DNA, 14 bp, D. melanogaster
aatatgttttaatc

SEQ ID NO: 562882 - DNA, 13 bp, D. melanogaster
aatatgttttatg

SEQ ID NO: 562883 - DNA, 13 bp, D. melanogaster
aatatgttttcat

SEQ ID NO: 562884 - DNA, 13 bp, D. melanogaster
aatatgtttttgc

SEQ ID NO: 562885 - DNA, 13 bp, D. melanogaster
aatattaacaaag

SEQ ID NO: 562886 - DNA, 18 bp, D. melanogaster
aatattaagaacaattaa

SEQ ID NO: 562887 - DNA, 13 bp, D. melanogaster
aatattaagcaat

SEQ ID NO: 562888 - DNA, 13 bp, D. melanogaster
aatattaagcatt

SEQ ID NO: 562889 - DNA, 13 bp, D. melanogaster
aatattaaggcaa

SEQ ID NO: 562890 - DNA, 13 bp, D. melanogaster
aatattaagttca

SEQ ID NO: 562891 - DNA, 13 bp, D. melanogaster
aatattaatgaac

SEQ ID NO: 562892 - DNA, 13 bp, D. melanogaster
aatattaatgcaa

SEQ ID NO: 562893 - DNA, 13 bp, D. melanogaster
aatattaatgcat

SEQ ID NO: 562894 - DNA, 13 bp, D. melanogaster
aatattaatggtt

SEQ ID NO: 562895 - DNA, 13 bp, D. melanogaster
aatattaatgtac

SEQ ID NO: 562896 - DNA, 13 bp, D. melanogaster
aatattaattggc

SEQ ID NO: 562897 - DNA, 14 bp, D. melanogaster
aatattacaatttc

SEQ ID NO: 562898 - DNA, 13 bp, D. melanogaster
aatattacacttt

SEQ ID NO: 562899 - DNA, 13 bp, D. melanogaster
aatattacgaaat

SEQ ID NO: 562900 - DNA, 13 bp, D. melanogaster
aatattacgattt

SEQ ID NO: 562901 - DNA, 13 bp, D. melanogaster
aatattacgtata

SEQ ID NO: 562902 - DNA, 13 bp, D. melanogaster
aatattacgttta

SEQ ID NO: 562903 - DNA, 13 bp, D. melanogaster
aatattacgtttt

SEQ ID NO: 562904 - DNA, 13 bp, D. melanogaster
aatattactgtta

SEQ ID NO: 562905 - DNA, 13 bp, D. melanogaster
aatattactttca

SEQ ID NO: 562906 - DNA, 13 bp, D. melanogaster
aatattagcaaaa

SEQ ID NO: 562907 - DNA, 13 bp, D. melanogaster
aatattatatgca

SEQ ID NO: 562908 - DNA, 13 bp, D. melanogaster
aatattatcaaca

SEQ ID NO: 562909 - DNA, 13 bp, D. melanogaster
aatattatcgaaa

SEQ ID NO: 562910 - DNA, 25 bp, D. melanogaster
aatattatcgagaaacttatcgact

SEQ ID NO: 562911 - DNA, 13 bp, D. melanogaster
aatattatgcaaa

SEQ ID NO: 562912 - DNA, 13 bp, D. melanogaster
aatattattgcaa

SEQ ID NO: 562913 - DNA, 13 bp, D. melanogaster
aatattatttctc

SEQ ID NO: 562914 - DNA, 13 bp, D. melanogaster
aatattcaaaaag

SEQ ID NO: 562915 - DNA, 13 bp, D. melanogaster
aatattcaaaagt

SEQ ID NO: 562916 - DNA, 13 bp, D. melanogaster
aatattcaaaatg

SEQ ID NO: 562917 - DNA, 13 bp, D. melanogaster
aatattcaaatga

SEQ ID NO: 562918 - DNA, 14 bp, D. melanogaster
aatattcaaatgaa

SEQ ID NO: 562919 - DNA, 13 bp, D. melanogaster
aatattcaaatgc

SEQ ID NO: 562920 - DNA, 13 bp, D. melanogaster
aatattcaaatgt

SEQ ID NO: 562921 - DNA, 13 bp, D. melanogaster
aatattcaaattc

SEQ ID NO: 562922 - DNA, 13 bp, D. melanogaster
aatattcaacaca

SEQ ID NO: 562923 - DNA, 13 bp, D. melanogaster
aatattcaacatt

SEQ ID NO: 562924 - DNA, 13 bp, D. melanogaster
aatattcaacttt

SEQ ID NO: 562925 - DNA, 13 bp, D. melanogaster
aatattcaagatt

SEQ ID NO: 562926 - DNA, 13 bp, D. melanogaster
aatattcaatgaa

SEQ ID NO: 562927 - DNA, 13 bp, D. melanogaster
aatattcaatgct

SEQ ID NO: 562928 - DNA, 13 bp, D. melanogaster
aatattcacaata

SEQ ID NO: 562929 - DNA, 14 bp, D. melanogaster
aatattcacacaaa

SEQ ID NO: 562930 - DNA, 13 bp, D. melanogaster
aatattcacttct

SEQ ID NO: 562931 - DNA, 13 bp, D. melanogaster
aatattcactttt

SEQ ID NO: 562932 - DNA, 13 bp, D. melanogaster
aatattcatattc

SEQ ID NO: 562933 - DNA, 13 bp, D. melanogaster
aatattcatttga

SEQ ID NO: 562934 - DNA, 13 bp, D. melanogaster
aatattccaaatt

SEQ ID NO: 562935 - DNA, 13 bp, D. melanogaster
aatattccaacaa

SEQ ID NO: 562936 - DNA, 13 bp, D. melanogaster
aatattccaatta

SEQ ID NO: 562937 - DNA, 13 bp, D. melanogaster
aatattccattaa

SEQ ID NO: 562938 - DNA, 13 bp, D. melanogaster
aatattccattta

SEQ ID NO: 562939 - DNA, 13 bp, D. melanogaster
aatattcccaacc

SEQ ID NO: 562940 - DNA, 13 bp, D. melanogaster
aatattccttaaa

SEQ ID NO: 562941 - DNA, 13 bp, D. melanogaster
aatattcgaaaaa

SEQ ID NO: 562942 - DNA, 13 bp, D. melanogaster
aatattcgaatcc

SEQ ID NO: 562943 - DNA, 13 bp, D. melanogaster
aatattcggaaat

SEQ ID NO: 562944 - DNA, 13 bp, D. melanogaster
aatattctgcaaa

SEQ ID NO: 562945 - DNA, 13 bp, D. melanogaster
aatattcttaaga

SEQ ID NO: 562946 - DNA, 13 bp, D. melanogaster
aatattcttcaat

SEQ ID NO: 562947 - DNA, 13 bp, D. melanogaster
aatattcttcttg

SEQ ID NO: 562948 - DNA, 13 bp, D. melanogaster
aatattcttgatc

SEQ ID NO: 562949 - DNA, 13 bp, D. melanogaster
aatattctttagt

SEQ ID NO: 562950 - DNA, 13 bp, D. melanogaster
aatattgaaaatg

SEQ ID NO: 562951 - DNA, 14 bp, D. melanogaster
aatattgaaaatgt

SEQ ID NO: 562952 - DNA, 13 bp, D. melanogaster
aatattgaaatac

SEQ ID NO: 562953 - DNA, 13 bp, D. melanogaster
aatattgaaatgc

SEQ ID NO: 562954 - DNA, 13 bp, D. melanogaster
aatattgaacaaa

SEQ ID NO: 562955 - DNA, 13 bp, D. melanogaster
aatattgaataac

SEQ ID NO: 562956 - DNA, 13 bp, D. melanogaster
aatattgacaaaa

SEQ ID NO: 562957 - DNA, 13 bp, D. melanogaster
aatattgacacca

SEQ ID NO: 562958 - DNA, 13 bp, D. melanogaster
aatattgacacta

SEQ ID NO: 562959 - DNA, 13 bp, D. melanogaster
aatattgacatca

SEQ ID NO: 562960 - DNA, 13 bp, D. melanogaster
aatattgatagtt

SEQ ID NO: 562961 - DNA, 13 bp, D. melanogaster
aatattgatgaaa

SEQ ID NO: 562962 - DNA, 13 bp, D. melanogaster
aatattgatttga

SEQ ID NO: 562963 - DNA, 14 bp, D. melanogaster
aatattgcaaaacc

SEQ ID NO: 562964 - DNA, 13 bp, D. melanogaster
aatattgcaaaat

SEQ ID NO: 562965 - DNA, 14 bp, D. melanogaster
aatattgcaaaatg

SEQ ID NO: 562966 - DNA, 13 bp, D. melanogaster
aatattgcacaaa

SEQ ID NO: 562967 - DNA, 13 bp, D. melanogaster
aatattgcagcaa

SEQ ID NO: 562968 - DNA, 14 bp, D. melanogaster
aatattgcataatt

SEQ ID NO: 562969 - DNA, 13 bp, D. melanogaster
aatattgcatata

SEQ ID NO: 562970 - DNA, 14 bp, D. melanogaster
aatattgcatattt

SEQ ID NO: 562971 - DNA, 13 bp, D. melanogaster
aatattgccacat

SEQ ID NO: 562972 - DNA, 13 bp, D. melanogaster
aatattgccataa

SEQ ID NO: 562973 - DNA, 13 bp, D. melanogaster
aatattgccattt

SEQ ID NO: 562974 - DNA, 13 bp, D. melanogaster
aatattgccgatt

SEQ ID NO: 562975 - DNA, 13 bp, D. melanogaster
aatattgcgaaaa

SEQ ID NO: 562976 - DNA, 13 bp, D. melanogaster
aatattgcgtttt

SEQ ID NO: 562977 - DNA, 13 bp, D. melanogaster
aatattgcttaaa

SEQ ID NO: 562978 - DNA, 13 bp, D. melanogaster
aatattgctttta

SEQ ID NO: 562979 - DNA, 13 bp, D. melanogaster
aatattggaaatt

SEQ ID NO: 562980 - DNA, 13 bp, D. melanogaster
aatattggaataa

SEQ ID NO: 562981 - DNA, 13 bp, D. melanogaster
aatattggaatat

SEQ ID NO: 562982 - DNA, 13 bp, D. melanogaster
aatattggatttg

SEQ ID NO: 562983 - DNA, 13 bp, D. melanogaster
aatattggcaatt

SEQ ID NO: 562984 - DNA, 13 bp, D. melanogaster
aatattgtaacat

SEQ ID NO: 562985 - DNA, 14 bp, D. melanogaster
aatattgtaacatt

SEQ ID NO: 562986 - DNA, 13 bp, D. melanogaster
aatattgtacaat

SEQ ID NO: 562987 - DNA, 13 bp, D. melanogaster
aatattgtagata

SEQ ID NO: 562988 - DNA, 13 bp, D. melanogaster
aatattgtcaata

SEQ ID NO: 562989 - DNA, 13 bp, D. melanogaster
aatattgtccata

SEQ ID NO: 562990 - DNA, 13 bp, D. melanogaster
aatattgtgaaaa

SEQ ID NO: 562991 - DNA, 13 bp, D. melanogaster
aatattgtgagta

SEQ ID NO: 562992 - DNA, 14 bp, D. melanogaster
aatattgtgagtaa

SEQ ID NO: 562993 - DNA, 13 bp, D. melanogaster
aatattgtgtaaa

SEQ ID NO: 562994 - DNA, 13 bp, D. melanogaster
aatattgtgtata

SEQ ID NO: 562995 - DNA, 13 bp, D. melanogaster
aatattgtgttta

SEQ ID NO: 562996 - DNA, 13 bp, D. melanogaster
aatattgttaatg

SEQ ID NO: 562997 - DNA, 13 bp, D. melanogaster
aatatttaaaagg

SEQ ID NO: 562998 - DNA, 13 bp, D. melanogaster
aatatttaaagca

SEQ ID NO: 562999 - DNA, 13 bp, D. melanogaster
aatatttaaagga

SEQ ID NO: 563000 - DNA, 13 bp, D. melanogaster
aatatttaaaggc

SEQ ID NO: 563001 - DNA, 13 bp, D. melanogaster
aatatttaaatgg

SEQ ID NO: 563002 - DNA, 14 bp, D. melanogaster
aatatttaaattgg

SEQ ID NO: 563003 - DNA, 13 bp, D. melanogaster
aatatttaacatg

SEQ ID NO: 563004 - DNA, 14 bp, D. melanogaster
aatatttaagcaat

SEQ ID NO: 563005 - DNA, 13 bp, D. melanogaster
aatatttaagcag

SEQ ID NO: 563006 - DNA, 13 bp, D. melanogaster
aatatttaaggat

SEQ ID NO: 563007 - DNA, 13 bp, D. melanogaster
aatatttaagtga

SEQ ID NO: 563008 - DNA, 13 bp, D. melanogaster
aatatttaatgcg

SEQ ID NO: 563009 - DNA, 13 bp, D. melanogaster
aatatttaattcg

SEQ ID NO: 563010 - DNA, 13 bp, D. melanogaster
aatatttaattgc

SEQ ID NO: 563011 - DNA, 13 bp, D. melanogaster
aatatttacaaac

SEQ ID NO: 563012 - DNA, 14 bp, D. melanogaster
aatatttacaaatg

SEQ ID NO: 563013 - DNA, 13 bp, D. melanogaster
aatatttacaaca

SEQ ID NO: 563014 - DNA, 13 bp, D. melanogaster
aatatttacaagc

SEQ ID NO: 563015 - DNA, 13 bp, D. melanogaster
aatatttacactg

SEQ ID NO: 563016 - DNA, 13 bp, D. melanogaster
aatatttacactt

SEQ ID NO: 563017 - DNA, 13 bp, D. melanogaster
aatatttacagaa

SEQ ID NO: 563018 - DNA, 13 bp, D. melanogaster
aatatttacagcc

SEQ ID NO: 563019 - DNA, 13 bp, D. melanogaster
aatatttacattg

SEQ ID NO: 563020 - DNA, 13 bp, D. melanogaster
aatatttaccaaa

SEQ ID NO: 563021 - DNA, 13 bp, D. melanogaster
aatatttaccaca

SEQ ID NO: 563022 - DNA, 13 bp, D. melanogaster
aatatttacccaa

SEQ ID NO: 563023 - DNA, 13 bp, D. melanogaster
aatatttacctaa

SEQ ID NO: 563024 - DNA, 13 bp, D. melanogaster
aatatttaccttt

SEQ ID NO: 563025 - DNA, 13 bp, D. melanogaster
aatatttactgaa

SEQ ID NO: 563026 - DNA, 13 bp, D. melanogaster
aatatttacttag

SEQ ID NO: 563027 - DNA, 13 bp, D. melanogaster
aatatttacttgt

SEQ ID NO: 563028 - DNA, 13 bp, D. melanogaster
aatatttagcata

SEQ ID NO: 563029 - DNA, 13 bp, D. melanogaster
aatatttagtgtt

SEQ ID NO: 563030 - DNA, 14 bp, D. melanogaster
aatatttataagtg

SEQ ID NO: 563031 - DNA, 13 bp, D. melanogaster
aatatttatagca

SEQ ID NO: 563032 - DNA, 13 bp, D. melanogaster
aatatttatcgaa

SEQ ID NO: 563033 - DNA, 13 bp, D. melanogaster
aatatttatcgca

SEQ ID NO: 563034 - DNA, 13 bp, D. melanogaster
aatatttatgaga

SEQ ID NO: 563035 - DNA, 14 bp, D. melanogaster
aatatttatgcagc

SEQ ID NO: 563036 - DNA, 13 bp, D. melanogaster
aatatttatgcga

SEQ ID NO: 563037 - DNA, 13 bp, D. melanogaster
aatatttatggca

SEQ ID NO: 563038 - DNA, 13 bp, D. melanogaster
aatatttatgtga

SEQ ID NO: 563039 - DNA, 13 bp, D. melanogaster
aatatttattcga

SEQ ID NO: 563040 - DNA, 13 bp, D. melanogaster
aatatttattctg

SEQ ID NO: 563041 - DNA, 13 bp, D. melanogaster
aatatttattgca

SEQ ID NO: 563042 - DNA, 14 bp, D. melanogaster
aatatttattgcaa

SEQ ID NO: 563043 - DNA, 13 bp, D. melanogaster
aatatttatttgc

SEQ ID NO: 563044 - DNA, 14 bp, D. melanogaster
aatatttatttgca

SEQ ID NO: 563045 - DNA, 13 bp, D. melanogaster
aatatttcaaaac

SEQ ID NO: 563046 - DNA, 13 bp, D. melanogaster
aatatttcaaaag

SEQ ID NO: 563047 - DNA, 13 bp, D. melanogaster
aatatttcaaaca

SEQ ID NO: 563048 - DNA, 13 bp, D. melanogaster
aatatttcaacaa

SEQ ID NO: 563049 - DNA, 13 bp, D. melanogaster
aatatttcaacac

SEQ ID NO: 563050 - DNA, 13 bp, D. melanogaster
aatatttcaagtt

SEQ ID NO: 563051 - DNA, 13 bp, D. melanogaster
aatatttcaatag

SEQ ID NO: 563052 - DNA, 13 bp, D. melanogaster
aatatttcaatgc

SEQ ID NO: 563053 - DNA, 13 bp, D. melanogaster
aatatttcaatgt

SEQ ID NO: 563054 - DNA, 13 bp, D. melanogaster
aatatttcacaaa

SEQ ID NO: 563055 - DNA, 13 bp, D. melanogaster
aatatttcacaca

SEQ ID NO: 563056 - DNA, 13 bp, D. melanogaster
aatatttcacttt

SEQ ID NO: 563057 - DNA, 13 bp, D. melanogaster
aatatttcagcaa

SEQ ID NO: 563058 - DNA, 13 bp, D. melanogaster
aatatttcagttt

SEQ ID NO: 563059 - DNA, 13 bp, D. melanogaster
aatatttcataag

SEQ ID NO: 563060 - DNA, 14 bp, D. melanogaster
aatatttcattgaa

SEQ ID NO: 563061 - DNA, 13 bp, D. melanogaster
aatatttcatttg

SEQ ID NO: 563062 - DNA, 14 bp, D. melanogaster
aatatttcatttga

SEQ ID NO: 563063 - DNA, 13 bp, D. melanogaster
aatatttccaaaa

SEQ ID NO: 563064 - DNA, 13 bp, D. melanogaster
aatatttccaatt

SEQ ID NO: 563065 - DNA, 13 bp, D. melanogaster
aatatttccataa

SEQ ID NO: 563066 - DNA, 13 bp, D. melanogaster
aatatttccattt

SEQ ID NO: 563067 - DNA, 13 bp, D. melanogaster
aatatttcccatt

SEQ ID NO: 563068 - DNA, 13 bp, D. melanogaster
aatatttcccttt

SEQ ID NO: 563069 - DNA, 13 bp, D. melanogaster
aatatttccgcat

SEQ ID NO: 563070 - DNA, 13 bp, D. melanogaster
aatatttcgaaaa

SEQ ID NO: 563071 - DNA, 13 bp, D. melanogaster
aatatttcgaatt

SEQ ID NO: 563072 - DNA, 13 bp, D. melanogaster
aatatttcgcaaa

SEQ ID NO: 563073 - DNA, 13 bp, D. melanogaster
aatatttcgcttg

SEQ ID NO: 563074 - DNA, 13 bp, D. melanogaster
aatatttcgcttt

SEQ ID NO: 563075 - DNA, 14 bp, D. melanogaster
aatatttcgctttt

SEQ ID NO: 563076 - DNA, 13 bp, D. melanogaster
aatatttcgtata

SEQ ID NO: 563077 - DNA, 13 bp, D. melanogaster
aatatttctagtt

SEQ ID NO: 563078 - DNA, 13 bp, D. melanogaster
aatatttctcgtg

SEQ ID NO: 563079 - DNA, 13 bp, D. melanogaster
aatatttctgaaa

SEQ ID NO: 563080 - DNA, 13 bp, D. melanogaster
aatatttctgttg

SEQ ID NO: 563081 - DNA, 13 bp, D. melanogaster
aatatttgaagaa

SEQ ID NO: 563082 - DNA, 13 bp, D. melanogaster
aatatttgaatgt

SEQ ID NO: 563083 - DNA, 13 bp, D. melanogaster
aatatttgacaaa

SEQ ID NO: 563084 - DNA, 13 bp, D. melanogaster
aatatttgacttt

SEQ ID NO: 563085 - DNA, 13 bp, D. melanogaster
aatatttgagcaa

SEQ ID NO: 563086 - DNA, 13 bp, D. melanogaster
aatatttgataga

SEQ ID NO: 563087 - DNA, 13 bp, D. melanogaster
aatatttgatcaa

SEQ ID NO: 563088 - DNA, 13 bp, D. melanogaster
aatatttgcaaaa

SEQ ID NO: 563089 - DNA, 14 bp, D. melanogaster
aatatttgcaaaaa

SEQ ID NO: 563090 - DNA, 13 bp, D. melanogaster
aatatttgcaaag

SEQ ID NO: 563091 - DNA, 13 bp, D. melanogaster
aatatttgcaaca

SEQ ID NO: 563092 - DNA, 13 bp, D. melanogaster
aatatttgcaatg

SEQ ID NO: 563093 - DNA, 13 bp, D. melanogaster
aatatttgcaatt

SEQ ID NO: 563094 - DNA, 13 bp, D. melanogaster
aatatttgcagat

SEQ ID NO: 563095 - DNA, 13 bp, D. melanogaster
aatatttgcagct

SEQ ID NO: 563096 - DNA, 13 bp, D. melanogaster
aatatttgcatac

SEQ ID NO: 563097 - DNA, 13 bp, D. melanogaster
aatatttgccaaa

SEQ ID NO: 563098 - DNA, 13 bp, D. melanogaster
aatatttgccttt

SEQ ID NO: 563099 - DNA, 13 bp, D. melanogaster
aatatttgcgcat

SEQ ID NO: 563100 - DNA, 13 bp, D. melanogaster
aatatttgctaac

SEQ ID NO: 563101 - DNA, 13 bp, D. melanogaster
aatatttgctatt

SEQ ID NO: 563102 - DNA, 13 bp, D. melanogaster
aatatttgctcaa

SEQ ID NO: 563103 - DNA, 13 bp, D. melanogaster
aatatttgctctt

SEQ ID NO: 563104 - DNA, 13 bp, D. melanogaster
aatatttggaaaa

SEQ ID NO: 563105 - DNA, 14 bp, D. melanogaster
aatatttggaaaat

SEQ ID NO: 563106 - DNA, 13 bp, D. melanogaster
aatatttggattt

SEQ ID NO: 563107 - DNA, 13 bp, D. melanogaster
aatatttggcaaa

SEQ ID NO: 563108 - DNA, 13 bp, D. melanogaster
aatatttggcaat

SEQ ID NO: 563109 - DNA, 13 bp, D. melanogaster
aatatttggccaa

SEQ ID NO: 563110 - DNA, 13 bp, D. melanogaster
aatatttggctta

SEQ ID NO: 563111 - DNA, 13 bp, D. melanogaster
aatatttggcttt

SEQ ID NO: 563112 - DNA, 14 bp, D. melanogaster
aatatttggctttg

SEQ ID NO: 563113 - DNA, 13 bp, D. melanogaster
aatatttgggcgg

SEQ ID NO: 563114 - DNA, 13 bp, D. melanogaster
aatatttggtata

SEQ ID NO: 563115 - DNA, 13 bp, D. melanogaster
aatatttggttaa

SEQ ID NO: 563116 - DNA, 13 bp, D. melanogaster
aatatttggttgc

SEQ ID NO: 563117 - DNA, 13 bp, D. melanogaster
aatatttgtaaag

SEQ ID NO: 563118 - DNA, 13 bp, D. melanogaster
aatatttgtagtt

SEQ ID NO: 563119 - DNA, 14 bp, D. melanogaster
aatatttgtatttc

SEQ ID NO: 563120 - DNA, 13 bp, D. melanogaster
aatatttgtcata

SEQ ID NO: 563121 - DNA, 13 bp, D. melanogaster
aatatttgtccaa

SEQ ID NO: 563122 - DNA, 13 bp, D. melanogaster
aatatttgtgaaa

SEQ ID NO: 563123 - DNA, 13 bp, D. melanogaster
aatatttgtgaat

SEQ ID NO: 563124 - DNA, 13 bp, D. melanogaster
aatatttgtgcag

SEQ ID NO: 563125 - DNA, 13 bp, D. melanogaster
aatatttgtgtgc

SEQ ID NO: 563126 - DNA, 13 bp, D. melanogaster
aatatttgttatg

SEQ ID NO: 563127 - DNA, 13 bp, D. melanogaster
aatatttgttcaa

SEQ ID NO: 563128 - DNA, 13 bp, D. melanogaster
aatatttgttcat

SEQ ID NO: 563129 - DNA, 13 bp, D. melanogaster
aatatttgtttga

SEQ ID NO: 563130 - DNA, 13 bp, D. melanogaster
aatattttaacgc

SEQ ID NO: 563131 - DNA, 13 bp, D. melanogaster
aatattttaagct

SEQ ID NO: 563132 - DNA, 13 bp, D. melanogaster
aatattttacaac

SEQ ID NO: 563133 - DNA, 13 bp, D. melanogaster
aatattttactac

SEQ ID NO: 563134 - DNA, 13 bp, D. melanogaster
aatattttagaga

SEQ ID NO: 563135 - DNA, 13 bp, D. melanogaster
aatattttagcca

SEQ ID NO: 563136 - DNA, 13 bp, D. melanogaster
aatattttagcta

SEQ ID NO: 563137 - DNA, 13 bp, D. melanogaster
aatattttagtgt

SEQ ID NO: 563138 - DNA, 13 bp, D. melanogaster
aatattttatggc

SEQ ID NO: 563139 - DNA, 14 bp, D. melanogaster
aatattttattgct

SEQ ID NO: 563140 - DNA, 13 bp, D. melanogaster
aatattttcaatc

SEQ ID NO: 563141 - DNA, 13 bp, D. melanogaster
aatattttcaatg

SEQ ID NO: 563142 - DNA, 13 bp, D. melanogaster
aatattttccaaa

SEQ ID NO: 563143 - DNA, 14 bp, D. melanogaster
aatattttccaaaa

SEQ ID NO: 563144 - DNA, 14 bp, D. melanogaster
aatattttccaaat

SEQ ID NO: 563145 - DNA, 13 bp, D. melanogaster
aatattttccaac

SEQ ID NO: 563146 - DNA, 13 bp, D. melanogaster
aatattttccaat

SEQ ID NO: 563147 - DNA, 14 bp, D. melanogaster
aatattttccaatt

SEQ ID NO: 563148 - DNA, 13 bp, D. melanogaster
aatattttccata

SEQ ID NO: 563149 - DNA, 13 bp, D. melanogaster
aatattttccatg

SEQ ID NO: 563150 - DNA, 13 bp, D. melanogaster
aatattttcccaa

SEQ ID NO: 563151 - DNA, 13 bp, D. melanogaster
aatattttcccag

SEQ ID NO: 563152 - DNA, 13 bp, D. melanogaster
aatattttcccct

SEQ ID NO: 563153 - DNA, 14 bp, D. melanogaster
aatattttcgaaaa

SEQ ID NO: 563154 - DNA, 14 bp, D. melanogaster
aatattttcgaaat

SEQ ID NO: 563155 - DNA, 13 bp, D. melanogaster
aatattttcggct

SEQ ID NO: 563156 - DNA, 13 bp, D. melanogaster
aatattttcggtg

SEQ ID NO: 563157 - DNA, 13 bp, D. melanogaster
aatattttcgtta

SEQ ID NO: 563158 - DNA, 13 bp, D. melanogaster
aatattttctgta

SEQ ID NO: 563159 - DNA, 13 bp, D. melanogaster
aatattttcttac

SEQ ID NO: 563160 - DNA, 14 bp, D. melanogaster
aatattttgaaatc

SEQ ID NO: 563161 - DNA, 13 bp, D. melanogaster
aatattttgattg

SEQ ID NO: 563162 - DNA, 13 bp, D. melanogaster
aatattttgcaaa

SEQ ID NO: 563163 - DNA, 14 bp, D. melanogaster
aatattttgcaaaa

SEQ ID NO: 563164 - DNA, 13 bp, D. melanogaster
aatattttgcaag

SEQ ID NO: 563165 - DNA, 13 bp, D. melanogaster
aatattttgcaat

SEQ ID NO: 563166 - DNA, 13 bp, D. melanogaster
aatattttgcatt

SEQ ID NO: 563167 - DNA, 13 bp, D. melanogaster
aatattttgccaa

SEQ ID NO: 563168 - DNA, 13 bp, D. melanogaster
aatattttgccac

SEQ ID NO: 563169 - DNA, 13 bp, D. melanogaster
aatattttgcttt

SEQ ID NO: 563170 - DNA, 14 bp, D. melanogaster
aatattttggaaaa

SEQ ID NO: 563171 - DNA, 13 bp, D. melanogaster
aatattttggatt

SEQ ID NO: 563172 - DNA, 13 bp, D. melanogaster
aatattttggcaa

SEQ ID NO: 563173 - DNA, 14 bp, D. melanogaster
aatattttggcaaa

SEQ ID NO: 563174 - DNA, 13 bp, D. melanogaster
aatattttgtgca

SEQ ID NO: 563175 - DNA, 13 bp, D. melanogaster
aatattttgtggc

SEQ ID NO: 563176 - DNA, 13 bp, D. melanogaster
aatattttgttct

SEQ ID NO: 563177 - DNA, 13 bp, D. melanogaster
aatatttttaagg

SEQ ID NO: 563178 - DNA, 13 bp, D. melanogaster
aatatttttacac

SEQ ID NO: 563179 - DNA, 14 bp, D. melanogaster
aatatttttacaca

SEQ ID NO: 563180 - DNA, 13 bp, D. melanogaster
aatatttttacag

SEQ ID NO: 563181 - DNA, 13 bp, D. melanogaster
aatatttttacga

SEQ ID NO: 563182 - DNA, 13 bp, D. melanogaster
aatatttttagct

SEQ ID NO: 563183 - DNA, 14 bp, D. melanogaster
aatatttttattgc

SEQ ID NO: 563184 - DNA, 13 bp, D. melanogaster
aatatttttccat

SEQ ID NO: 563185 - DNA, 13 bp, D. melanogaster
aatatttttccca

SEQ ID NO: 563186 - DNA, 13 bp, D. melanogaster
aatatttttcgaa

SEQ ID NO: 563187 - DNA, 13 bp, D. melanogaster
aatatttttcgag

SEQ ID NO: 563188 - DNA, 13 bp, D. melanogaster
aatatttttgcaa

SEQ ID NO: 563189 - DNA, 14 bp, D. melanogaster
aatatttttgcaaa

SEQ ID NO: 563190 - DNA, 13 bp, D. melanogaster
aatatttttgcac

SEQ ID NO: 563191 - DNA, 13 bp, D. melanogaster
aatatttttgcat

SEQ ID NO: 563192 - DNA, 13 bp, D. melanogaster
aatatttttgcca

SEQ ID NO: 563193 - DNA, 13 bp, D. melanogaster
aatatttttgcct

SEQ ID NO: 563194 - DNA, 13 bp, D. melanogaster
aatatttttgcta

SEQ ID NO: 563195 - DNA, 14 bp, D. melanogaster
aatatttttgctag

SEQ ID NO: 563196 - DNA, 13 bp, D. melanogaster
aatatttttggca

SEQ ID NO: 563197 - DNA, 13 bp, D. melanogaster
aatattttttctg

SEQ ID NO: 563198 - DNA, 13 bp, D. melanogaster
aatattttttgag

SEQ ID NO: 563199 - DNA, 13 bp, D. melanogaster
aatcaaaaaatgc

SEQ ID NO: 563200 - DNA, 13 bp, D. melanogaster
aatcaaaaagcca

SEQ ID NO: 563201 - DNA, 13 bp, D. melanogaster
aatcaaaaagtca

SEQ ID NO: 563202 - DNA, 13 bp, D. melanogaster
aatcaaaaagtta

SEQ ID NO: 563203 - DNA, 13 bp, D. melanogaster
aatcaaaaagttg

SEQ ID NO: 563204 - DNA, 13 bp, D. melanogaster
aatcaaaaatatg

SEQ ID NO: 563205 - DNA, 13 bp, D. melanogaster
aatcaaaaatccg

SEQ ID NO: 563206 - DNA, 13 bp, D. melanogaster
aatcaaaaatgcg

SEQ ID NO: 563207 - DNA, 13 bp, D. melanogaster
aatcaaaaatgtg

SEQ ID NO: 563208 - DNA, 13 bp, D. melanogaster
aatcaaaaatgtt

SEQ ID NO: 563209 - DNA, 13 bp, D. melanogaster
aatcaaaaattcg

SEQ ID NO: 563210 - DNA, 13 bp, D. melanogaster
aatcaaaaatttc

SEQ ID NO: 563211 - DNA, 14 bp, D. melanogaster
aatcaaaaatttgt

SEQ ID NO: 563212 - DNA, 13 bp, D. melanogaster
aatcaaaaccatt

SEQ ID NO: 563213 - DNA, 13 bp, D. melanogaster
aatcaaaaccgaa

SEQ ID NO: 563214 - DNA, 13 bp, D. melanogaster
aatcaaaaccttt

SEQ ID NO: 563215 - DNA, 13 bp, D. melanogaster
aatcaaaactggc

SEQ ID NO: 563216 - DNA, 13 bp, D. melanogaster
aatcaaaacttat

SEQ ID NO: 563217 - DNA, 13 bp, D. melanogaster
aatcaaaagactt

SEQ ID NO: 563218 - DNA, 14 bp, D. melanogaster
aatcaaaagcaaat

SEQ ID NO: 563219 - DNA, 13 bp, D. melanogaster
aatcaaaagcaga

SEQ ID NO: 563220 - DNA, 13 bp, D. melanogaster
aatcaaaagcata

SEQ ID NO: 563221 - DNA, 14 bp, D. melanogaster
aatcaaaagcattt

SEQ ID NO: 563222 - DNA, 13 bp, D. melanogaster
aatcaaaagccaa

SEQ ID NO: 563223 - DNA, 13 bp, D. melanogaster
aatcaaaagccat

SEQ ID NO: 563224 - DNA, 13 bp, D. melanogaster
aatcaaaagcgaa

SEQ ID NO: 563225 - DNA, 13 bp, D. melanogaster
aatcaaaagtgaa

SEQ ID NO: 563226 - DNA, 13 bp, D. melanogaster
aatcaaaagtgat

SEQ ID NO: 563227 - DNA, 13 bp, D. melanogaster
aatcaaaagtttc

SEQ ID NO: 563228 - DNA, 13 bp, D. melanogaster
aatcaaaagtttt

SEQ ID NO: 563229 - DNA, 14 bp, D. melanogaster
aatcaaaatcaaag

SEQ ID NO: 563230 - DNA, 13 bp, D. melanogaster
aatcaaaatcaga

SEQ ID NO: 563231 - DNA, 14 bp, D. melanogaster
aatcaaaatcagaa

SEQ ID NO: 563232 - DNA, 13 bp, D. melanogaster
aatcaaaatccat

SEQ ID NO: 563233 - DNA, 13 bp, D. melanogaster
aatcaaaatcgaa

SEQ ID NO: 563234 - DNA, 14 bp, D. melanogaster
aatcaaaatcgaaa

SEQ ID NO: 563235 - DNA, 14 bp, D. melanogaster
aatcaaaatgaaat

SEQ ID NO: 563236 - DNA, 13 bp, D. melanogaster
aatcaaaatgaga

SEQ ID NO: 563237 - DNA, 13 bp, D. melanogaster
aatcaaaatgata

SEQ ID NO: 563238 - DNA, 13 bp, D. melanogaster
aatcaaaatgcaa

SEQ ID NO: 563239 - DNA, 14 bp, D. melanogaster
aatcaaaatgcaaa

SEQ ID NO: 563240 - DNA, 13 bp, D. melanogaster
aatcaaaatgcat

SEQ ID NO: 563241 - DNA, 13 bp, D. melanogaster
aatcaaaatggaa

SEQ ID NO: 563242 - DNA, 13 bp, D. melanogaster
aatcaaaatggca

SEQ ID NO: 563243 - DNA, 14 bp, D. melanogaster
aatcaaaatggcac

SEQ ID NO: 563244 - DNA, 13 bp, D. melanogaster
aatcaaaatgtaa

SEQ ID NO: 563245 - DNA, 13 bp, D. melanogaster
aatcaaaatgttg

SEQ ID NO: 563246 - DNA, 13 bp, D. melanogaster
aatcaaaatgttt

SEQ ID NO: 563247 - DNA, 14 bp, D. melanogaster
aatcaaaatgttta

SEQ ID NO: 563248 - DNA, 13 bp, D. melanogaster
aatcaaaattgaa

SEQ ID NO: 563249 - DNA, 13 bp, D. melanogaster
aatcaaaattgat

SEQ ID NO: 563250 - DNA, 13 bp, D. melanogaster
aatcaaaatttcg

SEQ ID NO: 563251 - DNA, 14 bp, D. melanogaster
aatcaaaatttcgg

SEQ ID NO: 563252 - DNA, 13 bp, D. melanogaster
aatcaaaattttc

SEQ ID NO: 563253 - DNA, 13 bp, D. melanogaster
aatcaaacaattg

SEQ ID NO: 563254 - DNA, 13 bp, D. melanogaster
aatcaaacatatt

SEQ ID NO: 563255 - DNA, 13 bp, D. melanogaster
aatcaaacatttg

SEQ ID NO: 563256 - DNA, 13 bp, D. melanogaster
aatcaaaccattt

SEQ ID NO: 563257 - DNA, 13 bp, D. melanogaster
aatcaaaccgaaa

SEQ ID NO: 563258 - DNA, 13 bp, D. melanogaster
aatcaaactaatt

SEQ ID NO: 563259 - DNA, 13 bp, D. melanogaster
aatcaaactatcc

SEQ ID NO: 563260 - DNA, 13 bp, D. melanogaster
aatcaaactattt

SEQ ID NO: 563261 - DNA, 13 bp, D. melanogaster
aatcaaactgtgt

SEQ ID NO: 563262 - DNA, 13 bp, D. melanogaster
aatcaaacttcaa

SEQ ID NO: 563263 - DNA, 13 bp, D. melanogaster
aatcaaagaaatc

SEQ ID NO: 563264 - DNA, 13 bp, D. melanogaster
aatcaaagacaat

SEQ ID NO: 563265 - DNA, 14 bp, D. melanogaster
aatcaaagacaatc

SEQ ID NO: 563266 - DNA, 13 bp, D. melanogaster
aatcaaagagcac

SEQ ID NO: 563267 - DNA, 13 bp, D. melanogaster
aatcaaagcaaac

SEQ ID NO: 563268 - DNA, 14 bp, D. melanogaster
aatcaaagcaaaca

SEQ ID NO: 563269 - DNA, 13 bp, D. melanogaster
aatcaaagcaaat

SEQ ID NO: 563270 - DNA, 13 bp, D. melanogaster
aatcaaagcaata

SEQ ID NO: 563271 - DNA, 13 bp, D. melanogaster
aatcaaagccagc

SEQ ID NO: 563272 - DNA, 13 bp, D. melanogaster
aatcaaaggaaat

SEQ ID NO: 563273 - DNA, 13 bp, D. melanogaster
aatcaaaggcaat

SEQ ID NO: 563274 - DNA, 13 bp, D. melanogaster
aatcaaagtaaac

SEQ ID NO: 563275 - DNA, 13 bp, D. melanogaster
aatcaaagtaaat

SEQ ID NO: 563276 - DNA, 13 bp, D. melanogaster
aatcaaagtattt

SEQ ID NO: 563277 - DNA, 14 bp, D. melanogaster
aatcaaagtattta

SEQ ID NO: 563278 - DNA, 13 bp, D. melanogaster
aatcaaagtcaat

SEQ ID NO: 563279 - DNA, 13 bp, D. melanogaster
aatcaaagtgaaa

SEQ ID NO: 563280 - DNA, 14 bp, D. melanogaster
aatcaaataaaatg

SEQ ID NO: 563281 - DNA, 13 bp, D. melanogaster
aatcaaataaatg

SEQ ID NO: 563282 - DNA, 13 bp, D. melanogaster
aatcaaataactt

SEQ ID NO: 563283 - DNA, 13 bp, D. melanogaster
aatcaaatactta

SEQ ID NO: 563284 - DNA, 13 bp, D. melanogaster
aatcaaatacttt

SEQ ID NO: 563285 - DNA, 13 bp, D. melanogaster
aatcaaatatctt

SEQ ID NO: 563286 - DNA, 13 bp, D. melanogaster
aatcaaatatgaa

SEQ ID NO: 563287 - DNA, 13 bp, D. melanogaster
aatcaaatatgca

SEQ ID NO: 563288 - DNA, 13 bp, D. melanogaster
aatcaaatattca

SEQ ID NO: 563289 - DNA, 13 bp, D. melanogaster
aatcaaatattgt

SEQ ID NO: 563290 - DNA, 14 bp, D. melanogaster
aatcaaatcaaaag

SEQ ID NO: 563291 - DNA, 13 bp, D. melanogaster
aatcaaatcaaag

SEQ ID NO: 563292 - DNA, 14 bp, D. melanogaster
aatcaaatcaaatc

SEQ ID NO: 563293 - DNA, 13 bp, D. melanogaster
aatcaaatcaatg

SEQ ID NO: 563294 - DNA, 13 bp, D. melanogaster
aatcaaatcactt

SEQ ID NO: 563295 - DNA, 13 bp, D. melanogaster
aatcaaatcagtt

SEQ ID NO: 563296 - DNA, 13 bp, D. melanogaster
aatcaaatcatca

SEQ ID NO: 563297 - DNA, 13 bp, D. melanogaster
aatcaaatcattt

SEQ ID NO: 563298 - DNA, 13 bp, D. melanogaster
aatcaaatccaat

SEQ ID NO: 563299 - DNA, 13 bp, D. melanogaster
aatcaaatcgaaa

SEQ ID NO: 563300 - DNA, 14 bp, D. melanogaster
aatcaaatcgaaat

SEQ ID NO: 563301 - DNA, 13 bp, D. melanogaster
aatcaaatcgaac

SEQ ID NO: 563302 - DNA, 14 bp, D. melanogaster
aatcaaatcgaatt

SEQ ID NO: 563303 - DNA, 14 bp, D. melanogaster
aatcaaatcgataa

SEQ ID NO: 563304 - DNA, 14 bp, D. melanogaster
aatcaaatcggcaa

SEQ ID NO: 563305 - DNA, 13 bp, D. melanogaster
aatcaaatctaat

SEQ ID NO: 563306 - DNA, 13 bp, D. melanogaster
aatcaaatctatt

SEQ ID NO: 563307 - DNA, 13 bp, D. melanogaster
aatcaaatcttaa

SEQ ID NO: 563308 - DNA, 13 bp, D. melanogaster
aatcaaatgaata

SEQ ID NO: 563309 - DNA, 13 bp, D. melanogaster
aatcaaatgcaaa

SEQ ID NO: 563310 - DNA, 14 bp, D. melanogaster
aatcaaatgcaaat

SEQ ID NO: 563311 - DNA, 13 bp, D. melanogaster
aatcaaatgcaac

SEQ ID NO: 563312 - DNA, 13 bp, D. melanogaster
aatcaaatgcaat

SEQ ID NO: 563313 - DNA, 14 bp, D. melanogaster
aatcaaatgcaatt

SEQ ID NO: 563314 - DNA, 13 bp, D. melanogaster
aatcaaatgcaca

SEQ ID NO: 563315 - DNA, 13 bp, D. melanogaster
aatcaaatgcata

SEQ ID NO: 563316 - DNA, 13 bp, D. melanogaster
aatcaaatgcatt

SEQ ID NO: 563317 - DNA, 13 bp, D. melanogaster
aatcaaatgccag

SEQ ID NO: 563318 - DNA, 13 bp, D. melanogaster
aatcaaatgccat

SEQ ID NO: 563319 - DNA, 13 bp, D. melanogaster
aatcaaatgctac

SEQ ID NO: 563320 - DNA, 13 bp, D. melanogaster
aatcaaatgcttt

SEQ ID NO: 563321 - DNA, 13 bp, D. melanogaster
aatcaaatggaaa

SEQ ID NO: 563322 - DNA, 14 bp, D. melanogaster
aatcaaatggaaaa

SEQ ID NO: 563323 - DNA, 13 bp, D. melanogaster
aatcaaatggaat

SEQ ID NO: 563324 - DNA, 13 bp, D. melanogaster
aatcaaatgggca

SEQ ID NO: 563325 - DNA, 13 bp, D. melanogaster
aatcaaatgtaca

SEQ ID NO: 563326 - DNA, 13 bp, D. melanogaster
aatcaaatgtatt

SEQ ID NO: 563327 - DNA, 14 bp, D. melanogaster
aatcaaatgtattt

SEQ ID NO: 563328 - DNA, 13 bp, D. melanogaster
aatcaaatgtcat

SEQ ID NO: 563329 - DNA, 13 bp, D. melanogaster
aatcaaatgtgaa

SEQ ID NO: 563330 - DNA, 13 bp, D. melanogaster
aatcaaatgttaa

SEQ ID NO: 563331 - DNA, 13 bp, D. melanogaster
aatcaaatgtttt

SEQ ID NO: 563332 - DNA, 13 bp, D. melanogaster
aatcaaattaact

SEQ ID NO: 563333 - DNA, 13 bp, D. melanogaster
aatcaaattaatc

SEQ ID NO: 563334 - DNA, 13 bp, D. melanogaster
aatcaaattagaa

SEQ ID NO: 563335 - DNA, 13 bp, D. melanogaster
aatcaaattattc

SEQ ID NO: 563336 - DNA, 13 bp, D. melanogaster
aatcaaattattg

SEQ ID NO: 563337 - DNA, 13 bp, D. melanogaster
aatcaaattcata

SEQ ID NO: 563338 - DNA, 13 bp, D. melanogaster
aatcaaattcttt

SEQ ID NO: 563339 - DNA, 13 bp, D. melanogaster
aatcaaattgaaa

SEQ ID NO: 563340 - DNA, 14 bp, D. melanogaster
aatcaaattgaaaa

SEQ ID NO: 563341 - DNA, 14 bp, D. melanogaster
aatcaaattgaaat

SEQ ID NO: 563342 - DNA, 13 bp, D. melanogaster
aatcaaattgaag

SEQ ID NO: 563343 - DNA, 13 bp, D. melanogaster
aatcaaattgaat

SEQ ID NO: 563344 - DNA, 13 bp, D. melanogaster
aatcaaattgatt

SEQ ID NO: 563345 - DNA, 13 bp, D. melanogaster
aatcaaattgcaa

SEQ ID NO: 563346 - DNA, 13 bp, D. melanogaster
aatcaaattgctt

SEQ ID NO: 563347 - DNA, 13 bp, D. melanogaster
aatcaaattggca

SEQ ID NO: 563348 - DNA, 13 bp, D. melanogaster
aatcaaattgtaa

SEQ ID NO: 563349 - DNA, 13 bp, D. melanogaster
aatcaaattgttg

SEQ ID NO: 563350 - DNA, 13 bp, D. melanogaster
aatcaaattgttt

SEQ ID NO: 563351 - DNA, 13 bp, D. melanogaster
aatcaaatttatc

SEQ ID NO: 563352 - DNA, 13 bp, D. melanogaster
aatcaaatttcaa

SEQ ID NO: 563353 - DNA, 14 bp, D. melanogaster
aatcaaatttcaat

SEQ ID NO: 563354 - DNA, 13 bp, D. melanogaster
aatcaaatttgat

SEQ ID NO: 563355 - DNA, 13 bp, D. melanogaster
aatcaaatttgtt

SEQ ID NO: 563356 - DNA, 14 bp, D. melanogaster
aatcaaatttgttt

SEQ ID NO: 563357 - DNA, 13 bp, D. melanogaster
aatcaacaaattt

SEQ ID NO: 563358 - DNA, 13 bp, D. melanogaster
aatcaacaacatt

SEQ ID NO: 563359 - DNA, 13 bp, D. melanogaster
aatcaacaatttg

SEQ ID NO: 563360 - DNA, 13 bp, D. melanogaster
aatcaacacattt

SEQ ID NO: 563361 - DNA, 13 bp, D. melanogaster
aatcaacagaaat

SEQ ID NO: 563362 - DNA, 13 bp, D. melanogaster
aatcaacagaatt

SEQ ID NO: 563363 - DNA, 13 bp, D. melanogaster
aatcaacagagaa

SEQ ID NO: 563364 - DNA, 13 bp, D. melanogaster
aatcaacatttaa

SEQ ID NO: 563365 - DNA, 13 bp, D. melanogaster
aatcaacattttt

SEQ ID NO: 563366 - DNA, 14 bp, D. melanogaster
aatcaacatttttt

SEQ ID NO: 563367 - DNA, 13 bp, D. melanogaster
aatcaaccgaaaa

SEQ ID NO: 563368 - DNA, 13 bp, D. melanogaster
aatcaacctacaa

SEQ ID NO: 563369 - DNA, 13 bp, D. melanogaster
aatcaacgaaaat

SEQ ID NO: 563370 - DNA, 13 bp, D. melanogaster
aatcaacgaaata

SEQ ID NO: 563371 - DNA, 13 bp, D. melanogaster
aatcaactattgt

SEQ ID NO: 563372 - DNA, 13 bp, D. melanogaster
aatcaactgaaaa

SEQ ID NO: 563373 - DNA, 13 bp, D. melanogaster
aatcaactgaaat

SEQ ID NO: 563374 - DNA, 13 bp, D. melanogaster
aatcaactgcaat

SEQ ID NO: 563375 - DNA, 13 bp, D. melanogaster
aatcaacttaatt

SEQ ID NO: 563376 - DNA, 13 bp, D. melanogaster
aatcaacttcaat

SEQ ID NO: 563377 - DNA, 13 bp, D. melanogaster
aatcaactttatt

SEQ ID NO: 563378 - DNA, 13 bp, D. melanogaster
aatcaacttttaa

SEQ ID NO: 563379 - DNA, 13 bp, D. melanogaster
aatcaagaaaact

SEQ ID NO: 563380 - DNA, 14 bp, D. melanogaster
aatcaagaaataca

SEQ ID NO: 563381 - DNA, 13 bp, D. melanogaster
aatcaagaaattt

SEQ ID NO: 563382 - DNA, 13 bp, D. melanogaster
aatcaagaatata

SEQ ID NO: 563383 - DNA, 13 bp, D. melanogaster
aatcaagacgttc

SEQ ID NO: 563384 - DNA, 13 bp, D. melanogaster
aatcaagatgaaa

SEQ ID NO: 563385 - DNA, 13 bp, D. melanogaster
aatcaagcaaagt

SEQ ID NO: 563386 - DNA, 13 bp, D. melanogaster
aatcaagcaaatt

SEQ ID NO: 563387 - DNA, 13 bp, D. melanogaster
aatcaagccaaaa

SEQ ID NO: 563388 - DNA, 13 bp, D. melanogaster
aatcaagccaaat

SEQ ID NO: 563389 - DNA, 13 bp, D. melanogaster
aatcaagccaatt

SEQ ID NO: 563390 - DNA, 13 bp, D. melanogaster
aatcaagcgaaaa

SEQ ID NO: 563391 - DNA, 13 bp, D. melanogaster
aatcaagcgaaat

SEQ ID NO: 563392 - DNA, 13 bp, D. melanogaster
aatcaagcgcaaa

SEQ ID NO: 563393 - DNA, 13 bp, D. melanogaster
aatcaagcggaaa

SEQ ID NO: 563394 - DNA, 13 bp, D. melanogaster
aatcaagctgttg

SEQ ID NO: 563395 - DNA, 13 bp, D. melanogaster
aatcaagtaataa

SEQ ID NO: 563396 - DNA, 14 bp, D. melanogaster
aatcaagtaataaa

SEQ ID NO: 563397 - DNA, 13 bp, D. melanogaster
aatcaagtatacg

SEQ ID NO: 563398 - DNA, 13 bp, D. melanogaster
aatcaagtgtaaa

SEQ ID NO: 563399 - DNA, 13 bp, D. melanogaster
aatcaagttaaaa

SEQ ID NO: 563400 - DNA, 13 bp, D. melanogaster
aatcaagtttaca

SEQ ID NO: 563401 - DNA, 13 bp, D. melanogaster
aatcaataaaagg

SEQ ID NO: 563402 - DNA, 13 bp, D. melanogaster
aatcaataaactg

SEQ ID NO: 563403 - DNA, 13 bp, D. melanogaster
aatcaataagttt

SEQ ID NO: 563404 - DNA, 13 bp, D. melanogaster
aatcaataatgtt

SEQ ID NO: 563405 - DNA, 13 bp, D. melanogaster
aatcaataattgt

SEQ ID NO: 563406 - DNA, 13 bp, D. melanogaster
aatcaatacaatc

SEQ ID NO: 563407 - DNA, 13 bp, D. melanogaster
aatcaatacaatt

SEQ ID NO: 563408 - DNA, 13 bp, D. melanogaster
aatcaatacgaaa

SEQ ID NO: 563409 - DNA, 13 bp, D. melanogaster
aatcaatactttt

SEQ ID NO: 563410 - DNA, 13 bp, D. melanogaster
aatcaatagaaat

SEQ ID NO: 563411 - DNA, 13 bp, D. melanogaster
aatcaataggaat

SEQ ID NO: 563412 - DNA, 13 bp, D. melanogaster
aatcaatatcaat

SEQ ID NO: 563413 - DNA, 13 bp, D. melanogaster
aatcaatattcaa

SEQ ID NO: 563414 - DNA, 13 bp, D. melanogaster
aatcaatattcca

SEQ ID NO: 563415 - DNA, 13 bp, D. melanogaster
aatcaatatttct

SEQ ID NO: 563416 - DNA, 13 bp, D. melanogaster
aatcaatattttg

SEQ ID NO: 563417 - DNA, 13 bp, D. melanogaster
aatcaatcaaaag

SEQ ID NO: 563418 - DNA, 13 bp, D. melanogaster
aatcaatcaaacg

SEQ ID NO: 563419 - DNA, 13 bp, D. melanogaster
aatcaatcaaact

SEQ ID NO: 563420 - DNA, 13 bp, D. melanogaster
aatcaatcaaagc

SEQ ID NO: 563421 - DNA, 13 bp, D. melanogaster
aatcaatcaaagt

SEQ ID NO: 563422 - DNA, 13 bp, D. melanogaster
aatcaatcaagtg

SEQ ID NO: 563423 - DNA, 13 bp, D. melanogaster
aatcaatcaatat

SEQ ID NO: 563424 - DNA, 14 bp, D. melanogaster
aatcaatcaatcag

SEQ ID NO: 563425 - DNA, 13 bp, D. melanogaster
aatcaatcaatcg

SEQ ID NO: 563426 - DNA, 14 bp, D. melanogaster
aatcaatcaatcga

SEQ ID NO: 563427 - DNA, 13 bp, D. melanogaster
aatcaatcaatta

SEQ ID NO: 563428 - DNA, 13 bp, D. melanogaster
aatcaatcaattc

SEQ ID NO: 563429 - DNA, 13 bp, D. melanogaster
aatcaatcaattg

SEQ ID NO: 563430 - DNA, 13 bp, D. melanogaster
aatcaatcaattt

SEQ ID NO: 563431 - DNA, 13 bp, D. melanogaster
aatcaatcacttt

SEQ ID NO: 563432 - DNA, 13 bp, D. melanogaster
aatcaatcagcaa

SEQ ID NO: 563433 - DNA, 13 bp, D. melanogaster
aatcaatcagtca

SEQ ID NO: 563434 - DNA, 13 bp, D. melanogaster
aatcaatcagttg

SEQ ID NO: 563435 - DNA, 13 bp, D. melanogaster
aatcaatcatcaa

SEQ ID NO: 563436 - DNA, 13 bp, D. melanogaster
aatcaatcattca

SEQ ID NO: 563437 - DNA, 13 bp, D. melanogaster
aatcaatccattt

SEQ ID NO: 563438 - DNA, 13 bp, D. melanogaster
aatcaatcgaaat

SEQ ID NO: 563439 - DNA, 13 bp, D. melanogaster
aatcaatcgaacc

SEQ ID NO: 563440 - DNA, 13 bp, D. melanogaster
aatcaatcgattt

SEQ ID NO: 563441 - DNA, 13 bp, D. melanogaster
aatcaatcttaaa

SEQ ID NO: 563442 - DNA, 14 bp, D. melanogaster
aatcaatgaagaaa

SEQ ID NO: 563443 - DNA, 13 bp, D. melanogaster
aatcaatgaattt

SEQ ID NO: 563444 - DNA, 13 bp, D. melanogaster
aatcaatgacaat

SEQ ID NO: 563445 - DNA, 13 bp, D. melanogaster
aatcaatgcaaat

SEQ ID NO: 563446 - DNA, 14 bp, D. melanogaster
aatcaatgcaaatt

SEQ ID NO: 563447 - DNA, 13 bp, D. melanogaster
aatcaatgcaatc

SEQ ID NO: 563448 - DNA, 13 bp, D. melanogaster
aatcaatgccaaa

SEQ ID NO: 563449 - DNA, 14 bp, D. melanogaster
aatcaatgccaaac

SEQ ID NO: 563450 - DNA, 13 bp, D. melanogaster
aatcaatgcgacc

SEQ ID NO: 563451 - DNA, 13 bp, D. melanogaster
aatcaatgcgttt

SEQ ID NO: 563452 - DNA, 13 bp, D. melanogaster
aatcaatggaaaa

SEQ ID NO: 563453 - DNA, 13 bp, D. melanogaster
aatcaatgtgaat

SEQ ID NO: 563454 - DNA, 13 bp, D. melanogaster
aatcaatgtgcaa

SEQ ID NO: 563455 - DNA, 13 bp, D. melanogaster
aatcaatgttatt

SEQ ID NO: 563456 - DNA, 13 bp, D. melanogaster
aatcaatgttttt

SEQ ID NO: 563457 - DNA, 14 bp, D. melanogaster
aatcaattaaaaag

SEQ ID NO: 563458 - DNA, 13 bp, D. melanogaster
aatcaattaaact

SEQ ID NO: 563459 - DNA, 13 bp, D. melanogaster
aatcaattaaagc

SEQ ID NO: 563460 - DNA, 13 bp, D. melanogaster
aatcaattaaatg

SEQ ID NO: 563461 - DNA, 13 bp, D. melanogaster
aatcaattaacag

SEQ ID NO: 563462 - DNA, 13 bp, D. melanogaster
aatcaattaactt

SEQ ID NO: 563463 - DNA, 13 bp, D. melanogaster
aatcaattaagtt

SEQ ID NO: 563464 - DNA, 13 bp, D. melanogaster
aatcaattaatca

SEQ ID NO: 563465 - DNA, 13 bp, D. melanogaster
aatcaattaatct

SEQ ID NO: 563466 - DNA, 13 bp, D. melanogaster
aatcaattaatgt

SEQ ID NO: 563467 - DNA, 13 bp, D. melanogaster
aatcaattaattc

SEQ ID NO: 563468 - DNA, 13 bp, D. melanogaster
aatcaattacaat

SEQ ID NO: 563469 - DNA, 13 bp, D. melanogaster
aatcaattagaaa

SEQ ID NO: 563470 - DNA, 13 bp, D. melanogaster
aatcaattagcaa

SEQ ID NO: 563471 - DNA, 13 bp, D. melanogaster
aatcaattatgtg

SEQ ID NO: 563472 - DNA, 13 bp, D. melanogaster
aatcaattatttc

SEQ ID NO: 563473 - DNA, 13 bp, D. melanogaster
aatcaattcaaat

SEQ ID NO: 563474 - DNA, 13 bp, D. melanogaster
aatcaattcaagt

SEQ ID NO: 563475 - DNA, 13 bp, D. melanogaster
aatcaattcaatt

SEQ ID NO: 563476 - DNA, 13 bp, D. melanogaster
aatcaattcatct

SEQ ID NO: 563477 - DNA, 14 bp, D. melanogaster
aatcaattcatctg

SEQ ID NO: 563478 - DNA, 13 bp, D. melanogaster
aatcaattcattt

SEQ ID NO: 563479 - DNA, 13 bp, D. melanogaster
aatcaattcgatt

SEQ ID NO: 563480 - DNA, 13 bp, D. melanogaster
aatcaattgaaac

SEQ ID NO: 563481 - DNA, 13 bp, D. melanogaster
aatcaattgaaat

SEQ ID NO: 563482 - DNA, 14 bp, D. melanogaster
aatcaattgaaatt

SEQ ID NO: 563483 - DNA, 13 bp, D. melanogaster
aatcaattgaagt

SEQ ID NO: 563484 - DNA, 13 bp, D. melanogaster
aatcaattgataa

SEQ ID NO: 563485 - DNA, 13 bp, D. melanogaster
aatcaattgcaaa

SEQ ID NO: 563486 - DNA, 13 bp, D. melanogaster
aatcaattgcagg

SEQ ID NO: 563487 - DNA, 13 bp, D. melanogaster
aatcaattgccaa

SEQ ID NO: 563488 - DNA, 14 bp, D. melanogaster
aatcaattggaaat

SEQ ID NO: 563489 - DNA, 13 bp, D. melanogaster
aatcaattggatt

SEQ ID NO: 563490 - DNA, 13 bp, D. melanogaster
aatcaattggcca

SEQ ID NO: 563491 - DNA, 13 bp, D. melanogaster
aatcaattggttt

SEQ ID NO: 563492 - DNA, 13 bp, D. melanogaster
aatcaattgttta

SEQ ID NO: 563493 - DNA, 13 bp, D. melanogaster
aatcaattgtttt

SEQ ID NO: 563494 - DNA, 13 bp, D. melanogaster
aatcaatttacaa

SEQ ID NO: 563495 - DNA, 13 bp, D. melanogaster
aatcaatttagaa

SEQ ID NO: 563496 - DNA, 13 bp, D. melanogaster
aatcaatttcaaa

SEQ ID NO: 563497 - DNA, 13 bp, D. melanogaster
aatcaatttcagt

SEQ ID NO: 563498 - DNA, 13 bp, D. melanogaster
aatcaatttcata

SEQ ID NO: 563499 - DNA, 14 bp, D. melanogaster
aatcaatttcatat

SEQ ID NO: 563500 - DNA, 13 bp, D. melanogaster
aatcaatttccat

SEQ ID NO: 563501 - DNA, 13 bp, D. melanogaster
aatcaatttccca

SEQ ID NO: 563502 - DNA, 13 bp, D. melanogaster
aatcaatttcgat

SEQ ID NO: 563503 - DNA, 13 bp, D. melanogaster
aatcaatttctgt

SEQ ID NO: 563504 - DNA, 14 bp, D. melanogaster
aatcaatttgaaaa

SEQ ID NO: 563505 - DNA, 13 bp, D. melanogaster
aatcaatttgatt

SEQ ID NO: 563506 - DNA, 14 bp, D. melanogaster
aatcaatttgattt

SEQ ID NO: 563507 - DNA, 13 bp, D. melanogaster
aatcaatttggca

SEQ ID NO: 563508 - DNA, 13 bp, D. melanogaster
aatcaatttggct

SEQ ID NO: 563509 - DNA, 13 bp, D. melanogaster
aatcaatttgtgc

SEQ ID NO: 563510 - DNA, 13 bp, D. melanogaster
aatcaatttgtgt

SEQ ID NO: 563511 - DNA, 13 bp, D. melanogaster
aatcaatttgttt

SEQ ID NO: 563512 - DNA, 14 bp, D. melanogaster
aatcaatttgtttt

SEQ ID NO: 563513 - DNA, 13 bp, D. melanogaster
aatcaattttcaa

SEQ ID NO: 563514 - DNA, 13 bp, D. melanogaster
aatcaattttcgc

SEQ ID NO: 563515 - DNA, 13 bp, D. melanogaster
aatcaattttcgt

SEQ ID NO: 563516 - DNA, 13 bp, D. melanogaster
aatcaattttgtt

SEQ ID NO: 563517 - DNA, 14 bp, D. melanogaster
aatcaattttgttt

SEQ ID NO: 563518 - DNA, 13 bp, D. melanogaster
aatcaatttttgt

SEQ ID NO: 563519 - DNA, 13 bp, D. melanogaster
aatcaattttttc

SEQ ID NO: 563520 - DNA, 13 bp, D. melanogaster
aatcacaaattta

SEQ ID NO: 563521 - DNA, 13 bp, D. melanogaster
aatcacaataatt

SEQ ID NO: 563522 - DNA, 13 bp, D. melanogaster
aatcacaatattt

SEQ ID NO: 563523 - DNA, 13 bp, D. melanogaster
aatcacaatcaca

SEQ ID NO: 563524 - DNA, 13 bp, D. melanogaster
aatcacaattaat

SEQ ID NO: 563525 - DNA, 13 bp, D. melanogaster
aatcacaatttat

SEQ ID NO: 563526 - DNA, 13 bp, D. melanogaster
aatcacaatttgc

SEQ ID NO: 563527 - DNA, 13 bp, D. melanogaster
aatcacaattttt

SEQ ID NO: 563528 - DNA, 13 bp, D. melanogaster
aatcacacaaatc

SEQ ID NO: 563529 - DNA, 13 bp, D. melanogaster
aatcacacagcaa

SEQ ID NO: 563530 - DNA, 14 bp, D. melanogaster
aatcacacagcaaa

SEQ ID NO: 563531 - DNA, 13 bp, D. melanogaster
aatcacactcaca

SEQ ID NO: 563532 - DNA, 13 bp, D. melanogaster
aatcacatatgta

SEQ ID NO: 563533 - DNA, 13 bp, D. melanogaster
aatcacatgaaaa

SEQ ID NO: 563534 - DNA, 13 bp, D. melanogaster
aatcacattaaat

SEQ ID NO: 563535 - DNA, 13 bp, D. melanogaster
aatcacatttaaa

SEQ ID NO: 563536 - DNA, 13 bp, D. melanogaster
aatcacatttatt

SEQ ID NO: 563537 - DNA, 14 bp, D. melanogaster
aatcaccaaagaaa

SEQ ID NO: 563538 - DNA, 14 bp, D. melanogaster
aatcaccaaagaag

SEQ ID NO: 563539 - DNA, 13 bp, D. melanogaster
aatcaccgatcac

SEQ ID NO: 563540 - DNA, 14 bp, D. melanogaster
aatcacgcatacgc

SEQ ID NO: 563541 - DNA, 13 bp, D. melanogaster
aatcactcaattt

SEQ ID NO: 563542 - DNA, 13 bp, D. melanogaster
aatcacttaatta

SEQ ID NO: 563543 - DNA, 13 bp, D. melanogaster
aatcactttgttt

SEQ ID NO: 563544 - DNA, 13 bp, D. melanogaster
aatcacttttgaa

SEQ ID NO: 563545 - DNA, 13 bp, D. melanogaster
aatcacttttgtt

SEQ ID NO: 563546 - DNA, 13 bp, D. melanogaster
aatcactttttat

SEQ ID NO: 563547 - DNA, 13 bp, D. melanogaster
aatcagaaaatat

SEQ ID NO: 563548 - DNA, 14 bp, D. melanogaster
aatcagaaacagaa

SEQ ID NO: 563549 - DNA, 13 bp, D. melanogaster
aatcagaaatcag

SEQ ID NO: 563550 - DNA, 14 bp, D. melanogaster
aatcagaatcagaa

SEQ ID NO: 563551 - DNA, 13 bp, D. melanogaster
aatcagaatcagt

SEQ ID NO: 563552 - DNA, 13 bp, D. melanogaster
aatcagaatttat

SEQ ID NO: 563553 - DNA, 13 bp, D. melanogaster
aatcagagagtaa

SEQ ID NO: 563554 - DNA, 13 bp, D. melanogaster
aatcagattcaga

SEQ ID NO: 563555 - DNA, 13 bp, D. melanogaster
aatcagcaaaata

SEQ ID NO: 563556 - DNA, 13 bp, D. melanogaster
aatcagcaaacaa

SEQ ID NO: 563557 - DNA, 13 bp, D. melanogaster
aatcagcaacaaa

SEQ ID NO: 563558 - DNA, 13 bp, D. melanogaster
aatcagcaagcag

SEQ ID NO: 563559 - DNA, 13 bp, D. melanogaster
aatcagcagaaaa

SEQ ID NO: 563560 - DNA, 13 bp, D. melanogaster
aatcagcagcaac

SEQ ID NO: 563561 - DNA, 14 bp, D. melanogaster
aatcagcagcaaca

SEQ ID NO: 563562 - DNA, 13 bp, D. melanogaster
aatcagcagcagc

SEQ ID NO: 563563 - DNA, 14 bp, D. melanogaster
aatcagcagcatct

SEQ ID NO: 563564 - DNA, 13 bp, D. melanogaster
aatcagcaggaaa

SEQ ID NO: 563565 - DNA, 13 bp, D. melanogaster
aatcagcatccga

SEQ ID NO: 563566 - DNA, 13 bp, D. melanogaster
aatcagcattaaa

SEQ ID NO: 563567 - DNA, 13 bp, D. melanogaster
aatcagccaagat

SEQ ID NO: 563568 - DNA, 13 bp, D. melanogaster
aatcagctcaaaa

SEQ ID NO: 563569 - DNA, 13 bp, D. melanogaster
aatcagctgaaaa

SEQ ID NO: 563570 - DNA, 13 bp, D. melanogaster
aatcagctgttcg

SEQ ID NO: 563571 - DNA, 13 bp, D. melanogaster
aatcagctgttgc

SEQ ID NO: 563572 - DNA, 13 bp, D. melanogaster
aatcagctgtttt

SEQ ID NO: 563573 - DNA, 13 bp, D. melanogaster
aatcagcttaaaa

SEQ ID NO: 563574 - DNA, 14 bp, D. melanogaster
aatcagcttaaaaa

SEQ ID NO: 563575 - DNA, 13 bp, D. melanogaster
aatcaggacatta

SEQ ID NO: 563576 - DNA, 13 bp, D. melanogaster
aatcagtattttt

SEQ ID NO: 563577 - DNA, 13 bp, D. melanogaster
aatcagttgcaaa

SEQ ID NO: 563578 - DNA, 13 bp, D. melanogaster
aatcagttgctaa

SEQ ID NO: 563579 - DNA, 13 bp, D. melanogaster
aatcagttgtaca

SEQ ID NO: 563580 - DNA, 13 bp, D. melanogaster
aatcagtttaaat

SEQ ID NO: 563581 - DNA, 13 bp, D. melanogaster
aatcagtttaatt

SEQ ID NO: 563582 - DNA, 13 bp, D. melanogaster
aatcagtttcatt

SEQ ID NO: 563583 - DNA, 13 bp, D. melanogaster
aatcagttttaat

SEQ ID NO: 563584 - DNA, 13 bp, D. melanogaster
aatcagttttctt

SEQ ID NO: 563585 - DNA, 13 bp, D. melanogaster
aatcagtttttgt

SEQ ID NO: 563586 - DNA, 13 bp, D. melanogaster
aatcataaaactc

SEQ ID NO: 563587 - DNA, 13 bp, D. melanogaster
aatcataaagaat

SEQ ID NO: 563588 - DNA, 14 bp, D. melanogaster
aatcataaagaatt

SEQ ID NO: 563589 - DNA, 13 bp, D. melanogaster
aatcataaatact

SEQ ID NO: 563590 - DNA, 13 bp, D. melanogaster
aatcataactttt

SEQ ID NO: 563591 - DNA, 13 bp, D. melanogaster
aatcatacatttt

SEQ ID NO: 563592 - DNA, 14 bp, D. melanogaster
aatcatacgcactg

SEQ ID NO: 563593 - DNA, 13 bp, D. melanogaster
aatcatacgccgc

SEQ ID NO: 563594 - DNA, 13 bp, D. melanogaster
aatcatagcttca

SEQ ID NO: 563595 - DNA, 13 bp, D. melanogaster
aatcatatatgta

SEQ ID NO: 563596 - DNA, 14 bp, D. melanogaster
aatcatatatgtat

SEQ ID NO: 563597 - DNA, 13 bp, D. melanogaster
aatcatatgcaaa

SEQ ID NO: 563598 - DNA, 14 bp, D. melanogaster
aatcatatgcgatc

SEQ ID NO: 563599 - DNA, 13 bp, D. melanogaster
aatcatatttcaa

SEQ ID NO: 563600 - DNA, 14 bp, D. melanogaster
aatcatattttgaa

SEQ ID NO: 563601 - DNA, 13 bp, D. melanogaster
aatcatatttttc

SEQ ID NO: 563602 - DNA, 13 bp, D. melanogaster
aatcatcaatcaa

SEQ ID NO: 563603 - DNA, 13 bp, D. melanogaster
aatcatcaatcat

SEQ ID NO: 563604 - DNA, 13 bp, D. melanogaster
aatcatcatcaaa

SEQ ID NO: 563605 - DNA, 13 bp, D. melanogaster
aatcatcatcagc

SEQ ID NO: 563606 - DNA, 13 bp, D. melanogaster
aatcatcatcgtc

SEQ ID NO: 563607 - DNA, 13 bp, D. melanogaster
aatcatcattatc

SEQ ID NO: 563608 - DNA, 13 bp, D. melanogaster
aatcatccaatga

SEQ ID NO: 563609 - DNA, 14 bp, D. melanogaster
aatcatctcaacaa

SEQ ID NO: 563610 - DNA, 13 bp, D. melanogaster
aatcatcttcagg

SEQ ID NO: 563611 - DNA, 13 bp, D. melanogaster
aatcatgaaataa

SEQ ID NO: 563612 - DNA, 13 bp, D. melanogaster
aatcatgaatgaa

SEQ ID NO: 563613 - DNA, 13 bp, D. melanogaster
aatcatgataaat

SEQ ID NO: 563614 - DNA, 13 bp, D. melanogaster
aatcatggaaaat

SEQ ID NO: 563615 - DNA, 13 bp, D. melanogaster
aatcatgtcgcag

SEQ ID NO: 563616 - DNA, 13 bp, D. melanogaster
aatcatgtgtcct

SEQ ID NO: 563617 - DNA, 14 bp, D. melanogaster
aatcatgtgttttt

SEQ ID NO: 563618 - DNA, 13 bp, D. melanogaster
aatcatgtttttt

SEQ ID NO: 563619 - DNA, 13 bp, D. melanogaster
aatcattaaatca

SEQ ID NO: 563620 - DNA, 13 bp, D. melanogaster
aatcattaagttt

SEQ ID NO: 563621 - DNA, 13 bp, D. melanogaster
aatcattacccaa

SEQ ID NO: 563622 - DNA, 13 bp, D. melanogaster
aatcattaccttc

SEQ ID NO: 563623 - DNA, 13 bp, D. melanogaster
aatcattatcatc

SEQ ID NO: 563624 - DNA, 13 bp, D. melanogaster
aatcattatgatc

SEQ ID NO: 563625 - DNA, 13 bp, D. melanogaster
aatcattcaaaat

SEQ ID NO: 563626 - DNA, 13 bp, D. melanogaster
aatcattcaatca

SEQ ID NO: 563627 - DNA, 13 bp, D. melanogaster
aatcattcatttt

SEQ ID NO: 563628 - DNA, 13 bp, D. melanogaster
aatcattgacctt

SEQ ID NO: 563629 - DNA, 13 bp, D. melanogaster
aatcattggagca

SEQ ID NO: 563630 - DNA, 13 bp, D. melanogaster
aatcattggatga

SEQ ID NO: 563631 - DNA, 13 bp, D. melanogaster
aatcattgtatat

SEQ ID NO: 563632 - DNA, 13 bp, D. melanogaster
aatcatttaaaag

SEQ ID NO: 563633 - DNA, 14 bp, D. melanogaster
aatcatttaaaagt

SEQ ID NO: 563634 - DNA, 13 bp, D. melanogaster
aatcatttaagca

SEQ ID NO: 563635 - DNA, 13 bp, D. melanogaster
aatcatttaatca

SEQ ID NO: 563636 - DNA, 13 bp, D. melanogaster
aatcatttacaaa

SEQ ID NO: 563637 - DNA, 13 bp, D. melanogaster
aatcatttatcac

SEQ ID NO: 563638 - DNA, 13 bp, D. melanogaster
aatcatttattca

SEQ ID NO: 563639 - DNA, 13 bp, D. melanogaster
aatcatttcaagt

SEQ ID NO: 563640 - DNA, 13 bp, D. melanogaster
aatcatttcataa

SEQ ID NO: 563641 - DNA, 13 bp, D. melanogaster
aatcatttcatta

SEQ ID NO: 563642 - DNA, 13 bp, D. melanogaster
aatcatttcattg

SEQ ID NO: 563643 - DNA, 13 bp, D. melanogaster
aatcatttccaac

SEQ ID NO: 563644 - DNA, 13 bp, D. melanogaster
aatcatttcttaa

SEQ ID NO: 563645 - DNA, 13 bp, D. melanogaster
aatcatttcttat

SEQ ID NO: 563646 - DNA, 13 bp, D. melanogaster
aatcatttgaaaa

SEQ ID NO: 563647 - DNA, 14 bp, D. melanogaster
aatcatttgaaaag

SEQ ID NO: 563648 - DNA, 13 bp, D. melanogaster
aatcatttgaatg

SEQ ID NO: 563649 - DNA, 13 bp, D. melanogaster
aatcatttgatat

SEQ ID NO: 563650 - DNA, 13 bp, D. melanogaster
aatcatttgattg

SEQ ID NO: 563651 - DNA, 13 bp, D. melanogaster
aatcatttgcatt

SEQ ID NO: 563652 - DNA, 13 bp, D. melanogaster
aatcatttgccaa

SEQ ID NO: 563653 - DNA, 13 bp, D. melanogaster
aatcatttggaaa

SEQ ID NO: 563654 - DNA, 13 bp, D. melanogaster
aatcatttgtttg

SEQ ID NO: 563655 - DNA, 13 bp, D. melanogaster
aatcatttgtttt

SEQ ID NO: 563656 - DNA, 13 bp, D. melanogaster
aatcattttattg

SEQ ID NO: 563657 - DNA, 13 bp, D. melanogaster
aatcattttcaaa

SEQ ID NO: 563658 - DNA, 13 bp, D. melanogaster
aatcattttcagt

SEQ ID NO: 563659 - DNA, 13 bp, D. melanogaster
aatcattttcatt

SEQ ID NO: 563660 - DNA, 13 bp, D. melanogaster
aatcattttccat

SEQ ID NO: 563661 - DNA, 13 bp, D. melanogaster
aatcattttccca

SEQ ID NO: 563662 - DNA, 13 bp, D. melanogaster
aatcatttttgca

SEQ ID NO: 563663 - DNA, 13 bp, D. melanogaster
aatcatttttgtt

SEQ ID NO: 563664 - DNA, 13 bp, D. melanogaster
aatccaaaaatcc

SEQ ID NO: 563665 - DNA, 13 bp, D. melanogaster
aatccaaaacggc

SEQ ID NO: 563666 - DNA, 13 bp, D. melanogaster
aatccaaaagcca

SEQ ID NO: 563667 - DNA, 13 bp, D. melanogaster
aatccaaaatatt

SEQ ID NO: 563668 - DNA, 13 bp, D. melanogaster
aatccaaacaatt

SEQ ID NO: 563669 - DNA, 13 bp, D. melanogaster
aatccaaacattt

SEQ ID NO: 563670 - DNA, 13 bp, D. melanogaster
aatccaaaccaat

SEQ ID NO: 563671 - DNA, 13 bp, D. melanogaster
aatccaaagcaaa

SEQ ID NO: 563672 - DNA, 14 bp, D. melanogaster
aatccaaaggaaaa

SEQ ID NO: 563673 - DNA, 13 bp, D. melanogaster
aatccaaatccaa

SEQ ID NO: 563674 - DNA, 13 bp, D. melanogaster
aatccaaatccac

SEQ ID NO: 563675 - DNA, 13 bp, D. melanogaster
aatccaaatccga

SEQ ID NO: 563676 - DNA, 14 bp, D. melanogaster
aatccaaatccgaa

SEQ ID NO: 563677 - DNA, 13 bp, D. melanogaster
aatccaaatcgat

SEQ ID NO: 563678 - DNA, 13 bp, D. melanogaster
aatccaaatgcca

SEQ ID NO: 563679 - DNA, 13 bp, D. melanogaster
aatccaaattgaa

SEQ ID NO: 563680 - DNA, 13 bp, D. melanogaster
aatccaaattgat

SEQ ID NO: 563681 - DNA, 13 bp, D. melanogaster
aatccaactaatt

SEQ ID NO: 563682 - DNA, 13 bp, D. melanogaster
aatccaactgaaa

SEQ ID NO: 563683 - DNA, 13 bp, D. melanogaster
aatccaagagcaa

SEQ ID NO: 563684 - DNA, 13 bp, D. melanogaster
aatccaagcccaa

SEQ ID NO: 563685 - DNA, 13 bp, D. melanogaster
aatccaaggaaag

SEQ ID NO: 563686 - DNA, 14 bp, D. melanogaster
aatccaaggaaagc

SEQ ID NO: 563687 - DNA, 13 bp, D. melanogaster
aatccaagtccaa

SEQ ID NO: 563688 - DNA, 13 bp, D. melanogaster
aatccaagtggat

SEQ ID NO: 563689 - DNA, 14 bp, D. melanogaster
aatccaagttcaaa

SEQ ID NO: 563690 - DNA, 13 bp, D. melanogaster
aatccaagttgaa

SEQ ID NO: 563691 - DNA, 14 bp, D. melanogaster
aatccaataaaatc

SEQ ID NO: 563692 - DNA, 13 bp, D. melanogaster
aatccaataagca

SEQ ID NO: 563693 - DNA, 17 bp, D. melanogaster
aatccaataagcaaata

SEQ ID NO: 563694 - DNA, 13 bp, D. melanogaster
aatccaatcaaat

SEQ ID NO: 563695 - DNA, 13 bp, D. melanogaster
aatccaatcaatt

SEQ ID NO: 563696 - DNA, 13 bp, D. melanogaster
aatccaatccaag

SEQ ID NO: 563697 - DNA, 13 bp, D. melanogaster
aatccaatccaat

SEQ ID NO: 563698 - DNA, 14 bp, D. melanogaster
aatccaatccaatt

SEQ ID NO: 563699 - DNA, 13 bp, D. melanogaster
aatccaatccact

SEQ ID NO: 563700 - DNA, 13 bp, D. melanogaster
aatccaatccgat

SEQ ID NO: 563701 - DNA, 13 bp, D. melanogaster
aatccaatcgaaa

SEQ ID NO: 563702 - DNA, 13 bp, D. melanogaster
aatccaatcgaat

SEQ ID NO: 563703 - DNA, 14 bp, D. melanogaster
aatccaatcgaatc

SEQ ID NO: 563704 - DNA, 13 bp, D. melanogaster
aatccaattaaat

SEQ ID NO: 563705 - DNA, 14 bp, D. melanogaster
aatccaattaaatt

SEQ ID NO: 563706 - DNA, 13 bp, D. melanogaster
aatccaattaatt

SEQ ID NO: 563707 - DNA, 13 bp, D. melanogaster
aatccaattcaat

SEQ ID NO: 563708 - DNA, 13 bp, D. melanogaster
aatccaattcgaa

SEQ ID NO: 563709 - DNA, 13 bp, D. melanogaster
aatccaattgcaa

SEQ ID NO: 563710 - DNA, 13 bp, D. melanogaster
aatccaatttaag

SEQ ID NO: 563711 - DNA, 13 bp, D. melanogaster
aatccaatttaat

SEQ ID NO: 563712 - DNA, 13 bp, D. melanogaster
aatccaatttgtt

SEQ ID NO: 563713 - DNA, 13 bp, D. melanogaster
aatccacatgaag

SEQ ID NO: 563714 - DNA, 13 bp, D. melanogaster
aatccacattatt

SEQ ID NO: 563715 - DNA, 13 bp, D. melanogaster
aatccacattttt

SEQ ID NO: 563716 - DNA, 13 bp, D. melanogaster
aatccacccactc

SEQ ID NO: 563717 - DNA, 13 bp, D. melanogaster
aatccactcaaga

SEQ ID NO: 563718 - DNA, 14 bp, D. melanogaster
aatccactcaagag

SEQ ID NO: 563719 - DNA, 13 bp, D. melanogaster
aatccactttaaa

SEQ ID NO: 563720 - DNA, 13 bp, D. melanogaster
aatccagaaaaag

SEQ ID NO: 563721 - DNA, 13 bp, D. melanogaster
aatccagaatcca

SEQ ID NO: 563722 - DNA, 14 bp, D. melanogaster
aatccagaatccag

SEQ ID NO: 563723 - DNA, 13 bp, D. melanogaster
aatccagacatta

SEQ ID NO: 563724 - DNA, 13 bp, D. melanogaster
aatccagcagaac

SEQ ID NO: 563725 - DNA, 13 bp, D. melanogaster
aatccaggaattg

SEQ ID NO: 563726 - DNA, 13 bp, D. melanogaster
aatccagttcaat

SEQ ID NO: 563727 - DNA, 13 bp, D. melanogaster
aatccatatttaa

SEQ ID NO: 563728 - DNA, 13 bp, D. melanogaster
aatccatatttta

SEQ ID NO: 563729 - DNA, 13 bp, D. melanogaster
aatccatccatcc

SEQ ID NO: 563730 - DNA, 14 bp, D. melanogaster
aatccatccatcca

SEQ ID NO: 563731 - DNA, 13 bp, D. melanogaster
aatccattaaatt

SEQ ID NO: 563732 - DNA, 13 bp, D. melanogaster
aatccattaattt

SEQ ID NO: 563733 - DNA, 13 bp, D. melanogaster
aatccattcaaat

SEQ ID NO: 563734 - DNA, 13 bp, D. melanogaster
aatccattgaaat

SEQ ID NO: 563735 - DNA, 13 bp, D. melanogaster
aatccatttattt

SEQ ID NO: 563736 - DNA, 13 bp, D. melanogaster
aatccatttcatt

SEQ ID NO: 563737 - DNA, 13 bp, D. melanogaster
aatccatttgaaa

SEQ ID NO: 563738 - DNA, 13 bp, D. melanogaster
aatccatttgaat

SEQ ID NO: 563739 - DNA, 13 bp, D. melanogaster
aatccatttttgg

SEQ ID NO: 563740 - DNA, 14 bp, D. melanogaster
aatccatttttgga

SEQ ID NO: 563741 - DNA, 14 bp, D. melanogaster
aatcccaaacgcag

SEQ ID NO: 563742 - DNA, 13 bp, D. melanogaster
aatcccaaatgag

SEQ ID NO: 563743 - DNA, 13 bp, D. melanogaster
aatcccaaggtgg

SEQ ID NO: 563744 - DNA, 13 bp, D. melanogaster
aatcccaatccca

SEQ ID NO: 563745 - DNA, 14 bp, D. melanogaster
aatcccaatcccag

SEQ ID NO: 563746 - DNA, 13 bp, D. melanogaster
aatcccaatcccc

SEQ ID NO: 563747 - DNA, 13 bp, D. melanogaster
aatcccaatcccg

SEQ ID NO: 563748 - DNA, 13 bp, D. melanogaster
aatcccaatccct

SEQ ID NO: 563749 - DNA, 13 bp, D. melanogaster
aatcccaatccga

SEQ ID NO: 563750 - DNA, 13 bp, D. melanogaster
aatcccaatcgaa

SEQ ID NO: 563751 - DNA, 13 bp, D. melanogaster
aatcccaatcgat

SEQ ID NO: 563752 - DNA, 13 bp, D. melanogaster
aatcccaattcca

SEQ ID NO: 563753 - DNA, 13 bp, D. melanogaster
aatcccactccca

SEQ ID NO: 563754 - DNA, 13 bp, D. melanogaster
aatcccagccaga

SEQ ID NO: 563755 - DNA, 13 bp, D. melanogaster
aatcccagcccaa

SEQ ID NO: 563756 - DNA, 13 bp, D. melanogaster
aatcccagcccac

SEQ ID NO: 563757 - DNA, 13 bp, D. melanogaster
aatcccagtccca

SEQ ID NO: 563758 - DNA, 13 bp, D. melanogaster
aatcccataaaat

SEQ ID NO: 563759 - DNA, 13 bp, D. melanogaster
aatcccatcccat

SEQ ID NO: 563760 - DNA, 13 bp, D. melanogaster
aatcccattaaaa

SEQ ID NO: 563761 - DNA, 13 bp, D. melanogaster
aatcccattccca

SEQ ID NO: 563762 - DNA, 13 bp, D. melanogaster
aatcccatttcca

SEQ ID NO: 563763 - DNA, 13 bp, D. melanogaster
aatccccaatccc

SEQ ID NO: 563764 - DNA, 13 bp, D. melanogaster
aatccccatccca

SEQ ID NO: 563765 - DNA, 13 bp, D. melanogaster
aatccccgccagc

SEQ ID NO: 563766 - DNA, 13 bp, D. melanogaster
aatcccggccaga

SEQ ID NO: 563767 - DNA, 13 bp, D. melanogaster
aatccctcttttg

SEQ ID NO: 563768 - DNA, 13 bp, D. melanogaster
aatccctttgcca

SEQ ID NO: 563769 - DNA, 13 bp, D. melanogaster
aatcccttttcct

SEQ ID NO: 563770 - DNA, 13 bp, D. melanogaster
aatccgaaacaaa

SEQ ID NO: 563771 - DNA, 14 bp, D. melanogaster
aatccgaaacaaaa

SEQ ID NO: 563772 - DNA, 13 bp, D. melanogaster
aatccgaaaccaa

SEQ ID NO: 563773 - DNA, 13 bp, D. melanogaster
aatccgaaaccga

SEQ ID NO: 563774 - DNA, 14 bp, D. melanogaster
aatccgaaaccgaa

SEQ ID NO: 563775 - DNA, 13 bp, D. melanogaster
aatccgaaagaaa

SEQ ID NO: 563776 - DNA, 13 bp, D. melanogaster
aatccgaaatccg

SEQ ID NO: 563777 - DNA, 13 bp, D. melanogaster
aatccgaaggagt

SEQ ID NO: 563778 - DNA, 14 bp, D. melanogaster
aatccgaatcagaa

SEQ ID NO: 563779 - DNA, 14 bp, D. melanogaster
aatccgaatcccaa

SEQ ID NO: 563780 - DNA, 13 bp, D. melanogaster
aatccgaatccga

SEQ ID NO: 563781 - DNA, 14 bp, D. melanogaster
aatccgaatccgaa

SEQ ID NO: 563782 - DNA, 13 bp, D. melanogaster
aatccgaatccgt

SEQ ID NO: 563783 - DNA, 13 bp, D. melanogaster
aatccgaatcgga

SEQ ID NO: 563784 - DNA, 14 bp, D. melanogaster
aatccgaatctgaa

SEQ ID NO: 563785 - DNA, 14 bp, D. melanogaster
aatccgaatgcgaa

SEQ ID NO: 563786 - DNA, 13 bp, D. melanogaster
aatccgaatggca

SEQ ID NO: 563787 - DNA, 13 bp, D. melanogaster
aatccgaattcga

SEQ ID NO: 563788 - DNA, 13 bp, D. melanogaster
aatccgagtatgc

SEQ ID NO: 563789 - DNA, 14 bp, D. melanogaster
aatccgagtccgaa

SEQ ID NO: 563790 - DNA, 14 bp, D. melanogaster
aatccgataaaaat

SEQ ID NO: 563791 - DNA, 13 bp, D. melanogaster
aatccgattccga

SEQ ID NO: 563792 - DNA, 13 bp, D. melanogaster
aatccgattttta

SEQ ID NO: 563793 - DNA, 13 bp, D. melanogaster
aatccgcaagctg

SEQ ID NO: 563794 - DNA, 13 bp, D. melanogaster
aatccgcatccga

SEQ ID NO: 563795 - DNA, 13 bp, D. melanogaster
aatccgctggcca

SEQ ID NO: 563796 - DNA, 13 bp, D. melanogaster
aatccggcaccaa

SEQ ID NO: 563797 - DNA, 14 bp, D. melanogaster
aatccggcaccaag

SEQ ID NO: 563798 - DNA, 13 bp, D. melanogaster
aatccggcggcca

SEQ ID NO: 563799 - DNA, 14 bp, D. melanogaster
aatccggcggccac

SEQ ID NO: 563800 - DNA, 13 bp, D. melanogaster
aatcctaaaaatg

SEQ ID NO: 563801 - DNA, 14 bp, D. melanogaster
aatcctaaaaatga

SEQ ID NO: 563802 - DNA, 13 bp, D. melanogaster
aatcctaacaagc

SEQ ID NO: 563803 - DNA, 13 bp, D. melanogaster
aatcctaactttt

SEQ ID NO: 563804 - DNA, 13 bp, D. melanogaster
aatcctataaatg

SEQ ID NO: 563805 - DNA, 13 bp, D. melanogaster
aatcctatttaaa

SEQ ID NO: 563806 - DNA, 14 bp, D. melanogaster
aatcctatttaaat

SEQ ID NO: 563807 - DNA, 13 bp, D. melanogaster
aatcctctccaaa

SEQ ID NO: 563808 - DNA, 14 bp, D. melanogaster
aatcctctccaaaa

SEQ ID NO: 563809 - DNA, 13 bp, D. melanogaster
aatcctgaagtaa

SEQ ID NO: 563810 - DNA, 13 bp, D. melanogaster
aatcctgatgctc

SEQ ID NO: 563811 - DNA, 13 bp, D. melanogaster
aatcctggccaaa

SEQ ID NO: 563812 - DNA, 13 bp, D. melanogaster
aatcctggccagc

SEQ ID NO: 563813 - DNA, 14 bp, D. melanogaster
aatcctttatcctt

SEQ ID NO: 563814 - DNA, 13 bp, D. melanogaster
aatcctttgaaaa

SEQ ID NO: 563815 - DNA, 13 bp, D. melanogaster
aatccttttgagg

SEQ ID NO: 563816 - DNA, 13 bp, D. melanogaster
aatcgaaaaactt

SEQ ID NO: 563817 - DNA, 13 bp, D. melanogaster
aatcgaaaaatat

SEQ ID NO: 563818 - DNA, 13 bp, D. melanogaster
aatcgaaaacaat

SEQ ID NO: 563819 - DNA, 14 bp, D. melanogaster
aatcgaaaacaatt

SEQ ID NO: 563820 - DNA, 13 bp, D. melanogaster
aatcgaaaacgaa

SEQ ID NO: 563821 - DNA, 13 bp, D. melanogaster
aatcgaaaacttt

SEQ ID NO: 563822 - DNA, 13 bp, D. melanogaster
aatcgaaaagcaa

SEQ ID NO: 563823 - DNA, 13 bp, D. melanogaster
aatcgaaaagcga

SEQ ID NO: 563824 - DNA, 14 bp, D. melanogaster
aatcgaaaatcaaa

SEQ ID NO: 563825 - DNA, 14 bp, D. melanogaster
aatcgaaaatcgaa

SEQ ID NO: 563826 - DNA, 13 bp, D. melanogaster
aatcgaaaatgaa

SEQ ID NO: 563827 - DNA, 13 bp, D. melanogaster
aatcgaaaattgt

SEQ ID NO: 563828 - DNA, 13 bp, D. melanogaster
aatcgaaacaaat

SEQ ID NO: 563829 - DNA, 13 bp, D. melanogaster
aatcgaaacaatg

SEQ ID NO: 563830 - DNA, 13 bp, D. melanogaster
aatcgaaacaatt

SEQ ID NO: 563831 - DNA, 13 bp, D. melanogaster
aatcgaaacagaa

SEQ ID NO: 563832 - DNA, 13 bp, D. melanogaster
aatcgaaacattt

SEQ ID NO: 563833 - DNA, 13 bp, D. melanogaster
aatcgaaaccgaa

SEQ ID NO: 563834 - DNA, 14 bp, D. melanogaster
aatcgaaaccgaaa

SEQ ID NO: 563835 - DNA, 13 bp, D. melanogaster
aatcgaaacgaaa

SEQ ID NO: 563836 - DNA, 13 bp, D. melanogaster
aatcgaaacgaat

SEQ ID NO: 563837 - DNA, 14 bp, D. melanogaster
aatcgaaacgaatc

SEQ ID NO: 563838 - DNA, 13 bp, D. melanogaster
aatcgaaacggaa

SEQ ID NO: 563839 - DNA, 13 bp, D. melanogaster
aatcgaaactaat

SEQ ID NO: 563840 - DNA, 14 bp, D. melanogaster
aatcgaaactgaaa

SEQ ID NO: 563841 - DNA, 13 bp, D. melanogaster
aatcgaaagacaa

SEQ ID NO: 563842 - DNA, 13 bp, D. melanogaster
aatcgaaagactt

SEQ ID NO: 563843 - DNA, 13 bp, D. melanogaster
aatcgaaagattt

SEQ ID NO: 563844 - DNA, 13 bp, D. melanogaster
aatcgaaagcaaa

SEQ ID NO: 563845 - DNA, 13 bp, D. melanogaster
aatcgaaagcaat

SEQ ID NO: 563846 - DNA, 13 bp, D. melanogaster
aatcgaaagcgaa

SEQ ID NO: 563847 - DNA, 14 bp, D. melanogaster
aatcgaaagcgaaa

SEQ ID NO: 563848 - DNA, 13 bp, D. melanogaster
aatcgaaaggaaa

SEQ ID NO: 563849 - DNA, 13 bp, D. melanogaster
aatcgaaagtaaa

SEQ ID NO: 563850 - DNA, 13 bp, D. melanogaster
aatcgaaataatc

SEQ ID NO: 563851 - DNA, 13 bp, D. melanogaster
aatcgaaatacaa

SEQ ID NO: 563852 - DNA, 13 bp, D. melanogaster
aatcgaaatatat

SEQ ID NO: 563853 - DNA, 13 bp, D. melanogaster
aatcgaaatattc

SEQ ID NO: 563854 - DNA, 13 bp, D. melanogaster
aatcgaaatattt

SEQ ID NO: 563855 - DNA, 13 bp, D. melanogaster
aatcgaaatcaaa

SEQ ID NO: 563856 - DNA, 13 bp, D. melanogaster
aatcgaaatcaat

SEQ ID NO: 563857 - DNA, 13 bp, D. melanogaster
aatcgaaatcgaa

SEQ ID NO: 563858 - DNA, 14 bp, D. melanogaster
aatcgaaatcgaaa

SEQ ID NO: 563859 - DNA, 13 bp, D. melanogaster
aatcgaaatcgat

SEQ ID NO: 563860 - DNA, 13 bp, D. melanogaster
aatcgaaatcgga

SEQ ID NO: 563861 - DNA, 14 bp, D. melanogaster
aatcgaaatcggaa

SEQ ID NO: 563862 - DNA, 13 bp, D. melanogaster
aatcgaaatcgtt

SEQ ID NO: 563863 - DNA, 13 bp, D. melanogaster
aatcgaaatgaaa

SEQ ID NO: 563864 - DNA, 14 bp, D. melanogaster
aatcgaaatgaaaa

SEQ ID NO: 563865 - DNA, 14 bp, D. melanogaster
aatcgaaatgaaat

SEQ ID NO: 563866 - DNA, 13 bp, D. melanogaster
aatcgaaatgaga

SEQ ID NO: 563867 - DNA, 13 bp, D. melanogaster
aatcgaaatgagt

SEQ ID NO: 563868 - DNA, 13 bp, D. melanogaster
aatcgaaatgatt

SEQ ID NO: 563869 - DNA, 13 bp, D. melanogaster
aatcgaaatgcca

SEQ ID NO: 563870 - DNA, 13 bp, D. melanogaster
aatcgaaatggaa

SEQ ID NO: 563871 - DNA, 14 bp, D. melanogaster
aatcgaaatggaaa

SEQ ID NO: 563872 - DNA, 13 bp, D. melanogaster
aatcgaaatgtta

SEQ ID NO: 563873 - DNA, 13 bp, D. melanogaster
aatcgaaattaac

SEQ ID NO: 563874 - DNA, 13 bp, D. melanogaster
aatcgaaattatt

SEQ ID NO: 563875 - DNA, 13 bp, D. melanogaster
aatcgaaattgtt

SEQ ID NO: 563876 - DNA, 13 bp, D. melanogaster
aatcgaaatttat

SEQ ID NO: 563877 - DNA, 13 bp, D. melanogaster
aatcgaacacaaa

SEQ ID NO: 563878 - DNA, 13 bp, D. melanogaster
aatcgaaccaaca

SEQ ID NO: 563879 - DNA, 13 bp, D. melanogaster
aatcgaacggaaa

SEQ ID NO: 563880 - DNA, 13 bp, D. melanogaster
aatcgaactgaaa

SEQ ID NO: 563881 - DNA, 13 bp, D. melanogaster
aatcgaactgaat

SEQ ID NO: 563882 - DNA, 13 bp, D. melanogaster
aatcgaactgcat

SEQ ID NO: 563883 - DNA, 13 bp, D. melanogaster
aatcgaactggat

SEQ ID NO: 563884 - DNA, 13 bp, D. melanogaster
aatcgaactgtgt

SEQ ID NO: 563885 - DNA, 13 bp, D. melanogaster
aatcgaagaaaac

SEQ ID NO: 563886 - DNA, 13 bp, D. melanogaster
aatcgaaggaaaa

SEQ ID NO: 563887 - DNA, 13 bp, D. melanogaster
aatcgaagggaaa

SEQ ID NO: 563888 - DNA, 13 bp, D. melanogaster
aatcgaagtagaa

SEQ ID NO: 563889 - DNA, 13 bp, D. melanogaster
aatcgaagtgaaa

SEQ ID NO: 563890 - DNA, 13 bp, D. melanogaster
aatcgaataaatt

SEQ ID NO: 563891 - DNA, 13 bp, D. melanogaster
aatcgaatacaaa

SEQ ID NO: 563892 - DNA, 13 bp, D. melanogaster
aatcgaatatttt

SEQ ID NO: 563893 - DNA, 13 bp, D. melanogaster
aatcgaatcaaat

SEQ ID NO: 563894 - DNA, 13 bp, D. melanogaster
aatcgaatcaatc

SEQ ID NO: 563895 - DNA, 13 bp, D. melanogaster
aatcgaatccaaa

SEQ ID NO: 563896 - DNA, 13 bp, D. melanogaster
aatcgaatccaat

SEQ ID NO: 563897 - DNA, 13 bp, D. melanogaster
aatcgaatcgaaa

SEQ ID NO: 563898 - DNA, 14 bp, D. melanogaster
aatcgaatcgaaac

SEQ ID NO: 563899 - DNA, 13 bp, D. melanogaster
aatcgaatcgaag

SEQ ID NO: 563900 - DNA, 13 bp, D. melanogaster
aatcgaatcgaat

SEQ ID NO: 563901 - DNA, 14 bp, D. melanogaster
aatcgaatcgaatg

SEQ ID NO: 563902 - DNA, 14 bp, D. melanogaster
aatcgaatcgaatt

SEQ ID NO: 563903 - DNA, 13 bp, D. melanogaster
aatcgaatcgcat

SEQ ID NO: 563904 - DNA, 13 bp, D. melanogaster
aatcgaatcggat

SEQ ID NO: 563905 - DNA, 13 bp, D. melanogaster
aatcgaatgaaaa

SEQ ID NO: 563906 - DNA, 13 bp, D. melanogaster
aatcgaatgaaat

SEQ ID NO: 563907 - DNA, 13 bp, D. melanogaster
aatcgaatgcaat

SEQ ID NO: 563908 - DNA, 13 bp, D. melanogaster
aatcgaatgctga

SEQ ID NO: 563909 - DNA, 14 bp, D. melanogaster
aatcgaatgctgaa

SEQ ID NO: 563910 - DNA, 14 bp, D. melanogaster
aatcgaatggaatc

SEQ ID NO: 563911 - DNA, 13 bp, D. melanogaster
aatcgaatggcaa

SEQ ID NO: 563912 - DNA, 13 bp, D. melanogaster
aatcgaatgtaaa

SEQ ID NO: 563913 - DNA, 13 bp, D. melanogaster
aatcgaattaaag

SEQ ID NO: 563914 - DNA, 13 bp, D. melanogaster
aatcgaattaaat

SEQ ID NO: 563915 - DNA, 13 bp, D. melanogaster
aatcgaattaatc

SEQ ID NO: 563916 - DNA, 13 bp, D. melanogaster
aatcgaattataa

SEQ ID NO: 563917 - DNA, 13 bp, D. melanogaster
aatcgaattcatt

SEQ ID NO: 563918 - DNA, 13 bp, D. melanogaster
aatcgaattcgaa

SEQ ID NO: 563919 - DNA, 13 bp, D. melanogaster
aatcgaattcgat

SEQ ID NO: 563920 - DNA, 13 bp, D. melanogaster
aatcgaattgaat

SEQ ID NO: 563921 - DNA, 14 bp, D. melanogaster
aatcgaattgaatt

SEQ ID NO: 563922 - DNA, 13 bp, D. melanogaster
aatcgaattgttt

SEQ ID NO: 563923 - DNA, 13 bp, D. melanogaster
aatcgaatttcat

SEQ ID NO: 563924 - DNA, 13 bp, D. melanogaster
aatcgaatttgta

SEQ ID NO: 563925 - DNA, 13 bp, D. melanogaster
aatcgaatttgtt

SEQ ID NO: 563926 - DNA, 13 bp, D. melanogaster
aatcgaattttat

SEQ ID NO: 563927 - DNA, 13 bp, D. melanogaster
aatcgaattttcc

SEQ ID NO: 563928 - DNA, 13 bp, D. melanogaster
aatcgaattttta

SEQ ID NO: 563929 - DNA, 13 bp, D. melanogaster
aatcgaatttttg

SEQ ID NO: 563930 - DNA, 14 bp, D. melanogaster
aatcgaatttttga

SEQ ID NO: 563931 - DNA, 13 bp, D. melanogaster
aatcgacaaagaa

SEQ ID NO: 563932 - DNA, 13 bp, D. melanogaster
aatcgaccaagtt

SEQ ID NO: 563933 - DNA, 13 bp, D. melanogaster
aatcgacgataat

SEQ ID NO: 563934 - DNA, 13 bp, D. melanogaster
aatcgagaaaatc

SEQ ID NO: 563935 - DNA, 13 bp, D. melanogaster
aatcgagaatcga

SEQ ID NO: 563936 - DNA, 14 bp, D. melanogaster
aatcgagcggctgg

SEQ ID NO: 563937 - DNA, 13 bp, D. melanogaster
aatcgagggaaat

SEQ ID NO: 563938 - DNA, 13 bp, D. melanogaster
aatcgagtgaaat

SEQ ID NO: 563939 - DNA, 13 bp, D. melanogaster
aatcgataaatat

SEQ ID NO: 563940 - DNA, 13 bp, D. melanogaster
aatcgataactgt

SEQ ID NO: 563941 - DNA, 13 bp, D. melanogaster
aatcgatacaaat

SEQ ID NO: 563942 - DNA, 13 bp, D. melanogaster
aatcgataccgtt

SEQ ID NO: 563943 - DNA, 13 bp, D. melanogaster
aatcgatataaaa

SEQ ID NO: 563944 - DNA, 13 bp, D. melanogaster
aatcgatcgatcg

SEQ ID NO: 563945 - DNA, 14 bp, D. melanogaster
aatcgatcgatcga

SEQ ID NO: 563946 - DNA, 13 bp, D. melanogaster
aatcgatgaactg

SEQ ID NO: 563947 - DNA, 13 bp, D. melanogaster
aatcgatgcaaat

SEQ ID NO: 563948 - DNA, 13 bp, D. melanogaster
aatcgatggcaaa

SEQ ID NO: 563949 - DNA, 13 bp, D. melanogaster
aatcgattattat

SEQ ID NO: 563950 - DNA, 13 bp, D. melanogaster
aatcgattcaatt

SEQ ID NO: 563951 - DNA, 13 bp, D. melanogaster
aatcgattccatt

SEQ ID NO: 563952 - DNA, 13 bp, D. melanogaster
aatcgattcgaaa

SEQ ID NO: 563953 - DNA, 13 bp, D. melanogaster
aatcgattgaact

SEQ ID NO: 563954 - DNA, 13 bp, D. melanogaster
aatcgattgattt

SEQ ID NO: 563955 - DNA, 13 bp, D. melanogaster
aatcgattgcttt

SEQ ID NO: 563956 - DNA, 13 bp, D. melanogaster
aatcgattggaaa

SEQ ID NO: 563957 - DNA, 13 bp, D. melanogaster
aatcgattggaat

SEQ ID NO: 563958 - DNA, 14 bp, D. melanogaster
aatcgattggaatt

SEQ ID NO: 563959 - DNA, 13 bp, D. melanogaster
aatcgattggcat

SEQ ID NO: 563960 - DNA, 14 bp, D. melanogaster
aatcgattggcatt

SEQ ID NO: 563961 - DNA, 13 bp, D. melanogaster
aatcgattgggaa

SEQ ID NO: 563962 - DNA, 13 bp, D. melanogaster
aatcgattgtttt

SEQ ID NO: 563963 - DNA, 13 bp, D. melanogaster
aatcgatttaatt

SEQ ID NO: 563964 - DNA, 13 bp, D. melanogaster
aatcgatttataa

SEQ ID NO: 563965 - DNA, 13 bp, D. melanogaster
aatcgatttattt

SEQ ID NO: 563966 - DNA, 13 bp, D. melanogaster
aatcgatttcaat

SEQ ID NO: 563967 - DNA, 13 bp, D. melanogaster
aatcgatttgaaa

SEQ ID NO: 563968 - DNA, 13 bp, D. melanogaster
aatcgatttgaat

SEQ ID NO: 563969 - DNA, 13 bp, D. melanogaster
aatcgatttgagt

SEQ ID NO: 563970 - DNA, 13 bp, D. melanogaster
aatcgatttgtat

SEQ ID NO: 563971 - DNA, 13 bp, D. melanogaster
aatcgatttttat

SEQ ID NO: 563972 - DNA, 13 bp, D. melanogaster
aatcgatttttct

SEQ ID NO: 563973 - DNA, 13 bp, D. melanogaster
aatcgatttttga

SEQ ID NO: 563974 - DNA, 13 bp, D. melanogaster
aatcgatttttgt

SEQ ID NO: 563975 - DNA, 13 bp, D. melanogaster
aatcgattttttt

SEQ ID NO: 563976 - DNA, 13 bp, D. melanogaster
aatcgcaaataaa

SEQ ID NO: 563977 - DNA, 13 bp, D. melanogaster
aatcgcaaatgat

SEQ ID NO: 563978 - DNA, 13 bp, D. melanogaster
aatcgcaaattgc

SEQ ID NO: 563979 - DNA, 13 bp, D. melanogaster
aatcgcaagtgca

SEQ ID NO: 563980 - DNA, 13 bp, D. melanogaster
aatcgcaataaca

SEQ ID NO: 563981 - DNA, 13 bp, D. melanogaster
aatcgcaatcaaa

SEQ ID NO: 563982 - DNA, 13 bp, D. melanogaster
aatcgcaatcaca

SEQ ID NO: 563983 - DNA, 13 bp, D. melanogaster
aatcgcaatcgaa

SEQ ID NO: 563984 - DNA, 13 bp, D. melanogaster
aatcgcaatgaaa

SEQ ID NO: 563985 - DNA, 13 bp, D. melanogaster
aatcgcacacaca

SEQ ID NO: 563986 - DNA, 14 bp, D. melanogaster
aatcgcacacacac

SEQ ID NO: 563987 - DNA, 13 bp, D. melanogaster
aatcgcagacaat

SEQ ID NO: 563988 - DNA, 13 bp, D. melanogaster
aatcgcagcagca

SEQ ID NO: 563989 - DNA, 13 bp, D. melanogaster
aatcgcagggttg

SEQ ID NO: 563990 - DNA, 13 bp, D. melanogaster
aatcgcagtcgca

SEQ ID NO: 563991 - DNA, 13 bp, D. melanogaster
aatcgcatcaaat

SEQ ID NO: 563992 - DNA, 13 bp, D. melanogaster
aatcgcatcgaat

SEQ ID NO: 563993 - DNA, 13 bp, D. melanogaster
aatcgcattaaat

SEQ ID NO: 563994 - DNA, 13 bp, D. melanogaster
aatcgcattcgca

SEQ ID NO: 563995 - DNA, 13 bp, D. melanogaster
aatcgcattgaat

SEQ ID NO: 563996 - DNA, 13 bp, D. melanogaster
aatcgcatttaaa

SEQ ID NO: 563997 - DNA, 13 bp, D. melanogaster
aatcgcatttgtt

SEQ ID NO: 563998 - DNA, 13 bp, D. melanogaster
aatcgcattttaa

SEQ ID NO: 563999 - DNA, 13 bp, D. melanogaster
aatcgccaagctt

SEQ ID NO: 564000 - DNA, 13 bp, D. melanogaster
aatcgccattttt

SEQ ID NO: 564001 - DNA, 13 bp, D. melanogaster
aatcgccgctcga

SEQ ID NO: 564002 - DNA, 13 bp, D. melanogaster
aatcgcgaaatcg

SEQ ID NO: 564003 - DNA, 15 bp, D. melanogaster
aatcgcgaaatcgag

SEQ ID NO: 564004 - DNA, 13 bp, D. melanogaster
aatcgctgataag

SEQ ID NO: 564005 - DNA, 13 bp, D. melanogaster
aatcgctggaaaa

SEQ ID NO: 564006 - DNA, 13 bp, D. melanogaster
aatcgctggcatt

SEQ ID NO: 564007 - DNA, 13 bp, D. melanogaster
aatcgctggccaa

SEQ ID NO: 564008 - DNA, 13 bp, D. melanogaster
aatcgcttttgaa

SEQ ID NO: 564009 - DNA, 13 bp, D. melanogaster
aatcgctttttat

SEQ ID NO: 564010 - DNA, 13 bp, D. melanogaster
aatcggaaaacag

SEQ ID NO: 564011 - DNA, 14 bp, D. melanogaster
aatcggaaaacagc

SEQ ID NO: 564012 - DNA, 13 bp, D. melanogaster
aatcggaaaagcg

SEQ ID NO: 564013 - DNA, 13 bp, D. melanogaster
aatcggaaaatga

SEQ ID NO: 564014 - DNA, 13 bp, D. melanogaster
aatcggaaaatgc

SEQ ID NO: 564015 - DNA, 13 bp, D. melanogaster
aatcggaaacgga

SEQ ID NO: 564016 - DNA, 13 bp, D. melanogaster
aatcggaaatcaa

SEQ ID NO: 564017 - DNA, 13 bp, D. melanogaster
aatcggaaatgga

SEQ ID NO: 564018 - DNA, 13 bp, D. melanogaster
aatcggaaatttg

SEQ ID NO: 564019 - DNA, 13 bp, D. melanogaster
aatcggaagacgg

SEQ ID NO: 564020 - DNA, 13 bp, D. melanogaster
aatcggaatcaaa

SEQ ID NO: 564021 - DNA, 14 bp, D. melanogaster
aatcggaatcagaa

SEQ ID NO: 564022 - DNA, 13 bp, D. melanogaster
aatcggaatccga

SEQ ID NO: 564023 - DNA, 14 bp, D. melanogaster
aatcggaatcgaaa

SEQ ID NO: 564024 - DNA, 14 bp, D. melanogaster
aatcggaatcggag

SEQ ID NO: 564025 - DNA, 13 bp, D. melanogaster
aatcggaatcggg

SEQ ID NO: 564026 - DNA, 13 bp, D. melanogaster
aatcggaatctga

SEQ ID NO: 564027 - DNA, 13 bp, D. melanogaster
aatcggaattgga

SEQ ID NO: 564028 - DNA, 13 bp, D. melanogaster
aatcggacggact

SEQ ID NO: 564029 - DNA, 13 bp, D. melanogaster
aatcggagaactt

SEQ ID NO: 564030 - DNA, 13 bp, D. melanogaster
aatcggctaagaa

SEQ ID NO: 564031 - DNA, 13 bp, D. melanogaster
aatcggctggcca

SEQ ID NO: 564032 - DNA, 13 bp, D. melanogaster
aatcgggccaaaa

SEQ ID NO: 564033 - DNA, 13 bp, D. melanogaster
aatcggggaatcg

SEQ ID NO: 564034 - DNA, 13 bp, D. melanogaster
aatcggggtcacc

SEQ ID NO: 564035 - DNA, 13 bp, D. melanogaster
aatcggtccaaaa

SEQ ID NO: 564036 - DNA, 13 bp, D. melanogaster
aatcggtgatcga

SEQ ID NO: 564037 - DNA, 13 bp, D. melanogaster
aatcggtggaaaa

SEQ ID NO: 564038 - DNA, 13 bp, D. melanogaster
aatcggtttgttt

SEQ ID NO: 564039 - DNA, 13 bp, D. melanogaster
aatcgtaaaatat

SEQ ID NO: 564040 - DNA, 13 bp, D. melanogaster
aatcgtaaacaaa

SEQ ID NO: 564041 - DNA, 13 bp, D. melanogaster
aatcgtaaatcaa

SEQ ID NO: 564042 - DNA, 13 bp, D. melanogaster
aatcgtaataata

SEQ ID NO: 564043 - DNA, 14 bp, D. melanogaster
aatcgtaatcgtaa

SEQ ID NO: 564044 - DNA, 13 bp, D. melanogaster
aatcgtaattaaa

SEQ ID NO: 564045 - DNA, 14 bp, D. melanogaster
aatcgtataaaaat

SEQ ID NO: 564046 - DNA, 13 bp, D. melanogaster
aatcgtattaaaa

SEQ ID NO: 564047 - DNA, 13 bp, D. melanogaster
aatcgtattacaa

SEQ ID NO: 564048 - DNA, 13 bp, D. melanogaster
aatcgtatttaaa

SEQ ID NO: 564049 - DNA, 13 bp, D. melanogaster
aatcgtatttttt

SEQ ID NO: 564050 - DNA, 13 bp, D. melanogaster
aatcgtcttctag

SEQ ID NO: 564051 - DNA, 13 bp, D. melanogaster
aatcgtggaatca

SEQ ID NO: 564052 - DNA, 13 bp, D. melanogaster
aatcgttaacaat

SEQ ID NO: 564053 - DNA, 13 bp, D. melanogaster
aatcgttaagatt

SEQ ID NO: 564054 - DNA, 13 bp, D. melanogaster
aatcgttatattt

SEQ ID NO: 564055 - DNA, 13 bp, D. melanogaster
aatcgttgaaaag

SEQ ID NO: 564056 - DNA, 13 bp, D. melanogaster
aatcgtttaaaat

SEQ ID NO: 564057 - DNA, 13 bp, D. melanogaster
aatcgtttattaa

SEQ ID NO: 564058 - DNA, 13 bp, D. melanogaster
aatcgtttcaaat

SEQ ID NO: 564059 - DNA, 13 bp, D. melanogaster
aatcgttttaaaa

SEQ ID NO: 564060 - DNA, 13 bp, D. melanogaster
aatcgttttaatg

SEQ ID NO: 564061 - DNA, 13 bp, D. melanogaster
aatcgttttcatt

SEQ ID NO: 564062 - DNA, 13 bp, D. melanogaster
aatcgtttttata

SEQ ID NO: 564063 - DNA, 13 bp, D. melanogaster
aatcgtttttgtt

SEQ ID NO: 564064 - DNA, 13 bp, D. melanogaster
aatctaaaaaccc

SEQ ID NO: 564065 - DNA, 13 bp, D. melanogaster
aatctaaaaagtt

SEQ ID NO: 564066 - DNA, 13 bp, D. melanogaster
aatctaaaaatag

SEQ ID NO: 564067 - DNA, 13 bp, D. melanogaster
aatctaaacattt

SEQ ID NO: 564068 - DNA, 13 bp, D. melanogaster
aatctaaaccatc

SEQ ID NO: 564069 - DNA, 13 bp, D. melanogaster
aatctaaatatct

SEQ ID NO: 564070 - DNA, 13 bp, D. melanogaster
aatctaaatctaa

SEQ ID NO: 564071 - DNA, 14 bp, D. melanogaster
aatctaaatctaat

SEQ ID NO: 564072 - DNA, 13 bp, D. melanogaster
aatctaacatcta

SEQ ID NO: 564073 - DNA, 13 bp, D. melanogaster
aatctaatagaaa

SEQ ID NO: 564074 - DNA, 13 bp, D. melanogaster
aatctaatcaaat

SEQ ID NO: 564075 - DNA, 13 bp, D. melanogaster
aatctaatctaaa

SEQ ID NO: 564076 - DNA, 13 bp, D. melanogaster
aatctaatctaat

SEQ ID NO: 564077 - DNA, 13 bp, D. melanogaster
aatctaatgtgca

SEQ ID NO: 564078 - DNA, 13 bp, D. melanogaster
aatctaatttcgt

SEQ ID NO: 564079 - DNA, 13 bp, D. melanogaster
aatctaatttgca

SEQ ID NO: 564080 - DNA, 13 bp, D. melanogaster
aatctacataatt

SEQ ID NO: 564081 - DNA, 13 bp, D. melanogaster
aatctacatacat

SEQ ID NO: 564082 - DNA, 14 bp, D. melanogaster
aatctacatacata

SEQ ID NO: 564083 - DNA, 13 bp, D. melanogaster
aatctactttaaa

SEQ ID NO: 564084 - DNA, 13 bp, D. melanogaster
aatctagttatgt

SEQ ID NO: 564085 - DNA, 13 bp, D. melanogaster
aatctataatcta

SEQ ID NO: 564086 - DNA, 13 bp, D. melanogaster
aatctatacatat

SEQ ID NO: 564087 - DNA, 14 bp, D. melanogaster
aatctatagaaatt

SEQ ID NO: 564088 - DNA, 13 bp, D. melanogaster
aatctatctcaaa

SEQ ID NO: 564089 - DNA, 13 bp, D. melanogaster
aatctatgcaaat

SEQ ID NO: 564090 - DNA, 13 bp, D. melanogaster
aatctatgtatgt

SEQ ID NO: 564091 - DNA, 13 bp, D. melanogaster
aatctattaagat

SEQ ID NO: 564092 - DNA, 13 bp, D. melanogaster
aatctatttatgt

SEQ ID NO: 564093 - DNA, 14 bp, D. melanogaster
aatctatttatgta

SEQ ID NO: 564094 - DNA, 13 bp, D. melanogaster
aatctatttgaaa

SEQ ID NO: 564095 - DNA, 13 bp, D. melanogaster
aatctattttcaa

SEQ ID NO: 564096 - DNA, 13 bp, D. melanogaster
aatctattttcat

SEQ ID NO: 564097 - DNA, 13 bp, D. melanogaster
aatctatttttca

SEQ ID NO: 564098 - DNA, 13 bp, D. melanogaster
aatctcaaatatt

SEQ ID NO: 564099 - DNA, 14 bp, D. melanogaster
aatctcaacatatt

SEQ ID NO: 564100 - DNA, 13 bp, D. melanogaster
aatctcaacattc

SEQ ID NO: 564101 - DNA, 13 bp, D. melanogaster
aatctcaatctca

SEQ ID NO: 564102 - DNA, 14 bp, D. melanogaster
aatctcaatctcaa

SEQ ID NO: 564103 - DNA, 13 bp, D. melanogaster
aatctcaattgaa

SEQ ID NO: 564104 - DNA, 13 bp, D. melanogaster
aatctcacatgca

SEQ ID NO: 564105 - DNA, 14 bp, D. melanogaster
aatctcagcccgaa

SEQ ID NO: 564106 - DNA, 13 bp, D. melanogaster
aatctcattaaaa

SEQ ID NO: 564107 - DNA, 13 bp, D. melanogaster
aatctcatttcaa

SEQ ID NO: 564108 - DNA, 13 bp, D. melanogaster
aatctcatttgtt

SEQ ID NO: 564109 - DNA, 13 bp, D. melanogaster
aatctccatctcc

SEQ ID NO: 564110 - DNA, 13 bp, D. melanogaster
aatctccatttct

SEQ ID NO: 564111 - DNA, 13 bp, D. melanogaster
aatctcctgccaa

SEQ ID NO: 564112 - DNA, 13 bp, D. melanogaster
aatctcgcagcag

SEQ ID NO: 564113 - DNA, 14 bp, D. melanogaster
aatctctctctctc

SEQ ID NO: 564114 - DNA, 13 bp, D. melanogaster
aatctctgataaa

SEQ ID NO: 564115 - DNA, 13 bp, D. melanogaster
aatctctgccaga

SEQ ID NO: 564116 - DNA, 13 bp, D. melanogaster
aatctgaaaatct

SEQ ID NO: 564117 - DNA, 13 bp, D. melanogaster
aatctgaaattat

SEQ ID NO: 564118 - DNA, 13 bp, D. melanogaster
aatctgaacatgc

SEQ ID NO: 564119 - DNA, 13 bp, D. melanogaster
aatctgaatcaga

SEQ ID NO: 564120 - DNA, 14 bp, D. melanogaster
aatctgaatcagaa

SEQ ID NO: 564121 - DNA, 13 bp, D. melanogaster
aatctgaatccga

SEQ ID NO: 564122 - DNA, 13 bp, D. melanogaster
aatctgatctgat

SEQ ID NO: 564123 - DNA, 13 bp, D. melanogaster
aatctgatttgat

SEQ ID NO: 564124 - DNA, 13 bp, D. melanogaster
aatctgcaaaaat

SEQ ID NO: 564125 - DNA, 13 bp, D. melanogaster
aatctgcagaaaa

SEQ ID NO: 564126 - DNA, 13 bp, D. melanogaster
aatctgcataaat

SEQ ID NO: 564127 - DNA, 13 bp, D. melanogaster
aatctgcatgctt

SEQ ID NO: 564128 - DNA, 13 bp, D. melanogaster
aatctgcatttaa

SEQ ID NO: 564129 - DNA, 13 bp, D. melanogaster
aatctgccacgcc

SEQ ID NO: 564130 - DNA, 13 bp, D. melanogaster
aatctggaaacta

SEQ ID NO: 564131 - DNA, 13 bp, D. melanogaster
aatctggaatctg

SEQ ID NO: 564132 - DNA, 13 bp, D. melanogaster
aatctggactact

SEQ ID NO: 564133 - DNA, 13 bp, D. melanogaster
aatctggcccaaa

SEQ ID NO: 564134 - DNA, 13 bp, D. melanogaster
aatctgtaaataa

SEQ ID NO: 564135 - DNA, 14 bp, D. melanogaster
aatctgtacaaatt

SEQ ID NO: 564136 - DNA, 13 bp, D. melanogaster
aatctgtatgcta

SEQ ID NO: 564137 - DNA, 13 bp, D. melanogaster
aatctgttagaac

SEQ ID NO: 564138 - DNA, 13 bp, D. melanogaster
aatctgttggcaa

SEQ ID NO: 564139 - DNA, 13 bp, D. melanogaster
aatctgtttattc

SEQ ID NO: 564140 - DNA, 13 bp, D. melanogaster
aatcttaaacaag

SEQ ID NO: 564141 - DNA, 13 bp, D. melanogaster
aatcttaacgatt

SEQ ID NO: 564142 - DNA, 13 bp, D. melanogaster
aatcttaatctaa

SEQ ID NO: 564143 - DNA, 14 bp, D. melanogaster
aatcttaatctaac

SEQ ID NO: 564144 - DNA, 13 bp, D. melanogaster
aatcttaatcttt

SEQ ID NO: 564145 - DNA, 13 bp, D. melanogaster
aatcttacctaaa

SEQ ID NO: 564146 - DNA, 13 bp, D. melanogaster
aatcttatagata

SEQ ID NO: 564147 - DNA, 13 bp, D. melanogaster
aatcttatatttc

SEQ ID NO: 564148 - DNA, 13 bp, D. melanogaster
aatcttatcttat

SEQ ID NO: 564149 - DNA, 13 bp, D. melanogaster
aatcttcaaaaat

SEQ ID NO: 564150 - DNA, 13 bp, D. melanogaster
aatcttcaaaatt

SEQ ID NO: 564151 - DNA, 13 bp, D. melanogaster
aatcttcaaacag

SEQ ID NO: 564152 - DNA, 13 bp, D. melanogaster
aatcttcacacta

SEQ ID NO: 564153 - DNA, 13 bp, D. melanogaster
aatcttccaaaat

SEQ ID NO: 564154 - DNA, 13 bp, D. melanogaster
aatcttccaaaga

SEQ ID NO: 564155 - DNA, 13 bp, D. melanogaster
aatcttccagatc

SEQ ID NO: 564156 - DNA, 13 bp, D. melanogaster
aatcttcgatgtt

SEQ ID NO: 564157 - DNA, 13 bp, D. melanogaster
aatcttcttgtat

SEQ ID NO: 564158 - DNA, 13 bp, D. melanogaster
aatcttctttaat

SEQ ID NO: 564159 - DNA, 13 bp, D. melanogaster
aatcttggacaac

SEQ ID NO: 564160 - DNA, 13 bp, D. melanogaster
aatcttggccagc

SEQ ID NO: 564161 - DNA, 13 bp, D. melanogaster
aatcttgtaaaat

SEQ ID NO: 564162 - DNA, 13 bp, D. melanogaster
aatcttgttggtg

SEQ ID NO: 564163 - DNA, 13 bp, D. melanogaster
aatctttaaacat

SEQ ID NO: 564164 - DNA, 13 bp, D. melanogaster
aatctttaaactt

SEQ ID NO: 564165 - DNA, 13 bp, D. melanogaster
aatctttaagata

SEQ ID NO: 564166 - DNA, 13 bp, D. melanogaster
aatctttaatgaa

SEQ ID NO: 564167 - DNA, 13 bp, D. melanogaster
aatctttaattca

SEQ ID NO: 564168 - DNA, 13 bp, D. melanogaster
aatctttacaaat

SEQ ID NO: 564169 - DNA, 13 bp, D. melanogaster
aatctttcaatgt

SEQ ID NO: 564170 - DNA, 13 bp, D. melanogaster
aatctttcacttt

SEQ ID NO: 564171 - DNA, 13 bp, D. melanogaster
aatctttcgaatc

SEQ ID NO: 564172 - DNA, 14 bp, D. melanogaster
aatctttcgaatca

SEQ ID NO: 564173 - DNA, 13 bp, D. melanogaster
aatctttgaaaac

SEQ ID NO: 564174 - DNA, 13 bp, D. melanogaster
aatctttgaaata

SEQ ID NO: 564175 - DNA, 13 bp, D. melanogaster
aatctttgaaatt

SEQ ID NO: 564176 - DNA, 13 bp, D. melanogaster
aatctttgaattt

SEQ ID NO: 564177 - DNA, 13 bp, D. melanogaster
aatctttgtaaat

SEQ ID NO: 564178 - DNA, 13 bp, D. melanogaster
aatcttttatgtt

SEQ ID NO: 564179 - DNA, 13 bp, D. melanogaster
aatcttttcaaat

SEQ ID NO: 564180 - DNA, 13 bp, D. melanogaster
aatcttttccaga

SEQ ID NO: 564181 - DNA, 13 bp, D. melanogaster
aatcttttcgaaa

SEQ ID NO: 564182 - DNA, 13 bp, D. melanogaster
aatcttttgaata

SEQ ID NO: 564183 - DNA, 14 bp, D. melanogaster
aatcttttgatttt

SEQ ID NO: 564184 - DNA, 13 bp, D. melanogaster
aatctttttcaaa

SEQ ID NO: 564185 - DNA, 13 bp, D. melanogaster
aatctttttgcca

SEQ ID NO: 564186 - DNA, 13 bp, D. melanogaster
aatgaaaaaattc

SEQ ID NO: 564187 - DNA, 14 bp, D. melanogaster
aatgaaaaacaagt

SEQ ID NO: 564188 - DNA, 13 bp, D. melanogaster
aatgaaaaacatt

SEQ ID NO: 564189 - DNA, 13 bp, D. melanogaster
aatgaaaaaccat

SEQ ID NO: 564190 - DNA, 13 bp, D. melanogaster
aatgaaaaactat

SEQ ID NO: 564191 - DNA, 13 bp, D. melanogaster
aatgaaaaagtct

SEQ ID NO: 564192 - DNA, 13 bp, D. melanogaster
aatgaaaaagtgt

SEQ ID NO: 564193 - DNA, 13 bp, D. melanogaster
aatgaaaaatgtt

SEQ ID NO: 564194 - DNA, 13 bp, D. melanogaster
aatgaaaaattca

SEQ ID NO: 564195 - DNA, 14 bp, D. melanogaster
aatgaaaaattcaa

SEQ ID NO: 564196 - DNA, 13 bp, D. melanogaster
aatgaaaaattgc

SEQ ID NO: 564197 - DNA, 13 bp, D. melanogaster
aatgaaaaatttc

SEQ ID NO: 564198 - DNA, 14 bp, D. melanogaster
aatgaaaaatttca

SEQ ID NO: 564199 - DNA, 14 bp, D. melanogaster
aatgaaaacaatca

SEQ ID NO: 564200 - DNA, 13 bp, D. melanogaster
aatgaaaacaatt

SEQ ID NO: 564201 - DNA, 14 bp, D. melanogaster
aatgaaaacaattt

SEQ ID NO: 564202 - DNA, 13 bp, D. melanogaster
aatgaaaaccaat

SEQ ID NO: 564203 - DNA, 13 bp, D. melanogaster
aatgaaaaccaga

SEQ ID NO: 564204 - DNA, 14 bp, D. melanogaster
aatgaaaacgaaac

SEQ ID NO: 564205 - DNA, 14 bp, D. melanogaster
aatgaaaacgaaag

SEQ ID NO: 564206 - DNA, 13 bp, D. melanogaster
aatgaaaacgaga

SEQ ID NO: 564207 - DNA, 13 bp, D. melanogaster
aatgaaaacggaa

SEQ ID NO: 564208 - DNA, 13 bp, D. melanogaster
aatgaaaacgttt

SEQ ID NO: 564209 - DNA, 14 bp, D. melanogaster
aatgaaaactaaat

SEQ ID NO: 564210 - DNA, 13 bp, D. melanogaster
aatgaaaactaat

SEQ ID NO: 564211 - DNA, 14 bp, D. melanogaster
aatgaaaactaatt

SEQ ID NO: 564212 - DNA, 13 bp, D. melanogaster
aatgaaaactctg

SEQ ID NO: 564213 - DNA, 13 bp, D. melanogaster
aatgaaaactctt

SEQ ID NO: 564214 - DNA, 13 bp, D. melanogaster
aatgaaaactgtt

SEQ ID NO: 564215 - DNA, 13 bp, D. melanogaster
aatgaaaacttca

SEQ ID NO: 564216 - DNA, 13 bp, D. melanogaster
aatgaaaactttg

SEQ ID NO: 564217 - DNA, 14 bp, D. melanogaster
aatgaaaactttgt

SEQ ID NO: 564218 - DNA, 13 bp, D. melanogaster
aatgaaaagacca

SEQ ID NO: 564219 - DNA, 14 bp, D. melanogaster
aatgaaaagaccat

SEQ ID NO: 564220 - DNA, 13 bp, D. melanogaster
aatgaaaagagca

SEQ ID NO: 564221 - DNA, 13 bp, D. melanogaster
aatgaaaagcaga

SEQ ID NO: 564222 - DNA, 13 bp, D. melanogaster
aatgaaaagctct

SEQ ID NO: 564223 - DNA, 13 bp, D. melanogaster
aatgaaaagctgc

SEQ ID NO: 564224 - DNA, 13 bp, D. melanogaster
aatgaaaaggaca

SEQ ID NO: 564225 - DNA, 13 bp, D. melanogaster
aatgaaaaggatt

SEQ ID NO: 564226 - DNA, 13 bp, D. melanogaster
aatgaaaaggcaa

SEQ ID NO: 564227 - DNA, 14 bp, D. melanogaster
aatgaaaagtattt

SEQ ID NO: 564228 - DNA, 13 bp, D. melanogaster
aatgaaaagtgtt

SEQ ID NO: 564229 - DNA, 13 bp, D. melanogaster
aatgaaaagttat

SEQ ID NO: 564230 - DNA, 13 bp, D. melanogaster
aatgaaaagttca

SEQ ID NO: 564231 - DNA, 13 bp, D. melanogaster
aatgaaaagttta

SEQ ID NO: 564232 - DNA, 13 bp, D. melanogaster
aatgaaaataatc

SEQ ID NO: 564233 - DNA, 13 bp, D. melanogaster
aatgaaaatattc

SEQ ID NO: 564234 - DNA, 13 bp, D. melanogaster
aatgaaaatattg

SEQ ID NO: 564235 - DNA, 14 bp, D. melanogaster
aatgaaaatatttc

SEQ ID NO: 564236 - DNA, 13 bp, D. melanogaster
aatgaaaatcaat

SEQ ID NO: 564237 - DNA, 14 bp, D. melanogaster
aatgaaaatcaatt

SEQ ID NO: 564238 - DNA, 14 bp, D. melanogaster
aatgaaaatcattt

SEQ ID NO: 564239 - DNA, 13 bp, D. melanogaster
aatgaaaatcctt

SEQ ID NO: 564240 - DNA, 13 bp, D. melanogaster
aatgaaaatcgag

SEQ ID NO: 564241 - DNA, 13 bp, D. melanogaster
aatgaaaatctat

SEQ ID NO: 564242 - DNA, 13 bp, D. melanogaster
aatgaaaatctgc

SEQ ID NO: 564243 - DNA, 13 bp, D. melanogaster
aatgaaaatcttt

SEQ ID NO: 564244 - DNA, 13 bp, D. melanogaster
aatgaaaatgatt

SEQ ID NO: 564245 - DNA, 14 bp, D. melanogaster
aatgaaaatgattt

SEQ ID NO: 564246 - DNA, 13 bp, D. melanogaster
aatgaaaatgcaa

SEQ ID NO: 564247 - DNA, 14 bp, D. melanogaster
aatgaaaatgcaaa

SEQ ID NO: 564248 - DNA, 13 bp, D. melanogaster
aatgaaaatgcac

SEQ ID NO: 564249 - DNA, 13 bp, D. melanogaster
aatgaaaatgcat

SEQ ID NO: 564250 - DNA, 13 bp, D. melanogaster
aatgaaaatgcca

SEQ ID NO: 564251 - DNA, 14 bp, D. melanogaster
aatgaaaatgccaa

SEQ ID NO: 564252 - DNA, 13 bp, D. melanogaster
aatgaaaatgccg

SEQ ID NO: 564253 - DNA, 13 bp, D. melanogaster
aatgaaaatgcct

SEQ ID NO: 564254 - DNA, 13 bp, D. melanogaster
aatgaaaatgcgt

SEQ ID NO: 564255 - DNA, 13 bp, D. melanogaster
aatgaaaatgcta

SEQ ID NO: 564256 - DNA, 13 bp, D. melanogaster
aatgaaaatgctt

SEQ ID NO: 564257 - DNA, 13 bp, D. melanogaster
aatgaaaatggat

SEQ ID NO: 564258 - DNA, 13 bp, D. melanogaster
aatgaaaatggtt

SEQ ID NO: 564259 - DNA, 13 bp, D. melanogaster
aatgaaaatgtat

SEQ ID NO: 564260 - DNA, 13 bp, D. melanogaster
aatgaaaatgtga

SEQ ID NO: 564261 - DNA, 13 bp, D. melanogaster
aatgaaaatgtgt

SEQ ID NO: 564262 - DNA, 13 bp, D. melanogaster
aatgaaaatgtta

SEQ ID NO: 564263 - DNA, 13 bp, D. melanogaster
aatgaaaatgttg

SEQ ID NO: 564264 - DNA, 13 bp, D. melanogaster
aatgaaaatgttt

SEQ ID NO: 564265 - DNA, 14 bp, D. melanogaster
aatgaaaatgtttg

SEQ ID NO: 564266 - DNA, 14 bp, D. melanogaster
aatgaaaatgtttt

SEQ ID NO: 564267 - DNA, 13 bp, D. melanogaster
aatgaaaattgat

SEQ ID NO: 564268 - DNA, 14 bp, D. melanogaster
aatgaaaattgttt

SEQ ID NO: 564269 - DNA, 13 bp, D. melanogaster
aatgaaaatttcc

SEQ ID NO: 564270 - DNA, 13 bp, D. melanogaster
aatgaaaatttgt

SEQ ID NO: 564271 - DNA, 13 bp, D. melanogaster
aatgaaaattttc

SEQ ID NO: 564272 - DNA, 13 bp, D. melanogaster
aatgaaacaaatc

SEQ ID NO: 564273 - DNA, 13 bp, D. melanogaster
aatgaaacaaatg

SEQ ID NO: 564274 - DNA, 13 bp, D. melanogaster
aatgaaacaatta

SEQ ID NO: 564275 - DNA, 13 bp, D. melanogaster
aatgaaacacaca

SEQ ID NO: 564276 - DNA, 13 bp, D. melanogaster
aatgaaacacatt

SEQ ID NO: 564277 - DNA, 13 bp, D. melanogaster
aatgaaacatatt

SEQ ID NO: 564278 - DNA, 14 bp, D. melanogaster
aatgaaacatttga

SEQ ID NO: 564279 - DNA, 13 bp, D. melanogaster
aatgaaacatttt

SEQ ID NO: 564280 - DNA, 13 bp, D. melanogaster
aatgaaaccaaca

SEQ ID NO: 564281 - DNA, 13 bp, D. melanogaster
aatgaaaccatta

SEQ ID NO: 564282 - DNA, 13 bp, D. melanogaster
aatgaaaccattt

SEQ ID NO: 564283 - DNA, 13 bp, D. melanogaster
aatgaaacccgaa

SEQ ID NO: 564284 - DNA, 13 bp, D. melanogaster
aatgaaaccgaaa

SEQ ID NO: 564285 - DNA, 13 bp, D. melanogaster
aatgaaacctttt

SEQ ID NO: 564286 - DNA, 13 bp, D. melanogaster
aatgaaacgaaat

SEQ ID NO: 564287 - DNA, 13 bp, D. melanogaster
aatgaaacggaat

SEQ ID NO: 564288 - DNA, 13 bp, D. melanogaster
aatgaaacgtttt

SEQ ID NO: 564289 - DNA, 13 bp, D. melanogaster
aatgaaactcaaa

SEQ ID NO: 564290 - DNA, 13 bp, D. melanogaster
aatgaaactgaaa

SEQ ID NO: 564291 - DNA, 14 bp, D. melanogaster
aatgaaactgaaac

SEQ ID NO: 564292 - DNA, 13 bp, D. melanogaster
aatgaaactgaat

SEQ ID NO: 564293 - DNA, 13 bp, D. melanogaster
aatgaaactgatt

SEQ ID NO: 564294 - DNA, 13 bp, D. melanogaster
aatgaaactgttt

SEQ ID NO: 564295 - DNA, 13 bp, D. melanogaster
aatgaaacttatt

SEQ ID NO: 564296 - DNA, 13 bp, D. melanogaster
aatgaaactttaa

SEQ ID NO: 564297 - DNA, 13 bp, D. melanogaster
aatgaaactttcc

SEQ ID NO: 564298 - DNA, 13 bp, D. melanogaster
aatgaaagacaac

SEQ ID NO: 564299 - DNA, 13 bp, D. melanogaster
aatgaaagatttt

SEQ ID NO: 564300 - DNA, 13 bp, D. melanogaster
aatgaaagcaatt

SEQ ID NO: 564301 - DNA, 13 bp, D. melanogaster
aatgaaagcataa

SEQ ID NO: 564302 - DNA, 13 bp, D. melanogaster
aatgaaagccaaa

SEQ ID NO: 564303 - DNA, 13 bp, D. melanogaster
aatgaaagcgaaa

SEQ ID NO: 564304 - DNA, 14 bp, D. melanogaster
aatgaaagcgaaat

SEQ ID NO: 564305 - DNA, 13 bp, D. melanogaster
aatgaaaggaaac

SEQ ID NO: 564306 - DNA, 13 bp, D. melanogaster
aatgaaaggatat

SEQ ID NO: 564307 - DNA, 13 bp, D. melanogaster
aatgaaaggattt

SEQ ID NO: 564308 - DNA, 13 bp, D. melanogaster
aatgaaagtaagg

SEQ ID NO: 564309 - DNA, 13 bp, D. melanogaster
aatgaaagtattt

SEQ ID NO: 564310 - DNA, 13 bp, D. melanogaster
aatgaaagtgaat

SEQ ID NO: 564311 - DNA, 13 bp, D. melanogaster
aatgaaagtgcaa

SEQ ID NO: 564312 - DNA, 13 bp, D. melanogaster
aatgaaagtgctg

SEQ ID NO: 564313 - DNA, 13 bp, D. melanogaster
aatgaaagttaat

SEQ ID NO: 564314 - DNA, 13 bp, D. melanogaster
aatgaaataaagc

SEQ ID NO: 564315 - DNA, 13 bp, D. melanogaster
aatgaaataagtg

SEQ ID NO: 564316 - DNA, 13 bp, D. melanogaster
aatgaaataattc

SEQ ID NO: 564317 - DNA, 13 bp, D. melanogaster
aatgaaatacaat

SEQ ID NO: 564318 - DNA, 13 bp, D. melanogaster
aatgaaatacaca

SEQ ID NO: 564319 - DNA, 13 bp, D. melanogaster
aatgaaatacata

SEQ ID NO: 564320 - DNA, 14 bp, D. melanogaster
aatgaaatacattt

SEQ ID NO: 564321 - DNA, 14 bp, D. melanogaster
aatgaaataccatt

SEQ ID NO: 564322 - DNA, 13 bp, D. melanogaster
aatgaaatatatg

SEQ ID NO: 564323 - DNA, 13 bp, D. melanogaster
aatgaaatatgta

SEQ ID NO: 564324 - DNA, 13 bp, D. melanogaster
aatgaaatattga

SEQ ID NO: 564325 - DNA, 14 bp, D. melanogaster
aatgaaatattttc

SEQ ID NO: 564326 - DNA, 14 bp, D. melanogaster
aatgaaatcaaaat

SEQ ID NO: 564327 - DNA, 13 bp, D. melanogaster
aatgaaatcaaag

SEQ ID NO: 564328 - DNA, 13 bp, D. melanogaster
aatgaaatcaaat

SEQ ID NO: 564329 - DNA, 14 bp, D. melanogaster
aatgaaatcaaatt

SEQ ID NO: 564330 - DNA, 13 bp, D. melanogaster
aatgaaatcaagc

SEQ ID NO: 564331 - DNA, 13 bp, D. melanogaster
aatgaaatcaagt

SEQ ID NO: 564332 - DNA, 13 bp, D. melanogaster
aatgaaatcaata

SEQ ID NO: 564333 - DNA, 14 bp, D. melanogaster
aatgaaatcaataa

SEQ ID NO: 564334 - DNA, 13 bp, D. melanogaster
aatgaaatcaatt

SEQ ID NO: 564335 - DNA, 15 bp, D. melanogaster
aatgaaatcagagag

SEQ ID NO: 564336 - DNA, 13 bp, D. melanogaster
aatgaaatcagca

SEQ ID NO: 564337 - DNA, 13 bp, D. melanogaster
aatgaaatcataa

SEQ ID NO: 564338 - DNA, 14 bp, D. melanogaster
aatgaaatcataaa

SEQ ID NO: 564339 - DNA, 13 bp, D. melanogaster
aatgaaatcatca

SEQ ID NO: 564340 - DNA, 13 bp, D. melanogaster
aatgaaatcattt

SEQ ID NO: 564341 - DNA, 14 bp, D. melanogaster
aatgaaatcattta

SEQ ID NO: 564342 - DNA, 13 bp, D. melanogaster
aatgaaatccaag

SEQ ID NO: 564343 - DNA, 13 bp, D. melanogaster
aatgaaatcgaaa

SEQ ID NO: 564344 - DNA, 14 bp, D. melanogaster
aatgaaatcgaaaa

SEQ ID NO: 564345 - DNA, 14 bp, D. melanogaster
aatgaaatcgaaat

SEQ ID NO: 564346 - DNA, 13 bp, D. melanogaster
aatgaaatctaaa

SEQ ID NO: 564347 - DNA, 13 bp, D. melanogaster
aatgaaatctttt

SEQ ID NO: 564348 - DNA, 14 bp, D. melanogaster
aatgaaatgaaatg

SEQ ID NO: 564349 - DNA, 13 bp, D. melanogaster
aatgaaatgaatg

SEQ ID NO: 564350 - DNA, 14 bp, D. melanogaster
aatgaaatgaattg

SEQ ID NO: 564351 - DNA, 13 bp, D. melanogaster
aatgaaatgagct

SEQ ID NO: 564352 - DNA, 13 bp, D. melanogaster
aatgaaatgattt

SEQ ID NO: 564353 - DNA, 14 bp, D. melanogaster
aatgaaatgatttc

SEQ ID NO: 564354 - DNA, 14 bp, D. melanogaster
aatgaaatgcaatt

SEQ ID NO: 564355 - DNA, 13 bp, D. melanogaster
aatgaaatgcgaa

SEQ ID NO: 564356 - DNA, 14 bp, D. melanogaster
aatgaaatggaatt

SEQ ID NO: 564357 - DNA, 13 bp, D. melanogaster
aatgaaatggcct

SEQ ID NO: 564358 - DNA, 13 bp, D. melanogaster
aatgaaatgggaa

SEQ ID NO: 564359 - DNA, 13 bp, D. melanogaster
aatgaaatgggat

SEQ ID NO: 564360 - DNA, 13 bp, D. melanogaster
aatgaaatggttt

SEQ ID NO: 564361 - DNA, 13 bp, D. melanogaster
aatgaaatgtaat

SEQ ID NO: 564362 - DNA, 14 bp, D. melanogaster
aatgaaatgtaatt

SEQ ID NO: 564363 - DNA, 13 bp, D. melanogaster
aatgaaatgtatt

SEQ ID NO: 564364 - DNA, 14 bp, D. melanogaster
aatgaaatgtattt

SEQ ID NO: 564365 - DNA, 13 bp, D. melanogaster
aatgaaatgtcaa

SEQ ID NO: 564366 - DNA, 13 bp, D. melanogaster
aatgaaatgtgaa

SEQ ID NO: 564367 - DNA, 13 bp, D. melanogaster
aatgaaatgtgca

SEQ ID NO: 564368 - DNA, 13 bp, D. melanogaster
aatgaaatgtgta

SEQ ID NO: 564369 - DNA, 13 bp, D. melanogaster
aatgaaatgttta

SEQ ID NO: 564370 - DNA, 13 bp, D. melanogaster
aatgaaatgtttt

SEQ ID NO: 564371 - DNA, 13 bp, D. melanogaster
aatgaaattaagc

SEQ ID NO: 564372 - DNA, 13 bp, D. melanogaster
aatgaaattacat

SEQ ID NO: 564373 - DNA, 13 bp, D. melanogaster
aatgaaattagat

SEQ ID NO: 564374 - DNA, 13 bp, D. melanogaster
aatgaaattatca

SEQ ID NO: 564375 - DNA, 13 bp, D. melanogaster
aatgaaattcatt

SEQ ID NO: 564376 - DNA, 13 bp, D. melanogaster
aatgaaattccaa

SEQ ID NO: 564377 - DNA, 13 bp, D. melanogaster
aatgaaattccat

SEQ ID NO: 564378 - DNA, 13 bp, D. melanogaster
aatgaaattgaca

SEQ ID NO: 564379 - DNA, 13 bp, D. melanogaster
aatgaaattgata

SEQ ID NO: 564380 - DNA, 13 bp, D. melanogaster
aatgaaattgcaa

SEQ ID NO: 564381 - DNA, 13 bp, D. melanogaster
aatgaaattgcca

SEQ ID NO: 564382 - DNA, 13 bp, D. melanogaster
aatgaaattgtaa

SEQ ID NO: 564383 - DNA, 13 bp, D. melanogaster
aatgaaattgtgt

SEQ ID NO: 564384 - DNA, 13 bp, D. melanogaster
aatgaaattgtta

SEQ ID NO: 564385 - DNA, 13 bp, D. melanogaster
aatgaaattgttt

SEQ ID NO: 564386 - DNA, 14 bp, D. melanogaster
aatgaaatttatgt

SEQ ID NO: 564387 - DNA, 14 bp, D. melanogaster
aatgaaatttcgcg

SEQ ID NO: 564388 - DNA, 14 bp, D. melanogaster
aatgaaatttgcat

SEQ ID NO: 564389 - DNA, 13 bp, D. melanogaster
aatgaaattttag

SEQ ID NO: 564390 - DNA, 13 bp, D. melanogaster
aatgaaattttca

SEQ ID NO: 564391 - DNA, 13 bp, D. melanogaster
aatgaaattttgt

SEQ ID NO: 564392 - DNA, 13 bp, D. melanogaster
aatgaacacggcg

SEQ ID NO: 564393 - DNA, 13 bp, D. melanogaster
aatgaacagcaaa

SEQ ID NO: 564394 - DNA, 13 bp, D. melanogaster
aatgaacataaat

SEQ ID NO: 564395 - DNA, 14 bp, D. melanogaster
aatgaacatgccga

SEQ ID NO: 564396 - DNA, 13 bp, D. melanogaster
aatgaacattttc

SEQ ID NO: 564397 - DNA, 13 bp, D. melanogaster
aatgaactaacta

SEQ ID NO: 564398 - DNA, 13 bp, D. melanogaster
aatgaactcaaat

SEQ ID NO: 564399 - DNA, 13 bp, D. melanogaster
aatgaactgaaaa

SEQ ID NO: 564400 - DNA, 13 bp, D. melanogaster
aatgaactgagaa

SEQ ID NO: 564401 - DNA, 13 bp, D. melanogaster
aatgaactgtgtg

SEQ ID NO: 564402 - DNA, 13 bp, D. melanogaster
aatgaacttcaaa

SEQ ID NO: 564403 - DNA, 13 bp, D. melanogaster
aatgaacttgaaa

SEQ ID NO: 564404 - DNA, 13 bp, D. melanogaster
aatgaactttttc

SEQ ID NO: 564405 - DNA, 13 bp, D. melanogaster
aatgaagacatta

SEQ ID NO: 564406 - DNA, 13 bp, D. melanogaster
aatgaagacgttc

SEQ ID NO: 564407 - DNA, 13 bp, D. melanogaster
aatgaagaggata

SEQ ID NO: 564408 - DNA, 13 bp, D. melanogaster
aatgaagatattt

SEQ ID NO: 564409 - DNA, 13 bp, D. melanogaster
aatgaagatgaag

SEQ ID NO: 564410 - DNA, 13 bp, D. melanogaster
aatgaagattaat

SEQ ID NO: 564411 - DNA, 13 bp, D. melanogaster
aatgaagatttat

SEQ ID NO: 564412 - DNA, 13 bp, D. melanogaster
aatgaagccaaaa

SEQ ID NO: 564413 - DNA, 13 bp, D. melanogaster
aatgaagccaaag

SEQ ID NO: 564414 - DNA, 13 bp, D. melanogaster
aatgaagcgaaat

SEQ ID NO: 564415 - DNA, 13 bp, D. melanogaster
aatgaagcggaaa

SEQ ID NO: 564416 - DNA, 15 bp, D. melanogaster
aatgaagggcaacaa

SEQ ID NO: 564417 - DNA, 13 bp, D. melanogaster
aatgaagtgaatt

SEQ ID NO: 564418 - DNA, 13 bp, D. melanogaster
aatgaagtgcaaa

SEQ ID NO: 564419 - DNA, 13 bp, D. melanogaster
aatgaagtggaat

SEQ ID NO: 564420 - DNA, 13 bp, D. melanogaster
aatgaagttttat

SEQ ID NO: 564421 - DNA, 13 bp, D. melanogaster
aatgaataaaact

SEQ ID NO: 564422 - DNA, 13 bp, D. melanogaster
aatgaataaattg

SEQ ID NO: 564423 - DNA, 14 bp, D. melanogaster
aatgaataaatttg

SEQ ID NO: 564424 - DNA, 13 bp, D. melanogaster
aatgaatacaaat

SEQ ID NO: 564425 - DNA, 13 bp, D. melanogaster
aatgaatacacta

SEQ ID NO: 564426 - DNA, 14 bp, D. melanogaster
aatgaatacatttt

SEQ ID NO: 564427 - DNA, 13 bp, D. melanogaster
aatgaatacgaaa

SEQ ID NO: 564428 - DNA, 13 bp, D. melanogaster
aatgaatacttta

SEQ ID NO: 564429 - DNA, 13 bp, D. melanogaster
aatgaatataatg

SEQ ID NO: 564430 - DNA, 13 bp, D. melanogaster
aatgaatatgaat

SEQ ID NO: 564431 - DNA, 14 bp, D. melanogaster
aatgaatatgcaaa

SEQ ID NO: 564432 - DNA, 13 bp, D. melanogaster
aatgaatatgcag

SEQ ID NO: 564433 - DNA, 13 bp, D. melanogaster
aatgaatatgcca

SEQ ID NO: 564434 - DNA, 13 bp, D. melanogaster
aatgaatatgtat

SEQ ID NO: 564435 - DNA, 13 bp, D. melanogaster
aatgaatattctt

SEQ ID NO: 564436 - DNA, 13 bp, D. melanogaster
aatgaatattgaa

SEQ ID NO: 564437 - DNA, 13 bp, D. melanogaster
aatgaatatttga

SEQ ID NO: 564438 - DNA, 13 bp, D. melanogaster
aatgaatcaaaat

SEQ ID NO: 564439 - DNA, 13 bp, D. melanogaster
aatgaatcaaatg

SEQ ID NO: 564440 - DNA, 13 bp, D. melanogaster
aatgaatcatttg

SEQ ID NO: 564441 - DNA, 13 bp, D. melanogaster
aatgaatcgaaat

SEQ ID NO: 564442 - DNA, 13 bp, D. melanogaster
aatgaatcgattt

SEQ ID NO: 564443 - DNA, 13 bp, D. melanogaster
aatgaatctttgt

SEQ ID NO: 564444 - DNA, 13 bp, D. melanogaster
aatgaatgaaatg

SEQ ID NO: 564445 - DNA, 14 bp, D. melanogaster
aatgaatgaaatgc

SEQ ID NO: 564446 - DNA, 13 bp, D. melanogaster
aatgaatgaacga

SEQ ID NO: 564447 - DNA, 13 bp, D. melanogaster
aatgaatgaatat

SEQ ID NO: 564448 - DNA, 13 bp, D. melanogaster
aatgaatgaatga

SEQ ID NO: 564449 - DNA, 14 bp, D. melanogaster
aatgaatgaatgaa

SEQ ID NO: 564450 - DNA, 13 bp, D. melanogaster
aatgaatgaatgc

SEQ ID NO: 564451 - DNA, 13 bp, D. melanogaster
aatgaatgaatgg

SEQ ID NO: 564452 - DNA, 14 bp, D. melanogaster
aatgaatgaatggg

SEQ ID NO: 564453 - DNA, 13 bp, D. melanogaster
aatgaatgacatt

SEQ ID NO: 564454 - DNA, 13 bp, D. melanogaster
aatgaatgatttt

SEQ ID NO: 564455 - DNA, 13 bp, D. melanogaster
aatgaatgcaatt

SEQ ID NO: 564456 - DNA, 13 bp, D. melanogaster
aatgaatgcagca

SEQ ID NO: 564457 - DNA, 13 bp, D. melanogaster
aatgaatgcataa

SEQ ID NO: 564458 - DNA, 13 bp, D. melanogaster
aatgaatgcattt

SEQ ID NO: 564459 - DNA, 13 bp, D. melanogaster
aatgaatgccaaa

SEQ ID NO: 564460 - DNA, 13 bp, D. melanogaster
aatgaatgctttt

SEQ ID NO: 564461 - DNA, 13 bp, D. melanogaster
aatgaatggaata

SEQ ID NO: 564462 - DNA, 13 bp, D. melanogaster
aatgaatggcaaa

SEQ ID NO: 564463 - DNA, 13 bp, D. melanogaster
aatgaatgggaat

SEQ ID NO: 564464 - DNA, 13 bp, D. melanogaster
aatgaatgtaaat

SEQ ID NO: 564465 - DNA, 13 bp, D. melanogaster
aatgaatgtagaa

SEQ ID NO: 564466 - DNA, 13 bp, D. melanogaster
aatgaatgtgaat

SEQ ID NO: 564467 - DNA, 13 bp, D. melanogaster
aatgaatgtgttt

SEQ ID NO: 564468 - DNA, 13 bp, D. melanogaster
aatgaattaaaca

SEQ ID NO: 564469 - DNA, 14 bp, D. melanogaster
aatgaattaacatt

SEQ ID NO: 564470 - DNA, 13 bp, D. melanogaster
aatgaattaagtt

SEQ ID NO: 564471 - DNA, 13 bp, D. melanogaster
aatgaattacttt

SEQ ID NO: 564472 - DNA, 13 bp, D. melanogaster
aatgaattatgat

SEQ ID NO: 564473 - DNA, 13 bp, D. melanogaster
aatgaattcaaat

SEQ ID NO: 564474 - DNA, 13 bp, D. melanogaster
aatgaattcaatt

SEQ ID NO: 564475 - DNA, 13 bp, D. melanogaster
aatgaattcgatt

SEQ ID NO: 564476 - DNA, 13 bp, D. melanogaster
aatgaattctcca

SEQ ID NO: 564477 - DNA, 13 bp, D. melanogaster
aatgaattgaatg

SEQ ID NO: 564478 - DNA, 13 bp, D. melanogaster
aatgaattgaatt

SEQ ID NO: 564479 - DNA, 13 bp, D. melanogaster
aatgaattgcatt

SEQ ID NO: 564480 - DNA, 14 bp, D. melanogaster
aatgaattgcattt

SEQ ID NO: 564481 - DNA, 13 bp, D. melanogaster
aatgaattgctgc

SEQ ID NO: 564482 - DNA, 13 bp, D. melanogaster
aatgaattgtaat

SEQ ID NO: 564483 - DNA, 13 bp, D. melanogaster
aatgaattgttaa

SEQ ID NO: 564484 - DNA, 14 bp, D. melanogaster
aatgaatttaaatg

SEQ ID NO: 564485 - DNA, 13 bp, D. melanogaster
aatgaatttaatg

SEQ ID NO: 564486 - DNA, 13 bp, D. melanogaster
aatgaatttagtt

SEQ ID NO: 564487 - DNA, 13 bp, D. melanogaster
aatgaatttatga

SEQ ID NO: 564488 - DNA, 14 bp, D. melanogaster
aatgaatttcaaat

SEQ ID NO: 564489 - DNA, 13 bp, D. melanogaster
aatgaatttcatt

SEQ ID NO: 564490 - DNA, 13 bp, D. melanogaster
aatgaatttcgcg

SEQ ID NO: 564491 - DNA, 13 bp, D. melanogaster
aatgaatttgaat

SEQ ID NO: 564492 - DNA, 13 bp, D. melanogaster
aatgaatttgcca

SEQ ID NO: 564493 - DNA, 13 bp, D. melanogaster
aatgaatttgtat

SEQ ID NO: 564494 - DNA, 13 bp, D. melanogaster
aatgaatttttca

SEQ ID NO: 564495 - DNA, 13 bp, D. melanogaster
aatgacaaaggca

SEQ ID NO: 564496 - DNA, 13 bp, D. melanogaster
aatgacaaataat

SEQ ID NO: 564497 - DNA, 13 bp, D. melanogaster
aatgacaaatatt

SEQ ID NO: 564498 - DNA, 13 bp, D. melanogaster
aatgacaaattga

SEQ ID NO: 564499 - DNA, 13 bp, D. melanogaster
aatgacaacaaat

SEQ ID NO: 564500 - DNA, 14 bp, D. melanogaster
aatgacaacaacaa

SEQ ID NO: 564501 - DNA, 13 bp, D. melanogaster
aatgacaacaatg

SEQ ID NO: 564502 - DNA, 13 bp, D. melanogaster
aatgacaacattt

SEQ ID NO: 564503 - DNA, 13 bp, D. melanogaster
aatgacaacgaaa

SEQ ID NO: 564504 - DNA, 13 bp, D. melanogaster
aatgacaacggca

SEQ ID NO: 564505 - DNA, 13 bp, D. melanogaster
aatgacaatataa

SEQ ID NO: 564506 - DNA, 13 bp, D. melanogaster
aatgacaatcaaa

SEQ ID NO: 564507 - DNA, 13 bp, D. melanogaster
aatgacaatggca

SEQ ID NO: 564508 - DNA, 13 bp, D. melanogaster
aatgacaatttat

SEQ ID NO: 564509 - DNA, 13 bp, D. melanogaster
aatgacaattttc

SEQ ID NO: 564510 - DNA, 13 bp, D. melanogaster
aatgacacaaaga

SEQ ID NO: 564511 - DNA, 13 bp, D. melanogaster
aatgacacataaa

SEQ ID NO: 564512 - DNA, 13 bp, D. melanogaster
aatgacactttaa

SEQ ID NO: 564513 - DNA, 13 bp, D. melanogaster
aatgacagcagca

SEQ ID NO: 564514 - DNA, 13 bp, D. melanogaster
aatgacagcggca

SEQ ID NO: 564515 - DNA, 13 bp, D. melanogaster
aatgacaggcaga

SEQ ID NO: 564516 - DNA, 14 bp, D. melanogaster
aatgacatcatatt

SEQ ID NO: 564517 - DNA, 13 bp, D. melanogaster
aatgacattaaaa

SEQ ID NO: 564518 - DNA, 13 bp, D. melanogaster
aatgacatttaaa

SEQ ID NO: 564519 - DNA, 13 bp, D. melanogaster
aatgacatttgca

SEQ ID NO: 564520 - DNA, 13 bp, D. melanogaster
aatgacattttgc

SEQ ID NO: 564521 - DNA, 13 bp, D. melanogaster
aatgacattttta

SEQ ID NO: 564522 - DNA, 13 bp, D. melanogaster
aatgacatttttt

SEQ ID NO: 564523 - DNA, 14 bp, D. melanogaster
aatgaccacaacga

SEQ ID NO: 564524 - DNA, 13 bp, D. melanogaster
aatgacctcaact

SEQ ID NO: 564525 - DNA, 13 bp, D. melanogaster
aatgacgatgatg

SEQ ID NO: 564526 - DNA, 14 bp, D. melanogaster
aatgacgatgatga

SEQ ID NO: 564527 - DNA, 13 bp, D. melanogaster
aatgacggaagcc

SEQ ID NO: 564528 - DNA, 13 bp, D. melanogaster
aatgacgttatat

SEQ ID NO: 564529 - DNA, 13 bp, D. melanogaster
aatgactattcac

SEQ ID NO: 564530 - DNA, 13 bp, D. melanogaster
aatgactcgatat

SEQ ID NO: 564531 - DNA, 13 bp, D. melanogaster
aatgactggagct

SEQ ID NO: 564532 - DNA, 13 bp, D. melanogaster
aatgactggctga

SEQ ID NO: 564533 - DNA, 13 bp, D. melanogaster
aatgactttaaaa

SEQ ID NO: 564534 - DNA, 13 bp, D. melanogaster
aatgactttaatt

SEQ ID NO: 564535 - DNA, 13 bp, D. melanogaster
aatgactttatat

SEQ ID NO: 564536 - DNA, 13 bp, D. melanogaster
aatgacttttcta

SEQ ID NO: 564537 - DNA, 13 bp, D. melanogaster
aatgacttttggc

SEQ ID NO: 564538 - DNA, 13 bp, D. melanogaster
aatgagaaaattg

SEQ ID NO: 564539 - DNA, 13 bp, D. melanogaster
aatgagaaatgag

SEQ ID NO: 564540 - DNA, 13 bp, D. melanogaster
aatgagaaatgtg

SEQ ID NO: 564541 - DNA, 13 bp, D. melanogaster
aatgagaaattgt

SEQ ID NO: 564542 - DNA, 15 bp, D. melanogaster
aatgagaaattgtcg

SEQ ID NO: 564543 - DNA, 13 bp, D. melanogaster
aatgagaacattt

SEQ ID NO: 564544 - DNA, 13 bp, D. melanogaster
aatgagaacgaga

SEQ ID NO: 564545 - DNA, 13 bp, D. melanogaster
aatgagaatgaga

SEQ ID NO: 564546 - DNA, 13 bp, D. melanogaster
aatgagaatggga

SEQ ID NO: 564547 - DNA, 13 bp, D. melanogaster
aatgagacccact

SEQ ID NO: 564548 - DNA, 13 bp, D. melanogaster
aatgagacctaca

SEQ ID NO: 564549 - DNA, 14 bp, D. melanogaster
aatgagacgataat

SEQ ID NO: 564550 - DNA, 13 bp, D. melanogaster
aatgagaggcagt

SEQ ID NO: 564551 - DNA, 13 bp, D. melanogaster
aatgagatgagat

SEQ ID NO: 564552 - DNA, 13 bp, D. melanogaster
aatgagatggaaa

SEQ ID NO: 564553 - DNA, 13 bp, D. melanogaster
aatgagattttaa

SEQ ID NO: 564554 - DNA, 13 bp, D. melanogaster
aatgagattttta

SEQ ID NO: 564555 - DNA, 13 bp, D. melanogaster
aatgagcaaaaca

SEQ ID NO: 564556 - DNA, 13 bp, D. melanogaster
aatgagcaaaatg

SEQ ID NO: 564557 - DNA, 13 bp, D. melanogaster
aatgagcaattaa

SEQ ID NO: 564558 - DNA, 13 bp, D. melanogaster
aatgagcagcgaa

SEQ ID NO: 564559 - DNA, 13 bp, D. melanogaster
aatgagcaggaaa

SEQ ID NO: 564560 - DNA, 13 bp, D. melanogaster
aatgagctgcaat

SEQ ID NO: 564561 - DNA, 13 bp, D. melanogaster
aatgagctgcatt

SEQ ID NO: 564562 - DNA, 13 bp, D. melanogaster
aatgagctggaaa

SEQ ID NO: 564563 - DNA, 13 bp, D. melanogaster
aatgaggaaagta

SEQ ID NO: 564564 - DNA, 13 bp, D. melanogaster
aatgaggaaatca

SEQ ID NO: 564565 - DNA, 14 bp, D. melanogaster
aatgaggagaagcc

SEQ ID NO: 564566 - DNA, 13 bp, D. melanogaster
aatgaggcaacaa

SEQ ID NO: 564567 - DNA, 13 bp, D. melanogaster
aatgagtatgcag

SEQ ID NO: 564568 - DNA, 13 bp, D. melanogaster
aatgagtgaaaga

SEQ ID NO: 564569 - DNA, 13 bp, D. melanogaster
aatgagttaagaa

SEQ ID NO: 564570 - DNA, 13 bp, D. melanogaster
aatgagttaatta

SEQ ID NO: 564571 - DNA, 13 bp, D. melanogaster
aatgagttaattt

SEQ ID NO: 564572 - DNA, 13 bp, D. melanogaster
aatgagttcaatt

SEQ ID NO: 564573 - DNA, 13 bp, D. melanogaster
aatgagttcattt

SEQ ID NO: 564574 - DNA, 13 bp, D. melanogaster
aatgagttggaaa

SEQ ID NO: 564575 - DNA, 13 bp, D. melanogaster
aatgagttggcca

SEQ ID NO: 564576 - DNA, 13 bp, D. melanogaster
aatgagtttaatg

SEQ ID NO: 564577 - DNA, 13 bp, D. melanogaster
aatgagtttatta

SEQ ID NO: 564578 - DNA, 13 bp, D. melanogaster
aatgagttttcaa

SEQ ID NO: 564579 - DNA, 13 bp, D. melanogaster
aatgagttttccg

SEQ ID NO: 564580 - DNA, 13 bp, D. melanogaster
aatgagttttgaa

SEQ ID NO: 564581 - DNA, 13 bp, D. melanogaster
aatgagtttttca

SEQ ID NO: 564582 - DNA, 13 bp, D. melanogaster
aatgagtttttga

SEQ ID NO: 564583 - DNA, 13 bp, D. melanogaster
aatgagttttttg

SEQ ID NO: 564584 - DNA, 13 bp, D. melanogaster
aatgataaatgca

SEQ ID NO: 564585 - DNA, 13 bp, D. melanogaster
aatgataaatgga

SEQ ID NO: 564586 - DNA, 13 bp, D. melanogaster
aatgataaatgtg

SEQ ID NO: 564587 - DNA, 13 bp, D. melanogaster
aatgataagaacc

SEQ ID NO: 564588 - DNA, 13 bp, D. melanogaster
aatgataataatg

SEQ ID NO: 564589 - DNA, 13 bp, D. melanogaster
aatgataatcaaa

SEQ ID NO: 564590 - DNA, 13 bp, D. melanogaster
aatgataatgatt

SEQ ID NO: 564591 - DNA, 14 bp, D. melanogaster
aatgataatgcatg

SEQ ID NO: 564592 - DNA, 13 bp, D. melanogaster
aatgataatgctg

SEQ ID NO: 564593 - DNA, 13 bp, D. melanogaster
aatgataatggta

SEQ ID NO: 564594 - DNA, 13 bp, D. melanogaster
aatgataattgaa

SEQ ID NO: 564595 - DNA, 13 bp, D. melanogaster
aatgataatttgt

SEQ ID NO: 564596 - DNA, 13 bp, D. melanogaster
aatgatacaaaat

SEQ ID NO: 564597 - DNA, 13 bp, D. melanogaster
aatgatacagtta

SEQ ID NO: 564598 - DNA, 13 bp, D. melanogaster
aatgatacatttt

SEQ ID NO: 564599 - DNA, 13 bp, D. melanogaster
aatgataccatca

SEQ ID NO: 564600 - DNA, 13 bp, D. melanogaster
aatgatatataca

SEQ ID NO: 564601 - DNA, 13 bp, D. melanogaster
aatgatatatgta

SEQ ID NO: 564602 - DNA, 14 bp, D. melanogaster
aatgatatatgtat

SEQ ID NO: 564603 - DNA, 13 bp, D. melanogaster
aatgatatgtatt

SEQ ID NO: 564604 - DNA, 13 bp, D. melanogaster
aatgatattcaaa

SEQ ID NO: 564605 - DNA, 13 bp, D. melanogaster
aatgatatttatg

SEQ ID NO: 564606 - DNA, 13 bp, D. melanogaster
aatgatattttgt

SEQ ID NO: 564607 - DNA, 13 bp, D. melanogaster
aatgatcaaaaat

SEQ ID NO: 564608 - DNA, 15 bp, D. melanogaster
aatgatcaaagtgtg

SEQ ID NO: 564609 - DNA, 13 bp, D. melanogaster
aatgatcaattta

SEQ ID NO: 564610 - DNA, 13 bp, D. melanogaster
aatgatcagaaaa

SEQ ID NO: 564611 - DNA, 13 bp, D. melanogaster
aatgatctgatcg

SEQ ID NO: 564612 - DNA, 13 bp, D. melanogaster
aatgatgaaaaca

SEQ ID NO: 564613 - DNA, 13 bp, D. melanogaster
aatgatgaaatga

SEQ ID NO: 564614 - DNA, 13 bp, D. melanogaster
aatgatgaatact

SEQ ID NO: 564615 - DNA, 13 bp, D. melanogaster
aatgatgaatgaa

SEQ ID NO: 564616 - DNA, 13 bp, D. melanogaster
aatgatgaattaa

SEQ ID NO: 564617 - DNA, 13 bp, D. melanogaster
aatgatgagtcgc

SEQ ID NO: 564618 - DNA, 13 bp, D. melanogaster
aatgatgagtttt

SEQ ID NO: 564619 - DNA, 13 bp, D. melanogaster
aatgatgataaat

SEQ ID NO: 564620 - DNA, 13 bp, D. melanogaster
aatgatgataagg

SEQ ID NO: 564621 - DNA, 13 bp, D. melanogaster
aatgatgataatg

SEQ ID NO: 564622 - DNA, 13 bp, D. melanogaster
aatgatgatatag

SEQ ID NO: 564623 - DNA, 13 bp, D. melanogaster
aatgatgatgaaa

SEQ ID NO: 564624 - DNA, 13 bp, D. melanogaster
aatgatgatgaag

SEQ ID NO: 564625 - DNA, 13 bp, D. melanogaster
aatgatgatgatg

SEQ ID NO: 564626 - DNA, 14 bp, D. melanogaster
aatgatgatgatga

SEQ ID NO: 564627 - DNA, 13 bp, D. melanogaster
aatgatgatgatt

SEQ ID NO: 564628 - DNA, 13 bp, D. melanogaster
aatgatgctcttt

SEQ ID NO: 564629 - DNA, 13 bp, D. melanogaster
aatgatggaaaat

SEQ ID NO: 564630 - DNA, 13 bp, D. melanogaster
aatgatgggaaaa

SEQ ID NO: 564631 - DNA, 13 bp, D. melanogaster
aatgatgtcaata

SEQ ID NO: 564632 - DNA, 13 bp, D. melanogaster
aatgatgtggaaa

SEQ ID NO: 564633 - DNA, 13 bp, D. melanogaster
aatgatgttcaaa

SEQ ID NO: 564634 - DNA, 13 bp, D. melanogaster
aatgattaaaaac

SEQ ID NO: 564635 - DNA, 14 bp, D. melanogaster
aatgattaaatcaa

SEQ ID NO: 564636 - DNA, 13 bp, D. melanogaster
aatgattaaatga

SEQ ID NO: 564637 - DNA, 13 bp, D. melanogaster
aatgattaaatgt

SEQ ID NO: 564638 - DNA, 13 bp, D. melanogaster
aatgattacaatt

SEQ ID NO: 564639 - DNA, 13 bp, D. melanogaster
aatgattacattt

SEQ ID NO: 564640 - DNA, 13 bp, D. melanogaster
aatgattactttt

SEQ ID NO: 564641 - DNA, 13 bp, D. melanogaster
aatgattatgaaa

SEQ ID NO: 564642 - DNA, 13 bp, D. melanogaster
aatgattcaaaaa

SEQ ID NO: 564643 - DNA, 13 bp, D. melanogaster
aatgattcacttt

SEQ ID NO: 564644 - DNA, 13 bp, D. melanogaster
aatgattcattta

SEQ ID NO: 564645 - DNA, 13 bp, D. melanogaster
aatgattccaatt

SEQ ID NO: 564646 - DNA, 14 bp, D. melanogaster
aatgattcgctttt

SEQ ID NO: 564647 - DNA, 13 bp, D. melanogaster
aatgattgaatga

SEQ ID NO: 564648 - DNA, 13 bp, D. melanogaster
aatgattgcagca

SEQ ID NO: 564649 - DNA, 13 bp, D. melanogaster
aatgattgcattt

SEQ ID NO: 564650 - DNA, 13 bp, D. melanogaster
aatgattgttgag

SEQ ID NO: 564651 - DNA, 13 bp, D. melanogaster
aatgatttaaagt

SEQ ID NO: 564652 - DNA, 13 bp, D. melanogaster
aatgatttaattg

SEQ ID NO: 564653 - DNA, 13 bp, D. melanogaster
aatgatttacata

SEQ ID NO: 564654 - DNA, 13 bp, D. melanogaster
aatgatttagaca

SEQ ID NO: 564655 - DNA, 13 bp, D. melanogaster
aatgatttcaatg

SEQ ID NO: 564656 - DNA, 13 bp, D. melanogaster
aatgatttcataa

SEQ ID NO: 564657 - DNA, 14 bp, D. melanogaster
aatgatttcatatt

SEQ ID NO: 564658 - DNA, 14 bp, D. melanogaster
aatgatttcatttt

SEQ ID NO: 564659 - DNA, 13 bp, D. melanogaster
aatgatttccaaa

SEQ ID NO: 564660 - DNA, 13 bp, D. melanogaster
aatgatttccatt

SEQ ID NO: 564661 - DNA, 13 bp, D. melanogaster
aatgatttcgttt

SEQ ID NO: 564662 - DNA, 14 bp, D. melanogaster
aatgatttctatat

SEQ ID NO: 564663 - DNA, 13 bp, D. melanogaster
aatgatttctttg

SEQ ID NO: 564664 - DNA, 13 bp, D. melanogaster
aatgatttgaaaa

SEQ ID NO: 564665 - DNA, 13 bp, D. melanogaster
aatgatttgcagt

SEQ ID NO: 564666 - DNA, 13 bp, D. melanogaster
aatgatttgtttg

SEQ ID NO: 564667 - DNA, 13 bp, D. melanogaster
aatgattttatgg

SEQ ID NO: 564668 - DNA, 13 bp, D. melanogaster
aatgattttcaat

SEQ ID NO: 564669 - DNA, 13 bp, D. melanogaster
aatgattttgaat

SEQ ID NO: 564670 - DNA, 13 bp, D. melanogaster
aatgatttttaag

SEQ ID NO: 564671 - DNA, 13 bp, D. melanogaster
aatgatttttggt

SEQ ID NO: 564672 - DNA, 13 bp, D. melanogaster
aatgcaaaaaagt

SEQ ID NO: 564673 - DNA, 13 bp, D. melanogaster
aatgcaaaaacta

SEQ ID NO: 564674 - DNA, 13 bp, D. melanogaster
aatgcaaaaagca

SEQ ID NO: 564675 - DNA, 13 bp, D. melanogaster
aatgcaaaaagct

SEQ ID NO: 564676 - DNA, 13 bp, D. melanogaster
aatgcaaaaagtg

SEQ ID NO: 564677 - DNA, 14 bp, D. melanogaster
aatgcaaaaagttt

SEQ ID NO: 564678 - DNA, 13 bp, D. melanogaster
aatgcaaaaatca

SEQ ID NO: 564679 - DNA, 13 bp, D. melanogaster
aatgcaaaaatcg

SEQ ID NO: 564680 - DNA, 13 bp, D. melanogaster
aatgcaaaaattc

SEQ ID NO: 564681 - DNA, 13 bp, D. melanogaster
aatgcaaaaattg

SEQ ID NO: 564682 - DNA, 14 bp, D. melanogaster
aatgcaaaaattga

SEQ ID NO: 564683 - DNA, 13 bp, D. melanogaster
aatgcaaaaattt

SEQ ID NO: 564684 - DNA, 13 bp, D. melanogaster
aatgcaaaacaca

SEQ ID NO: 564685 - DNA, 13 bp, D. melanogaster
aatgcaaaaccaa

SEQ ID NO: 564686 - DNA, 13 bp, D. melanogaster
aatgcaaaactat

SEQ ID NO: 564687 - DNA, 13 bp, D. melanogaster
aatgcaaaactta

SEQ ID NO: 564688 - DNA, 13 bp, D. melanogaster
aatgcaaaacttt

SEQ ID NO: 564689 - DNA, 14 bp, D. melanogaster
aatgcaaaagcaaa

SEQ ID NO: 564690 - DNA, 13 bp, D. melanogaster
aatgcaaaaggaa

SEQ ID NO: 564691 - DNA, 14 bp, D. melanogaster
aatgcaaaaggaaa

SEQ ID NO: 564692 - DNA, 13 bp, D. melanogaster
aatgcaaaagttc

SEQ ID NO: 564693 - DNA, 14 bp, D. melanogaster
aatgcaaaatgaaa

SEQ ID NO: 564694 - DNA, 13 bp, D. melanogaster
aatgcaaaatgat

SEQ ID NO: 564695 - DNA, 13 bp, D. melanogaster
aatgcaaaatgca

SEQ ID NO: 564696 - DNA, 14 bp, D. melanogaster
aatgcaaaatgcag

SEQ ID NO: 564697 - DNA, 14 bp, D. melanogaster
aatgcaaaatgcat

SEQ ID NO: 564698 - DNA, 13 bp, D. melanogaster
aatgcaaaatgcc

SEQ ID NO: 564699 - DNA, 14 bp, D. melanogaster
aatgcaaaatgcca

SEQ ID NO: 564700 - DNA, 13 bp, D. melanogaster
aatgcaaaatgct

SEQ ID NO: 564701 - DNA, 13 bp, D. melanogaster
aatgcaaaatgta

SEQ ID NO: 564702 - DNA, 13 bp, D. melanogaster
aatgcaaaatgtg

SEQ ID NO: 564703 - DNA, 13 bp, D. melanogaster
aatgcaaaattat

SEQ ID NO: 564704 - DNA, 13 bp, D. melanogaster
aatgcaaaattct

SEQ ID NO: 564705 - DNA, 13 bp, D. melanogaster
aatgcaaaattta

SEQ ID NO: 564706 - DNA, 13 bp, D. melanogaster
aatgcaaacaaac

SEQ ID NO: 564707 - DNA, 14 bp, D. melanogaster
aatgcaaacaacaa

SEQ ID NO: 564708 - DNA, 13 bp, D. melanogaster
aatgcaaacaact

SEQ ID NO: 564709 - DNA, 13 bp, D. melanogaster
aatgcaaacaatg

SEQ ID NO: 564710 - DNA, 13 bp, D. melanogaster
aatgcaaacaatt

SEQ ID NO: 564711 - DNA, 14 bp, D. melanogaster
aatgcaaacaattt

SEQ ID NO: 564712 - DNA, 13 bp, D. melanogaster
aatgcaaacacaa

SEQ ID NO: 564713 - DNA, 14 bp, D. melanogaster
aatgcaaacagaaa

SEQ ID NO: 564714 - DNA, 13 bp, D. melanogaster
aatgcaaacagca

SEQ ID NO: 564715 - DNA, 13 bp, D. melanogaster
aatgcaaacagcg

SEQ ID NO: 564716 - DNA, 13 bp, D. melanogaster
aatgcaaacataa

SEQ ID NO: 564717 - DNA, 13 bp, D. melanogaster
aatgcaaacgaaa

SEQ ID NO: 564718 - DNA, 13 bp, D. melanogaster
aatgcaaacgaat

SEQ ID NO: 564719 - DNA, 13 bp, D. melanogaster
aatgcaaacggaa

SEQ ID NO: 564720 - DNA, 13 bp, D. melanogaster
aatgcaaactacg

SEQ ID NO: 564721 - DNA, 13 bp, D. melanogaster
aatgcaaactgaa

SEQ ID NO: 564722 - DNA, 13 bp, D. melanogaster
aatgcaaactttt

SEQ ID NO: 564723 - DNA, 13 bp, D. melanogaster
aatgcaaagaaac

SEQ ID NO: 564724 - DNA, 13 bp, D. melanogaster
aatgcaaagaaat

SEQ ID NO: 564725 - DNA, 13 bp, D. melanogaster
aatgcaaagataa

SEQ ID NO: 564726 - DNA, 13 bp, D. melanogaster
aatgcaaagcaaa

SEQ ID NO: 564727 - DNA, 14 bp, D. melanogaster
aatgcaaagcaaac

SEQ ID NO: 564728 - DNA, 13 bp, D. melanogaster
aatgcaaagcagc

SEQ ID NO: 564729 - DNA, 13 bp, D. melanogaster
aatgcaaagcatt

SEQ ID NO: 564730 - DNA, 13 bp, D. melanogaster
aatgcaaagtgcg

SEQ ID NO: 564731 - DNA, 14 bp, D. melanogaster
aatgcaaataaaca

SEQ ID NO: 564732 - DNA, 13 bp, D. melanogaster
aatgcaaataaat

SEQ ID NO: 564733 - DNA, 14 bp, D. melanogaster
aatgcaaataaatg

SEQ ID NO: 564734 - DNA, 13 bp, D. melanogaster
aatgcaaataaca

SEQ ID NO: 564735 - DNA, 13 bp, D. melanogaster
aatgcaaataatt

SEQ ID NO: 564736 - DNA, 14 bp, D. melanogaster
aatgcaaataattt

SEQ ID NO: 564737 - DNA, 14 bp, D. melanogaster
aatgcaaatacaaa

SEQ ID NO: 564738 - DNA, 13 bp, D. melanogaster
aatgcaaatacat

SEQ ID NO: 564739 - DNA, 13 bp, D. melanogaster
aatgcaaatagaa

SEQ ID NO: 564740 - DNA, 13 bp, D. melanogaster
aatgcaaatattg

SEQ ID NO: 564741 - DNA, 13 bp, D. melanogaster
aatgcaaatattt

SEQ ID NO: 564742 - DNA, 14 bp, D. melanogaster
aatgcaaatatttt

SEQ ID NO: 564743 - DNA, 14 bp, D. melanogaster
aatgcaaatcaaaa

SEQ ID NO: 564744 - DNA, 13 bp, D. melanogaster
aatgcaaatcaat

SEQ ID NO: 564745 - DNA, 14 bp, D. melanogaster
aatgcaaatcaatt

SEQ ID NO: 564746 - DNA, 13 bp, D. melanogaster
aatgcaaatcatt

SEQ ID NO: 564747 - DNA, 13 bp, D. melanogaster
aatgcaaatccaa

SEQ ID NO: 564748 - DNA, 14 bp, D. melanogaster
aatgcaaatccaaa

SEQ ID NO: 564749 - DNA, 13 bp, D. melanogaster
aatgcaaatccca

SEQ ID NO: 564750 - DNA, 13 bp, D. melanogaster
aatgcaaatctaa

SEQ ID NO: 564751 - DNA, 13 bp, D. melanogaster
aatgcaaatgaaa

SEQ ID NO: 564752 - DNA, 14 bp, D. melanogaster
aatgcaaatgaaaa

SEQ ID NO: 564753 - DNA, 14 bp, D. melanogaster
aatgcaaatgaaat

SEQ ID NO: 564754 - DNA, 13 bp, D. melanogaster
aatgcaaatgact

SEQ ID NO: 564755 - DNA, 13 bp, D. melanogaster
aatgcaaatgagc

SEQ ID NO: 564756 - DNA, 13 bp, D. melanogaster
aatgcaaatgagt

SEQ ID NO: 564757 - DNA, 14 bp, D. melanogaster
aatgcaaatgattt

SEQ ID NO: 564758 - DNA, 14 bp, D. melanogaster
aatgcaaatgcaag

SEQ ID NO: 564759 - DNA, 14 bp, D. melanogaster
aatgcaaatgcaat

SEQ ID NO: 564760 - DNA, 13 bp, D. melanogaster
aatgcaaatgcag

SEQ ID NO: 564761 - DNA, 14 bp, D. melanogaster
aatgcaaatgcatt

SEQ ID NO: 564762 - DNA, 13 bp, D. melanogaster
aatgcaaatgcca

SEQ ID NO: 564763 - DNA, 14 bp, D. melanogaster
aatgcaaatgccaa

SEQ ID NO: 564764 - DNA, 13 bp, D. melanogaster
aatgcaaatgcgc

SEQ ID NO: 564765 - DNA, 13 bp, D. melanogaster
aatgcaaatggct

SEQ ID NO: 564766 - DNA, 13 bp, D. melanogaster
aatgcaaatggtt

SEQ ID NO: 564767 - DNA, 13 bp, D. melanogaster
aatgcaaatgtaa

SEQ ID NO: 564768 - DNA, 13 bp, D. melanogaster
aatgcaaatgtct

SEQ ID NO: 564769 - DNA, 14 bp, D. melanogaster
aatgcaaatgtgca

SEQ ID NO: 564770 - DNA, 13 bp, D. melanogaster
aatgcaaatgtgg

SEQ ID NO: 564771 - DNA, 13 bp, D. melanogaster
aatgcaaatgttt

SEQ ID NO: 564772 - DNA, 14 bp, D. melanogaster
aatgcaaatgtttt

SEQ ID NO: 564773 - DNA, 14 bp, D. melanogaster
aatgcaaattaatt

SEQ ID NO: 564774 - DNA, 13 bp, D. melanogaster
aatgcaaattatg

SEQ ID NO: 564775 - DNA, 13 bp, D. melanogaster
aatgcaaattcaa

SEQ ID NO: 564776 - DNA, 13 bp, D. melanogaster
aatgcaaattcat

SEQ ID NO: 564777 - DNA, 13 bp, D. melanogaster
aatgcaaattgaa

SEQ ID NO: 564778 - DNA, 13 bp, D. melanogaster
aatgcaaattgca

SEQ ID NO: 564779 - DNA, 13 bp, D. melanogaster
aatgcaaattgcg

SEQ ID NO: 564780 - DNA, 14 bp, D. melanogaster
aatgcaaattggat

SEQ ID NO: 564781 - DNA, 14 bp, D. melanogaster
aatgcaaattgttt

SEQ ID NO: 564782 - DNA, 13 bp, D. melanogaster
aatgcaaattttc

SEQ ID NO: 564783 - DNA, 13 bp, D. melanogaster
aatgcaacaaaat

SEQ ID NO: 564784 - DNA, 13 bp, D. melanogaster
aatgcaacaacaa

SEQ ID NO: 564785 - DNA, 13 bp, D. melanogaster
aatgcaacaatgt

SEQ ID NO: 564786 - DNA, 13 bp, D. melanogaster
aatgcaacaatta

SEQ ID NO: 564787 - DNA, 13 bp, D. melanogaster
aatgcaacatttg

SEQ ID NO: 564788 - DNA, 13 bp, D. melanogaster
aatgcaaccacaa

SEQ ID NO: 564789 - DNA, 13 bp, D. melanogaster
aatgcaacgaaat

SEQ ID NO: 564790 - DNA, 13 bp, D. melanogaster
aatgcaactaaat

SEQ ID NO: 564791 - DNA, 13 bp, D. melanogaster
aatgcaactaagt

SEQ ID NO: 564792 - DNA, 13 bp, D. melanogaster
aatgcaactgatg

SEQ ID NO: 564793 - DNA, 13 bp, D. melanogaster
aatgcaactgcaa

SEQ ID NO: 564794 - DNA, 13 bp, D. melanogaster
aatgcaactgcat

SEQ ID NO: 564795 - DNA, 13 bp, D. melanogaster
aatgcaactttat

SEQ ID NO: 564796 - DNA, 13 bp, D. melanogaster
aatgcaagcaaaa

SEQ ID NO: 564797 - DNA, 14 bp, D. melanogaster
aatgcaagcaataa

SEQ ID NO: 564798 - DNA, 13 bp, D. melanogaster
aatgcaagcaatt

SEQ ID NO: 564799 - DNA, 13 bp, D. melanogaster
aatgcaagccaaa

SEQ ID NO: 564800 - DNA, 13 bp, D. melanogaster
aatgcaagtgcaa

SEQ ID NO: 564801 - DNA, 13 bp, D. melanogaster
aatgcaagtgcag

SEQ ID NO: 564802 - DNA, 13 bp, D. melanogaster
aatgcaagtgcat

SEQ ID NO: 564803 - DNA, 13 bp, D. melanogaster
aatgcaagtttat

SEQ ID NO: 564804 - DNA, 13 bp, D. melanogaster
aatgcaataaaac

SEQ ID NO: 564805 - DNA, 14 bp, D. melanogaster
aatgcaataaaata

SEQ ID NO: 564806 - DNA, 14 bp, D. melanogaster
aatgcaataaatat

SEQ ID NO: 564807 - DNA, 13 bp, D. melanogaster
aatgcaataaatc

SEQ ID NO: 564808 - DNA, 14 bp, D. melanogaster
aatgcaataaattt

SEQ ID NO: 564809 - DNA, 13 bp, D. melanogaster
aatgcaataacag

SEQ ID NO: 564810 - DNA, 14 bp, D. melanogaster
aatgcaataataaa

SEQ ID NO: 564811 - DNA, 14 bp, D. melanogaster
aatgcaataataat

SEQ ID NO: 564812 - DNA, 13 bp, D. melanogaster
aatgcaataattt

SEQ ID NO: 564813 - DNA, 13 bp, D. melanogaster
aatgcaatacatt

SEQ ID NO: 564814 - DNA, 13 bp, D. melanogaster
aatgcaatagcaa

SEQ ID NO: 564815 - DNA, 13 bp, D. melanogaster
aatgcaatataaa

SEQ ID NO: 564816 - DNA, 13 bp, D. melanogaster
aatgcaatatatt

SEQ ID NO: 564817 - DNA, 13 bp, D. melanogaster
aatgcaatatgtc

SEQ ID NO: 564818 - DNA, 13 bp, D. melanogaster
aatgcaatattat

SEQ ID NO: 564819 - DNA, 13 bp, D. melanogaster
aatgcaatcaaaa

SEQ ID NO: 564820 - DNA, 14 bp, D. melanogaster
aatgcaatcaaaat

SEQ ID NO: 564821 - DNA, 13 bp, D. melanogaster
aatgcaatcaaag

SEQ ID NO: 564822 - DNA, 13 bp, D. melanogaster
aatgcaatcaagt

SEQ ID NO: 564823 - DNA, 13 bp, D. melanogaster
aatgcaatcaata

SEQ ID NO: 564824 - DNA, 13 bp, D. melanogaster
aatgcaatcaatg

SEQ ID NO: 564825 - DNA, 13 bp, D. melanogaster
aatgcaatcaatt

SEQ ID NO: 564826 - DNA, 13 bp, D. melanogaster
aatgcaatcataa

SEQ ID NO: 564827 - DNA, 13 bp, D. melanogaster
aatgcaatcattt

SEQ ID NO: 564828 - DNA, 14 bp, D. melanogaster
aatgcaatcgaaaa

SEQ ID NO: 564829 - DNA, 13 bp, D. melanogaster
aatgcaatcgaat

SEQ ID NO: 564830 - DNA, 13 bp, D. melanogaster
aatgcaatcgcaa

SEQ ID NO: 564831 - DNA, 13 bp, D. melanogaster
aatgcaatcttaa

SEQ ID NO: 564832 - DNA, 13 bp, D. melanogaster
aatgcaatgaaaa

SEQ ID NO: 564833 - DNA, 13 bp, D. melanogaster
aatgcaatgaatg

SEQ ID NO: 564834 - DNA, 13 bp, D. melanogaster
aatgcaatgcaaa

SEQ ID NO: 564835 - DNA, 14 bp, D. melanogaster
aatgcaatgcaaaa

SEQ ID NO: 564836 - DNA, 13 bp, D. melanogaster
aatgcaatgcaat

SEQ ID NO: 564837 - DNA, 13 bp, D. melanogaster
aatgcaatgcatt

SEQ ID NO: 564838 - DNA, 13 bp, D. melanogaster
aatgcaatgccaa

SEQ ID NO: 564839 - DNA, 13 bp, D. melanogaster
aatgcaatggcaa

SEQ ID NO: 564840 - DNA, 13 bp, D. melanogaster
aatgcaatggcca

SEQ ID NO: 564841 - DNA, 13 bp, D. melanogaster
aatgcaatgtaaa

SEQ ID NO: 564842 - DNA, 13 bp, D. melanogaster
aatgcaattaaaa

SEQ ID NO: 564843 - DNA, 14 bp, D. melanogaster
aatgcaattaaaat

SEQ ID NO: 564844 - DNA, 13 bp, D. melanogaster
aatgcaattaaat

SEQ ID NO: 564845 - DNA, 14 bp, D. melanogaster
aatgcaattaaatt

SEQ ID NO: 564846 - DNA, 13 bp, D. melanogaster
aatgcaattaagt

SEQ ID NO: 564847 - DNA, 14 bp, D. melanogaster
aatgcaattacaat

SEQ ID NO: 564848 - DNA, 13 bp, D. melanogaster
aatgcaattacca

SEQ ID NO: 564849 - DNA, 13 bp, D. melanogaster
aatgcaattagtg

SEQ ID NO: 564850 - DNA, 13 bp, D. melanogaster
aatgcaattagtt

SEQ ID NO: 564851 - DNA, 13 bp, D. melanogaster
aatgcaattatat

SEQ ID NO: 564852 - DNA, 13 bp, D. melanogaster
aatgcaattattt

SEQ ID NO: 564853 - DNA, 13 bp, D. melanogaster
aatgcaattcaaa

SEQ ID NO: 564854 - DNA, 14 bp, D. melanogaster
aatgcaattcaatt

SEQ ID NO: 564855 - DNA, 13 bp, D. melanogaster
aatgcaattcaca

SEQ ID NO: 564856 - DNA, 13 bp, D. melanogaster
aatgcaattccat

SEQ ID NO: 564857 - DNA, 13 bp, D. melanogaster
aatgcaattccta

SEQ ID NO: 564858 - DNA, 13 bp, D. melanogaster
aatgcaattcgca

SEQ ID NO: 564859 - DNA, 13 bp, D. melanogaster
aatgcaattgaaa

SEQ ID NO: 564860 - DNA, 14 bp, D. melanogaster
aatgcaattgaaat

SEQ ID NO: 564861 - DNA, 13 bp, D. melanogaster
aatgcaattgcat

SEQ ID NO: 564862 - DNA, 13 bp, D. melanogaster
aatgcaattgcca

SEQ ID NO: 564863 - DNA, 14 bp, D. melanogaster
aatgcaattgccaa

SEQ ID NO: 564864 - DNA, 13 bp, D. melanogaster
aatgcaattgtaa

SEQ ID NO: 564865 - DNA, 13 bp, D. melanogaster
aatgcaattgttt

SEQ ID NO: 564866 - DNA, 14 bp, D. melanogaster
aatgcaattgtttt

SEQ ID NO: 564867 - DNA, 13 bp, D. melanogaster
aatgcaatttaaa

SEQ ID NO: 564868 - DNA, 13 bp, D. melanogaster
aatgcaatttaag

SEQ ID NO: 564869 - DNA, 13 bp, D. melanogaster
aatgcaatttaat

SEQ ID NO: 564870 - DNA, 13 bp, D. melanogaster
aatgcaatttcaa

SEQ ID NO: 564871 - DNA, 13 bp, D. melanogaster
aatgcaatttcag

SEQ ID NO: 564872 - DNA, 13 bp, D. melanogaster
aatgcaatttgaa

SEQ ID NO: 564873 - DNA, 13 bp, D. melanogaster
aatgcaatttgcc

SEQ ID NO: 564874 - DNA, 13 bp, D. melanogaster
aatgcaatttgct

SEQ ID NO: 564875 - DNA, 13 bp, D. melanogaster
aatgcaattttaa

SEQ ID NO: 564876 - DNA, 14 bp, D. melanogaster
aatgcaattttcaa

SEQ ID NO: 564877 - DNA, 13 bp, D. melanogaster
aatgcaatttttg

SEQ ID NO: 564878 - DNA, 13 bp, D. melanogaster
aatgcacaaaaat

SEQ ID NO: 564879 - DNA, 13 bp, D. melanogaster
aatgcacaaaaca

SEQ ID NO: 564880 - DNA, 13 bp, D. melanogaster
aatgcacaaaagc

SEQ ID NO: 564881 - DNA, 13 bp, D. melanogaster
aatgcacaaacaa

SEQ ID NO: 564882 - DNA, 13 bp, D. melanogaster
aatgcacaaatat

SEQ ID NO: 564883 - DNA, 13 bp, D. melanogaster
aatgcacaataaa

SEQ ID NO: 564884 - DNA, 13 bp, D. melanogaster
aatgcacaatgca

SEQ ID NO: 564885 - DNA, 13 bp, D. melanogaster
aatgcacaattaa

SEQ ID NO: 564886 - DNA, 13 bp, D. melanogaster
aatgcacacaatt

SEQ ID NO: 564887 - DNA, 13 bp, D. melanogaster
aatgcacacacaa

SEQ ID NO: 564888 - DNA, 13 bp, D. melanogaster
aatgcacacacat

SEQ ID NO: 564889 - DNA, 13 bp, D. melanogaster
aatgcacacactc

SEQ ID NO: 564890 - DNA, 13 bp, D. melanogaster
aatgcacacatac

SEQ ID NO: 564891 - DNA, 13 bp, D. melanogaster
aatgcacacattt

SEQ ID NO: 564892 - DNA, 13 bp, D. melanogaster
aatgcacatttaa

SEQ ID NO: 564893 - DNA, 13 bp, D. melanogaster
aatgcaccaaaaa

SEQ ID NO: 564894 - DNA, 13 bp, D. melanogaster
aatgcacccaaaa

SEQ ID NO: 564895 - DNA, 13 bp, D. melanogaster
aatgcacccaatg

SEQ ID NO: 564896 - DNA, 13 bp, D. melanogaster
aatgcacctgcaa

SEQ ID NO: 564897 - DNA, 13 bp, D. melanogaster
aatgcactcgaaa

SEQ ID NO: 564898 - DNA, 14 bp, D. melanogaster
aatgcactcgaaaa

SEQ ID NO: 564899 - DNA, 13 bp, D. melanogaster
aatgcactgagaa

SEQ ID NO: 564900 - DNA, 13 bp, D. melanogaster
aatgcactgagag

SEQ ID NO: 564901 - DNA, 13 bp, D. melanogaster
aatgcacttggaa

SEQ ID NO: 564902 - DNA, 13 bp, D. melanogaster
aatgcactttgaa

SEQ ID NO: 564903 - DNA, 13 bp, D. melanogaster
aatgcacttttaa

SEQ ID NO: 564904 - DNA, 13 bp, D. melanogaster
aatgcacttttgt

SEQ ID NO: 564905 - DNA, 13 bp, D. melanogaster
aatgcacttttta

SEQ ID NO: 564906 - DNA, 13 bp, D. melanogaster
aatgcagaaaatg

SEQ ID NO: 564907 - DNA, 13 bp, D. melanogaster
aatgcagaaacaa

SEQ ID NO: 564908 - DNA, 14 bp, D. melanogaster
aatgcagaaacaat

SEQ ID NO: 564909 - DNA, 13 bp, D. melanogaster
aatgcagaaacgc

SEQ ID NO: 564910 - DNA, 14 bp, D. melanogaster
aatgcagaaacgca

SEQ ID NO: 564911 - DNA, 13 bp, D. melanogaster
aatgcagaaatgt

SEQ ID NO: 564912 - DNA, 13 bp, D. melanogaster
aatgcagaatgca

SEQ ID NO: 564913 - DNA, 13 bp, D. melanogaster
aatgcagaattta

SEQ ID NO: 564914 - DNA, 13 bp, D. melanogaster
aatgcagagtgga

SEQ ID NO: 564915 - DNA, 13 bp, D. melanogaster
aatgcagatgcaa

SEQ ID NO: 564916 - DNA, 13 bp, D. melanogaster
aatgcagattttt

SEQ ID NO: 564917 - DNA, 14 bp, D. melanogaster
aatgcagcaaaaaa

SEQ ID NO: 564918 - DNA, 13 bp, D. melanogaster
aatgcagcaaatg

SEQ ID NO: 564919 - DNA, 15 bp, D. melanogaster
aatgcagcaatacca

SEQ ID NO: 564920 - DNA, 13 bp, D. melanogaster
aatgcagcaggaa

SEQ ID NO: 564921 - DNA, 13 bp, D. melanogaster
aatgcagccaaag

SEQ ID NO: 564922 - DNA, 13 bp, D. melanogaster
aatgcagccagca

SEQ ID NO: 564923 - DNA, 13 bp, D. melanogaster
aatgcagcgaaaa

SEQ ID NO: 564924 - DNA, 13 bp, D. melanogaster
aatgcagcgcata

SEQ ID NO: 564925 - DNA, 13 bp, D. melanogaster
aatgcagcgccaa

SEQ ID NO: 564926 - DNA, 13 bp, D. melanogaster
aatgcagctaaat

SEQ ID NO: 564927 - DNA, 13 bp, D. melanogaster
aatgcagctcatt

SEQ ID NO: 564928 - DNA, 13 bp, D. melanogaster
aatgcagggaata

SEQ ID NO: 564929 - DNA, 14 bp, D. melanogaster
aatgcagggaatac

SEQ ID NO: 564930 - DNA, 13 bp, D. melanogaster
aatgcagtaactg

SEQ ID NO: 564931 - DNA, 13 bp, D. melanogaster
aatgcagtgcaaa

SEQ ID NO: 564932 - DNA, 13 bp, D. melanogaster
aatgcagtttacg

SEQ ID NO: 564933 - DNA, 13 bp, D. melanogaster
aatgcagtttgca

SEQ ID NO: 564934 - DNA, 13 bp, D. melanogaster
aatgcagttttgg

SEQ ID NO: 564935 - DNA, 13 bp, D. melanogaster
aatgcagtttttc

SEQ ID NO: 564936 - DNA, 14 bp, D. melanogaster
aatgcataaatatt

SEQ ID NO: 564937 - DNA, 13 bp, D. melanogaster
aatgcatacaaat

SEQ ID NO: 564938 - DNA, 13 bp, D. melanogaster
aatgcatacataa

SEQ ID NO: 564939 - DNA, 13 bp, D. melanogaster
aatgcatactttt

SEQ ID NO: 564940 - DNA, 13 bp, D. melanogaster
aatgcatagaaaa

SEQ ID NO: 564941 - DNA, 14 bp, D. melanogaster
aatgcatatatata

SEQ ID NO: 564942 - DNA, 13 bp, D. melanogaster
aatgcatatattt

SEQ ID NO: 564943 - DNA, 13 bp, D. melanogaster
aatgcatatgcat

SEQ ID NO: 564944 - DNA, 14 bp, D. melanogaster
aatgcatatgcata

SEQ ID NO: 564945 - DNA, 13 bp, D. melanogaster
aatgcatattatt

SEQ ID NO: 564946 - DNA, 14 bp, D. melanogaster
aatgcatatttatg

SEQ ID NO: 564947 - DNA, 14 bp, D. melanogaster
aatgcatatttatt

SEQ ID NO: 564948 - DNA, 13 bp, D. melanogaster
aatgcatatttca

SEQ ID NO: 564949 - DNA, 13 bp, D. melanogaster
aatgcatcatttt

SEQ ID NO: 564950 - DNA, 13 bp, D. melanogaster
aatgcatcggcaa

SEQ ID NO: 564951 - DNA, 14 bp, D. melanogaster
aatgcatgcaaatt

SEQ ID NO: 564952 - DNA, 13 bp, D. melanogaster
aatgcatgccaaa

SEQ ID NO: 564953 - DNA, 13 bp, D. melanogaster
aatgcatgtgaat

SEQ ID NO: 564954 - DNA, 13 bp, D. melanogaster
aatgcattaaaag

SEQ ID NO: 564955 - DNA, 13 bp, D. melanogaster
aatgcattaaaca

SEQ ID NO: 564956 - DNA, 13 bp, D. melanogaster
aatgcattaaata

SEQ ID NO: 564957 - DNA, 13 bp, D. melanogaster
aatgcattaaatg

SEQ ID NO: 564958 - DNA, 13 bp, D. melanogaster
aatgcattaatat

SEQ ID NO: 564959 - DNA, 13 bp, D. melanogaster
aatgcattaatta

SEQ ID NO: 564960 - DNA, 13 bp, D. melanogaster
aatgcattatatt

SEQ ID NO: 564961 - DNA, 13 bp, D. melanogaster
aatgcattcaaaa

SEQ ID NO: 564962 - DNA, 13 bp, D. melanogaster
aatgcattcaaca

SEQ ID NO: 564963 - DNA, 13 bp, D. melanogaster
aatgcattcacat

SEQ ID NO: 564964 - DNA, 13 bp, D. melanogaster
aatgcattcattg

SEQ ID NO: 564965 - DNA, 13 bp, D. melanogaster
aatgcattccaaa

SEQ ID NO: 564966 - DNA, 13 bp, D. melanogaster
aatgcattcgaaa

SEQ ID NO: 564967 - DNA, 13 bp, D. melanogaster
aatgcattcgagt

SEQ ID NO: 564968 - DNA, 13 bp, D. melanogaster
aatgcattctttt

SEQ ID NO: 564969 - DNA, 13 bp, D. melanogaster
aatgcattgaatg

SEQ ID NO: 564970 - DNA, 13 bp, D. melanogaster
aatgcattgcatt

SEQ ID NO: 564971 - DNA, 13 bp, D. melanogaster
aatgcattggaaa

SEQ ID NO: 564972 - DNA, 13 bp, D. melanogaster
aatgcattggata

SEQ ID NO: 564973 - DNA, 13 bp, D. melanogaster
aatgcattggcaa

SEQ ID NO: 564974 - DNA, 13 bp, D. melanogaster
aatgcattggcat

SEQ ID NO: 564975 - DNA, 13 bp, D. melanogaster
aatgcattgtaaa

SEQ ID NO: 564976 - DNA, 13 bp, D. melanogaster
aatgcattgttta

SEQ ID NO: 564977 - DNA, 13 bp, D. melanogaster
aatgcattgtttt

SEQ ID NO: 564978 - DNA, 14 bp, D. melanogaster
aatgcatttaaata

SEQ ID NO: 564979 - DNA, 13 bp, D. melanogaster
aatgcatttaaca

SEQ ID NO: 564980 - DNA, 13 bp, D. melanogaster
aatgcatttaagc

SEQ ID NO: 564981 - DNA, 13 bp, D. melanogaster
aatgcatttagtt

SEQ ID NO: 564982 - DNA, 13 bp, D. melanogaster
aatgcatttatga

SEQ ID NO: 564983 - DNA, 13 bp, D. melanogaster
aatgcatttatta

SEQ ID NO: 564984 - DNA, 14 bp, D. melanogaster
aatgcatttattta

SEQ ID NO: 564985 - DNA, 14 bp, D. melanogaster
aatgcatttatttt

SEQ ID NO: 564986 - DNA, 13 bp, D. melanogaster
aatgcatttcttt

SEQ ID NO: 564987 - DNA, 13 bp, D. melanogaster
aatgcatttgaat

SEQ ID NO: 564988 - DNA, 13 bp, D. melanogaster
aatgcatttgaca

SEQ ID NO: 564989 - DNA, 13 bp, D. melanogaster
aatgcatttgatt

SEQ ID NO: 564990 - DNA, 13 bp, D. melanogaster
aatgcatttgcat

SEQ ID NO: 564991 - DNA, 13 bp, D. melanogaster
aatgcatttgccg

SEQ ID NO: 564992 - DNA, 13 bp, D. melanogaster
aatgcatttgcct

SEQ ID NO: 564993 - DNA, 13 bp, D. melanogaster
aatgcatttgctg

SEQ ID NO: 564994 - DNA, 13 bp, D. melanogaster
aatgcatttgtca

SEQ ID NO: 564995 - DNA, 13 bp, D. melanogaster
aatgcattttaaa

SEQ ID NO: 564996 - DNA, 14 bp, D. melanogaster
aatgcattttaaat

SEQ ID NO: 564997 - DNA, 13 bp, D. melanogaster
aatgcattttaat

SEQ ID NO: 564998 - DNA, 14 bp, D. melanogaster
aatgcattttaatt

SEQ ID NO: 564999 - DNA, 13 bp, D. melanogaster
aatgcattttaga

SEQ ID NO: 565000 - DNA, 13 bp, D. melanogaster
aatgcattttatg

SEQ ID NO: 565001 - DNA, 14 bp, D. melanogaster
aatgcattttattt

SEQ ID NO: 565002 - DNA, 13 bp, D. melanogaster
aatgcattttcaa

SEQ ID NO: 565003 - DNA, 14 bp, D. melanogaster
aatgcattttcaat

SEQ ID NO: 565004 - DNA, 13 bp, D. melanogaster
aatgcattttcat

SEQ ID NO: 565005 - DNA, 13 bp, D. melanogaster
aatgcattttccg

SEQ ID NO: 565006 - DNA, 13 bp, D. melanogaster
aatgcattttgca

SEQ ID NO: 565007 - DNA, 14 bp, D. melanogaster
aatgcatttttaat

SEQ ID NO: 565008 - DNA, 13 bp, D. melanogaster
aatgcatttttca

SEQ ID NO: 565009 - DNA, 14 bp, D. melanogaster
aatgcatttttcaa

SEQ ID NO: 565010 - DNA, 13 bp, D. melanogaster
aatgcatttttcc

SEQ ID NO: 565011 - DNA, 13 bp, D. melanogaster
aatgcatttttgt

SEQ ID NO: 565012 - DNA, 13 bp, D. melanogaster
aatgccaaaaaat

SEQ ID NO: 565013 - DNA, 14 bp, D. melanogaster
aatgccaaaaagca

SEQ ID NO: 565014 - DNA, 13 bp, D. melanogaster
aatgccaaaaagg

SEQ ID NO: 565015 - DNA, 13 bp, D. melanogaster
aatgccaaaaagt

SEQ ID NO: 565016 - DNA, 13 bp, D. melanogaster
aatgccaaaaatt

SEQ ID NO: 565017 - DNA, 13 bp, D. melanogaster
aatgccaaaacgc

SEQ ID NO: 565018 - DNA, 13 bp, D. melanogaster
aatgccaaaaggc

SEQ ID NO: 565019 - DNA, 13 bp, D. melanogaster
aatgccaaaatgc

SEQ ID NO: 565020 - DNA, 13 bp, D. melanogaster
aatgccaaaatgt

SEQ ID NO: 565021 - DNA, 13 bp, D. melanogaster
aatgccaaacaaa

SEQ ID NO: 565022 - DNA, 13 bp, D. melanogaster
aatgccaaacaca

SEQ ID NO: 565023 - DNA, 13 bp, D. melanogaster
aatgccaaacgat

SEQ ID NO: 565024 - DNA, 13 bp, D. melanogaster
aatgccaaacgca

SEQ ID NO: 565025 - DNA, 13 bp, D. melanogaster
aatgccaaacgga

SEQ ID NO: 565026 - DNA, 13 bp, D. melanogaster
aatgccaaagaaa

SEQ ID NO: 565027 - DNA, 13 bp, D. melanogaster
aatgccaaagaat

SEQ ID NO: 565028 - DNA, 13 bp, D. melanogaster
aatgccaaagaca

SEQ ID NO: 565029 - DNA, 13 bp, D. melanogaster
aatgccaaagcca

SEQ ID NO: 565030 - DNA, 14 bp, D. melanogaster
aatgccaaagccaa

SEQ ID NO: 565031 - DNA, 13 bp, D. melanogaster
aatgccaaaggca

SEQ ID NO: 565032 - DNA, 13 bp, D. melanogaster
aatgccaaagtgg

SEQ ID NO: 565033 - DNA, 13 bp, D. melanogaster
aatgccaaagttt

SEQ ID NO: 565034 - DNA, 13 bp, D. melanogaster
aatgccaaataaa

SEQ ID NO: 565035 - DNA, 14 bp, D. melanogaster
aatgccaaataaaa

SEQ ID NO: 565036 - DNA, 13 bp, D. melanogaster
aatgccaaataat

SEQ ID NO: 565037 - DNA, 14 bp, D. melanogaster
aatgccaaatactt

SEQ ID NO: 565038 - DNA, 13 bp, D. melanogaster
aatgccaaatgcc

SEQ ID NO: 565039 - DNA, 14 bp, D. melanogaster
aatgccaaatgcca

SEQ ID NO: 565040 - DNA, 13 bp, D. melanogaster
aatgccaaatgga

SEQ ID NO: 565041 - DNA, 14 bp, D. melanogaster
aatgccaaattaaa

SEQ ID NO: 565042 - DNA, 13 bp, D. melanogaster
aatgccaaattgc

SEQ ID NO: 565043 - DNA, 13 bp, D. melanogaster
aatgccaaattgt

SEQ ID NO: 565044 - DNA, 13 bp, D. melanogaster
aatgccaacaaat

SEQ ID NO: 565045 - DNA, 13 bp, D. melanogaster
aatgccaacaatt

SEQ ID NO: 565046 - DNA, 13 bp, D. melanogaster
aatgccaaccgaa

SEQ ID NO: 565047 - DNA, 13 bp, D. melanogaster
aatgccaacgaaa

SEQ ID NO: 565048 - DNA, 13 bp, D. melanogaster
aatgccaactcaa

SEQ ID NO: 565049 - DNA, 13 bp, D. melanogaster
aatgccaagaaat

SEQ ID NO: 565050 - DNA, 13 bp, D. melanogaster
aatgccaagcaaa

SEQ ID NO: 565051 - DNA, 13 bp, D. melanogaster
aatgccaaggaaa

SEQ ID NO: 565052 - DNA, 13 bp, D. melanogaster
aatgccaagtcaa

SEQ ID NO: 565053 - DNA, 13 bp, D. melanogaster
aatgccaagtgaa

SEQ ID NO: 565054 - DNA, 13 bp, D. melanogaster
aatgccaagtgcc

SEQ ID NO: 565055 - DNA, 13 bp, D. melanogaster
aatgccaataaaa

SEQ ID NO: 565056 - DNA, 13 bp, D. melanogaster
aatgccaataaat

SEQ ID NO: 565057 - DNA, 13 bp, D. melanogaster
aatgccaatattt

SEQ ID NO: 565058 - DNA, 13 bp, D. melanogaster
aatgccaatcaat

SEQ ID NO: 565059 - DNA, 14 bp, D. melanogaster
aatgccaatcgatt

SEQ ID NO: 565060 - DNA, 13 bp, D. melanogaster
aatgccaatgcaa

SEQ ID NO: 565061 - DNA, 13 bp, D. melanogaster
aatgccaattgaa

SEQ ID NO: 565062 - DNA, 13 bp, D. melanogaster
aatgccaattgca

SEQ ID NO: 565063 - DNA, 13 bp, D. melanogaster
aatgccaattttt

SEQ ID NO: 565064 - DNA, 13 bp, D. melanogaster
aatgccacaaaac

SEQ ID NO: 565065 - DNA, 13 bp, D. melanogaster
aatgccacaaaag

SEQ ID NO: 565066 - DNA, 13 bp, D. melanogaster
aatgccacaaaca

SEQ ID NO: 565067 - DNA, 13 bp, D. melanogaster
aatgccacaaatg

SEQ ID NO: 565068 - DNA, 13 bp, D. melanogaster
aatgccacaagcc

SEQ ID NO: 565069 - DNA, 13 bp, D. melanogaster
aatgccacacaaa

SEQ ID NO: 565070 - DNA, 13 bp, D. melanogaster
aatgccacacaca

SEQ ID NO: 565071 - DNA, 13 bp, D. melanogaster
aatgccacccgaa

SEQ ID NO: 565072 - DNA, 14 bp, D. melanogaster
aatgccacccgaaa

SEQ ID NO: 565073 - DNA, 13 bp, D. melanogaster
aatgccacgccca

SEQ ID NO: 565074 - DNA, 14 bp, D. melanogaster
aatgccacgcccac

SEQ ID NO: 565075 - DNA, 13 bp, D. melanogaster
aatgccacgcccc

SEQ ID NO: 565076 - DNA, 14 bp, D. melanogaster
aatgccacgccccc

SEQ ID NO: 565077 - DNA, 13 bp, D. melanogaster
aatgccactaaaa

SEQ ID NO: 565078 - DNA, 13 bp, D. melanogaster
aatgccactggat

SEQ ID NO: 565079 - DNA, 13 bp, D. melanogaster
aatgccacttaat

SEQ ID NO: 565080 - DNA, 13 bp, D. melanogaster
aatgccagaaagt

SEQ ID NO: 565081 - DNA, 13 bp, D. melanogaster
aatgccagaatgc

SEQ ID NO: 565082 - DNA, 13 bp, D. melanogaster
aatgccagcaaaa

SEQ ID NO: 565083 - DNA, 13 bp, D. melanogaster
aatgccagcaaca

SEQ ID NO: 565084 - DNA, 13 bp, D. melanogaster
aatgccagcaatg

SEQ ID NO: 565085 - DNA, 13 bp, D. melanogaster
aatgccagcattt

SEQ ID NO: 565086 - DNA, 13 bp, D. melanogaster
aatgccagccagc

SEQ ID NO: 565087 - DNA, 13 bp, D. melanogaster
aatgccagcgaca

SEQ ID NO: 565088 - DNA, 13 bp, D. melanogaster
aatgccagctaat

SEQ ID NO: 565089 - DNA, 13 bp, D. melanogaster
aatgccaggaaaa

SEQ ID NO: 565090 - DNA, 13 bp, D. melanogaster
aatgccatcaaaa

SEQ ID NO: 565091 - DNA, 13 bp, D. melanogaster
aatgccatcaaat

SEQ ID NO: 565092 - DNA, 13 bp, D. melanogaster
aatgccatcacca

SEQ ID NO: 565093 - DNA, 13 bp, D. melanogaster
aatgccatcgaaa

SEQ ID NO: 565094 - DNA, 13 bp, D. melanogaster
aatgccatgaaaa

SEQ ID NO: 565095 - DNA, 13 bp, D. melanogaster
aatgccatgaaat

SEQ ID NO: 565096 - DNA, 13 bp, D. melanogaster
aatgccatggaaa

SEQ ID NO: 565097 - DNA, 13 bp, D. melanogaster
aatgccatggcaa

SEQ ID NO: 565098 - DNA, 13 bp, D. melanogaster
aatgccattaaag

SEQ ID NO: 565099 - DNA, 13 bp, D. melanogaster
aatgccattaaat

SEQ ID NO: 565100 - DNA, 13 bp, D. melanogaster
aatgccattcaat

SEQ ID NO: 565101 - DNA, 13 bp, D. melanogaster
aatgccattgaaa

SEQ ID NO: 565102 - DNA, 13 bp, D. melanogaster
aatgccattgcca

SEQ ID NO: 565103 - DNA, 13 bp, D. melanogaster
aatgccatttgcc

SEQ ID NO: 565104 - DNA, 13 bp, D. melanogaster
aatgccatttggc

SEQ ID NO: 565105 - DNA, 14 bp, D. melanogaster
aatgccatttggcc

SEQ ID NO: 565106 - DNA, 13 bp, D. melanogaster
aatgccatttggt

SEQ ID NO: 565107 - DNA, 13 bp, D. melanogaster
aatgccattttaa

SEQ ID NO: 565108 - DNA, 13 bp, D. melanogaster
aatgccattttga

SEQ ID NO: 565109 - DNA, 13 bp, D. melanogaster
aatgccattttgt

SEQ ID NO: 565110 - DNA, 13 bp, D. melanogaster
aatgccattttta

SEQ ID NO: 565111 - DNA, 13 bp, D. melanogaster
aatgcccaaaaaa

SEQ ID NO: 565112 - DNA, 13 bp, D. melanogaster
aatgcccaaaaat

SEQ ID NO: 565113 - DNA, 14 bp, D. melanogaster
aatgcccaaaacaa

SEQ ID NO: 565114 - DNA, 13 bp, D. melanogaster
aatgcccaatatc

SEQ ID NO: 565115 - DNA, 13 bp, D. melanogaster
aatgcccaatgcc

SEQ ID NO: 565116 - DNA, 13 bp, D. melanogaster
aatgccccaaaaa

SEQ ID NO: 565117 - DNA, 15 bp, D. melanogaster
aatgccccaatttgc

SEQ ID NO: 565118 - DNA, 13 bp, D. melanogaster
aatgccccagcca

SEQ ID NO: 565119 - DNA, 13 bp, D. melanogaster
aatgcccgaaaat

SEQ ID NO: 565120 - DNA, 13 bp, D. melanogaster
aatgcccttaagt

SEQ ID NO: 565121 - DNA, 13 bp, D. melanogaster
aatgccgaaaaaa

SEQ ID NO: 565122 - DNA, 13 bp, D. melanogaster
aatgccgaaatgc

SEQ ID NO: 565123 - DNA, 13 bp, D. melanogaster
aatgccgaatgca

SEQ ID NO: 565124 - DNA, 13 bp, D. melanogaster
aatgccgaggcat

SEQ ID NO: 565125 - DNA, 13 bp, D. melanogaster
aatgccgtcttta

SEQ ID NO: 565126 - DNA, 13 bp, D. melanogaster
aatgccgtttggc

SEQ ID NO: 565127 - DNA, 14 bp, D. melanogaster
aatgccgtttggcc

SEQ ID NO: 565128 - DNA, 13 bp, D. melanogaster
aatgcctgaaaat

SEQ ID NO: 565129 - DNA, 14 bp, D. melanogaster
aatgcctgcttgaa

SEQ ID NO: 565130 - DNA, 13 bp, D. melanogaster
aatgccttaatta

SEQ ID NO: 565131 - DNA, 13 bp, D. melanogaster
aatgcctttggcc

SEQ ID NO: 565132 - DNA, 13 bp, D. melanogaster
aatgcctttggct

SEQ ID NO: 565133 - DNA, 13 bp, D. melanogaster
aatgcctttgttt

SEQ ID NO: 565134 - DNA, 13 bp, D. melanogaster
aatgcctttttaa

SEQ ID NO: 565135 - DNA, 14 bp, D. melanogaster
aatgcgaaaaaaat

SEQ ID NO: 565136 - DNA, 13 bp, D. melanogaster
aatgcgaaaaaat

SEQ ID NO: 565137 - DNA, 13 bp, D. melanogaster
aatgcgaaaaaca

SEQ ID NO: 565138 - DNA, 13 bp, D. melanogaster
aatgcgaaaaacg

SEQ ID NO: 565139 - DNA, 13 bp, D. melanogaster
aatgcgaaaaatg

SEQ ID NO: 565140 - DNA, 14 bp, D. melanogaster
aatgcgaaaaatga

SEQ ID NO: 565141 - DNA, 13 bp, D. melanogaster
aatgcgaaaaatt

SEQ ID NO: 565142 - DNA, 14 bp, D. melanogaster
aatgcgaaaaattg

SEQ ID NO: 565143 - DNA, 13 bp, D. melanogaster
aatgcgaaaacaa

SEQ ID NO: 565144 - DNA, 13 bp, D. melanogaster
aatgcgaaaagtt

SEQ ID NO: 565145 - DNA, 13 bp, D. melanogaster
aatgcgaaaataa

SEQ ID NO: 565146 - DNA, 14 bp, D. melanogaster
aatgcgaaaataaa

SEQ ID NO: 565147 - DNA, 13 bp, D. melanogaster
aatgcgaaaatca

SEQ ID NO: 565148 - DNA, 13 bp, D. melanogaster
aatgcgaaaattg

SEQ ID NO: 565149 - DNA, 13 bp, D. melanogaster
aatgcgaaaattt

SEQ ID NO: 565150 - DNA, 14 bp, D. melanogaster
aatgcgaaaatttg

SEQ ID NO: 565151 - DNA, 13 bp, D. melanogaster
aatgcgaaacaaa

SEQ ID NO: 565152 - DNA, 14 bp, D. melanogaster
aatgcgaaacaaaa

SEQ ID NO: 565153 - DNA, 13 bp, D. melanogaster
aatgcgaaacgaa

SEQ ID NO: 565154 - DNA, 13 bp, D. melanogaster
aatgcgaaactat

SEQ ID NO: 565155 - DNA, 13 bp, D. melanogaster
aatgcgaaagaaa

SEQ ID NO: 565156 - DNA, 13 bp, D. melanogaster
aatgcgaaagcaa

SEQ ID NO: 565157 - DNA, 14 bp, D. melanogaster
aatgcgaaataaaa

SEQ ID NO: 565158 - DNA, 13 bp, D. melanogaster
aatgcgaaatttg

SEQ ID NO: 565159 - DNA, 13 bp, D. melanogaster
aatgcgaacaaaa

SEQ ID NO: 565160 - DNA, 13 bp, D. melanogaster
aatgcgaacgcaa

SEQ ID NO: 565161 - DNA, 14 bp, D. melanogaster
aatgcgaacgcgaa

SEQ ID NO: 565162 - DNA, 13 bp, D. melanogaster
aatgcgaataaaa

SEQ ID NO: 565163 - DNA, 13 bp, D. melanogaster
aatgcgaataaat

SEQ ID NO: 565164 - DNA, 13 bp, D. melanogaster
aatgcgaatacga

SEQ ID NO: 565165 - DNA, 14 bp, D. melanogaster
aatgcgaatataaa

SEQ ID NO: 565166 - DNA, 13 bp, D. melanogaster
aatgcgaatatca

SEQ ID NO: 565167 - DNA, 13 bp, D. melanogaster
aatgcgaatcaat

SEQ ID NO: 565168 - DNA, 14 bp, D. melanogaster
aatgcgaatcaatg

SEQ ID NO: 565169 - DNA, 13 bp, D. melanogaster
aatgcgaatcgaa

SEQ ID NO: 565170 - DNA, 13 bp, D. melanogaster
aatgcgaatgcaa

SEQ ID NO: 565171 - DNA, 13 bp, D. melanogaster
aatgcgaatgcat

SEQ ID NO: 565172 - DNA, 13 bp, D. melanogaster
aatgcgaatgcca

SEQ ID NO: 565173 - DNA, 13 bp, D. melanogaster
aatgcgaatgcga

SEQ ID NO: 565174 - DNA, 14 bp, D. melanogaster
aatgcgaatgcgaa

SEQ ID NO: 565175 - DNA, 14 bp, D. melanogaster
aatgcgaatggaaa

SEQ ID NO: 565176 - DNA, 13 bp, D. melanogaster
aatgcgaatgtga

SEQ ID NO: 565177 - DNA, 13 bp, D. melanogaster
aatgcgaatgtgt

SEQ ID NO: 565178 - DNA, 13 bp, D. melanogaster
aatgcgaattcga

SEQ ID NO: 565179 - DNA, 13 bp, D. melanogaster
aatgcgaattgtt

SEQ ID NO: 565180 - DNA, 13 bp, D. melanogaster
aatgcgactgcaa

SEQ ID NO: 565181 - DNA, 13 bp, D. melanogaster
aatgcgaggaaaa

SEQ ID NO: 565182 - DNA, 13 bp, D. melanogaster
aatgcgagtgcaa

SEQ ID NO: 565183 - DNA, 13 bp, D. melanogaster
aatgcgagtgcga

SEQ ID NO: 565184 - DNA, 13 bp, D. melanogaster
aatgcgattaaat

SEQ ID NO: 565185 - DNA, 13 bp, D. melanogaster
aatgcgattgcga

SEQ ID NO: 565186 - DNA, 13 bp, D. melanogaster
aatgcgatttgca

SEQ ID NO: 565187 - DNA, 13 bp, D. melanogaster
aatgcgcaaaaaa

SEQ ID NO: 565188 - DNA, 13 bp, D. melanogaster
aatgcgcaaaatg

SEQ ID NO: 565189 - DNA, 13 bp, D. melanogaster
aatgcgcaataaa

SEQ ID NO: 565190 - DNA, 14 bp, D. melanogaster
aatgcgcataaatt

SEQ ID NO: 565191 - DNA, 13 bp, D. melanogaster
aatgcgcattaat

SEQ ID NO: 565192 - DNA, 13 bp, D. melanogaster
aatgcgctgaaaa

SEQ ID NO: 565193 - DNA, 13 bp, D. melanogaster
aatgcgcttaaaa

SEQ ID NO: 565194 - DNA, 13 bp, D. melanogaster
aatgcggaaaaaa

SEQ ID NO: 565195 - DNA, 13 bp, D. melanogaster
aatgcggaaaagc

SEQ ID NO: 565196 - DNA, 13 bp, D. melanogaster
aatgcggaaaata

SEQ ID NO: 565197 - DNA, 13 bp, D. melanogaster
aatgcggaaaatg

SEQ ID NO: 565198 - DNA, 13 bp, D. melanogaster
aatgcggccaaaa

SEQ ID NO: 565199 - DNA, 13 bp, D. melanogaster
aatgcggctgcgg

SEQ ID NO: 565200 - DNA, 13 bp, D. melanogaster
aatgcggtgtgaa

SEQ ID NO: 565201 - DNA, 14 bp, D. melanogaster
aatgcggtgtgcat

SEQ ID NO: 565202 - DNA, 13 bp, D. melanogaster
aatgcgtattttt

SEQ ID NO: 565203 - DNA, 13 bp, D. melanogaster
aatgcgtgtaaat

SEQ ID NO: 565204 - DNA, 13 bp, D. melanogaster
aatgcgttggcca

SEQ ID NO: 565205 - DNA, 14 bp, D. melanogaster
aatgcgttggccat

SEQ ID NO: 565206 - DNA, 13 bp, D. melanogaster
aatgcgttttaaa

SEQ ID NO: 565207 - DNA, 14 bp, D. melanogaster
aatgcgttttaatt

SEQ ID NO: 565208 - DNA, 13 bp, D. melanogaster
aatgcgttttcaa

SEQ ID NO: 565209 - DNA, 13 bp, D. melanogaster
aatgcgtttttaa

SEQ ID NO: 565210 - DNA, 13 bp, D. melanogaster
aatgcgtttttgc

SEQ ID NO: 565211 - DNA, 14 bp, D. melanogaster
aatgctaaaataaa

SEQ ID NO: 565212 - DNA, 13 bp, D. melanogaster
aatgctaaacaaa

SEQ ID NO: 565213 - DNA, 13 bp, D. melanogaster
aatgctaaagaaa

SEQ ID NO: 565214 - DNA, 13 bp, D. melanogaster
aatgctaaagctg

SEQ ID NO: 565215 - DNA, 13 bp, D. melanogaster
aatgctaaataaa

SEQ ID NO: 565216 - DNA, 13 bp, D. melanogaster
aatgctaaatgaa

SEQ ID NO: 565217 - DNA, 13 bp, D. melanogaster
aatgctaaatgca

SEQ ID NO: 565218 - DNA, 13 bp, D. melanogaster
aatgctaaatgct

SEQ ID NO: 565219 - DNA, 13 bp, D. melanogaster
aatgctaaatgtg

SEQ ID NO: 565220 - DNA, 13 bp, D. melanogaster
aatgctaagcaaa

SEQ ID NO: 565221 - DNA, 13 bp, D. melanogaster
aatgctaataaaa

SEQ ID NO: 565222 - DNA, 13 bp, D. melanogaster
aatgctaataata

SEQ ID NO: 565223 - DNA, 13 bp, D. melanogaster
aatgctaatgaat

SEQ ID NO: 565224 - DNA, 13 bp, D. melanogaster
aatgctaatgcca

SEQ ID NO: 565225 - DNA, 13 bp, D. melanogaster
aatgctaatgcta

SEQ ID NO: 565226 - DNA, 13 bp, D. melanogaster
aatgctaattaaa

SEQ ID NO: 565227 - DNA, 13 bp, D. melanogaster
aatgctaattaat

SEQ ID NO: 565228 - DNA, 13 bp, D. melanogaster
aatgctaattgaa

SEQ ID NO: 565229 - DNA, 13 bp, D. melanogaster
aatgctaatttaa

SEQ ID NO: 565230 - DNA, 13 bp, D. melanogaster
aatgctaatttta

SEQ ID NO: 565231 - DNA, 13 bp, D. melanogaster
aatgctaattttg

SEQ ID NO: 565232 - DNA, 13 bp, D. melanogaster
aatgctataaaaa

SEQ ID NO: 565233 - DNA, 13 bp, D. melanogaster
aatgctatagtca

SEQ ID NO: 565234 - DNA, 13 bp, D. melanogaster
aatgctatagtcg

SEQ ID NO: 565235 - DNA, 14 bp, D. melanogaster
aatgctatagtcga

SEQ ID NO: 565236 - DNA, 13 bp, D. melanogaster
aatgctatatttt

SEQ ID NO: 565237 - DNA, 13 bp, D. melanogaster
aatgctattaatt

SEQ ID NO: 565238 - DNA, 13 bp, D. melanogaster
aatgctatttaaa

SEQ ID NO: 565239 - DNA, 13 bp, D. melanogaster
aatgctatttaat

SEQ ID NO: 565240 - DNA, 13 bp, D. melanogaster
aatgctcaaaatg

SEQ ID NO: 565241 - DNA, 13 bp, D. melanogaster
aatgctcaacaaa

SEQ ID NO: 565242 - DNA, 13 bp, D. melanogaster
aatgctcataaaa

SEQ ID NO: 565243 - DNA, 13 bp, D. melanogaster
aatgctcattaaa

SEQ ID NO: 565244 - DNA, 13 bp, D. melanogaster
aatgctccaaaat

SEQ ID NO: 565245 - DNA, 13 bp, D. melanogaster
aatgctcctcctg

SEQ ID NO: 565246 - DNA, 13 bp, D. melanogaster
aatgctcgaaaaa

SEQ ID NO: 565247 - DNA, 13 bp, D. melanogaster
aatgctctgatcg

SEQ ID NO: 565248 - DNA, 13 bp, D. melanogaster
aatgctctttaaa

SEQ ID NO: 565249 - DNA, 13 bp, D. melanogaster
aatgctgaaaatt

SEQ ID NO: 565250 - DNA, 13 bp, D. melanogaster
aatgctgaaatgc

SEQ ID NO: 565251 - DNA, 13 bp, D. melanogaster
aatgctgaaattt

SEQ ID NO: 565252 - DNA, 13 bp, D. melanogaster
aatgctgaataaa

SEQ ID NO: 565253 - DNA, 13 bp, D. melanogaster
aatgctgaatgaa

SEQ ID NO: 565254 - DNA, 13 bp, D. melanogaster
aatgctgaatgct

SEQ ID NO: 565255 - DNA, 14 bp, D. melanogaster
aatgctgaatgctg

SEQ ID NO: 565256 - DNA, 13 bp, D. melanogaster
aatgctgacaaat

SEQ ID NO: 565257 - DNA, 14 bp, D. melanogaster
aatgctgacaaatt

SEQ ID NO: 565258 - DNA, 13 bp, D. melanogaster
aatgctgacattc

SEQ ID NO: 565259 - DNA, 13 bp, D. melanogaster
aatgctgaccatg

SEQ ID NO: 565260 - DNA, 13 bp, D. melanogaster
aatgctgagcatg

SEQ ID NO: 565261 - DNA, 13 bp, D. melanogaster
aatgctgataaat

SEQ ID NO: 565262 - DNA, 13 bp, D. melanogaster
aatgctgatgatg

SEQ ID NO: 565263 - DNA, 13 bp, D. melanogaster
aatgctgcaaatg

SEQ ID NO: 565264 - DNA, 13 bp, D. melanogaster
aatgctgcaaatt

SEQ ID NO: 565265 - DNA, 13 bp, D. melanogaster
aatgctgcatttt

SEQ ID NO: 565266 - DNA, 13 bp, D. melanogaster
aatgctgccaaaa

SEQ ID NO: 565267 - DNA, 13 bp, D. melanogaster
aatgctgccaaat

SEQ ID NO: 565268 - DNA, 13 bp, D. melanogaster
aatgctgccaatt

SEQ ID NO: 565269 - DNA, 13 bp, D. melanogaster
aatgctgccctgc

SEQ ID NO: 565270 - DNA, 13 bp, D. melanogaster
aatgctgctgcag

SEQ ID NO: 565271 - DNA, 13 bp, D. melanogaster
aatgctggaaaat

SEQ ID NO: 565272 - DNA, 13 bp, D. melanogaster
aatgctggcaaaa

SEQ ID NO: 565273 - DNA, 14 bp, D. melanogaster
aatgctggccatta

SEQ ID NO: 565274 - DNA, 13 bp, D. melanogaster
aatgctgggaaat

SEQ ID NO: 565275 - DNA, 13 bp, D. melanogaster
aatgctggtgctg

SEQ ID NO: 565276 - DNA, 13 bp, D. melanogaster
aatgctgtaaatt

SEQ ID NO: 565277 - DNA, 13 bp, D. melanogaster
aatgctgtgaaaa

SEQ ID NO: 565278 - DNA, 13 bp, D. melanogaster
aatgctgtgaaat

SEQ ID NO: 565279 - DNA, 13 bp, D. melanogaster
aatgctgtggaaa

SEQ ID NO: 565280 - DNA, 13 bp, D. melanogaster
aatgctgttgctg

SEQ ID NO: 565281 - DNA, 13 bp, D. melanogaster
aatgctgttttgt

SEQ ID NO: 565282 - DNA, 13 bp, D. melanogaster
aatgcttaaaact

SEQ ID NO: 565283 - DNA, 13 bp, D. melanogaster
aatgcttaaagga

SEQ ID NO: 565284 - DNA, 13 bp, D. melanogaster
aatgcttaaatgc

SEQ ID NO: 565285 - DNA, 13 bp, D. melanogaster
aatgcttaattaa

SEQ ID NO: 565286 - DNA, 14 bp, D. melanogaster
aatgcttaccacgg

SEQ ID NO: 565287 - DNA, 13 bp, D. melanogaster
aatgcttattaat

SEQ ID NO: 565288 - DNA, 13 bp, D. melanogaster
aatgcttatttat

SEQ ID NO: 565289 - DNA, 13 bp, D. melanogaster
aatgctttaaagt

SEQ ID NO: 565290 - DNA, 13 bp, D. melanogaster
aatgctttaaatg

SEQ ID NO: 565291 - DNA, 13 bp, D. melanogaster
aatgctttacaaa

SEQ ID NO: 565292 - DNA, 13 bp, D. melanogaster
aatgctttcaaat

SEQ ID NO: 565293 - DNA, 13 bp, D. melanogaster
aatgctttcaatt

SEQ ID NO: 565294 - DNA, 14 bp, D. melanogaster
aatgctttcaattt

SEQ ID NO: 565295 - DNA, 13 bp, D. melanogaster
aatgctttccatt

SEQ ID NO: 565296 - DNA, 13 bp, D. melanogaster
aatgctttgattt

SEQ ID NO: 565297 - DNA, 13 bp, D. melanogaster
aatgctttgtaca

SEQ ID NO: 565298 - DNA, 13 bp, D. melanogaster
aatgcttttaaat

SEQ ID NO: 565299 - DNA, 13 bp, D. melanogaster
aatgcttttatat

SEQ ID NO: 565300 - DNA, 13 bp, D. melanogaster
aatgcttttatta

SEQ ID NO: 565301 - DNA, 13 bp, D. melanogaster
aatgcttttgctt

SEQ ID NO: 565302 - DNA, 13 bp, D. melanogaster
aatgcttttggca

SEQ ID NO: 565303 - DNA, 13 bp, D. melanogaster
aatgctttttgtg

SEQ ID NO: 565304 - DNA, 13 bp, D. melanogaster
aatggaaaaagct

SEQ ID NO: 565305 - DNA, 13 bp, D. melanogaster
aatggaaaaagtc

SEQ ID NO: 565306 - DNA, 13 bp, D. melanogaster
aatggaaaaatac

SEQ ID NO: 565307 - DNA, 13 bp, D. melanogaster
aatggaaaaatgc

SEQ ID NO: 565308 - DNA, 13 bp, D. melanogaster
aatggaaaaattg

SEQ ID NO: 565309 - DNA, 13 bp, D. melanogaster
aatggaaaacaat

SEQ ID NO: 565310 - DNA, 13 bp, D. melanogaster
aatggaaaaccaa

SEQ ID NO: 565311 - DNA, 14 bp, D. melanogaster
aatggaaaaccaaa

SEQ ID NO: 565312 - DNA, 13 bp, D. melanogaster
aatggaaaacgaa

SEQ ID NO: 565313 - DNA, 14 bp, D. melanogaster
aatggaaaacgaaa

SEQ ID NO: 565314 - DNA, 13 bp, D. melanogaster
aatggaaaacgca

SEQ ID NO: 565315 - DNA, 13 bp, D. melanogaster
aatggaaaacgga

SEQ ID NO: 565316 - DNA, 13 bp, D. melanogaster
aatggaaaactaa

SEQ ID NO: 565317 - DNA, 13 bp, D. melanogaster
aatggaaaactca

SEQ ID NO: 565318 - DNA, 13 bp, D. melanogaster
aatggaaaactgg

SEQ ID NO: 565319 - DNA, 13 bp, D. melanogaster
aatggaaaactgt

SEQ ID NO: 565320 - DNA, 13 bp, D. melanogaster
aatggaaaacttt

SEQ ID NO: 565321 - DNA, 13 bp, D. melanogaster
aatggaaaagcaa

SEQ ID NO: 565322 - DNA, 13 bp, D. melanogaster
aatggaaaagctt

SEQ ID NO: 565323 - DNA, 13 bp, D. melanogaster
aatggaaaagtga

SEQ ID NO: 565324 - DNA, 13 bp, D. melanogaster
aatggaaaagtgc

SEQ ID NO: 565325 - DNA, 13 bp, D. melanogaster
aatggaaaagtgg

SEQ ID NO: 565326 - DNA, 13 bp, D. melanogaster
aatggaaaagttt

SEQ ID NO: 565327 - DNA, 14 bp, D. melanogaster
aatggaaaagttta

SEQ ID NO: 565328 - DNA, 13 bp, D. melanogaster
aatggaaaatatg

SEQ ID NO: 565329 - DNA, 13 bp, D. melanogaster
aatggaaaatcaa

SEQ ID NO: 565330 - DNA, 13 bp, D. melanogaster
aatggaaaatcga

SEQ ID NO: 565331 - DNA, 13 bp, D. melanogaster
aatggaaaatctt

SEQ ID NO: 565332 - DNA, 13 bp, D. melanogaster
aatggaaaatgcg

SEQ ID NO: 565333 - DNA, 13 bp, D. melanogaster
aatggaaaatgga

SEQ ID NO: 565334 - DNA, 13 bp, D. melanogaster
aatggaaaatggc

SEQ ID NO: 565335 - DNA, 14 bp, D. melanogaster
aatggaaaatggca

SEQ ID NO: 565336 - DNA, 13 bp, D. melanogaster
aatggaaaatgtg

SEQ ID NO: 565337 - DNA, 13 bp, D. melanogaster
aatggaaaatgtt

SEQ ID NO: 565338 - DNA, 14 bp, D. melanogaster
aatggaaaatgttt

SEQ ID NO: 565339 - DNA, 13 bp, D. melanogaster
aatggaaaattat

SEQ ID NO: 565340 - DNA, 13 bp, D. melanogaster
aatggaaaattgc

SEQ ID NO: 565341 - DNA, 13 bp, D. melanogaster
aatggaaaatttg

SEQ ID NO: 565342 - DNA, 14 bp, D. melanogaster
aatggaaaatttgt

SEQ ID NO: 565343 - DNA, 13 bp, D. melanogaster
aatggaaacaaac

SEQ ID NO: 565344 - DNA, 13 bp, D. melanogaster
aatggaaacaaag

SEQ ID NO: 565345 - DNA, 13 bp, D. melanogaster
aatggaaacaaca

SEQ ID NO: 565346 - DNA, 13 bp, D. melanogaster
aatggaaacaatt

SEQ ID NO: 565347 - DNA, 13 bp, D. melanogaster
aatggaaacagaa

SEQ ID NO: 565348 - DNA, 13 bp, D. melanogaster
aatggaaaccaaa

SEQ ID NO: 565349 - DNA, 13 bp, D. melanogaster
aatggaaaccgaa

SEQ ID NO: 565350 - DNA, 14 bp, D. melanogaster
aatggaaaccgaaa

SEQ ID NO: 565351 - DNA, 13 bp, D. melanogaster
aatggaaacgaaa

SEQ ID NO: 565352 - DNA, 13 bp, D. melanogaster
aatggaaactttt

SEQ ID NO: 565353 - DNA, 13 bp, D. melanogaster
aatggaaagcatt

SEQ ID NO: 565354 - DNA, 13 bp, D. melanogaster
aatggaaaggcaa

SEQ ID NO: 565355 - DNA, 13 bp, D. melanogaster
aatggaaagtttt

SEQ ID NO: 565356 - DNA, 13 bp, D. melanogaster
aatggaaatacaa

SEQ ID NO: 565357 - DNA, 13 bp, D. melanogaster
aatggaaatagat

SEQ ID NO: 565358 - DNA, 13 bp, D. melanogaster
aatggaaatcaat

SEQ ID NO: 565359 - DNA, 13 bp, D. melanogaster
aatggaaatcata

SEQ ID NO: 565360 - DNA, 13 bp, D. melanogaster
aatggaaatccaa

SEQ ID NO: 565361 - DNA, 13 bp, D. melanogaster
aatggaaatcgat

SEQ ID NO: 565362 - DNA, 14 bp, D. melanogaster
aatggaaatgaaat

SEQ ID NO: 565363 - DNA, 13 bp, D. melanogaster
aatggaaatgaag

SEQ ID NO: 565364 - DNA, 13 bp, D. melanogaster
aatggaaatgaat

SEQ ID NO: 565365 - DNA, 13 bp, D. melanogaster
aatggaaatgaga

SEQ ID NO: 565366 - DNA, 13 bp, D. melanogaster
aatggaaatgatt

SEQ ID NO: 565367 - DNA, 13 bp, D. melanogaster
aatggaaatgcaa

SEQ ID NO: 565368 - DNA, 14 bp, D. melanogaster
aatggaaatgcaaa

SEQ ID NO: 565369 - DNA, 13 bp, D. melanogaster
aatggaaatgcat

SEQ ID NO: 565370 - DNA, 14 bp, D. melanogaster
aatggaaatgcatt

SEQ ID NO: 565371 - DNA, 13 bp, D. melanogaster
aatggaaatgcca

SEQ ID NO: 565372 - DNA, 14 bp, D. melanogaster
aatggaaatggaag

SEQ ID NO: 565373 - DNA, 13 bp, D. melanogaster
aatggaaatggag

SEQ ID NO: 565374 - DNA, 14 bp, D. melanogaster
aatggaaatggagc

SEQ ID NO: 565375 - DNA, 13 bp, D. melanogaster
aatggaaatggcc

SEQ ID NO: 565376 - DNA, 13 bp, D. melanogaster
aatggaaatggcg

SEQ ID NO: 565377 - DNA, 13 bp, D. melanogaster
aatggaaatggga

SEQ ID NO: 565378 - DNA, 14 bp, D. melanogaster
aatggaaatgggaa

SEQ ID NO: 565379 - DNA, 13 bp, D. melanogaster
aatggaaatgggc

SEQ ID NO: 565380 - DNA, 13 bp, D. melanogaster
aatggaaatggta

SEQ ID NO: 565381 - DNA, 14 bp, D. melanogaster
aatggaaatggtaa

SEQ ID NO: 565382 - DNA, 13 bp, D. melanogaster
aatggaaatgtca

SEQ ID NO: 565383 - DNA, 13 bp, D. melanogaster
aatggaaatgtgg

SEQ ID NO: 565384 - DNA, 13 bp, D. melanogaster
aatggaaatgtta

SEQ ID NO: 565385 - DNA, 13 bp, D. melanogaster
aatggaaatgttg

SEQ ID NO: 565386 - DNA, 13 bp, D. melanogaster
aatggaaattaat

SEQ ID NO: 565387 - DNA, 13 bp, D. melanogaster
aatggaaattaca

SEQ ID NO: 565388 - DNA, 13 bp, D. melanogaster
aatggaaattatg

SEQ ID NO: 565389 - DNA, 14 bp, D. melanogaster
aatggaaattatta

SEQ ID NO: 565390 - DNA, 13 bp, D. melanogaster
aatggaaattcct

SEQ ID NO: 565391 - DNA, 13 bp, D. melanogaster
aatggaaattcga

SEQ ID NO: 565392 - DNA, 13 bp, D. melanogaster
aatggaaattgaa

SEQ ID NO: 565393 - DNA, 14 bp, D. melanogaster
aatggaaattgaaa

SEQ ID NO: 565394 - DNA, 13 bp, D. melanogaster
aatggaaattgca

SEQ ID NO: 565395 - DNA, 13 bp, D. melanogaster
aatggaaattggc

SEQ ID NO: 565396 - DNA, 13 bp, D. melanogaster
aatggaaatttaa

SEQ ID NO: 565397 - DNA, 13 bp, D. melanogaster
aatggaaatttat

SEQ ID NO: 565398 - DNA, 13 bp, D. melanogaster
aatggaaatttta

SEQ ID NO: 565399 - DNA, 13 bp, D. melanogaster
aatggaaattttg

SEQ ID NO: 565400 - DNA, 13 bp, D. melanogaster
aatggaaattttt

SEQ ID NO: 565401 - DNA, 14 bp, D. melanogaster
aatggaacacacac

SEQ ID NO: 565402 - DNA, 13 bp, D. melanogaster
aatggaacatact

SEQ ID NO: 565403 - DNA, 13 bp, D. melanogaster
aatggaactagtc

SEQ ID NO: 565404 - DNA, 13 bp, D. melanogaster
aatggaactgcaa

SEQ ID NO: 565405 - DNA, 14 bp, D. melanogaster
aatggaactgcaaa

SEQ ID NO: 565406 - DNA, 14 bp, D. melanogaster
aatggaagaacttt

SEQ ID NO: 565407 - DNA, 13 bp, D. melanogaster
aatggaagtggag

SEQ ID NO: 565408 - DNA, 13 bp, D. melanogaster
aatggaagtggct

SEQ ID NO: 565409 - DNA, 13 bp, D. melanogaster
aatggaagtggga

SEQ ID NO: 565410 - DNA, 13 bp, D. melanogaster
aatggaataaatt

SEQ ID NO: 565411 - DNA, 13 bp, D. melanogaster
aatggaatagaat

SEQ ID NO: 565412 - DNA, 13 bp, D. melanogaster
aatggaatatatt

SEQ ID NO: 565413 - DNA, 13 bp, D. melanogaster
aatggaatattaa

SEQ ID NO: 565414 - DNA, 13 bp, D. melanogaster
aatggaatattta

SEQ ID NO: 565415 - DNA, 13 bp, D. melanogaster
aatggaatccaat

SEQ ID NO: 565416 - DNA, 13 bp, D. melanogaster
aatggaatcgatt

SEQ ID NO: 565417 - DNA, 13 bp, D. melanogaster
aatggaatgcatt

SEQ ID NO: 565418 - DNA, 13 bp, D. melanogaster
aatggaatggaag

SEQ ID NO: 565419 - DNA, 13 bp, D. melanogaster
aatggaatggaat

SEQ ID NO: 565420 - DNA, 13 bp, D. melanogaster
aatggaatgggaa

SEQ ID NO: 565421 - DNA, 14 bp, D. melanogaster
aatggaatgggaaa

SEQ ID NO: 565422 - DNA, 13 bp, D. melanogaster
aatggaatgggat

SEQ ID NO: 565423 - DNA, 13 bp, D. melanogaster
aatggaatgtcat

SEQ ID NO: 565424 - DNA, 13 bp, D. melanogaster
aatggaattaagt

SEQ ID NO: 565425 - DNA, 13 bp, D. melanogaster
aatggaattaatg

SEQ ID NO: 565426 - DNA, 13 bp, D. melanogaster
aatggaattaatt

SEQ ID NO: 565427 - DNA, 13 bp, D. melanogaster
aatggaattatta

SEQ ID NO: 565428 - DNA, 13 bp, D. melanogaster
aatggaattattt

SEQ ID NO: 565429 - DNA, 13 bp, D. melanogaster
aatggaattcaaa

SEQ ID NO: 565430 - DNA, 13 bp, D. melanogaster
aatggaattcatt

SEQ ID NO: 565431 - DNA, 13 bp, D. melanogaster
aatggaattcttg

SEQ ID NO: 565432 - DNA, 13 bp, D. melanogaster
aatggaattgaaa

SEQ ID NO: 565433 - DNA, 13 bp, D. melanogaster
aatggaattgaat

SEQ ID NO: 565434 - DNA, 13 bp, D. melanogaster
aatggaattgcaa

SEQ ID NO: 565435 - DNA, 13 bp, D. melanogaster
aatggaatttatg

SEQ ID NO: 565436 - DNA, 13 bp, D. melanogaster
aatggaatttcca

SEQ ID NO: 565437 - DNA, 13 bp, D. melanogaster
aatggaattttaa

SEQ ID NO: 565438 - DNA, 14 bp, D. melanogaster
aatggaattttaaa

SEQ ID NO: 565439 - DNA, 13 bp, D. melanogaster
aatggaattttca

SEQ ID NO: 565440 - DNA, 13 bp, D. melanogaster
aatggacaaatgg

SEQ ID NO: 565441 - DNA, 13 bp, D. melanogaster
aatggacaacaaa

SEQ ID NO: 565442 - DNA, 13 bp, D. melanogaster
aatggacaagcga

SEQ ID NO: 565443 - DNA, 13 bp, D. melanogaster
aatggacaaggct

SEQ ID NO: 565444 - DNA, 13 bp, D. melanogaster
aatggacagcaga

SEQ ID NO: 565445 - DNA, 14 bp, D. melanogaster
aatggacagcagaa

SEQ ID NO: 565446 - DNA, 13 bp, D. melanogaster
aatggacatggat

SEQ ID NO: 565447 - DNA, 13 bp, D. melanogaster
aatggacgaagaa

SEQ ID NO: 565448 - DNA, 13 bp, D. melanogaster
aatggacttatta

SEQ ID NO: 565449 - DNA, 13 bp, D. melanogaster
aatggactttaaa

SEQ ID NO: 565450 - DNA, 13 bp, D. melanogaster
aatggagaaaaac

SEQ ID NO: 565451 - DNA, 13 bp, D. melanogaster
aatggagaaaatg

SEQ ID NO: 565452 - DNA, 13 bp, D. melanogaster
aatggagaacgga

SEQ ID NO: 565453 - DNA, 13 bp, D. melanogaster
aatggagaatgga

SEQ ID NO: 565454 - DNA, 13 bp, D. melanogaster
aatggagaattca

SEQ ID NO: 565455 - DNA, 13 bp, D. melanogaster
aatggagcaattt

SEQ ID NO: 565456 - DNA, 13 bp, D. melanogaster
aatggagcagaaa

SEQ ID NO: 565457 - DNA, 13 bp, D. melanogaster
aatggagcggaaa

SEQ ID NO: 565458 - DNA, 13 bp, D. melanogaster
aatggaggtggag

SEQ ID NO: 565459 - DNA, 13 bp, D. melanogaster
aatggagtaataa

SEQ ID NO: 565460 - DNA, 13 bp, D. melanogaster
aatggagtggaat

SEQ ID NO: 565461 - DNA, 13 bp, D. melanogaster
aatggagtggagt

SEQ ID NO: 565462 - DNA, 14 bp, D. melanogaster
aatggagtggagtg

SEQ ID NO: 565463 - DNA, 13 bp, D. melanogaster
aatggagttttcg

SEQ ID NO: 565464 - DNA, 13 bp, D. melanogaster
aatggatatggaa

SEQ ID NO: 565465 - DNA, 13 bp, D. melanogaster
aatggatatggat

SEQ ID NO: 565466 - DNA, 13 bp, D. melanogaster
aatggatatttat

SEQ ID NO: 565467 - DNA, 13 bp, D. melanogaster
aatggatattttt

SEQ ID NO: 565468 - DNA, 13 bp, D. melanogaster
aatggatgaaaat

SEQ ID NO: 565469 - DNA, 13 bp, D. melanogaster
aatggatggaaat

SEQ ID NO: 565470 - DNA, 14 bp, D. melanogaster
aatggatgtggatg

SEQ ID NO: 565471 - DNA, 13 bp, D. melanogaster
aatggattcaatg

SEQ ID NO: 565472 - DNA, 13 bp, D. melanogaster
aatggattccatt

SEQ ID NO: 565473 - DNA, 13 bp, D. melanogaster
aatggattgtaat

SEQ ID NO: 565474 - DNA, 13 bp, D. melanogaster
aatggatttaaaa

SEQ ID NO: 565475 - DNA, 13 bp, D. melanogaster
aatggatttaaat

SEQ ID NO: 565476 - DNA, 13 bp, D. melanogaster
aatggatttcaat

SEQ ID NO: 565477 - DNA, 13 bp, D. melanogaster
aatggatttgcaa

SEQ ID NO: 565478 - DNA, 13 bp, D. melanogaster
aatggatttgttt

SEQ ID NO: 565479 - DNA, 13 bp, D. melanogaster
aatggattttcaa

SEQ ID NO: 565480 - DNA, 13 bp, D. melanogaster
aatggattttcct

SEQ ID NO: 565481 - DNA, 13 bp, D. melanogaster
aatggatttttaa

SEQ ID NO: 565482 - DNA, 13 bp, D. melanogaster
aatggatttttta

SEQ ID NO: 565483 - DNA, 14 bp, D. melanogaster
aatggcaaaaacaa

SEQ ID NO: 565484 - DNA, 13 bp, D. melanogaster
aatggcaaaaact

SEQ ID NO: 565485 - DNA, 13 bp, D. melanogaster
aatggcaaaaagt

SEQ ID NO: 565486 - DNA, 13 bp, D. melanogaster
aatggcaaaaatg

SEQ ID NO: 565487 - DNA, 13 bp, D. melanogaster
aatggcaaaacac

SEQ ID NO: 565488 - DNA, 13 bp, D. melanogaster
aatggcaaaagga

SEQ ID NO: 565489 - DNA, 13 bp, D. melanogaster
aatggcaaaaggc

SEQ ID NO: 565490 - DNA, 13 bp, D. melanogaster
aatggcaaaaggg

SEQ ID NO: 565491 - DNA, 13 bp, D. melanogaster
aatggcaaaagtt

SEQ ID NO: 565492 - DNA, 13 bp, D. melanogaster
aatggcaaaataa

SEQ ID NO: 565493 - DNA, 13 bp, D. melanogaster
aatggcaaacatt

SEQ ID NO: 565494 - DNA, 13 bp, D. melanogaster
aatggcaaacgca

SEQ ID NO: 565495 - DNA, 13 bp, D. melanogaster
aatggcaaacgga

SEQ ID NO: 565496 - DNA, 13 bp, D. melanogaster
aatggcaaactca

SEQ ID NO: 565497 - DNA, 13 bp, D. melanogaster
aatggcaaagaat

SEQ ID NO: 565498 - DNA, 13 bp, D. melanogaster
aatggcaaaggca

SEQ ID NO: 565499 - DNA, 13 bp, D. melanogaster
aatggcaaataaa

SEQ ID NO: 565500 - DNA, 14 bp, D. melanogaster
aatggcaaataaat

SEQ ID NO: 565501 - DNA, 13 bp, D. melanogaster
aatggcaaatcaa

SEQ ID NO: 565502 - DNA, 14 bp, D. melanogaster
aatggcaaatggaa

SEQ ID NO: 565503 - DNA, 13 bp, D. melanogaster
aatggcaaatggc

SEQ ID NO: 565504 - DNA, 14 bp, D. melanogaster
aatggcaaatggca

SEQ ID NO: 565505 - DNA, 13 bp, D. melanogaster
aatggcaaatgtt

SEQ ID NO: 565506 - DNA, 13 bp, D. melanogaster
aatggcaaattat

SEQ ID NO: 565507 - DNA, 13 bp, D. melanogaster
aatggcaacaaag

SEQ ID NO: 565508 - DNA, 13 bp, D. melanogaster
aatggcaacaaca

SEQ ID NO: 565509 - DNA, 14 bp, D. melanogaster
aatggcaacaacaa

SEQ ID NO: 565510 - DNA, 13 bp, D. melanogaster
aatggcaacaact

SEQ ID NO: 565511 - DNA, 13 bp, D. melanogaster
aatggcaacaatt

SEQ ID NO: 565512 - DNA, 13 bp, D. melanogaster
aatggcaacagca

SEQ ID NO: 565513 - DNA, 13 bp, D. melanogaster
aatggcaacagct

SEQ ID NO: 565514 - DNA, 13 bp, D. melanogaster
aatggcaacataa

SEQ ID NO: 565515 - DNA, 13 bp, D. melanogaster
aatggcaactaaa

SEQ ID NO: 565516 - DNA, 13 bp, D. melanogaster
aatggcaagaaaa

SEQ ID NO: 565517 - DNA, 13 bp, D. melanogaster
aatggcaagcaat

SEQ ID NO: 565518 - DNA, 13 bp, D. melanogaster
aatggcaagccaa

SEQ ID NO: 565519 - DNA, 13 bp, D. melanogaster
aatggcaaggaaa

SEQ ID NO: 565520 - DNA, 13 bp, D. melanogaster
aatggcaataaaa

SEQ ID NO: 565521 - DNA, 14 bp, D. melanogaster
aatggcaataaaaa

SEQ ID NO: 565522 - DNA, 13 bp, D. melanogaster
aatggcaataaat

SEQ ID NO: 565523 - DNA, 13 bp, D. melanogaster
aatggcaatcaaa

SEQ ID NO: 565524 - DNA, 13 bp, D. melanogaster
aatggcaatcaat

SEQ ID NO: 565525 - DNA, 13 bp, D. melanogaster
aatggcaatcgat

SEQ ID NO: 565526 - DNA, 13 bp, D. melanogaster
aatggcaatcgcg

SEQ ID NO: 565527 - DNA, 13 bp, D. melanogaster
aatggcaatcttc

SEQ ID NO: 565528 - DNA, 13 bp, D. melanogaster
aatggcaatgaaa

SEQ ID NO: 565529 - DNA, 13 bp, D. melanogaster
aatggcaatgaac

SEQ ID NO: 565530 - DNA, 13 bp, D. melanogaster
aatggcaatgaca

SEQ ID NO: 565531 - DNA, 13 bp, D. melanogaster
aatggcaatgcaa

SEQ ID NO: 565532 - DNA, 13 bp, D. melanogaster
aatggcaatgcca

SEQ ID NO: 565533 - DNA, 14 bp, D. melanogaster
aatggcaatgccaa

SEQ ID NO: 565534 - DNA, 13 bp, D. melanogaster
aatggcaatgcga

SEQ ID NO: 565535 - DNA, 13 bp, D. melanogaster
aatggcaatggaa

SEQ ID NO: 565536 - DNA, 13 bp, D. melanogaster
aatggcaatggca

SEQ ID NO: 565537 - DNA, 14 bp, D. melanogaster
aatggcaatggcca

SEQ ID NO: 565538 - DNA, 13 bp, D. melanogaster
aatggcaatggga

SEQ ID NO: 565539 - DNA, 13 bp, D. melanogaster
aatggcaatgggc

SEQ ID NO: 565540 - DNA, 13 bp, D. melanogaster
aatggcaatgggt

SEQ ID NO: 565541 - DNA, 13 bp, D. melanogaster
aatggcaatggta

SEQ ID NO: 565542 - DNA, 13 bp, D. melanogaster
aatggcaattgtt

SEQ ID NO: 565543 - DNA, 13 bp, D. melanogaster
aatggcaatttaa

SEQ ID NO: 565544 - DNA, 13 bp, D. melanogaster
aatggcacaaaca

SEQ ID NO: 565545 - DNA, 13 bp, D. melanogaster
aatggcacaacaa

SEQ ID NO: 565546 - DNA, 13 bp, D. melanogaster
aatggcacacaaa

SEQ ID NO: 565547 - DNA, 13 bp, D. melanogaster
aatggcagaaaaa

SEQ ID NO: 565548 - DNA, 13 bp, D. melanogaster
aatggcagagaaa

SEQ ID NO: 565549 - DNA, 13 bp, D. melanogaster
aatggcagcagaa

SEQ ID NO: 565550 - DNA, 14 bp, D. melanogaster
aatggcagcagcag

SEQ ID NO: 565551 - DNA, 13 bp, D. melanogaster
aatggcagccaaa

SEQ ID NO: 565552 - DNA, 13 bp, D. melanogaster
aatggcagccaca

SEQ ID NO: 565553 - DNA, 13 bp, D. melanogaster
aatggcagcgaaa

SEQ ID NO: 565554 - DNA, 13 bp, D. melanogaster
aatggcagctgct

SEQ ID NO: 565555 - DNA, 14 bp, D. melanogaster
aatggcagctgctt

SEQ ID NO: 565556 - DNA, 13 bp, D. melanogaster
aatggcaggcaac

SEQ ID NO: 565557 - DNA, 13 bp, D. melanogaster
aatggcaggcagc

SEQ ID NO: 565558 - DNA, 13 bp, D. melanogaster
aatggcaggccaa

SEQ ID NO: 565559 - DNA, 13 bp, D. melanogaster
aatggcagggcaa

SEQ ID NO: 565560 - DNA, 13 bp, D. melanogaster
aatggcataaaaa

SEQ ID NO: 565561 - DNA, 13 bp, D. melanogaster
aatggcatggaaa

SEQ ID NO: 565562 - DNA, 13 bp, D. melanogaster
aatggcatggaat

SEQ ID NO: 565563 - DNA, 13 bp, D. melanogaster
aatggcattaaat

SEQ ID NO: 565564 - DNA, 13 bp, D. melanogaster
aatggcattaata

SEQ ID NO: 565565 - DNA, 13 bp, D. melanogaster
aatggcattcaaa

SEQ ID NO: 565566 - DNA, 13 bp, D. melanogaster
aatggcattcgaa

SEQ ID NO: 565567 - DNA, 13 bp, D. melanogaster
aatggcattcgca

SEQ ID NO: 565568 - DNA, 13 bp, D. melanogaster
aatggcattgaaa

SEQ ID NO: 565569 - DNA, 13 bp, D. melanogaster
aatggcattggca

SEQ ID NO: 565570 - DNA, 14 bp, D. melanogaster
aatggcattggcaa

SEQ ID NO: 565571 - DNA, 13 bp, D. melanogaster
aatggcatttaag

SEQ ID NO: 565572 - DNA, 13 bp, D. melanogaster
aatggcatttaat

SEQ ID NO: 565573 - DNA, 13 bp, D. melanogaster
aatggcatttata

SEQ ID NO: 565574 - DNA, 13 bp, D. melanogaster
aatggcattttca

SEQ ID NO: 565575 - DNA, 13 bp, D. melanogaster
aatggcattttcg

SEQ ID NO: 565576 - DNA, 13 bp, D. melanogaster
aatggcattttga

SEQ ID NO: 565577 - DNA, 13 bp, D. melanogaster
aatggcattttta

SEQ ID NO: 565578 - DNA, 13 bp, D. melanogaster
aatggccaaaaaa

SEQ ID NO: 565579 - DNA, 13 bp, D. melanogaster
aatggccaaaaac

SEQ ID NO: 565580 - DNA, 13 bp, D. melanogaster
aatggccaaaagg

SEQ ID NO: 565581 - DNA, 13 bp, D. melanogaster
aatggccaaaatg

SEQ ID NO: 565582 - DNA, 14 bp, D. melanogaster
aatggccaaaatgc

SEQ ID NO: 565583 - DNA, 13 bp, D. melanogaster
aatggccaaacaa

SEQ ID NO: 565584 - DNA, 13 bp, D. melanogaster
aatggccaaactg

SEQ ID NO: 565585 - DNA, 13 bp, D. melanogaster
aatggccaaagga

SEQ ID NO: 565586 - DNA, 13 bp, D. melanogaster
aatggccaaatgg

SEQ ID NO: 565587 - DNA, 14 bp, D. melanogaster
aatggccaaatggc

SEQ ID NO: 565588 - DNA, 13 bp, D. melanogaster
aatggccaacaaa

SEQ ID NO: 565589 - DNA, 13 bp, D. melanogaster
aatggccaacttt

SEQ ID NO: 565590 - DNA, 13 bp, D. melanogaster
aatggccaagaca

SEQ ID NO: 565591 - DNA, 13 bp, D. melanogaster
aatggccaattgt

SEQ ID NO: 565592 - DNA, 13 bp, D. melanogaster
aatggccacaaaa

SEQ ID NO: 565593 - DNA, 13 bp, D. melanogaster
aatggccacaaat

SEQ ID NO: 565594 - DNA, 13 bp, D. melanogaster
aatggccacaatt

SEQ ID NO: 565595 - DNA, 13 bp, D. melanogaster
aatggccaccaac

SEQ ID NO: 565596 - DNA, 13 bp, D. melanogaster
aatggccagcaaa

SEQ ID NO: 565597 - DNA, 13 bp, D. melanogaster
aatggccagcaca

SEQ ID NO: 565598 - DNA, 13 bp, D. melanogaster
aatggccagcaga

SEQ ID NO: 565599 - DNA, 14 bp, D. melanogaster
aatggccagcattt

SEQ ID NO: 565600 - DNA, 13 bp, D. melanogaster
aatggccaggaaa

SEQ ID NO: 565601 - DNA, 13 bp, D. melanogaster
aatggccaggaat

SEQ ID NO: 565602 - DNA, 13 bp, D. melanogaster
aatggccagtgga

SEQ ID NO: 565603 - DNA, 13 bp, D. melanogaster
aatggccagtggc

SEQ ID NO: 565604 - DNA, 13 bp, D. melanogaster
aatggccataaaa

SEQ ID NO: 565605 - DNA, 13 bp, D. melanogaster
aatggccataatt

SEQ ID NO: 565606 - DNA, 13 bp, D. melanogaster
aatggccattaaa

SEQ ID NO: 565607 - DNA, 13 bp, D. melanogaster
aatggccattgtt

SEQ ID NO: 565608 - DNA, 13 bp, D. melanogaster
aatggccatttgt

SEQ ID NO: 565609 - DNA, 13 bp, D. melanogaster
aatggcccaaatg

SEQ ID NO: 565610 - DNA, 13 bp, D. melanogaster
aatggccgaaaag

SEQ ID NO: 565611 - DNA, 14 bp, D. melanogaster
aatggccgaggaaa

SEQ ID NO: 565612 - DNA, 13 bp, D. melanogaster
aatggccggcaat

SEQ ID NO: 565613 - DNA, 13 bp, D. melanogaster
aatggcctacgca

SEQ ID NO: 565614 - DNA, 13 bp, D. melanogaster
aatggcgaaaaaa

SEQ ID NO: 565615 - DNA, 13 bp, D. melanogaster
aatggcgaaaaac

SEQ ID NO: 565616 - DNA, 13 bp, D. melanogaster
aatggcgaaaaat

SEQ ID NO: 565617 - DNA, 13 bp, D. melanogaster
aatggcgaaaagt

SEQ ID NO: 565618 - DNA, 13 bp, D. melanogaster
aatggcgaaaatg

SEQ ID NO: 565619 - DNA, 13 bp, D. melanogaster
aatggcgaaaatt

SEQ ID NO: 565620 - DNA, 13 bp, D. melanogaster
aatggcgaaatgg

SEQ ID NO: 565621 - DNA, 13 bp, D. melanogaster
aatggcgaatgga

SEQ ID NO: 565622 - DNA, 13 bp, D. melanogaster
aatggcgatggca

SEQ ID NO: 565623 - DNA, 13 bp, D. melanogaster
aatggcgatggtg

SEQ ID NO: 565624 - DNA, 13 bp, D. melanogaster
aatggcggaaaag

SEQ ID NO: 565625 - DNA, 13 bp, D. melanogaster
aatggcgtttcac

SEQ ID NO: 565626 - DNA, 14 bp, D. melanogaster
aatggctaaataaa

SEQ ID NO: 565627 - DNA, 14 bp, D. melanogaster
aatggctaccttac

SEQ ID NO: 565628 - DNA, 13 bp, D. melanogaster
aatggctataaca

SEQ ID NO: 565629 - DNA, 13 bp, D. melanogaster
aatggctcaaatg

SEQ ID NO: 565630 - DNA, 13 bp, D. melanogaster
aatggctgcaaat

SEQ ID NO: 565631 - DNA, 13 bp, D. melanogaster
aatggctgcactt

SEQ ID NO: 565632 - DNA, 13 bp, D. melanogaster
aatggctgccaaa

SEQ ID NO: 565633 - DNA, 13 bp, D. melanogaster
aatggctgccatt

SEQ ID NO: 565634 - DNA, 13 bp, D. melanogaster
aatggctgcgaaa

SEQ ID NO: 565635 - DNA, 13 bp, D. melanogaster
aatggctgctgtt

SEQ ID NO: 565636 - DNA, 13 bp, D. melanogaster
aatggctggaaaa

SEQ ID NO: 565637 - DNA, 13 bp, D. melanogaster
aatggctggcaaa

SEQ ID NO: 565638 - DNA, 13 bp, D. melanogaster
aatggctggcaat

SEQ ID NO: 565639 - DNA, 13 bp, D. melanogaster
aatggctggccat

SEQ ID NO: 565640 - DNA, 13 bp, D. melanogaster
aatggctgggaaa

SEQ ID NO: 565641 - DNA, 13 bp, D. melanogaster
aatggcttaaaaa

SEQ ID NO: 565642 - DNA, 13 bp, D. melanogaster
aatggcttaaatg

SEQ ID NO: 565643 - DNA, 13 bp, D. melanogaster
aatggcttaataa

SEQ ID NO: 565644 - DNA, 13 bp, D. melanogaster
aatggcttaatta

SEQ ID NO: 565645 - DNA, 13 bp, D. melanogaster
aatggcttcccta

SEQ ID NO: 565646 - DNA, 13 bp, D. melanogaster
aatggctttaaaa

SEQ ID NO: 565647 - DNA, 13 bp, D. melanogaster
aatggctttaaat

SEQ ID NO: 565648 - DNA, 13 bp, D. melanogaster
aatggctttaagc

SEQ ID NO: 565649 - DNA, 13 bp, D. melanogaster
aatggctttattt

SEQ ID NO: 565650 - DNA, 13 bp, D. melanogaster
aatggctttcttt

SEQ ID NO: 565651 - DNA, 13 bp, D. melanogaster
aatggcttttaaa

SEQ ID NO: 565652 - DNA, 13 bp, D. melanogaster
aatggcttttatt

SEQ ID NO: 565653 - DNA, 14 bp, D. melanogaster
aatgggaaaaacaa

SEQ ID NO: 565654 - DNA, 13 bp, D. melanogaster
aatgggaaaaact

SEQ ID NO: 565655 - DNA, 13 bp, D. melanogaster
aatgggaaaaatg

SEQ ID NO: 565656 - DNA, 13 bp, D. melanogaster
aatgggaaaacaa

SEQ ID NO: 565657 - DNA, 13 bp, D. melanogaster
aatgggaaaacca

SEQ ID NO: 565658 - DNA, 13 bp, D. melanogaster
aatgggaaaacta

SEQ ID NO: 565659 - DNA, 13 bp, D. melanogaster
aatgggaaaagcg

SEQ ID NO: 565660 - DNA, 13 bp, D. melanogaster
aatgggaaaatat

SEQ ID NO: 565661 - DNA, 13 bp, D. melanogaster
aatgggaaaatct

SEQ ID NO: 565662 - DNA, 13 bp, D. melanogaster
aatgggaaaatga

SEQ ID NO: 565663 - DNA, 13 bp, D. melanogaster
aatgggaaacgaa

SEQ ID NO: 565664 - DNA, 13 bp, D. melanogaster
aatgggaaatatt

SEQ ID NO: 565665 - DNA, 13 bp, D. melanogaster
aatgggaaatgcg

SEQ ID NO: 565666 - DNA, 14 bp, D. melanogaster
aatgggaaatgcga

SEQ ID NO: 565667 - DNA, 14 bp, D. melanogaster
aatgggaaatggaa

SEQ ID NO: 565668 - DNA, 13 bp, D. melanogaster
aatgggaaatggc

SEQ ID NO: 565669 - DNA, 13 bp, D. melanogaster
aatgggaaatgtg

SEQ ID NO: 565670 - DNA, 13 bp, D. melanogaster
aatgggaaattat

SEQ ID NO: 565671 - DNA, 13 bp, D. melanogaster
aatgggaacggga

SEQ ID NO: 565672 - DNA, 14 bp, D. melanogaster
aatgggaacgggaa

SEQ ID NO: 565673 - DNA, 13 bp, D. melanogaster
aatgggaatgaaa

SEQ ID NO: 565674 - DNA, 13 bp, D. melanogaster
aatgggaatgaga

SEQ ID NO: 565675 - DNA, 13 bp, D. melanogaster
aatgggaatgcag

SEQ ID NO: 565676 - DNA, 13 bp, D. melanogaster
aatgggaatgcga

SEQ ID NO: 565677 - DNA, 14 bp, D. melanogaster
aatgggaatgcgaa

SEQ ID NO: 565678 - DNA, 13 bp, D. melanogaster
aatgggaatggct

SEQ ID NO: 565679 - DNA, 13 bp, D. melanogaster
aatgggaatggta

SEQ ID NO: 565680 - DNA, 13 bp, D. melanogaster
aatgggaatgtga

SEQ ID NO: 565681 - DNA, 13 bp, D. melanogaster
aatgggaatttgt

SEQ ID NO: 565682 - DNA, 13 bp, D. melanogaster
aatgggaatttta

SEQ ID NO: 565683 - DNA, 13 bp, D. melanogaster
aatgggagtggaa

SEQ ID NO: 565684 - DNA, 13 bp, D. melanogaster
aatgggatcagga

SEQ ID NO: 565685 - DNA, 13 bp, D. melanogaster
aatgggatctttt

SEQ ID NO: 565686 - DNA, 13 bp, D. melanogaster
aatgggattggga

SEQ ID NO: 565687 - DNA, 13 bp, D. melanogaster
aatgggatttgcc

SEQ ID NO: 565688 - DNA, 13 bp, D. melanogaster
aatgggattttaa

SEQ ID NO: 565689 - DNA, 13 bp, D. melanogaster
aatgggcaaaaca

SEQ ID NO: 565690 - DNA, 13 bp, D. melanogaster
aatgggcaaacaa

SEQ ID NO: 565691 - DNA, 13 bp, D. melanogaster
aatgggcaatggg

SEQ ID NO: 565692 - DNA, 13 bp, D. melanogaster
aatgggcagccaa

SEQ ID NO: 565693 - DNA, 13 bp, D. melanogaster
aatgggcataaaa

SEQ ID NO: 565694 - DNA, 13 bp, D. melanogaster
aatgggccaacaa

SEQ ID NO: 565695 - DNA, 13 bp, D. melanogaster
aatgggccataaa

SEQ ID NO: 565696 - DNA, 14 bp, D. melanogaster
aatgggcgtggcag

SEQ ID NO: 565697 - DNA, 13 bp, D. melanogaster
aatgggcgtggcc

SEQ ID NO: 565698 - DNA, 13 bp, D. melanogaster
aatgggcgtggct

SEQ ID NO: 565699 - DNA, 13 bp, D. melanogaster
aatggggaaaaac

SEQ ID NO: 565700 - DNA, 13 bp, D. melanogaster
aatggggaaaact

SEQ ID NO: 565701 - DNA, 13 bp, D. melanogaster
aatggggaaaagc

SEQ ID NO: 565702 - DNA, 13 bp, D. melanogaster
aatggggaaaata

SEQ ID NO: 565703 - DNA, 13 bp, D. melanogaster
aatggggaaaatt

SEQ ID NO: 565704 - DNA, 13 bp, D. melanogaster
aatggggaaatat

SEQ ID NO: 565705 - DNA, 13 bp, D. melanogaster
aatggggaatggg

SEQ ID NO: 565706 - DNA, 13 bp, D. melanogaster
aatggggcaaaaa

SEQ ID NO: 565707 - DNA, 13 bp, D. melanogaster
aatggggcgtggc

SEQ ID NO: 565708 - DNA, 14 bp, D. melanogaster
aatggggcgtggca

SEQ ID NO: 565709 - DNA, 14 bp, D. melanogaster
aatgggggcgtggc

SEQ ID NO: 565710 - DNA, 13 bp, D. melanogaster
aatgggtataaaa

SEQ ID NO: 565711 - DNA, 13 bp, D. melanogaster
aatgggtattatt

SEQ ID NO: 565712 - DNA, 13 bp, D. melanogaster
aatgggtgaaaat

SEQ ID NO: 565713 - DNA, 14 bp, D. melanogaster
aatgggtggaaaat

SEQ ID NO: 565714 - DNA, 13 bp, D. melanogaster
aatgggtgggaaa

SEQ ID NO: 565715 - DNA, 13 bp, D. melanogaster
aatgggtgtgctt

SEQ ID NO: 565716 - DNA, 13 bp, D. melanogaster
aatgggtttcttt

SEQ ID NO: 565717 - DNA, 13 bp, D. melanogaster
aatgggttttcca

SEQ ID NO: 565718 - DNA, 13 bp, D. melanogaster
aatgggttttggt

SEQ ID NO: 565719 - DNA, 13 bp, D. melanogaster
aatggtaaaacaa

SEQ ID NO: 565720 - DNA, 13 bp, D. melanogaster
aatggtaaacaaa

SEQ ID NO: 565721 - DNA, 13 bp, D. melanogaster
aatggtaaacagg

SEQ ID NO: 565722 - DNA, 13 bp, D. melanogaster
aatggtaaatgaa

SEQ ID NO: 565723 - DNA, 13 bp, D. melanogaster
aatggtaacaaaa

SEQ ID NO: 565724 - DNA, 13 bp, D. melanogaster
aatggtaataaat

SEQ ID NO: 565725 - DNA, 13 bp, D. melanogaster
aatggtaatgttt

SEQ ID NO: 565726 - DNA, 13 bp, D. melanogaster
aatggtacacaaa

SEQ ID NO: 565727 - DNA, 13 bp, D. melanogaster
aatggtataaata

SEQ ID NO: 565728 - DNA, 13 bp, D. melanogaster
aatggtattaaat

SEQ ID NO: 565729 - DNA, 13 bp, D. melanogaster
aatggtcaacaac

SEQ ID NO: 565730 - DNA, 14 bp, D. melanogaster
aatggtcaacaact

SEQ ID NO: 565731 - DNA, 14 bp, D. melanogaster
aatggtcaagcgaa

SEQ ID NO: 565732 - DNA, 13 bp, D. melanogaster
aatggtcagatgg

SEQ ID NO: 565733 - DNA, 13 bp, D. melanogaster
aatggtctaaaaa

SEQ ID NO: 565734 - DNA, 13 bp, D. melanogaster
aatggtctatgat

SEQ ID NO: 565735 - DNA, 13 bp, D. melanogaster
aatggtctatttt

SEQ ID NO: 565736 - DNA, 13 bp, D. melanogaster
aatggtgaaaaat

SEQ ID NO: 565737 - DNA, 13 bp, D. melanogaster
aatggtgaaaatg

SEQ ID NO: 565738 - DNA, 13 bp, D. melanogaster
aatggtgaaaatt

SEQ ID NO: 565739 - DNA, 13 bp, D. melanogaster
aatggtgaatggt

SEQ ID NO: 565740 - DNA, 13 bp, D. melanogaster
aatggtgatgatg

SEQ ID NO: 565741 - DNA, 13 bp, D. melanogaster
aatggtggaaaat

SEQ ID NO: 565742 - DNA, 13 bp, D. melanogaster
aatggtggaacaa

SEQ ID NO: 565743 - DNA, 13 bp, D. melanogaster
aatggtgggaaaa

SEQ ID NO: 565744 - DNA, 13 bp, D. melanogaster
aatggtggtcctg

SEQ ID NO: 565745 - DNA, 13 bp, D. melanogaster
aatggtgtttctg

SEQ ID NO: 565746 - DNA, 13 bp, D. melanogaster
aatggttccgtgg

SEQ ID NO: 565747 - DNA, 13 bp, D. melanogaster
aatggttggaaaa

SEQ ID NO: 565748 - DNA, 13 bp, D. melanogaster
aatggtttaaaat

SEQ ID NO: 565749 - DNA, 13 bp, D. melanogaster
aatggtttaatat

SEQ ID NO: 565750 - DNA, 13 bp, D. melanogaster
aatggtttagttt

SEQ ID NO: 565751 - DNA, 13 bp, D. melanogaster
aatggtttataaa

SEQ ID NO: 565752 - DNA, 13 bp, D. melanogaster
aatggtttcaatt

SEQ ID NO: 565753 - DNA, 13 bp, D. melanogaster
aatggtttctttt

SEQ ID NO: 565754 - DNA, 13 bp, D. melanogaster
aatggttttaaaa

SEQ ID NO: 565755 - DNA, 13 bp, D. melanogaster
aatggttttaagt

SEQ ID NO: 565756 - DNA, 13 bp, D. melanogaster
aatggttttataa

SEQ ID NO: 565757 - DNA, 13 bp, D. melanogaster
aatggttttatta

SEQ ID NO: 565758 - DNA, 13 bp, D. melanogaster
aatggttttcatt

SEQ ID NO: 565759 - DNA, 13 bp, D. melanogaster
aatggttttgaat

SEQ ID NO: 565760 - DNA, 13 bp, D. melanogaster
aatggtttttgat

SEQ ID NO: 565761 - DNA, 13 bp, D. melanogaster
aatgtaaaaacta

SEQ ID NO: 565762 - DNA, 13 bp, D. melanogaster
aatgtaaaaatgt

SEQ ID NO: 565763 - DNA, 14 bp, D. melanogaster
aatgtaaaacaaat

SEQ ID NO: 565764 - DNA, 13 bp, D. melanogaster
aatgtaaaacata

SEQ ID NO: 565765 - DNA, 13 bp, D. melanogaster
aatgtaaaacttt

SEQ ID NO: 565766 - DNA, 13 bp, D. melanogaster
aatgtaaaagttc

SEQ ID NO: 565767 - DNA, 14 bp, D. melanogaster
aatgtaaaatgcaa

SEQ ID NO: 565768 - DNA, 14 bp, D. melanogaster
aatgtaaaatgtat

SEQ ID NO: 565769 - DNA, 13 bp, D. melanogaster
aatgtaaaatgtt

SEQ ID NO: 565770 - DNA, 13 bp, D. melanogaster
aatgtaaacaaag

SEQ ID NO: 565771 - DNA, 13 bp, D. melanogaster
aatgtaaacaaat

SEQ ID NO: 565772 - DNA, 13 bp, D. melanogaster
aatgtaaacaatt

SEQ ID NO: 565773 - DNA, 13 bp, D. melanogaster
aatgtaaacatta

SEQ ID NO: 565774 - DNA, 13 bp, D. melanogaster
aatgtaaaccaaa

SEQ ID NO: 565775 - DNA, 13 bp, D. melanogaster
aatgtaaacgaaa

SEQ ID NO: 565776 - DNA, 13 bp, D. melanogaster
aatgtaaagttaa

SEQ ID NO: 565777 - DNA, 14 bp, D. melanogaster
aatgtaaataaaca

SEQ ID NO: 565778 - DNA, 13 bp, D. melanogaster
aatgtaaatagtt

SEQ ID NO: 565779 - DNA, 13 bp, D. melanogaster
aatgtaaatatga

SEQ ID NO: 565780 - DNA, 13 bp, D. melanogaster
aatgtaaatcaaa

SEQ ID NO: 565781 - DNA, 13 bp, D. melanogaster
aatgtaaatgatt

SEQ ID NO: 565782 - DNA, 13 bp, D. melanogaster
aatgtaaatgctt

SEQ ID NO: 565783 - DNA, 13 bp, D. melanogaster
aatgtaaatggaa

SEQ ID NO: 565784 - DNA, 13 bp, D. melanogaster
aatgtaaatgtaa

SEQ ID NO: 565785 - DNA, 14 bp, D. melanogaster
aatgtaaatgtaat

SEQ ID NO: 565786 - DNA, 13 bp, D. melanogaster
aatgtaaatgtgt

SEQ ID NO: 565787 - DNA, 13 bp, D. melanogaster
aatgtaaatgtta

SEQ ID NO: 565788 - DNA, 14 bp, D. melanogaster
aatgtaaatgttaa

SEQ ID NO: 565789 - DNA, 13 bp, D. melanogaster
aatgtaaatgttg

SEQ ID NO: 565790 - DNA, 13 bp, D. melanogaster
aatgtaaatgttt

SEQ ID NO: 565791 - DNA, 14 bp, D. melanogaster
aatgtaaatgtttt

SEQ ID NO: 565792 - DNA, 13 bp, D. melanogaster
aatgtaaattatg

SEQ ID NO: 565793 - DNA, 13 bp, D. melanogaster
aatgtaaattcaa

SEQ ID NO: 565794 - DNA, 13 bp, D. melanogaster
aatgtaaattcat

SEQ ID NO: 565795 - DNA, 13 bp, D. melanogaster
aatgtaaattgta

SEQ ID NO: 565796 - DNA, 13 bp, D. melanogaster
aatgtaacaattt

SEQ ID NO: 565797 - DNA, 13 bp, D. melanogaster
aatgtaactaaat

SEQ ID NO: 565798 - DNA, 13 bp, D. melanogaster
aatgtaactatat

SEQ ID NO: 565799 - DNA, 13 bp, D. melanogaster
aatgtaactgaaa

SEQ ID NO: 565800 - DNA, 13 bp, D. melanogaster
aatgtaacttaaa

SEQ ID NO: 565801 - DNA, 13 bp, D. melanogaster
aatgtaataatgt

SEQ ID NO: 565802 - DNA, 13 bp, D. melanogaster
aatgtaatacaat

SEQ ID NO: 565803 - DNA, 13 bp, D. melanogaster
aatgtaatacata

SEQ ID NO: 565804 - DNA, 14 bp, D. melanogaster
aatgtaatacattt

SEQ ID NO: 565805 - DNA, 13 bp, D. melanogaster
aatgtaatcaaaa

SEQ ID NO: 565806 - DNA, 13 bp, D. melanogaster
aatgtaatcaaat

SEQ ID NO: 565807 - DNA, 13 bp, D. melanogaster
aatgtaatcaaca

SEQ ID NO: 565808 - DNA, 13 bp, D. melanogaster
aatgtaatcaatt

SEQ ID NO: 565809 - DNA, 13 bp, D. melanogaster
aatgtaatctttt

SEQ ID NO: 565810 - DNA, 13 bp, D. melanogaster
aatgtaatgaaat

SEQ ID NO: 565811 - DNA, 13 bp, D. melanogaster
aatgtaatgatta

SEQ ID NO: 565812 - DNA, 13 bp, D. melanogaster
aatgtaatgattt

SEQ ID NO: 565813 - DNA, 13 bp, D. melanogaster
aatgtaatgtaaa

SEQ ID NO: 565814 - DNA, 13 bp, D. melanogaster
aatgtaatgtaat

SEQ ID NO: 565815 - DNA, 14 bp, D. melanogaster
aatgtaatgtaatg

SEQ ID NO: 565816 - DNA, 13 bp, D. melanogaster
aatgtaatgtatt

SEQ ID NO: 565817 - DNA, 13 bp, D. melanogaster
aatgtaatgttaa

SEQ ID NO: 565818 - DNA, 13 bp, D. melanogaster
aatgtaattaaac

SEQ ID NO: 565819 - DNA, 13 bp, D. melanogaster
aatgtaattaagc

SEQ ID NO: 565820 - DNA, 13 bp, D. melanogaster
aatgtaattagtt

SEQ ID NO: 565821 - DNA, 13 bp, D. melanogaster
aatgtaattcatg

SEQ ID NO: 565822 - DNA, 13 bp, D. melanogaster
aatgtaattgaat

SEQ ID NO: 565823 - DNA, 13 bp, D. melanogaster
aatgtaattgcat

SEQ ID NO: 565824 - DNA, 13 bp, D. melanogaster
aatgtaattgctt

SEQ ID NO: 565825 - DNA, 13 bp, D. melanogaster
aatgtaatttaca

SEQ ID NO: 565826 - DNA, 13 bp, D. melanogaster
aatgtaatttgtt

SEQ ID NO: 565827 - DNA, 13 bp, D. melanogaster
aatgtacaaaata

SEQ ID NO: 565828 - DNA, 13 bp, D. melanogaster
aatgtacaaatat

SEQ ID NO: 565829 - DNA, 13 bp, D. melanogaster
aatgtacaaattt

SEQ ID NO: 565830 - DNA, 13 bp, D. melanogaster
aatgtacaacaaa

SEQ ID NO: 565831 - DNA, 13 bp, D. melanogaster
aatgtacaataaa

SEQ ID NO: 565832 - DNA, 13 bp, D. melanogaster
aatgtacaatata

SEQ ID NO: 565833 - DNA, 13 bp, D. melanogaster
aatgtacataaat

SEQ ID NO: 565834 - DNA, 14 bp, D. melanogaster
aatgtacataaatt

SEQ ID NO: 565835 - DNA, 13 bp, D. melanogaster
aatgtacataata

SEQ ID NO: 565836 - DNA, 14 bp, D. melanogaster
aatgtacataatgc

SEQ ID NO: 565837 - DNA, 13 bp, D. melanogaster
aatgtacatacat

SEQ ID NO: 565838 - DNA, 14 bp, D. melanogaster
aatgtacatacata

SEQ ID NO: 565839 - DNA, 14 bp, D. melanogaster
aatgtacatatgta

SEQ ID NO: 565840 - DNA, 13 bp, D. melanogaster
aatgtacatttaa

SEQ ID NO: 565841 - DNA, 13 bp, D. melanogaster
aatgtacatttat

SEQ ID NO: 565842 - DNA, 13 bp, D. melanogaster
aatgtacatttta

SEQ ID NO: 565843 - DNA, 14 bp, D. melanogaster
aatgtacctgtgat

SEQ ID NO: 565844 - DNA, 13 bp, D. melanogaster
aatgtacgaaaaa

SEQ ID NO: 565845 - DNA, 13 bp, D. melanogaster
aatgtacttatat

SEQ ID NO: 565846 - DNA, 13 bp, D. melanogaster
aatgtactttttt

SEQ ID NO: 565847 - DNA, 13 bp, D. melanogaster
aatgtagaatgta

SEQ ID NO: 565848 - DNA, 13 bp, D. melanogaster
aatgtataaaatg

SEQ ID NO: 565849 - DNA, 13 bp, D. melanogaster
aatgtataaacaa

SEQ ID NO: 565850 - DNA, 14 bp, D. melanogaster
aatgtataagtaca

SEQ ID NO: 565851 - DNA, 13 bp, D. melanogaster
aatgtatacaaaa

SEQ ID NO: 565852 - DNA, 14 bp, D. melanogaster
aatgtatacaaatt

SEQ ID NO: 565853 - DNA, 13 bp, D. melanogaster
aatgtatagaaat

SEQ ID NO: 565854 - DNA, 13 bp, D. melanogaster
aatgtatatacaa

SEQ ID NO: 565855 - DNA, 13 bp, D. melanogaster
aatgtatatatac

SEQ ID NO: 565856 - DNA, 13 bp, D. melanogaster
aatgtatatgaaa

SEQ ID NO: 565857 - DNA, 13 bp, D. melanogaster
aatgtatctcaaa

SEQ ID NO: 565858 - DNA, 13 bp, D. melanogaster
aatgtatctgaaa

SEQ ID NO: 565859 - DNA, 13 bp, D. melanogaster
aatgtatctgatg

SEQ ID NO: 565860 - DNA, 14 bp, D. melanogaster
aatgtatctgtatc

SEQ ID NO: 565861 - DNA, 13 bp, D. melanogaster
aatgtatctttat

SEQ ID NO: 565862 - DNA, 13 bp, D. melanogaster
aatgtatctttga

SEQ ID NO: 565863 - DNA, 13 bp, D. melanogaster
aatgtatgaaata

SEQ ID NO: 565864 - DNA, 13 bp, D. melanogaster
aatgtatgaattt

SEQ ID NO: 565865 - DNA, 13 bp, D. melanogaster
aatgtatgcatat

SEQ ID NO: 565866 - DNA, 13 bp, D. melanogaster
aatgtatgccaaa

SEQ ID NO: 565867 - DNA, 13 bp, D. melanogaster
aatgtatgtaaat

SEQ ID NO: 565868 - DNA, 13 bp, D. melanogaster
aatgtatgtatgt

SEQ ID NO: 565869 - DNA, 14 bp, D. melanogaster
aatgtatgtatgta

SEQ ID NO: 565870 - DNA, 14 bp, D. melanogaster
aatgtatgtatgtt

SEQ ID NO: 565871 - DNA, 13 bp, D. melanogaster
aatgtatgtattt

SEQ ID NO: 565872 - DNA, 13 bp, D. melanogaster
aatgtatgtgtat

SEQ ID NO: 565873 - DNA, 13 bp, D. melanogaster
aatgtattacaaa

SEQ ID NO: 565874 - DNA, 13 bp, D. melanogaster
aatgtattacttt

SEQ ID NO: 565875 - DNA, 13 bp, D. melanogaster
aatgtattatgaa

SEQ ID NO: 565876 - DNA, 13 bp, D. melanogaster
aatgtattcaaat

SEQ ID NO: 565877 - DNA, 13 bp, D. melanogaster
aatgtattcaatt

SEQ ID NO: 565878 - DNA, 13 bp, D. melanogaster
aatgtattgattt

SEQ ID NO: 565879 - DNA, 13 bp, D. melanogaster
aatgtattggaaa

SEQ ID NO: 565880 - DNA, 14 bp, D. melanogaster
aatgtattgtatat

SEQ ID NO: 565881 - DNA, 13 bp, D. melanogaster
aatgtatttaact

SEQ ID NO: 565882 - DNA, 13 bp, D. melanogaster
aatgtatttacat

SEQ ID NO: 565883 - DNA, 13 bp, D. melanogaster
aatgtatttcaaa

SEQ ID NO: 565884 - DNA, 13 bp, D. melanogaster
aatgtatttcatt

SEQ ID NO: 565885 - DNA, 13 bp, D. melanogaster
aatgtatttgcat

SEQ ID NO: 565886 - DNA, 13 bp, D. melanogaster
aatgtattttatg

SEQ ID NO: 565887 - DNA, 13 bp, D. melanogaster
aatgtattttcat

SEQ ID NO: 565888 - DNA, 13 bp, D. melanogaster
aatgtattttctt

SEQ ID NO: 565889 - DNA, 14 bp, D. melanogaster
aatgtcaaaaaaat

SEQ ID NO: 565890 - DNA, 13 bp, D. melanogaster
aatgtcaaaaaag

SEQ ID NO: 565891 - DNA, 13 bp, D. melanogaster
aatgtcaaaaaat

SEQ ID NO: 565892 - DNA, 13 bp, D. melanogaster
aatgtcaaaaagc

SEQ ID NO: 565893 - DNA, 13 bp, D. melanogaster
aatgtcaaaagaa

SEQ ID NO: 565894 - DNA, 13 bp, D. melanogaster
aatgtcaaaagtg

SEQ ID NO: 565895 - DNA, 13 bp, D. melanogaster
aatgtcaaaagtt

SEQ ID NO: 565896 - DNA, 13 bp, D. melanogaster
aatgtcaaaatgc

SEQ ID NO: 565897 - DNA, 13 bp, D. melanogaster
aatgtcaaagaaa

SEQ ID NO: 565898 - DNA, 13 bp, D. melanogaster
aatgtcaaagatg

SEQ ID NO: 565899 - DNA, 13 bp, D. melanogaster
aatgtcaaagcaa

SEQ ID NO: 565900 - DNA, 14 bp, D. melanogaster
aatgtcaaagcaaa

SEQ ID NO: 565901 - DNA, 13 bp, D. melanogaster
aatgtcaaagtca

SEQ ID NO: 565902 - DNA, 13 bp, D. melanogaster
aatgtcaaagttt

SEQ ID NO: 565903 - DNA, 13 bp, D. melanogaster
aatgtcaaataaa

SEQ ID NO: 565904 - DNA, 13 bp, D. melanogaster
aatgtcaaataat

SEQ ID NO: 565905 - DNA, 13 bp, D. melanogaster
aatgtcaaatggc

SEQ ID NO: 565906 - DNA, 13 bp, D. melanogaster
aatgtcaaattaa

SEQ ID NO: 565907 - DNA, 13 bp, D. melanogaster
aatgtcaaatttt

SEQ ID NO: 565908 - DNA, 13 bp, D. melanogaster
aatgtcaacaaaa

SEQ ID NO: 565909 - DNA, 13 bp, D. melanogaster
aatgtcaacaagc

SEQ ID NO: 565910 - DNA, 13 bp, D. melanogaster
aatgtcaactctt

SEQ ID NO: 565911 - DNA, 13 bp, D. melanogaster
aatgtcaacttct

SEQ ID NO: 565912 - DNA, 13 bp, D. melanogaster
aatgtcaagaaat

SEQ ID NO: 565913 - DNA, 14 bp, D. melanogaster
aatgtcaagaaatt

SEQ ID NO: 565914 - DNA, 13 bp, D. melanogaster
aatgtcaagtgca

SEQ ID NO: 565915 - DNA, 13 bp, D. melanogaster
aatgtcaagttca

SEQ ID NO: 565916 - DNA, 13 bp, D. melanogaster
aatgtcaatcaaa

SEQ ID NO: 565917 - DNA, 13 bp, D. melanogaster
aatgtcaatgcca

SEQ ID NO: 565918 - DNA, 13 bp, D. melanogaster
aatgtcaatggca

SEQ ID NO: 565919 - DNA, 13 bp, D. melanogaster
aatgtcaatgtca

SEQ ID NO: 565920 - DNA, 14 bp, D. melanogaster
aatgtcaatgtcaa

SEQ ID NO: 565921 - DNA, 13 bp, D. melanogaster
aatgtcaatgttt

SEQ ID NO: 565922 - DNA, 13 bp, D. melanogaster
aatgtcaattatt

SEQ ID NO: 565923 - DNA, 13 bp, D. melanogaster
aatgtcaattgca

SEQ ID NO: 565924 - DNA, 13 bp, D. melanogaster
aatgtcaatttat

SEQ ID NO: 565925 - DNA, 14 bp, D. melanogaster
aatgtcaatttatt

SEQ ID NO: 565926 - DNA, 13 bp, D. melanogaster
aatgtcaatttta

SEQ ID NO: 565927 - DNA, 13 bp, D. melanogaster
aatgtcacataaa

SEQ ID NO: 565928 - DNA, 13 bp, D. melanogaster
aatgtcagcattc

SEQ ID NO: 565929 - DNA, 13 bp, D. melanogaster
aatgtcaggtttt

SEQ ID NO: 565930 - DNA, 14 bp, D. melanogaster
aatgtcaggttttc

SEQ ID NO: 565931 - DNA, 14 bp, D. melanogaster
aatgtcataaataa

SEQ ID NO: 565932 - DNA, 13 bp, D. melanogaster
aatgtcataaatt

SEQ ID NO: 565933 - DNA, 14 bp, D. melanogaster
aatgtcataaatta

SEQ ID NO: 565934 - DNA, 13 bp, D. melanogaster
aatgtcatagtct

SEQ ID NO: 565935 - DNA, 13 bp, D. melanogaster
aatgtcatatctc

SEQ ID NO: 565936 - DNA, 13 bp, D. melanogaster
aatgtcatatttt

SEQ ID NO: 565937 - DNA, 13 bp, D. melanogaster
aatgtcatcaatt

SEQ ID NO: 565938 - DNA, 13 bp, D. melanogaster
aatgtcattaaaa

SEQ ID NO: 565939 - DNA, 13 bp, D. melanogaster
aatgtcattgttt

SEQ ID NO: 565940 - DNA, 13 bp, D. melanogaster
aatgtccaataaa

SEQ ID NO: 565941 - DNA, 13 bp, D. melanogaster
aatgtcctggcca

SEQ ID NO: 565942 - DNA, 13 bp, D. melanogaster
aatgtccttgtgc

SEQ ID NO: 565943 - DNA, 13 bp, D. melanogaster
aatgtcgaaaagt

SEQ ID NO: 565944 - DNA, 13 bp, D. melanogaster
aatgtcgctggca

SEQ ID NO: 565945 - DNA, 13 bp, D. melanogaster
aatgtctatgcaa

SEQ ID NO: 565946 - DNA, 13 bp, D. melanogaster
aatgtctatgtta

SEQ ID NO: 565947 - DNA, 13 bp, D. melanogaster
aatgtctgccgaa

SEQ ID NO: 565948 - DNA, 13 bp, D. melanogaster
aatgtctggtggt

SEQ ID NO: 565949 - DNA, 13 bp, D. melanogaster
aatgtcttcatta

SEQ ID NO: 565950 - DNA, 13 bp, D. melanogaster
aatgtctttaaaa

SEQ ID NO: 565951 - DNA, 13 bp, D. melanogaster
aatgtctttaaat

SEQ ID NO: 565952 - DNA, 13 bp, D. melanogaster
aatgtgaaaaact

SEQ ID NO: 565953 - DNA, 13 bp, D. melanogaster
aatgtgaaaaagt

SEQ ID NO: 565954 - DNA, 13 bp, D. melanogaster
aatgtgaaaaatt

SEQ ID NO: 565955 - DNA, 13 bp, D. melanogaster
aatgtgaaaagca

SEQ ID NO: 565956 - DNA, 14 bp, D. melanogaster
aatgtgaaaatatt

SEQ ID NO: 565957 - DNA, 13 bp, D. melanogaster
aatgtgaaaatgg

SEQ ID NO: 565958 - DNA, 13 bp, D. melanogaster
aatgtgaaacttt

SEQ ID NO: 565959 - DNA, 13 bp, D. melanogaster
aatgtgaaatgtg

SEQ ID NO: 565960 - DNA, 13 bp, D. melanogaster
aatgtgaaattgt

SEQ ID NO: 565961 - DNA, 14 bp, D. melanogaster
aatgtgaaatttat

SEQ ID NO: 565962 - DNA, 13 bp, D. melanogaster
aatgtgaataaat

SEQ ID NO: 565963 - DNA, 13 bp, D. melanogaster
aatgtgaataatt

SEQ ID NO: 565964 - DNA, 13 bp, D. melanogaster
aatgtgaatgtaa

SEQ ID NO: 565965 - DNA, 13 bp, D. melanogaster
aatgtgaattgaa

SEQ ID NO: 565966 - DNA, 13 bp, D. melanogaster
aatgtgaatttta

SEQ ID NO: 565967 - DNA, 13 bp, D. melanogaster
aatgtgaattttt

SEQ ID NO: 565968 - DNA, 13 bp, D. melanogaster
aatgtgacacaaa

SEQ ID NO: 565969 - DNA, 13 bp, D. melanogaster
aatgtgacatttg

SEQ ID NO: 565970 - DNA, 13 bp, D. melanogaster
aatgtgagtatat

SEQ ID NO: 565971 - DNA, 13 bp, D. melanogaster
aatgtgagtgagt

SEQ ID NO: 565972 - DNA, 13 bp, D. melanogaster
aatgtgataaaat

SEQ ID NO: 565973 - DNA, 13 bp, D. melanogaster
aatgtgatattta

SEQ ID NO: 565974 - DNA, 13 bp, D. melanogaster
aatgtgattaaat

SEQ ID NO: 565975 - DNA, 13 bp, D. melanogaster
aatgtgatttaaa

SEQ ID NO: 565976 - DNA, 13 bp, D. melanogaster
aatgtgattttaa

SEQ ID NO: 565977 - DNA, 13 bp, D. melanogaster
aatgtgcaaaaac

SEQ ID NO: 565978 - DNA, 13 bp, D. melanogaster
aatgtgcaaaata

SEQ ID NO: 565979 - DNA, 14 bp, D. melanogaster
aatgtgcaaaataa

SEQ ID NO: 565980 - DNA, 13 bp, D. melanogaster
aatgtgcaaaatg

SEQ ID NO: 565981 - DNA, 13 bp, D. melanogaster
aatgtgcaacaaa

SEQ ID NO: 565982 - DNA, 13 bp, D. melanogaster
aatgtgcaacaat

SEQ ID NO: 565983 - DNA, 13 bp, D. melanogaster
aatgtgcaagaaa

SEQ ID NO: 565984 - DNA, 13 bp, D. melanogaster
aatgtgcaataaa

SEQ ID NO: 565985 - DNA, 13 bp, D. melanogaster
aatgtgcaataca

SEQ ID NO: 565986 - DNA, 13 bp, D. melanogaster
aatgtgcaatgtg

SEQ ID NO: 565987 - DNA, 14 bp, D. melanogaster
aatgtgcaatgtgc

SEQ ID NO: 565988 - DNA, 13 bp, D. melanogaster
aatgtgcaattaa

SEQ ID NO: 565989 - DNA, 13 bp, D. melanogaster
aatgtgcaattta

SEQ ID NO: 565990 - DNA, 13 bp, D. melanogaster
aatgtgcacaaaa

SEQ ID NO: 565991 - DNA, 13 bp, D. melanogaster
aatgtgcactttt

SEQ ID NO: 565992 - DNA, 13 bp, D. melanogaster
aatgtgcagaaaa

SEQ ID NO: 565993 - DNA, 13 bp, D. melanogaster
aatgtgcataatt

SEQ ID NO: 565994 - DNA, 13 bp, D. melanogaster
aatgtgcatttaa

SEQ ID NO: 565995 - DNA, 13 bp, D. melanogaster
aatgtgcatttta

SEQ ID NO: 565996 - DNA, 14 bp, D. melanogaster
aatgtgcattttaa

SEQ ID NO: 565997 - DNA, 13 bp, D. melanogaster
aatgtgccaaaat

SEQ ID NO: 565998 - DNA, 13 bp, D. melanogaster
aatgtgcctgcgc

SEQ ID NO: 565999 - DNA, 13 bp, D. melanogaster
aatgtgcctgctt

SEQ ID NO: 566000 - DNA, 13 bp, D. melanogaster
aatgtgcgcaaaa

SEQ ID NO: 566001 - DNA, 14 bp, D. melanogaster
aatgtgctgtgcaa

SEQ ID NO: 566002 - DNA, 13 bp, D. melanogaster
aatgtgctttaaa

SEQ ID NO: 566003 - DNA, 13 bp, D. melanogaster
aatgtgcttttaa

SEQ ID NO: 566004 - DNA, 13 bp, D. melanogaster
aatgtgcttttgt

SEQ ID NO: 566005 - DNA, 13 bp, D. melanogaster
aatgtgctttttt

SEQ ID NO: 566006 - DNA, 13 bp, D. melanogaster
aatgtggaaaagc

SEQ ID NO: 566007 - DNA, 13 bp, D. melanogaster
aatgtggaaaagt

SEQ ID NO: 566008 - DNA, 13 bp, D. melanogaster
aatgtggaaaatg

SEQ ID NO: 566009 - DNA, 13 bp, D. melanogaster
aatgtggaaagtg

SEQ ID NO: 566010 - DNA, 13 bp, D. melanogaster
aatgtggaaatgc

SEQ ID NO: 566011 - DNA, 13 bp, D. melanogaster
aatgtggaaatgg

SEQ ID NO: 566012 - DNA, 13 bp, D. melanogaster
aatgtggaaatgt

SEQ ID NO: 566013 - DNA, 13 bp, D. melanogaster
aatgtggagcaga

SEQ ID NO: 566014 - DNA, 13 bp, D. melanogaster
aatgtggataccg

SEQ ID NO: 566015 - DNA, 14 bp, D. melanogaster
aatgtggatgtgga

SEQ ID NO: 566016 - DNA, 13 bp, D. melanogaster
aatgtggcaaaag

SEQ ID NO: 566017 - DNA, 13 bp, D. melanogaster
aatgtggcaaaca

SEQ ID NO: 566018 - DNA, 13 bp, D. melanogaster
aatgtggcaaagt

SEQ ID NO: 566019 - DNA, 13 bp, D. melanogaster
aatgtggcaaatg

SEQ ID NO: 566020 - DNA, 13 bp, D. melanogaster
aatgtggcaaatt

SEQ ID NO: 566021 - DNA, 13 bp, D. melanogaster
aatgtggcaagtg

SEQ ID NO: 566022 - DNA, 13 bp, D. melanogaster
aatgtggcacaca

SEQ ID NO: 566023 - DNA, 14 bp, D. melanogaster
aatgtggcagctgg

SEQ ID NO: 566024 - DNA, 13 bp, D. melanogaster
aatgtggccaaaa

SEQ ID NO: 566025 - DNA, 13 bp, D. melanogaster
aatgtggccaaca

SEQ ID NO: 566026 - DNA, 14 bp, D. melanogaster
aatgtggccaacat

SEQ ID NO: 566027 - DNA, 13 bp, D. melanogaster
aatgtggccgaaa

SEQ ID NO: 566028 - DNA, 13 bp, D. melanogaster
aatgtggctaaaa

SEQ ID NO: 566029 - DNA, 13 bp, D. melanogaster
aatgtgggccaaa

SEQ ID NO: 566030 - DNA, 14 bp, D. melanogaster
aatgtgggcgtggc

SEQ ID NO: 566031 - DNA, 13 bp, D. melanogaster
aatgtgggtggtg

SEQ ID NO: 566032 - DNA, 13 bp, D. melanogaster
aatgtggtcaata

SEQ ID NO: 566033 - DNA, 13 bp, D. melanogaster
aatgtggtggctg

SEQ ID NO: 566034 - DNA, 13 bp, D. melanogaster
aatgtggttactc

SEQ ID NO: 566035 - DNA, 13 bp, D. melanogaster
aatgtgtaaaaag

SEQ ID NO: 566036 - DNA, 13 bp, D. melanogaster
aatgtgtaaaaat

SEQ ID NO: 566037 - DNA, 13 bp, D. melanogaster
aatgtgtaaataa

SEQ ID NO: 566038 - DNA, 13 bp, D. melanogaster
aatgtgtaaattt

SEQ ID NO: 566039 - DNA, 13 bp, D. melanogaster
aatgtgtaattta

SEQ ID NO: 566040 - DNA, 13 bp, D. melanogaster
aatgtgtaatttt

SEQ ID NO: 566041 - DNA, 13 bp, D. melanogaster
aatgtgtacataa

SEQ ID NO: 566042 - DNA, 13 bp, D. melanogaster
aatgtgtacatat

SEQ ID NO: 566043 - DNA, 13 bp, D. melanogaster
aatgtgtacattt

SEQ ID NO: 566044 - DNA, 13 bp, D. melanogaster
aatgtgtataaat

SEQ ID NO: 566045 - DNA, 13 bp, D. melanogaster
aatgtgtatgtat

SEQ ID NO: 566046 - DNA, 13 bp, D. melanogaster
aatgtgtatgtgt

SEQ ID NO: 566047 - DNA, 13 bp, D. melanogaster
aatgtgtattaaa

SEQ ID NO: 566048 - DNA, 13 bp, D. melanogaster
aatgtgtatttat

SEQ ID NO: 566049 - DNA, 13 bp, D. melanogaster
aatgtgtcaaatg

SEQ ID NO: 566050 - DNA, 13 bp, D. melanogaster
aatgtgtcaataa

SEQ ID NO: 566051 - DNA, 13 bp, D. melanogaster
aatgtgtcagaaa

SEQ ID NO: 566052 - DNA, 13 bp, D. melanogaster
aatgtgtgaaatt

SEQ ID NO: 566053 - DNA, 14 bp, D. melanogaster
aatgtgtgagtgtg

SEQ ID NO: 566054 - DNA, 13 bp, D. melanogaster
aatgtgtgcaaat

SEQ ID NO: 566055 - DNA, 13 bp, D. melanogaster
aatgtgtgccaaa

SEQ ID NO: 566056 - DNA, 13 bp, D. melanogaster
aatgtgtggcaaa

SEQ ID NO: 566057 - DNA, 13 bp, D. melanogaster
aatgtgtggcaat

SEQ ID NO: 566058 - DNA, 13 bp, D. melanogaster
aatgtgtggctat

SEQ ID NO: 566059 - DNA, 13 bp, D. melanogaster
aatgtgtgggcgt

SEQ ID NO: 566060 - DNA, 13 bp, D. melanogaster
aatgtgtgggtgt

SEQ ID NO: 566061 - DNA, 13 bp, D. melanogaster
aatgtgtgtatgt

SEQ ID NO: 566062 - DNA, 14 bp, D. melanogaster
aatgtgtgtatgtg

SEQ ID NO: 566063 - DNA, 13 bp, D. melanogaster
aatgtgtgtgagt

SEQ ID NO: 566064 - DNA, 13 bp, D. melanogaster
aatgtgtgtgcaa

SEQ ID NO: 566065 - DNA, 13 bp, D. melanogaster
aatgtgtgtgtgt

SEQ ID NO: 566066 - DNA, 13 bp, D. melanogaster
aatgtgttaaaat

SEQ ID NO: 566067 - DNA, 13 bp, D. melanogaster
aatgtgttcattt

SEQ ID NO: 566068 - DNA, 13 bp, D. melanogaster
aatgtgttcttca

SEQ ID NO: 566069 - DNA, 13 bp, D. melanogaster
aatgtgttgaaat

SEQ ID NO: 566070 - DNA, 13 bp, D. melanogaster
aatgtgttgcaaa

SEQ ID NO: 566071 - DNA, 13 bp, D. melanogaster
aatgtgttggcaa

SEQ ID NO: 566072 - DNA, 13 bp, D. melanogaster
aatgtgtttaaat

SEQ ID NO: 566073 - DNA, 13 bp, D. melanogaster
aatgtgtttactt

SEQ ID NO: 566074 - DNA, 13 bp, D. melanogaster
aatgtgtttattg

SEQ ID NO: 566075 - DNA, 13 bp, D. melanogaster
aatgtgtttcgtt

SEQ ID NO: 566076 - DNA, 13 bp, D. melanogaster
aatgtgtttgcca

SEQ ID NO: 566077 - DNA, 13 bp, D. melanogaster
aatgtgtttgcct

SEQ ID NO: 566078 - DNA, 13 bp, D. melanogaster
aatgtgtttgctt

SEQ ID NO: 566079 - DNA, 14 bp, D. melanogaster
aatgtgtttgcttg

SEQ ID NO: 566080 - DNA, 13 bp, D. melanogaster
aatgtgtttgtaa

SEQ ID NO: 566081 - DNA, 13 bp, D. melanogaster
aatgtgttttgtg

SEQ ID NO: 566082 - DNA, 13 bp, D. melanogaster
aatgttaaaaatg

SEQ ID NO: 566083 - DNA, 14 bp, D. melanogaster
aatgttaaaaatgt

SEQ ID NO: 566084 - DNA, 13 bp, D. melanogaster
aatgttaaacaat

SEQ ID NO: 566085 - DNA, 13 bp, D. melanogaster
aatgttaaacata

SEQ ID NO: 566086 - DNA, 13 bp, D. melanogaster
aatgttaaacatt

SEQ ID NO: 566087 - DNA, 13 bp, D. melanogaster
aatgttaaatcaa

SEQ ID NO: 566088 - DNA, 13 bp, D. melanogaster
aatgttaaatgtt

SEQ ID NO: 566089 - DNA, 13 bp, D. melanogaster
aatgttaaatttc

SEQ ID NO: 566090 - DNA, 13 bp, D. melanogaster
aatgttaacaaaa

SEQ ID NO: 566091 - DNA, 13 bp, D. melanogaster
aatgttaactatt

SEQ ID NO: 566092 - DNA, 13 bp, D. melanogaster
aatgttaagcaat

SEQ ID NO: 566093 - DNA, 13 bp, D. melanogaster
aatgttaagttaa

SEQ ID NO: 566094 - DNA, 13 bp, D. melanogaster
aatgttaataatg

SEQ ID NO: 566095 - DNA, 13 bp, D. melanogaster
aatgttaatgtta

SEQ ID NO: 566096 - DNA, 13 bp, D. melanogaster
aatgttaattaac

SEQ ID NO: 566097 - DNA, 13 bp, D. melanogaster
aatgttaattaag

SEQ ID NO: 566098 - DNA, 13 bp, D. melanogaster
aatgttaattagt

SEQ ID NO: 566099 - DNA, 13 bp, D. melanogaster
aatgttaattatg

SEQ ID NO: 566100 - DNA, 13 bp, D. melanogaster
aatgttaattcat

SEQ ID NO: 566101 - DNA, 13 bp, D. melanogaster
aatgttaatttcg

SEQ ID NO: 566102 - DNA, 13 bp, D. melanogaster
aatgttaatttct

SEQ ID NO: 566103 - DNA, 13 bp, D. melanogaster
aatgttaatttgt

SEQ ID NO: 566104 - DNA, 13 bp, D. melanogaster
aatgttacaatat

SEQ ID NO: 566105 - DNA, 13 bp, D. melanogaster
aatgttactttaa

SEQ ID NO: 566106 - DNA, 13 bp, D. melanogaster
aatgttagatttt

SEQ ID NO: 566107 - DNA, 13 bp, D. melanogaster
aatgttatacaaa

SEQ ID NO: 566108 - DNA, 13 bp, D. melanogaster
aatgttatagttt

SEQ ID NO: 566109 - DNA, 13 bp, D. melanogaster
aatgttatataca

SEQ ID NO: 566110 - DNA, 13 bp, D. melanogaster
aatgttatcatct

SEQ ID NO: 566111 - DNA, 13 bp, D. melanogaster
aatgttatcttaa

SEQ ID NO: 566112 - DNA, 13 bp, D. melanogaster
aatgttatgtaaa

SEQ ID NO: 566113 - DNA, 13 bp, D. melanogaster
aatgttatgttta

SEQ ID NO: 566114 - DNA, 13 bp, D. melanogaster
aatgttattagtt

SEQ ID NO: 566115 - DNA, 13 bp, D. melanogaster
aatgttattcatt

SEQ ID NO: 566116 - DNA, 13 bp, D. melanogaster
aatgttattgatt

SEQ ID NO: 566117 - DNA, 14 bp, D. melanogaster
aatgttattgatta

SEQ ID NO: 566118 - DNA, 13 bp, D. melanogaster
aatgttattgcat

SEQ ID NO: 566119 - DNA, 14 bp, D. melanogaster
aatgttcaaaaatg

SEQ ID NO: 566120 - DNA, 13 bp, D. melanogaster
aatgttcaaatta

SEQ ID NO: 566121 - DNA, 13 bp, D. melanogaster
aatgttcaacaaa

SEQ ID NO: 566122 - DNA, 14 bp, D. melanogaster
aatgttcaataaat

SEQ ID NO: 566123 - DNA, 13 bp, D. melanogaster
aatgttcaatgtt

SEQ ID NO: 566124 - DNA, 14 bp, D. melanogaster
aatgttcaattcga

SEQ ID NO: 566125 - DNA, 13 bp, D. melanogaster
aatgttcttaaaa

SEQ ID NO: 566126 - DNA, 13 bp, D. melanogaster
aatgttcttaaat

SEQ ID NO: 566127 - DNA, 13 bp, D. melanogaster
aatgttctttaaa

SEQ ID NO: 566128 - DNA, 13 bp, D. melanogaster
aatgttctttctt

SEQ ID NO: 566129 - DNA, 13 bp, D. melanogaster
aatgttgaaaatt

SEQ ID NO: 566130 - DNA, 13 bp, D. melanogaster
aatgttgaacatt

SEQ ID NO: 566131 - DNA, 13 bp, D. melanogaster
aatgttgaataaa

SEQ ID NO: 566132 - DNA, 13 bp, D. melanogaster
aatgttgaatgtt

SEQ ID NO: 566133 - DNA, 13 bp, D. melanogaster
aatgttgactttt

SEQ ID NO: 566134 - DNA, 13 bp, D. melanogaster
aatgttgatagat

SEQ ID NO: 566135 - DNA, 13 bp, D. melanogaster
aatgttgatattt

SEQ ID NO: 566136 - DNA, 13 bp, D. melanogaster
aatgttgatgatg

SEQ ID NO: 566137 - DNA, 13 bp, D. melanogaster
aatgttgattaat

SEQ ID NO: 566138 - DNA, 13 bp, D. melanogaster
aatgttgatttat

SEQ ID NO: 566139 - DNA, 13 bp, D. melanogaster
aatgttgcaaaaa

SEQ ID NO: 566140 - DNA, 13 bp, D. melanogaster
aatgttgcaacaa

SEQ ID NO: 566141 - DNA, 13 bp, D. melanogaster
aatgttgcaacat

SEQ ID NO: 566142 - DNA, 13 bp, D. melanogaster
aatgttgcatgtg

SEQ ID NO: 566143 - DNA, 13 bp, D. melanogaster
aatgttgccaact

SEQ ID NO: 566144 - DNA, 13 bp, D. melanogaster
aatgttgctgcaa

SEQ ID NO: 566145 - DNA, 13 bp, D. melanogaster
aatgttgctgcag

SEQ ID NO: 566146 - DNA, 14 bp, D. melanogaster
aatgttgctgctgc

SEQ ID NO: 566147 - DNA, 13 bp, D. melanogaster
aatgttggaaaaa

SEQ ID NO: 566148 - DNA, 13 bp, D. melanogaster
aatgttggaaaat

SEQ ID NO: 566149 - DNA, 13 bp, D. melanogaster
aatgttggcaaca

SEQ ID NO: 566150 - DNA, 13 bp, D. melanogaster
aatgttggccaaa

SEQ ID NO: 566151 - DNA, 13 bp, D. melanogaster
aatgttggccaat

SEQ ID NO: 566152 - DNA, 13 bp, D. melanogaster
aatgttggccaca

SEQ ID NO: 566153 - DNA, 13 bp, D. melanogaster
aatgttgggaaat

SEQ ID NO: 566154 - DNA, 13 bp, D. melanogaster
aatgttggtaatt

SEQ ID NO: 566155 - DNA, 13 bp, D. melanogaster
aatgttggtttca

SEQ ID NO: 566156 - DNA, 13 bp, D. melanogaster
aatgttgtaaaaa

SEQ ID NO: 566157 - DNA, 13 bp, D. melanogaster
aatgttgtaaaat

SEQ ID NO: 566158 - DNA, 13 bp, D. melanogaster
aatgttgtaataa

SEQ ID NO: 566159 - DNA, 13 bp, D. melanogaster
aatgttgtcaaat

SEQ ID NO: 566160 - DNA, 13 bp, D. melanogaster
aatgttgtcaaca

SEQ ID NO: 566161 - DNA, 13 bp, D. melanogaster
aatgttgtcatta

SEQ ID NO: 566162 - DNA, 14 bp, D. melanogaster
aatgttgtcattat

SEQ ID NO: 566163 - DNA, 13 bp, D. melanogaster
aatgttgtgaaaa

SEQ ID NO: 566164 - DNA, 13 bp, D. melanogaster
aatgttgtgctta

SEQ ID NO: 566165 - DNA, 13 bp, D. melanogaster
aatgttgttaaat

SEQ ID NO: 566166 - DNA, 13 bp, D. melanogaster
aatgttgttaatt

SEQ ID NO: 566167 - DNA, 13 bp, D. melanogaster
aatgttgttgatg

SEQ ID NO: 566168 - DNA, 14 bp, D. melanogaster
aatgttgttgctgt

SEQ ID NO: 566169 - DNA, 13 bp, D. melanogaster
aatgttgttggcc

SEQ ID NO: 566170 - DNA, 13 bp, D. melanogaster
aatgttgtttgcc

SEQ ID NO: 566171 - DNA, 13 bp, D. melanogaster
aatgttgttttcc

SEQ ID NO: 566172 - DNA, 13 bp, D. melanogaster
aatgtttaaaaac

SEQ ID NO: 566173 - DNA, 13 bp, D. melanogaster
aatgtttaaaaag

SEQ ID NO: 566174 - DNA, 13 bp, D. melanogaster
aatgtttaaaatg

SEQ ID NO: 566175 - DNA, 13 bp, D. melanogaster
aatgtttaaacta

SEQ ID NO: 566176 - DNA, 13 bp, D. melanogaster
aatgtttaaactt

SEQ ID NO: 566177 - DNA, 13 bp, D. melanogaster
aatgtttaaagaa

SEQ ID NO: 566178 - DNA, 13 bp, D. melanogaster
aatgtttaaagtt

SEQ ID NO: 566179 - DNA, 13 bp, D. melanogaster
aatgtttaacaaa

SEQ ID NO: 566180 - DNA, 13 bp, D. melanogaster
aatgtttaacatt

SEQ ID NO: 566181 - DNA, 13 bp, D. melanogaster
aatgtttaattca

SEQ ID NO: 566182 - DNA, 13 bp, D. melanogaster
aatgtttaattgt

SEQ ID NO: 566183 - DNA, 13 bp, D. melanogaster
aatgtttacatat

SEQ ID NO: 566184 - DNA, 13 bp, D. melanogaster
aatgtttactcaa

SEQ ID NO: 566185 - DNA, 13 bp, D. melanogaster
aatgtttactttg

SEQ ID NO: 566186 - DNA, 13 bp, D. melanogaster
aatgtttagcttt

SEQ ID NO: 566187 - DNA, 13 bp, D. melanogaster
aatgtttataaac

SEQ ID NO: 566188 - DNA, 13 bp, D. melanogaster
aatgtttataatc

SEQ ID NO: 566189 - DNA, 13 bp, D. melanogaster
aatgtttatacaa

SEQ ID NO: 566190 - DNA, 13 bp, D. melanogaster
aatgtttatatac

SEQ ID NO: 566191 - DNA, 14 bp, D. melanogaster
aatgtttatatact

SEQ ID NO: 566192 - DNA, 13 bp, D. melanogaster
aatgtttatccaa

SEQ ID NO: 566193 - DNA, 13 bp, D. melanogaster
aatgtttatgttc

SEQ ID NO: 566194 - DNA, 13 bp, D. melanogaster
aatgtttattaac

SEQ ID NO: 566195 - DNA, 13 bp, D. melanogaster
aatgtttattgaa

SEQ ID NO: 566196 - DNA, 13 bp, D. melanogaster
aatgtttatttag

SEQ ID NO: 566197 - DNA, 13 bp, D. melanogaster
aatgtttcaaaat

SEQ ID NO: 566198 - DNA, 13 bp, D. melanogaster
aatgtttcaattt

SEQ ID NO: 566199 - DNA, 13 bp, D. melanogaster
aatgtttcatgtt

SEQ ID NO: 566200 - DNA, 13 bp, D. melanogaster
aatgtttcatttc

SEQ ID NO: 566201 - DNA, 13 bp, D. melanogaster
aatgtttccattt

SEQ ID NO: 566202 - DNA, 13 bp, D. melanogaster
aatgtttctcttt

SEQ ID NO: 566203 - DNA, 13 bp, D. melanogaster
aatgtttcttaaa

SEQ ID NO: 566204 - DNA, 13 bp, D. melanogaster
aatgtttctttat

SEQ ID NO: 566205 - DNA, 13 bp, D. melanogaster
aatgtttgaaaaa

SEQ ID NO: 566206 - DNA, 14 bp, D. melanogaster
aatgtttgaaaaat

SEQ ID NO: 566207 - DNA, 13 bp, D. melanogaster
aatgtttgaaatt

SEQ ID NO: 566208 - DNA, 13 bp, D. melanogaster
aatgtttgcaaac

SEQ ID NO: 566209 - DNA, 14 bp, D. melanogaster
aatgtttgcaaact

SEQ ID NO: 566210 - DNA, 13 bp, D. melanogaster
aatgtttgcacaa

SEQ ID NO: 566211 - DNA, 13 bp, D. melanogaster
aatgtttgcactt

SEQ ID NO: 566212 - DNA, 13 bp, D. melanogaster
aatgtttgcattt

SEQ ID NO: 566213 - DNA, 14 bp, D. melanogaster
aatgtttgccaaaa

SEQ ID NO: 566214 - DNA, 13 bp, D. melanogaster
aatgtttgccaat

SEQ ID NO: 566215 - DNA, 13 bp, D. melanogaster
aatgtttgccagc

SEQ ID NO: 566216 - DNA, 13 bp, D. melanogaster
aatgtttgccata

SEQ ID NO: 566217 - DNA, 13 bp, D. melanogaster
aatgtttgcctaa

SEQ ID NO: 566218 - DNA, 13 bp, D. melanogaster
aatgtttgccttg

SEQ ID NO: 566219 - DNA, 13 bp, D. melanogaster
aatgtttgccttt

SEQ ID NO: 566220 - DNA, 13 bp, D. melanogaster
aatgtttgcgcaa

SEQ ID NO: 566221 - DNA, 13 bp, D. melanogaster
aatgtttgctgct

SEQ ID NO: 566222 - DNA, 13 bp, D. melanogaster
aatgtttgctggc

SEQ ID NO: 566223 - DNA, 13 bp, D. melanogaster
aatgtttgctgtt

SEQ ID NO: 566224 - DNA, 13 bp, D. melanogaster
aatgtttgcttaa

SEQ ID NO: 566225 - DNA, 13 bp, D. melanogaster
aatgtttggaatt

SEQ ID NO: 566226 - DNA, 13 bp, D. melanogaster
aatgtttggcaat

SEQ ID NO: 566227 - DNA, 13 bp, D. melanogaster
aatgtttgtaaat

SEQ ID NO: 566228 - DNA, 13 bp, D. melanogaster
aatgtttgtatgt

SEQ ID NO: 566229 - DNA, 13 bp, D. melanogaster
aatgtttgtgatg

SEQ ID NO: 566230 - DNA, 13 bp, D. melanogaster
aatgtttgtttac

SEQ ID NO: 566231 - DNA, 13 bp, D. melanogaster
aatgtttgtttag

SEQ ID NO: 566232 - DNA, 13 bp, D. melanogaster
aatgttttaaaca

SEQ ID NO: 566233 - DNA, 13 bp, D. melanogaster
aatgttttaaact

SEQ ID NO: 566234 - DNA, 14 bp, D. melanogaster
aatgttttaagtat

SEQ ID NO: 566235 - DNA, 13 bp, D. melanogaster
aatgttttaagtg

SEQ ID NO: 566236 - DNA, 13 bp, D. melanogaster
aatgttttaatgt

SEQ ID NO: 566237 - DNA, 13 bp, D. melanogaster
aatgttttaattg

SEQ ID NO: 566238 - DNA, 14 bp, D. melanogaster
aatgttttactttt

SEQ ID NO: 566239 - DNA, 13 bp, D. melanogaster
aatgttttcaaga

SEQ ID NO: 566240 - DNA, 13 bp, D. melanogaster
aatgttttcaata

SEQ ID NO: 566241 - DNA, 13 bp, D. melanogaster
aatgttttcatta

SEQ ID NO: 566242 - DNA, 13 bp, D. melanogaster
aatgttttcattt

SEQ ID NO: 566243 - DNA, 14 bp, D. melanogaster
aatgttttcccttt

SEQ ID NO: 566244 - DNA, 13 bp, D. melanogaster
aatgttttcgaaa

SEQ ID NO: 566245 - DNA, 13 bp, D. melanogaster
aatgttttcgaat

SEQ ID NO: 566246 - DNA, 13 bp, D. melanogaster
aatgttttcgata

SEQ ID NO: 566247 - DNA, 13 bp, D. melanogaster
aatgttttcgctt

SEQ ID NO: 566248 - DNA, 13 bp, D. melanogaster
aatgttttcggtt

SEQ ID NO: 566249 - DNA, 13 bp, D. melanogaster
aatgttttcttat

SEQ ID NO: 566250 - DNA, 13 bp, D. melanogaster
aatgttttcttct

SEQ ID NO: 566251 - DNA, 13 bp, D. melanogaster
aatgttttgaaag

SEQ ID NO: 566252 - DNA, 13 bp, D. melanogaster
aatgttttgaatg

SEQ ID NO: 566253 - DNA, 13 bp, D. melanogaster
aatgttttgataa

SEQ ID NO: 566254 - DNA, 13 bp, D. melanogaster
aatgttttgatat

SEQ ID NO: 566255 - DNA, 13 bp, D. melanogaster
aatgttttgatca

SEQ ID NO: 566256 - DNA, 13 bp, D. melanogaster
aatgttttgatta

SEQ ID NO: 566257 - DNA, 13 bp, D. melanogaster
aatgttttgcaat

SEQ ID NO: 566258 - DNA, 13 bp, D. melanogaster
aatgttttgcact

SEQ ID NO: 566259 - DNA, 13 bp, D. melanogaster
aatgttttgcata

SEQ ID NO: 566260 - DNA, 14 bp, D. melanogaster
aatgttttgcatat

SEQ ID NO: 566261 - DNA, 13 bp, D. melanogaster
aatgttttggcaa

SEQ ID NO: 566262 - DNA, 13 bp, D. melanogaster
aatgttttggctg

SEQ ID NO: 566263 - DNA, 13 bp, D. melanogaster
aatgttttggtaa

SEQ ID NO: 566264 - DNA, 14 bp, D. melanogaster
aatgttttggtaaa

SEQ ID NO: 566265 - DNA, 13 bp, D. melanogaster
aatgttttgtaat

SEQ ID NO: 566266 - DNA, 13 bp, D. melanogaster
aatgttttgtgtg

SEQ ID NO: 566267 - DNA, 13 bp, D. melanogaster
aatgttttgttaa

SEQ ID NO: 566268 - DNA, 13 bp, D. melanogaster
aatgtttttaaca

SEQ ID NO: 566269 - DNA, 13 bp, D. melanogaster
aatgtttttaagc

SEQ ID NO: 566270 - DNA, 13 bp, D. melanogaster
aatgtttttaagt

SEQ ID NO: 566271 - DNA, 13 bp, D. melanogaster
aatgtttttagct

SEQ ID NO: 566272 - DNA, 13 bp, D. melanogaster
aatgtttttcaac

SEQ ID NO: 566273 - DNA, 13 bp, D. melanogaster
aatgtttttcatg

SEQ ID NO: 566274 - DNA, 14 bp, D. melanogaster
aatgtttttcattt

SEQ ID NO: 566275 - DNA, 13 bp, D. melanogaster
aatgtttttcctt

SEQ ID NO: 566276 - DNA, 13 bp, D. melanogaster
aatgtttttcgaa

SEQ ID NO: 566277 - DNA, 13 bp, D. melanogaster
aatgtttttgaaa

SEQ ID NO: 566278 - DNA, 13 bp, D. melanogaster
aatgtttttgaat

SEQ ID NO: 566279 - DNA, 13 bp, D. melanogaster
aatgtttttggca

SEQ ID NO: 566280 - DNA, 13 bp, D. melanogaster
aatgtttttggcc

SEQ ID NO: 566281 - DNA, 13 bp, D. melanogaster
aatgttttttgaa

SEQ ID NO: 566282 - DNA, 14 bp, D. melanogaster
aattaaaaaatgac

SEQ ID NO: 566283 - DNA, 14 bp, D. melanogaster
aattaaaaacgcaa

SEQ ID NO: 566284 - DNA, 13 bp, D. melanogaster
aattaaaaacgta

SEQ ID NO: 566285 - DNA, 13 bp, D. melanogaster
aattaaaaactga

SEQ ID NO: 566286 - DNA, 13 bp, D. melanogaster
aattaaaaagcca

SEQ ID NO: 566287 - DNA, 14 bp, D. melanogaster
aattaaaaagccaa

SEQ ID NO: 566288 - DNA, 13 bp, D. melanogaster
aattaaaaagtgc

SEQ ID NO: 566289 - DNA, 13 bp, D. melanogaster
aattaaaaatgca

SEQ ID NO: 566290 - DNA, 14 bp, D. melanogaster
aattaaaaatgcat

SEQ ID NO: 566291 - DNA, 13 bp, D. melanogaster
aattaaaaatggc

SEQ ID NO: 566292 - DNA, 13 bp, D. melanogaster
aattaaaaatgtg

SEQ ID NO: 566293 - DNA, 14 bp, D. melanogaster
aattaaaaatgtgt

SEQ ID NO: 566294 - DNA, 14 bp, D. melanogaster
aattaaaacaaatg

SEQ ID NO: 566295 - DNA, 13 bp, D. melanogaster
aattaaaacagat

SEQ ID NO: 566296 - DNA, 13 bp, D. melanogaster
aattaaaacagta

SEQ ID NO: 566297 - DNA, 14 bp, D. melanogaster
aattaaaacagtat

SEQ ID NO: 566298 - DNA, 13 bp, D. melanogaster
aattaaaacccat

SEQ ID NO: 566299 - DNA, 14 bp, D. melanogaster
aattaaaaccgaaa

SEQ ID NO: 566300 - DNA, 13 bp, D. melanogaster
aattaaaaccgca

SEQ ID NO: 566301 - DNA, 14 bp, D. melanogaster
aattaaaacgaaat

SEQ ID NO: 566302 - DNA, 13 bp, D. melanogaster
aattaaaacgcaa

SEQ ID NO: 566303 - DNA, 13 bp, D. melanogaster
aattaaaacgctt

SEQ ID NO: 566304 - DNA, 13 bp, D. melanogaster
aattaaaacggaa

SEQ ID NO: 566305 - DNA, 13 bp, D. melanogaster
aattaaaactaga

SEQ ID NO: 566306 - DNA, 13 bp, D. melanogaster
aattaaaactgaa

SEQ ID NO: 566307 - DNA, 14 bp, D. melanogaster
aattaaaactgaaa

SEQ ID NO: 566308 - DNA, 13 bp, D. melanogaster
aattaaaactgca

SEQ ID NO: 566309 - DNA, 13 bp, D. melanogaster
aattaaaacttgc

SEQ ID NO: 566310 - DNA, 14 bp, D. melanogaster
aattaaaactttgt

SEQ ID NO: 566311 - DNA, 13 bp, D. melanogaster
aattaaaagacat

SEQ ID NO: 566312 - DNA, 13 bp, D. melanogaster
aattaaaagcaat

SEQ ID NO: 566313 - DNA, 13 bp, D. melanogaster
aattaaaagcaca

SEQ ID NO: 566314 - DNA, 13 bp, D. melanogaster
aattaaaagcagc

SEQ ID NO: 566315 - DNA, 13 bp, D. melanogaster
aattaaaagccaa

SEQ ID NO: 566316 - DNA, 13 bp, D. melanogaster
aattaaaagccag

SEQ ID NO: 566317 - DNA, 13 bp, D. melanogaster
aattaaaagccgc

SEQ ID NO: 566318 - DNA, 13 bp, D. melanogaster
aattaaaagcgca

SEQ ID NO: 566319 - DNA, 13 bp, D. melanogaster
aattaaaagcggc

SEQ ID NO: 566320 - DNA, 13 bp, D. melanogaster
aattaaaagctgc

SEQ ID NO: 566321 - DNA, 13 bp, D. melanogaster
aattaaaagcttt

SEQ ID NO: 566322 - DNA, 14 bp, D. melanogaster
aattaaaagctttt

SEQ ID NO: 566323 - DNA, 13 bp, D. melanogaster
aattaaaaggcca

SEQ ID NO: 566324 - DNA, 13 bp, D. melanogaster
aattaaaagtagt

SEQ ID NO: 566325 - DNA, 13 bp, D. melanogaster
aattaaaagtgct

SEQ ID NO: 566326 - DNA, 14 bp, D. melanogaster
aattaaaagttttg

SEQ ID NO: 566327 - DNA, 13 bp, D. melanogaster
aattaaaatccac

SEQ ID NO: 566328 - DNA, 14 bp, D. melanogaster
aattaaaatcgaaa

SEQ ID NO: 566329 - DNA, 13 bp, D. melanogaster
aattaaaatcgat

SEQ ID NO: 566330 - DNA, 13 bp, D. melanogaster
aattaaaatcgtt

SEQ ID NO: 566331 - DNA, 13 bp, D. melanogaster
aattaaaatgaca

SEQ ID NO: 566332 - DNA, 13 bp, D. melanogaster
aattaaaatgagc

SEQ ID NO: 566333 - DNA, 13 bp, D. melanogaster
aattaaaatgcaa

SEQ ID NO: 566334 - DNA, 13 bp, D. melanogaster
aattaaaatgcat

SEQ ID NO: 566335 - DNA, 14 bp, D. melanogaster
aattaaaatgcatt

SEQ ID NO: 566336 - DNA, 13 bp, D. melanogaster
aattaaaatgctt

SEQ ID NO: 566337 - DNA, 13 bp, D. melanogaster
aattaaaatggca

SEQ ID NO: 566338 - DNA, 14 bp, D. melanogaster
aattaaaatggctt

SEQ ID NO: 566339 - DNA, 14 bp, D. melanogaster
aattaaaatggttt

SEQ ID NO: 566340 - DNA, 13 bp, D. melanogaster
aattaaaatgtca

SEQ ID NO: 566341 - DNA, 13 bp, D. melanogaster
aattaaaattcca

SEQ ID NO: 566342 - DNA, 14 bp, D. melanogaster
aattaaaattccat

SEQ ID NO: 566343 - DNA, 13 bp, D. melanogaster
aattaaaattcga

SEQ ID NO: 566344 - DNA, 13 bp, D. melanogaster
aattaaaattctg

SEQ ID NO: 566345 - DNA, 13 bp, D. melanogaster
aattaaaattgca

SEQ ID NO: 566346 - DNA, 13 bp, D. melanogaster
aattaaaattgct

SEQ ID NO: 566347 - DNA, 13 bp, D. melanogaster
aattaaaattgga

SEQ ID NO: 566348 - DNA, 13 bp, D. melanogaster
aattaaacaagat

SEQ ID NO: 566349 - DNA, 13 bp, D. melanogaster
aattaaacaagca

SEQ ID NO: 566350 - DNA, 13 bp, D. melanogaster
aattaaacaagct

SEQ ID NO: 566351 - DNA, 13 bp, D. melanogaster
aattaaacaagtt

SEQ ID NO: 566352 - DNA, 13 bp, D. melanogaster
aattaaacaattc

SEQ ID NO: 566353 - DNA, 13 bp, D. melanogaster
aattaaacacttt

SEQ ID NO: 566354 - DNA, 13 bp, D. melanogaster
aattaaacagcaa

SEQ ID NO: 566355 - DNA, 13 bp, D. melanogaster
aattaaacattgt

SEQ ID NO: 566356 - DNA, 13 bp, D. melanogaster
aattaaaccattt

SEQ ID NO: 566357 - DNA, 13 bp, D. melanogaster
aattaaaccgaat

SEQ ID NO: 566358 - DNA, 13 bp, D. melanogaster
aattaaacgaaac

SEQ ID NO: 566359 - DNA, 13 bp, D. melanogaster
aattaaacgaaat

SEQ ID NO: 566360 - DNA, 14 bp, D. melanogaster
aattaaacgaaatt

SEQ ID NO: 566361 - DNA, 13 bp, D. melanogaster
aattaaacgaagt

SEQ ID NO: 566362 - DNA, 13 bp, D. melanogaster
aattaaacgattt

SEQ ID NO: 566363 - DNA, 13 bp, D. melanogaster
aattaaacgcaaa

SEQ ID NO: 566364 - DNA, 14 bp, D. melanogaster
aattaaacgcaaat

SEQ ID NO: 566365 - DNA, 13 bp, D. melanogaster
aattaaacgcaat

SEQ ID NO: 566366 - DNA, 13 bp, D. melanogaster
aattaaacggaaa

SEQ ID NO: 566367 - DNA, 13 bp, D. melanogaster
aattaaacggaat

SEQ ID NO: 566368 - DNA, 13 bp, D. melanogaster
aattaaacgtaat

SEQ ID NO: 566369 - DNA, 13 bp, D. melanogaster
aattaaacgttaa

SEQ ID NO: 566370 - DNA, 13 bp, D. melanogaster
aattaaactaatg

SEQ ID NO: 566371 - DNA, 13 bp, D. melanogaster
aattaaactttcc

SEQ ID NO: 566372 - DNA, 13 bp, D. melanogaster
aattaaactttgt

SEQ ID NO: 566373 - DNA, 13 bp, D. melanogaster
aattaaagaagct

SEQ ID NO: 566374 - DNA, 13 bp, D. melanogaster
aattaaagaatgt

SEQ ID NO: 566375 - DNA, 13 bp, D. melanogaster
aattaaagagcca

SEQ ID NO: 566376 - DNA, 13 bp, D. melanogaster
aattaaagataac

SEQ ID NO: 566377 - DNA, 13 bp, D. melanogaster
aattaaagatgtt

SEQ ID NO: 566378 - DNA, 13 bp, D. melanogaster
aattaaagattgt

SEQ ID NO: 566379 - DNA, 13 bp, D. melanogaster
aattaaagcaaac

SEQ ID NO: 566380 - DNA, 13 bp, D. melanogaster
aattaaagcaaca

SEQ ID NO: 566381 - DNA, 13 bp, D. melanogaster
aattaaagcaaga

SEQ ID NO: 566382 - DNA, 13 bp, D. melanogaster
aattaaagcaata

SEQ ID NO: 566383 - DNA, 13 bp, D. melanogaster
aattaaagcaatt

SEQ ID NO: 566384 - DNA, 14 bp, D. melanogaster
aattaaagcaattt

SEQ ID NO: 566385 - DNA, 13 bp, D. melanogaster
aattaaagcattt

SEQ ID NO: 566386 - DNA, 13 bp, D. melanogaster
aattaaagccaca

SEQ ID NO: 566387 - DNA, 13 bp, D. melanogaster
aattaaagcccaa

SEQ ID NO: 566388 - DNA, 13 bp, D. melanogaster
aattaaagcgaaa

SEQ ID NO: 566389 - DNA, 13 bp, D. melanogaster
aattaaagcgatt

SEQ ID NO: 566390 - DNA, 13 bp, D. melanogaster
aattaaagcgcaa

SEQ ID NO: 566391 - DNA, 13 bp, D. melanogaster
aattaaagcgcca

SEQ ID NO: 566392 - DNA, 13 bp, D. melanogaster
aattaaagcttat

SEQ ID NO: 566393 - DNA, 13 bp, D. melanogaster
aattaaagtgcaa

SEQ ID NO: 566394 - DNA, 13 bp, D. melanogaster
aattaaagttaag

SEQ ID NO: 566395 - DNA, 13 bp, D. melanogaster
aattaaagttcaa

SEQ ID NO: 566396 - DNA, 13 bp, D. melanogaster
aattaaagttgag

SEQ ID NO: 566397 - DNA, 13 bp, D. melanogaster
aattaaagttgca

SEQ ID NO: 566398 - DNA, 13 bp, D. melanogaster
aattaaagttttg

SEQ ID NO: 566399 - DNA, 13 bp, D. melanogaster
aattaaataaacg

SEQ ID NO: 566400 - DNA, 13 bp, D. melanogaster
aattaaataaagc

SEQ ID NO: 566401 - DNA, 14 bp, D. melanogaster
aattaaataaatgc

SEQ ID NO: 566402 - DNA, 13 bp, D. melanogaster
aattaaataagtg

SEQ ID NO: 566403 - DNA, 13 bp, D. melanogaster
aattaaatagcaa

SEQ ID NO: 566404 - DNA, 13 bp, D. melanogaster
aattaaatatgca

SEQ ID NO: 566405 - DNA, 14 bp, D. melanogaster
aattaaatatgcaa

SEQ ID NO: 566406 - DNA, 13 bp, D. melanogaster
aattaaatcaagt

SEQ ID NO: 566407 - DNA, 13 bp, D. melanogaster
aattaaatcactt

SEQ ID NO: 566408 - DNA, 13 bp, D. melanogaster
aattaaatccatt

SEQ ID NO: 566409 - DNA, 13 bp, D. melanogaster
aattaaatccttt

SEQ ID NO: 566410 - DNA, 13 bp, D. melanogaster
aattaaatcgaaa

SEQ ID NO: 566411 - DNA, 13 bp, D. melanogaster
aattaaatcgaag

SEQ ID NO: 566412 - DNA, 13 bp, D. melanogaster
aattaaatcgaat

SEQ ID NO: 566413 - DNA, 14 bp, D. melanogaster
aattaaatcgaatt

SEQ ID NO: 566414 - DNA, 13 bp, D. melanogaster
aattaaatcgcaa

SEQ ID NO: 566415 - DNA, 13 bp, D. melanogaster
aattaaatcgttt

SEQ ID NO: 566416 - DNA, 13 bp, D. melanogaster
aattaaatctcaa

SEQ ID NO: 566417 - DNA, 13 bp, D. melanogaster
aattaaatgaaac

SEQ ID NO: 566418 - DNA, 13 bp, D. melanogaster
aattaaatgactt

SEQ ID NO: 566419 - DNA, 13 bp, D. melanogaster
aattaaatgagca

SEQ ID NO: 566420 - DNA, 14 bp, D. melanogaster
aattaaatgcaaat

SEQ ID NO: 566421 - DNA, 13 bp, D. melanogaster
aattaaatgcaat

SEQ ID NO: 566422 - DNA, 14 bp, D. melanogaster
aattaaatgcaatt

SEQ ID NO: 566423 - DNA, 13 bp, D. melanogaster
aattaaatgcaca

SEQ ID NO: 566424 - DNA, 14 bp, D. melanogaster
aattaaatgcactt

SEQ ID NO: 566425 - DNA, 13 bp, D. melanogaster
aattaaatgcatg

SEQ ID NO: 566426 - DNA, 14 bp, D. melanogaster
aattaaatgccaaa

SEQ ID NO: 566427 - DNA, 13 bp, D. melanogaster
aattaaatgcgaa

SEQ ID NO: 566428 - DNA, 13 bp, D. melanogaster
aattaaatgcgct

SEQ ID NO: 566429 - DNA, 14 bp, D. melanogaster
aattaaatgctaaa

SEQ ID NO: 566430 - DNA, 13 bp, D. melanogaster
aattaaatgctat

SEQ ID NO: 566431 - DNA, 13 bp, D. melanogaster
aattaaatgctgt

SEQ ID NO: 566432 - DNA, 13 bp, D. melanogaster
aattaaatgcttt

SEQ ID NO: 566433 - DNA, 14 bp, D. melanogaster
aattaaatggaact

SEQ ID NO: 566434 - DNA, 13 bp, D. melanogaster
aattaaatggaat

SEQ ID NO: 566435 - DNA, 14 bp, D. melanogaster
aattaaatggattt

SEQ ID NO: 566436 - DNA, 13 bp, D. melanogaster
aattaaatggcca

SEQ ID NO: 566437 - DNA, 14 bp, D. melanogaster
aattaaatggccaa

SEQ ID NO: 566438 - DNA, 13 bp, D. melanogaster
aattaaatggctg

SEQ ID NO: 566439 - DNA, 13 bp, D. melanogaster
aattaaatgggtt

SEQ ID NO: 566440 - DNA, 14 bp, D. melanogaster
aattaaatggtttt

SEQ ID NO: 566441 - DNA, 13 bp, D. melanogaster
aattaaatgtcaa

SEQ ID NO: 566442 - DNA, 14 bp, D. melanogaster
aattaaatgtcaaa

SEQ ID NO: 566443 - DNA, 13 bp, D. melanogaster
aattaaatgtgac

SEQ ID NO: 566444 - DNA, 13 bp, D. melanogaster
aattaaatgttct

SEQ ID NO: 566445 - DNA, 13 bp, D. melanogaster
aattaaattaagc

SEQ ID NO: 566446 - DNA, 13 bp, D. melanogaster
aattaaattagca

SEQ ID NO: 566447 - DNA, 13 bp, D. melanogaster
aattaaattatgc

SEQ ID NO: 566448 - DNA, 13 bp, D. melanogaster
aattaaattcaag

SEQ ID NO: 566449 - DNA, 13 bp, D. melanogaster
aattaaattcagc

SEQ ID NO: 566450 - DNA, 13 bp, D. melanogaster
aattaaattcgaa

SEQ ID NO: 566451 - DNA, 13 bp, D. melanogaster
aattaaattcgca

SEQ ID NO: 566452 - DNA, 13 bp, D. melanogaster
aattaaattcgct

SEQ ID NO: 566453 - DNA, 13 bp, D. melanogaster
aattaaattgagt

SEQ ID NO: 566454 - DNA, 13 bp, D. melanogaster
aattaaattgcaa

SEQ ID NO: 566455 - DNA, 14 bp, D. melanogaster
aattaaattgcaaa

SEQ ID NO: 566456 - DNA, 13 bp, D. melanogaster
aattaaattgcat

SEQ ID NO: 566457 - DNA, 13 bp, D. melanogaster
aattaaattggcc

SEQ ID NO: 566458 - DNA, 13 bp, D. melanogaster
aattaaattggct

SEQ ID NO: 566459 - DNA, 14 bp, D. melanogaster
aattaaattgtgaa

SEQ ID NO: 566460 - DNA, 13 bp, D. melanogaster
aattaaattgttg

SEQ ID NO: 566461 - DNA, 13 bp, D. melanogaster
aattaaatttcac

SEQ ID NO: 566462 - DNA, 13 bp, D. melanogaster
aattaaatttcag

SEQ ID NO: 566463 - DNA, 13 bp, D. melanogaster
aattaaatttcca

SEQ ID NO: 566464 - DNA, 13 bp, D. melanogaster
aattaacaaattc

SEQ ID NO: 566465 - DNA, 13 bp, D. melanogaster
aattaacaaattg

SEQ ID NO: 566466 - DNA, 13 bp, D. melanogaster
aattaacacattt

SEQ ID NO: 566467 - DNA, 13 bp, D. melanogaster
aattaacagcaat

SEQ ID NO: 566468 - DNA, 13 bp, D. melanogaster
aattaacattctt

SEQ ID NO: 566469 - DNA, 13 bp, D. melanogaster
aattaacattgaa

SEQ ID NO: 566470 - DNA, 13 bp, D. melanogaster
aattaacattgat

SEQ ID NO: 566471 - DNA, 13 bp, D. melanogaster
aattaaccaattt

SEQ ID NO: 566472 - DNA, 13 bp, D. melanogaster
aattaaccagaat

SEQ ID NO: 566473 - DNA, 13 bp, D. melanogaster
aattaaccatatt

SEQ ID NO: 566474 - DNA, 14 bp, D. melanogaster
aattaaccatattg

SEQ ID NO: 566475 - DNA, 14 bp, D. melanogaster
aattaaccattgca

SEQ ID NO: 566476 - DNA, 13 bp, D. melanogaster
aattaacccaatt

SEQ ID NO: 566477 - DNA, 13 bp, D. melanogaster
aattaaccgaaat

SEQ ID NO: 566478 - DNA, 13 bp, D. melanogaster
aattaacgaaaat

SEQ ID NO: 566479 - DNA, 13 bp, D. melanogaster
aattaacgaaata

SEQ ID NO: 566480 - DNA, 13 bp, D. melanogaster
aattaacgcaaat

SEQ ID NO: 566481 - DNA, 13 bp, D. melanogaster
aattaacgcattt

SEQ ID NO: 566482 - DNA, 13 bp, D. melanogaster
aattaactaactt

SEQ ID NO: 566483 - DNA, 13 bp, D. melanogaster
aattaactcaaat

SEQ ID NO: 566484 - DNA, 13 bp, D. melanogaster
aattaactgaaaa

SEQ ID NO: 566485 - DNA, 13 bp, D. melanogaster
aattaactgaatt

SEQ ID NO: 566486 - DNA, 13 bp, D. melanogaster
aattaactgagtt

SEQ ID NO: 566487 - DNA, 13 bp, D. melanogaster
aattaactgcaaa

SEQ ID NO: 566488 - DNA, 13 bp, D. melanogaster
aattaactgcaat

SEQ ID NO: 566489 - DNA, 13 bp, D. melanogaster
aattaactggaaa

SEQ ID NO: 566490 - DNA, 13 bp, D. melanogaster
aattaacttgaaa

SEQ ID NO: 566491 - DNA, 13 bp, D. melanogaster
aattaacttgatt

SEQ ID NO: 566492 - DNA, 13 bp, D. melanogaster
aattaacttggcc

SEQ ID NO: 566493 - DNA, 13 bp, D. melanogaster
aattaacttggct

SEQ ID NO: 566494 - DNA, 13 bp, D. melanogaster
aattaacttgttt

SEQ ID NO: 566495 - DNA, 13 bp, D. melanogaster
aattaactttgaa

SEQ ID NO: 566496 - DNA, 13 bp, D. melanogaster
aattaactttggc

SEQ ID NO: 566497 - DNA, 13 bp, D. melanogaster
aattaacttttac

SEQ ID NO: 566498 - DNA, 13 bp, D. melanogaster
aattaagaaaact

SEQ ID NO: 566499 - DNA, 13 bp, D. melanogaster
aattaagaaaatc

SEQ ID NO: 566500 - DNA, 13 bp, D. melanogaster
aattaagaaacca

SEQ ID NO: 566501 - DNA, 13 bp, D. melanogaster
aattaagaaactt

SEQ ID NO: 566502 - DNA, 14 bp, D. melanogaster
aattaagaacacaa

SEQ ID NO: 566503 - DNA, 13 bp, D. melanogaster
aattaagaaccta

SEQ ID NO: 566504 - DNA, 13 bp, D. melanogaster
aattaagacaatt

SEQ ID NO: 566505 - DNA, 13 bp, D. melanogaster
aattaagatatga

SEQ ID NO: 566506 - DNA, 13 bp, D. melanogaster
aattaagattgat

SEQ ID NO: 566507 - DNA, 13 bp, D. melanogaster
aattaagcaaaca

SEQ ID NO: 566508 - DNA, 13 bp, D. melanogaster
aattaagcaaagt

SEQ ID NO: 566509 - DNA, 13 bp, D. melanogaster
aattaagcaaata

SEQ ID NO: 566510 - DNA, 13 bp, D. melanogaster
aattaagcaaatc

SEQ ID NO: 566511 - DNA, 13 bp, D. melanogaster
aattaagcaacaa

SEQ ID NO: 566512 - DNA, 13 bp, D. melanogaster
aattaagcaattt

SEQ ID NO: 566513 - DNA, 14 bp, D. melanogaster
aattaagcaattta

SEQ ID NO: 566514 - DNA, 13 bp, D. melanogaster
aattaagcacaaa

SEQ ID NO: 566515 - DNA, 13 bp, D. melanogaster
aattaagcagaaa

SEQ ID NO: 566516 - DNA, 13 bp, D. melanogaster
aattaagcagttt

SEQ ID NO: 566517 - DNA, 13 bp, D. melanogaster
aattaagcattta

SEQ ID NO: 566518 - DNA, 13 bp, D. melanogaster
aattaagcatttt

SEQ ID NO: 566519 - DNA, 13 bp, D. melanogaster
aattaagccaaac

SEQ ID NO: 566520 - DNA, 13 bp, D. melanogaster
aattaagccaaca

SEQ ID NO: 566521 - DNA, 13 bp, D. melanogaster
aattaagccaatt

SEQ ID NO: 566522 - DNA, 13 bp, D. melanogaster
aattaagccattt

SEQ ID NO: 566523 - DNA, 13 bp, D. melanogaster
aattaagcgaaaa

SEQ ID NO: 566524 - DNA, 13 bp, D. melanogaster
aattaagcgaatg

SEQ ID NO: 566525 - DNA, 13 bp, D. melanogaster
aattaagctaaaa

SEQ ID NO: 566526 - DNA, 13 bp, D. melanogaster
aattaagctacga

SEQ ID NO: 566527 - DNA, 14 bp, D. melanogaster
aattaagctacgaa

SEQ ID NO: 566528 - DNA, 13 bp, D. melanogaster
aattaagctgaaa

SEQ ID NO: 566529 - DNA, 13 bp, D. melanogaster
aattaagctgcaa

SEQ ID NO: 566530 - DNA, 13 bp, D. melanogaster
aattaagcttaaa

SEQ ID NO: 566531 - DNA, 13 bp, D. melanogaster
aattaagcttaat

SEQ ID NO: 566532 - DNA, 13 bp, D. melanogaster
aattaagctttat

SEQ ID NO: 566533 - DNA, 13 bp, D. melanogaster
aattaaggatctt

SEQ ID NO: 566534 - DNA, 13 bp, D. melanogaster
aattaaggcaaaa

SEQ ID NO: 566535 - DNA, 14 bp, D. melanogaster
aattaaggcaaatt

SEQ ID NO: 566536 - DNA, 13 bp, D. melanogaster
aattaaggcgcac

SEQ ID NO: 566537 - DNA, 14 bp, D. melanogaster
aattaaggcgcaca

SEQ ID NO: 566538 - DNA, 13 bp, D. melanogaster
aattaagtaaaca

SEQ ID NO: 566539 - DNA, 13 bp, D. melanogaster
aattaagtacaaa

SEQ ID NO: 566540 - DNA, 13 bp, D. melanogaster
aattaagtataac

SEQ ID NO: 566541 - DNA, 13 bp, D. melanogaster
aattaagtatacg

SEQ ID NO: 566542 - DNA, 13 bp, D. melanogaster
aattaagtcattt

SEQ ID NO: 566543 - DNA, 13 bp, D. melanogaster
aattaagtgaaag

SEQ ID NO: 566544 - DNA, 13 bp, D. melanogaster
aattaagtgcaaa

SEQ ID NO: 566545 - DNA, 13 bp, D. melanogaster
aattaagtgcagt

SEQ ID NO: 566546 - DNA, 13 bp, D. melanogaster
aattaagtgcatt

SEQ ID NO: 566547 - DNA, 13 bp, D. melanogaster
aattaagtggaaa

SEQ ID NO: 566548 - DNA, 13 bp, D. melanogaster
aattaagtggcaa

SEQ ID NO: 566549 - DNA, 13 bp, D. melanogaster
aattaagtgtaaa

SEQ ID NO: 566550 - DNA, 13 bp, D. melanogaster
aattaagtgtttt

SEQ ID NO: 566551 - DNA, 13 bp, D. melanogaster
aattaagttaact

SEQ ID NO: 566552 - DNA, 13 bp, D. melanogaster
aattaagttaaga

SEQ ID NO: 566553 - DNA, 13 bp, D. melanogaster
aattaagttacaa

SEQ ID NO: 566554 - DNA, 13 bp, D. melanogaster
aattaagttagaa

SEQ ID NO: 566555 - DNA, 13 bp, D. melanogaster
aattaagttagtt

SEQ ID NO: 566556 - DNA, 13 bp, D. melanogaster
aattaagttcatt

SEQ ID NO: 566557 - DNA, 13 bp, D. melanogaster
aattaagttggca

SEQ ID NO: 566558 - DNA, 13 bp, D. melanogaster
aattaagttgtta

SEQ ID NO: 566559 - DNA, 13 bp, D. melanogaster
aattaagtttcat

SEQ ID NO: 566560 - DNA, 13 bp, D. melanogaster
aattaagtttctt

SEQ ID NO: 566561 - DNA, 13 bp, D. melanogaster
aattaagtttgaa

SEQ ID NO: 566562 - DNA, 13 bp, D. melanogaster
aattaagtttgca

SEQ ID NO: 566563 - DNA, 13 bp, D. melanogaster
aattaagtttgct

SEQ ID NO: 566564 - DNA, 13 bp, D. melanogaster
aattaagttttga

SEQ ID NO: 566565 - DNA, 13 bp, D. melanogaster
aattaagtttttg

SEQ ID NO: 566566 - DNA, 13 bp, D. melanogaster
aattaataaaagc

SEQ ID NO: 566567 - DNA, 13 bp, D. melanogaster
aattaataaagca

SEQ ID NO: 566568 - DNA, 13 bp, D. melanogaster
aattaataaatgc

SEQ ID NO: 566569 - DNA, 13 bp, D. melanogaster
aattaataacgaa

SEQ ID NO: 566570 - DNA, 14 bp, D. melanogaster
aattaataactgat

SEQ ID NO: 566571 - DNA, 13 bp, D. melanogaster
aattaataagcaa

SEQ ID NO: 566572 - DNA, 13 bp, D. melanogaster
aattaataagcat

SEQ ID NO: 566573 - DNA, 13 bp, D. melanogaster
aattaataagcca

SEQ ID NO: 566574 - DNA, 13 bp, D. melanogaster
aattaataagcga

SEQ ID NO: 566575 - DNA, 13 bp, D. melanogaster
aattaatagcaat

SEQ ID NO: 566576 - DNA, 13 bp, D. melanogaster
aattaatatccaa

SEQ ID NO: 566577 - DNA, 13 bp, D. melanogaster
aattaatatgcaa

SEQ ID NO: 566578 - DNA, 14 bp, D. melanogaster
aattaatatgcaaa

SEQ ID NO: 566579 - DNA, 13 bp, D. melanogaster
aattaatcaaagt

SEQ ID NO: 566580 - DNA, 13 bp, D. melanogaster
aattaatcaaatc

SEQ ID NO: 566581 - DNA, 13 bp, D. melanogaster
aattaatcaagtg

SEQ ID NO: 566582 - DNA, 13 bp, D. melanogaster
aattaatcaatca

SEQ ID NO: 566583 - DNA, 14 bp, D. melanogaster
aattaatcaatttg

SEQ ID NO: 566584 - DNA, 13 bp, D. melanogaster
aattaatcagaaa

SEQ ID NO: 566585 - DNA, 13 bp, D. melanogaster
aattaatcagttt

SEQ ID NO: 566586 - DNA, 13 bp, D. melanogaster
aattaatcatttc

SEQ ID NO: 566587 - DNA, 13 bp, D. melanogaster
aattaatccaaat

SEQ ID NO: 566588 - DNA, 13 bp, D. melanogaster
aattaatcgattt

SEQ ID NO: 566589 - DNA, 13 bp, D. melanogaster
aattaatgaaacc

SEQ ID NO: 566590 - DNA, 14 bp, D. melanogaster
aattaatgaaacca

SEQ ID NO: 566591 - DNA, 17 bp, D. melanogaster
aattaatgaaaccaaca

SEQ ID NO: 566592 - DNA, 13 bp, D. melanogaster
aattaatgaaagc

SEQ ID NO: 566593 - DNA, 13 bp, D. melanogaster
aattaatgaaatg

SEQ ID NO: 566594 - DNA, 13 bp, D. melanogaster
aattaatgaagtt

SEQ ID NO: 566595 - DNA, 13 bp, D. melanogaster
aattaatgaatga

SEQ ID NO: 566596 - DNA, 13 bp, D. melanogaster
aattaatgaattc

SEQ ID NO: 566597 - DNA, 13 bp, D. melanogaster
aattaatgacaat

SEQ ID NO: 566598 - DNA, 13 bp, D. melanogaster
aattaatgagaat

SEQ ID NO: 566599 - DNA, 13 bp, D. melanogaster
aattaatgcaaaa

SEQ ID NO: 566600 - DNA, 13 bp, D. melanogaster
aattaatgcaaca

SEQ ID NO: 566601 - DNA, 13 bp, D. melanogaster
aattaatgcaatt

SEQ ID NO: 566602 - DNA, 13 bp, D. melanogaster
aattaatgcactt

SEQ ID NO: 566603 - DNA, 13 bp, D. melanogaster
aattaatgcataa

SEQ ID NO: 566604 - DNA, 13 bp, D. melanogaster
aattaatgcattt

SEQ ID NO: 566605 - DNA, 13 bp, D. melanogaster
aattaatgccatt

SEQ ID NO: 566606 - DNA, 13 bp, D. melanogaster
aattaatgctaat

SEQ ID NO: 566607 - DNA, 13 bp, D. melanogaster
aattaatggcatt

SEQ ID NO: 566608 - DNA, 13 bp, D. melanogaster
aattaatggtaaa

SEQ ID NO: 566609 - DNA, 13 bp, D. melanogaster
aattaatgtgaaa

SEQ ID NO: 566610 - DNA, 13 bp, D. melanogaster
aattaatgtgcaa

SEQ ID NO: 566611 - DNA, 13 bp, D. melanogaster
aattaattaaacg

SEQ ID NO: 566612 - DNA, 13 bp, D. melanogaster
aattaattaagcg

SEQ ID NO: 566613 - DNA, 13 bp, D. melanogaster
aattaattacaca

SEQ ID NO: 566614 - DNA, 13 bp, D. melanogaster
aattaattacgaa

SEQ ID NO: 566615 - DNA, 13 bp, D. melanogaster
aattaattacttc

SEQ ID NO: 566616 - DNA, 13 bp, D. melanogaster
aattaattagcaa

SEQ ID NO: 566617 - DNA, 13 bp, D. melanogaster
aattaattagcca

SEQ ID NO: 566618 - DNA, 13 bp, D. melanogaster
aattaattagcta

SEQ ID NO: 566619 - DNA, 13 bp, D. melanogaster
aattaattaggaa

SEQ ID NO: 566620 - DNA, 13 bp, D. melanogaster
aattaattaggca

SEQ ID NO: 566621 - DNA, 13 bp, D. melanogaster
aattaattatgca

SEQ ID NO: 566622 - DNA, 13 bp, D. melanogaster
aattaattattgg

SEQ ID NO: 566623 - DNA, 13 bp, D. melanogaster
aattaattcaaag

SEQ ID NO: 566624 - DNA, 13 bp, D. melanogaster
aattaattcaaca

SEQ ID NO: 566625 - DNA, 13 bp, D. melanogaster
aattaattccaaa

SEQ ID NO: 566626 - DNA, 13 bp, D. melanogaster
aattaattcgaaa

SEQ ID NO: 566627 - DNA, 13 bp, D. melanogaster
aattaattgaaag

SEQ ID NO: 566628 - DNA, 13 bp, D. melanogaster
aattaattgacaa

SEQ ID NO: 566629 - DNA, 13 bp, D. melanogaster
aattaattgagtg

SEQ ID NO: 566630 - DNA, 13 bp, D. melanogaster
aattaattgattg

SEQ ID NO: 566631 - DNA, 13 bp, D. melanogaster
aattaattgcaaa

SEQ ID NO: 566632 - DNA, 14 bp, D. melanogaster
aattaattgcaaat

SEQ ID NO: 566633 - DNA, 13 bp, D. melanogaster
aattaattgcaac

SEQ ID NO: 566634 - DNA, 13 bp, D. melanogaster
aattaattgcaat

SEQ ID NO: 566635 - DNA, 14 bp, D. melanogaster
aattaattgcaatt

SEQ ID NO: 566636 - DNA, 13 bp, D. melanogaster
aattaattgcaca

SEQ ID NO: 566637 - DNA, 13 bp, D. melanogaster
aattaattgcatt

SEQ ID NO: 566638 - DNA, 14 bp, D. melanogaster
aattaattgcattt

SEQ ID NO: 566639 - DNA, 13 bp, D. melanogaster
aattaattgccat

SEQ ID NO: 566640 - DNA, 14 bp, D. melanogaster
aattaattgccatt

SEQ ID NO: 566641 - DNA, 13 bp, D. melanogaster
aattaattgcgaa

SEQ ID NO: 566642 - DNA, 13 bp, D. melanogaster
aattaattgctgc

SEQ ID NO: 566643 - DNA, 13 bp, D. melanogaster
aattaattggaaa

SEQ ID NO: 566644 - DNA, 14 bp, D. melanogaster
aattaattggaaat

SEQ ID NO: 566645 - DNA, 13 bp, D. melanogaster
aattaattggcca

SEQ ID NO: 566646 - DNA, 13 bp, D. melanogaster
aattaattgtcaa

SEQ ID NO: 566647 - DNA, 13 bp, D. melanogaster
aattaatttcaca

SEQ ID NO: 566648 - DNA, 13 bp, D. melanogaster
aattaatttcact

SEQ ID NO: 566649 - DNA, 13 bp, D. melanogaster
aattaatttccaa

SEQ ID NO: 566650 - DNA, 14 bp, D. melanogaster
aattaatttccaat

SEQ ID NO: 566651 - DNA, 13 bp, D. melanogaster
aattaatttccag

SEQ ID NO: 566652 - DNA, 13 bp, D. melanogaster
aattaatttcgtt

SEQ ID NO: 566653 - DNA, 13 bp, D. melanogaster
aattaatttgagc

SEQ ID NO: 566654 - DNA, 13 bp, D. melanogaster
aattaatttggca

SEQ ID NO: 566655 - DNA, 13 bp, D. melanogaster
aattaattttagc

SEQ ID NO: 566656 - DNA, 13 bp, D. melanogaster
aattaattttcca

SEQ ID NO: 566657 - DNA, 14 bp, D. melanogaster
aattaattttccat

SEQ ID NO: 566658 - DNA, 13 bp, D. melanogaster
aattaattttctg

SEQ ID NO: 566659 - DNA, 13 bp, D. melanogaster
aattaattttgca

SEQ ID NO: 566660 - DNA, 13 bp, D. melanogaster
aattaatttttgg

SEQ ID NO: 566661 - DNA, 14 bp, D. melanogaster
aattaatttttggc

SEQ ID NO: 566662 - DNA, 13 bp, D. melanogaster
aattacaaaaatg

SEQ ID NO: 566663 - DNA, 14 bp, D. melanogaster
aattacaaaaatgt

SEQ ID NO: 566664 - DNA, 13 bp, D. melanogaster
aattacaaaactg

SEQ ID NO: 566665 - DNA, 13 bp, D. melanogaster
aattacaaaagga

SEQ ID NO: 566666 - DNA, 13 bp, D. melanogaster
aattacaaaagtt

SEQ ID NO: 566667 - DNA, 14 bp, D. melanogaster
aattacaaaagttt

SEQ ID NO: 566668 - DNA, 13 bp, D. melanogaster
aattacaaacatt

SEQ ID NO: 566669 - DNA, 13 bp, D. melanogaster
aattacaaacttt

SEQ ID NO: 566670 - DNA, 13 bp, D. melanogaster
aattacaaattga

SEQ ID NO: 566671 - DNA, 13 bp, D. melanogaster
aattacaaattgc

SEQ ID NO: 566672 - DNA, 13 bp, D. melanogaster
aattacaacacat

SEQ ID NO: 566673 - DNA, 14 bp, D. melanogaster
aattacaacacata

SEQ ID NO: 566674 - DNA, 13 bp, D. melanogaster
aattacaacttcg

SEQ ID NO: 566675 - DNA, 13 bp, D. melanogaster
aattacaagaaat

SEQ ID NO: 566676 - DNA, 13 bp, D. melanogaster
aattacaagcaca

SEQ ID NO: 566677 - DNA, 13 bp, D. melanogaster
aattacaagctaa

SEQ ID NO: 566678 - DNA, 13 bp, D. melanogaster
aattacaatgata

SEQ ID NO: 566679 - DNA, 13 bp, D. melanogaster
aattacaatgcaa

SEQ ID NO: 566680 - DNA, 13 bp, D. melanogaster
aattacaattaag

SEQ ID NO: 566681 - DNA, 13 bp, D. melanogaster
aattacaattaca

SEQ ID NO: 566682 - DNA, 14 bp, D. melanogaster
aattacaattacat

SEQ ID NO: 566683 - DNA, 13 bp, D. melanogaster
aattacaattacg

SEQ ID NO: 566684 - DNA, 13 bp, D. melanogaster
aattacaattgaa

SEQ ID NO: 566685 - DNA, 14 bp, D. melanogaster
aattacaattgcaa

SEQ ID NO: 566686 - DNA, 13 bp, D. melanogaster
aattacaatttgc

SEQ ID NO: 566687 - DNA, 13 bp, D. melanogaster
aattacaatttgt

SEQ ID NO: 566688 - DNA, 13 bp, D. melanogaster
aattacaattttc

SEQ ID NO: 566689 - DNA, 13 bp, D. melanogaster
aattacacaaaag

SEQ ID NO: 566690 - DNA, 13 bp, D. melanogaster
aattacacatgca

SEQ ID NO: 566691 - DNA, 13 bp, D. melanogaster
aattacacattaa

SEQ ID NO: 566692 - DNA, 14 bp, D. melanogaster
aattacacattttt

SEQ ID NO: 566693 - DNA, 13 bp, D. melanogaster
aattacacgaaaa

SEQ ID NO: 566694 - DNA, 13 bp, D. melanogaster
aattacacgtatt

SEQ ID NO: 566695 - DNA, 13 bp, D. melanogaster
aattacagaaaat

SEQ ID NO: 566696 - DNA, 13 bp, D. melanogaster
aattacagaaggc

SEQ ID NO: 566697 - DNA, 13 bp, D. melanogaster
aattacagaggaa

SEQ ID NO: 566698 - DNA, 13 bp, D. melanogaster
aattacagcaaca

SEQ ID NO: 566699 - DNA, 13 bp, D. melanogaster
aattacagcacaa

SEQ ID NO: 566700 - DNA, 13 bp, D. melanogaster
aattacagggtat

SEQ ID NO: 566701 - DNA, 13 bp, D. melanogaster
aattacagtgcta

SEQ ID NO: 566702 - DNA, 13 bp, D. melanogaster
aattacagttttt

SEQ ID NO: 566703 - DNA, 13 bp, D. melanogaster
aattacataaatc

SEQ ID NO: 566704 - DNA, 13 bp, D. melanogaster
aattacatatttc

SEQ ID NO: 566705 - DNA, 13 bp, D. melanogaster
aattacatcttta

SEQ ID NO: 566706 - DNA, 13 bp, D. melanogaster
aattacattaaca

SEQ ID NO: 566707 - DNA, 13 bp, D. melanogaster
aattacattacat

SEQ ID NO: 566708 - DNA, 13 bp, D. melanogaster
aattacattgaaa

SEQ ID NO: 566709 - DNA, 13 bp, D. melanogaster
aattacatttaag

SEQ ID NO: 566710 - DNA, 13 bp, D. melanogaster
aattacatttaca

SEQ ID NO: 566711 - DNA, 13 bp, D. melanogaster
aattacatttcaa

SEQ ID NO: 566712 - DNA, 13 bp, D. melanogaster
aattacatttgaa

SEQ ID NO: 566713 - DNA, 13 bp, D. melanogaster
aattacatttgca

SEQ ID NO: 566714 - DNA, 13 bp, D. melanogaster
aattacatttgta

SEQ ID NO: 566715 - DNA, 13 bp, D. melanogaster
aattacattttca

SEQ ID NO: 566716 - DNA, 14 bp, D. melanogaster
aattacattttcat

SEQ ID NO: 566717 - DNA, 13 bp, D. melanogaster
aattacattttgt

SEQ ID NO: 566718 - DNA, 13 bp, D. melanogaster
aattacatttttg

SEQ ID NO: 566719 - DNA, 14 bp, D. melanogaster
aattacatttttgt

SEQ ID NO: 566720 - DNA, 13 bp, D. melanogaster
aattaccaaattt

SEQ ID NO: 566721 - DNA, 13 bp, D. melanogaster
aattaccaattaa

SEQ ID NO: 566722 - DNA, 13 bp, D. melanogaster
aattaccaattac

SEQ ID NO: 566723 - DNA, 13 bp, D. melanogaster
aattaccaattta

SEQ ID NO: 566724 - DNA, 13 bp, D. melanogaster
aattaccagaaca

SEQ ID NO: 566725 - DNA, 13 bp, D. melanogaster
aattaccagcagc

SEQ ID NO: 566726 - DNA, 13 bp, D. melanogaster
aattaccataaat

SEQ ID NO: 566727 - DNA, 13 bp, D. melanogaster
aattaccatattg

SEQ ID NO: 566728 - DNA, 13 bp, D. melanogaster
aattaccattaat

SEQ ID NO: 566729 - DNA, 13 bp, D. melanogaster
aattaccatttga

SEQ ID NO: 566730 - DNA, 13 bp, D. melanogaster
aattacccaaata

SEQ ID NO: 566731 - DNA, 13 bp, D. melanogaster
aattacccatatt

SEQ ID NO: 566732 - DNA, 13 bp, D. melanogaster
aattacgaaaaat

SEQ ID NO: 566733 - DNA, 13 bp, D. melanogaster
aattacgaaaata

SEQ ID NO: 566734 - DNA, 13 bp, D. melanogaster
aattacgaaacaa

SEQ ID NO: 566735 - DNA, 13 bp, D. melanogaster
aattacgaacaaa

SEQ ID NO: 566736 - DNA, 14 bp, D. melanogaster
aattacgaacaaaa

SEQ ID NO: 566737 - DNA, 13 bp, D. melanogaster
aattacgacaaaa

SEQ ID NO: 566738 - DNA, 14 bp, D. melanogaster
aattacgacaaaaa

SEQ ID NO: 566739 - DNA, 13 bp, D. melanogaster
aattacgagttca

SEQ ID NO: 566740 - DNA, 13 bp, D. melanogaster
aattacgcaaaat

SEQ ID NO: 566741 - DNA, 13 bp, D. melanogaster
aattacgtttttt

SEQ ID NO: 566742 - DNA, 13 bp, D. melanogaster
aattactaaaatg

SEQ ID NO: 566743 - DNA, 13 bp, D. melanogaster
aattactaactaa

SEQ ID NO: 566744 - DNA, 13 bp, D. melanogaster
aattactaactta

SEQ ID NO: 566745 - DNA, 13 bp, D. melanogaster
aattactaatgaa

SEQ ID NO: 566746 - DNA, 13 bp, D. melanogaster
aattactcaatta

SEQ ID NO: 566747 - DNA, 13 bp, D. melanogaster
aattactcaattt

SEQ ID NO: 566748 - DNA, 13 bp, D. melanogaster
aattactgacctg

SEQ ID NO: 566749 - DNA, 13 bp, D. melanogaster
aattactgcaaat

SEQ ID NO: 566750 - DNA, 13 bp, D. melanogaster
aattacttaaaca

SEQ ID NO: 566751 - DNA, 13 bp, D. melanogaster
aattacttaattc

SEQ ID NO: 566752 - DNA, 14 bp, D. melanogaster
aattacttaattca

SEQ ID NO: 566753 - DNA, 13 bp, D. melanogaster
aattacttatttg

SEQ ID NO: 566754 - DNA, 13 bp, D. melanogaster
aattacttcaaaa

SEQ ID NO: 566755 - DNA, 13 bp, D. melanogaster
aattacttgccat

SEQ ID NO: 566756 - DNA, 13 bp, D. melanogaster
aattacttgcccc

SEQ ID NO: 566757 - DNA, 13 bp, D. melanogaster
aattacttggcca

SEQ ID NO: 566758 - DNA, 13 bp, D. melanogaster
aattacttgtaaa

SEQ ID NO: 566759 - DNA, 13 bp, D. melanogaster
aattacttgttct

SEQ ID NO: 566760 - DNA, 13 bp, D. melanogaster
aattactttaatg

SEQ ID NO: 566761 - DNA, 13 bp, D. melanogaster
aattactttcact

SEQ ID NO: 566762 - DNA, 13 bp, D. melanogaster
aattactttcatt

SEQ ID NO: 566763 - DNA, 13 bp, D. melanogaster
aattactttgttg

SEQ ID NO: 566764 - DNA, 13 bp, D. melanogaster
aattacttttaca

SEQ ID NO: 566765 - DNA, 13 bp, D. melanogaster
aattacttttagt

SEQ ID NO: 566766 - DNA, 13 bp, D. melanogaster
aattacttttcta

SEQ ID NO: 566767 - DNA, 13 bp, D. melanogaster
aattacttttggc

SEQ ID NO: 566768 - DNA, 13 bp, D. melanogaster
aattagaaaaact

SEQ ID NO: 566769 - DNA, 13 bp, D. melanogaster
aattagaaaactt

SEQ ID NO: 566770 - DNA, 13 bp, D. melanogaster
aattagaaaatac

SEQ ID NO: 566771 - DNA, 13 bp, D. melanogaster
aattagaaaatcc

SEQ ID NO: 566772 - DNA, 13 bp, D. melanogaster
aattagaaaattc

SEQ ID NO: 566773 - DNA, 13 bp, D. melanogaster
aattagaaagttt

SEQ ID NO: 566774 - DNA, 13 bp, D. melanogaster
aattagaattcca

SEQ ID NO: 566775 - DNA, 13 bp, D. melanogaster
aattagaatttgt

SEQ ID NO: 566776 - DNA, 13 bp, D. melanogaster
aattagacaaatt

SEQ ID NO: 566777 - DNA, 13 bp, D. melanogaster
aattagaccaaac

SEQ ID NO: 566778 - DNA, 13 bp, D. melanogaster
aattagatacaaa

SEQ ID NO: 566779 - DNA, 13 bp, D. melanogaster
aattagcaaaaat

SEQ ID NO: 566780 - DNA, 13 bp, D. melanogaster
aattagcaaaagc

SEQ ID NO: 566781 - DNA, 13 bp, D. melanogaster
aattagcaacaaa

SEQ ID NO: 566782 - DNA, 13 bp, D. melanogaster
aattagcaacaat

SEQ ID NO: 566783 - DNA, 13 bp, D. melanogaster
aattagcaattat

SEQ ID NO: 566784 - DNA, 13 bp, D. melanogaster
aattagcagctgc

SEQ ID NO: 566785 - DNA, 14 bp, D. melanogaster
aattagcataaatt

SEQ ID NO: 566786 - DNA, 13 bp, D. melanogaster
aattagcataatt

SEQ ID NO: 566787 - DNA, 13 bp, D. melanogaster
aattagcattaaa

SEQ ID NO: 566788 - DNA, 13 bp, D. melanogaster
aattagcattttg

SEQ ID NO: 566789 - DNA, 13 bp, D. melanogaster
aattagccaaaaa

SEQ ID NO: 566790 - DNA, 13 bp, D. melanogaster
aattagccaaaca

SEQ ID NO: 566791 - DNA, 13 bp, D. melanogaster
aattagccaaata

SEQ ID NO: 566792 - DNA, 13 bp, D. melanogaster
aattagccaaatg

SEQ ID NO: 566793 - DNA, 13 bp, D. melanogaster
aattagccaaatt

SEQ ID NO: 566794 - DNA, 13 bp, D. melanogaster
aattagccaagtt

SEQ ID NO: 566795 - DNA, 13 bp, D. melanogaster
aattagccaattt

SEQ ID NO: 566796 - DNA, 13 bp, D. melanogaster
aattagccagaaa

SEQ ID NO: 566797 - DNA, 13 bp, D. melanogaster
aattagccagcaa

SEQ ID NO: 566798 - DNA, 13 bp, D. melanogaster
aattagccagcga

SEQ ID NO: 566799 - DNA, 13 bp, D. melanogaster
aattagccataat

SEQ ID NO: 566800 - DNA, 13 bp, D. melanogaster
aattagccggcaa

SEQ ID NO: 566801 - DNA, 13 bp, D. melanogaster
aattagcctggcc

SEQ ID NO: 566802 - DNA, 13 bp, D. melanogaster
aattagcgaactt

SEQ ID NO: 566803 - DNA, 13 bp, D. melanogaster
aattagcgatttt

SEQ ID NO: 566804 - DNA, 13 bp, D. melanogaster
aattagctgaaaa

SEQ ID NO: 566805 - DNA, 13 bp, D. melanogaster
aattagctgcaca

SEQ ID NO: 566806 - DNA, 13 bp, D. melanogaster
aattagctgtaaa

SEQ ID NO: 566807 - DNA, 13 bp, D. melanogaster
aattagcttaaaa

SEQ ID NO: 566808 - DNA, 13 bp, D. melanogaster
aattagcttaaat

SEQ ID NO: 566809 - DNA, 13 bp, D. melanogaster
aattagcttaatt

SEQ ID NO: 566810 - DNA, 13 bp, D. melanogaster
aattagctttaat

SEQ ID NO: 566811 - DNA, 13 bp, D. melanogaster
aattaggcaaaaa

SEQ ID NO: 566812 - DNA, 13 bp, D. melanogaster
aattagggaaagt

SEQ ID NO: 566813 - DNA, 13 bp, D. melanogaster
aattagtaaatca

SEQ ID NO: 566814 - DNA, 13 bp, D. melanogaster
aattagtatgcat

SEQ ID NO: 566815 - DNA, 13 bp, D. melanogaster
aattagtcaaata

SEQ ID NO: 566816 - DNA, 13 bp, D. melanogaster
aattagtcaatat

SEQ ID NO: 566817 - DNA, 13 bp, D. melanogaster
aattagtcaatta

SEQ ID NO: 566818 - DNA, 13 bp, D. melanogaster
aattagtgaaata

SEQ ID NO: 566819 - DNA, 13 bp, D. melanogaster
aattagtgcaaat

SEQ ID NO: 566820 - DNA, 13 bp, D. melanogaster
aattagtggcaaa

SEQ ID NO: 566821 - DNA, 13 bp, D. melanogaster
aattagtgtcaat

SEQ ID NO: 566822 - DNA, 13 bp, D. melanogaster
aattagttaacaa

SEQ ID NO: 566823 - DNA, 13 bp, D. melanogaster
aattagttagtta

SEQ ID NO: 566824 - DNA, 13 bp, D. melanogaster
aattagttcaatt

SEQ ID NO: 566825 - DNA, 13 bp, D. melanogaster
aattagttcttta

SEQ ID NO: 566826 - DNA, 14 bp, D. melanogaster
aattagttctttag

SEQ ID NO: 566827 - DNA, 14 bp, D. melanogaster
aattagttgaaaat

SEQ ID NO: 566828 - DNA, 13 bp, D. melanogaster
aattagttgaatt

SEQ ID NO: 566829 - DNA, 13 bp, D. melanogaster
aattagttgataa

SEQ ID NO: 566830 - DNA, 13 bp, D. melanogaster
aattagttggcat

SEQ ID NO: 566831 - DNA, 13 bp, D. melanogaster
aattagttgggcc

SEQ ID NO: 566832 - DNA, 13 bp, D. melanogaster
aattagtttacat

SEQ ID NO: 566833 - DNA, 13 bp, D. melanogaster
aattagtttcaaa

SEQ ID NO: 566834 - DNA, 14 bp, D. melanogaster
aattagtttcaatt

SEQ ID NO: 566835 - DNA, 13 bp, D. melanogaster
aattagtttccat

SEQ ID NO: 566836 - DNA, 13 bp, D. melanogaster
aattagttttcag

SEQ ID NO: 566837 - DNA, 13 bp, D. melanogaster
aattagttttcca

SEQ ID NO: 566838 - DNA, 13 bp, D. melanogaster
aattagttttccc

SEQ ID NO: 566839 - DNA, 13 bp, D. melanogaster
aattagttttcga

SEQ ID NO: 566840 - DNA, 13 bp, D. melanogaster
aattagttttgta

SEQ ID NO: 566841 - DNA, 13 bp, D. melanogaster
aattagttttgtg

SEQ ID NO: 566842 - DNA, 13 bp, D. melanogaster
aattataaaatgc

SEQ ID NO: 566843 - DNA, 13 bp, D. melanogaster
aattataaacaga

SEQ ID NO: 566844 - DNA, 14 bp, D. melanogaster
aattataacataga

SEQ ID NO: 566845 - DNA, 13 bp, D. melanogaster
aattataagcaaa

SEQ ID NO: 566846 - DNA, 13 bp, D. melanogaster
aattataatgaga

SEQ ID NO: 566847 - DNA, 13 bp, D. melanogaster
aattataattgca

SEQ ID NO: 566848 - DNA, 13 bp, D. melanogaster
aattatacaaaag

SEQ ID NO: 566849 - DNA, 13 bp, D. melanogaster
aattatacatatg

SEQ ID NO: 566850 - DNA, 13 bp, D. melanogaster
aattataccacaa

SEQ ID NO: 566851 - DNA, 13 bp, D. melanogaster
aattatactttct

SEQ ID NO: 566852 - DNA, 13 bp, D. melanogaster
aattatagccaaa

SEQ ID NO: 566853 - DNA, 13 bp, D. melanogaster
aattatagcttaa

SEQ ID NO: 566854 - DNA, 14 bp, D. melanogaster
aattatagtgacaa

SEQ ID NO: 566855 - DNA, 13 bp, D. melanogaster
aattatatcgaaa

SEQ ID NO: 566856 - DNA, 13 bp, D. melanogaster
aattatattagca

SEQ ID NO: 566857 - DNA, 13 bp, D. melanogaster
aattatcaaagaa

SEQ ID NO: 566858 - DNA, 13 bp, D. melanogaster
aattatccaacat

SEQ ID NO: 566859 - DNA, 13 bp, D. melanogaster
aattatcgaaaaa

SEQ ID NO: 566860 - DNA, 13 bp, D. melanogaster
aattatcgatttt

SEQ ID NO: 566861 - DNA, 15 bp, D. melanogaster
aattatctaaagtca

SEQ ID NO: 566862 - DNA, 13 bp, D. melanogaster
aattatctgaaat

SEQ ID NO: 566863 - DNA, 13 bp, D. melanogaster
aattatgaaaaca

SEQ ID NO: 566864 - DNA, 13 bp, D. melanogaster
aattatgaaaagt

SEQ ID NO: 566865 - DNA, 13 bp, D. melanogaster
aattatgaaaatg

SEQ ID NO: 566866 - DNA, 13 bp, D. melanogaster
aattatgaaagtt

SEQ ID NO: 566867 - DNA, 13 bp, D. melanogaster
aattatgaaatga

SEQ ID NO: 566868 - DNA, 13 bp, D. melanogaster
aattatgaaatgt

SEQ ID NO: 566869 - DNA, 13 bp, D. melanogaster
aattatgaaattc

SEQ ID NO: 566870 - DNA, 13 bp, D. melanogaster
aattatgaaattg

SEQ ID NO: 566871 - DNA, 13 bp, D. melanogaster
aattatgaatttg

SEQ ID NO: 566872 - DNA, 13 bp, D. melanogaster
aattatgacaatt

SEQ ID NO: 566873 - DNA, 13 bp, D. melanogaster
aattatgagcaaa

SEQ ID NO: 566874 - DNA, 13 bp, D. melanogaster
aattatgatgaaa

SEQ ID NO: 566875 - DNA, 13 bp, D. melanogaster
aattatgattgat

SEQ ID NO: 566876 - DNA, 13 bp, D. melanogaster
aattatgatttca

SEQ ID NO: 566877 - DNA, 13 bp, D. melanogaster
aattatgattttg

SEQ ID NO: 566878 - DNA, 13 bp, D. melanogaster
aattatgcaaaaa

SEQ ID NO: 566879 - DNA, 14 bp, D. melanogaster
aattatgcaaaaat

SEQ ID NO: 566880 - DNA, 13 bp, D. melanogaster
aattatgcaaaat

SEQ ID NO: 566881 - DNA, 14 bp, D. melanogaster
aattatgcaaaatg

SEQ ID NO: 566882 - DNA, 13 bp, D. melanogaster
aattatgcaaagc

SEQ ID NO: 566883 - DNA, 14 bp, D. melanogaster
aattatgcaaatat

SEQ ID NO: 566884 - DNA, 13 bp, D. melanogaster
aattatgcaaatg

SEQ ID NO: 566885 - DNA, 13 bp, D. melanogaster
aattatgcaacaa

SEQ ID NO: 566886 - DNA, 14 bp, D. melanogaster
aattatgcaataaa

SEQ ID NO: 566887 - DNA, 13 bp, D. melanogaster
aattatgcaattt

SEQ ID NO: 566888 - DNA, 14 bp, D. melanogaster
aattatgcaattta

SEQ ID NO: 566889 - DNA, 13 bp, D. melanogaster
aattatgcacata

SEQ ID NO: 566890 - DNA, 13 bp, D. melanogaster
aattatgcagatg

SEQ ID NO: 566891 - DNA, 13 bp, D. melanogaster
aattatgcatttc

SEQ ID NO: 566892 - DNA, 13 bp, D. melanogaster
aattatgcatttt

SEQ ID NO: 566893 - DNA, 13 bp, D. melanogaster
aattatgccaaaa

SEQ ID NO: 566894 - DNA, 13 bp, D. melanogaster
aattatgccaaat

SEQ ID NO: 566895 - DNA, 13 bp, D. melanogaster
aattatgccaatt

SEQ ID NO: 566896 - DNA, 13 bp, D. melanogaster
aattatgctaatt

SEQ ID NO: 566897 - DNA, 13 bp, D. melanogaster
aattatgctgcat

SEQ ID NO: 566898 - DNA, 13 bp, D. melanogaster
aattatggaaaat

SEQ ID NO: 566899 - DNA, 13 bp, D. melanogaster
aattatggaaatt

SEQ ID NO: 566900 - DNA, 13 bp, D. melanogaster
aattatggcaaaa

SEQ ID NO: 566901 - DNA, 13 bp, D. melanogaster
aattatggttaat

SEQ ID NO: 566902 - DNA, 13 bp, D. melanogaster
aattatggttata

SEQ ID NO: 566903 - DNA, 13 bp, D. melanogaster
aattatgtaacag

SEQ ID NO: 566904 - DNA, 14 bp, D. melanogaster
aattatgtatgtat

SEQ ID NO: 566905 - DNA, 13 bp, D. melanogaster
aattatgtgaaat

SEQ ID NO: 566906 - DNA, 13 bp, D. melanogaster
aattatgtgaatt

SEQ ID NO: 566907 - DNA, 13 bp, D. melanogaster
aattatgtgagcg

SEQ ID NO: 566908 - DNA, 13 bp, D. melanogaster
aattatgtgattt

SEQ ID NO: 566909 - DNA, 13 bp, D. melanogaster
aattatgtgcagc

SEQ ID NO: 566910 - DNA, 13 bp, D. melanogaster
aattatgtgttaa

SEQ ID NO: 566911 - DNA, 13 bp, D. melanogaster
aattatgttaagt

SEQ ID NO: 566912 - DNA, 13 bp, D. melanogaster
aattatgttgaaa

SEQ ID NO: 566913 - DNA, 13 bp, D. melanogaster
aattatgttgcat

SEQ ID NO: 566914 - DNA, 13 bp, D. melanogaster
aattatgttttga

SEQ ID NO: 566915 - DNA, 13 bp, D. melanogaster
aattattaaaggc

SEQ ID NO: 566916 - DNA, 13 bp, D. melanogaster
aattattaagcca

SEQ ID NO: 566917 - DNA, 13 bp, D. melanogaster
aattattaatgtg

SEQ ID NO: 566918 - DNA, 13 bp, D. melanogaster
aattattacagaa

SEQ ID NO: 566919 - DNA, 13 bp, D. melanogaster
aattattaccaaa

SEQ ID NO: 566920 - DNA, 13 bp, D. melanogaster
aattattagcaat

SEQ ID NO: 566921 - DNA, 13 bp, D. melanogaster
aattattagctga

SEQ ID NO: 566922 - DNA, 13 bp, D. melanogaster
aattattatcaac

SEQ ID NO: 566923 - DNA, 14 bp, D. melanogaster
aattattatcaaca

SEQ ID NO: 566924 - DNA, 13 bp, D. melanogaster
aattattattgct

SEQ ID NO: 566925 - DNA, 13 bp, D. melanogaster
aattattattgga

SEQ ID NO: 566926 - DNA, 13 bp, D. melanogaster
aattattattgtg

SEQ ID NO: 566927 - DNA, 13 bp, D. melanogaster
aattattatttgc

SEQ ID NO: 566928 - DNA, 13 bp, D. melanogaster
aattattcaaaac

SEQ ID NO: 566929 - DNA, 13 bp, D. melanogaster
aattattcaacaa

SEQ ID NO: 566930 - DNA, 13 bp, D. melanogaster
aattattcaacat

SEQ ID NO: 566931 - DNA, 13 bp, D. melanogaster
aattattcacaat

SEQ ID NO: 566932 - DNA, 13 bp, D. melanogaster
aattattcagaaa

SEQ ID NO: 566933 - DNA, 13 bp, D. melanogaster
aattattcagcat

SEQ ID NO: 566934 - DNA, 13 bp, D. melanogaster
aattattcattca

SEQ ID NO: 566935 - DNA, 13 bp, D. melanogaster
aattattccatat

SEQ ID NO: 566936 - DNA, 13 bp, D. melanogaster
aattattccattt

SEQ ID NO: 566937 - DNA, 13 bp, D. melanogaster
aattattccgcgt

SEQ ID NO: 566938 - DNA, 13 bp, D. melanogaster
aattattctgatt

SEQ ID NO: 566939 - DNA, 13 bp, D. melanogaster
aattattctgttt

SEQ ID NO: 566940 - DNA, 13 bp, D. melanogaster
aattattgaaaag

SEQ ID NO: 566941 - DNA, 13 bp, D. melanogaster
aattattgaacaa

SEQ ID NO: 566942 - DNA, 13 bp, D. melanogaster
aattattgatcaa

SEQ ID NO: 566943 - DNA, 13 bp, D. melanogaster
aattattgatttg

SEQ ID NO: 566944 - DNA, 13 bp, D. melanogaster
aattattgcattt

SEQ ID NO: 566945 - DNA, 13 bp, D. melanogaster
aattattgctaaa

SEQ ID NO: 566946 - DNA, 13 bp, D. melanogaster
aattattggaaat

SEQ ID NO: 566947 - DNA, 13 bp, D. melanogaster
aattattggcaaa

SEQ ID NO: 566948 - DNA, 13 bp, D. melanogaster
aattattggccaa

SEQ ID NO: 566949 - DNA, 13 bp, D. melanogaster
aattattgggaaa

SEQ ID NO: 566950 - DNA, 13 bp, D. melanogaster
aattattggttta

SEQ ID NO: 566951 - DNA, 13 bp, D. melanogaster
aattattgtagtt

SEQ ID NO: 566952 - DNA, 13 bp, D. melanogaster
aattattgtcaag

SEQ ID NO: 566953 - DNA, 13 bp, D. melanogaster
aattattgtgaaa

SEQ ID NO: 566954 - DNA, 13 bp, D. melanogaster
aattattgtgatt

SEQ ID NO: 566955 - DNA, 13 bp, D. melanogaster
aattattgttgca

SEQ ID NO: 566956 - DNA, 13 bp, D. melanogaster
aattatttaaagc

SEQ ID NO: 566957 - DNA, 13 bp, D. melanogaster
aattatttaagca

SEQ ID NO: 566958 - DNA, 13 bp, D. melanogaster
aattatttaagtg

SEQ ID NO: 566959 - DNA, 13 bp, D. melanogaster
aattatttacaag

SEQ ID NO: 566960 - DNA, 13 bp, D. melanogaster
aattatttagcaa

SEQ ID NO: 566961 - DNA, 13 bp, D. melanogaster
aattatttagcta

SEQ ID NO: 566962 - DNA, 13 bp, D. melanogaster
aattatttatcca

SEQ ID NO: 566963 - DNA, 13 bp, D. melanogaster
aattatttatgca

SEQ ID NO: 566964 - DNA, 14 bp, D. melanogaster
aattatttatgcat

SEQ ID NO: 566965 - DNA, 13 bp, D. melanogaster
aattatttcaaag

SEQ ID NO: 566966 - DNA, 13 bp, D. melanogaster
aattatttcaact

SEQ ID NO: 566967 - DNA, 14 bp, D. melanogaster
aattatttcacaaa

SEQ ID NO: 566968 - DNA, 13 bp, D. melanogaster
aattatttcactt

SEQ ID NO: 566969 - DNA, 13 bp, D. melanogaster
aattatttcagaa

SEQ ID NO: 566970 - DNA, 13 bp, D. melanogaster
aattatttcattg

SEQ ID NO: 566971 - DNA, 13 bp, D. melanogaster
aattatttcgaat

SEQ ID NO: 566972 - DNA, 13 bp, D. melanogaster
aattatttcgatt

SEQ ID NO: 566973 - DNA, 13 bp, D. melanogaster
aattatttcgttt

SEQ ID NO: 566974 - DNA, 13 bp, D. melanogaster
aattatttctgca

SEQ ID NO: 566975 - DNA, 13 bp, D. melanogaster
aattatttctgcc

SEQ ID NO: 566976 - DNA, 13 bp, D. melanogaster
aattatttctttg

SEQ ID NO: 566977 - DNA, 13 bp, D. melanogaster
aattatttgaaag

SEQ ID NO: 566978 - DNA, 13 bp, D. melanogaster
aattatttgacaa

SEQ ID NO: 566979 - DNA, 13 bp, D. melanogaster
aattatttgcaca

SEQ ID NO: 566980 - DNA, 14 bp, D. melanogaster
aattatttgcacac

SEQ ID NO: 566981 - DNA, 13 bp, D. melanogaster
aattatttgcagt

SEQ ID NO: 566982 - DNA, 13 bp, D. melanogaster
aattatttgcata

SEQ ID NO: 566983 - DNA, 13 bp, D. melanogaster
aattatttgcatt

SEQ ID NO: 566984 - DNA, 13 bp, D. melanogaster
aattatttgccaa

SEQ ID NO: 566985 - DNA, 13 bp, D. melanogaster
aattatttgcgaa

SEQ ID NO: 566986 - DNA, 13 bp, D. melanogaster
aattattttaacg

SEQ ID NO: 566987 - DNA, 13 bp, D. melanogaster
aattattttcact

SEQ ID NO: 566988 - DNA, 13 bp, D. melanogaster
aattattttccaa

SEQ ID NO: 566989 - DNA, 13 bp, D. melanogaster
aattattttccag

SEQ ID NO: 566990 - DNA, 13 bp, D. melanogaster
aattattttccat

SEQ ID NO: 566991 - DNA, 13 bp, D. melanogaster
aattattttcgat

SEQ ID NO: 566992 - DNA, 13 bp, D. melanogaster
aattattttgaca

SEQ ID NO: 566993 - DNA, 13 bp, D. melanogaster
aattattttgcaa

SEQ ID NO: 566994 - DNA, 13 bp, D. melanogaster
aattattttggaa

SEQ ID NO: 566995 - DNA, 14 bp, D. melanogaster
aattattttggaaa

SEQ ID NO: 566996 - DNA, 13 bp, D. melanogaster
aattattttgtgc

SEQ ID NO: 566997 - DNA, 13 bp, D. melanogaster
aattatttttacc

SEQ ID NO: 566998 - DNA, 13 bp, D. melanogaster
aattatttttgca

SEQ ID NO: 566999 - DNA, 14 bp, D. melanogaster
aattatttttgcat

SEQ ID NO: 567000 - DNA, 13 bp, D. melanogaster
aattcaaaacatt

SEQ ID NO: 567001 - DNA, 13 bp, D. melanogaster
aattcaaaacgaa

SEQ ID NO: 567002 - DNA, 13 bp, D. melanogaster
aattcaaaacttt

SEQ ID NO: 567003 - DNA, 13 bp, D. melanogaster
aattcaaaagcaa

SEQ ID NO: 567004 - DNA, 13 bp, D. melanogaster
aattcaaaagttt

SEQ ID NO: 567005 - DNA, 13 bp, D. melanogaster
aattcaaaatgaa

SEQ ID NO: 567006 - DNA, 14 bp, D. melanogaster
aattcaaaatgaaa

SEQ ID NO: 567007 - DNA, 13 bp, D. melanogaster
aattcaaaatgct

SEQ ID NO: 567008 - DNA, 13 bp, D. melanogaster
aattcaaaatggc

SEQ ID NO: 567009 - DNA, 13 bp, D. melanogaster
aattcaaaatgta

SEQ ID NO: 567010 - DNA, 14 bp, D. melanogaster
aattcaaaatgttt

SEQ ID NO: 567011 - DNA, 13 bp, D. melanogaster
aattcaaaattca

SEQ ID NO: 567012 - DNA, 13 bp, D. melanogaster
aattcaaaattga

SEQ ID NO: 567013 - DNA, 14 bp, D. melanogaster
aattcaaaatttct

SEQ ID NO: 567014 - DNA, 13 bp, D. melanogaster
aattcaaacaatt

SEQ ID NO: 567015 - DNA, 13 bp, D. melanogaster
aattcaaacacca

SEQ ID NO: 567016 - DNA, 13 bp, D. melanogaster
aattcaaacagaa

SEQ ID NO: 567017 - DNA, 13 bp, D. melanogaster
aattcaaacagtt

SEQ ID NO: 567018 - DNA, 13 bp, D. melanogaster
aattcaaacattt

SEQ ID NO: 567019 - DNA, 13 bp, D. melanogaster
aattcaaaccgat

SEQ ID NO: 567020 - DNA, 14 bp, D. melanogaster
aattcaaaccgata

SEQ ID NO: 567021 - DNA, 13 bp, D. melanogaster
aattcaaacgaat

SEQ ID NO: 567022 - DNA, 13 bp, D. melanogaster
aattcaaacttaa

SEQ ID NO: 567023 - DNA, 13 bp, D. melanogaster
aattcaaagaaat

SEQ ID NO: 567024 - DNA, 14 bp, D. melanogaster
aattcaaagaaatc

SEQ ID NO: 567025 - DNA, 13 bp, D. melanogaster
aattcaaagcaaa

SEQ ID NO: 567026 - DNA, 13 bp, D. melanogaster
aattcaaaggaaa

SEQ ID NO: 567027 - DNA, 13 bp, D. melanogaster
aattcaaaggcaa

SEQ ID NO: 567028 - DNA, 13 bp, D. melanogaster
aattcaaagtaaa

SEQ ID NO: 567029 - DNA, 13 bp, D. melanogaster
aattcaaagtcaa

SEQ ID NO: 567030 - DNA, 13 bp, D. melanogaster
aattcaaataact

SEQ ID NO: 567031 - DNA, 13 bp, D. melanogaster
aattcaaatccaa

SEQ ID NO: 567032 - DNA, 13 bp, D. melanogaster
aattcaaatctaa

SEQ ID NO: 567033 - DNA, 14 bp, D. melanogaster
aattcaaatgaaat

SEQ ID NO: 567034 - DNA, 13 bp, D. melanogaster
aattcaaatgatt

SEQ ID NO: 567035 - DNA, 13 bp, D. melanogaster
aattcaaatgcaa

SEQ ID NO: 567036 - DNA, 14 bp, D. melanogaster
aattcaaatgcaaa

SEQ ID NO: 567037 - DNA, 13 bp, D. melanogaster
aattcaaatgctt

SEQ ID NO: 567038 - DNA, 13 bp, D. melanogaster
aattcaaatgtgt

SEQ ID NO: 567039 - DNA, 13 bp, D. melanogaster
aattcaaattaga

SEQ ID NO: 567040 - DNA, 13 bp, D. melanogaster
aattcaaattatg

SEQ ID NO: 567041 - DNA, 13 bp, D. melanogaster
aattcaaattcaa

SEQ ID NO: 567042 - DNA, 14 bp, D. melanogaster
aattcaaattcaat

SEQ ID NO: 567043 - DNA, 13 bp, D. melanogaster
aattcaaattgaa

SEQ ID NO: 567044 - DNA, 13 bp, D. melanogaster
aattcaaattgct

SEQ ID NO: 567045 - DNA, 13 bp, D. melanogaster
aattcaaatttct

SEQ ID NO: 567046 - DNA, 13 bp, D. melanogaster
aattcaaatttga

SEQ ID NO: 567047 - DNA, 14 bp, D. melanogaster
aattcaaatttgaa

SEQ ID NO: 567048 - DNA, 13 bp, D. melanogaster
aattcaacaaatt

SEQ ID NO: 567049 - DNA, 13 bp, D. melanogaster
aattcaacaattc

SEQ ID NO: 567050 - DNA, 13 bp, D. melanogaster
aattcaacaattt

SEQ ID NO: 567051 - DNA, 13 bp, D. melanogaster
aattcaacatcac

SEQ ID NO: 567052 - DNA, 13 bp, D. melanogaster
aattcaaccaatt

SEQ ID NO: 567053 - DNA, 13 bp, D. melanogaster
aattcaactaaat

SEQ ID NO: 567054 - DNA, 13 bp, D. melanogaster
aattcaacttatt

SEQ ID NO: 567055 - DNA, 13 bp, D. melanogaster
aattcaacttcaa

SEQ ID NO: 567056 - DNA, 13 bp, D. melanogaster
aattcaacttgaa

SEQ ID NO: 567057 - DNA, 13 bp, D. melanogaster
aattcaactttaa

SEQ ID NO: 567058 - DNA, 13 bp, D. melanogaster
aattcaagaattt

SEQ ID NO: 567059 - DNA, 13 bp, D. melanogaster
aattcaagcaaaa

SEQ ID NO: 567060 - DNA, 13 bp, D. melanogaster
aattcaagccttt

SEQ ID NO: 567061 - DNA, 13 bp, D. melanogaster
aattcaaggaaaa

SEQ ID NO: 567062 - DNA, 13 bp, D. melanogaster
aattcaaggaaat

SEQ ID NO: 567063 - DNA, 13 bp, D. melanogaster
aattcaagtaaat

SEQ ID NO: 567064 - DNA, 13 bp, D. melanogaster
aattcaagttaat

SEQ ID NO: 567065 - DNA, 13 bp, D. melanogaster
aattcaagttatt

SEQ ID NO: 567066 - DNA, 13 bp, D. melanogaster
aattcaagttcgc

SEQ ID NO: 567067 - DNA, 13 bp, D. melanogaster
aattcaagtttat

SEQ ID NO: 567068 - DNA, 13 bp, D. melanogaster
aattcaagtttta

SEQ ID NO: 567069 - DNA, 14 bp, D. melanogaster
aattcaataaaagg

SEQ ID NO: 567070 - DNA, 13 bp, D. melanogaster
aattcaataagtt

SEQ ID NO: 567071 - DNA, 13 bp, D. melanogaster
aattcaatacaat

SEQ ID NO: 567072 - DNA, 13 bp, D. melanogaster
aattcaatagaaa

SEQ ID NO: 567073 - DNA, 13 bp, D. melanogaster
aattcaatatgat

SEQ ID NO: 567074 - DNA, 14 bp, D. melanogaster
aattcaatatgatg

SEQ ID NO: 567075 - DNA, 13 bp, D. melanogaster
aattcaatcaaac

SEQ ID NO: 567076 - DNA, 13 bp, D. melanogaster
aattcaatcaaat

SEQ ID NO: 567077 - DNA, 13 bp, D. melanogaster
aattcaatcaaca

SEQ ID NO: 567078 - DNA, 14 bp, D. melanogaster
aattcaatcaacat

SEQ ID NO: 567079 - DNA, 13 bp, D. melanogaster
aattcaatcaata

SEQ ID NO: 567080 - DNA, 13 bp, D. melanogaster
aattcaatcaatt

SEQ ID NO: 567081 - DNA, 14 bp, D. melanogaster
aattcaatcatgaa

SEQ ID NO: 567082 - DNA, 13 bp, D. melanogaster
aattcaatcgaaa

SEQ ID NO: 567083 - DNA, 13 bp, D. melanogaster
aattcaatcgatt

SEQ ID NO: 567084 - DNA, 13 bp, D. melanogaster
aattcaatgaaat

SEQ ID NO: 567085 - DNA, 14 bp, D. melanogaster
aattcaatgaaatt

SEQ ID NO: 567086 - DNA, 13 bp, D. melanogaster
aattcaatgaatt

SEQ ID NO: 567087 - DNA, 13 bp, D. melanogaster
aattcaatgcaaa

SEQ ID NO: 567088 - DNA, 13 bp, D. melanogaster
aattcaatgccaa

SEQ ID NO: 567089 - DNA, 13 bp, D. melanogaster
aattcaatggaat

SEQ ID NO: 567090 - DNA, 13 bp, D. melanogaster
aattcaatggcaa

SEQ ID NO: 567091 - DNA, 13 bp, D. melanogaster
aattcaattaaag

SEQ ID NO: 567092 - DNA, 14 bp, D. melanogaster
aattcaattaaagt

SEQ ID NO: 567093 - DNA, 14 bp, D. melanogaster
aattcaattaaatg

SEQ ID NO: 567094 - DNA, 13 bp, D. melanogaster
aattcaattaaca

SEQ ID NO: 567095 - DNA, 13 bp, D. melanogaster
aattcaattaact

SEQ ID NO: 567096 - DNA, 13 bp, D. melanogaster
aattcaattaagc

SEQ ID NO: 567097 - DNA, 13 bp, D. melanogaster
aattcaattaagt

SEQ ID NO: 567098 - DNA, 13 bp, D. melanogaster
aattcaattagaa

SEQ ID NO: 567099 - DNA, 13 bp, D. melanogaster
aattcaattagac

SEQ ID NO: 567100 - DNA, 13 bp, D. melanogaster
aattcaattagca

SEQ ID NO: 567101 - DNA, 14 bp, D. melanogaster
aattcaattagttt

SEQ ID NO: 567102 - DNA, 13 bp, D. melanogaster
aattcaattatga

SEQ ID NO: 567103 - DNA, 14 bp, D. melanogaster
aattcaattcaatt

SEQ ID NO: 567104 - DNA, 13 bp, D. melanogaster
aattcaattcgat

SEQ ID NO: 567105 - DNA, 13 bp, D. melanogaster
aattcaattcgca

SEQ ID NO: 567106 - DNA, 14 bp, D. melanogaster
aattcaattgaaat

SEQ ID NO: 567107 - DNA, 13 bp, D. melanogaster
aattcaattgaac

SEQ ID NO: 567108 - DNA, 14 bp, D. melanogaster
aattcaattgaatt

SEQ ID NO: 567109 - DNA, 13 bp, D. melanogaster
aattcaattgata

SEQ ID NO: 567110 - DNA, 13 bp, D. melanogaster
aattcaattgatt

SEQ ID NO: 567111 - DNA, 13 bp, D. melanogaster
aattcaattgctg

SEQ ID NO: 567112 - DNA, 13 bp, D. melanogaster
aattcaattgctt

SEQ ID NO: 567113 - DNA, 13 bp, D. melanogaster
aattcaattggaa

SEQ ID NO: 567114 - DNA, 13 bp, D. melanogaster
aattcaattgttc

SEQ ID NO: 567115 - DNA, 13 bp, D. melanogaster
aattcaatttacg

SEQ ID NO: 567116 - DNA, 14 bp, D. melanogaster
aattcaatttcaat

SEQ ID NO: 567117 - DNA, 13 bp, D. melanogaster
aattcaatttcat

SEQ ID NO: 567118 - DNA, 14 bp, D. melanogaster
aattcaatttcatt

SEQ ID NO: 567119 - DNA, 13 bp, D. melanogaster
aattcaatttcca

SEQ ID NO: 567120 - DNA, 13 bp, D. melanogaster
aattcaatttccg

SEQ ID NO: 567121 - DNA, 14 bp, D. melanogaster
aattcaatttcgtt

SEQ ID NO: 567122 - DNA, 13 bp, D. melanogaster
aattcaatttcta

SEQ ID NO: 567123 - DNA, 13 bp, D. melanogaster
aattcaatttctg

SEQ ID NO: 567124 - DNA, 13 bp, D. melanogaster
aattcaatttgag

SEQ ID NO: 567125 - DNA, 14 bp, D. melanogaster
aattcaatttgaga

SEQ ID NO: 567126 - DNA, 13 bp, D. melanogaster
aattcaatttgca

SEQ ID NO: 567127 - DNA, 14 bp, D. melanogaster
aattcaatttgcat

SEQ ID NO: 567128 - DNA, 13 bp, D. melanogaster
aattcaatttgcc

SEQ ID NO: 567129 - DNA, 13 bp, D. melanogaster
aattcaatttgct

SEQ ID NO: 567130 - DNA, 13 bp, D. melanogaster
aattcaattttca

SEQ ID NO: 567131 - DNA, 14 bp, D. melanogaster
aattcaattttcaa

SEQ ID NO: 567132 - DNA, 13 bp, D. melanogaster
aattcaattttct

SEQ ID NO: 567133 - DNA, 13 bp, D. melanogaster
aattcacaaaatt

SEQ ID NO: 567134 - DNA, 13 bp, D. melanogaster
aattcacaaatat

SEQ ID NO: 567135 - DNA, 13 bp, D. melanogaster
aattcacaaattg

SEQ ID NO: 567136 - DNA, 13 bp, D. melanogaster
aattcacaaattt

SEQ ID NO: 567137 - DNA, 13 bp, D. melanogaster
aattcacaattaa

SEQ ID NO: 567138 - DNA, 13 bp, D. melanogaster
aattcacaattta

SEQ ID NO: 567139 - DNA, 14 bp, D. melanogaster
aattcacaatttaa

SEQ ID NO: 567140 - DNA, 13 bp, D. melanogaster
aattcacaatttt

SEQ ID NO: 567141 - DNA, 14 bp, D. melanogaster
aattcacacaatcg

SEQ ID NO: 567142 - DNA, 13 bp, D. melanogaster
aattcacagaaaa

SEQ ID NO: 567143 - DNA, 13 bp, D. melanogaster
aattcacataatt

SEQ ID NO: 567144 - DNA, 13 bp, D. melanogaster
aattcacatcaaa

SEQ ID NO: 567145 - DNA, 13 bp, D. melanogaster
aattcacattcaa

SEQ ID NO: 567146 - DNA, 13 bp, D. melanogaster
aattcacattttt

SEQ ID NO: 567147 - DNA, 13 bp, D. melanogaster
aattcacccaaaa

SEQ ID NO: 567148 - DNA, 13 bp, D. melanogaster
aattcacgtctta

SEQ ID NO: 567149 - DNA, 13 bp, D. melanogaster
aattcacttaaaa

SEQ ID NO: 567150 - DNA, 13 bp, D. melanogaster
aattcacttaaat

SEQ ID NO: 567151 - DNA, 13 bp, D. melanogaster
aattcacttaact

SEQ ID NO: 567152 - DNA, 13 bp, D. melanogaster
aattcactttcaa

SEQ ID NO: 567153 - DNA, 13 bp, D. melanogaster
aattcactttgaa

SEQ ID NO: 567154 - DNA, 13 bp, D. melanogaster
aattcactttgtt

SEQ ID NO: 567155 - DNA, 13 bp, D. melanogaster
aattcagaaattc

SEQ ID NO: 567156 - DNA, 13 bp, D. melanogaster
aattcagaaattt

SEQ ID NO: 567157 - DNA, 13 bp, D. melanogaster
aattcagaatata

SEQ ID NO: 567158 - DNA, 13 bp, D. melanogaster
aattcagatttaa

SEQ ID NO: 567159 - DNA, 13 bp, D. melanogaster
aattcagattttt

SEQ ID NO: 567160 - DNA, 13 bp, D. melanogaster
aattcagtaattt

SEQ ID NO: 567161 - DNA, 13 bp, D. melanogaster
aattcagttaatt

SEQ ID NO: 567162 - DNA, 13 bp, D. melanogaster
aattcagttcagt

SEQ ID NO: 567163 - DNA, 13 bp, D. melanogaster
aattcagttgccg

SEQ ID NO: 567164 - DNA, 13 bp, D. melanogaster
aattcagtttaaa

SEQ ID NO: 567165 - DNA, 13 bp, D. melanogaster
aattcagtttttc

SEQ ID NO: 567166 - DNA, 13 bp, D. melanogaster
aattcagtttttt

SEQ ID NO: 567167 - DNA, 13 bp, D. melanogaster
aattcataatgaa

SEQ ID NO: 567168 - DNA, 13 bp, D. melanogaster
aattcataattca

SEQ ID NO: 567169 - DNA, 13 bp, D. melanogaster
aattcatacgttt

SEQ ID NO: 567170 - DNA, 13 bp, D. melanogaster
aattcatatgaaa

SEQ ID NO: 567171 - DNA, 13 bp, D. melanogaster
aattcatattcga

SEQ ID NO: 567172 - DNA, 14 bp, D. melanogaster
aattcatattcgat

SEQ ID NO: 567173 - DNA, 13 bp, D. melanogaster
aattcatattgtt

SEQ ID NO: 567174 - DNA, 13 bp, D. melanogaster
aattcatatttct

SEQ ID NO: 567175 - DNA, 13 bp, D. melanogaster
aattcatcaaaat

SEQ ID NO: 567176 - DNA, 13 bp, D. melanogaster
aattcatcaaatt

SEQ ID NO: 567177 - DNA, 13 bp, D. melanogaster
aattcatcaggtg

SEQ ID NO: 567178 - DNA, 13 bp, D. melanogaster
aattcatcatcta

SEQ ID NO: 567179 - DNA, 13 bp, D. melanogaster
aattcatgcaaaa

SEQ ID NO: 567180 - DNA, 13 bp, D. melanogaster
aattcattaaaag

SEQ ID NO: 567181 - DNA, 14 bp, D. melanogaster
aattcattaatttg

SEQ ID NO: 567182 - DNA, 13 bp, D. melanogaster
aattcattacaaa

SEQ ID NO: 567183 - DNA, 13 bp, D. melanogaster
aattcattcataa

SEQ ID NO: 567184 - DNA, 14 bp, D. melanogaster
aattcattcataaa

SEQ ID NO: 567185 - DNA, 13 bp, D. melanogaster
aattcattcatat

SEQ ID NO: 567186 - DNA, 13 bp, D. melanogaster
aattcattcattc

SEQ ID NO: 567187 - DNA, 13 bp, D. melanogaster
aattcattctaat

SEQ ID NO: 567188 - DNA, 13 bp, D. melanogaster
aattcattgaaaa

SEQ ID NO: 567189 - DNA, 13 bp, D. melanogaster
aattcattgaaat

SEQ ID NO: 567190 - DNA, 13 bp, D. melanogaster
aattcattgataa

SEQ ID NO: 567191 - DNA, 13 bp, D. melanogaster
aattcattgattt

SEQ ID NO: 567192 - DNA, 13 bp, D. melanogaster
aattcattgggca

SEQ ID NO: 567193 - DNA, 13 bp, D. melanogaster
aattcattgtttt

SEQ ID NO: 567194 - DNA, 13 bp, D. melanogaster
aattcatttaaca

SEQ ID NO: 567195 - DNA, 13 bp, D. melanogaster
aattcatttaact

SEQ ID NO: 567196 - DNA, 13 bp, D. melanogaster
aattcatttattg

SEQ ID NO: 567197 - DNA, 13 bp, D. melanogaster
aattcatttccaa

SEQ ID NO: 567198 - DNA, 13 bp, D. melanogaster
aattcatttcctt

SEQ ID NO: 567199 - DNA, 13 bp, D. melanogaster
aattcatttcgaa

SEQ ID NO: 567200 - DNA, 13 bp, D. melanogaster
aattcatttgaat

SEQ ID NO: 567201 - DNA, 13 bp, D. melanogaster
aattcatttgatg

SEQ ID NO: 567202 - DNA, 13 bp, D. melanogaster
aattcatttgcat

SEQ ID NO: 567203 - DNA, 13 bp, D. melanogaster
aattcatttgctc

SEQ ID NO: 567204 - DNA, 13 bp, D. melanogaster
aattcatttgctt

SEQ ID NO: 567205 - DNA, 13 bp, D. melanogaster
aattcattttaca

SEQ ID NO: 567206 - DNA, 13 bp, D. melanogaster
aattcattttgtt

SEQ ID NO: 567207 - DNA, 13 bp, D. melanogaster
aattccaaaagaa

SEQ ID NO: 567208 - DNA, 13 bp, D. melanogaster
aattccaaaatat

SEQ ID NO: 567209 - DNA, 13 bp, D. melanogaster
aattccaaaatca

SEQ ID NO: 567210 - DNA, 13 bp, D. melanogaster
aattccaaaatgt

SEQ ID NO: 567211 - DNA, 13 bp, D. melanogaster
aattccaaaattc

SEQ ID NO: 567212 - DNA, 13 bp, D. melanogaster
aattccaaacatt

SEQ ID NO: 567213 - DNA, 13 bp, D. melanogaster
aattccaaaccag

SEQ ID NO: 567214 - DNA, 13 bp, D. melanogaster
aattccaaagaaa

SEQ ID NO: 567215 - DNA, 13 bp, D. melanogaster
aattccaaattca

SEQ ID NO: 567216 - DNA, 13 bp, D. melanogaster
aattccaaattcc

SEQ ID NO: 567217 - DNA, 13 bp, D. melanogaster
aattccaagaaaa

SEQ ID NO: 567218 - DNA, 13 bp, D. melanogaster
aattccaagaaat

SEQ ID NO: 567219 - DNA, 15 bp, D. melanogaster
aattccaagtttaca

SEQ ID NO: 567220 - DNA, 13 bp, D. melanogaster
aattccaataatt

SEQ ID NO: 567221 - DNA, 13 bp, D. melanogaster
aattccaatattt

SEQ ID NO: 567222 - DNA, 13 bp, D. melanogaster
aattccaatcgat

SEQ ID NO: 567223 - DNA, 14 bp, D. melanogaster
aattccaatcgatt

SEQ ID NO: 567224 - DNA, 13 bp, D. melanogaster
aattccaatgcag

SEQ ID NO: 567225 - DNA, 13 bp, D. melanogaster
aattccaattaag

SEQ ID NO: 567226 - DNA, 13 bp, D. melanogaster
aattccaattaat

SEQ ID NO: 567227 - DNA, 13 bp, D. melanogaster
aattccaattaca

SEQ ID NO: 567228 - DNA, 13 bp, D. melanogaster
aattccaattatg

SEQ ID NO: 567229 - DNA, 13 bp, D. melanogaster
aattccaattatt

SEQ ID NO: 567230 - DNA, 13 bp, D. melanogaster
aattccaattccc

SEQ ID NO: 567231 - DNA, 14 bp, D. melanogaster
aattccaattccga

SEQ ID NO: 567232 - DNA, 13 bp, D. melanogaster
aattccaattcgg

SEQ ID NO: 567233 - DNA, 14 bp, D. melanogaster
aattccaattcggt

SEQ ID NO: 567234 - DNA, 13 bp, D. melanogaster
aattccaatttaa

SEQ ID NO: 567235 - DNA, 13 bp, D. melanogaster
aattccaatttat

SEQ ID NO: 567236 - DNA, 13 bp, D. melanogaster
aattccaatttca

SEQ ID NO: 567237 - DNA, 13 bp, D. melanogaster
aattccaatttga

SEQ ID NO: 567238 - DNA, 13 bp, D. melanogaster
aattccaattttt

SEQ ID NO: 567239 - DNA, 13 bp, D. melanogaster
aattccacgacca

SEQ ID NO: 567240 - DNA, 13 bp, D. melanogaster
aattccactttaa

SEQ ID NO: 567241 - DNA, 13 bp, D. melanogaster
aattccagcaatt

SEQ ID NO: 567242 - DNA, 13 bp, D. melanogaster
aattccaggaaaa

SEQ ID NO: 567243 - DNA, 13 bp, D. melanogaster
aattccatataaa

SEQ ID NO: 567244 - DNA, 13 bp, D. melanogaster
aattccattaaaa

SEQ ID NO: 567245 - DNA, 13 bp, D. melanogaster
aattccattacaa

SEQ ID NO: 567246 - DNA, 13 bp, D. melanogaster
aattccattagta

SEQ ID NO: 567247 - DNA, 13 bp, D. melanogaster
aattccattataa

SEQ ID NO: 567248 - DNA, 13 bp, D. melanogaster
aattccattatgt

SEQ ID NO: 567249 - DNA, 13 bp, D. melanogaster
aattccattccat

SEQ ID NO: 567250 - DNA, 14 bp, D. melanogaster
aattccattccatt

SEQ ID NO: 567251 - DNA, 13 bp, D. melanogaster
aattccattcgaa

SEQ ID NO: 567252 - DNA, 13 bp, D. melanogaster
aattccattgcaa

SEQ ID NO: 567253 - DNA, 13 bp, D. melanogaster
aattccatttaat

SEQ ID NO: 567254 - DNA, 14 bp, D. melanogaster
aattccatttaatt

SEQ ID NO: 567255 - DNA, 14 bp, D. melanogaster
aattccatttcaaa

SEQ ID NO: 567256 - DNA, 13 bp, D. melanogaster
aattccatttcat

SEQ ID NO: 567257 - DNA, 13 bp, D. melanogaster
aattccatttcca

SEQ ID NO: 567258 - DNA, 13 bp, D. melanogaster
aattccatttcgc

SEQ ID NO: 567259 - DNA, 13 bp, D. melanogaster
aattccatttgat

SEQ ID NO: 567260 - DNA, 13 bp, D. melanogaster
aattccatttgca

SEQ ID NO: 567261 - DNA, 13 bp, D. melanogaster
aattccattttat

SEQ ID NO: 567262 - DNA, 13 bp, D. melanogaster
aattcccaaactt

SEQ ID NO: 567263 - DNA, 14 bp, D. melanogaster
aattcccaaatttg

SEQ ID NO: 567264 - DNA, 13 bp, D. melanogaster
aattcccaacaaa

SEQ ID NO: 567265 - DNA, 13 bp, D. melanogaster
aattcccaatcga

SEQ ID NO: 567266 - DNA, 13 bp, D. melanogaster
aattcccaatttc

SEQ ID NO: 567267 - DNA, 13 bp, D. melanogaster
aattcccactccc

SEQ ID NO: 567268 - DNA, 13 bp, D. melanogaster
aattcccacttcc

SEQ ID NO: 567269 - DNA, 14 bp, D. melanogaster
aattcccagaatat

SEQ ID NO: 567270 - DNA, 13 bp, D. melanogaster
aattcccagcaaa

SEQ ID NO: 567271 - DNA, 13 bp, D. melanogaster
aattcccataaaa

SEQ ID NO: 567272 - DNA, 13 bp, D. melanogaster
aattccccatcga

SEQ ID NO: 567273 - DNA, 13 bp, D. melanogaster
aattccccatgaa

SEQ ID NO: 567274 - DNA, 13 bp, D. melanogaster
aattcccccaaaa

SEQ ID NO: 567275 - DNA, 13 bp, D. melanogaster
aattccccttttt

SEQ ID NO: 567276 - DNA, 13 bp, D. melanogaster
aattccctatcga

SEQ ID NO: 567277 - DNA, 13 bp, D. melanogaster
aattccctggaaa

SEQ ID NO: 567278 - DNA, 13 bp, D. melanogaster
aattccctgtttt

SEQ ID NO: 567279 - DNA, 13 bp, D. melanogaster
aattccctttaaa

SEQ ID NO: 567280 - DNA, 13 bp, D. melanogaster
aattccgaaaaaa

SEQ ID NO: 567281 - DNA, 13 bp, D. melanogaster
aattccgattcca

SEQ ID NO: 567282 - DNA, 13 bp, D. melanogaster
aattccggaaaat

SEQ ID NO: 567283 - DNA, 13 bp, D. melanogaster
aattccgtttaat

SEQ ID NO: 567284 - DNA, 13 bp, D. melanogaster
aattcctaaattt

SEQ ID NO: 567285 - DNA, 13 bp, D. melanogaster
aattcctattaaa

SEQ ID NO: 567286 - DNA, 13 bp, D. melanogaster
aattcctcaaaat

SEQ ID NO: 567287 - DNA, 15 bp, D. melanogaster
aattcctcaaaatgt

SEQ ID NO: 567288 - DNA, 13 bp, D. melanogaster
aattcctggattt

SEQ ID NO: 567289 - DNA, 13 bp, D. melanogaster
aattcctggttgg

SEQ ID NO: 567290 - DNA, 13 bp, D. melanogaster
aattcctgtaaac

SEQ ID NO: 567291 - DNA, 13 bp, D. melanogaster
aattcctgtctgt

SEQ ID NO: 567292 - DNA, 13 bp, D. melanogaster
aattccttaagaa

SEQ ID NO: 567293 - DNA, 14 bp, D. melanogaster
aattccttatcggc

SEQ ID NO: 567294 - DNA, 13 bp, D. melanogaster
aattccttgaaaa

SEQ ID NO: 567295 - DNA, 13 bp, D. melanogaster
aattccttggcca

SEQ ID NO: 567296 - DNA, 13 bp, D. melanogaster
aattcctttaaat

SEQ ID NO: 567297 - DNA, 13 bp, D. melanogaster
aattcctttctta

SEQ ID NO: 567298 - DNA, 13 bp, D. melanogaster
aattccttttaaa

SEQ ID NO: 567299 - DNA, 13 bp, D. melanogaster
aattccttttcaa

SEQ ID NO: 567300 - DNA, 13 bp, D. melanogaster
aattcgaaaagcg

SEQ ID NO: 567301 - DNA, 13 bp, D. melanogaster
aattcgaaaataa

SEQ ID NO: 567302 - DNA, 13 bp, D. melanogaster
aattcgaaaatgt

SEQ ID NO: 567303 - DNA, 13 bp, D. melanogaster
aattcgaaacaat

SEQ ID NO: 567304 - DNA, 13 bp, D. melanogaster
aattcgaaagaaa

SEQ ID NO: 567305 - DNA, 13 bp, D. melanogaster
aattcgaaaggag

SEQ ID NO: 567306 - DNA, 13 bp, D. melanogaster
aattcgaaatcca

SEQ ID NO: 567307 - DNA, 13 bp, D. melanogaster
aattcgaaatgaa

SEQ ID NO: 567308 - DNA, 13 bp, D. melanogaster
aattcgaaatgca

SEQ ID NO: 567309 - DNA, 13 bp, D. melanogaster
aattcgaaatgtt

SEQ ID NO: 567310 - DNA, 14 bp, D. melanogaster
aattcgaaattatt

SEQ ID NO: 567311 - DNA, 13 bp, D. melanogaster
aattcgaagaaat

SEQ ID NO: 567312 - DNA, 13 bp, D. melanogaster
aattcgaagattt

SEQ ID NO: 567313 - DNA, 14 bp, D. melanogaster
aattcgaagatttg

SEQ ID NO: 567314 - DNA, 13 bp, D. melanogaster
aattcgaataaaa

SEQ ID NO: 567315 - DNA, 13 bp, D. melanogaster
aattcgaatattc

SEQ ID NO: 567316 - DNA, 13 bp, D. melanogaster
aattcgaatccaa

SEQ ID NO: 567317 - DNA, 13 bp, D. melanogaster
aattcgaatcgaa

SEQ ID NO: 567318 - DNA, 13 bp, D. melanogaster
aattcgaatgaaa

SEQ ID NO: 567319 - DNA, 13 bp, D. melanogaster
aattcgaatgcaa

SEQ ID NO: 567320 - DNA, 13 bp, D. melanogaster
aattcgaattcaa

SEQ ID NO: 567321 - DNA, 13 bp, D. melanogaster
aattcgaattgga

SEQ ID NO: 567322 - DNA, 14 bp, D. melanogaster
aattcgaatttaaa

SEQ ID NO: 567323 - DNA, 13 bp, D. melanogaster
aattcgaatttga

SEQ ID NO: 567324 - DNA, 13 bp, D. melanogaster
aattcgaatttgt

SEQ ID NO: 567325 - DNA, 13 bp, D. melanogaster
aattcgacgaaag

SEQ ID NO: 567326 - DNA, 14 bp, D. melanogaster
aattcgacttcttc

SEQ ID NO: 567327 - DNA, 13 bp, D. melanogaster
aattcgattaaaa

SEQ ID NO: 567328 - DNA, 13 bp, D. melanogaster
aattcgattaaat

SEQ ID NO: 567329 - DNA, 13 bp, D. melanogaster
aattcgattataa

SEQ ID NO: 567330 - DNA, 13 bp, D. melanogaster
aattcgattatat

SEQ ID NO: 567331 - DNA, 13 bp, D. melanogaster
aattcgattcaat

SEQ ID NO: 567332 - DNA, 13 bp, D. melanogaster
aattcgattccca

SEQ ID NO: 567333 - DNA, 13 bp, D. melanogaster
aattcgattcgaa

SEQ ID NO: 567334 - DNA, 13 bp, D. melanogaster
aattcgattggaa

SEQ ID NO: 567335 - DNA, 13 bp, D. melanogaster
aattcgatttaaa

SEQ ID NO: 567336 - DNA, 13 bp, D. melanogaster
aattcgatttaat

SEQ ID NO: 567337 - DNA, 14 bp, D. melanogaster
aattcgatttaatt

SEQ ID NO: 567338 - DNA, 13 bp, D. melanogaster
aattcgatttcaa

SEQ ID NO: 567339 - DNA, 13 bp, D. melanogaster
aattcgatttcat

SEQ ID NO: 567340 - DNA, 13 bp, D. melanogaster
aattcgatttcca

SEQ ID NO: 567341 - DNA, 13 bp, D. melanogaster
aattcgatttgca

SEQ ID NO: 567342 - DNA, 13 bp, D. melanogaster
aattcgatttggt

SEQ ID NO: 567343 - DNA, 14 bp, D. melanogaster
aattcgattttaat

SEQ ID NO: 567344 - DNA, 14 bp, D. melanogaster
aattcgattttgat

SEQ ID NO: 567345 - DNA, 13 bp, D. melanogaster
aattcgatttttc

SEQ ID NO: 567346 - DNA, 13 bp, D. melanogaster
aattcgcaaaaaa

SEQ ID NO: 567347 - DNA, 14 bp, D. melanogaster
aattcgcaaaaaat

SEQ ID NO: 567348 - DNA, 13 bp, D. melanogaster
aattcgcataatt

SEQ ID NO: 567349 - DNA, 13 bp, D. melanogaster
aattcgcatgcaa

SEQ ID NO: 567350 - DNA, 13 bp, D. melanogaster
aattcgcattaat

SEQ ID NO: 567351 - DNA, 13 bp, D. melanogaster
aattcgcatttaa

SEQ ID NO: 567352 - DNA, 13 bp, D. melanogaster
aattcgctcgaaa

SEQ ID NO: 567353 - DNA, 13 bp, D. melanogaster
aattcgctggaaa

SEQ ID NO: 567354 - DNA, 13 bp, D. melanogaster
aattcgctttaat

SEQ ID NO: 567355 - DNA, 13 bp, D. melanogaster
aattcgctttgtt

SEQ ID NO: 567356 - DNA, 13 bp, D. melanogaster
aattcggaaaaac

SEQ ID NO: 567357 - DNA, 13 bp, D. melanogaster
aattcgggcttga

SEQ ID NO: 567358 - DNA, 13 bp, D. melanogaster
aattcgtaaatat

SEQ ID NO: 567359 - DNA, 13 bp, D. melanogaster
aattcgtaacaaa

SEQ ID NO: 567360 - DNA, 13 bp, D. melanogaster
aattcgtatattt

SEQ ID NO: 567361 - DNA, 13 bp, D. melanogaster
aattcgtgatcgt

SEQ ID NO: 567362 - DNA, 13 bp, D. melanogaster
aattcgttaattt

SEQ ID NO: 567363 - DNA, 14 bp, D. melanogaster
aattcgttattact

SEQ ID NO: 567364 - DNA, 13 bp, D. melanogaster
aattcgttatttt

SEQ ID NO: 567365 - DNA, 13 bp, D. melanogaster
aattcgtttcaat

SEQ ID NO: 567366 - DNA, 13 bp, D. melanogaster
aattcgtttcatt

SEQ ID NO: 567367 - DNA, 13 bp, D. melanogaster
aattcgtttctaa

SEQ ID NO: 567368 - DNA, 13 bp, D. melanogaster
aattcgtttcttc

SEQ ID NO: 567369 - DNA, 13 bp, D. melanogaster
aattcgttttaaa

SEQ ID NO: 567370 - DNA, 13 bp, D. melanogaster
aattcgttttaat

SEQ ID NO: 567371 - DNA, 13 bp, D. melanogaster
aattcgttttatg

SEQ ID NO: 567372 - DNA, 13 bp, D. melanogaster
aattcgttttatt

SEQ ID NO: 567373 - DNA, 13 bp, D. melanogaster
aattcgttttcaa

SEQ ID NO: 567374 - DNA, 13 bp, D. melanogaster
aattcgtttttat

SEQ ID NO: 567375 - DNA, 13 bp, D. melanogaster
aattctaaaatag

SEQ ID NO: 567376 - DNA, 13 bp, D. melanogaster
aattctaaacagc

SEQ ID NO: 567377 - DNA, 13 bp, D. melanogaster
aattctaaatttc

SEQ ID NO: 567378 - DNA, 13 bp, D. melanogaster
aattctaacattt

SEQ ID NO: 567379 - DNA, 14 bp, D. melanogaster
aattctaaccagaa

SEQ ID NO: 567380 - DNA, 14 bp, D. melanogaster
aattctaattctaa

SEQ ID NO: 567381 - DNA, 13 bp, D. melanogaster
aattctatattgt

SEQ ID NO: 567382 - DNA, 13 bp, D. melanogaster
aattctatgaaaa

SEQ ID NO: 567383 - DNA, 13 bp, D. melanogaster
aattctatggaag

SEQ ID NO: 567384 - DNA, 13 bp, D. melanogaster
aattctattcaaa

SEQ ID NO: 567385 - DNA, 13 bp, D. melanogaster
aattctattcaat

SEQ ID NO: 567386 - DNA, 14 bp, D. melanogaster
aattctattgtctt

SEQ ID NO: 567387 - DNA, 13 bp, D. melanogaster
aattctattgttt

SEQ ID NO: 567388 - DNA, 14 bp, D. melanogaster
aattctatttttag

SEQ ID NO: 567389 - DNA, 13 bp, D. melanogaster
aattctcaagaat

SEQ ID NO: 567390 - DNA, 14 bp, D. melanogaster
aattctcaagaatc

SEQ ID NO: 567391 - DNA, 13 bp, D. melanogaster
aattctcatattt

SEQ ID NO: 567392 - DNA, 14 bp, D. melanogaster
aattctccgaaaaa

SEQ ID NO: 567393 - DNA, 13 bp, D. melanogaster
aattctcctggct

SEQ ID NO: 567394 - DNA, 14 bp, D. melanogaster
aattctgaactaaa

SEQ ID NO: 567395 - DNA, 13 bp, D. melanogaster
aattctgataaaa

SEQ ID NO: 567396 - DNA, 13 bp, D. melanogaster
aattctgcaatat

SEQ ID NO: 567397 - DNA, 13 bp, D. melanogaster
aattctgccagag

SEQ ID NO: 567398 - DNA, 13 bp, D. melanogaster
aattctggaaaag

SEQ ID NO: 567399 - DNA, 14 bp, D. melanogaster
aattctggaaaaga

SEQ ID NO: 567400 - DNA, 13 bp, D. melanogaster
aattctggcactg

SEQ ID NO: 567401 - DNA, 13 bp, D. melanogaster
aattctggttata

SEQ ID NO: 567402 - DNA, 13 bp, D. melanogaster
aattctgtcgagc

SEQ ID NO: 567403 - DNA, 13 bp, D. melanogaster
aattctgttttaa

SEQ ID NO: 567404 - DNA, 13 bp, D. melanogaster
aattcttaaaacc

SEQ ID NO: 567405 - DNA, 13 bp, D. melanogaster
aattcttaagaaa

SEQ ID NO: 567406 - DNA, 13 bp, D. melanogaster
aattcttcaaaaa

SEQ ID NO: 567407 - DNA, 13 bp, D. melanogaster
aattcttcgaaaa

SEQ ID NO: 567408 - DNA, 13 bp, D. melanogaster
aattcttcggaaa

SEQ ID NO: 567409 - DNA, 13 bp, D. melanogaster
aattcttgattta

SEQ ID NO: 567410 - DNA, 13 bp, D. melanogaster
aattctttatgat

SEQ ID NO: 567411 - DNA, 13 bp, D. melanogaster
aattctttcaaaa

SEQ ID NO: 567412 - DNA, 13 bp, D. melanogaster
aattctttcaata

SEQ ID NO: 567413 - DNA, 13 bp, D. melanogaster
aattctttgatac

SEQ ID NO: 567414 - DNA, 13 bp, D. melanogaster
aattctttgcgaa

SEQ ID NO: 567415 - DNA, 13 bp, D. melanogaster
aattctttgtaaa

SEQ ID NO: 567416 - DNA, 13 bp, D. melanogaster
aattctttgtaca

SEQ ID NO: 567417 - DNA, 13 bp, D. melanogaster
aattcttttgatt

SEQ ID NO: 567418 - DNA, 13 bp, D. melanogaster
aattctttttcga

SEQ ID NO: 567419 - DNA, 13 bp, D. melanogaster
aattctttttgct

SEQ ID NO: 567420 - DNA, 14 bp, D. melanogaster
aattgaaaaacaat

SEQ ID NO: 567421 - DNA, 13 bp, D. melanogaster
aattgaaaaacac

SEQ ID NO: 567422 - DNA, 14 bp, D. melanogaster
aattgaaaaacttt

SEQ ID NO: 567423 - DNA, 14 bp, D. melanogaster
aattgaaaaagaac

SEQ ID NO: 567424 - DNA, 13 bp, D. melanogaster
aattgaaaaatca

SEQ ID NO: 567425 - DNA, 14 bp, D. melanogaster
aattgaaaaatcaa

SEQ ID NO: 567426 - DNA, 13 bp, D. melanogaster
aattgaaaaatcc

SEQ ID NO: 567427 - DNA, 13 bp, D. melanogaster
aattgaaaaatgt

SEQ ID NO: 567428 - DNA, 14 bp, D. melanogaster
aattgaaaaattac

SEQ ID NO: 567429 - DNA, 13 bp, D. melanogaster
aattgaaaaattc

SEQ ID NO: 567430 - DNA, 14 bp, D. melanogaster
aattgaaaacaaat

SEQ ID NO: 567431 - DNA, 14 bp, D. melanogaster
aattgaaaacaatt

SEQ ID NO: 567432 - DNA, 13 bp, D. melanogaster
aattgaaaacaca

SEQ ID NO: 567433 - DNA, 13 bp, D. melanogaster
aattgaaaacaga

SEQ ID NO: 567434 - DNA, 13 bp, D. melanogaster
aattgaaaacatt

SEQ ID NO: 567435 - DNA, 13 bp, D. melanogaster
aattgaaaaccat

SEQ ID NO: 567436 - DNA, 14 bp, D. melanogaster
aattgaaaacgaaa

SEQ ID NO: 567437 - DNA, 13 bp, D. melanogaster
aattgaaaactaa

SEQ ID NO: 567438 - DNA, 14 bp, D. melanogaster
aattgaaaactaaa

SEQ ID NO: 567439 - DNA, 13 bp, D. melanogaster
aattgaaaactga

SEQ ID NO: 567440 - DNA, 13 bp, D. melanogaster
aattgaaaacttc

SEQ ID NO: 567441 - DNA, 13 bp, D. melanogaster
aattgaaaacttt

SEQ ID NO: 567442 - DNA, 13 bp, D. melanogaster
aattgaaaagcaa

SEQ ID NO: 567443 - DNA, 13 bp, D. melanogaster
aattgaaaagcac

SEQ ID NO: 567444 - DNA, 14 bp, D. melanogaster
aattgaaaagcatt

SEQ ID NO: 567445 - DNA, 13 bp, D. melanogaster
aattgaaaagtgc

SEQ ID NO: 567446 - DNA, 13 bp, D. melanogaster
aattgaaaagttc

SEQ ID NO: 567447 - DNA, 13 bp, D. melanogaster
aattgaaaagttt

SEQ ID NO: 567448 - DNA, 14 bp, D. melanogaster
aattgaaaagtttt

SEQ ID NO: 567449 - DNA, 13 bp, D. melanogaster
aattgaaaatacc

SEQ ID NO: 567450 - DNA, 13 bp, D. melanogaster
aattgaaaatcat

SEQ ID NO: 567451 - DNA, 14 bp, D. melanogaster
aattgaaaatcgaa

SEQ ID NO: 567452 - DNA, 14 bp, D. melanogaster
aattgaaaatctga

SEQ ID NO: 567453 - DNA, 13 bp, D. melanogaster
aattgaaaatctt

SEQ ID NO: 567454 - DNA, 13 bp, D. melanogaster
aattgaaaatgat

SEQ ID NO: 567455 - DNA, 13 bp, D. melanogaster
aattgaaaatgca

SEQ ID NO: 567456 - DNA, 14 bp, D. melanogaster
aattgaaaatgcaa

SEQ ID NO: 567457 - DNA, 13 bp, D. melanogaster
aattgaaaatgcc

SEQ ID NO: 567458 - DNA, 14 bp, D. melanogaster
aattgaaaatggaa

SEQ ID NO: 567459 - DNA, 13 bp, D. melanogaster
aattgaaaatgtg

SEQ ID NO: 567460 - DNA, 14 bp, D. melanogaster
aattgaaaatgttt

SEQ ID NO: 567461 - DNA, 13 bp, D. melanogaster
aattgaaaattcc

SEQ ID NO: 567462 - DNA, 14 bp, D. melanogaster
aattgaaaattgca

SEQ ID NO: 567463 - DNA, 13 bp, D. melanogaster
aattgaaaatttg

SEQ ID NO: 567464 - DNA, 13 bp, D. melanogaster
aattgaaacaaag

SEQ ID NO: 567465 - DNA, 13 bp, D. melanogaster
aattgaaacaatt

SEQ ID NO: 567466 - DNA, 13 bp, D. melanogaster
aattgaaacagaa

SEQ ID NO: 567467 - DNA, 13 bp, D. melanogaster
aattgaaaccaaa

SEQ ID NO: 567468 - DNA, 14 bp, D. melanogaster
aattgaaaccgaaa

SEQ ID NO: 567469 - DNA, 13 bp, D. melanogaster
aattgaaacgaaa

SEQ ID NO: 567470 - DNA, 14 bp, D. melanogaster
aattgaaacgaaat

SEQ ID NO: 567471 - DNA, 13 bp, D. melanogaster
aattgaaacggaa

SEQ ID NO: 567472 - DNA, 13 bp, D. melanogaster
aattgaaactaaa

SEQ ID NO: 567473 - DNA, 14 bp, D. melanogaster
aattgaaactaatt

SEQ ID NO: 567474 - DNA, 13 bp, D. melanogaster
aattgaaactatt

SEQ ID NO: 567475 - DNA, 13 bp, D. melanogaster
aattgaaactgaa

SEQ ID NO: 567476 - DNA, 14 bp, D. melanogaster
aattgaaactgaaa

SEQ ID NO: 567477 - DNA, 13 bp, D. melanogaster
aattgaaactgat

SEQ ID NO: 567478 - DNA, 13 bp, D. melanogaster
aattgaaactttg

SEQ ID NO: 567479 - DNA, 13 bp, D. melanogaster
aattgaaagattt

SEQ ID NO: 567480 - DNA, 13 bp, D. melanogaster
aattgaaagcaaa

SEQ ID NO: 567481 - DNA, 14 bp, D. melanogaster
aattgaaagcaaaa

SEQ ID NO: 567482 - DNA, 13 bp, D. melanogaster
aattgaaagcaca

SEQ ID NO: 567483 - DNA, 13 bp, D. melanogaster
aattgaaagcatt

SEQ ID NO: 567484 - DNA, 14 bp, D. melanogaster
aattgaaagcattt

SEQ ID NO: 567485 - DNA, 13 bp, D. melanogaster
aattgaaagccaa

SEQ ID NO: 567486 - DNA, 14 bp, D. melanogaster
aattgaaagccaaa

SEQ ID NO: 567487 - DNA, 13 bp, D. melanogaster
aattgaaagccat

SEQ ID NO: 567488 - DNA, 13 bp, D. melanogaster
aattgaaagcgaa

SEQ ID NO: 567489 - DNA, 13 bp, D. melanogaster
aattgaaagggaa

SEQ ID NO: 567490 - DNA, 13 bp, D. melanogaster
aattgaaagtaat

SEQ ID NO: 567491 - DNA, 13 bp, D. melanogaster
aattgaaagtgaa

SEQ ID NO: 567492 - DNA, 14 bp, D. melanogaster
aattgaaagtgaaa

SEQ ID NO: 567493 - DNA, 13 bp, D. melanogaster
aattgaaagtgat

SEQ ID NO: 567494 - DNA, 13 bp, D. melanogaster
aattgaaagttaa

SEQ ID NO: 567495 - DNA, 13 bp, D. melanogaster
aattgaaataaac

SEQ ID NO: 567496 - DNA, 13 bp, D. melanogaster
aattgaaataaca

SEQ ID NO: 567497 - DNA, 14 bp, D. melanogaster
aattgaaatacaat

SEQ ID NO: 567498 - DNA, 14 bp, D. melanogaster
aattgaaatagttt

SEQ ID NO: 567499 - DNA, 14 bp, D. melanogaster
aattgaaatcaaaa

SEQ ID NO: 567500 - DNA, 13 bp, D. melanogaster
aattgaaatcaac

SEQ ID NO: 567501 - DNA, 13 bp, D. melanogaster
aattgaaatcaag

SEQ ID NO: 567502 - DNA, 13 bp, D. melanogaster
aattgaaatcaat

SEQ ID NO: 567503 - DNA, 14 bp, D. melanogaster
aattgaaatcaatt

SEQ ID NO: 567504 - DNA, 13 bp, D. melanogaster
aattgaaatcctt

SEQ ID NO: 567505 - DNA, 13 bp, D. melanogaster
aattgaaatcgaa

SEQ ID NO: 567506 - DNA, 14 bp, D. melanogaster
aattgaaatcgaaa

SEQ ID NO: 567507 - DNA, 13 bp, D. melanogaster
aattgaaatcgat

SEQ ID NO: 567508 - DNA, 13 bp, D. melanogaster
aattgaaatcgca

SEQ ID NO: 567509 - DNA, 14 bp, D. melanogaster
aattgaaatgaatt

SEQ ID NO: 567510 - DNA, 13 bp, D. melanogaster
aattgaaatgaga

SEQ ID NO: 567511 - DNA, 13 bp, D. melanogaster
aattgaaatgcaa

SEQ ID NO: 567512 - DNA, 14 bp, D. melanogaster
aattgaaatgcaaa

SEQ ID NO: 567513 - DNA, 14 bp, D. melanogaster
aattgaaatgcatt

SEQ ID NO: 567514 - DNA, 13 bp, D. melanogaster
aattgaaatgcca

SEQ ID NO: 567515 - DNA, 14 bp, D. melanogaster
aattgaaatgccaa

SEQ ID NO: 567516 - DNA, 13 bp, D. melanogaster
aattgaaatgcga

SEQ ID NO: 567517 - DNA, 13 bp, D. melanogaster
aattgaaatgctg

SEQ ID NO: 567518 - DNA, 13 bp, D. melanogaster
aattgaaatggaa

SEQ ID NO: 567519 - DNA, 13 bp, D. melanogaster
aattgaaatggct

SEQ ID NO: 567520 - DNA, 13 bp, D. melanogaster
aattgaaatggga

SEQ ID NO: 567521 - DNA, 13 bp, D. melanogaster
aattgaaatgggc

SEQ ID NO: 567522 - DNA, 13 bp, D. melanogaster
aattgaaatgtct

SEQ ID NO: 567523 - DNA, 13 bp, D. melanogaster
aattgaaatgtta

SEQ ID NO: 567524 - DNA, 13 bp, D. melanogaster
aattgaaatgttt

SEQ ID NO: 567525 - DNA, 13 bp, D. melanogaster
aattgaaattcaa

SEQ ID NO: 567526 - DNA, 13 bp, D. melanogaster
aattgaaattcat

SEQ ID NO: 567527 - DNA, 13 bp, D. melanogaster
aattgaaattgaa

SEQ ID NO: 567528 - DNA, 13 bp, D. melanogaster
aattgaaattgat

SEQ ID NO: 567529 - DNA, 13 bp, D. melanogaster
aattgaaattgcc

SEQ ID NO: 567530 - DNA, 13 bp, D. melanogaster
aattgaaattgga

SEQ ID NO: 567531 - DNA, 14 bp, D. melanogaster
aattgaaattggaa

SEQ ID NO: 567532 - DNA, 13 bp, D. melanogaster
aattgaaattgta

SEQ ID NO: 567533 - DNA, 13 bp, D. melanogaster
aattgaaattgtt

SEQ ID NO: 567534 - DNA, 13 bp, D. melanogaster
aattgaaatttac

SEQ ID NO: 567535 - DNA, 14 bp, D. melanogaster
aattgaaatttatg

SEQ ID NO: 567536 - DNA, 13 bp, D. melanogaster
aattgaaatttca

SEQ ID NO: 567537 - DNA, 14 bp, D. melanogaster
aattgaaatttcaa

SEQ ID NO: 567538 - DNA, 13 bp, D. melanogaster
aattgaaatttgt

SEQ ID NO: 567539 - DNA, 13 bp, D. melanogaster
aattgaacaaaat

SEQ ID NO: 567540 - DNA, 13 bp, D. melanogaster
aattgaacaattg

SEQ ID NO: 567541 - DNA, 13 bp, D. melanogaster
aattgaacaattt

SEQ ID NO: 567542 - DNA, 14 bp, D. melanogaster
aattgaacaatttt

SEQ ID NO: 567543 - DNA, 13 bp, D. melanogaster
aattgaacataaa

SEQ ID NO: 567544 - DNA, 13 bp, D. melanogaster
aattgaacattct

SEQ ID NO: 567545 - DNA, 13 bp, D. melanogaster
aattgaacatttc

SEQ ID NO: 567546 - DNA, 13 bp, D. melanogaster
aattgaacatttt

SEQ ID NO: 567547 - DNA, 13 bp, D. melanogaster
aattgaaccgaaa

SEQ ID NO: 567548 - DNA, 13 bp, D. melanogaster
aattgaacgaaaa

SEQ ID NO: 567549 - DNA, 13 bp, D. melanogaster
aattgaacgaaat

SEQ ID NO: 567550 - DNA, 13 bp, D. melanogaster
aattgaactattt

SEQ ID NO: 567551 - DNA, 13 bp, D. melanogaster
aattgaactttct

SEQ ID NO: 567552 - DNA, 13 bp, D. melanogaster
aattgaagaattt

SEQ ID NO: 567553 - DNA, 13 bp, D. melanogaster
aattgaagagcaa

SEQ ID NO: 567554 - DNA, 13 bp, D. melanogaster
aattgaagagcag

SEQ ID NO: 567555 - DNA, 13 bp, D. melanogaster
aattgaagcaaaa

SEQ ID NO: 567556 - DNA, 13 bp, D. melanogaster
aattgaagcaatt

SEQ ID NO: 567557 - DNA, 13 bp, D. melanogaster
aattgaagcattt

SEQ ID NO: 567558 - DNA, 13 bp, D. melanogaster
aattgaagcgaat

SEQ ID NO: 567559 - DNA, 13 bp, D. melanogaster
aattgaagctggc

SEQ ID NO: 567560 - DNA, 13 bp, D. melanogaster
aattgaagcttaa

SEQ ID NO: 567561 - DNA, 13 bp, D. melanogaster
aattgaaggcaaa

SEQ ID NO: 567562 - DNA, 13 bp, D. melanogaster
aattgaaggcaat

SEQ ID NO: 567563 - DNA, 13 bp, D. melanogaster
aattgaaggcatt

SEQ ID NO: 567564 - DNA, 13 bp, D. melanogaster
aattgaagtcgaa

SEQ ID NO: 567565 - DNA, 13 bp, D. melanogaster
aattgaagtgaaa

SEQ ID NO: 567566 - DNA, 13 bp, D. melanogaster
aattgaagtgaag

SEQ ID NO: 567567 - DNA, 13 bp, D. melanogaster
aattgaagtgcag

SEQ ID NO: 567568 - DNA, 13 bp, D. melanogaster
aattgaagtgcca

SEQ ID NO: 567569 - DNA, 13 bp, D. melanogaster
aattgaagtggaa

SEQ ID NO: 567570 - DNA, 13 bp, D. melanogaster
aattgaagttcaa

SEQ ID NO: 567571 - DNA, 13 bp, D. melanogaster
aattgaagttgca

SEQ ID NO: 567572 - DNA, 13 bp, D. melanogaster
aattgaagttgtg

SEQ ID NO: 567573 - DNA, 13 bp, D. melanogaster
aattgaagttttt

SEQ ID NO: 567574 - DNA, 14 bp, D. melanogaster
aattgaataaaaac

SEQ ID NO: 567575 - DNA, 13 bp, D. melanogaster
aattgaataaatg

SEQ ID NO: 567576 - DNA, 13 bp, D. melanogaster
aattgaatacatt

SEQ ID NO: 567577 - DNA, 14 bp, D. melanogaster
aattgaatacattt

SEQ ID NO: 567578 - DNA, 13 bp, D. melanogaster
aattgaatattga

SEQ ID NO: 567579 - DNA, 13 bp, D. melanogaster
aattgaatcaatt

SEQ ID NO: 567580 - DNA, 13 bp, D. melanogaster
aattgaatcacaa

SEQ ID NO: 567581 - DNA, 13 bp, D. melanogaster
aattgaatcataa

SEQ ID NO: 567582 - DNA, 13 bp, D. melanogaster
aattgaatccatt

SEQ ID NO: 567583 - DNA, 13 bp, D. melanogaster
aattgaatcgaaa

SEQ ID NO: 567584 - DNA, 13 bp, D. melanogaster
aattgaatcgaat

SEQ ID NO: 567585 - DNA, 13 bp, D. melanogaster
aattgaatcgctt

SEQ ID NO: 567586 - DNA, 13 bp, D. melanogaster
aattgaatctttt

SEQ ID NO: 567587 - DNA, 13 bp, D. melanogaster
aattgaatgagaa

SEQ ID NO: 567588 - DNA, 13 bp, D. melanogaster
aattgaatgattt

SEQ ID NO: 567589 - DNA, 13 bp, D. melanogaster
aattgaatgcaat

SEQ ID NO: 567590 - DNA, 13 bp, D. melanogaster
aattgaatgcact

SEQ ID NO: 567591 - DNA, 13 bp, D. melanogaster
aattgaatgccaa

SEQ ID NO: 567592 - DNA, 13 bp, D. melanogaster
aattgaatgcgaa

SEQ ID NO: 567593 - DNA, 13 bp, D. melanogaster
aattgaatgcttt

SEQ ID NO: 567594 - DNA, 13 bp, D. melanogaster
aattgaatggcaa

SEQ ID NO: 567595 - DNA, 13 bp, D. melanogaster
aattgaatggcag

SEQ ID NO: 567596 - DNA, 13 bp, D. melanogaster
aattgaatgggaa

SEQ ID NO: 567597 - DNA, 13 bp, D. melanogaster
aattgaatgtaaa

SEQ ID NO: 567598 - DNA, 13 bp, D. melanogaster
aattgaatgtcaa

SEQ ID NO: 567599 - DNA, 13 bp, D. melanogaster
aattgaatgtgaa

SEQ ID NO: 567600 - DNA, 13 bp, D. melanogaster
aattgaatgttat

SEQ ID NO: 567601 - DNA, 13 bp, D. melanogaster
aattgaattaaac

SEQ ID NO: 567602 - DNA, 14 bp, D. melanogaster
aattgaattaaatg

SEQ ID NO: 567603 - DNA, 13 bp, D. melanogaster
aattgaattaaca

SEQ ID NO: 567604 - DNA, 13 bp, D. melanogaster
aattgaattagaa

SEQ ID NO: 567605 - DNA, 13 bp, D. melanogaster
aattgaattagtt

SEQ ID NO: 567606 - DNA, 13 bp, D. melanogaster
aattgaattcaaa

SEQ ID NO: 567607 - DNA, 14 bp, D. melanogaster
aattgaattcaaaa

SEQ ID NO: 567608 - DNA, 13 bp, D. melanogaster
aattgaattcaat

SEQ ID NO: 567609 - DNA, 13 bp, D. melanogaster
aattgaattcatt

SEQ ID NO: 567610 - DNA, 14 bp, D. melanogaster
aattgaattcattt

SEQ ID NO: 567611 - DNA, 13 bp, D. melanogaster
aattgaattccca

SEQ ID NO: 567612 - DNA, 13 bp, D. melanogaster
aattgaattcgat

SEQ ID NO: 567613 - DNA, 14 bp, D. melanogaster
aattgaattcgatt

SEQ ID NO: 567614 - DNA, 13 bp, D. melanogaster
aattgaattcgca

SEQ ID NO: 567615 - DNA, 13 bp, D. melanogaster
aattgaattgaaa

SEQ ID NO: 567616 - DNA, 13 bp, D. melanogaster
aattgaattgaag

SEQ ID NO: 567617 - DNA, 13 bp, D. melanogaster
aattgaattgaat

SEQ ID NO: 567618 - DNA, 14 bp, D. melanogaster
aattgaattgaatt

SEQ ID NO: 567619 - DNA, 13 bp, D. melanogaster
aattgaattgaca

SEQ ID NO: 567620 - DNA, 13 bp, D. melanogaster
aattgaattgata

SEQ ID NO: 567621 - DNA, 13 bp, D. melanogaster
aattgaattgatg

SEQ ID NO: 567622 - DNA, 13 bp, D. melanogaster
aattgaattgatt

SEQ ID NO: 567623 - DNA, 13 bp, D. melanogaster
aattgaattgcca

SEQ ID NO: 567624 - DNA, 13 bp, D. melanogaster
aattgaattgtat

SEQ ID NO: 567625 - DNA, 13 bp, D. melanogaster
aattgaatttacg

SEQ ID NO: 567626 - DNA, 13 bp, D. melanogaster
aattgaatttatg

SEQ ID NO: 567627 - DNA, 14 bp, D. melanogaster
aattgaatttattg

SEQ ID NO: 567628 - DNA, 13 bp, D. melanogaster
aattgaatttcac

SEQ ID NO: 567629 - DNA, 13 bp, D. melanogaster
aattgaatttcat

SEQ ID NO: 567630 - DNA, 13 bp, D. melanogaster
aattgaatttcgt

SEQ ID NO: 567631 - DNA, 13 bp, D. melanogaster
aattgaatttctg

SEQ ID NO: 567632 - DNA, 13 bp, D. melanogaster
aattgaatttgaa

SEQ ID NO: 567633 - DNA, 13 bp, D. melanogaster
aattgaatttgat

SEQ ID NO: 567634 - DNA, 14 bp, D. melanogaster
aattgaatttgatt

SEQ ID NO: 567635 - DNA, 13 bp, D. melanogaster
aattgaatttgca

SEQ ID NO: 567636 - DNA, 14 bp, D. melanogaster
aattgaatttgcat

SEQ ID NO: 567637 - DNA, 13 bp, D. melanogaster
aattgaatttgct

SEQ ID NO: 567638 - DNA, 13 bp, D. melanogaster
aattgaatttgta

SEQ ID NO: 567639 - DNA, 14 bp, D. melanogaster
aattgaatttgtaa

SEQ ID NO: 567640 - DNA, 13 bp, D. melanogaster
aattgaatttgtt

SEQ ID NO: 567641 - DNA, 13 bp, D. melanogaster
aattgaattttga

SEQ ID NO: 567642 - DNA, 13 bp, D. melanogaster
aattgaattttgc

SEQ ID NO: 567643 - DNA, 13 bp, D. melanogaster
aattgaatttttc

SEQ ID NO: 567644 - DNA, 14 bp, D. melanogaster
aattgaattttttc

SEQ ID NO: 567645 - DNA, 13 bp, D. melanogaster
aattgacaaaagc

SEQ ID NO: 567646 - DNA, 13 bp, D. melanogaster
aattgacaaaata

SEQ ID NO: 567647 - DNA, 13 bp, D. melanogaster
aattgacaaaatg

SEQ ID NO: 567648 - DNA, 13 bp, D. melanogaster
aattgacaaacaa

SEQ ID NO: 567649 - DNA, 13 bp, D. melanogaster
aattgacaatata

SEQ ID NO: 567650 - DNA, 13 bp, D. melanogaster
aattgacattaat

SEQ ID NO: 567651 - DNA, 13 bp, D. melanogaster
aattgacatttga

SEQ ID NO: 567652 - DNA, 13 bp, D. melanogaster
aattgaccaattc

SEQ ID NO: 567653 - DNA, 13 bp, D. melanogaster
aattgacttaaat

SEQ ID NO: 567654 - DNA, 13 bp, D. melanogaster
aattgacttgatt

SEQ ID NO: 567655 - DNA, 13 bp, D. melanogaster
aattgactttaat

SEQ ID NO: 567656 - DNA, 13 bp, D. melanogaster
aattgactttatt

SEQ ID NO: 567657 - DNA, 13 bp, D. melanogaster
aattgacttttaa

SEQ ID NO: 567658 - DNA, 13 bp, D. melanogaster
aattgacttttta

SEQ ID NO: 567659 - DNA, 13 bp, D. melanogaster
aattgagaaaaca

SEQ ID NO: 567660 - DNA, 13 bp, D. melanogaster
aattgagaaattg

SEQ ID NO: 567661 - DNA, 13 bp, D. melanogaster
aattgagaacacg

SEQ ID NO: 567662 - DNA, 13 bp, D. melanogaster
aattgagaacatg

SEQ ID NO: 567663 - DNA, 13 bp, D. melanogaster
aattgagaattga

SEQ ID NO: 567664 - DNA, 13 bp, D. melanogaster
aattgagaattta

SEQ ID NO: 567665 - DNA, 13 bp, D. melanogaster
aattgagattaat

SEQ ID NO: 567666 - DNA, 13 bp, D. melanogaster
aattgagatttat

SEQ ID NO: 567667 - DNA, 13 bp, D. melanogaster
aattgagcaaaaa

SEQ ID NO: 567668 - DNA, 14 bp, D. melanogaster
aattgagcaaaaaa

SEQ ID NO: 567669 - DNA, 13 bp, D. melanogaster
aattgagcaaatt

SEQ ID NO: 567670 - DNA, 13 bp, D. melanogaster
aattgagcaattg

SEQ ID NO: 567671 - DNA, 13 bp, D. melanogaster
aattgagcaattt

SEQ ID NO: 567672 - DNA, 13 bp, D. melanogaster
aattgaggaaaat

SEQ ID NO: 567673 - DNA, 14 bp, D. melanogaster
aattgaggctctga

SEQ ID NO: 567674 - DNA, 13 bp, D. melanogaster
aattgagtaaata

SEQ ID NO: 567675 - DNA, 13 bp, D. melanogaster
aattgagtaattt

SEQ ID NO: 567676 - DNA, 13 bp, D. melanogaster
aattgagtgcaga

SEQ ID NO: 567677 - DNA, 14 bp, D. melanogaster
aattgagtgcagaa

SEQ ID NO: 567678 - DNA, 13 bp, D. melanogaster
aattgagtggaaa

SEQ ID NO: 567679 - DNA, 13 bp, D. melanogaster
aattgagttaatt

SEQ ID NO: 567680 - DNA, 13 bp, D. melanogaster
aattgagttgaaa

SEQ ID NO: 567681 - DNA, 13 bp, D. melanogaster
aattgagtttaaa

SEQ ID NO: 567682 - DNA, 13 bp, D. melanogaster
aattgagtttcaa

SEQ ID NO: 567683 - DNA, 13 bp, D. melanogaster
aattgagtttgca

SEQ ID NO: 567684 - DNA, 13 bp, D. melanogaster
aattgagttttaa

SEQ ID NO: 567685 - DNA, 13 bp, D. melanogaster
aattgagttttca

SEQ ID NO: 567686 - DNA, 13 bp, D. melanogaster
aattgagttttct

SEQ ID NO: 567687 - DNA, 13 bp, D. melanogaster
aattgagttttga

SEQ ID NO: 567688 - DNA, 13 bp, D. melanogaster
aattgagttttgt

SEQ ID NO: 567689 - DNA, 13 bp, D. melanogaster
aattgataaaagc

SEQ ID NO: 567690 - DNA, 13 bp, D. melanogaster
aattgataaatga

SEQ ID NO: 567691 - DNA, 13 bp, D. melanogaster
aattgataaattc

SEQ ID NO: 567692 - DNA, 13 bp, D. melanogaster
aattgataacaat

SEQ ID NO: 567693 - DNA, 13 bp, D. melanogaster
aattgataagcaa

SEQ ID NO: 567694 - DNA, 13 bp, D. melanogaster
aattgataatgaa

SEQ ID NO: 567695 - DNA, 13 bp, D. melanogaster
aattgatagaaat

SEQ ID NO: 567696 - DNA, 13 bp, D. melanogaster
aattgatattcaa

SEQ ID NO: 567697 - DNA, 13 bp, D. melanogaster
aattgatattgat

SEQ ID NO: 567698 - DNA, 13 bp, D. melanogaster
aattgatatttac

SEQ ID NO: 567699 - DNA, 13 bp, D. melanogaster
aattgatcaagaa

SEQ ID NO: 567700 - DNA, 13 bp, D. melanogaster
aattgatcattag

SEQ ID NO: 567701 - DNA, 13 bp, D. melanogaster
aattgatgaaatt

SEQ ID NO: 567702 - DNA, 13 bp, D. melanogaster
aattgatgaatag

SEQ ID NO: 567703 - DNA, 14 bp, D. melanogaster
aattgatgaatagg

SEQ ID NO: 567704 - DNA, 13 bp, D. melanogaster
aattgatgatttt

SEQ ID NO: 567705 - DNA, 13 bp, D. melanogaster
aattgatggcaaa

SEQ ID NO: 567706 - DNA, 13 bp, D. melanogaster
aattgatggccaa

SEQ ID NO: 567707 - DNA, 13 bp, D. melanogaster
aattgatggtgta

SEQ ID NO: 567708 - DNA, 14 bp, D. melanogaster
aattgatggtgtat

SEQ ID NO: 567709 - DNA, 13 bp, D. melanogaster
aattgatgtattt

SEQ ID NO: 567710 - DNA, 14 bp, D. melanogaster
aattgattaaaaca

SEQ ID NO: 567711 - DNA, 13 bp, D. melanogaster
aattgattaattc

SEQ ID NO: 567712 - DNA, 13 bp, D. melanogaster
aattgattacatt

SEQ ID NO: 567713 - DNA, 13 bp, D. melanogaster
aattgattagttc

SEQ ID NO: 567714 - DNA, 13 bp, D. melanogaster
aattgattataga

SEQ ID NO: 567715 - DNA, 13 bp, D. melanogaster
aattgattatttg

SEQ ID NO: 567716 - DNA, 13 bp, D. melanogaster
aattgattcaatt

SEQ ID NO: 567717 - DNA, 13 bp, D. melanogaster
aattgattcattt

SEQ ID NO: 567718 - DNA, 13 bp, D. melanogaster
aattgattgaaat

SEQ ID NO: 567719 - DNA, 14 bp, D. melanogaster
aattgattgaaatg

SEQ ID NO: 567720 - DNA, 13 bp, D. melanogaster
aattgattgaatt

SEQ ID NO: 567721 - DNA, 13 bp, D. melanogaster
aattgattgagat

SEQ ID NO: 567722 - DNA, 13 bp, D. melanogaster
aattgattgatat

SEQ ID NO: 567723 - DNA, 13 bp, D. melanogaster
aattgattgattt

SEQ ID NO: 567724 - DNA, 13 bp, D. melanogaster
aattgattgcata

SEQ ID NO: 567725 - DNA, 13 bp, D. melanogaster
aattgattgccaa

SEQ ID NO: 567726 - DNA, 13 bp, D. melanogaster
aattgattgcttt

SEQ ID NO: 567727 - DNA, 13 bp, D. melanogaster
aattgattggaaa

SEQ ID NO: 567728 - DNA, 13 bp, D. melanogaster
aattgattggcca

SEQ ID NO: 567729 - DNA, 13 bp, D. melanogaster
aattgattgttgt

SEQ ID NO: 567730 - DNA, 13 bp, D. melanogaster
aattgatttagat

SEQ ID NO: 567731 - DNA, 13 bp, D. melanogaster
aattgatttcaac

SEQ ID NO: 567732 - DNA, 13 bp, D. melanogaster
aattgatttccat

SEQ ID NO: 567733 - DNA, 13 bp, D. melanogaster
aattgatttcgat

SEQ ID NO: 567734 - DNA, 13 bp, D. melanogaster
aattgatttctaa

SEQ ID NO: 567735 - DNA, 13 bp, D. melanogaster
aattgatttgatt

SEQ ID NO: 567736 - DNA, 13 bp, D. melanogaster
aattgatttgctc

SEQ ID NO: 567737 - DNA, 13 bp, D. melanogaster
aattgattttaag

SEQ ID NO: 567738 - DNA, 13 bp, D. melanogaster
aattgattttatg

SEQ ID NO: 567739 - DNA, 13 bp, D. melanogaster
aattgattttcaa

SEQ ID NO: 567740 - DNA, 14 bp, D. melanogaster
aattgattttcaat

SEQ ID NO: 567741 - DNA, 13 bp, D. melanogaster
aattgattttcct

SEQ ID NO: 567742 - DNA, 13 bp, D. melanogaster
aattgattttcta

SEQ ID NO: 567743 - DNA, 13 bp, D. melanogaster
aattgattttgaa

SEQ ID NO: 567744 - DNA, 13 bp, D. melanogaster
aattgatttttcc

SEQ ID NO: 567745 - DNA, 13 bp, D. melanogaster
aattgcaaaaaca

SEQ ID NO: 567746 - DNA, 13 bp, D. melanogaster
aattgcaaaaagt

SEQ ID NO: 567747 - DNA, 13 bp, D. melanogaster
aattgcaaaacaa

SEQ ID NO: 567748 - DNA, 14 bp, D. melanogaster
aattgcaaaacaaa

SEQ ID NO: 567749 - DNA, 13 bp, D. melanogaster
aattgcaaaactt

SEQ ID NO: 567750 - DNA, 13 bp, D. melanogaster
aattgcaaaagca

SEQ ID NO: 567751 - DNA, 13 bp, D. melanogaster
aattgcaaaagtg

SEQ ID NO: 567752 - DNA, 14 bp, D. melanogaster
aattgcaaaagttt

SEQ ID NO: 567753 - DNA, 14 bp, D. melanogaster
aattgcaaaataaa

SEQ ID NO: 567754 - DNA, 13 bp, D. melanogaster
aattgcaaaatat

SEQ ID NO: 567755 - DNA, 13 bp, D. melanogaster
aattgcaaaatca

SEQ ID NO: 567756 - DNA, 13 bp, D. melanogaster
aattgcaaaatgc

SEQ ID NO: 567757 - DNA, 14 bp, D. melanogaster
aattgcaaaatgca

SEQ ID NO: 567758 - DNA, 15 bp, D. melanogaster
aattgcaaaatgcca

SEQ ID NO: 567759 - DNA, 13 bp, D. melanogaster
aattgcaaaatta

SEQ ID NO: 567760 - DNA, 13 bp, D. melanogaster
aattgcaaaattc

SEQ ID NO: 567761 - DNA, 13 bp, D. melanogaster
aattgcaaaattt

SEQ ID NO: 567762 - DNA, 13 bp, D. melanogaster
aattgcaaacaaa

SEQ ID NO: 567763 - DNA, 13 bp, D. melanogaster
aattgcaaacaca

SEQ ID NO: 567764 - DNA, 13 bp, D. melanogaster
aattgcaaacagc

SEQ ID NO: 567765 - DNA, 13 bp, D. melanogaster
aattgcaaagaaa

SEQ ID NO: 567766 - DNA, 13 bp, D. melanogaster
aattgcaaagtaa

SEQ ID NO: 567767 - DNA, 13 bp, D. melanogaster
aattgcaaagttt

SEQ ID NO: 567768 - DNA, 14 bp, D. melanogaster
aattgcaaataaat

SEQ ID NO: 567769 - DNA, 86 bp, D. melanogaster
aattgcaaataaatggttgcaataaatagttttgagtctattaaatggaccgttccgaatatgaactaagaccaacgctgaaaatt

SEQ ID NO: 567770 - DNA, 13 bp, D. melanogaster
aattgcaaataat

SEQ ID NO: 567771 - DNA, 13 bp, D. melanogaster
aattgcaaatact

SEQ ID NO: 567772 - DNA, 14 bp, D. melanogaster
aattgcaaatattt

SEQ ID NO: 567773 - DNA, 13 bp, D. melanogaster
aattgcaaatcaa

SEQ ID NO: 567774 - DNA, 13 bp, D. melanogaster
aattgcaaatcga

SEQ ID NO: 567775 - DNA, 13 bp, D. melanogaster
aattgcaaatgca

SEQ ID NO: 567776 - DNA, 13 bp, D. melanogaster
aattgcaaatgtg

SEQ ID NO: 567777 - DNA, 13 bp, D. melanogaster
aattgcaaatgtt

SEQ ID NO: 567778 - DNA, 14 bp, D. melanogaster
aattgcaaattaaa

SEQ ID NO: 567779 - DNA, 13 bp, D. melanogaster
aattgcaaattga

SEQ ID NO: 567780 - DNA, 13 bp, D. melanogaster
aattgcaaattgc

SEQ ID NO: 567781 - DNA, 14 bp, D. melanogaster
aattgcaaattgca

SEQ ID NO: 567782 - DNA, 14 bp, D. melanogaster
aattgcaacaaatt

SEQ ID NO: 567783 - DNA, 13 bp, D. melanogaster
aattgcaacaaca

SEQ ID NO: 567784 - DNA, 13 bp, D. melanogaster
aattgcaacaatt

SEQ ID NO: 567785 - DNA, 13 bp, D. melanogaster
aattgcaaccaga

SEQ ID NO: 567786 - DNA, 13 bp, D. melanogaster
aattgcaaccgat

SEQ ID NO: 567787 - DNA, 14 bp, D. melanogaster
aattgcaaccgatg

SEQ ID NO: 567788 - DNA, 13 bp, D. melanogaster
aattgcaactgaa

SEQ ID NO: 567789 - DNA, 14 bp, D. melanogaster
aattgcaactgcaa

SEQ ID NO: 567790 - DNA, 13 bp, D. melanogaster
aattgcaagaaaa

SEQ ID NO: 567791 - DNA, 13 bp, D. melanogaster
aattgcaagaaat

SEQ ID NO: 567792 - DNA, 13 bp, D. melanogaster
aattgcaagcaaa

SEQ ID NO: 567793 - DNA, 13 bp, D. melanogaster
aattgcaagctca

SEQ ID NO: 567794 - DNA, 13 bp, D. melanogaster
aattgcaataaaa

SEQ ID NO: 567795 - DNA, 14 bp, D. melanogaster
aattgcaataaaaa

SEQ ID NO: 567796 - DNA, 13 bp, D. melanogaster
aattgcaataaca

SEQ ID NO: 567797 - DNA, 13 bp, D. melanogaster
aattgcaataata

SEQ ID NO: 567798 - DNA, 13 bp, D. melanogaster
aattgcaatataa

SEQ ID NO: 567799 - DNA, 13 bp, D. melanogaster
aattgcaatatca

SEQ ID NO: 567800 - DNA, 13 bp, D. melanogaster
aattgcaatcaaa

SEQ ID NO: 567801 - DNA, 13 bp, D. melanogaster
aattgcaatcaat

SEQ ID NO: 567802 - DNA, 13 bp, D. melanogaster
aattgcaatcgaa

SEQ ID NO: 567803 - DNA, 13 bp, D. melanogaster
aattgcaatgaaa

SEQ ID NO: 567804 - DNA, 13 bp, D. melanogaster
aattgcaatgatt

SEQ ID NO: 567805 - DNA, 13 bp, D. melanogaster
aattgcaatgcaa

SEQ ID NO: 567806 - DNA, 14 bp, D. melanogaster
aattgcaatgcaaa

SEQ ID NO: 567807 - DNA, 13 bp, D. melanogaster
aattgcaatggaa

SEQ ID NO: 567808 - DNA, 13 bp, D. melanogaster
aattgcaatggca

SEQ ID NO: 567809 - DNA, 13 bp, D. melanogaster
aattgcaatgtca

SEQ ID NO: 567810 - DNA, 13 bp, D. melanogaster
aattgcaatgttt

SEQ ID NO: 567811 - DNA, 13 bp, D. melanogaster
aattgcaattaag

SEQ ID NO: 567812 - DNA, 13 bp, D. melanogaster
aattgcaattacc

SEQ ID NO: 567813 - DNA, 13 bp, D. melanogaster
aattgcaattatg

SEQ ID NO: 567814 - DNA, 13 bp, D. melanogaster
aattgcaattatt

SEQ ID NO: 567815 - DNA, 13 bp, D. melanogaster
aattgcaattcaa

SEQ ID NO: 567816 - DNA, 13 bp, D. melanogaster
aattgcaattgaa

SEQ ID NO: 567817 - DNA, 14 bp, D. melanogaster
aattgcaattgaaa

SEQ ID NO: 567818 - DNA, 13 bp, D. melanogaster
aattgcaattgca

SEQ ID NO: 567819 - DNA, 14 bp, D. melanogaster
aattgcaattgcaa

SEQ ID NO: 567820 - DNA, 13 bp, D. melanogaster
aattgcaattgcc

SEQ ID NO: 567821 - DNA, 13 bp, D. melanogaster
aattgcaattgcg

SEQ ID NO: 567822 - DNA, 13 bp, D. melanogaster
aattgcaattgct

SEQ ID NO: 567823 - DNA, 13 bp, D. melanogaster
aattgcaattgga

SEQ ID NO: 567824 - DNA, 13 bp, D. melanogaster
aattgcaattggc

SEQ ID NO: 567825 - DNA, 13 bp, D. melanogaster
aattgcaatttat

SEQ ID NO: 567826 - DNA, 14 bp, D. melanogaster
aattgcaatttatt

SEQ ID NO: 567827 - DNA, 13 bp, D. melanogaster
aattgcaatttgc

SEQ ID NO: 567828 - DNA, 14 bp, D. melanogaster
aattgcaatttgca

SEQ ID NO: 567829 - DNA, 13 bp, D. melanogaster
aattgcaatttgg

SEQ ID NO: 567830 - DNA, 13 bp, D. melanogaster
aattgcaatttgt

SEQ ID NO: 567831 - DNA, 14 bp, D. melanogaster
aattgcaattttat

SEQ ID NO: 567832 - DNA, 13 bp, D. melanogaster
aattgcaattttg

SEQ ID NO: 567833 - DNA, 13 bp, D. melanogaster
aattgcaattttt

SEQ ID NO: 567834 - DNA, 13 bp, D. melanogaster
aattgcacaaaag

SEQ ID NO: 567835 - DNA, 13 bp, D. melanogaster
aattgcacaaata

SEQ ID NO: 567836 - DNA, 13 bp, D. melanogaster
aattgcacaaatg

SEQ ID NO: 567837 - DNA, 13 bp, D. melanogaster
aattgcacaaatt

SEQ ID NO: 567838 - DNA, 13 bp, D. melanogaster
aattgcacaacaa

SEQ ID NO: 567839 - DNA, 13 bp, D. melanogaster
aattgcacaatta

SEQ ID NO: 567840 - DNA, 13 bp, D. melanogaster
aattgcacaattt

SEQ ID NO: 567841 - DNA, 13 bp, D. melanogaster
aattgcacacaat

SEQ ID NO: 567842 - DNA, 13 bp, D. melanogaster
aattgcacacaca

SEQ ID NO: 567843 - DNA, 14 bp, D. melanogaster
aattgcacacacac

SEQ ID NO: 567844 - DNA, 13 bp, D. melanogaster
aattgcacagaaa

SEQ ID NO: 567845 - DNA, 13 bp, D. melanogaster
aattgcacataaa

SEQ ID NO: 567846 - DNA, 13 bp, D. melanogaster
aattgcacatttg

SEQ ID NO: 567847 - DNA, 13 bp, D. melanogaster
aattgcactgaaa

SEQ ID NO: 567848 - DNA, 13 bp, D. melanogaster
aattgcactggca

SEQ ID NO: 567849 - DNA, 13 bp, D. melanogaster
aattgcacttaaa

SEQ ID NO: 567850 - DNA, 13 bp, D. melanogaster
aattgcacttgca

SEQ ID NO: 567851 - DNA, 13 bp, D. melanogaster
aattgcactttac

SEQ ID NO: 567852 - DNA, 13 bp, D. melanogaster
aattgcactttgt

SEQ ID NO: 567853 - DNA, 13 bp, D. melanogaster
aattgcacttttc

SEQ ID NO: 567854 - DNA, 13 bp, D. melanogaster
aattgcacttttt

SEQ ID NO: 567855 - DNA, 13 bp, D. melanogaster
aattgcagaaaat

SEQ ID NO: 567856 - DNA, 13 bp, D. melanogaster
aattgcagaaagt

SEQ ID NO: 567857 - DNA, 14 bp, D. melanogaster
aattgcagaaagta

SEQ ID NO: 567858 - DNA, 14 bp, D. melanogaster
aattgcagaaagtt

SEQ ID NO: 567859 - DNA, 13 bp, D. melanogaster
aattgcagcaatt

SEQ ID NO: 567860 - DNA, 14 bp, D. melanogaster
aattgcagcaattt

SEQ ID NO: 567861 - DNA, 13 bp, D. melanogaster
aattgcagcacaa

SEQ ID NO: 567862 - DNA, 13 bp, D. melanogaster
aattgcagcagca

SEQ ID NO: 567863 - DNA, 13 bp, D. melanogaster
aattgcagcagct

SEQ ID NO: 567864 - DNA, 13 bp, D. melanogaster
aattgcagccaaa

SEQ ID NO: 567865 - DNA, 13 bp, D. melanogaster
aattgcagccaca

SEQ ID NO: 567866 - DNA, 13 bp, D. melanogaster
aattgcagctaaa

SEQ ID NO: 567867 - DNA, 13 bp, D. melanogaster
aattgcagctgaa

SEQ ID NO: 567868 - DNA, 13 bp, D. melanogaster
aattgcagctgca

SEQ ID NO: 567869 - DNA, 14 bp, D. melanogaster
aattgcagctgcaa

SEQ ID NO: 567870 - DNA, 13 bp, D. melanogaster
aattgcagctgct

SEQ ID NO: 567871 - DNA, 14 bp, D. melanogaster
aattgcagctggag

SEQ ID NO: 567872 - DNA, 13 bp, D. melanogaster
aattgcagcttaa

SEQ ID NO: 567873 - DNA, 13 bp, D. melanogaster
aattgcagctttt

SEQ ID NO: 567874 - DNA, 13 bp, D. melanogaster
aattgcaggaaaa

SEQ ID NO: 567875 - DNA, 13 bp, D. melanogaster
aattgcaggaaat

SEQ ID NO: 567876 - DNA, 13 bp, D. melanogaster
aattgcaggcaaa

SEQ ID NO: 567877 - DNA, 13 bp, D. melanogaster
aattgcaggcaat

SEQ ID NO: 567878 - DNA, 13 bp, D. melanogaster
aattgcaggccgg

SEQ ID NO: 567879 - DNA, 13 bp, D. melanogaster
aattgcagggcaa

SEQ ID NO: 567880 - DNA, 13 bp, D. melanogaster
aattgcagtgcat

SEQ ID NO: 567881 - DNA, 13 bp, D. melanogaster
aattgcagtggca

SEQ ID NO: 567882 - DNA, 13 bp, D. melanogaster
aattgcagttgaa

SEQ ID NO: 567883 - DNA, 13 bp, D. melanogaster
aattgcagttgca

SEQ ID NO: 567884 - DNA, 14 bp, D. melanogaster
aattgcagttgcaa

SEQ ID NO: 567885 - DNA, 13 bp, D. melanogaster
aattgcagttggc

SEQ ID NO: 567886 - DNA, 13 bp, D. melanogaster
aattgcagttgtt

SEQ ID NO: 567887 - DNA, 13 bp, D. melanogaster
aattgcagttttt

SEQ ID NO: 567888 - DNA, 13 bp, D. melanogaster
aattgcataaata

SEQ ID NO: 567889 - DNA, 13 bp, D. melanogaster
aattgcataatca

SEQ ID NO: 567890 - DNA, 13 bp, D. melanogaster
aattgcataatga

SEQ ID NO: 567891 - DNA, 13 bp, D. melanogaster
aattgcatacaaa

SEQ ID NO: 567892 - DNA, 13 bp, D. melanogaster
aattgcatagaaa

SEQ ID NO: 567893 - DNA, 13 bp, D. melanogaster
aattgcatatttt

SEQ ID NO: 567894 - DNA, 13 bp, D. melanogaster
aattgcatcaaat

SEQ ID NO: 567895 - DNA, 13 bp, D. melanogaster
aattgcatcaatt

SEQ ID NO: 567896 - DNA, 13 bp, D. melanogaster
aattgcatccaca

SEQ ID NO: 567897 - DNA, 13 bp, D. melanogaster
aattgcatctgca

SEQ ID NO: 567898 - DNA, 13 bp, D. melanogaster
aattgcatgccaa

SEQ ID NO: 567899 - DNA, 13 bp, D. melanogaster
aattgcatgcgaa

SEQ ID NO: 567900 - DNA, 13 bp, D. melanogaster
aattgcatgtgtg

SEQ ID NO: 567901 - DNA, 14 bp, D. melanogaster
aattgcattaaaaa

SEQ ID NO: 567902 - DNA, 14 bp, D. melanogaster
aattgcattaaaat

SEQ ID NO: 567903 - DNA, 13 bp, D. melanogaster
aattgcattagaa

SEQ ID NO: 567904 - DNA, 13 bp, D. melanogaster
aattgcattattt

SEQ ID NO: 567905 - DNA, 13 bp, D. melanogaster
aattgcattcaaa

SEQ ID NO: 567906 - DNA, 14 bp, D. melanogaster
aattgcattcaatt

SEQ ID NO: 567907 - DNA, 13 bp, D. melanogaster
aattgcattgaaa

SEQ ID NO: 567908 - DNA, 14 bp, D. melanogaster
aattgcattgaaat

SEQ ID NO: 567909 - DNA, 13 bp, D. melanogaster
aattgcattgaat

SEQ ID NO: 567910 - DNA, 13 bp, D. melanogaster
aattgcattgaca

SEQ ID NO: 567911 - DNA, 13 bp, D. melanogaster
aattgcattgcac

SEQ ID NO: 567912 - DNA, 13 bp, D. melanogaster
aattgcattgcat

SEQ ID NO: 567913 - DNA, 14 bp, D. melanogaster
aattgcattgcata

SEQ ID NO: 567914 - DNA, 13 bp, D. melanogaster
aattgcattgctt

SEQ ID NO: 567915 - DNA, 13 bp, D. melanogaster
aattgcattgtaa

SEQ ID NO: 567916 - DNA, 13 bp, D. melanogaster
aattgcattgtga

SEQ ID NO: 567917 - DNA, 13 bp, D. melanogaster
aattgcattgttt

SEQ ID NO: 567918 - DNA, 14 bp, D. melanogaster
aattgcattgtttt

SEQ ID NO: 567919 - DNA, 13 bp, D. melanogaster
aattgcatttaaa

SEQ ID NO: 567920 - DNA, 14 bp, D. melanogaster
aattgcatttaaaa

SEQ ID NO: 567921 - DNA, 13 bp, D. melanogaster
aattgcatttaat

SEQ ID NO: 567922 - DNA, 14 bp, D. melanogaster
aattgcatttaatt

SEQ ID NO: 567923 - DNA, 14 bp, D. melanogaster
aattgcatttactt

SEQ ID NO: 567924 - DNA, 13 bp, D. melanogaster
aattgcatttatc

SEQ ID NO: 567925 - DNA, 13 bp, D. melanogaster
aattgcatttatt

SEQ ID NO: 567926 - DNA, 14 bp, D. melanogaster
aattgcatttattg

SEQ ID NO: 567927 - DNA, 13 bp, D. melanogaster
aattgcatttccc

SEQ ID NO: 567928 - DNA, 13 bp, D. melanogaster
aattgcatttctc

SEQ ID NO: 567929 - DNA, 13 bp, D. melanogaster
aattgcatttgca

SEQ ID NO: 567930 - DNA, 14 bp, D. melanogaster
aattgcatttgcat

SEQ ID NO: 567931 - DNA, 14 bp, D. melanogaster
aattgcatttgctg

SEQ ID NO: 567932 - DNA, 13 bp, D. melanogaster
aattgcatttgga

SEQ ID NO: 567933 - DNA, 13 bp, D. melanogaster
aattgcatttggc

SEQ ID NO: 567934 - DNA, 13 bp, D. melanogaster
aattgcattttaa

SEQ ID NO: 567935 - DNA, 14 bp, D. melanogaster
aattgcattttaat

SEQ ID NO: 567936 - DNA, 13 bp, D. melanogaster
aattgcattttac

SEQ ID NO: 567937 - DNA, 13 bp, D. melanogaster
aattgcattttag

SEQ ID NO: 567938 - DNA, 14 bp, D. melanogaster
aattgcattttatg

SEQ ID NO: 567939 - DNA, 14 bp, D. melanogaster
aattgcattttatt

SEQ ID NO: 567940 - DNA, 13 bp, D. melanogaster
aattgcattttct

SEQ ID NO: 567941 - DNA, 14 bp, D. melanogaster
aattgcatttttat

SEQ ID NO: 567942 - DNA, 13 bp, D. melanogaster
aattgcatttttc

SEQ ID NO: 567943 - DNA, 14 bp, D. melanogaster
aattgccaaaaaaa

SEQ ID NO: 567944 - DNA, 13 bp, D. melanogaster
aattgccaaaaat

SEQ ID NO: 567945 - DNA, 14 bp, D. melanogaster
aattgccaaaaatt

SEQ ID NO: 567946 - DNA, 13 bp, D. melanogaster
aattgccaaaagc

SEQ ID NO: 567947 - DNA, 13 bp, D. melanogaster
aattgccaaaatt

SEQ ID NO: 567948 - DNA, 14 bp, D. melanogaster
aattgccaaataaa

SEQ ID NO: 567949 - DNA, 14 bp, D. melanogaster
aattgccaaatcga

SEQ ID NO: 567950 - DNA, 13 bp, D. melanogaster
aattgccaaatgc

SEQ ID NO: 567951 - DNA, 13 bp, D. melanogaster
aattgccaacaaa

SEQ ID NO: 567952 - DNA, 13 bp, D. melanogaster
aattgccaagaat

SEQ ID NO: 567953 - DNA, 13 bp, D. melanogaster
aattgccaagcta

SEQ ID NO: 567954 - DNA, 13 bp, D. melanogaster
aattgccaagtga

SEQ ID NO: 567955 - DNA, 13 bp, D. melanogaster
aattgccaataaa

SEQ ID NO: 567956 - DNA, 13 bp, D. melanogaster
aattgccaatatt

SEQ ID NO: 567957 - DNA, 13 bp, D. melanogaster
aattgccaatcga

SEQ ID NO: 567958 - DNA, 13 bp, D. melanogaster
aattgccaatgaa

SEQ ID NO: 567959 - DNA, 13 bp, D. melanogaster
aattgccaatggc

SEQ ID NO: 567960 - DNA, 13 bp, D. melanogaster
aattgccaattat

SEQ ID NO: 567961 - DNA, 13 bp, D. melanogaster
aattgccaattgg

SEQ ID NO: 567962 - DNA, 13 bp, D. melanogaster
aattgccaattta

SEQ ID NO: 567963 - DNA, 13 bp, D. melanogaster
aattgccacaaaa

SEQ ID NO: 567964 - DNA, 14 bp, D. melanogaster
aattgccacaaaaa

SEQ ID NO: 567965 - DNA, 13 bp, D. melanogaster
aattgccacaaat

SEQ ID NO: 567966 - DNA, 13 bp, D. melanogaster
aattgccacaatt

SEQ ID NO: 567967 - DNA, 13 bp, D. melanogaster
aattgccacattt

SEQ ID NO: 567968 - DNA, 13 bp, D. melanogaster
aattgccagaaaa

SEQ ID NO: 567969 - DNA, 14 bp, D. melanogaster
aattgccagcaatt

SEQ ID NO: 567970 - DNA, 13 bp, D. melanogaster
aattgccagcaca

SEQ ID NO: 567971 - DNA, 13 bp, D. melanogaster
aattgccagcagc

SEQ ID NO: 567972 - DNA, 13 bp, D. melanogaster
aattgccagtggc

SEQ ID NO: 567973 - DNA, 13 bp, D. melanogaster
aattgccataatt

SEQ ID NO: 567974 - DNA, 13 bp, D. melanogaster
aattgccatattt

SEQ ID NO: 567975 - DNA, 13 bp, D. melanogaster
aattgccatgcaa

SEQ ID NO: 567976 - DNA, 13 bp, D. melanogaster
aattgccattgat

SEQ ID NO: 567977 - DNA, 13 bp, D. melanogaster
aattgccattgtt

SEQ ID NO: 567978 - DNA, 13 bp, D. melanogaster
aattgccatttaa

SEQ ID NO: 567979 - DNA, 13 bp, D. melanogaster
aattgccatttat

SEQ ID NO: 567980 - DNA, 13 bp, D. melanogaster
aattgccattttg

SEQ ID NO: 567981 - DNA, 13 bp, D. melanogaster
aattgcccaaaaa

SEQ ID NO: 567982 - DNA, 13 bp, D. melanogaster
aattgcccaatga

SEQ ID NO: 567983 - DNA, 13 bp, D. melanogaster
aattgccgcaaat

SEQ ID NO: 567984 - DNA, 13 bp, D. melanogaster
aattgccgccgtc

SEQ ID NO: 567985 - DNA, 13 bp, D. melanogaster
aattgccggcaat

SEQ ID NO: 567986 - DNA, 13 bp, D. melanogaster
aattgccggtcat

SEQ ID NO: 567987 - DNA, 14 bp, D. melanogaster
aattgccggtcatt

SEQ ID NO: 567988 - DNA, 13 bp, D. melanogaster
aattgccggttat

SEQ ID NO: 567989 - DNA, 13 bp, D. melanogaster
aattgcctctttg

SEQ ID NO: 567990 - DNA, 13 bp, D. melanogaster
aattgcctgattt

SEQ ID NO: 567991 - DNA, 13 bp, D. melanogaster
aattgcctgcaat

SEQ ID NO: 567992 - DNA, 13 bp, D. melanogaster
aattgcctgccat

SEQ ID NO: 567993 - DNA, 13 bp, D. melanogaster
aattgccttaatt

SEQ ID NO: 567994 - DNA, 13 bp, D. melanogaster
aattgcctttgtt

SEQ ID NO: 567995 - DNA, 13 bp, D. melanogaster
aattgccttttgt

SEQ ID NO: 567996 - DNA, 13 bp, D. melanogaster
aattgcgaaaaaa

SEQ ID NO: 567997 - DNA, 13 bp, D. melanogaster
aattgcgaaaaga

SEQ ID NO: 567998 - DNA, 13 bp, D. melanogaster
aattgcgaaaatg

SEQ ID NO: 567999 - DNA, 13 bp, D. melanogaster
aattgcgaattaa

SEQ ID NO: 568000 - DNA, 13 bp, D. melanogaster
aattgcgaattgc

SEQ ID NO: 568001 - DNA, 13 bp, D. melanogaster
aattgcgattgca

SEQ ID NO: 568002 - DNA, 13 bp, D. melanogaster
aattgcgcaatta

SEQ ID NO: 568003 - DNA, 13 bp, D. melanogaster
aattgcggcaatt

SEQ ID NO: 568004 - DNA, 13 bp, D. melanogaster
aattgcgttaaat

SEQ ID NO: 568005 - DNA, 14 bp, D. melanogaster
aattgcgtttaatt

SEQ ID NO: 568006 - DNA, 13 bp, D. melanogaster
aattgctaaataa

SEQ ID NO: 568007 - DNA, 13 bp, D. melanogaster
aattgctaaatta

SEQ ID NO: 568008 - DNA, 13 bp, D. melanogaster
aattgctaattgc

SEQ ID NO: 568009 - DNA, 13 bp, D. melanogaster
aattgctacaaat

SEQ ID NO: 568010 - DNA, 13 bp, D. melanogaster
aattgctattatt

SEQ ID NO: 568011 - DNA, 13 bp, D. melanogaster
aattgctattcaa

SEQ ID NO: 568012 - DNA, 13 bp, D. melanogaster
aattgctattttt

SEQ ID NO: 568013 - DNA, 13 bp, D. melanogaster
aattgctcaaatt

SEQ ID NO: 568014 - DNA, 13 bp, D. melanogaster
aattgctcaataa

SEQ ID NO: 568015 - DNA, 13 bp, D. melanogaster
aattgctcaatta

SEQ ID NO: 568016 - DNA, 13 bp, D. melanogaster
aattgctcaattg

SEQ ID NO: 568017 - DNA, 13 bp, D. melanogaster
aattgctcattaa

SEQ ID NO: 568018 - DNA, 13 bp, D. melanogaster
aattgctgaaatt

SEQ ID NO: 568019 - DNA, 13 bp, D. melanogaster
aattgctgaccaa

SEQ ID NO: 568020 - DNA, 13 bp, D. melanogaster
aattgctgataaa

SEQ ID NO: 568021 - DNA, 13 bp, D. melanogaster
aattgctgcaatc

SEQ ID NO: 568022 - DNA, 13 bp, D. melanogaster
aattgctgcaatt

SEQ ID NO: 568023 - DNA, 13 bp, D. melanogaster
aattgctgccgaa

SEQ ID NO: 568024 - DNA, 15 bp, D. melanogaster
aattgctgccgaagc

SEQ ID NO: 568025 - DNA, 13 bp, D. melanogaster
aattgctgccgct

SEQ ID NO: 568026 - DNA, 13 bp, D. melanogaster
aattgctgctaat

SEQ ID NO: 568027 - DNA, 13 bp, D. melanogaster
aattgctggaaaa

SEQ ID NO: 568028 - DNA, 13 bp, D. melanogaster
aattgctggccac

SEQ ID NO: 568029 - DNA, 13 bp, D. melanogaster
aattgctgggaaa

SEQ ID NO: 568030 - DNA, 13 bp, D. melanogaster
aattgctgggcaa

SEQ ID NO: 568031 - DNA, 13 bp, D. melanogaster
aattgctgtattt

SEQ ID NO: 568032 - DNA, 14 bp, D. melanogaster
aattgctgtcgtag

SEQ ID NO: 568033 - DNA, 13 bp, D. melanogaster
aattgctgttaat

SEQ ID NO: 568034 - DNA, 14 bp, D. melanogaster
aattgcttaaaaat

SEQ ID NO: 568035 - DNA, 13 bp, D. melanogaster
aattgcttaaata

SEQ ID NO: 568036 - DNA, 13 bp, D. melanogaster
aattgcttaaatt

SEQ ID NO: 568037 - DNA, 13 bp, D. melanogaster
aattgcttaacaa

SEQ ID NO: 568038 - DNA, 13 bp, D. melanogaster
aattgcttaatat

SEQ ID NO: 568039 - DNA, 13 bp, D. melanogaster
aattgcttatttt

SEQ ID NO: 568040 - DNA, 13 bp, D. melanogaster
aattgcttgaatt

SEQ ID NO: 568041 - DNA, 13 bp, D. melanogaster
aattgcttgcatc

SEQ ID NO: 568042 - DNA, 13 bp, D. melanogaster
aattgcttggaaa

SEQ ID NO: 568043 - DNA, 13 bp, D. melanogaster
aattgcttggcaa

SEQ ID NO: 568044 - DNA, 13 bp, D. melanogaster
aattgcttgtttt

SEQ ID NO: 568045 - DNA, 13 bp, D. melanogaster
aattgctttaaat

SEQ ID NO: 568046 - DNA, 14 bp, D. melanogaster
aattgctttaaatt

SEQ ID NO: 568047 - DNA, 13 bp, D. melanogaster
aattgctttaatt

SEQ ID NO: 568048 - DNA, 13 bp, D. melanogaster
aattgctttagtt

SEQ ID NO: 568049 - DNA, 14 bp, D. melanogaster
aattgctttagttt

SEQ ID NO: 568050 - DNA, 13 bp, D. melanogaster
aattgctttataa

SEQ ID NO: 568051 - DNA, 13 bp, D. melanogaster
aattgctttatta

SEQ ID NO: 568052 - DNA, 13 bp, D. melanogaster
aattgctttattt

SEQ ID NO: 568053 - DNA, 13 bp, D. melanogaster
aattgctttcaaa

SEQ ID NO: 568054 - DNA, 13 bp, D. melanogaster
aattgctttcaat

SEQ ID NO: 568055 - DNA, 13 bp, D. melanogaster
aattgctttcttt

SEQ ID NO: 568056 - DNA, 13 bp, D. melanogaster
aattgctttgctt

SEQ ID NO: 568057 - DNA, 13 bp, D. melanogaster
aattgctttggaa

SEQ ID NO: 568058 - DNA, 13 bp, D. melanogaster
aattgctttggtt

SEQ ID NO: 568059 - DNA, 13 bp, D. melanogaster
aattgcttttaaa

SEQ ID NO: 568060 - DNA, 14 bp, D. melanogaster
aattgcttttaatt

SEQ ID NO: 568061 - DNA, 13 bp, D. melanogaster
aattgcttttcca

SEQ ID NO: 568062 - DNA, 13 bp, D. melanogaster
aattgcttttggc

SEQ ID NO: 568063 - DNA, 13 bp, D. melanogaster
aattgcttttgtt

SEQ ID NO: 568064 - DNA, 13 bp, D. melanogaster
aattgctttttct

SEQ ID NO: 568065 - DNA, 13 bp, D. melanogaster
aattggaaaaagt

SEQ ID NO: 568066 - DNA, 13 bp, D. melanogaster
aattggaaaaatt

SEQ ID NO: 568067 - DNA, 13 bp, D. melanogaster
aattggaaaacat

SEQ ID NO: 568068 - DNA, 13 bp, D. melanogaster
aattggaaaacta

SEQ ID NO: 568069 - DNA, 13 bp, D. melanogaster
aattggaaaactt

SEQ ID NO: 568070 - DNA, 13 bp, D. melanogaster
aattggaaaatat

SEQ ID NO: 568071 - DNA, 13 bp, D. melanogaster
aattggaaaatgt

SEQ ID NO: 568072 - DNA, 13 bp, D. melanogaster
aattggaaactaa

SEQ ID NO: 568073 - DNA, 13 bp, D. melanogaster
aattggaaagtaa

SEQ ID NO: 568074 - DNA, 13 bp, D. melanogaster
aattggaaatatg

SEQ ID NO: 568075 - DNA, 13 bp, D. melanogaster
aattggaaatatt

SEQ ID NO: 568076 - DNA, 14 bp, D. melanogaster
aattggaaatattt

SEQ ID NO: 568077 - DNA, 13 bp, D. melanogaster
aattggaaatcaa

SEQ ID NO: 568078 - DNA, 13 bp, D. melanogaster
aattggaaatgga

SEQ ID NO: 568079 - DNA, 14 bp, D. melanogaster
aattggaaatggaa

SEQ ID NO: 568080 - DNA, 13 bp, D. melanogaster
aattggaaattgt

SEQ ID NO: 568081 - DNA, 13 bp, D. melanogaster
aattggaaattta

SEQ ID NO: 568082 - DNA, 13 bp, D. melanogaster
aattggaaatttg

SEQ ID NO: 568083 - DNA, 13 bp, D. melanogaster
aattggaagacca

SEQ ID NO: 568084 - DNA, 13 bp, D. melanogaster
aattggaagtgaa

SEQ ID NO: 568085 - DNA, 13 bp, D. melanogaster
aattggaataatt

SEQ ID NO: 568086 - DNA, 13 bp, D. melanogaster
aattggaatataa

SEQ ID NO: 568087 - DNA, 13 bp, D. melanogaster
aattggaatattt

SEQ ID NO: 568088 - DNA, 13 bp, D. melanogaster
aattggaatcaat

SEQ ID NO: 568089 - DNA, 13 bp, D. melanogaster
aattggaatgcca

SEQ ID NO: 568090 - DNA, 13 bp, D. melanogaster
aattggaatggaa

SEQ ID NO: 568091 - DNA, 13 bp, D. melanogaster
aattggaatggca

SEQ ID NO: 568092 - DNA, 13 bp, D. melanogaster
aattggaattata

SEQ ID NO: 568093 - DNA, 14 bp, D. melanogaster
aattggaattataa

SEQ ID NO: 568094 - DNA, 13 bp, D. melanogaster
aattggaattgaa

SEQ ID NO: 568095 - DNA, 14 bp, D. melanogaster
aattggaattgaaa

SEQ ID NO: 568096 - DNA, 13 bp, D. melanogaster
aattggaattgat

SEQ ID NO: 568097 - DNA, 13 bp, D. melanogaster
aattggaattgga

SEQ ID NO: 568098 - DNA, 14 bp, D. melanogaster
aattggaattggaa

SEQ ID NO: 568099 - DNA, 13 bp, D. melanogaster
aattggaattggg

SEQ ID NO: 568100 - DNA, 13 bp, D. melanogaster
aattggaattggt

SEQ ID NO: 568101 - DNA, 13 bp, D. melanogaster
aattggaattgtt

SEQ ID NO: 568102 - DNA, 13 bp, D. melanogaster
aattggaatttaa

SEQ ID NO: 568103 - DNA, 13 bp, D. melanogaster
aattggaatttat

SEQ ID NO: 568104 - DNA, 14 bp, D. melanogaster
aattggaatttatt

SEQ ID NO: 568105 - DNA, 13 bp, D. melanogaster
aattggaattttc

SEQ ID NO: 568106 - DNA, 13 bp, D. melanogaster
aattggagaaaat

SEQ ID NO: 568107 - DNA, 13 bp, D. melanogaster
aattggataaata

SEQ ID NO: 568108 - DNA, 13 bp, D. melanogaster
aattggatatttt

SEQ ID NO: 568109 - DNA, 13 bp, D. melanogaster
aattggatgataa

SEQ ID NO: 568110 - DNA, 13 bp, D. melanogaster
aattggatgtttt

SEQ ID NO: 568111 - DNA, 13 bp, D. melanogaster
aattggattaaaa

SEQ ID NO: 568112 - DNA, 13 bp, D. melanogaster
aattggattaaat

SEQ ID NO: 568113 - DNA, 13 bp, D. melanogaster
aattggattacaa

SEQ ID NO: 568114 - DNA, 13 bp, D. melanogaster
aattggattgaaa

SEQ ID NO: 568115 - DNA, 13 bp, D. melanogaster
aattggattggat

SEQ ID NO: 568116 - DNA, 14 bp, D. melanogaster
aattggattggatt

SEQ ID NO: 568117 - DNA, 13 bp, D. melanogaster
aattggatttact

SEQ ID NO: 568118 - DNA, 13 bp, D. melanogaster
aattggatttatt

SEQ ID NO: 568119 - DNA, 13 bp, D. melanogaster
aattggatttcaa

SEQ ID NO: 568120 - DNA, 14 bp, D. melanogaster
aattggatttcaag

SEQ ID NO: 568121 - DNA, 13 bp, D. melanogaster
aattggatttgca

SEQ ID NO: 568122 - DNA, 13 bp, D. melanogaster
aattggatttgga

SEQ ID NO: 568123 - DNA, 13 bp, D. melanogaster
aattggattttat

SEQ ID NO: 568124 - DNA, 13 bp, D. melanogaster
aattggattttta

SEQ ID NO: 568125 - DNA, 13 bp, D. melanogaster
aattggcaaaaac

SEQ ID NO: 568126 - DNA, 13 bp, D. melanogaster
aattggcaaaaca

SEQ ID NO: 568127 - DNA, 13 bp, D. melanogaster
aattggcaaaagg

SEQ ID NO: 568128 - DNA, 13 bp, D. melanogaster
aattggcaaacaa

SEQ ID NO: 568129 - DNA, 14 bp, D. melanogaster
aattggcaaacaaa

SEQ ID NO: 568130 - DNA, 13 bp, D. melanogaster
aattggcaaacat

SEQ ID NO: 568131 - DNA, 13 bp, D. melanogaster
aattggcaaagtt

SEQ ID NO: 568132 - DNA, 13 bp, D. melanogaster
aattggcaaataa

SEQ ID NO: 568133 - DNA, 14 bp, D. melanogaster
aattggcaaataaa

SEQ ID NO: 568134 - DNA, 13 bp, D. melanogaster
aattggcaactgg

SEQ ID NO: 568135 - DNA, 13 bp, D. melanogaster
aattggcaagaaa

SEQ ID NO: 568136 - DNA, 14 bp, D. melanogaster
aattggcaagaaaa

SEQ ID NO: 568137 - DNA, 13 bp, D. melanogaster
aattggcaaggag

SEQ ID NO: 568138 - DNA, 13 bp, D. melanogaster
aattggcaataaa

SEQ ID NO: 568139 - DNA, 13 bp, D. melanogaster
aattggcaattgg

SEQ ID NO: 568140 - DNA, 14 bp, D. melanogaster
aattggcaattggc

SEQ ID NO: 568141 - DNA, 13 bp, D. melanogaster
aattggcaattta

SEQ ID NO: 568142 - DNA, 13 bp, D. melanogaster
aattggcacaaaa

SEQ ID NO: 568143 - DNA, 13 bp, D. melanogaster
aattggcacattt

SEQ ID NO: 568144 - DNA, 13 bp, D. melanogaster
aattggcagaaaa

SEQ ID NO: 568145 - DNA, 13 bp, D. melanogaster
aattggcagcaaa

SEQ ID NO: 568146 - DNA, 13 bp, D. melanogaster
aattggcagcaca

SEQ ID NO: 568147 - DNA, 13 bp, D. melanogaster
aattggcagccaa

SEQ ID NO: 568148 - DNA, 13 bp, D. melanogaster
aattggcataaat

SEQ ID NO: 568149 - DNA, 13 bp, D. melanogaster
aattggcataatt

SEQ ID NO: 568150 - DNA, 13 bp, D. melanogaster
aattggcattaat

SEQ ID NO: 568151 - DNA, 13 bp, D. melanogaster
aattggcatttaa

SEQ ID NO: 568152 - DNA, 14 bp, D. melanogaster
aattggccaaaact

SEQ ID NO: 568153 - DNA, 13 bp, D. melanogaster
aattggccaaagg

SEQ ID NO: 568154 - DNA, 13 bp, D. melanogaster
aattggccaaata

SEQ ID NO: 568155 - DNA, 13 bp, D. melanogaster
aattggccaactt

SEQ ID NO: 568156 - DNA, 13 bp, D. melanogaster
aattggccaataa

SEQ ID NO: 568157 - DNA, 13 bp, D. melanogaster
aattggccaattg

SEQ ID NO: 568158 - DNA, 13 bp, D. melanogaster
aattggccagcaa

SEQ ID NO: 568159 - DNA, 13 bp, D. melanogaster
aattggccattaa

SEQ ID NO: 568160 - DNA, 13 bp, D. melanogaster
aattggccatttt

SEQ ID NO: 568161 - DNA, 13 bp, D. melanogaster
aattggcccaaaa

SEQ ID NO: 568162 - DNA, 13 bp, D. melanogaster
aattggccgaaaa

SEQ ID NO: 568163 - DNA, 13 bp, D. melanogaster
aattggctaaaaa

SEQ ID NO: 568164 - DNA, 13 bp, D. melanogaster
aattggctaaaat

SEQ ID NO: 568165 - DNA, 14 bp, D. melanogaster
aattggctaatttt

SEQ ID NO: 568166 - DNA, 13 bp, D. melanogaster
aattggctgcaaa

SEQ ID NO: 568167 - DNA, 13 bp, D. melanogaster
aattggcttaaat

SEQ ID NO: 568168 - DNA, 13 bp, D. melanogaster
aattggcttaatt

SEQ ID NO: 568169 - DNA, 13 bp, D. melanogaster
aattggcttattt

SEQ ID NO: 568170 - DNA, 13 bp, D. melanogaster
aattggcttgatt

SEQ ID NO: 568171 - DNA, 14 bp, D. melanogaster
aattggcttgattg

SEQ ID NO: 568172 - DNA, 13 bp, D. melanogaster
aattggctttgct

SEQ ID NO: 568173 - DNA, 13 bp, D. melanogaster
aattggcttttaa

SEQ ID NO: 568174 - DNA, 13 bp, D. melanogaster
aattgggaaacaa

SEQ ID NO: 568175 - DNA, 13 bp, D. melanogaster
aattgggaattgg

SEQ ID NO: 568176 - DNA, 13 bp, D. melanogaster
aattgggcaattt

SEQ ID NO: 568177 - DNA, 13 bp, D. melanogaster
aattgggcagatg

SEQ ID NO: 568178 - DNA, 13 bp, D. melanogaster
aattgggccaaca

SEQ ID NO: 568179 - DNA, 13 bp, D. melanogaster
aattgggcttaaa

SEQ ID NO: 568180 - DNA, 13 bp, D. melanogaster
aattgggctttgt

SEQ ID NO: 568181 - DNA, 13 bp, D. melanogaster
aattggggaaaaa

SEQ ID NO: 568182 - DNA, 13 bp, D. melanogaster
aattgggggaaaa

SEQ ID NO: 568183 - DNA, 13 bp, D. melanogaster
aattgggtaatgt

SEQ ID NO: 568184 - DNA, 13 bp, D. melanogaster
aattgggttttca

SEQ ID NO: 568185 - DNA, 13 bp, D. melanogaster
aattggtaaaaat

SEQ ID NO: 568186 - DNA, 13 bp, D. melanogaster
aattggtaaaaca

SEQ ID NO: 568187 - DNA, 13 bp, D. melanogaster
aattggtaaaata

SEQ ID NO: 568188 - DNA, 13 bp, D. melanogaster
aattggtaaattg

SEQ ID NO: 568189 - DNA, 13 bp, D. melanogaster
aattggtaattgg

SEQ ID NO: 568190 - DNA, 13 bp, D. melanogaster
aattggtatttat

SEQ ID NO: 568191 - DNA, 13 bp, D. melanogaster
aattggtccagtt

SEQ ID NO: 568192 - DNA, 14 bp, D. melanogaster
aattggtggaggcc

SEQ ID NO: 568193 - DNA, 14 bp, D. melanogaster
aattggtgggcaaa

SEQ ID NO: 568194 - DNA, 13 bp, D. melanogaster
aattggttaacaa

SEQ ID NO: 568195 - DNA, 13 bp, D. melanogaster
aattggttaattt

SEQ ID NO: 568196 - DNA, 14 bp, D. melanogaster
aattggttgtattt

SEQ ID NO: 568197 - DNA, 13 bp, D. melanogaster
aattggtttaaaa

SEQ ID NO: 568198 - DNA, 13 bp, D. melanogaster
aattggtttggct

SEQ ID NO: 568199 - DNA, 13 bp, D. melanogaster
aattggttttata

SEQ ID NO: 568200 - DNA, 13 bp, D. melanogaster
aattggttttcaa

SEQ ID NO: 568201 - DNA, 13 bp, D. melanogaster
aattggttttcct

SEQ ID NO: 568202 - DNA, 13 bp, D. melanogaster
aattggttttgaa

SEQ ID NO: 568203 - DNA, 13 bp, D. melanogaster
aattggtttttaa

SEQ ID NO: 568204 - DNA, 13 bp, D. melanogaster
aattgtaaaacaa

SEQ ID NO: 568205 - DNA, 13 bp, D. melanogaster
aattgtaaaacac

SEQ ID NO: 568206 - DNA, 14 bp, D. melanogaster
aattgtaaaacaca

SEQ ID NO: 568207 - DNA, 13 bp, D. melanogaster
aattgtaaaagtt

SEQ ID NO: 568208 - DNA, 13 bp, D. melanogaster
aattgtaaaattc

SEQ ID NO: 568209 - DNA, 13 bp, D. melanogaster
aattgtaaacaaa

SEQ ID NO: 568210 - DNA, 13 bp, D. melanogaster
aattgtaaacatt

SEQ ID NO: 568211 - DNA, 13 bp, D. melanogaster
aattgtaaacttt

SEQ ID NO: 568212 - DNA, 14 bp, D. melanogaster
aattgtaaactttt

SEQ ID NO: 568213 - DNA, 13 bp, D. melanogaster
aattgtaaatcaa

SEQ ID NO: 568214 - DNA, 13 bp, D. melanogaster
aattgtaaatgaa

SEQ ID NO: 568215 - DNA, 13 bp, D. melanogaster
aattgtaaatgca

SEQ ID NO: 568216 - DNA, 13 bp, D. melanogaster
aattgtaaatgta

SEQ ID NO: 568217 - DNA, 13 bp, D. melanogaster
aattgtaaatttc

SEQ ID NO: 568218 - DNA, 13 bp, D. melanogaster
aattgtaaccaaa

SEQ ID NO: 568219 - DNA, 13 bp, D. melanogaster
aattgtaactttt

SEQ ID NO: 568220 - DNA, 13 bp, D. melanogaster
aattgtaataaca

SEQ ID NO: 568221 - DNA, 13 bp, D. melanogaster
aattgtaatacaa

SEQ ID NO: 568222 - DNA, 13 bp, D. melanogaster
aattgtaatcaaa

SEQ ID NO: 568223 - DNA, 13 bp, D. melanogaster
aattgtaatgaaa

SEQ ID NO: 568224 - DNA, 13 bp, D. melanogaster
aattgtaatgcag

SEQ ID NO: 568225 - DNA, 13 bp, D. melanogaster
aattgtaattcaa

SEQ ID NO: 568226 - DNA, 14 bp, D. melanogaster
aattgtaattgaaa

SEQ ID NO: 568227 - DNA, 14 bp, D. melanogaster
aattgtaattgtaa

SEQ ID NO: 568228 - DNA, 13 bp, D. melanogaster
aattgtaattgtg

SEQ ID NO: 568229 - DNA, 13 bp, D. melanogaster
aattgtaatttac

SEQ ID NO: 568230 - DNA, 13 bp, D. melanogaster
aattgtaatttca

SEQ ID NO: 568231 - DNA, 13 bp, D. melanogaster
aattgtaatttct

SEQ ID NO: 568232 - DNA, 13 bp, D. melanogaster
aattgtaatttga

SEQ ID NO: 568233 - DNA, 13 bp, D. melanogaster
aattgtaatttgt

SEQ ID NO: 568234 - DNA, 13 bp, D. melanogaster
aattgtacaaact

SEQ ID NO: 568235 - DNA, 13 bp, D. melanogaster
aattgtacaaatt

SEQ ID NO: 568236 - DNA, 13 bp, D. melanogaster
aattgtacaacaa

SEQ ID NO: 568237 - DNA, 13 bp, D. melanogaster
aattgtacaatta

SEQ ID NO: 568238 - DNA, 13 bp, D. melanogaster
aattgtacatttt

SEQ ID NO: 568239 - DNA, 13 bp, D. melanogaster
aattgtagaattt

SEQ ID NO: 568240 - DNA, 13 bp, D. melanogaster
aattgtagatatt

SEQ ID NO: 568241 - DNA, 14 bp, D. melanogaster
aattgtagatattg

SEQ ID NO: 568242 - DNA, 13 bp, D. melanogaster
aattgtagcaatt

SEQ ID NO: 568243 - DNA, 13 bp, D. melanogaster
aattgtagttaaa

SEQ ID NO: 568244 - DNA, 13 bp, D. melanogaster
aattgtataagaa

SEQ ID NO: 568245 - DNA, 13 bp, D. melanogaster
aattgtatattgg

SEQ ID NO: 568246 - DNA, 13 bp, D. melanogaster
aattgtatatttg

SEQ ID NO: 568247 - DNA, 13 bp, D. melanogaster
aattgtatctgtg

SEQ ID NO: 568248 - DNA, 13 bp, D. melanogaster
aattgtatgaaat

SEQ ID NO: 568249 - DNA, 13 bp, D. melanogaster
aattgtatgcaaa

SEQ ID NO: 568250 - DNA, 13 bp, D. melanogaster
aattgtatgcata

SEQ ID NO: 568251 - DNA, 13 bp, D. melanogaster
aattgtatgcatt

SEQ ID NO: 568252 - DNA, 13 bp, D. melanogaster
aattgtatgtaca

SEQ ID NO: 568253 - DNA, 13 bp, D. melanogaster
aattgtatgtatt

SEQ ID NO: 568254 - DNA, 13 bp, D. melanogaster
aattgtattagtt

SEQ ID NO: 568255 - DNA, 13 bp, D. melanogaster
aattgtattgaat

SEQ ID NO: 568256 - DNA, 14 bp, D. melanogaster
aattgtattgaatt

SEQ ID NO: 568257 - DNA, 13 bp, D. melanogaster
aattgtattggta

SEQ ID NO: 568258 - DNA, 13 bp, D. melanogaster
aattgtatttact

SEQ ID NO: 568259 - DNA, 13 bp, D. melanogaster
aattgtatttcat

SEQ ID NO: 568260 - DNA, 14 bp, D. melanogaster
aattgtatttcatt

SEQ ID NO: 568261 - DNA, 13 bp, D. melanogaster
aattgtatttgaa

SEQ ID NO: 568262 - DNA, 13 bp, D. melanogaster
aattgtatttgct

SEQ ID NO: 568263 - DNA, 14 bp, D. melanogaster
aattgtatttgctt

SEQ ID NO: 568264 - DNA, 13 bp, D. melanogaster
aattgtattttgg

SEQ ID NO: 568265 - DNA, 13 bp, D. melanogaster
aattgtcaaaaaa

SEQ ID NO: 568266 - DNA, 13 bp, D. melanogaster
aattgtcaaacaa

SEQ ID NO: 568267 - DNA, 13 bp, D. melanogaster
aattgtcaataaa

SEQ ID NO: 568268 - DNA, 13 bp, D. melanogaster
aattgtcaataat

SEQ ID NO: 568269 - DNA, 13 bp, D. melanogaster
aattgtcaattta

SEQ ID NO: 568270 - DNA, 13 bp, D. melanogaster
aattgtcactata

SEQ ID NO: 568271 - DNA, 13 bp, D. melanogaster
aattgtcagcttg

SEQ ID NO: 568272 - DNA, 13 bp, D. melanogaster
aattgtccaaaaa

SEQ ID NO: 568273 - DNA, 13 bp, D. melanogaster
aattgtccaaatt

SEQ ID NO: 568274 - DNA, 14 bp, D. melanogaster
aattgtcccttgcc

SEQ ID NO: 568275 - DNA, 13 bp, D. melanogaster
aattgtcgtccta

SEQ ID NO: 568276 - DNA, 13 bp, D. melanogaster
aattgtcgtgtgc

SEQ ID NO: 568277 - DNA, 13 bp, D. melanogaster
aattgtctgcact

SEQ ID NO: 568278 - DNA, 13 bp, D. melanogaster
aattgtcttcatt

SEQ ID NO: 568279 - DNA, 13 bp, D. melanogaster
aattgtctttaat

SEQ ID NO: 568280 - DNA, 13 bp, D. melanogaster
aattgtgaaaaat

SEQ ID NO: 568281 - DNA, 13 bp, D. melanogaster
aattgtgaaaaca

SEQ ID NO: 568282 - DNA, 13 bp, D. melanogaster
aattgtgaaaagc

SEQ ID NO: 568283 - DNA, 13 bp, D. melanogaster
aattgtgaaaata

SEQ ID NO: 568284 - DNA, 13 bp, D. melanogaster
aattgtgaaaatt

SEQ ID NO: 568285 - DNA, 13 bp, D. melanogaster
aattgtgaaatta

SEQ ID NO: 568286 - DNA, 13 bp, D. melanogaster
aattgtgaaattg

SEQ ID NO: 568287 - DNA, 13 bp, D. melanogaster
aattgtgaattat

SEQ ID NO: 568288 - DNA, 13 bp, D. melanogaster
aattgtgattaat

SEQ ID NO: 568289 - DNA, 13 bp, D. melanogaster
aattgtgatttaa

SEQ ID NO: 568290 - DNA, 13 bp, D. melanogaster
aattgtgatttat

SEQ ID NO: 568291 - DNA, 14 bp, D. melanogaster
aattgtgatttttc

SEQ ID NO: 568292 - DNA, 13 bp, D. melanogaster
aattgtgcaaaaa

SEQ ID NO: 568293 - DNA, 13 bp, D. melanogaster
aattgtgcaaatt

SEQ ID NO: 568294 - DNA, 13 bp, D. melanogaster
aattgtgcatatt

SEQ ID NO: 568295 - DNA, 13 bp, D. melanogaster
aattgtgcgaaat

SEQ ID NO: 568296 - DNA, 13 bp, D. melanogaster
aattgtgctaaat

SEQ ID NO: 568297 - DNA, 13 bp, D. melanogaster
aattgtgcttatt

SEQ ID NO: 568298 - DNA, 13 bp, D. melanogaster
aattgtggaaaaa

SEQ ID NO: 568299 - DNA, 13 bp, D. melanogaster
aattgtggaaaag

SEQ ID NO: 568300 - DNA, 13 bp, D. melanogaster
aattgtggaaatg

SEQ ID NO: 568301 - DNA, 13 bp, D. melanogaster
aattgtggaatta

SEQ ID NO: 568302 - DNA, 13 bp, D. melanogaster
aattgtggcaaaa

SEQ ID NO: 568303 - DNA, 13 bp, D. melanogaster
aattgtggcaaat

SEQ ID NO: 568304 - DNA, 13 bp, D. melanogaster
aattgtggccatt

SEQ ID NO: 568305 - DNA, 13 bp, D. melanogaster
aattgtgggaaaa

SEQ ID NO: 568306 - DNA, 13 bp, D. melanogaster
aattgtgggcgtg

SEQ ID NO: 568307 - DNA, 13 bp, D. melanogaster
aattgtggtgttg

SEQ ID NO: 568308 - DNA, 13 bp, D. melanogaster
aattgtgtaaaat

SEQ ID NO: 568309 - DNA, 13 bp, D. melanogaster
aattgtgtaaaca

SEQ ID NO: 568310 - DNA, 13 bp, D. melanogaster
aattgtgtaaata

SEQ ID NO: 568311 - DNA, 14 bp, D. melanogaster
aattgtgtaaatat

SEQ ID NO: 568312 - DNA, 13 bp, D. melanogaster
aattgtgtaaatt

SEQ ID NO: 568313 - DNA, 13 bp, D. melanogaster
aattgtgtaattg

SEQ ID NO: 568314 - DNA, 13 bp, D. melanogaster
aattgtgtgaaaa

SEQ ID NO: 568315 - DNA, 13 bp, D. melanogaster
aattgtgtgcaaa

SEQ ID NO: 568316 - DNA, 14 bp, D. melanogaster
aattgtgtgccaaa

SEQ ID NO: 568317 - DNA, 13 bp, D. melanogaster
aattgtgtggaaa

SEQ ID NO: 568318 - DNA, 13 bp, D. melanogaster
aattgtgtgtatt

SEQ ID NO: 568319 - DNA, 13 bp, D. melanogaster
aattgtgtgtgaa

SEQ ID NO: 568320 - DNA, 13 bp, D. melanogaster
aattgtgttaaaa

SEQ ID NO: 568321 - DNA, 13 bp, D. melanogaster
aattgtgttaatt

SEQ ID NO: 568322 - DNA, 13 bp, D. melanogaster
aattgtgtttaat

SEQ ID NO: 568323 - DNA, 13 bp, D. melanogaster
aattgtgtttgaa

SEQ ID NO: 568324 - DNA, 13 bp, D. melanogaster
aattgtgtttggt

SEQ ID NO: 568325 - DNA, 14 bp, D. melanogaster
aattgtgttttgta

SEQ ID NO: 568326 - DNA, 13 bp, D. melanogaster
aattgttaaacaa

SEQ ID NO: 568327 - DNA, 13 bp, D. melanogaster
aattgttaacttt

SEQ ID NO: 568328 - DNA, 13 bp, D. melanogaster
aattgttaagtaa

SEQ ID NO: 568329 - DNA, 14 bp, D. melanogaster
aattgttaattgaa

SEQ ID NO: 568330 - DNA, 13 bp, D. melanogaster
aattgttagtcca

SEQ ID NO: 568331 - DNA, 13 bp, D. melanogaster
aattgttagttgt

SEQ ID NO: 568332 - DNA, 13 bp, D. melanogaster
aattgttatactt

SEQ ID NO: 568333 - DNA, 13 bp, D. melanogaster
aattgttatgaaa

SEQ ID NO: 568334 - DNA, 13 bp, D. melanogaster
aattgttatgatt

SEQ ID NO: 568335 - DNA, 13 bp, D. melanogaster
aattgttatgcaa

SEQ ID NO: 568336 - DNA, 14 bp, D. melanogaster
aattgttatgcaaa

SEQ ID NO: 568337 - DNA, 13 bp, D. melanogaster
aattgttatgtaa

SEQ ID NO: 568338 - DNA, 13 bp, D. melanogaster
aattgttattgca

SEQ ID NO: 568339 - DNA, 13 bp, D. melanogaster
aattgttatttca

SEQ ID NO: 568340 - DNA, 13 bp, D. melanogaster
aattgttattttc

SEQ ID NO: 568341 - DNA, 13 bp, D. melanogaster
aattgttcaaaaa

SEQ ID NO: 568342 - DNA, 14 bp, D. melanogaster
aattgttcaaaaat

SEQ ID NO: 568343 - DNA, 13 bp, D. melanogaster
aattgttcaaaag

SEQ ID NO: 568344 - DNA, 14 bp, D. melanogaster
aattgttcaaaagt

SEQ ID NO: 568345 - DNA, 13 bp, D. melanogaster
aattgttcaaaat

SEQ ID NO: 568346 - DNA, 13 bp, D. melanogaster
aattgttcaaatt

SEQ ID NO: 568347 - DNA, 13 bp, D. melanogaster
aattgttcaataa

SEQ ID NO: 568348 - DNA, 13 bp, D. melanogaster
aattgttcaattt

SEQ ID NO: 568349 - DNA, 13 bp, D. melanogaster
aattgttcacttt

SEQ ID NO: 568350 - DNA, 13 bp, D. melanogaster
aattgttcataaa

SEQ ID NO: 568351 - DNA, 13 bp, D. melanogaster
aattgttcatttt

SEQ ID NO: 568352 - DNA, 14 bp, D. melanogaster
aattgttgaaaaat

SEQ ID NO: 568353 - DNA, 13 bp, D. melanogaster
aattgttgaaata

SEQ ID NO: 568354 - DNA, 13 bp, D. melanogaster
aattgttgaatta

SEQ ID NO: 568355 - DNA, 14 bp, D. melanogaster
aattgttgaattaa

SEQ ID NO: 568356 - DNA, 13 bp, D. melanogaster
aattgttgatatt

SEQ ID NO: 568357 - DNA, 13 bp, D. melanogaster
aattgttgcactt

SEQ ID NO: 568358 - DNA, 13 bp, D. melanogaster
aattgttgcagca

SEQ ID NO: 568359 - DNA, 13 bp, D. melanogaster
aattgttgcagct

SEQ ID NO: 568360 - DNA, 13 bp, D. melanogaster
aattgttgcatat

SEQ ID NO: 568361 - DNA, 13 bp, D. melanogaster
aattgttgccaaa

SEQ ID NO: 568362 - DNA, 13 bp, D. melanogaster
aattgttgccaac

SEQ ID NO: 568363 - DNA, 13 bp, D. melanogaster
aattgttgccaca

SEQ ID NO: 568364 - DNA, 13 bp, D. melanogaster
aattgttgcgcaa

SEQ ID NO: 568365 - DNA, 13 bp, D. melanogaster
aattgttgctatt

SEQ ID NO: 568366 - DNA, 13 bp, D. melanogaster
aattgttgctgca

SEQ ID NO: 568367 - DNA, 13 bp, D. melanogaster
aattgttgctgct

SEQ ID NO: 568368 - DNA, 13 bp, D. melanogaster
aattgttgctttt

SEQ ID NO: 568369 - DNA, 13 bp, D. melanogaster
aattgttggaaaa

SEQ ID NO: 568370 - DNA, 13 bp, D. melanogaster
aattgttggaaat

SEQ ID NO: 568371 - DNA, 13 bp, D. melanogaster
aattgttggcaat

SEQ ID NO: 568372 - DNA, 13 bp, D. melanogaster
aattgttggcagc

SEQ ID NO: 568373 - DNA, 13 bp, D. melanogaster
aattgttggcatt

SEQ ID NO: 568374 - DNA, 13 bp, D. melanogaster
aattgttggccaa

SEQ ID NO: 568375 - DNA, 13 bp, D. melanogaster
aattgttgggaaa

SEQ ID NO: 568376 - DNA, 13 bp, D. melanogaster
aattgttgtaaaa

SEQ ID NO: 568377 - DNA, 13 bp, D. melanogaster
aattgttgtaaat

SEQ ID NO: 568378 - DNA, 13 bp, D. melanogaster
aattgttgtaatt

SEQ ID NO: 568379 - DNA, 13 bp, D. melanogaster
aattgttgtatat

SEQ ID NO: 568380 - DNA, 13 bp, D. melanogaster
aattgttgtatta

SEQ ID NO: 568381 - DNA, 13 bp, D. melanogaster
aattgttgttaaa

SEQ ID NO: 568382 - DNA, 13 bp, D. melanogaster
aattgttgttctt

SEQ ID NO: 568383 - DNA, 13 bp, D. melanogaster
aattgttgttgct

SEQ ID NO: 568384 - DNA, 14 bp, D. melanogaster
aattgttgttgctg

SEQ ID NO: 568385 - DNA, 14 bp, D. melanogaster
aattgtttaaaatg

SEQ ID NO: 568386 - DNA, 13 bp, D. melanogaster
aattgtttaaaca

SEQ ID NO: 568387 - DNA, 13 bp, D. melanogaster
aattgtttaaatc

SEQ ID NO: 568388 - DNA, 13 bp, D. melanogaster
aattgtttaagca

SEQ ID NO: 568389 - DNA, 13 bp, D. melanogaster
aattgtttaagta

SEQ ID NO: 568390 - DNA, 13 bp, D. melanogaster
aattgtttaagtg

SEQ ID NO: 568391 - DNA, 13 bp, D. melanogaster
aattgtttaattg

SEQ ID NO: 568392 - DNA, 13 bp, D. melanogaster
aattgtttacaaa

SEQ ID NO: 568393 - DNA, 13 bp, D. melanogaster
aattgtttacagc

SEQ ID NO: 568394 - DNA, 13 bp, D. melanogaster
aattgtttaccaa

SEQ ID NO: 568395 - DNA, 13 bp, D. melanogaster
aattgtttacctt

SEQ ID NO: 568396 - DNA, 13 bp, D. melanogaster
aattgtttacttt

SEQ ID NO: 568397 - DNA, 13 bp, D. melanogaster
aattgtttagata

SEQ ID NO: 568398 - DNA, 13 bp, D. melanogaster
aattgtttagtta

SEQ ID NO: 568399 - DNA, 13 bp, D. melanogaster
aattgtttatgct

SEQ ID NO: 568400 - DNA, 13 bp, D. melanogaster
aattgtttattgc

SEQ ID NO: 568401 - DNA, 14 bp, D. melanogaster
aattgtttattttc

SEQ ID NO: 568402 - DNA, 13 bp, D. melanogaster
aattgtttcatat

SEQ ID NO: 568403 - DNA, 13 bp, D. melanogaster
aattgtttcgatt

SEQ ID NO: 568404 - DNA, 14 bp, D. melanogaster
aattgtttgaaatt

SEQ ID NO: 568405 - DNA, 13 bp, D. melanogaster
aattgtttgagaa

SEQ ID NO: 568406 - DNA, 13 bp, D. melanogaster
aattgtttgagtt

SEQ ID NO: 568407 - DNA, 13 bp, D. melanogaster
aattgtttgataa

SEQ ID NO: 568408 - DNA, 14 bp, D. melanogaster
aattgtttgataat

SEQ ID NO: 568409 - DNA, 13 bp, D. melanogaster
aattgtttgatat

SEQ ID NO: 568410 - DNA, 13 bp, D. melanogaster
aattgtttgcaat

SEQ ID NO: 568411 - DNA, 13 bp, D. melanogaster
aattgtttgcaca

SEQ ID NO: 568412 - DNA, 13 bp, D. melanogaster
aattgtttgccat

SEQ ID NO: 568413 - DNA, 14 bp, D. melanogaster
aattgtttgccatt

SEQ ID NO: 568414 - DNA, 13 bp, D. melanogaster
aattgtttgccgc

SEQ ID NO: 568415 - DNA, 13 bp, D. melanogaster
aattgtttgcctg

SEQ ID NO: 568416 - DNA, 13 bp, D. melanogaster
aattgtttgcctt

SEQ ID NO: 568417 - DNA, 13 bp, D. melanogaster
aattgtttgcgtt

SEQ ID NO: 568418 - DNA, 13 bp, D. melanogaster
aattgtttgctta

SEQ ID NO: 568419 - DNA, 14 bp, D. melanogaster
aattgtttgctttt

SEQ ID NO: 568420 - DNA, 13 bp, D. melanogaster
aattgtttggaaa

SEQ ID NO: 568421 - DNA, 13 bp, D. melanogaster
aattgtttggatt

SEQ ID NO: 568422 - DNA, 13 bp, D. melanogaster
aattgtttggcaa

SEQ ID NO: 568423 - DNA, 13 bp, D. melanogaster
aattgtttgtcgt

SEQ ID NO: 568424 - DNA, 13 bp, D. melanogaster
aattgtttgtgaa

SEQ ID NO: 568425 - DNA, 13 bp, D. melanogaster
aattgtttgttaa

SEQ ID NO: 568426 - DNA, 14 bp, D. melanogaster
aattgtttgttaaa

SEQ ID NO: 568427 - DNA, 13 bp, D. melanogaster
aattgtttgttga

SEQ ID NO: 568428 - DNA, 14 bp, D. melanogaster
aattgttttaaatg

SEQ ID NO: 568429 - DNA, 13 bp, D. melanogaster
aattgttttagat

SEQ ID NO: 568430 - DNA, 13 bp, D. melanogaster
aattgttttcaac

SEQ ID NO: 568431 - DNA, 13 bp, D. melanogaster
aattgttttccat

SEQ ID NO: 568432 - DNA, 14 bp, D. melanogaster
aattgttttccatt

SEQ ID NO: 568433 - DNA, 13 bp, D. melanogaster
aattgttttcgat

SEQ ID NO: 568434 - DNA, 14 bp, D. melanogaster
aattgttttcgatt

SEQ ID NO: 568435 - DNA, 13 bp, D. melanogaster
aattgttttcggt

SEQ ID NO: 568436 - DNA, 14 bp, D. melanogaster
aattgttttcgttt

SEQ ID NO: 568437 - DNA, 13 bp, D. melanogaster
aattgttttctct

SEQ ID NO: 568438 - DNA, 13 bp, D. melanogaster
aattgttttgata

SEQ ID NO: 568439 - DNA, 13 bp, D. melanogaster
aattgttttgctt

SEQ ID NO: 568440 - DNA, 13 bp, D. melanogaster
aattgttttggca

SEQ ID NO: 568441 - DNA, 13 bp, D. melanogaster
aattgttttgtct

SEQ ID NO: 568442 - DNA, 13 bp, D. melanogaster
aattgtttttaag

SEQ ID NO: 568443 - DNA, 13 bp, D. melanogaster
aattgtttttcaa

SEQ ID NO: 568444 - DNA, 13 bp, D. melanogaster
aattgtttttcct

SEQ ID NO: 568445 - DNA, 14 bp, D. melanogaster
aattgtttttcctc

SEQ ID NO: 568446 - DNA, 13 bp, D. melanogaster
aattgtttttgaa

SEQ ID NO: 568447 - DNA, 13 bp, D. melanogaster
aattgtttttgct

SEQ ID NO: 568448 - DNA, 13 bp, D. melanogaster
aatttaaaaagct

SEQ ID NO: 568449 - DNA, 14 bp, D. melanogaster
aatttaaaaatagc

SEQ ID NO: 568450 - DNA, 13 bp, D. melanogaster
aatttaaaaatgg

SEQ ID NO: 568451 - DNA, 13 bp, D. melanogaster
aatttaaaacgct

SEQ ID NO: 568452 - DNA, 13 bp, D. melanogaster
aatttaaaacgtt

SEQ ID NO: 568453 - DNA, 13 bp, D. melanogaster
aatttaaaagcta

SEQ ID NO: 568454 - DNA, 13 bp, D. melanogaster
aatttaaaagtag

SEQ ID NO: 568455 - DNA, 13 bp, D. melanogaster
aatttaaaatcga

SEQ ID NO: 568456 - DNA, 13 bp, D. melanogaster
aatttaaaatgct

SEQ ID NO: 568457 - DNA, 13 bp, D. melanogaster
aatttaaaatggt

SEQ ID NO: 568458 - DNA, 13 bp, D. melanogaster
aatttaaaattgc

SEQ ID NO: 568459 - DNA, 13 bp, D. melanogaster
aatttaaacagct

SEQ ID NO: 568460 - DNA, 13 bp, D. melanogaster
aatttaaacattg

SEQ ID NO: 568461 - DNA, 13 bp, D. melanogaster
aatttaaaccaat

SEQ ID NO: 568462 - DNA, 13 bp, D. melanogaster
aatttaaacgaaa

SEQ ID NO: 568463 - DNA, 14 bp, D. melanogaster
aatttaaacgaaat

SEQ ID NO: 568464 - DNA, 13 bp, D. melanogaster
aatttaaacgaat

SEQ ID NO: 568465 - DNA, 13 bp, D. melanogaster
aatttaaacgcaa

SEQ ID NO: 568466 - DNA, 13 bp, D. melanogaster
aatttaaacgttt

SEQ ID NO: 568467 - DNA, 14 bp, D. melanogaster
aatttaaactcatt

SEQ ID NO: 568468 - DNA, 13 bp, D. melanogaster
aatttaaactttc

SEQ ID NO: 568469 - DNA, 14 bp, D. melanogaster
aatttaaagaaaac

SEQ ID NO: 568470 - DNA, 13 bp, D. melanogaster
aatttaaagaaca

SEQ ID NO: 568471 - DNA, 13 bp, D. melanogaster
aatttaaagaagc

SEQ ID NO: 568472 - DNA, 13 bp, D. melanogaster
aatttaaagaagt

SEQ ID NO: 568473 - DNA, 13 bp, D. melanogaster
aatttaaagaggc

SEQ ID NO: 568474 - DNA, 13 bp, D. melanogaster
aatttaaagcaag

SEQ ID NO: 568475 - DNA, 13 bp, D. melanogaster
aatttaaagcaat

SEQ ID NO: 568476 - DNA, 13 bp, D. melanogaster
aatttaaagcata

SEQ ID NO: 568477 - DNA, 13 bp, D. melanogaster
aatttaaagctaa

SEQ ID NO: 568478 - DNA, 13 bp, D. melanogaster
aatttaaagctca

SEQ ID NO: 568479 - DNA, 13 bp, D. melanogaster
aatttaaagctta

SEQ ID NO: 568480 - DNA, 13 bp, D. melanogaster
aatttaaagtaca

SEQ ID NO: 568481 - DNA, 13 bp, D. melanogaster
aatttaaagtgtt

SEQ ID NO: 568482 - DNA, 13 bp, D. melanogaster
aatttaaagttgt

SEQ ID NO: 568483 - DNA, 13 bp, D. melanogaster
aatttaaatagca

SEQ ID NO: 568484 - DNA, 14 bp, D. melanogaster
aatttaaatcactt

SEQ ID NO: 568485 - DNA, 13 bp, D. melanogaster
aatttaaatctga

SEQ ID NO: 568486 - DNA, 13 bp, D. melanogaster
aatttaaatgact

SEQ ID NO: 568487 - DNA, 13 bp, D. melanogaster
aatttaaatgaga

SEQ ID NO: 568488 - DNA, 13 bp, D. melanogaster
aatttaaatgcaa

SEQ ID NO: 568489 - DNA, 14 bp, D. melanogaster
aatttaaatgcaaa

SEQ ID NO: 568490 - DNA, 13 bp, D. melanogaster
aatttaaatgcag

SEQ ID NO: 568491 - DNA, 13 bp, D. melanogaster
aatttaaatggca

SEQ ID NO: 568492 - DNA, 13 bp, D. melanogaster
aatttaaatggtt

SEQ ID NO: 568493 - DNA, 13 bp, D. melanogaster
aatttaaatgtga

SEQ ID NO: 568494 - DNA, 14 bp, D. melanogaster
aatttaaattatcc

SEQ ID NO: 568495 - DNA, 13 bp, D. melanogaster
aatttaaattcct

SEQ ID NO: 568496 - DNA, 13 bp, D. melanogaster
aatttaaattgca

SEQ ID NO: 568497 - DNA, 13 bp, D. melanogaster
aatttaaattgcc

SEQ ID NO: 568498 - DNA, 13 bp, D. melanogaster
aatttaacaacat

SEQ ID NO: 568499 - DNA, 13 bp, D. melanogaster
aatttaacaagca

SEQ ID NO: 568500 - DNA, 15 bp, D. melanogaster
aatttaacatggaaa

SEQ ID NO: 568501 - DNA, 13 bp, D. melanogaster
aatttaaccaaat

SEQ ID NO: 568502 - DNA, 13 bp, D. melanogaster
aatttaaccattt

SEQ ID NO: 568503 - DNA, 13 bp, D. melanogaster
aatttaactgaaa

SEQ ID NO: 568504 - DNA, 14 bp, D. melanogaster
aatttaactgaaat

SEQ ID NO: 568505 - DNA, 13 bp, D. melanogaster
aatttaactgcaa

SEQ ID NO: 568506 - DNA, 13 bp, D. melanogaster
aatttaagaaagt

SEQ ID NO: 568507 - DNA, 13 bp, D. melanogaster
aatttaagaacat

SEQ ID NO: 568508 - DNA, 13 bp, D. melanogaster
aatttaagataca

SEQ ID NO: 568509 - DNA, 13 bp, D. melanogaster
aatttaagcaaat

SEQ ID NO: 568510 - DNA, 13 bp, D. melanogaster
aatttaagcaatc

SEQ ID NO: 568511 - DNA, 13 bp, D. melanogaster
aatttaagcaatt

SEQ ID NO: 568512 - DNA, 13 bp, D. melanogaster
aatttaagcagaa

SEQ ID NO: 568513 - DNA, 13 bp, D. melanogaster
aatttaagcagtt

SEQ ID NO: 568514 - DNA, 13 bp, D. melanogaster
aatttaagcatta

SEQ ID NO: 568515 - DNA, 14 bp, D. melanogaster
aatttaagcatttt

SEQ ID NO: 568516 - DNA, 13 bp, D. melanogaster
aatttaagcccaa

SEQ ID NO: 568517 - DNA, 13 bp, D. melanogaster
aatttaagctcaa

SEQ ID NO: 568518 - DNA, 13 bp, D. melanogaster
aatttaaggaatt

SEQ ID NO: 568519 - DNA, 13 bp, D. melanogaster
aatttaaggtttt

SEQ ID NO: 568520 - DNA, 13 bp, D. melanogaster
aatttaagtaaac

SEQ ID NO: 568521 - DNA, 13 bp, D. melanogaster
aatttaagtgatg

SEQ ID NO: 568522 - DNA, 13 bp, D. melanogaster
aatttaagtgcat

SEQ ID NO: 568523 - DNA, 13 bp, D. melanogaster
aatttaataaacc

SEQ ID NO: 568524 - DNA, 13 bp, D. melanogaster
aatttaataagct

SEQ ID NO: 568525 - DNA, 13 bp, D. melanogaster
aatttaatagcca

SEQ ID NO: 568526 - DNA, 13 bp, D. melanogaster
aatttaatattcc

SEQ ID NO: 568527 - DNA, 13 bp, D. melanogaster
aatttaatcaact

SEQ ID NO: 568528 - DNA, 13 bp, D. melanogaster
aatttaatcaaga

SEQ ID NO: 568529 - DNA, 13 bp, D. melanogaster
aatttaatcaagc

SEQ ID NO: 568530 - DNA, 13 bp, D. melanogaster
aatttaatcaagt

SEQ ID NO: 568531 - DNA, 13 bp, D. melanogaster
aatttaatcacaa

SEQ ID NO: 568532 - DNA, 13 bp, D. melanogaster
aatttaatccaat

SEQ ID NO: 568533 - DNA, 13 bp, D. melanogaster
aatttaatccttt

SEQ ID NO: 568534 - DNA, 13 bp, D. melanogaster
aatttaatcgaaa

SEQ ID NO: 568535 - DNA, 13 bp, D. melanogaster
aatttaatgactt

SEQ ID NO: 568536 - DNA, 14 bp, D. melanogaster
aatttaatgcaaat

SEQ ID NO: 568537 - DNA, 13 bp, D. melanogaster
aatttaatgcatt

SEQ ID NO: 568538 - DNA, 13 bp, D. melanogaster
aatttaatgccaa

SEQ ID NO: 568539 - DNA, 13 bp, D. melanogaster
aatttaatgccca

SEQ ID NO: 568540 - DNA, 13 bp, D. melanogaster
aatttaatgcgca

SEQ ID NO: 568541 - DNA, 13 bp, D. melanogaster
aatttaatgcgtt

SEQ ID NO: 568542 - DNA, 13 bp, D. melanogaster
aatttaatggaat

SEQ ID NO: 568543 - DNA, 13 bp, D. melanogaster
aatttaatggatt

SEQ ID NO: 568544 - DNA, 13 bp, D. melanogaster
aatttaatggctt

SEQ ID NO: 568545 - DNA, 13 bp, D. melanogaster
aatttaattacca

SEQ ID NO: 568546 - DNA, 13 bp, D. melanogaster
aatttaattacga

SEQ ID NO: 568547 - DNA, 13 bp, D. melanogaster
aatttaattagac

SEQ ID NO: 568548 - DNA, 14 bp, D. melanogaster
aatttaattagtct

SEQ ID NO: 568549 - DNA, 13 bp, D. melanogaster
aatttaattcaag

SEQ ID NO: 568550 - DNA, 14 bp, D. melanogaster
aatttaattcactt

SEQ ID NO: 568551 - DNA, 13 bp, D. melanogaster
aatttaattcgaa

SEQ ID NO: 568552 - DNA, 13 bp, D. melanogaster
aatttaattgagc

SEQ ID NO: 568553 - DNA, 14 bp, D. melanogaster
aatttaattgcaaa

SEQ ID NO: 568554 - DNA, 13 bp, D. melanogaster
aatttaattgcac

SEQ ID NO: 568555 - DNA, 13 bp, D. melanogaster
aatttaattgcga

SEQ ID NO: 568556 - DNA, 13 bp, D. melanogaster
aatttaattgtgc

SEQ ID NO: 568557 - DNA, 13 bp, D. melanogaster
aatttaatttcca

SEQ ID NO: 568558 - DNA, 14 bp, D. melanogaster
aatttaatttccaa

SEQ ID NO: 568559 - DNA, 14 bp, D. melanogaster
aatttaatttgcat

SEQ ID NO: 568560 - DNA, 13 bp, D. melanogaster
aatttaatttgcc

SEQ ID NO: 568561 - DNA, 13 bp, D. melanogaster
aatttaatttggc

SEQ ID NO: 568562 - DNA, 14 bp, D. melanogaster
aatttaatttggca

SEQ ID NO: 568563 - DNA, 13 bp, D. melanogaster
aatttaattttcc

SEQ ID NO: 568564 - DNA, 13 bp, D. melanogaster
aatttacaaacat

SEQ ID NO: 568565 - DNA, 13 bp, D. melanogaster
aatttacaaactc

SEQ ID NO: 568566 - DNA, 13 bp, D. melanogaster
aatttacaaatgt

SEQ ID NO: 568567 - DNA, 13 bp, D. melanogaster
aatttacaactga

SEQ ID NO: 568568 - DNA, 13 bp, D. melanogaster
aatttacaagaaa

SEQ ID NO: 568569 - DNA, 13 bp, D. melanogaster
aatttacaagcca

SEQ ID NO: 568570 - DNA, 13 bp, D. melanogaster
aatttacaatact

SEQ ID NO: 568571 - DNA, 13 bp, D. melanogaster
aatttacaatgca

SEQ ID NO: 568572 - DNA, 13 bp, D. melanogaster
aatttacaatttc

SEQ ID NO: 568573 - DNA, 13 bp, D. melanogaster
aatttacacaatt

SEQ ID NO: 568574 - DNA, 14 bp, D. melanogaster
aatttacacatttt

SEQ ID NO: 568575 - DNA, 13 bp, D. melanogaster
aatttacagagaa

SEQ ID NO: 568576 - DNA, 14 bp, D. melanogaster
aatttacagagaaa

SEQ ID NO: 568577 - DNA, 13 bp, D. melanogaster
aatttacagcatt

SEQ ID NO: 568578 - DNA, 13 bp, D. melanogaster
aatttacagtact

SEQ ID NO: 568579 - DNA, 13 bp, D. melanogaster
aatttacataaca

SEQ ID NO: 568580 - DNA, 14 bp, D. melanogaster
aatttacatacata

SEQ ID NO: 568581 - DNA, 14 bp, D. melanogaster
aatttacatatgta

SEQ ID NO: 568582 - DNA, 13 bp, D. melanogaster
aatttacattcaa

SEQ ID NO: 568583 - DNA, 13 bp, D. melanogaster
aatttacattcat

SEQ ID NO: 568584 - DNA, 14 bp, D. melanogaster
aatttacatttaca

SEQ ID NO: 568585 - DNA, 13 bp, D. melanogaster
aatttacatttct

SEQ ID NO: 568586 - DNA, 14 bp, D. melanogaster
aatttacatttttg

SEQ ID NO: 568587 - DNA, 13 bp, D. melanogaster
aatttaccaacta

SEQ ID NO: 568588 - DNA, 14 bp, D. melanogaster
aatttaccaactag

SEQ ID NO: 568589 - DNA, 13 bp, D. melanogaster
aatttaccacaaa

SEQ ID NO: 568590 - DNA, 13 bp, D. melanogaster
aatttaccattta

SEQ ID NO: 568591 - DNA, 13 bp, D. melanogaster
aatttacccaaaa

SEQ ID NO: 568592 - DNA, 13 bp, D. melanogaster
aatttacctattt

SEQ ID NO: 568593 - DNA, 13 bp, D. melanogaster
aatttaccttaaa

SEQ ID NO: 568594 - DNA, 13 bp, D. melanogaster
aatttacgatttt

SEQ ID NO: 568595 - DNA, 13 bp, D. melanogaster
aatttacgcattt

SEQ ID NO: 568596 - DNA, 13 bp, D. melanogaster
aatttacgctgaa

SEQ ID NO: 568597 - DNA, 13 bp, D. melanogaster
aatttactcattt

SEQ ID NO: 568598 - DNA, 13 bp, D. melanogaster
aatttactgccca

SEQ ID NO: 568599 - DNA, 14 bp, D. melanogaster
aatttacttgaaat

SEQ ID NO: 568600 - DNA, 13 bp, D. melanogaster
aatttacttttgc

SEQ ID NO: 568601 - DNA, 13 bp, D. melanogaster
aatttagaaacaa

SEQ ID NO: 568602 - DNA, 13 bp, D. melanogaster
aatttagaaattg

SEQ ID NO: 568603 - DNA, 13 bp, D. melanogaster
aatttagaactgg

SEQ ID NO: 568604 - DNA, 14 bp, D. melanogaster
aatttagaagatca

SEQ ID NO: 568605 - DNA, 14 bp, D. melanogaster
aatttagcaaatat

SEQ ID NO: 568606 - DNA, 13 bp, D. melanogaster
aatttagcaacaa

SEQ ID NO: 568607 - DNA, 13 bp, D. melanogaster
aatttagcataaa

SEQ ID NO: 568608 - DNA, 13 bp, D. melanogaster
aatttagctaaaa

SEQ ID NO: 568609 - DNA, 13 bp, D. melanogaster
aatttagcttaat

SEQ ID NO: 568610 - DNA, 13 bp, D. melanogaster
aatttaggcaaaa

SEQ ID NO: 568611 - DNA, 13 bp, D. melanogaster
aatttagtgcaaa

SEQ ID NO: 568612 - DNA, 13 bp, D. melanogaster
aatttagttagtt

SEQ ID NO: 568613 - DNA, 13 bp, D. melanogaster
aatttagtttgaa

SEQ ID NO: 568614 - DNA, 13 bp, D. melanogaster
aatttagtttgga

SEQ ID NO: 568615 - DNA, 13 bp, D. melanogaster
aatttagttttct

SEQ ID NO: 568616 - DNA, 13 bp, D. melanogaster
aatttataagcca

SEQ ID NO: 568617 - DNA, 13 bp, D. melanogaster
aatttataagctt

SEQ ID NO: 568618 - DNA, 13 bp, D. melanogaster
aatttataatgca

SEQ ID NO: 568619 - DNA, 13 bp, D. melanogaster
aatttataattgc

SEQ ID NO: 568620 - DNA, 13 bp, D. melanogaster
aatttatacactt

SEQ ID NO: 568621 - DNA, 13 bp, D. melanogaster
aatttatacattc

SEQ ID NO: 568622 - DNA, 13 bp, D. melanogaster
aatttatagcaaa

SEQ ID NO: 568623 - DNA, 13 bp, D. melanogaster
aatttatagcatt

SEQ ID NO: 568624 - DNA, 13 bp, D. melanogaster
aatttatatgaga

SEQ ID NO: 568625 - DNA, 14 bp, D. melanogaster
aatttatatgcaaa

SEQ ID NO: 568626 - DNA, 13 bp, D. melanogaster
aatttatatgcca

SEQ ID NO: 568627 - DNA, 13 bp, D. melanogaster
aatttatatgtga

SEQ ID NO: 568628 - DNA, 13 bp, D. melanogaster
aatttatcaaaac

SEQ ID NO: 568629 - DNA, 13 bp, D. melanogaster
aatttatcaaagt

SEQ ID NO: 568630 - DNA, 13 bp, D. melanogaster
aatttatcaacat

SEQ ID NO: 568631 - DNA, 13 bp, D. melanogaster
aatttatcacaaa

SEQ ID NO: 568632 - DNA, 13 bp, D. melanogaster
aatttatcacaca

SEQ ID NO: 568633 - DNA, 13 bp, D. melanogaster
aatttatcagaaa

SEQ ID NO: 568634 - DNA, 13 bp, D. melanogaster
aatttatcagaga

SEQ ID NO: 568635 - DNA, 13 bp, D. melanogaster
aatttatcagttt

SEQ ID NO: 568636 - DNA, 13 bp, D. melanogaster
aatttatcgattt

SEQ ID NO: 568637 - DNA, 13 bp, D. melanogaster
aatttatctacat

SEQ ID NO: 568638 - DNA, 13 bp, D. melanogaster
aatttatgaacaa

SEQ ID NO: 568639 - DNA, 13 bp, D. melanogaster
aatttatgacact

SEQ ID NO: 568640 - DNA, 13 bp, D. melanogaster
aatttatgaccaa

SEQ ID NO: 568641 - DNA, 13 bp, D. melanogaster
aatttatgagctg

SEQ ID NO: 568642 - DNA, 13 bp, D. melanogaster
aatttatgagttt

SEQ ID NO: 568643 - DNA, 13 bp, D. melanogaster
aatttatgatttc

SEQ ID NO: 568644 - DNA, 13 bp, D. melanogaster
aatttatgcaaaa

SEQ ID NO: 568645 - DNA, 14 bp, D. melanogaster
aatttatgcaaaat

SEQ ID NO: 568646 - DNA, 13 bp, D. melanogaster
aatttatgcaaat

SEQ ID NO: 568647 - DNA, 14 bp, D. melanogaster
aatttatgcaaatt

SEQ ID NO: 568648 - DNA, 13 bp, D. melanogaster
aatttatgcacga

SEQ ID NO: 568649 - DNA, 13 bp, D. melanogaster
aatttatgcagaa

SEQ ID NO: 568650 - DNA, 13 bp, D. melanogaster
aatttatgcatgt

SEQ ID NO: 568651 - DNA, 13 bp, D. melanogaster
aatttatgcattt

SEQ ID NO: 568652 - DNA, 13 bp, D. melanogaster
aatttatgcgaaa

SEQ ID NO: 568653 - DNA, 14 bp, D. melanogaster
aatttatgcgaaaa

SEQ ID NO: 568654 - DNA, 13 bp, D. melanogaster
aatttatgcgaat

SEQ ID NO: 568655 - DNA, 13 bp, D. melanogaster
aatttatgcgaca

SEQ ID NO: 568656 - DNA, 13 bp, D. melanogaster
aatttatgcgcac

SEQ ID NO: 568657 - DNA, 13 bp, D. melanogaster
aatttatgcgcca

SEQ ID NO: 568658 - DNA, 14 bp, D. melanogaster
aatttatggaaatt

SEQ ID NO: 568659 - DNA, 13 bp, D. melanogaster
aatttatggaatt

SEQ ID NO: 568660 - DNA, 13 bp, D. melanogaster
aatttatggattt

SEQ ID NO: 568661 - DNA, 13 bp, D. melanogaster
aatttatggcaaa

SEQ ID NO: 568662 - DNA, 13 bp, D. melanogaster
aatttatggcagc

SEQ ID NO: 568663 - DNA, 13 bp, D. melanogaster
aatttatggcatt

SEQ ID NO: 568664 - DNA, 14 bp, D. melanogaster
aatttatggcattt

SEQ ID NO: 568665 - DNA, 13 bp, D. melanogaster
aatttatggccaa

SEQ ID NO: 568666 - DNA, 14 bp, D. melanogaster
aatttatggccaac

SEQ ID NO: 568667 - DNA, 13 bp, D. melanogaster
aatttatggctgt

SEQ ID NO: 568668 - DNA, 14 bp, D. melanogaster
aatttatgtacatt

SEQ ID NO: 568669 - DNA, 13 bp, D. melanogaster
aatttatgtactt

SEQ ID NO: 568670 - DNA, 13 bp, D. melanogaster
aatttatgtcttt

SEQ ID NO: 568671 - DNA, 13 bp, D. melanogaster
aatttatgtttag

SEQ ID NO: 568672 - DNA, 13 bp, D. melanogaster
aatttattaacca

SEQ ID NO: 568673 - DNA, 13 bp, D. melanogaster
aatttattaactg

SEQ ID NO: 568674 - DNA, 13 bp, D. melanogaster
aatttattaagca

SEQ ID NO: 568675 - DNA, 13 bp, D. melanogaster
aatttattagcat

SEQ ID NO: 568676 - DNA, 13 bp, D. melanogaster
aatttattagcta

SEQ ID NO: 568677 - DNA, 13 bp, D. melanogaster
aatttattagctt

SEQ ID NO: 568678 - DNA, 13 bp, D. melanogaster
aatttattcacat

SEQ ID NO: 568679 - DNA, 13 bp, D. melanogaster
aatttattccaaa

SEQ ID NO: 568680 - DNA, 14 bp, D. melanogaster
aatttattccaaat

SEQ ID NO: 568681 - DNA, 13 bp, D. melanogaster
aatttattcgaaa

SEQ ID NO: 568682 - DNA, 14 bp, D. melanogaster
aatttattcgaaac

SEQ ID NO: 568683 - DNA, 13 bp, D. melanogaster
aatttattcgcat

SEQ ID NO: 568684 - DNA, 13 bp, D. melanogaster
aatttattcttag

SEQ ID NO: 568685 - DNA, 13 bp, D. melanogaster
aatttattgaact

SEQ ID NO: 568686 - DNA, 13 bp, D. melanogaster
aatttattgacat

SEQ ID NO: 568687 - DNA, 13 bp, D. melanogaster
aatttattgcaaa

SEQ ID NO: 568688 - DNA, 13 bp, D. melanogaster
aatttattgcaca

SEQ ID NO: 568689 - DNA, 13 bp, D. melanogaster
aatttattgcact

SEQ ID NO: 568690 - DNA, 14 bp, D. melanogaster
aatttattgcactt

SEQ ID NO: 568691 - DNA, 13 bp, D. melanogaster
aatttattgcatt

SEQ ID NO: 568692 - DNA, 13 bp, D. melanogaster
aatttattgccca

SEQ ID NO: 568693 - DNA, 13 bp, D. melanogaster
aatttattggatt

SEQ ID NO: 568694 - DNA, 13 bp, D. melanogaster
aatttattggcaa

SEQ ID NO: 568695 - DNA, 13 bp, D. melanogaster
aatttattggcca

SEQ ID NO: 568696 - DNA, 14 bp, D. melanogaster
aatttattggccaa

SEQ ID NO: 568697 - DNA, 13 bp, D. melanogaster
aatttattgttca

SEQ ID NO: 568698 - DNA, 14 bp, D. melanogaster
aatttattgttttc

SEQ ID NO: 568699 - DNA, 14 bp, D. melanogaster
aatttatttaagca

SEQ ID NO: 568700 - DNA, 14 bp, D. melanogaster
aatttatttattgc

SEQ ID NO: 568701 - DNA, 13 bp, D. melanogaster
aatttatttcaag

SEQ ID NO: 568702 - DNA, 14 bp, D. melanogaster
aatttatttcacat

SEQ ID NO: 568703 - DNA, 13 bp, D. melanogaster
aatttatttcagt

SEQ ID NO: 568704 - DNA, 13 bp, D. melanogaster
aatttatttccca

SEQ ID NO: 568705 - DNA, 13 bp, D. melanogaster
aatttatttcctg

SEQ ID NO: 568706 - DNA, 13 bp, D. melanogaster
aatttatttcggt

SEQ ID NO: 568707 - DNA, 13 bp, D. melanogaster
aatttatttgcca

SEQ ID NO: 568708 - DNA, 14 bp, D. melanogaster
aatttatttgcttt

SEQ ID NO: 568709 - DNA, 13 bp, D. melanogaster
aatttatttggcc

SEQ ID NO: 568710 - DNA, 13 bp, D. melanogaster
aatttattttacg

SEQ ID NO: 568711 - DNA, 13 bp, D. melanogaster
aatttattttcac

SEQ ID NO: 568712 - DNA, 13 bp, D. melanogaster
aatttattttgca

SEQ ID NO: 568713 - DNA, 14 bp, D. melanogaster
aatttattttgcat

SEQ ID NO: 568714 - DNA, 13 bp, D. melanogaster
aatttatttttcg

SEQ ID NO: 568715 - DNA, 13 bp, D. melanogaster
aatttcaaaactt

SEQ ID NO: 568716 - DNA, 13 bp, D. melanogaster
aatttcaaaagaa

SEQ ID NO: 568717 - DNA, 13 bp, D. melanogaster
aatttcaaaagat

SEQ ID NO: 568718 - DNA, 13 bp, D. melanogaster
aatttcaaaatct

SEQ ID NO: 568719 - DNA, 14 bp, D. melanogaster
aatttcaaaatcta

SEQ ID NO: 568720 - DNA, 13 bp, D. melanogaster
aatttcaaaatgt

SEQ ID NO: 568721 - DNA, 13 bp, D. melanogaster
aatttcaaacatt

SEQ ID NO: 568722 - DNA, 13 bp, D. melanogaster
aatttcaaagaaa

SEQ ID NO: 568723 - DNA, 13 bp, D. melanogaster
aatttcaaagcaa

SEQ ID NO: 568724 - DNA, 14 bp, D. melanogaster
aatttcaaagcaaa

SEQ ID NO: 568725 - DNA, 13 bp, D. melanogaster
aatttcaaagcca

SEQ ID NO: 568726 - DNA, 13 bp, D. melanogaster
aatttcaaagtaa

SEQ ID NO: 568727 - DNA, 13 bp, D. melanogaster
aatttcaaatcaa

SEQ ID NO: 568728 - DNA, 13 bp, D. melanogaster
aatttcaaatgaa

SEQ ID NO: 568729 - DNA, 14 bp, D. melanogaster
aatttcaaatgaat

SEQ ID NO: 568730 - DNA, 13 bp, D. melanogaster
aatttcaaatgca

SEQ ID NO: 568731 - DNA, 14 bp, D. melanogaster
aatttcaaatgcaa

SEQ ID NO: 568732 - DNA, 14 bp, D. melanogaster
aatttcaaattgaa

SEQ ID NO: 568733 - DNA, 14 bp, D. melanogaster
aatttcaacaaatt

SEQ ID NO: 568734 - DNA, 13 bp, D. melanogaster
aatttcaacaatt

SEQ ID NO: 568735 - DNA, 13 bp, D. melanogaster
aatttcaacagtt

SEQ ID NO: 568736 - DNA, 13 bp, D. melanogaster
aatttcaactacg

SEQ ID NO: 568737 - DNA, 13 bp, D. melanogaster
aatttcaacttaa

SEQ ID NO: 568738 - DNA, 13 bp, D. melanogaster
aatttcaagcaaa

SEQ ID NO: 568739 - DNA, 13 bp, D. melanogaster
aatttcaagcagc

SEQ ID NO: 568740 - DNA, 13 bp, D. melanogaster
aatttcaagcgaa

SEQ ID NO: 568741 - DNA, 13 bp, D. melanogaster
aatttcaagtatt

SEQ ID NO: 568742 - DNA, 13 bp, D. melanogaster
aatttcaagtgca

SEQ ID NO: 568743 - DNA, 13 bp, D. melanogaster
aatttcaagtttc

SEQ ID NO: 568744 - DNA, 14 bp, D. melanogaster
aatttcaagtttcc

SEQ ID NO: 568745 - DNA, 14 bp, D. melanogaster
aatttcaataaatg

SEQ ID NO: 568746 - DNA, 13 bp, D. melanogaster
aatttcaatatca

SEQ ID NO: 568747 - DNA, 13 bp, D. melanogaster
aatttcaatcaat

SEQ ID NO: 568748 - DNA, 14 bp, D. melanogaster
aatttcaatcaatt

SEQ ID NO: 568749 - DNA, 13 bp, D. melanogaster
aatttcaatcgat

SEQ ID NO: 568750 - DNA, 13 bp, D. melanogaster
aatttcaatgaaa

SEQ ID NO: 568751 - DNA, 14 bp, D. melanogaster
aatttcaatgaaat

SEQ ID NO: 568752 - DNA, 13 bp, D. melanogaster
aatttcaatgttt

SEQ ID NO: 568753 - DNA, 13 bp, D. melanogaster
aatttcaattaca

SEQ ID NO: 568754 - DNA, 14 bp, D. melanogaster
aatttcaattacaa

SEQ ID NO: 568755 - DNA, 14 bp, D. melanogaster
aatttcaattcaat

SEQ ID NO: 568756 - DNA, 13 bp, D. melanogaster
aatttcaattcca

SEQ ID NO: 568757 - DNA, 14 bp, D. melanogaster
aatttcaattgaaa

SEQ ID NO: 568758 - DNA, 14 bp, D. melanogaster
aatttcaattgatt

SEQ ID NO: 568759 - DNA, 13 bp, D. melanogaster
aatttcaattgca

SEQ ID NO: 568760 - DNA, 13 bp, D. melanogaster
aatttcaattgta

SEQ ID NO: 568761 - DNA, 13 bp, D. melanogaster
aatttcaattgtt

SEQ ID NO: 568762 - DNA, 13 bp, D. melanogaster
aatttcaatttca

SEQ ID NO: 568763 - DNA, 14 bp, D. melanogaster
aatttcaatttcaa

SEQ ID NO: 568764 - DNA, 14 bp, D. melanogaster
aatttcaatttcat

SEQ ID NO: 568765 - DNA, 13 bp, D. melanogaster
aatttcaatttgc

SEQ ID NO: 568766 - DNA, 14 bp, D. melanogaster
aatttcaatttgct

SEQ ID NO: 568767 - DNA, 14 bp, D. melanogaster
aatttcaatttgtt

SEQ ID NO: 568768 - DNA, 13 bp, D. melanogaster
aatttcacaaaac

SEQ ID NO: 568769 - DNA, 13 bp, D. melanogaster
aatttcacaaatt

SEQ ID NO: 568770 - DNA, 13 bp, D. melanogaster
aatttcacaagaa

SEQ ID NO: 568771 - DNA, 14 bp, D. melanogaster
aatttcacaattgc

SEQ ID NO: 568772 - DNA, 13 bp, D. melanogaster
aatttcacaattt

SEQ ID NO: 568773 - DNA, 13 bp, D. melanogaster
aatttcacacaaa

SEQ ID NO: 568774 - DNA, 13 bp, D. melanogaster
aatttcacacatt

SEQ ID NO: 568775 - DNA, 13 bp, D. melanogaster
aatttcacagcca

SEQ ID NO: 568776 - DNA, 13 bp, D. melanogaster
aatttcacataaa

SEQ ID NO: 568777 - DNA, 14 bp, D. melanogaster
aatttcacataaat

SEQ ID NO: 568778 - DNA, 13 bp, D. melanogaster
aatttcacattca

SEQ ID NO: 568779 - DNA, 13 bp, D. melanogaster
aatttcacattta

SEQ ID NO: 568780 - DNA, 13 bp, D. melanogaster
aatttcacatttc

SEQ ID NO: 568781 - DNA, 13 bp, D. melanogaster
aatttcacccaaa

SEQ ID NO: 568782 - DNA, 13 bp, D. melanogaster
aatttcacccatt

SEQ ID NO: 568783 - DNA, 13 bp, D. melanogaster
aatttcacgattt

SEQ ID NO: 568784 - DNA, 13 bp, D. melanogaster
aatttcacttcat

SEQ ID NO: 568785 - DNA, 13 bp, D. melanogaster
aatttcactttca

SEQ ID NO: 568786 - DNA, 14 bp, D. melanogaster
aatttcactttcaa

SEQ ID NO: 568787 - DNA, 13 bp, D. melanogaster
aatttcactttga

SEQ ID NO: 568788 - DNA, 13 bp, D. melanogaster
aatttcactttta

SEQ ID NO: 568789 - DNA, 13 bp, D. melanogaster
aatttcagcattt

SEQ ID NO: 568790 - DNA, 13 bp, D. melanogaster
aatttcagctgct

SEQ ID NO: 568791 - DNA, 13 bp, D. melanogaster
aatttcagcttaa

SEQ ID NO: 568792 - DNA, 13 bp, D. melanogaster
aatttcagtattt

SEQ ID NO: 568793 - DNA, 13 bp, D. melanogaster
aatttcagttgca

SEQ ID NO: 568794 - DNA, 13 bp, D. melanogaster
aatttcataatca

SEQ ID NO: 568795 - DNA, 13 bp, D. melanogaster
aatttcatacaaa

SEQ ID NO: 568796 - DNA, 13 bp, D. melanogaster
aatttcatatcga

SEQ ID NO: 568797 - DNA, 13 bp, D. melanogaster
aatttcatatctt

SEQ ID NO: 568798 - DNA, 13 bp, D. melanogaster
aatttcatatgca

SEQ ID NO: 568799 - DNA, 13 bp, D. melanogaster
aatttcatattca

SEQ ID NO: 568800 - DNA, 14 bp, D. melanogaster
aatttcatattcat

SEQ ID NO: 568801 - DNA, 13 bp, D. melanogaster
aatttcatattgt

SEQ ID NO: 568802 - DNA, 13 bp, D. melanogaster
aatttcatcaaat

SEQ ID NO: 568803 - DNA, 13 bp, D. melanogaster
aatttcatgaaaa

SEQ ID NO: 568804 - DNA, 13 bp, D. melanogaster
aatttcatggcat

SEQ ID NO: 568805 - DNA, 13 bp, D. melanogaster
aatttcattaaca

SEQ ID NO: 568806 - DNA, 13 bp, D. melanogaster
aatttcattagtt

SEQ ID NO: 568807 - DNA, 13 bp, D. melanogaster
aatttcattattg

SEQ ID NO: 568808 - DNA, 13 bp, D. melanogaster
aatttcattcaat

SEQ ID NO: 568809 - DNA, 14 bp, D. melanogaster
aatttcattcaatt

SEQ ID NO: 568810 - DNA, 13 bp, D. melanogaster
aatttcattcaca

SEQ ID NO: 568811 - DNA, 13 bp, D. melanogaster
aatttcattcaga

SEQ ID NO: 568812 - DNA, 13 bp, D. melanogaster
aatttcattccat

SEQ ID NO: 568813 - DNA, 13 bp, D. melanogaster
aatttcattgctg

SEQ ID NO: 568814 - DNA, 13 bp, D. melanogaster
aatttcattgttt

SEQ ID NO: 568815 - DNA, 13 bp, D. melanogaster
aatttcatttaca

SEQ ID NO: 568816 - DNA, 13 bp, D. melanogaster
aatttcatttagc

SEQ ID NO: 568817 - DNA, 13 bp, D. melanogaster
aatttcatttcct

SEQ ID NO: 568818 - DNA, 14 bp, D. melanogaster
aatttcatttcgtt

SEQ ID NO: 568819 - DNA, 14 bp, D. melanogaster
aatttcatttgcag

SEQ ID NO: 568820 - DNA, 14 bp, D. melanogaster
aatttcatttgcat

SEQ ID NO: 568821 - DNA, 13 bp, D. melanogaster
aatttcatttgct

SEQ ID NO: 568822 - DNA, 13 bp, D. melanogaster
aatttcatttggc

SEQ ID NO: 568823 - DNA, 13 bp, D. melanogaster
aatttcatttgtt

SEQ ID NO: 568824 - DNA, 14 bp, D. melanogaster
aatttcattttgaa

SEQ ID NO: 568825 - DNA, 13 bp, D. melanogaster
aatttcattttgt

SEQ ID NO: 568826 - DNA, 13 bp, D. melanogaster
aatttccaaaaat

SEQ ID NO: 568827 - DNA, 14 bp, D. melanogaster
aatttccaaaaatt

SEQ ID NO: 568828 - DNA, 13 bp, D. melanogaster
aatttccaaaaca

SEQ ID NO: 568829 - DNA, 13 bp, D. melanogaster
aatttccaaaagt

SEQ ID NO: 568830 - DNA, 13 bp, D. melanogaster
aatttccaaaata

SEQ ID NO: 568831 - DNA, 13 bp, D. melanogaster
aatttccaaaatg

SEQ ID NO: 568832 - DNA, 13 bp, D. melanogaster
aatttccaaataa

SEQ ID NO: 568833 - DNA, 13 bp, D. melanogaster
aatttccaaatcg

SEQ ID NO: 568834 - DNA, 13 bp, D. melanogaster
aatttccaaattg

SEQ ID NO: 568835 - DNA, 13 bp, D. melanogaster
aatttccaaattt

SEQ ID NO: 568836 - DNA, 13 bp, D. melanogaster
aatttccaacaaa

SEQ ID NO: 568837 - DNA, 13 bp, D. melanogaster
aatttccaacttt

SEQ ID NO: 568838 - DNA, 13 bp, D. melanogaster
aatttccaagttt

SEQ ID NO: 568839 - DNA, 13 bp, D. melanogaster
aatttccaataat

SEQ ID NO: 568840 - DNA, 13 bp, D. melanogaster
aatttccaatata

SEQ ID NO: 568841 - DNA, 13 bp, D. melanogaster
aatttccaatcaa

SEQ ID NO: 568842 - DNA, 14 bp, D. melanogaster
aatttccaatcaaa

SEQ ID NO: 568843 - DNA, 13 bp, D. melanogaster
aatttccaatttc

SEQ ID NO: 568844 - DNA, 13 bp, D. melanogaster
aatttccacaatt

SEQ ID NO: 568845 - DNA, 13 bp, D. melanogaster
aatttccacacaa

SEQ ID NO: 568846 - DNA, 13 bp, D. melanogaster
aatttccacacac

SEQ ID NO: 568847 - DNA, 13 bp, D. melanogaster
aatttccacattt

SEQ ID NO: 568848 - DNA, 13 bp, D. melanogaster
aatttccacgaaa

SEQ ID NO: 568849 - DNA, 13 bp, D. melanogaster
aatttccacttta

SEQ ID NO: 568850 - DNA, 13 bp, D. melanogaster
aatttccactttt

SEQ ID NO: 568851 - DNA, 13 bp, D. melanogaster
aatttccagcaaa

SEQ ID NO: 568852 - DNA, 13 bp, D. melanogaster
aatttccagcaat

SEQ ID NO: 568853 - DNA, 13 bp, D. melanogaster
aatttccagcaga

SEQ ID NO: 568854 - DNA, 13 bp, D. melanogaster
aatttccataaaa

SEQ ID NO: 568855 - DNA, 13 bp, D. melanogaster
aatttccataata

SEQ ID NO: 568856 - DNA, 13 bp, D. melanogaster
aatttccataatt

SEQ ID NO: 568857 - DNA, 13 bp, D. melanogaster
aatttccatcgat

SEQ ID NO: 568858 - DNA, 13 bp, D. melanogaster
aatttccatggaa

SEQ ID NO: 568859 - DNA, 13 bp, D. melanogaster
aatttccattaaa

SEQ ID NO: 568860 - DNA, 13 bp, D. melanogaster
aatttccattatt

SEQ ID NO: 568861 - DNA, 13 bp, D. melanogaster
aatttccattgaa

SEQ ID NO: 568862 - DNA, 14 bp, D. melanogaster
aatttccattgaat

SEQ ID NO: 568863 - DNA, 13 bp, D. melanogaster
aatttccattgtt

SEQ ID NO: 568864 - DNA, 13 bp, D. melanogaster
aatttccatttca

SEQ ID NO: 568865 - DNA, 13 bp, D. melanogaster
aatttccatttct

SEQ ID NO: 568866 - DNA, 13 bp, D. melanogaster
aatttcccaaaaa

SEQ ID NO: 568867 - DNA, 13 bp, D. melanogaster
aatttcccaaaag

SEQ ID NO: 568868 - DNA, 13 bp, D. melanogaster
aatttcccaaaat

SEQ ID NO: 568869 - DNA, 13 bp, D. melanogaster
aatttcccacaaa

SEQ ID NO: 568870 - DNA, 13 bp, D. melanogaster
aatttcccacaca

SEQ ID NO: 568871 - DNA, 13 bp, D. melanogaster
aatttcccagcca

SEQ ID NO: 568872 - DNA, 13 bp, D. melanogaster
aatttcccattca

SEQ ID NO: 568873 - DNA, 13 bp, D. melanogaster
aatttcccatttt

SEQ ID NO: 568874 - DNA, 13 bp, D. melanogaster
aatttccccaaac

SEQ ID NO: 568875 - DNA, 13 bp, D. melanogaster
aatttcccccaaa

SEQ ID NO: 568876 - DNA, 13 bp, D. melanogaster
aatttcccccgaa

SEQ ID NO: 568877 - DNA, 13 bp, D. melanogaster
aatttccccgaat

SEQ ID NO: 568878 - DNA, 13 bp, D. melanogaster
aatttcccgaaac

SEQ ID NO: 568879 - DNA, 14 bp, D. melanogaster
aatttcccgaaacg

SEQ ID NO: 568880 - DNA, 14 bp, D. melanogaster
aatttccctgctta

SEQ ID NO: 568881 - DNA, 13 bp, D. melanogaster
aatttcccttatt

SEQ ID NO: 568882 - DNA, 13 bp, D. melanogaster
aatttcccttgaa

SEQ ID NO: 568883 - DNA, 13 bp, D. melanogaster
aatttccgctgct

SEQ ID NO: 568884 - DNA, 13 bp, D. melanogaster
aatttccgtttca

SEQ ID NO: 568885 - DNA, 13 bp, D. melanogaster
aatttccgttttt

SEQ ID NO: 568886 - DNA, 13 bp, D. melanogaster
aatttcctaaaat

SEQ ID NO: 568887 - DNA, 14 bp, D. melanogaster
aatttcctacaaat

SEQ ID NO: 568888 - DNA, 13 bp, D. melanogaster
aatttcctatcca

SEQ ID NO: 568889 - DNA, 13 bp, D. melanogaster
aatttcctcaatt

SEQ ID NO: 568890 - DNA, 13 bp, D. melanogaster
aatttccttttaa

SEQ ID NO: 568891 - DNA, 13 bp, D. melanogaster
aatttccttttgc

SEQ ID NO: 568892 - DNA, 13 bp, D. melanogaster
aatttcctttttg

SEQ ID NO: 568893 - DNA, 13 bp, D. melanogaster
aatttcgaaaaaa

SEQ ID NO: 568894 - DNA, 13 bp, D. melanogaster
aatttcgaaaatt

SEQ ID NO: 568895 - DNA, 13 bp, D. melanogaster
aatttcgaaacaa

SEQ ID NO: 568896 - DNA, 13 bp, D. melanogaster
aatttcgaaacta

SEQ ID NO: 568897 - DNA, 13 bp, D. melanogaster
aatttcgaaagaa

SEQ ID NO: 568898 - DNA, 13 bp, D. melanogaster
aatttcgaaatat

SEQ ID NO: 568899 - DNA, 13 bp, D. melanogaster
aatttcgaaattt

SEQ ID NO: 568900 - DNA, 14 bp, D. melanogaster
aatttcgaaatttt

SEQ ID NO: 568901 - DNA, 13 bp, D. melanogaster
aatttcgaacaat

SEQ ID NO: 568902 - DNA, 13 bp, D. melanogaster
aatttcgaagaaa

SEQ ID NO: 568903 - DNA, 13 bp, D. melanogaster
aatttcgaatcaa

SEQ ID NO: 568904 - DNA, 13 bp, D. melanogaster
aatttcgaattta

SEQ ID NO: 568905 - DNA, 13 bp, D. melanogaster
aatttcgaatttc

SEQ ID NO: 568906 - DNA, 13 bp, D. melanogaster
aatttcgagctat

SEQ ID NO: 568907 - DNA, 13 bp, D. melanogaster
aatttcgagtttt

SEQ ID NO: 568908 - DNA, 15 bp, D. melanogaster
aatttcgattgccca

SEQ ID NO: 568909 - DNA, 13 bp, D. melanogaster
aatttcgcaaaaa

SEQ ID NO: 568910 - DNA, 13 bp, D. melanogaster
aatttcgcaaaag

SEQ ID NO: 568911 - DNA, 13 bp, D. melanogaster
aatttcgcaaatg

SEQ ID NO: 568912 - DNA, 13 bp, D. melanogaster
aatttcgcaaatt

SEQ ID NO: 568913 - DNA, 13 bp, D. melanogaster
aatttcgcaacaa

SEQ ID NO: 568914 - DNA, 13 bp, D. melanogaster
aatttcgcagcaa

SEQ ID NO: 568915 - DNA, 13 bp, D. melanogaster
aatttcgcataaa

SEQ ID NO: 568916 - DNA, 13 bp, D. melanogaster
aatttcgcattca

SEQ ID NO: 568917 - DNA, 13 bp, D. melanogaster
aatttcgcatttt

SEQ ID NO: 568918 - DNA, 14 bp, D. melanogaster
aatttcgcattttt

SEQ ID NO: 568919 - DNA, 13 bp, D. melanogaster
aatttcgccgact

SEQ ID NO: 568920 - DNA, 13 bp, D. melanogaster
aatttcgcgtttg

SEQ ID NO: 568921 - DNA, 13 bp, D. melanogaster
aatttcgctggct

SEQ ID NO: 568922 - DNA, 13 bp, D. melanogaster
aatttcgcttaat

SEQ ID NO: 568923 - DNA, 14 bp, D. melanogaster
aatttcgctttttt

SEQ ID NO: 568924 - DNA, 13 bp, D. melanogaster
aatttcggaattt

SEQ ID NO: 568925 - DNA, 13 bp, D. melanogaster
aatttcggtttca

SEQ ID NO: 568926 - DNA, 13 bp, D. melanogaster
aatttcgtaaaat

SEQ ID NO: 568927 - DNA, 13 bp, D. melanogaster
aatttcgtaaatt

SEQ ID NO: 568928 - DNA, 13 bp, D. melanogaster
aatttcgtaattt

SEQ ID NO: 568929 - DNA, 13 bp, D. melanogaster
aatttcgtattta

SEQ ID NO: 568930 - DNA, 13 bp, D. melanogaster
aatttcgtatttc

SEQ ID NO: 568931 - DNA, 14 bp, D. melanogaster
aatttcgtcgaagg

SEQ ID NO: 568932 - DNA, 13 bp, D. melanogaster
aatttcgtgtttc

SEQ ID NO: 568933 - DNA, 13 bp, D. melanogaster
aatttcgttaaaa

SEQ ID NO: 568934 - DNA, 13 bp, D. melanogaster
aatttcgttggca

SEQ ID NO: 568935 - DNA, 13 bp, D. melanogaster
aatttcgtttaat

SEQ ID NO: 568936 - DNA, 14 bp, D. melanogaster
aatttcgtttaatt

SEQ ID NO: 568937 - DNA, 13 bp, D. melanogaster
aatttcgtttcca

SEQ ID NO: 568938 - DNA, 13 bp, D. melanogaster
aatttcgtttcgt

SEQ ID NO: 568939 - DNA, 13 bp, D. melanogaster
aatttcgtttgaa

SEQ ID NO: 568940 - DNA, 13 bp, D. melanogaster
aatttcgtttgca

SEQ ID NO: 568941 - DNA, 13 bp, D. melanogaster
aatttcgttttca

SEQ ID NO: 568942 - DNA, 14 bp, D. melanogaster
aatttcgttttcat

SEQ ID NO: 568943 - DNA, 13 bp, D. melanogaster
aatttcgttttgc

SEQ ID NO: 568944 - DNA, 13 bp, D. melanogaster
aatttctaattga

SEQ ID NO: 568945 - DNA, 13 bp, D. melanogaster
aatttctaatttc

SEQ ID NO: 568946 - DNA, 13 bp, D. melanogaster
aatttctacaaac

SEQ ID NO: 568947 - DNA, 13 bp, D. melanogaster
aatttctatatca

SEQ ID NO: 568948 - DNA, 13 bp, D. melanogaster
aatttctatcgat

SEQ ID NO: 568949 - DNA, 13 bp, D. melanogaster
aatttctatgcaa

SEQ ID NO: 568950 - DNA, 13 bp, D. melanogaster
aatttctatgcca

SEQ ID NO: 568951 - DNA, 14 bp, D. melanogaster
aatttctatgccat

SEQ ID NO: 568952 - DNA, 13 bp, D. melanogaster
aatttctattgat

SEQ ID NO: 568953 - DNA, 13 bp, D. melanogaster
aatttctattgta

SEQ ID NO: 568954 - DNA, 14 bp, D. melanogaster
aatttctccataaa

SEQ ID NO: 568955 - DNA, 13 bp, D. melanogaster
aatttctcgttcg

SEQ ID NO: 568956 - DNA, 13 bp, D. melanogaster
aatttctctatta

SEQ ID NO: 568957 - DNA, 13 bp, D. melanogaster
aatttctgacatt

SEQ ID NO: 568958 - DNA, 13 bp, D. melanogaster
aatttctgcataa

SEQ ID NO: 568959 - DNA, 13 bp, D. melanogaster
aatttctgcattt

SEQ ID NO: 568960 - DNA, 13 bp, D. melanogaster
aatttctggaaat

SEQ ID NO: 568961 - DNA, 13 bp, D. melanogaster
aatttctggccaa

SEQ ID NO: 568962 - DNA, 13 bp, D. melanogaster
aatttctggccac

SEQ ID NO: 568963 - DNA, 13 bp, D. melanogaster
aatttctgggaaa

SEQ ID NO: 568964 - DNA, 13 bp, D. melanogaster
aatttctgttttg

SEQ ID NO: 568965 - DNA, 13 bp, D. melanogaster
aatttcttaaaag

SEQ ID NO: 568966 - DNA, 13 bp, D. melanogaster
aatttcttagttt

SEQ ID NO: 568967 - DNA, 13 bp, D. melanogaster
aatttcttcaaat

SEQ ID NO: 568968 - DNA, 13 bp, D. melanogaster
aatttcttgaatt

SEQ ID NO: 568969 - DNA, 13 bp, D. melanogaster
aatttcttgcagt

SEQ ID NO: 568970 - DNA, 13 bp, D. melanogaster
aatttcttgctca

SEQ ID NO: 568971 - DNA, 13 bp, D. melanogaster
aatttcttgcttt

SEQ ID NO: 568972 - DNA, 13 bp, D. melanogaster
aatttcttggaaa

SEQ ID NO: 568973 - DNA, 13 bp, D. melanogaster
aatttcttgtaaa

SEQ ID NO: 568974 - DNA, 13 bp, D. melanogaster
aatttcttgtatt

SEQ ID NO: 568975 - DNA, 13 bp, D. melanogaster
aatttctttaagc

SEQ ID NO: 568976 - DNA, 13 bp, D. melanogaster
aatttctttcaac

SEQ ID NO: 568977 - DNA, 13 bp, D. melanogaster
aatttctttcagt

SEQ ID NO: 568978 - DNA, 14 bp, D. melanogaster
aatttctttcagtg

SEQ ID NO: 568979 - DNA, 13 bp, D. melanogaster
aatttctttcgat

SEQ ID NO: 568980 - DNA, 13 bp, D. melanogaster
aatttctttcggt

SEQ ID NO: 568981 - DNA, 13 bp, D. melanogaster
aatttctttgctt

SEQ ID NO: 568982 - DNA, 13 bp, D. melanogaster
aatttctttggat

SEQ ID NO: 568983 - DNA, 13 bp, D. melanogaster
aatttcttttaag

SEQ ID NO: 568984 - DNA, 14 bp, D. melanogaster
aatttcttttaagt

SEQ ID NO: 568985 - DNA, 13 bp, D. melanogaster
aatttcttttcgt

SEQ ID NO: 568986 - DNA, 13 bp, D. melanogaster
aatttgaaaaact

SEQ ID NO: 568987 - DNA, 13 bp, D. melanogaster
aatttgaaaaatg

SEQ ID NO: 568988 - DNA, 14 bp, D. melanogaster
aatttgaaaacaaa

SEQ ID NO: 568989 - DNA, 13 bp, D. melanogaster
aatttgaaaacca

SEQ ID NO: 568990 - DNA, 13 bp, D. melanogaster
aatttgaaaagta

SEQ ID NO: 568991 - DNA, 13 bp, D. melanogaster
aatttgaaaatcg

SEQ ID NO: 568992 - DNA, 13 bp, D. melanogaster
aatttgaaaatgt

SEQ ID NO: 568993 - DNA, 13 bp, D. melanogaster
aatttgaaacgaa

SEQ ID NO: 568994 - DNA, 13 bp, D. melanogaster
aatttgaaactta

SEQ ID NO: 568995 - DNA, 13 bp, D. melanogaster
aatttgaaagctg

SEQ ID NO: 568996 - DNA, 13 bp, D. melanogaster
aatttgaaagtaa

SEQ ID NO: 568997 - DNA, 13 bp, D. melanogaster
aatttgaaatcaa

SEQ ID NO: 568998 - DNA, 14 bp, D. melanogaster
aatttgaaatcaaa

SEQ ID NO: 568999 - DNA, 13 bp, D. melanogaster
aatttgaaatcca

SEQ ID NO: 569000 - DNA, 13 bp, D. melanogaster
aatttgaaatcta

SEQ ID NO: 569001 - DNA, 13 bp, D. melanogaster
aatttgaaatgct

SEQ ID NO: 569002 - DNA, 13 bp, D. melanogaster
aatttgaaatggc

SEQ ID NO: 569003 - DNA, 14 bp, D. melanogaster
aatttgaaatggct

SEQ ID NO: 569004 - DNA, 13 bp, D. melanogaster
aatttgaaattac

SEQ ID NO: 569005 - DNA, 13 bp, D. melanogaster
aatttgaaattga

SEQ ID NO: 569006 - DNA, 13 bp, D. melanogaster
aatttgaaattgg

SEQ ID NO: 569007 - DNA, 13 bp, D. melanogaster
aatttgaaatttc

SEQ ID NO: 569008 - DNA, 13 bp, D. melanogaster
aatttgaaatttg

SEQ ID NO: 569009 - DNA, 14 bp, D. melanogaster
aatttgaaatttga

SEQ ID NO: 569010 - DNA, 13 bp, D. melanogaster
aatttgaacaaaa

SEQ ID NO: 569011 - DNA, 13 bp, D. melanogaster
aatttgaacaaat

SEQ ID NO: 569012 - DNA, 13 bp, D. melanogaster
aatttgaacaatt

SEQ ID NO: 569013 - DNA, 13 bp, D. melanogaster
aatttgaacgatt

SEQ ID NO: 569014 - DNA, 14 bp, D. melanogaster
aatttgaacgattg

SEQ ID NO: 569015 - DNA, 13 bp, D. melanogaster
aatttgaacttaa

SEQ ID NO: 569016 - DNA, 13 bp, D. melanogaster
aatttgaacttta

SEQ ID NO: 569017 - DNA, 13 bp, D. melanogaster
aatttgaactttg

SEQ ID NO: 569018 - DNA, 13 bp, D. melanogaster
aatttgaactttt

SEQ ID NO: 569019 - DNA, 13 bp, D. melanogaster
aatttgaagccaa

SEQ ID NO: 569020 - DNA, 13 bp, D. melanogaster
aatttgaagttat

SEQ ID NO: 569021 - DNA, 13 bp, D. melanogaster
aatttgaagtttg

SEQ ID NO: 569022 - DNA, 13 bp, D. melanogaster
aatttgaatacaa

SEQ ID NO: 569023 - DNA, 13 bp, D. melanogaster
aatttgaatagat

SEQ ID NO: 569024 - DNA, 13 bp, D. melanogaster
aatttgaatgaag

SEQ ID NO: 569025 - DNA, 14 bp, D. melanogaster
aatttgaatgaaga

SEQ ID NO: 569026 - DNA, 13 bp, D. melanogaster
aatttgaatgcaa

SEQ ID NO: 569027 - DNA, 13 bp, D. melanogaster
aatttgaatgcca

SEQ ID NO: 569028 - DNA, 13 bp, D. melanogaster
aatttgaatggaa

SEQ ID NO: 569029 - DNA, 13 bp, D. melanogaster
aatttgaatgttt

SEQ ID NO: 569030 - DNA, 13 bp, D. melanogaster
aatttgaattcaa

SEQ ID NO: 569031 - DNA, 14 bp, D. melanogaster
aatttgaattgaaa

SEQ ID NO: 569032 - DNA, 14 bp, D. melanogaster
aatttgaattgaat

SEQ ID NO: 569033 - DNA, 13 bp, D. melanogaster
aatttgaattgga

SEQ ID NO: 569034 - DNA, 13 bp, D. melanogaster
aatttgaatttca

SEQ ID NO: 569035 - DNA, 13 bp, D. melanogaster
aatttgaatttct

SEQ ID NO: 569036 - DNA, 14 bp, D. melanogaster
aatttgaatttgaa

SEQ ID NO: 569037 - DNA, 13 bp, D. melanogaster
aatttgaatttgt

SEQ ID NO: 569038 - DNA, 13 bp, D. melanogaster
aatttgaattttc

SEQ ID NO: 569039 - DNA, 14 bp, D. melanogaster
aatttgaattttca

SEQ ID NO: 569040 - DNA, 14 bp, D. melanogaster
aatttgaatttttc

SEQ ID NO: 569041 - DNA, 13 bp, D. melanogaster
aatttgacaaaca

SEQ ID NO: 569042 - DNA, 14 bp, D. melanogaster
aatttgacaaacaa

SEQ ID NO: 569043 - DNA, 13 bp, D. melanogaster
aatttgacaaatt

SEQ ID NO: 569044 - DNA, 13 bp, D. melanogaster
aatttgacaattg

SEQ ID NO: 569045 - DNA, 13 bp, D. melanogaster
aatttgacaattt

SEQ ID NO: 569046 - DNA, 13 bp, D. melanogaster
aatttgacatttt

SEQ ID NO: 569047 - DNA, 13 bp, D. melanogaster
aatttgactaaaa

SEQ ID NO: 569048 - DNA, 13 bp, D. melanogaster
aatttgagaaaat

SEQ ID NO: 569049 - DNA, 13 bp, D. melanogaster
aatttgagaattt

SEQ ID NO: 569050 - DNA, 13 bp, D. melanogaster
aatttgagagaag

SEQ ID NO: 569051 - DNA, 13 bp, D. melanogaster
aatttgagtgaaa

SEQ ID NO: 569052 - DNA, 14 bp, D. melanogaster
aatttgagtgaaaa

SEQ ID NO: 569053 - DNA, 13 bp, D. melanogaster
aatttgagtggcc

SEQ ID NO: 569054 - DNA, 13 bp, D. melanogaster
aatttgagttggc

SEQ ID NO: 569055 - DNA, 13 bp, D. melanogaster
aatttgagtttgt

SEQ ID NO: 569056 - DNA, 13 bp, D. melanogaster
aatttgagtttta

SEQ ID NO: 569057 - DNA, 13 bp, D. melanogaster
aatttgatatgca

SEQ ID NO: 569058 - DNA, 13 bp, D. melanogaster
aatttgatattca

SEQ ID NO: 569059 - DNA, 14 bp, D. melanogaster
aatttgatattgat

SEQ ID NO: 569060 - DNA, 13 bp, D. melanogaster
aatttgatcattt

SEQ ID NO: 569061 - DNA, 13 bp, D. melanogaster
aatttgatgaaaa

SEQ ID NO: 569062 - DNA, 13 bp, D. melanogaster
aatttgatgaata

SEQ ID NO: 569063 - DNA, 13 bp, D. melanogaster
aatttgatgatcc

SEQ ID NO: 569064 - DNA, 13 bp, D. melanogaster
aatttgatgattt

SEQ ID NO: 569065 - DNA, 13 bp, D. melanogaster
aatttgatgtttg

SEQ ID NO: 569066 - DNA, 13 bp, D. melanogaster
aatttgattaaca

SEQ ID NO: 569067 - DNA, 13 bp, D. melanogaster
aatttgattaatg

SEQ ID NO: 569068 - DNA, 13 bp, D. melanogaster
aatttgattagca

SEQ ID NO: 569069 - DNA, 13 bp, D. melanogaster
aatttgattagct

SEQ ID NO: 569070 - DNA, 13 bp, D. melanogaster
aatttgattatga

SEQ ID NO: 569071 - DNA, 13 bp, D. melanogaster
aatttgattatgc

SEQ ID NO: 569072 - DNA, 14 bp, D. melanogaster
aatttgattcaatt

SEQ ID NO: 569073 - DNA, 13 bp, D. melanogaster
aatttgattgatt

SEQ ID NO: 569074 - DNA, 14 bp, D. melanogaster
aatttgattgcctt

SEQ ID NO: 569075 - DNA, 13 bp, D. melanogaster
aatttgattggaa

SEQ ID NO: 569076 - DNA, 13 bp, D. melanogaster
aatttgattggca

SEQ ID NO: 569077 - DNA, 13 bp, D. melanogaster
aatttgattgtaa

SEQ ID NO: 569078 - DNA, 13 bp, D. melanogaster
aatttgatttcaa

SEQ ID NO: 569079 - DNA, 13 bp, D. melanogaster
aatttgatttcca

SEQ ID NO: 569080 - DNA, 13 bp, D. melanogaster
aatttgatttcga

SEQ ID NO: 569081 - DNA, 13 bp, D. melanogaster
aatttgatttctt

SEQ ID NO: 569082 - DNA, 13 bp, D. melanogaster
aatttgatttgat

SEQ ID NO: 569083 - DNA, 13 bp, D. melanogaster
aatttgatttgca

SEQ ID NO: 569084 - DNA, 14 bp, D. melanogaster
aatttgatttgcct

SEQ ID NO: 569085 - DNA, 13 bp, D. melanogaster
aatttgattttac

SEQ ID NO: 569086 - DNA, 13 bp, D. melanogaster
aatttgattttcc

SEQ ID NO: 569087 - DNA, 13 bp, D. melanogaster
aatttgattttct

SEQ ID NO: 569088 - DNA, 13 bp, D. melanogaster
aatttgcaaaaat

SEQ ID NO: 569089 - DNA, 13 bp, D. melanogaster
aatttgcaaaaca

SEQ ID NO: 569090 - DNA, 13 bp, D. melanogaster
aatttgcaaaact

SEQ ID NO: 569091 - DNA, 14 bp, D. melanogaster
aatttgcaaaagtt

SEQ ID NO: 569092 - DNA, 14 bp, D. melanogaster
aatttgcaaatatt

SEQ ID NO: 569093 - DNA, 13 bp, D. melanogaster
aatttgcaacaac

SEQ ID NO: 569094 - DNA, 13 bp, D. melanogaster
aatttgcaaggca

SEQ ID NO: 569095 - DNA, 14 bp, D. melanogaster
aatttgcaataaaa

SEQ ID NO: 569096 - DNA, 13 bp, D. melanogaster
aatttgcaataat

SEQ ID NO: 569097 - DNA, 14 bp, D. melanogaster
aatttgcaatattt

SEQ ID NO: 569098 - DNA, 13 bp, D. melanogaster
aatttgcaatcga

SEQ ID NO: 569099 - DNA, 13 bp, D. melanogaster
aatttgcaattaa

SEQ ID NO: 569100 - DNA, 14 bp, D. melanogaster
aatttgcaattaaa

SEQ ID NO: 569101 - DNA, 13 bp, D. melanogaster
aatttgcaattca

SEQ ID NO: 569102 - DNA, 14 bp, D. melanogaster
aatttgcaattgaa

SEQ ID NO: 569103 - DNA, 13 bp, D. melanogaster
aatttgcacaaaa

SEQ ID NO: 569104 - DNA, 13 bp, D. melanogaster
aatttgcacaatt

SEQ ID NO: 569105 - DNA, 13 bp, D. melanogaster
aatttgcacagca

SEQ ID NO: 569106 - DNA, 13 bp, D. melanogaster
aatttgcagctaa

SEQ ID NO: 569107 - DNA, 13 bp, D. melanogaster
aatttgcagttta

SEQ ID NO: 569108 - DNA, 13 bp, D. melanogaster
aatttgcagtttt

SEQ ID NO: 569109 - DNA, 14 bp, D. melanogaster
aatttgcataaaat

SEQ ID NO: 569110 - DNA, 13 bp, D. melanogaster
aatttgcataaat

SEQ ID NO: 569111 - DNA, 13 bp, D. melanogaster
aatttgcataaca

SEQ ID NO: 569112 - DNA, 14 bp, D. melanogaster
aatttgcataacaa

SEQ ID NO: 569113 - DNA, 13 bp, D. melanogaster
aatttgcataact

SEQ ID NO: 569114 - DNA, 13 bp, D. melanogaster
aatttgcataagc

SEQ ID NO: 569115 - DNA, 13 bp, D. melanogaster
aatttgcataata

SEQ ID NO: 569116 - DNA, 14 bp, D. melanogaster
aatttgcataatta

SEQ ID NO: 569117 - DNA, 14 bp, D. melanogaster
aatttgcataattt

SEQ ID NO: 569118 - DNA, 13 bp, D. melanogaster
aatttgcatacca

SEQ ID NO: 569119 - DNA, 13 bp, D. melanogaster
aatttgcatacga

SEQ ID NO: 569120 - DNA, 13 bp, D. melanogaster
aatttgcatataa

SEQ ID NO: 569121 - DNA, 14 bp, D. melanogaster
aatttgcatataaa

SEQ ID NO: 569122 - DNA, 13 bp, D. melanogaster
aatttgcatatat

SEQ ID NO: 569123 - DNA, 13 bp, D. melanogaster
aatttgcatatgc

SEQ ID NO: 569124 - DNA, 13 bp, D. melanogaster
aatttgcatattt

SEQ ID NO: 569125 - DNA, 14 bp, D. melanogaster
aatttgcatattta

SEQ ID NO: 569126 - DNA, 13 bp, D. melanogaster
aatttgcatgaat

SEQ ID NO: 569127 - DNA, 13 bp, D. melanogaster
aatttgcatgaca

SEQ ID NO: 569128 - DNA, 13 bp, D. melanogaster
aatttgcatgcaa

SEQ ID NO: 569129 - DNA, 14 bp, D. melanogaster
aatttgcatgcaaa

SEQ ID NO: 569130 - DNA, 13 bp, D. melanogaster
aatttgcatgcca

SEQ ID NO: 569131 - DNA, 13 bp, D. melanogaster
aatttgcatgccg

SEQ ID NO: 569132 - DNA, 14 bp, D. melanogaster
aatttgcattaaat

SEQ ID NO: 569133 - DNA, 13 bp, D. melanogaster
aatttgcattaat

SEQ ID NO: 569134 - DNA, 14 bp, D. melanogaster
aatttgcattaatt

SEQ ID NO: 569135 - DNA, 13 bp, D. melanogaster
aatttgcattcca

SEQ ID NO: 569136 - DNA, 13 bp, D. melanogaster
aatttgcattgtg

SEQ ID NO: 569137 - DNA, 14 bp, D. melanogaster
aatttgcattgttt

SEQ ID NO: 569138 - DNA, 14 bp, D. melanogaster
aatttgcatttaat

SEQ ID NO: 569139 - DNA, 13 bp, D. melanogaster
aatttgcatttct

SEQ ID NO: 569140 - DNA, 13 bp, D. melanogaster
aatttgcatttga

SEQ ID NO: 569141 - DNA, 13 bp, D. melanogaster
aatttgccaaaca

SEQ ID NO: 569142 - DNA, 13 bp, D. melanogaster
aatttgccaaact

SEQ ID NO: 569143 - DNA, 13 bp, D. melanogaster
aatttgccaaaga

SEQ ID NO: 569144 - DNA, 13 bp, D. melanogaster
aatttgccaagca

SEQ ID NO: 569145 - DNA, 13 bp, D. melanogaster
aatttgccaagtt

SEQ ID NO: 569146 - DNA, 13 bp, D. melanogaster
aatttgccaattg

SEQ ID NO: 569147 - DNA, 13 bp, D. melanogaster
aatttgccacaaa

SEQ ID NO: 569148 - DNA, 14 bp, D. melanogaster
aatttgccacaaaa

SEQ ID NO: 569149 - DNA, 13 bp, D. melanogaster
aatttgccacgcc

SEQ ID NO: 569150 - DNA, 13 bp, D. melanogaster
aatttgccagcaa

SEQ ID NO: 569151 - DNA, 14 bp, D. melanogaster
aatttgccataatt

SEQ ID NO: 569152 - DNA, 13 bp, D. melanogaster
aatttgccattaa

SEQ ID NO: 569153 - DNA, 13 bp, D. melanogaster
aatttgccattgc

SEQ ID NO: 569154 - DNA, 13 bp, D. melanogaster
aatttgccatttg

SEQ ID NO: 569155 - DNA, 13 bp, D. melanogaster
aatttgcccaaaa

SEQ ID NO: 569156 - DNA, 13 bp, D. melanogaster
aatttgccttaat

SEQ ID NO: 569157 - DNA, 13 bp, D. melanogaster
aatttgcctttgt

SEQ ID NO: 569158 - DNA, 13 bp, D. melanogaster
aatttgcgaaaaa

SEQ ID NO: 569159 - DNA, 14 bp, D. melanogaster
aatttgcgaaaaaa

SEQ ID NO: 569160 - DNA, 13 bp, D. melanogaster
aatttgcgcaaaa

SEQ ID NO: 569161 - DNA, 13 bp, D. melanogaster
aatttgcgcaaat

SEQ ID NO: 569162 - DNA, 14 bp, D. melanogaster
aatttgcgcaaatt

SEQ ID NO: 569163 - DNA, 13 bp, D. melanogaster
aatttgcgcaaca

SEQ ID NO: 569164 - DNA, 13 bp, D. melanogaster
aatttgcgcattt

SEQ ID NO: 569165 - DNA, 13 bp, D. melanogaster
aatttgcggcgca

SEQ ID NO: 569166 - DNA, 13 bp, D. melanogaster
aatttgcgtaaat

SEQ ID NO: 569167 - DNA, 13 bp, D. melanogaster
aatttgcgttttt

SEQ ID NO: 569168 - DNA, 13 bp, D. melanogaster
aatttgctaaaaa

SEQ ID NO: 569169 - DNA, 14 bp, D. melanogaster
aatttgctcaagtg

SEQ ID NO: 569170 - DNA, 13 bp, D. melanogaster
aatttgctgaaat

SEQ ID NO: 569171 - DNA, 13 bp, D. melanogaster
aatttgctgcaat

SEQ ID NO: 569172 - DNA, 13 bp, D. melanogaster
aatttgctgccat

SEQ ID NO: 569173 - DNA, 13 bp, D. melanogaster
aatttgctgttaa

SEQ ID NO: 569174 - DNA, 13 bp, D. melanogaster
aatttgcttaaaa

SEQ ID NO: 569175 - DNA, 14 bp, D. melanogaster
aatttgcttaaaat

SEQ ID NO: 569176 - DNA, 13 bp, D. melanogaster
aatttgcttaaat

SEQ ID NO: 569177 - DNA, 13 bp, D. melanogaster
aatttgcttgctt

SEQ ID NO: 569178 - DNA, 13 bp, D. melanogaster
aatttgcttggca

SEQ ID NO: 569179 - DNA, 14 bp, D. melanogaster
aatttgctttcatt

SEQ ID NO: 569180 - DNA, 13 bp, D. melanogaster
aatttgctttggc

SEQ ID NO: 569181 - DNA, 13 bp, D. melanogaster
aatttgcttttaa

SEQ ID NO: 569182 - DNA, 14 bp, D. melanogaster
aatttgcttttaat

SEQ ID NO: 569183 - DNA, 14 bp, D. melanogaster
aatttgcttttatt

SEQ ID NO: 569184 - DNA, 13 bp, D. melanogaster
aatttggaaaaat

SEQ ID NO: 569185 - DNA, 14 bp, D. melanogaster
aatttggaaaaatg

SEQ ID NO: 569186 - DNA, 13 bp, D. melanogaster
aatttggaaaata

SEQ ID NO: 569187 - DNA, 13 bp, D. melanogaster
aatttggaaaatt

SEQ ID NO: 569188 - DNA, 13 bp, D. melanogaster
aatttggaaacaa

SEQ ID NO: 569189 - DNA, 13 bp, D. melanogaster
aatttggaagttg

SEQ ID NO: 569190 - DNA, 13 bp, D. melanogaster
aatttggaataaa

SEQ ID NO: 569191 - DNA, 14 bp, D. melanogaster
aatttggaataaat

SEQ ID NO: 569192 - DNA, 13 bp, D. melanogaster
aatttggaatata

SEQ ID NO: 569193 - DNA, 13 bp, D. melanogaster
aatttggaatatt

SEQ ID NO: 569194 - DNA, 13 bp, D. melanogaster
aatttggaatttt

SEQ ID NO: 569195 - DNA, 13 bp, D. melanogaster
aatttggacaatt

SEQ ID NO: 569196 - DNA, 13 bp, D. melanogaster
aatttggatggat

SEQ ID NO: 569197 - DNA, 13 bp, D. melanogaster
aatttggattatt

SEQ ID NO: 569198 - DNA, 13 bp, D. melanogaster
aatttggatttcg

SEQ ID NO: 569199 - DNA, 13 bp, D. melanogaster
aatttggatttta

SEQ ID NO: 569200 - DNA, 13 bp, D. melanogaster
aatttggcaaact

SEQ ID NO: 569201 - DNA, 13 bp, D. melanogaster
aatttggcaacaa

SEQ ID NO: 569202 - DNA, 13 bp, D. melanogaster
aatttggcaagaa

SEQ ID NO: 569203 - DNA, 13 bp, D. melanogaster
aatttggcagcaa

SEQ ID NO: 569204 - DNA, 13 bp, D. melanogaster
aatttggccaaaa

SEQ ID NO: 569205 - DNA, 13 bp, D. melanogaster
aatttggccaaag

SEQ ID NO: 569206 - DNA, 13 bp, D. melanogaster
aatttggccaaga

SEQ ID NO: 569207 - DNA, 13 bp, D. melanogaster
aatttggccaagt

SEQ ID NO: 569208 - DNA, 13 bp, D. melanogaster
aatttggccaata

SEQ ID NO: 569209 - DNA, 13 bp, D. melanogaster
aatttggccagaa

SEQ ID NO: 569210 - DNA, 13 bp, D. melanogaster
aatttggccagct

SEQ ID NO: 569211 - DNA, 13 bp, D. melanogaster
aatttggccataa

SEQ ID NO: 569212 - DNA, 13 bp, D. melanogaster
aatttggctaaaa

SEQ ID NO: 569213 - DNA, 13 bp, D. melanogaster
aatttggctaatt

SEQ ID NO: 569214 - DNA, 13 bp, D. melanogaster
aatttggctgcct

SEQ ID NO: 569215 - DNA, 13 bp, D. melanogaster
aatttggcttatt

SEQ ID NO: 569216 - DNA, 13 bp, D. melanogaster
aatttgggaaatt

SEQ ID NO: 569217 - DNA, 13 bp, D. melanogaster
aatttgggatttt

SEQ ID NO: 569218 - DNA, 13 bp, D. melanogaster
aatttgggcacct

SEQ ID NO: 569219 - DNA, 13 bp, D. melanogaster
aatttggggaaaa

SEQ ID NO: 569220 - DNA, 13 bp, D. melanogaster
aatttggggttaa

SEQ ID NO: 569221 - DNA, 13 bp, D. melanogaster
aatttggggttat

SEQ ID NO: 569222 - DNA, 13 bp, D. melanogaster
aatttggtaacta

SEQ ID NO: 569223 - DNA, 13 bp, D. melanogaster
aatttggtaatat

SEQ ID NO: 569224 - DNA, 13 bp, D. melanogaster
aatttggtattta

SEQ ID NO: 569225 - DNA, 13 bp, D. melanogaster
aatttggtctaaa

SEQ ID NO: 569226 - DNA, 14 bp, D. melanogaster
aatttggtgctatt

SEQ ID NO: 569227 - DNA, 13 bp, D. melanogaster
aatttggtttaat

SEQ ID NO: 569228 - DNA, 13 bp, D. melanogaster
aatttggtttctt

SEQ ID NO: 569229 - DNA, 13 bp, D. melanogaster
aatttggtttgct

SEQ ID NO: 569230 - DNA, 13 bp, D. melanogaster
aatttgtaaacaa

SEQ ID NO: 569231 - DNA, 14 bp, D. melanogaster
aatttgtaaacaaa

SEQ ID NO: 569232 - DNA, 13 bp, D. melanogaster
aatttgtaaagaa

SEQ ID NO: 569233 - DNA, 13 bp, D. melanogaster
aatttgtaatcat

SEQ ID NO: 569234 - DNA, 13 bp, D. melanogaster
aatttgtaatctt

SEQ ID NO: 569235 - DNA, 13 bp, D. melanogaster
aatttgtaatttg

SEQ ID NO: 569236 - DNA, 13 bp, D. melanogaster
aatttgtacaaat

SEQ ID NO: 569237 - DNA, 13 bp, D. melanogaster
aatttgtacataa

SEQ ID NO: 569238 - DNA, 13 bp, D. melanogaster
aatttgtacatat

SEQ ID NO: 569239 - DNA, 13 bp, D. melanogaster
aatttgtacattt

SEQ ID NO: 569240 - DNA, 14 bp, D. melanogaster
aatttgtacattta

SEQ ID NO: 569241 - DNA, 14 bp, D. melanogaster
aatttgtacatttt

SEQ ID NO: 569242 - DNA, 13 bp, D. melanogaster
aatttgtacttaa

SEQ ID NO: 569243 - DNA, 13 bp, D. melanogaster
aatttgtagcata

SEQ ID NO: 569244 - DNA, 13 bp, D. melanogaster
aatttgtagccac

SEQ ID NO: 569245 - DNA, 13 bp, D. melanogaster
aatttgtagctgg

SEQ ID NO: 569246 - DNA, 13 bp, D. melanogaster
aatttgtagctta

SEQ ID NO: 569247 - DNA, 13 bp, D. melanogaster
aatttgtataaac

SEQ ID NO: 569248 - DNA, 13 bp, D. melanogaster
aatttgtatacat

SEQ ID NO: 569249 - DNA, 14 bp, D. melanogaster
aatttgtatacatt

SEQ ID NO: 569250 - DNA, 13 bp, D. melanogaster
aatttgtatagtt

SEQ ID NO: 569251 - DNA, 13 bp, D. melanogaster
aatttgtatctct

SEQ ID NO: 569252 - DNA, 13 bp, D. melanogaster
aatttgtatctta

SEQ ID NO: 569253 - DNA, 13 bp, D. melanogaster
aatttgtatgcag

SEQ ID NO: 569254 - DNA, 13 bp, D. melanogaster
aatttgtatgcca

SEQ ID NO: 569255 - DNA, 13 bp, D. melanogaster
aatttgtatgctg

SEQ ID NO: 569256 - DNA, 13 bp, D. melanogaster
aatttgtatgctt

SEQ ID NO: 569257 - DNA, 13 bp, D. melanogaster
aatttgtatgtgt

SEQ ID NO: 569258 - DNA, 13 bp, D. melanogaster
aatttgtattaca

SEQ ID NO: 569259 - DNA, 13 bp, D. melanogaster
aatttgtattagt

SEQ ID NO: 569260 - DNA, 14 bp, D. melanogaster
aatttgtattcaaa

SEQ ID NO: 569261 - DNA, 13 bp, D. melanogaster
aatttgtattctt

SEQ ID NO: 569262 - DNA, 13 bp, D. melanogaster
aatttgtattgaa

SEQ ID NO: 569263 - DNA, 13 bp, D. melanogaster
aatttgtattgat

SEQ ID NO: 569264 - DNA, 13 bp, D. melanogaster
aatttgtattgta

SEQ ID NO: 569265 - DNA, 13 bp, D. melanogaster
aatttgtattttc

SEQ ID NO: 569266 - DNA, 14 bp, D. melanogaster
aatttgtatttttc

SEQ ID NO: 569267 - DNA, 13 bp, D. melanogaster
aatttgtcaaaaa

SEQ ID NO: 569268 - DNA, 13 bp, D. melanogaster
aatttgtcaaatt

SEQ ID NO: 569269 - DNA, 13 bp, D. melanogaster
aatttgtcaactt

SEQ ID NO: 569270 - DNA, 13 bp, D. melanogaster
aatttgtcaataa

SEQ ID NO: 569271 - DNA, 13 bp, D. melanogaster
aatttgtcaattt

SEQ ID NO: 569272 - DNA, 13 bp, D. melanogaster
aatttgtccaaat

SEQ ID NO: 569273 - DNA, 13 bp, D. melanogaster
aatttgtcctttt

SEQ ID NO: 569274 - DNA, 13 bp, D. melanogaster
aatttgtcggaaa

SEQ ID NO: 569275 - DNA, 14 bp, D. melanogaster
aatttgtctgcatt

SEQ ID NO: 569276 - DNA, 13 bp, D. melanogaster
aatttgtgaaatt

SEQ ID NO: 569277 - DNA, 13 bp, D. melanogaster
aatttgtgcaaat

SEQ ID NO: 569278 - DNA, 14 bp, D. melanogaster
aatttgtgcaaatt

SEQ ID NO: 569279 - DNA, 13 bp, D. melanogaster
aatttgtgcagct

SEQ ID NO: 569280 - DNA, 13 bp, D. melanogaster
aatttgtgcattt

SEQ ID NO: 569281 - DNA, 13 bp, D. melanogaster
aatttgtgcggca

SEQ ID NO: 569282 - DNA, 13 bp, D. melanogaster
aatttgtgcttat

SEQ ID NO: 569283 - DNA, 13 bp, D. melanogaster
aatttgtggaaaa

SEQ ID NO: 569284 - DNA, 14 bp, D. melanogaster
aatttgtggaaaat

SEQ ID NO: 569285 - DNA, 13 bp, D. melanogaster
aatttgtggaaat

SEQ ID NO: 569286 - DNA, 13 bp, D. melanogaster
aatttgtggacct

SEQ ID NO: 569287 - DNA, 14 bp, D. melanogaster
aatttgtggaccta

SEQ ID NO: 569288 - DNA, 13 bp, D. melanogaster
aatttgtggagct

SEQ ID NO: 569289 - DNA, 13 bp, D. melanogaster
aatttgtggcagc

SEQ ID NO: 569290 - DNA, 13 bp, D. melanogaster
aatttgtgtaaaa

SEQ ID NO: 569291 - DNA, 13 bp, D. melanogaster
aatttgtgtaaat

SEQ ID NO: 569292 - DNA, 13 bp, D. melanogaster
aatttgtgtcaat

SEQ ID NO: 569293 - DNA, 13 bp, D. melanogaster
aatttgtgtgcca

SEQ ID NO: 569294 - DNA, 13 bp, D. melanogaster
aatttgtgtggct

SEQ ID NO: 569295 - DNA, 13 bp, D. melanogaster
aatttgtgtgtgc

SEQ ID NO: 569296 - DNA, 13 bp, D. melanogaster
aatttgtgtgtgt

SEQ ID NO: 569297 - DNA, 13 bp, D. melanogaster
aatttgtgttaaa

SEQ ID NO: 569298 - DNA, 13 bp, D. melanogaster
aatttgtgttctt

SEQ ID NO: 569299 - DNA, 13 bp, D. melanogaster
aatttgtgtttaa

SEQ ID NO: 569300 - DNA, 13 bp, D. melanogaster
aatttgttaaaga

SEQ ID NO: 569301 - DNA, 14 bp, D. melanogaster
aatttgttaaagat

SEQ ID NO: 569302 - DNA, 13 bp, D. melanogaster
aatttgttaaagt

SEQ ID NO: 569303 - DNA, 13 bp, D. melanogaster
aatttgttaagct

SEQ ID NO: 569304 - DNA, 13 bp, D. melanogaster
aatttgttaagtt

SEQ ID NO: 569305 - DNA, 13 bp, D. melanogaster
aatttgttagcca

SEQ ID NO: 569306 - DNA, 13 bp, D. melanogaster
aatttgttcaaat

SEQ ID NO: 569307 - DNA, 14 bp, D. melanogaster
aatttgttcaaatt

SEQ ID NO: 569308 - DNA, 13 bp, D. melanogaster
aatttgttcaaca

SEQ ID NO: 569309 - DNA, 13 bp, D. melanogaster
aatttgttcaata

SEQ ID NO: 569310 - DNA, 13 bp, D. melanogaster
aatttgttcaatt

SEQ ID NO: 569311 - DNA, 13 bp, D. melanogaster
aatttgttcgctg

SEQ ID NO: 569312 - DNA, 14 bp, D. melanogaster
aatttgttctgaaa

SEQ ID NO: 569313 - DNA, 13 bp, D. melanogaster
aatttgttgaaaa

SEQ ID NO: 569314 - DNA, 14 bp, D. melanogaster
aatttgttgaaaaa

SEQ ID NO: 569315 - DNA, 13 bp, D. melanogaster
aatttgttgaaat

SEQ ID NO: 569316 - DNA, 14 bp, D. melanogaster
aatttgttgaatgc

SEQ ID NO: 569317 - DNA, 14 bp, D. melanogaster
aatttgttgacttt

SEQ ID NO: 569318 - DNA, 13 bp, D. melanogaster
aatttgttgataa

SEQ ID NO: 569319 - DNA, 13 bp, D. melanogaster
aatttgttgcaat

SEQ ID NO: 569320 - DNA, 14 bp, D. melanogaster
aatttgttgcaatt

SEQ ID NO: 569321 - DNA, 13 bp, D. melanogaster
aatttgttgcata

SEQ ID NO: 569322 - DNA, 13 bp, D. melanogaster
aatttgttgcatt

SEQ ID NO: 569323 - DNA, 13 bp, D. melanogaster
aatttgttgccaa

SEQ ID NO: 569324 - DNA, 13 bp, D. melanogaster
aatttgttgccac

SEQ ID NO: 569325 - DNA, 13 bp, D. melanogaster
aatttgttgccgc

SEQ ID NO: 569326 - DNA, 14 bp, D. melanogaster
aatttgttgcctaa

SEQ ID NO: 569327 - DNA, 13 bp, D. melanogaster
aatttgttgctaa

SEQ ID NO: 569328 - DNA, 13 bp, D. melanogaster
aatttgttgctgt

SEQ ID NO: 569329 - DNA, 13 bp, D. melanogaster
aatttgttgcttt

SEQ ID NO: 569330 - DNA, 13 bp, D. melanogaster
aatttgttggaaa

SEQ ID NO: 569331 - DNA, 13 bp, D. melanogaster
aatttgttggcca

SEQ ID NO: 569332 - DNA, 13 bp, D. melanogaster
aatttgttggctg

SEQ ID NO: 569333 - DNA, 13 bp, D. melanogaster
aatttgttgtaat

SEQ ID NO: 569334 - DNA, 13 bp, D. melanogaster
aatttgttgtgtg

SEQ ID NO: 569335 - DNA, 13 bp, D. melanogaster
aatttgttgttaa

SEQ ID NO: 569336 - DNA, 13 bp, D. melanogaster
aatttgttgttgc

SEQ ID NO: 569337 - DNA, 13 bp, D. melanogaster
aatttgtttaact

SEQ ID NO: 569338 - DNA, 13 bp, D. melanogaster
aatttgtttaagc

SEQ ID NO: 569339 - DNA, 13 bp, D. melanogaster
aatttgtttacaa

SEQ ID NO: 569340 - DNA, 14 bp, D. melanogaster
aatttgtttacaaa

SEQ ID NO: 569341 - DNA, 13 bp, D. melanogaster
aatttgtttacca

SEQ ID NO: 569342 - DNA, 13 bp, D. melanogaster
aatttgtttaccc

SEQ ID NO: 569343 - DNA, 14 bp, D. melanogaster
aatttgtttacttt

SEQ ID NO: 569344 - DNA, 13 bp, D. melanogaster
aatttgtttagaa

SEQ ID NO: 569345 - DNA, 13 bp, D. melanogaster
aatttgtttagat

SEQ ID NO: 569346 - DNA, 13 bp, D. melanogaster
aatttgtttagca

SEQ ID NO: 569347 - DNA, 14 bp, D. melanogaster
aatttgtttatcaa

SEQ ID NO: 569348 - DNA, 13 bp, D. melanogaster
aatttgtttatgc

SEQ ID NO: 569349 - DNA, 13 bp, D. melanogaster
aatttgtttatgg

SEQ ID NO: 569350 - DNA, 13 bp, D. melanogaster
aatttgtttcaaa

SEQ ID NO: 569351 - DNA, 14 bp, D. melanogaster
aatttgtttcaaat

SEQ ID NO: 569352 - DNA, 13 bp, D. melanogaster
aatttgtttcagt

SEQ ID NO: 569353 - DNA, 13 bp, D. melanogaster
aatttgtttcata

SEQ ID NO: 569354 - DNA, 13 bp, D. melanogaster
aatttgtttccaa

SEQ ID NO: 569355 - DNA, 13 bp, D. melanogaster
aatttgtttctgt

SEQ ID NO: 569356 - DNA, 13 bp, D. melanogaster
aatttgtttgaaa

SEQ ID NO: 569357 - DNA, 14 bp, D. melanogaster
aatttgtttgaaat

SEQ ID NO: 569358 - DNA, 14 bp, D. melanogaster
aatttgtttgccaa

SEQ ID NO: 569359 - DNA, 13 bp, D. melanogaster
aatttgtttgcct

SEQ ID NO: 569360 - DNA, 13 bp, D. melanogaster
aatttgtttgctt

SEQ ID NO: 569361 - DNA, 13 bp, D. melanogaster
aatttgtttgtca

SEQ ID NO: 569362 - DNA, 13 bp, D. melanogaster
aatttgtttgtct

SEQ ID NO: 569363 - DNA, 13 bp, D. melanogaster
aatttgtttgtgg

SEQ ID NO: 569364 - DNA, 13 bp, D. melanogaster
aatttgttttaac

SEQ ID NO: 569365 - DNA, 13 bp, D. melanogaster
aatttgttttaag

SEQ ID NO: 569366 - DNA, 14 bp, D. melanogaster
aatttgttttcaaa

SEQ ID NO: 569367 - DNA, 13 bp, D. melanogaster
aatttgttttcca

SEQ ID NO: 569368 - DNA, 13 bp, D. melanogaster
aatttgttttcga

SEQ ID NO: 569369 - DNA, 13 bp, D. melanogaster
aatttgttttcta

SEQ ID NO: 569370 - DNA, 13 bp, D. melanogaster
aatttgttttgag

SEQ ID NO: 569371 - DNA, 13 bp, D. melanogaster
aatttgttttgca

SEQ ID NO: 569372 - DNA, 13 bp, D. melanogaster
aatttgttttgcc

SEQ ID NO: 569373 - DNA, 14 bp, D. melanogaster
aatttgttttgctg

SEQ ID NO: 569374 - DNA, 13 bp, D. melanogaster
aatttgttttgtc

SEQ ID NO: 569375 - DNA, 13 bp, D. melanogaster
aatttgtttttca

SEQ ID NO: 569376 - DNA, 13 bp, D. melanogaster
aattttaaaacga

SEQ ID NO: 569377 - DNA, 13 bp, D. melanogaster
aattttaaaatgc

SEQ ID NO: 569378 - DNA, 14 bp, D. melanogaster
aattttaaaatgct

SEQ ID NO: 569379 - DNA, 13 bp, D. melanogaster
aattttaaaatgg

SEQ ID NO: 569380 - DNA, 14 bp, D. melanogaster
aattttaaaatgtg

SEQ ID NO: 569381 - DNA, 14 bp, D. melanogaster
aattttaaagcaaa

SEQ ID NO: 569382 - DNA, 13 bp, D. melanogaster
aattttaaagcat

SEQ ID NO: 569383 - DNA, 13 bp, D. melanogaster
aattttaaagcca

SEQ ID NO: 569384 - DNA, 13 bp, D. melanogaster
aattttaaaggca

SEQ ID NO: 569385 - DNA, 13 bp, D. melanogaster
aattttaaagggt

SEQ ID NO: 569386 - DNA, 13 bp, D. melanogaster
aattttaaaggta

SEQ ID NO: 569387 - DNA, 13 bp, D. melanogaster
aattttaaagtgt

SEQ ID NO: 569388 - DNA, 13 bp, D. melanogaster
aattttaaatctc

SEQ ID NO: 569389 - DNA, 13 bp, D. melanogaster
aattttaaatgct

SEQ ID NO: 569390 - DNA, 13 bp, D. melanogaster
aattttaacaagt

SEQ ID NO: 569391 - DNA, 13 bp, D. melanogaster
aattttaacagaa

SEQ ID NO: 569392 - DNA, 13 bp, D. melanogaster
aattttaactttc

SEQ ID NO: 569393 - DNA, 13 bp, D. melanogaster
aattttaagcact

SEQ ID NO: 569394 - DNA, 13 bp, D. melanogaster
aattttaagcaga

SEQ ID NO: 569395 - DNA, 13 bp, D. melanogaster
aattttaagctta

SEQ ID NO: 569396 - DNA, 13 bp, D. melanogaster
aattttaagcttt

SEQ ID NO: 569397 - DNA, 13 bp, D. melanogaster
aattttaagtgaa

SEQ ID NO: 569398 - DNA, 14 bp, D. melanogaster
aattttaagtgcaa

SEQ ID NO: 569399 - DNA, 13 bp, D. melanogaster
aattttaagtggc

SEQ ID NO: 569400 - DNA, 13 bp, D. melanogaster
aattttaatcaag

SEQ ID NO: 569401 - DNA, 13 bp, D. melanogaster
aattttaatccca

SEQ ID NO: 569402 - DNA, 13 bp, D. melanogaster
aattttaatgagc

SEQ ID NO: 569403 - DNA, 13 bp, D. melanogaster
aattttaatgcaa

SEQ ID NO: 569404 - DNA, 14 bp, D. melanogaster
aattttaatgcaaa

SEQ ID NO: 569405 - DNA, 13 bp, D. melanogaster
aattttaatgcca

SEQ ID NO: 569406 - DNA, 13 bp, D. melanogaster
aattttaatggca

SEQ ID NO: 569407 - DNA, 13 bp, D. melanogaster
aattttaatggtt

SEQ ID NO: 569408 - DNA, 13 bp, D. melanogaster
aattttaatgtgt

SEQ ID NO: 569409 - DNA, 13 bp, D. melanogaster
aattttaattgca

SEQ ID NO: 569410 - DNA, 14 bp, D. melanogaster
aattttaattgcaa

SEQ ID NO: 569411 - DNA, 14 bp, D. melanogaster
aattttaattgcat

SEQ ID NO: 569412 - DNA, 13 bp, D. melanogaster
aattttaatttcg

SEQ ID NO: 569413 - DNA, 14 bp, D. melanogaster
aattttacaaaatc

SEQ ID NO: 569414 - DNA, 13 bp, D. melanogaster
aattttacaaact

SEQ ID NO: 569415 - DNA, 13 bp, D. melanogaster
aattttacatatg

SEQ ID NO: 569416 - DNA, 13 bp, D. melanogaster
aattttaccaaat

SEQ ID NO: 569417 - DNA, 13 bp, D. melanogaster
aattttacccaaa

SEQ ID NO: 569418 - DNA, 13 bp, D. melanogaster
aattttacccaga

SEQ ID NO: 569419 - DNA, 13 bp, D. melanogaster
aattttactgctt

SEQ ID NO: 569420 - DNA, 14 bp, D. melanogaster
aattttacttcttc

SEQ ID NO: 569421 - DNA, 13 bp, D. melanogaster
aattttactttca

SEQ ID NO: 569422 - DNA, 13 bp, D. melanogaster
aattttagatttc

SEQ ID NO: 569423 - DNA, 13 bp, D. melanogaster
aattttagatttg

SEQ ID NO: 569424 - DNA, 13 bp, D. melanogaster
aattttagcaaat

SEQ ID NO: 569425 - DNA, 13 bp, D. melanogaster
aattttagcattt

SEQ ID NO: 569426 - DNA, 13 bp, D. melanogaster
aattttagctttt

SEQ ID NO: 569427 - DNA, 13 bp, D. melanogaster
aattttatattgc

SEQ ID NO: 569428 - DNA, 13 bp, D. melanogaster
aattttatcgtcg

SEQ ID NO: 569429 - DNA, 13 bp, D. melanogaster
aattttatgaaca

SEQ ID NO: 569430 - DNA, 14 bp, D. melanogaster
aattttatgagcat

SEQ ID NO: 569431 - DNA, 13 bp, D. melanogaster
aattttatgagct

SEQ ID NO: 569432 - DNA, 13 bp, D. melanogaster
aattttatgatgt

SEQ ID NO: 569433 - DNA, 13 bp, D. melanogaster
aattttatgcaaa

SEQ ID NO: 569434 - DNA, 14 bp, D. melanogaster
aattttatgcaaaa

SEQ ID NO: 569435 - DNA, 14 bp, D. melanogaster
aattttatgcaaat

SEQ ID NO: 569436 - DNA, 13 bp, D. melanogaster
aattttatgcagc

SEQ ID NO: 569437 - DNA, 13 bp, D. melanogaster
aattttatgcatt

SEQ ID NO: 569438 - DNA, 13 bp, D. melanogaster
aattttatgcgtt

SEQ ID NO: 569439 - DNA, 13 bp, D. melanogaster
aattttatgtgta

SEQ ID NO: 569440 - DNA, 13 bp, D. melanogaster
aattttattcgtt

SEQ ID NO: 569441 - DNA, 14 bp, D. melanogaster
aattttattgattc

SEQ ID NO: 569442 - DNA, 13 bp, D. melanogaster
aattttattgcca

SEQ ID NO: 569443 - DNA, 13 bp, D. melanogaster
aattttattgctt

SEQ ID NO: 569444 - DNA, 13 bp, D. melanogaster
aattttattggca

SEQ ID NO: 569445 - DNA, 13 bp, D. melanogaster
aattttatttgca

SEQ ID NO: 569446 - DNA, 13 bp, D. melanogaster
aattttatttgcc

SEQ ID NO: 569447 - DNA, 14 bp, D. melanogaster
aattttatttggaa

SEQ ID NO: 569448 - DNA, 14 bp, D. melanogaster
aattttatttggct

SEQ ID NO: 569449 - DNA, 13 bp, D. melanogaster
aattttcaaaaac

SEQ ID NO: 569450 - DNA, 13 bp, D. melanogaster
aattttcaaaaca

SEQ ID NO: 569451 - DNA, 13 bp, D. melanogaster
aattttcaaaatg

SEQ ID NO: 569452 - DNA, 13 bp, D. melanogaster
aattttcaaacac

SEQ ID NO: 569453 - DNA, 13 bp, D. melanogaster
aattttcaaattg

SEQ ID NO: 569454 - DNA, 14 bp, D. melanogaster
aattttcaaatttc

SEQ ID NO: 569455 - DNA, 13 bp, D. melanogaster
aattttcaacaaa

SEQ ID NO: 569456 - DNA, 13 bp, D. melanogaster
aattttcaacatt

SEQ ID NO: 569457 - DNA, 13 bp, D. melanogaster
aattttcaacgaa

SEQ ID NO: 569458 - DNA, 14 bp, D. melanogaster
aattttcaacgaat

SEQ ID NO: 569459 - DNA, 13 bp, D. melanogaster
aattttcaataca

SEQ ID NO: 569460 - DNA, 13 bp, D. melanogaster
aattttcaatcag

SEQ ID NO: 569461 - DNA, 13 bp, D. melanogaster
aattttcaatgaa

SEQ ID NO: 569462 - DNA, 14 bp, D. melanogaster
aattttcaatgaaa

SEQ ID NO: 569463 - DNA, 13 bp, D. melanogaster
aattttcacaaaa

SEQ ID NO: 569464 - DNA, 13 bp, D. melanogaster
aattttcacaaat

SEQ ID NO: 569465 - DNA, 13 bp, D. melanogaster
aattttcacagca

SEQ ID NO: 569466 - DNA, 13 bp, D. melanogaster
aattttcacagtt

SEQ ID NO: 569467 - DNA, 13 bp, D. melanogaster
aattttcaccatt

SEQ ID NO: 569468 - DNA, 13 bp, D. melanogaster
aattttcacgttt

SEQ ID NO: 569469 - DNA, 13 bp, D. melanogaster
aattttcacttaa

SEQ ID NO: 569470 - DNA, 13 bp, D. melanogaster
aattttcacttca

SEQ ID NO: 569471 - DNA, 13 bp, D. melanogaster
aattttcagccaa

SEQ ID NO: 569472 - DNA, 13 bp, D. melanogaster
aattttcagcgtt

SEQ ID NO: 569473 - DNA, 13 bp, D. melanogaster
aattttcagtttg

SEQ ID NO: 569474 - DNA, 13 bp, D. melanogaster
aattttcagtttt

SEQ ID NO: 569475 - DNA, 14 bp, D. melanogaster
aattttcagtttta

SEQ ID NO: 569476 - DNA, 13 bp, D. melanogaster
aattttcatacaa

SEQ ID NO: 569477 - DNA, 14 bp, D. melanogaster
aattttcatatacc

SEQ ID NO: 569478 - DNA, 13 bp, D. melanogaster
aattttcatgaat

SEQ ID NO: 569479 - DNA, 13 bp, D. melanogaster
aattttcatgttc

SEQ ID NO: 569480 - DNA, 13 bp, D. melanogaster
aattttcattcaa

SEQ ID NO: 569481 - DNA, 13 bp, D. melanogaster
aattttcattcat

SEQ ID NO: 569482 - DNA, 13 bp, D. melanogaster
aattttcattgtt

SEQ ID NO: 569483 - DNA, 13 bp, D. melanogaster
aattttcatttgc

SEQ ID NO: 569484 - DNA, 14 bp, D. melanogaster
aattttcatttgca

SEQ ID NO: 569485 - DNA, 13 bp, D. melanogaster
aattttcatttgt

SEQ ID NO: 569486 - DNA, 13 bp, D. melanogaster
aattttcattttg

SEQ ID NO: 569487 - DNA, 13 bp, D. melanogaster
aattttccaaaaa

SEQ ID NO: 569488 - DNA, 14 bp, D. melanogaster
aattttccaaaaag

SEQ ID NO: 569489 - DNA, 14 bp, D. melanogaster
aattttccaaaaat

SEQ ID NO: 569490 - DNA, 13 bp, D. melanogaster
aattttccaacac

SEQ ID NO: 569491 - DNA, 13 bp, D. melanogaster
aattttccaacgc

SEQ ID NO: 569492 - DNA, 13 bp, D. melanogaster
aattttccaactt

SEQ ID NO: 569493 - DNA, 13 bp, D. melanogaster
aattttccaatat

SEQ ID NO: 569494 - DNA, 13 bp, D. melanogaster
aattttccacaaa

SEQ ID NO: 569495 - DNA, 14 bp, D. melanogaster
aattttccacaaat

SEQ ID NO: 569496 - DNA, 13 bp, D. melanogaster
aattttccacaac

SEQ ID NO: 569497 - DNA, 13 bp, D. melanogaster
aattttccacagc

SEQ ID NO: 569498 - DNA, 13 bp, D. melanogaster
aattttccacatt

SEQ ID NO: 569499 - DNA, 14 bp, D. melanogaster
aattttccacattt

SEQ ID NO: 569500 - DNA, 13 bp, D. melanogaster
aattttccaccga

SEQ ID NO: 569501 - DNA, 13 bp, D. melanogaster
aattttccacttt

SEQ ID NO: 569502 - DNA, 13 bp, D. melanogaster
aattttccagcca

SEQ ID NO: 569503 - DNA, 13 bp, D. melanogaster
aattttccagttt

SEQ ID NO: 569504 - DNA, 13 bp, D. melanogaster
aattttccatgtg

SEQ ID NO: 569505 - DNA, 14 bp, D. melanogaster
aattttccatttgt

SEQ ID NO: 569506 - DNA, 14 bp, D. melanogaster
aattttccattttc

SEQ ID NO: 569507 - DNA, 13 bp, D. melanogaster
aattttcccaaaa

SEQ ID NO: 569508 - DNA, 13 bp, D. melanogaster
aattttcccactt

SEQ ID NO: 569509 - DNA, 13 bp, D. melanogaster
aattttcccagat

SEQ ID NO: 569510 - DNA, 13 bp, D. melanogaster
aattttcccatca

SEQ ID NO: 569511 - DNA, 14 bp, D. melanogaster
aattttccccatat

SEQ ID NO: 569512 - DNA, 13 bp, D. melanogaster
aattttccccatt

SEQ ID NO: 569513 - DNA, 13 bp, D. melanogaster
aattttcccccaa

SEQ ID NO: 569514 - DNA, 13 bp, D. melanogaster
aattttccgaaaa

SEQ ID NO: 569515 - DNA, 13 bp, D. melanogaster
aattttccgcaca

SEQ ID NO: 569516 - DNA, 13 bp, D. melanogaster
aattttccgcact

SEQ ID NO: 569517 - DNA, 13 bp, D. melanogaster
aattttccgccca

SEQ ID NO: 569518 - DNA, 13 bp, D. melanogaster
aattttcctatac

SEQ ID NO: 569519 - DNA, 14 bp, D. melanogaster
aattttcgaaaaag

SEQ ID NO: 569520 - DNA, 13 bp, D. melanogaster
aattttcgaaaat

SEQ ID NO: 569521 - DNA, 13 bp, D. melanogaster
aattttcgaaatg

SEQ ID NO: 569522 - DNA, 13 bp, D. melanogaster
aattttcgaatat

SEQ ID NO: 569523 - DNA, 14 bp, D. melanogaster
aattttcgaatttt

SEQ ID NO: 569524 - DNA, 13 bp, D. melanogaster
aattttcgacttt

SEQ ID NO: 569525 - DNA, 13 bp, D. melanogaster
aattttcgatatt

SEQ ID NO: 569526 - DNA, 13 bp, D. melanogaster
aattttcgatttt

SEQ ID NO: 569527 - DNA, 13 bp, D. melanogaster
aattttcgcaaat

SEQ ID NO: 569528 - DNA, 13 bp, D. melanogaster
aattttcgcaaca

SEQ ID NO: 569529 - DNA, 13 bp, D. melanogaster
aattttcgcacat

SEQ ID NO: 569530 - DNA, 13 bp, D. melanogaster
aattttcgcattt

SEQ ID NO: 569531 - DNA, 13 bp, D. melanogaster
aattttcgccaaa

SEQ ID NO: 569532 - DNA, 13 bp, D. melanogaster
aattttcgccatt

SEQ ID NO: 569533 - DNA, 13 bp, D. melanogaster
aattttcgctttt

SEQ ID NO: 569534 - DNA, 13 bp, D. melanogaster
aattttcggaaat

SEQ ID NO: 569535 - DNA, 13 bp, D. melanogaster
aattttcggcatt

SEQ ID NO: 569536 - DNA, 13 bp, D. melanogaster
aattttcggttaa

SEQ ID NO: 569537 - DNA, 13 bp, D. melanogaster
aattttcgtacaa

SEQ ID NO: 569538 - DNA, 13 bp, D. melanogaster
aattttcgtattt

SEQ ID NO: 569539 - DNA, 13 bp, D. melanogaster
aattttcgtttat

SEQ ID NO: 569540 - DNA, 13 bp, D. melanogaster
aattttcgtttga

SEQ ID NO: 569541 - DNA, 13 bp, D. melanogaster
aattttcgttttc

SEQ ID NO: 569542 - DNA, 13 bp, D. melanogaster
aattttctaacaa

SEQ ID NO: 569543 - DNA, 13 bp, D. melanogaster
aattttctatccg

SEQ ID NO: 569544 - DNA, 13 bp, D. melanogaster
aattttctcgttt

SEQ ID NO: 569545 - DNA, 13 bp, D. melanogaster
aattttctgaaga

SEQ ID NO: 569546 - DNA, 13 bp, D. melanogaster
aattttctgaatt

SEQ ID NO: 569547 - DNA, 13 bp, D. melanogaster
aattttctgcaaa

SEQ ID NO: 569548 - DNA, 13 bp, D. melanogaster
aattttctgcttt

SEQ ID NO: 569549 - DNA, 13 bp, D. melanogaster
aattttctgggaa

SEQ ID NO: 569550 - DNA, 13 bp, D. melanogaster
aattttctgtaat

SEQ ID NO: 569551 - DNA, 13 bp, D. melanogaster
aattttctgtata

SEQ ID NO: 569552 - DNA, 13 bp, D. melanogaster
aattttctgtatt

SEQ ID NO: 569553 - DNA, 14 bp, D. melanogaster
aattttctgtattg

SEQ ID NO: 569554 - DNA, 14 bp, D. melanogaster
aattttctgttgcc

SEQ ID NO: 569555 - DNA, 13 bp, D. melanogaster
aattttcttcaat

SEQ ID NO: 569556 - DNA, 13 bp, D. melanogaster
aattttctttcaa

SEQ ID NO: 569557 - DNA, 13 bp, D. melanogaster
aattttctttccc

SEQ ID NO: 569558 - DNA, 13 bp, D. melanogaster
aattttctttctg

SEQ ID NO: 569559 - DNA, 13 bp, D. melanogaster
aattttgaaacaa

SEQ ID NO: 569560 - DNA, 13 bp, D. melanogaster
aattttgaaacat

SEQ ID NO: 569561 - DNA, 13 bp, D. melanogaster
aattttgaaactt

SEQ ID NO: 569562 - DNA, 13 bp, D. melanogaster
aattttgaaatgt

SEQ ID NO: 569563 - DNA, 13 bp, D. melanogaster
aattttgaacaaa

SEQ ID NO: 569564 - DNA, 13 bp, D. melanogaster
aattttgaacatt

SEQ ID NO: 569565 - DNA, 13 bp, D. melanogaster
aattttgaactca

SEQ ID NO: 569566 - DNA, 13 bp, D. melanogaster
aattttgaagaaa

SEQ ID NO: 569567 - DNA, 13 bp, D. melanogaster
aattttgaatgaa

SEQ ID NO: 569568 - DNA, 13 bp, D. melanogaster
aattttgacaaaa

SEQ ID NO: 569569 - DNA, 14 bp, D. melanogaster
aattttgacaaaaa

SEQ ID NO: 569570 - DNA, 14 bp, D. melanogaster
aattttgaccattt

SEQ ID NO: 569571 - DNA, 13 bp, D. melanogaster
aattttgatcaaa

SEQ ID NO: 569572 - DNA, 13 bp, D. melanogaster
aattttgatttag

SEQ ID NO: 569573 - DNA, 13 bp, D. melanogaster
aattttgcaaaat

SEQ ID NO: 569574 - DNA, 13 bp, D. melanogaster
aattttgcaaata

SEQ ID NO: 569575 - DNA, 14 bp, D. melanogaster
aattttgcaaatat

SEQ ID NO: 569576 - DNA, 13 bp, D. melanogaster
aattttgcaataa

SEQ ID NO: 569577 - DNA, 13 bp, D. melanogaster
aattttgcaattt

SEQ ID NO: 569578 - DNA, 14 bp, D. melanogaster
aattttgcaatttt

SEQ ID NO: 569579 - DNA, 13 bp, D. melanogaster
aattttgcacaat

SEQ ID NO: 569580 - DNA, 13 bp, D. melanogaster
aattttgcagctg

SEQ ID NO: 569581 - DNA, 13 bp, D. melanogaster
aattttgcataac

SEQ ID NO: 569582 - DNA, 13 bp, D. melanogaster
aattttgcatgcc

SEQ ID NO: 569583 - DNA, 13 bp, D. melanogaster
aattttgcattaa

SEQ ID NO: 569584 - DNA, 13 bp, D. melanogaster
aattttgcatttg

SEQ ID NO: 569585 - DNA, 13 bp, D. melanogaster
aattttgcatttt

SEQ ID NO: 569586 - DNA, 14 bp, D. melanogaster
aattttgcattttt

SEQ ID NO: 569587 - DNA, 13 bp, D. melanogaster
aattttgccagct

SEQ ID NO: 569588 - DNA, 14 bp, D. melanogaster
aattttgccagcta

SEQ ID NO: 569589 - DNA, 13 bp, D. melanogaster
aattttgcgaaaa

SEQ ID NO: 569590 - DNA, 13 bp, D. melanogaster
aattttgcggtca

SEQ ID NO: 569591 - DNA, 14 bp, D. melanogaster
aattttgctaaaaa

SEQ ID NO: 569592 - DNA, 13 bp, D. melanogaster
aattttgctaaat

SEQ ID NO: 569593 - DNA, 13 bp, D. melanogaster
aattttgctcatt

SEQ ID NO: 569594 - DNA, 13 bp, D. melanogaster
aattttgctggta

SEQ ID NO: 569595 - DNA, 13 bp, D. melanogaster
aattttgcttaaa

SEQ ID NO: 569596 - DNA, 13 bp, D. melanogaster
aattttggcaaca

SEQ ID NO: 569597 - DNA, 22 bp, D. melanogaster
aattttggccgtcaccaaaaaa

SEQ ID NO: 569598 - DNA, 13 bp, D. melanogaster
aattttgggaaaa

SEQ ID NO: 569599 - DNA, 13 bp, D. melanogaster
aattttggtaaaa

SEQ ID NO: 569600 - DNA, 14 bp, D. melanogaster
aattttggttaaaa

SEQ ID NO: 569601 - DNA, 13 bp, D. melanogaster
aattttggttttc

SEQ ID NO: 569602 - DNA, 13 bp, D. melanogaster
aattttgtaacta

SEQ ID NO: 569603 - DNA, 14 bp, D. melanogaster
aattttgtaggagc

SEQ ID NO: 569604 - DNA, 14 bp, D. melanogaster
aattttgtatcttt

SEQ ID NO: 569605 - DNA, 13 bp, D. melanogaster
aattttgtatgcc

SEQ ID NO: 569606 - DNA, 13 bp, D. melanogaster
aattttgtcaaaa

SEQ ID NO: 569607 - DNA, 14 bp, D. melanogaster
aattttgtcaaaat

SEQ ID NO: 569608 - DNA, 14 bp, D. melanogaster
aattttgtcaattt

SEQ ID NO: 569609 - DNA, 13 bp, D. melanogaster
aattttgtgaaaa

SEQ ID NO: 569610 - DNA, 13 bp, D. melanogaster
aattttgtgcttt

SEQ ID NO: 569611 - DNA, 13 bp, D. melanogaster
aattttgtggctg

SEQ ID NO: 569612 - DNA, 14 bp, D. melanogaster
aattttgtgtgcgg

SEQ ID NO: 569613 - DNA, 13 bp, D. melanogaster
aattttgtgttaa

SEQ ID NO: 569614 - DNA, 14 bp, D. melanogaster
aattttgttcattt

SEQ ID NO: 569615 - DNA, 13 bp, D. melanogaster
aattttgttgaaa

SEQ ID NO: 569616 - DNA, 13 bp, D. melanogaster
aattttgttggat

SEQ ID NO: 569617 - DNA, 13 bp, D. melanogaster
aattttgttggca

SEQ ID NO: 569618 - DNA, 13 bp, D. melanogaster
aattttgtttcgt

SEQ ID NO: 569619 - DNA, 13 bp, D. melanogaster
aattttgtttgaa

SEQ ID NO: 569620 - DNA, 13 bp, D. melanogaster
aattttgttttgc

SEQ ID NO: 569621 - DNA, 13 bp, D. melanogaster
aatttttaaaacc

SEQ ID NO: 569622 - DNA, 13 bp, D. melanogaster
aatttttaaagag

SEQ ID NO: 569623 - DNA, 13 bp, D. melanogaster
aatttttaaagca

SEQ ID NO: 569624 - DNA, 13 bp, D. melanogaster
aatttttaaagtg

SEQ ID NO: 569625 - DNA, 13 bp, D. melanogaster
aatttttaagcat

SEQ ID NO: 569626 - DNA, 13 bp, D. melanogaster
aatttttacgatt

SEQ ID NO: 569627 - DNA, 13 bp, D. melanogaster
aatttttactcaa

SEQ ID NO: 569628 - DNA, 13 bp, D. melanogaster
aatttttagactt

SEQ ID NO: 569629 - DNA, 13 bp, D. melanogaster
aatttttatcatc

SEQ ID NO: 569630 - DNA, 13 bp, D. melanogaster
aatttttatgaca

SEQ ID NO: 569631 - DNA, 14 bp, D. melanogaster
aatttttatggcat

SEQ ID NO: 569632 - DNA, 14 bp, D. melanogaster
aatttttatggcca

SEQ ID NO: 569633 - DNA, 13 bp, D. melanogaster
aatttttatggtc

SEQ ID NO: 569634 - DNA, 13 bp, D. melanogaster
aatttttcaaaag

SEQ ID NO: 569635 - DNA, 14 bp, D. melanogaster
aatttttcaaaagc

SEQ ID NO: 569636 - DNA, 13 bp, D. melanogaster
aatttttcaaaga

SEQ ID NO: 569637 - DNA, 13 bp, D. melanogaster
aatttttcaacat

SEQ ID NO: 569638 - DNA, 13 bp, D. melanogaster
aatttttcaagaa

SEQ ID NO: 569639 - DNA, 13 bp, D. melanogaster
aatttttcaattc

SEQ ID NO: 569640 - DNA, 13 bp, D. melanogaster
aatttttcaattg

SEQ ID NO: 569641 - DNA, 13 bp, D. melanogaster
aatttttcacacg

SEQ ID NO: 569642 - DNA, 14 bp, D. melanogaster
aatttttcacctgc

SEQ ID NO: 569643 - DNA, 13 bp, D. melanogaster
aatttttcatcat

SEQ ID NO: 569644 - DNA, 13 bp, D. melanogaster
aatttttccaaag

SEQ ID NO: 569645 - DNA, 13 bp, D. melanogaster
aatttttccaaat

SEQ ID NO: 569646 - DNA, 13 bp, D. melanogaster
aatttttccaatt

SEQ ID NO: 569647 - DNA, 13 bp, D. melanogaster
aatttttcgaaat

SEQ ID NO: 569648 - DNA, 13 bp, D. melanogaster
aatttttcgagct

SEQ ID NO: 569649 - DNA, 13 bp, D. melanogaster
aatttttcgttga

SEQ ID NO: 569650 - DNA, 13 bp, D. melanogaster
aatttttctcata

SEQ ID NO: 569651 - DNA, 14 bp, D. melanogaster
aatttttctcggca

SEQ ID NO: 569652 - DNA, 13 bp, D. melanogaster
aatttttctgatt

SEQ ID NO: 569653 - DNA, 13 bp, D. melanogaster
aatttttgaagaa

SEQ ID NO: 569654 - DNA, 13 bp, D. melanogaster
aatttttgaagtg

SEQ ID NO: 569655 - DNA, 13 bp, D. melanogaster
aatttttgacaac

SEQ ID NO: 569656 - DNA, 13 bp, D. melanogaster
aatttttgacagc

SEQ ID NO: 569657 - DNA, 14 bp, D. melanogaster
aatttttgagcata

SEQ ID NO: 569658 - DNA, 14 bp, D. melanogaster
aatttttgatggtt

SEQ ID NO: 569659 - DNA, 13 bp, D. melanogaster
aatttttgcaaaa

SEQ ID NO: 569660 - DNA, 13 bp, D. melanogaster
aatttttgcaatt

SEQ ID NO: 569661 - DNA, 13 bp, D. melanogaster
aatttttgcacaa

SEQ ID NO: 569662 - DNA, 13 bp, D. melanogaster
aatttttgcacag

SEQ ID NO: 569663 - DNA, 13 bp, D. melanogaster
aatttttgccaaa

SEQ ID NO: 569664 - DNA, 13 bp, D. melanogaster
aatttttgccatt

SEQ ID NO: 569665 - DNA, 13 bp, D. melanogaster
aatttttgcgaaa

SEQ ID NO: 569666 - DNA, 13 bp, D. melanogaster
aatttttgctgct

SEQ ID NO: 569667 - DNA, 13 bp, D. melanogaster
aatttttgcttgt

SEQ ID NO: 569668 - DNA, 13 bp, D. melanogaster
aatttttggaaaa

SEQ ID NO: 569669 - DNA, 13 bp, D. melanogaster
aatttttggaaat

SEQ ID NO: 569670 - DNA, 14 bp, D. melanogaster
aatttttggaaatt

SEQ ID NO: 569671 - DNA, 13 bp, D. melanogaster
aatttttggccaa

SEQ ID NO: 569672 - DNA, 14 bp, D. melanogaster
aatttttggccaaa

SEQ ID NO: 569673 - DNA, 14 bp, D. melanogaster
aatttttggctttt

SEQ ID NO: 569674 - DNA, 13 bp, D. melanogaster
aatttttgggctt

SEQ ID NO: 569675 - DNA, 13 bp, D. melanogaster
aatttttggtaat

SEQ ID NO: 569676 - DNA, 13 bp, D. melanogaster
aatttttggtatc

SEQ ID NO: 569677 - DNA, 13 bp, D. melanogaster
aatttttgtagca

SEQ ID NO: 569678 - DNA, 13 bp, D. melanogaster
aatttttgtcaat

SEQ ID NO: 569679 - DNA, 13 bp, D. melanogaster
aatttttgtgaaa

SEQ ID NO: 569680 - DNA, 14 bp, D. melanogaster
aatttttgtgcaaa

SEQ ID NO: 569681 - DNA, 13 bp, D. melanogaster
aatttttgtgcgc

SEQ ID NO: 569682 - DNA, 13 bp, D. melanogaster
aatttttgtggcc

SEQ ID NO: 569683 - DNA, 13 bp, D. melanogaster
aatttttgtgtca

SEQ ID NO: 569684 - DNA, 13 bp, D. melanogaster
aatttttgttaga

SEQ ID NO: 569685 - DNA, 13 bp, D. melanogaster
aatttttgttagc

SEQ ID NO: 569686 - DNA, 13 bp, D. melanogaster
aatttttgttcat

SEQ ID NO: 569687 - DNA, 13 bp, D. melanogaster
aatttttgttgaa

SEQ ID NO: 569688 - DNA, 13 bp, D. melanogaster
aatttttgtttgc

SEQ ID NO: 569689 - DNA, 14 bp, D. melanogaster
aatttttgtttgct

SEQ ID NO: 569690 - DNA, 14 bp, D. melanogaster
aattttttaaaagc

SEQ ID NO: 569691 - DNA, 13 bp, D. melanogaster
aattttttatgca

SEQ ID NO: 569692 - DNA, 13 bp, D. melanogaster
aattttttcaaca

SEQ ID NO: 569693 - DNA, 13 bp, D. melanogaster
aattttttcacat

SEQ ID NO: 569694 - DNA, 13 bp, D. melanogaster
aattttttcagat

SEQ ID NO: 569695 - DNA, 13 bp, D. melanogaster
aattttttccagc

SEQ ID NO: 569696 - DNA, 14 bp, D. melanogaster
aattttttcgattt

SEQ ID NO: 569697 - DNA, 13 bp, D. melanogaster
aattttttcgcat

SEQ ID NO: 569698 - DNA, 13 bp, D. melanogaster
aattttttctaca

SEQ ID NO: 569699 - DNA, 13 bp, D. melanogaster
aattttttgcagt

SEQ ID NO: 569700 - DNA, 14 bp, D. melanogaster
aattttttgcattt

SEQ ID NO: 569701 - DNA, 14 bp, D. melanogaster
aattttttgtttgc

SEQ ID NO: 569702 - DNA, 14 bp, D. melanogaster
aatttttttgccat

SEQ ID NO: 569703 - DNA, 13 bp, D. melanogaster
acaaaaaaccatg

SEQ ID NO: 569704 - DNA, 13 bp, D. melanogaster
acaaaaaactttg

SEQ ID NO: 569705 - DNA, 13 bp, D. melanogaster
acaaaaaagattt

SEQ ID NO: 569706 - DNA, 13 bp, D. melanogaster
acaaaaaagcatt

SEQ ID NO: 569707 - DNA, 13 bp, D. melanogaster
acaaaaaagcgtt

SEQ ID NO: 569708 - DNA, 13 bp, D. melanogaster
acaaaaaagtgta

SEQ ID NO: 569709 - DNA, 13 bp, D. melanogaster
acaaaaaagtgtg

SEQ ID NO: 569710 - DNA, 13 bp, D. melanogaster
acaaaaaagttca

SEQ ID NO: 569711 - DNA, 13 bp, D. melanogaster
acaaaaaagttta

SEQ ID NO: 569712 - DNA, 14 bp, D. melanogaster
acaaaaaatgcgaa

SEQ ID NO: 569713 - DNA, 13 bp, D. melanogaster
acaaaaaatggcc

SEQ ID NO: 569714 - DNA, 13 bp, D. melanogaster
acaaaaaatgtat

SEQ ID NO: 569715 - DNA, 13 bp, D. melanogaster
acaaaaaatgttg

SEQ ID NO: 569716 - DNA, 13 bp, D. melanogaster
acaaaaaatgttt

SEQ ID NO: 569717 - DNA, 13 bp, D. melanogaster
acaaaaaattcga

SEQ ID NO: 569718 - DNA, 14 bp, D. melanogaster
acaaaaaattgttt

SEQ ID NO: 569719 - DNA, 13 bp, D. melanogaster
acaaaaacaatgc

SEQ ID NO: 569720 - DNA, 13 bp, D. melanogaster
acaaaaacaatgt

SEQ ID NO: 569721 - DNA, 13 bp, D. melanogaster
acaaaaacaattg

SEQ ID NO: 569722 - DNA, 13 bp, D. melanogaster
acaaaaacacatg

SEQ ID NO: 569723 - DNA, 13 bp, D. melanogaster
acaaaaacacttt

SEQ ID NO: 569724 - DNA, 13 bp, D. melanogaster
acaaaaacattgc

SEQ ID NO: 569725 - DNA, 14 bp, D. melanogaster
acaaaaacattttg

SEQ ID NO: 569726 - DNA, 14 bp, D. melanogaster
acaaaaacattttt

SEQ ID NO: 569727 - DNA, 13 bp, D. melanogaster
acaaaaacgattt

SEQ ID NO: 569728 - DNA, 13 bp, D. melanogaster
acaaaaacgtaat

SEQ ID NO: 569729 - DNA, 14 bp, D. melanogaster
acaaaaactactta

SEQ ID NO: 569730 - DNA, 13 bp, D. melanogaster
acaaaaactgaag

SEQ ID NO: 569731 - DNA, 14 bp, D. melanogaster
acaaaaactgaagc

SEQ ID NO: 569732 - DNA, 13 bp, D. melanogaster
acaaaaactgcaa

SEQ ID NO: 569733 - DNA, 13 bp, D. melanogaster
acaaaaacttatt

SEQ ID NO: 569734 - DNA, 13 bp, D. melanogaster
acaaaaacttgag

SEQ ID NO: 569735 - DNA, 14 bp, D. melanogaster
acaaaaactttatt

SEQ ID NO: 569736 - DNA, 13 bp, D. melanogaster
acaaaaacttttc

SEQ ID NO: 569737 - DNA, 13 bp, D. melanogaster
acaaaaacttttg

SEQ ID NO: 569738 - DNA, 13 bp, D. melanogaster
acaaaaacttttt

SEQ ID NO: 569739 - DNA, 13 bp, D. melanogaster
acaaaaagcattc

SEQ ID NO: 569740 - DNA, 13 bp, D. melanogaster
acaaaaagccagc

SEQ ID NO: 569741 - DNA, 13 bp, D. melanogaster
acaaaaagccatt

SEQ ID NO: 569742 - DNA, 13 bp, D. melanogaster
acaaaaagctgag

SEQ ID NO: 569743 - DNA, 13 bp, D. melanogaster
acaaaaagctgca

SEQ ID NO: 569744 - DNA, 13 bp, D. melanogaster
acaaaaagcttag

SEQ ID NO: 569745 - DNA, 13 bp, D. melanogaster
acaaaaagctttc

SEQ ID NO: 569746 - DNA, 14 bp, D. melanogaster
acaaaaaggaaatt

SEQ ID NO: 569747 - DNA, 13 bp, D. melanogaster
acaaaaaggttaa

SEQ ID NO: 569748 - DNA, 14 bp, D. melanogaster
acaaaaagtatctg

SEQ ID NO: 569749 - DNA, 13 bp, D. melanogaster
acaaaaagtatta

SEQ ID NO: 569750 - DNA, 13 bp, D. melanogaster
acaaaaagtattt

SEQ ID NO: 569751 - DNA, 13 bp, D. melanogaster
acaaaaagtcaac

SEQ ID NO: 569752 - DNA, 13 bp, D. melanogaster
acaaaaagtggtc

SEQ ID NO: 569753 - DNA, 13 bp, D. melanogaster
acaaaaagttaac

SEQ ID NO: 569754 - DNA, 13 bp, D. melanogaster
acaaaaagttcaa

SEQ ID NO: 569755 - DNA, 13 bp, D. melanogaster
acaaaaagttgta

SEQ ID NO: 569756 - DNA, 13 bp, D. melanogaster
acaaaaatagcac

SEQ ID NO: 569757 - DNA, 13 bp, D. melanogaster
acaaaaatagttt

SEQ ID NO: 569758 - DNA, 13 bp, D. melanogaster
acaaaaatattgt

SEQ ID NO: 569759 - DNA, 13 bp, D. melanogaster
acaaaaatcacga

SEQ ID NO: 569760 - DNA, 13 bp, D. melanogaster
acaaaaatcattt

SEQ ID NO: 569761 - DNA, 13 bp, D. melanogaster
acaaaaatcctgc

SEQ ID NO: 569762 - DNA, 14 bp, D. melanogaster
acaaaaatgacgaa

SEQ ID NO: 569763 - DNA, 13 bp, D. melanogaster
acaaaaatgatat

SEQ ID NO: 569764 - DNA, 13 bp, D. melanogaster
acaaaaatgcact

SEQ ID NO: 569765 - DNA, 13 bp, D. melanogaster
acaaaaatgcatt

SEQ ID NO: 569766 - DNA, 13 bp, D. melanogaster
acaaaaatgccaa

SEQ ID NO: 569767 - DNA, 13 bp, D. melanogaster
acaaaaatgcttt

SEQ ID NO: 569768 - DNA, 13 bp, D. melanogaster
acaaaaatgggtt

SEQ ID NO: 569769 - DNA, 13 bp, D. melanogaster
acaaaaatgtaca

SEQ ID NO: 569770 - DNA, 13 bp, D. melanogaster
acaaaaatgtatt

SEQ ID NO: 569771 - DNA, 14 bp, D. melanogaster
acaaaaatgtattt

SEQ ID NO: 569772 - DNA, 13 bp, D. melanogaster
acaaaaatgttta

SEQ ID NO: 569773 - DNA, 14 bp, D. melanogaster
acaaaaatgtttaa

SEQ ID NO: 569774 - DNA, 13 bp, D. melanogaster
acaaaaatgtttt

SEQ ID NO: 569775 - DNA, 13 bp, D. melanogaster
acaaaaattatgt

SEQ ID NO: 569776 - DNA, 13 bp, D. melanogaster
acaaaaattggca

SEQ ID NO: 569777 - DNA, 13 bp, D. melanogaster
acaaaaattgtgt

SEQ ID NO: 569778 - DNA, 13 bp, D. melanogaster
acaaaaattgtta

SEQ ID NO: 569779 - DNA, 14 bp, D. melanogaster
acaaaaattgtttt

SEQ ID NO: 569780 - DNA, 13 bp, D. melanogaster
acaaaaatttcat

SEQ ID NO: 569781 - DNA, 13 bp, D. melanogaster
acaaaaatttgtt

SEQ ID NO: 569782 - DNA, 14 bp, D. melanogaster
acaaaacaaagtag

SEQ ID NO: 569783 - DNA, 13 bp, D. melanogaster
acaaaacaacgct

SEQ ID NO: 569784 - DNA, 13 bp, D. melanogaster
acaaaacaatgct

SEQ ID NO: 569785 - DNA, 13 bp, D. melanogaster
acaaaacaattga

SEQ ID NO: 569786 - DNA, 13 bp, D. melanogaster
acaaaacaattgt

SEQ ID NO: 569787 - DNA, 13 bp, D. melanogaster
acaaaacagcagc

SEQ ID NO: 569788 - DNA, 13 bp, D. melanogaster
acaaaacagcatt

SEQ ID NO: 569789 - DNA, 14 bp, D. melanogaster
acaaaacagtaaat

SEQ ID NO: 569790 - DNA, 13 bp, D. melanogaster
acaaaacattttt

SEQ ID NO: 569791 - DNA, 13 bp, D. melanogaster
acaaaaccaaatg

SEQ ID NO: 569792 - DNA, 13 bp, D. melanogaster
acaaaaccgattg

SEQ ID NO: 569793 - DNA, 13 bp, D. melanogaster
acaaaaccttcga

SEQ ID NO: 569794 - DNA, 13 bp, D. melanogaster
acaaaacgaaatg

SEQ ID NO: 569795 - DNA, 13 bp, D. melanogaster
acaaaacgaaatt

SEQ ID NO: 569796 - DNA, 13 bp, D. melanogaster
acaaaacgaattg

SEQ ID NO: 569797 - DNA, 13 bp, D. melanogaster
acaaaacgcataa

SEQ ID NO: 569798 - DNA, 13 bp, D. melanogaster
acaaaactcaatt

SEQ ID NO: 569799 - DNA, 13 bp, D. melanogaster
acaaaactccagt

SEQ ID NO: 569800 - DNA, 13 bp, D. melanogaster
acaaaactgaaat

SEQ ID NO: 569801 - DNA, 13 bp, D. melanogaster
acaaaactgctac

SEQ ID NO: 569802 - DNA, 13 bp, D. melanogaster
acaaaagaaatgg

SEQ ID NO: 569803 - DNA, 13 bp, D. melanogaster
acaaaagaatctt

SEQ ID NO: 569804 - DNA, 13 bp, D. melanogaster
acaaaagacttag

SEQ ID NO: 569805 - DNA, 13 bp, D. melanogaster
acaaaagacttgg

SEQ ID NO: 569806 - DNA, 13 bp, D. melanogaster
acaaaagatacat

SEQ ID NO: 569807 - DNA, 13 bp, D. melanogaster
acaaaagattgtt

SEQ ID NO: 569808 - DNA, 13 bp, D. melanogaster
acaaaagatttaa

SEQ ID NO: 569809 - DNA, 13 bp, D. melanogaster
acaaaagcaaact

SEQ ID NO: 569810 - DNA, 13 bp, D. melanogaster
acaaaagcaacta

SEQ ID NO: 569811 - DNA, 13 bp, D. melanogaster
acaaaagcagcag

SEQ ID NO: 569812 - DNA, 14 bp, D. melanogaster
acaaaagcagcagc

SEQ ID NO: 569813 - DNA, 13 bp, D. melanogaster
acaaaagcagcgg

SEQ ID NO: 569814 - DNA, 13 bp, D. melanogaster
acaaaagcattta

SEQ ID NO: 569815 - DNA, 13 bp, D. melanogaster
acaaaagccaaat

SEQ ID NO: 569816 - DNA, 13 bp, D. melanogaster
acaaaagccaagc

SEQ ID NO: 569817 - DNA, 13 bp, D. melanogaster
acaaaagccgcag

SEQ ID NO: 569818 - DNA, 13 bp, D. melanogaster
acaaaagcgcagc

SEQ ID NO: 569819 - DNA, 13 bp, D. melanogaster
acaaaagcggaac

SEQ ID NO: 569820 - DNA, 13 bp, D. melanogaster
acaaaagcggcag

SEQ ID NO: 569821 - DNA, 13 bp, D. melanogaster
acaaaagcggcga

SEQ ID NO: 569822 - DNA, 13 bp, D. melanogaster
acaaaagcggtgt

SEQ ID NO: 569823 - DNA, 13 bp, D. melanogaster
acaaaagctgaaa

SEQ ID NO: 569824 - DNA, 13 bp, D. melanogaster
acaaaaggaaatc

SEQ ID NO: 569825 - DNA, 13 bp, D. melanogaster
acaaaaggccaac

SEQ ID NO: 569826 - DNA, 13 bp, D. melanogaster
acaaaaggcgatc

SEQ ID NO: 569827 - DNA, 13 bp, D. melanogaster
acaaaaggctgaa

SEQ ID NO: 569828 - DNA, 13 bp, D. melanogaster
acaaaagtaaatg

SEQ ID NO: 569829 - DNA, 13 bp, D. melanogaster
acaaaagtaattt

SEQ ID NO: 569830 - DNA, 13 bp, D. melanogaster
acaaaagtatata

SEQ ID NO: 569831 - DNA, 13 bp, D. melanogaster
acaaaagtatcta

SEQ ID NO: 569832 - DNA, 13 bp, D. melanogaster
acaaaagtatctt

SEQ ID NO: 569833 - DNA, 13 bp, D. melanogaster
acaaaagtatgct

SEQ ID NO: 569834 - DNA, 13 bp, D. melanogaster
acaaaagtcaaca

SEQ ID NO: 569835 - DNA, 13 bp, D. melanogaster
acaaaagtcaagc

SEQ ID NO: 569836 - DNA, 13 bp, D. melanogaster
acaaaagtcaagt

SEQ ID NO: 569837 - DNA, 13 bp, D. melanogaster
acaaaagtcaatg

SEQ ID NO: 569838 - DNA, 13 bp, D. melanogaster
acaaaagtgaatt

SEQ ID NO: 569839 - DNA, 13 bp, D. melanogaster
acaaaagtgattg

SEQ ID NO: 569840 - DNA, 13 bp, D. melanogaster
acaaaagtgcaaa

SEQ ID NO: 569841 - DNA, 13 bp, D. melanogaster
acaaaagtggaat

SEQ ID NO: 569842 - DNA, 13 bp, D. melanogaster
acaaaagtgtaaa

SEQ ID NO: 569843 - DNA, 13 bp, D. melanogaster
acaaaagttatta

SEQ ID NO: 569844 - DNA, 13 bp, D. melanogaster
acaaaagttcaaa

SEQ ID NO: 569845 - DNA, 13 bp, D. melanogaster
acaaaagttgcat

SEQ ID NO: 569846 - DNA, 13 bp, D. melanogaster
acaaaagttttcg

SEQ ID NO: 569847 - DNA, 13 bp, D. melanogaster
acaaaagttttga

SEQ ID NO: 569848 - DNA, 14 bp, D. melanogaster
acaaaagtttttaa

SEQ ID NO: 569849 - DNA, 13 bp, D. melanogaster
acaaaagtttttt

SEQ ID NO: 569850 - DNA, 13 bp, D. melanogaster
acaaaataatgat

SEQ ID NO: 569851 - DNA, 13 bp, D. melanogaster
acaaaatacagct

SEQ ID NO: 569852 - DNA, 13 bp, D. melanogaster
acaaaatactcga

SEQ ID NO: 569853 - DNA, 13 bp, D. melanogaster
acaaaatactgaa

SEQ ID NO: 569854 - DNA, 13 bp, D. melanogaster
acaaaatataatg

SEQ ID NO: 569855 - DNA, 13 bp, D. melanogaster
acaaaatatatct

SEQ ID NO: 569856 - DNA, 14 bp, D. melanogaster
acaaaatatatctg

SEQ ID NO: 569857 - DNA, 13 bp, D. melanogaster
acaaaatatgaca

SEQ ID NO: 569858 - DNA, 13 bp, D. melanogaster
acaaaatatgcat

SEQ ID NO: 569859 - DNA, 14 bp, D. melanogaster
acaaaatatgtgtt

SEQ ID NO: 569860 - DNA, 13 bp, D. melanogaster
acaaaatatgttt

SEQ ID NO: 569861 - DNA, 14 bp, D. melanogaster
acaaaatatgttta

SEQ ID NO: 569862 - DNA, 13 bp, D. melanogaster
acaaaatattgaa

SEQ ID NO: 569863 - DNA, 13 bp, D. melanogaster
acaaaatattgca

SEQ ID NO: 569864 - DNA, 13 bp, D. melanogaster
acaaaatattgta

SEQ ID NO: 569865 - DNA, 13 bp, D. melanogaster
acaaaatattgtt

SEQ ID NO: 569866 - DNA, 14 bp, D. melanogaster
acaaaatatttccc

SEQ ID NO: 569867 - DNA, 13 bp, D. melanogaster
acaaaatatttgg

SEQ ID NO: 569868 - DNA, 13 bp, D. melanogaster
acaaaatcaaagt

SEQ ID NO: 569869 - DNA, 13 bp, D. melanogaster
acaaaatcaaatg

SEQ ID NO: 569870 - DNA, 13 bp, D. melanogaster
acaaaatcaattc

SEQ ID NO: 569871 - DNA, 13 bp, D. melanogaster
acaaaatcaattt

SEQ ID NO: 569872 - DNA, 14 bp, D. melanogaster
acaaaatcagaatt

SEQ ID NO: 569873 - DNA, 13 bp, D. melanogaster
acaaaatccaatt

SEQ ID NO: 569874 - DNA, 13 bp, D. melanogaster
acaaaatccatta

SEQ ID NO: 569875 - DNA, 13 bp, D. melanogaster
acaaaatccgttt

SEQ ID NO: 569876 - DNA, 13 bp, D. melanogaster
acaaaatcgagaa

SEQ ID NO: 569877 - DNA, 13 bp, D. melanogaster
acaaaatcgtttg

SEQ ID NO: 569878 - DNA, 13 bp, D. melanogaster
acaaaatcgtttt

SEQ ID NO: 569879 - DNA, 13 bp, D. melanogaster
acaaaatcttata

SEQ ID NO: 569880 - DNA, 13 bp, D. melanogaster
acaaaatctttta

SEQ ID NO: 569881 - DNA, 13 bp, D. melanogaster
acaaaatgaaact

SEQ ID NO: 569882 - DNA, 13 bp, D. melanogaster
acaaaatgaaatt

SEQ ID NO: 569883 - DNA, 13 bp, D. melanogaster
acaaaatgacaga

SEQ ID NO: 569884 - DNA, 14 bp, D. melanogaster
acaaaatgagggaa

SEQ ID NO: 569885 - DNA, 13 bp, D. melanogaster
acaaaatgataat

SEQ ID NO: 569886 - DNA, 13 bp, D. melanogaster
acaaaatgatgaa

SEQ ID NO: 569887 - DNA, 13 bp, D. melanogaster
acaaaatgattta

SEQ ID NO: 569888 - DNA, 14 bp, D. melanogaster
acaaaatgcaaaca

SEQ ID NO: 569889 - DNA, 14 bp, D. melanogaster
acaaaatgcaaatg

SEQ ID NO: 569890 - DNA, 13 bp, D. melanogaster
acaaaatgcaaca

SEQ ID NO: 569891 - DNA, 14 bp, D. melanogaster
acaaaatgcaattt

SEQ ID NO: 569892 - DNA, 13 bp, D. melanogaster
acaaaatgcacaa

SEQ ID NO: 569893 - DNA, 13 bp, D. melanogaster
acaaaatgccaca

SEQ ID NO: 569894 - DNA, 13 bp, D. melanogaster
acaaaatgctaat

SEQ ID NO: 569895 - DNA, 13 bp, D. melanogaster
acaaaatgctgcc

SEQ ID NO: 569896 - DNA, 13 bp, D. melanogaster
acaaaatgcttaa

SEQ ID NO: 569897 - DNA, 13 bp, D. melanogaster
acaaaatgctttt

SEQ ID NO: 569898 - DNA, 13 bp, D. melanogaster
acaaaatggattt

SEQ ID NO: 569899 - DNA, 13 bp, D. melanogaster
acaaaatggcgac

SEQ ID NO: 569900 - DNA, 13 bp, D. melanogaster
acaaaatggcgtc

SEQ ID NO: 569901 - DNA, 13 bp, D. melanogaster
acaaaatggctaa

SEQ ID NO: 569902 - DNA, 13 bp, D. melanogaster
acaaaatggggaa

SEQ ID NO: 569903 - DNA, 13 bp, D. melanogaster
acaaaatggtaaa

SEQ ID NO: 569904 - DNA, 13 bp, D. melanogaster
acaaaatgtaaat

SEQ ID NO: 569905 - DNA, 13 bp, D. melanogaster
acaaaatgtaatt

SEQ ID NO: 569906 - DNA, 14 bp, D. melanogaster
acaaaatgtacaaa

SEQ ID NO: 569907 - DNA, 13 bp, D. melanogaster
acaaaatgtatat

SEQ ID NO: 569908 - DNA, 14 bp, D. melanogaster
acaaaatgtattat

SEQ ID NO: 569909 - DNA, 13 bp, D. melanogaster
acaaaatgtcaaa

SEQ ID NO: 569910 - DNA, 13 bp, D. melanogaster
acaaaatgtgaaa

SEQ ID NO: 569911 - DNA, 13 bp, D. melanogaster
acaaaatgtgttc

SEQ ID NO: 569912 - DNA, 13 bp, D. melanogaster
acaaaatgttatt

SEQ ID NO: 569913 - DNA, 13 bp, D. melanogaster
acaaaatgttgac

SEQ ID NO: 569914 - DNA, 14 bp, D. melanogaster
acaaaatgtttttt

SEQ ID NO: 569915 - DNA, 13 bp, D. melanogaster
acaaaattaaagt

SEQ ID NO: 569916 - DNA, 13 bp, D. melanogaster
acaaaattaatct

SEQ ID NO: 569917 - DNA, 13 bp, D. melanogaster
acaaaattaatga

SEQ ID NO: 569918 - DNA, 14 bp, D. melanogaster
acaaaattagccaa

SEQ ID NO: 569919 - DNA, 13 bp, D. melanogaster
acaaaattatgaa

SEQ ID NO: 569920 - DNA, 13 bp, D. melanogaster
acaaaattcaagt

SEQ ID NO: 569921 - DNA, 13 bp, D. melanogaster
acaaaattcatat

SEQ ID NO: 569922 - DNA, 13 bp, D. melanogaster
acaaaattccttt

SEQ ID NO: 569923 - DNA, 13 bp, D. melanogaster
acaaaattcgaaa

SEQ ID NO: 569924 - DNA, 14 bp, D. melanogaster
acaaaattgaaatt

SEQ ID NO: 569925 - DNA, 13 bp, D. melanogaster
acaaaattgaagt

SEQ ID NO: 569926 - DNA, 14 bp, D. melanogaster
acaaaattgaagtt

SEQ ID NO: 569927 - DNA, 13 bp, D. melanogaster
acaaaattgaatt

SEQ ID NO: 569928 - DNA, 13 bp, D. melanogaster
acaaaattgattt

SEQ ID NO: 569929 - DNA, 13 bp, D. melanogaster
acaaaattgcaat

SEQ ID NO: 569930 - DNA, 13 bp, D. melanogaster
acaaaattgcagt

SEQ ID NO: 569931 - DNA, 13 bp, D. melanogaster
acaaaattgcatt

SEQ ID NO: 569932 - DNA, 13 bp, D. melanogaster
acaaaattgtttt

SEQ ID NO: 569933 - DNA, 13 bp, D. melanogaster
acaaaatttaagt

SEQ ID NO: 569934 - DNA, 13 bp, D. melanogaster
acaaaatttcaat

SEQ ID NO: 569935 - DNA, 13 bp, D. melanogaster
acaaaatttgaaa

SEQ ID NO: 569936 - DNA, 14 bp, D. melanogaster
acaaaatttgaaat

SEQ ID NO: 569937 - DNA, 13 bp, D. melanogaster
acaaaatttgtgc

SEQ ID NO: 569938 - DNA, 14 bp, D. melanogaster
acaaaatttgtttt

SEQ ID NO: 569939 - DNA, 14 bp, D. melanogaster
acaaacaaaaatgt

SEQ ID NO: 569940 - DNA, 13 bp, D. melanogaster
acaaacaaaactg

SEQ ID NO: 569941 - DNA, 13 bp, D. melanogaster
acaaacaaaagtg

SEQ ID NO: 569942 - DNA, 13 bp, D. melanogaster
acaaacaaaatcg

SEQ ID NO: 569943 - DNA, 13 bp, D. melanogaster
acaaacaaaatgg

SEQ ID NO: 569944 - DNA, 13 bp, D. melanogaster
acaaacaaaatgt

SEQ ID NO: 569945 - DNA, 13 bp, D. melanogaster
acaaacaaactga

SEQ ID NO: 569946 - DNA, 13 bp, D. melanogaster
acaaacaaatgag

SEQ ID NO: 569947 - DNA, 13 bp, D. melanogaster
acaaacaaatgcc

SEQ ID NO: 569948 - DNA, 13 bp, D. melanogaster
acaaacaaatgga

SEQ ID NO: 569949 - DNA, 13 bp, D. melanogaster
acaaacaaatggg

SEQ ID NO: 569950 - DNA, 13 bp, D. melanogaster
acaaacaaattgc

SEQ ID NO: 569951 - DNA, 13 bp, D. melanogaster
acaaacaaattgg

SEQ ID NO: 569952 - DNA, 13 bp, D. melanogaster
acaaacaacaatg

SEQ ID NO: 569953 - DNA, 14 bp, D. melanogaster
acaaacaagcaaat

SEQ ID NO: 569954 - DNA, 13 bp, D. melanogaster
acaaacaagccag

SEQ ID NO: 569955 - DNA, 13 bp, D. melanogaster
acaaacaagctgg

SEQ ID NO: 569956 - DNA, 13 bp, D. melanogaster
acaaacaagtgaa

SEQ ID NO: 569957 - DNA, 13 bp, D. melanogaster
acaaacaagtttt

SEQ ID NO: 569958 - DNA, 13 bp, D. melanogaster
acaaacaatattt

SEQ ID NO: 569959 - DNA, 13 bp, D. melanogaster
acaaacaatgcca

SEQ ID NO: 569960 - DNA, 14 bp, D. melanogaster
acaaacaatttgtt

SEQ ID NO: 569961 - DNA, 13 bp, D. melanogaster
acaaacaattttt

SEQ ID NO: 569962 - DNA, 13 bp, D. melanogaster
acaaacacaagcg

SEQ ID NO: 569963 - DNA, 13 bp, D. melanogaster
acaaacacaattc

SEQ ID NO: 569964 - DNA, 13 bp, D. melanogaster
acaaacacacagt

SEQ ID NO: 569965 - DNA, 13 bp, D. melanogaster
acaaacacacatg

SEQ ID NO: 569966 - DNA, 14 bp, D. melanogaster
acaaacacactcgc

SEQ ID NO: 569967 - DNA, 13 bp, D. melanogaster
acaaacacagcga

SEQ ID NO: 569968 - DNA, 13 bp, D. melanogaster
acaaacacatgca

SEQ ID NO: 569969 - DNA, 13 bp, D. melanogaster
acaaacacatgtt

SEQ ID NO: 569970 - DNA, 13 bp, D. melanogaster
acaaacacattta

SEQ ID NO: 569971 - DNA, 13 bp, D. melanogaster
acaaacacatttt

SEQ ID NO: 569972 - DNA, 13 bp, D. melanogaster
acaaacacgaaat

SEQ ID NO: 569973 - DNA, 13 bp, D. melanogaster
acaaacactggca

SEQ ID NO: 569974 - DNA, 13 bp, D. melanogaster
acaaacagaaatc

SEQ ID NO: 569975 - DNA, 13 bp, D. melanogaster
acaaacagaaatg

SEQ ID NO: 569976 - DNA, 13 bp, D. melanogaster
acaaacagaaatt

SEQ ID NO: 569977 - DNA, 13 bp, D. melanogaster
acaaacagacgga

SEQ ID NO: 569978 - DNA, 13 bp, D. melanogaster
acaaacagcagtg

SEQ ID NO: 569979 - DNA, 14 bp, D. melanogaster
acaaacatacatat

SEQ ID NO: 569980 - DNA, 13 bp, D. melanogaster
acaaacatatatt

SEQ ID NO: 569981 - DNA, 13 bp, D. melanogaster
acaaacatatgta

SEQ ID NO: 569982 - DNA, 13 bp, D. melanogaster
acaaacatatttg

SEQ ID NO: 569983 - DNA, 13 bp, D. melanogaster
acaaacatctcca

SEQ ID NO: 569984 - DNA, 13 bp, D. melanogaster
acaaacatgccca

SEQ ID NO: 569985 - DNA, 13 bp, D. melanogaster
acaaacattattt

SEQ ID NO: 569986 - DNA, 13 bp, D. melanogaster
acaaacatttgcg

SEQ ID NO: 569987 - DNA, 13 bp, D. melanogaster
acaaacatttgtt

SEQ ID NO: 569988 - DNA, 13 bp, D. melanogaster
acaaacattttca

SEQ ID NO: 569989 - DNA, 13 bp, D. melanogaster
acaaacattttcg

SEQ ID NO: 569990 - DNA, 14 bp, D. melanogaster
acaaacattttgag

SEQ ID NO: 569991 - DNA, 13 bp, D. melanogaster
acaaacattttta

SEQ ID NO: 569992 - DNA, 13 bp, D. melanogaster
acaaacatttttt

SEQ ID NO: 569993 - DNA, 14 bp, D. melanogaster
acaaacattttttt

SEQ ID NO: 569994 - DNA, 14 bp, D. melanogaster
acaaaccactcgca

SEQ ID NO: 569995 - DNA, 13 bp, D. melanogaster
acaaacgaaaatg

SEQ ID NO: 569996 - DNA, 13 bp, D. melanogaster
acaaacgaaactt

SEQ ID NO: 569997 - DNA, 13 bp, D. melanogaster
acaaacgaaattg

SEQ ID NO: 569998 - DNA, 13 bp, D. melanogaster
acaaacgcaaaat

SEQ ID NO: 569999 - DNA, 13 bp, D. melanogaster
acaaacgcaaatt

SEQ ID NO: 570000 - DNA, 13 bp, D. melanogaster
acaaacgcaacgc

SEQ ID NO: 570001 - DNA, 13 bp, D. melanogaster
acaaacgcacgca

SEQ ID NO: 570002 - DNA, 13 bp, D. melanogaster
acaaacgcataca

SEQ ID NO: 570003 - DNA, 13 bp, D. melanogaster
acaaacgccaatg

SEQ ID NO: 570004 - DNA, 13 bp, D. melanogaster
acaaacggacgga

SEQ ID NO: 570005 - DNA, 13 bp, D. melanogaster
acaaacggcacaa

SEQ ID NO: 570006 - DNA, 13 bp, D. melanogaster
acaaacgtatcaa

SEQ ID NO: 570007 - DNA, 13 bp, D. melanogaster
acaaacgtattgc

SEQ ID NO: 570008 - DNA, 13 bp, D. melanogaster
acaaactaaaatg

SEQ ID NO: 570009 - DNA, 13 bp, D. melanogaster
acaaactaagaat

SEQ ID NO: 570010 - DNA, 13 bp, D. melanogaster
acaaactatatgc

SEQ ID NO: 570011 - DNA, 13 bp, D. melanogaster
acaaactatttta

SEQ ID NO: 570012 - DNA, 13 bp, D. melanogaster
acaaactccagct

SEQ ID NO: 570013 - DNA, 13 bp, D. melanogaster
acaaactgcaaaa

SEQ ID NO: 570014 - DNA, 13 bp, D. melanogaster
acaaactgcagca

SEQ ID NO: 570015 - DNA, 13 bp, D. melanogaster
acaaactgccaaa

SEQ ID NO: 570016 - DNA, 13 bp, D. melanogaster
acaaactgccaag

SEQ ID NO: 570017 - DNA, 13 bp, D. melanogaster
acaaactggcaaa

SEQ ID NO: 570018 - DNA, 14 bp, D. melanogaster
acaaactggccaag

SEQ ID NO: 570019 - DNA, 13 bp, D. melanogaster
acaaacttaattt

SEQ ID NO: 570020 - DNA, 13 bp, D. melanogaster
acaaacttctgga

SEQ ID NO: 570021 - DNA, 13 bp, D. melanogaster
acaaacttgaaaa

SEQ ID NO: 570022 - DNA, 13 bp, D. melanogaster
acaaacttgagct

SEQ ID NO: 570023 - DNA, 13 bp, D. melanogaster
acaaacttgcact

SEQ ID NO: 570024 - DNA, 13 bp, D. melanogaster
acaaactttcgct

SEQ ID NO: 570025 - DNA, 13 bp, D. melanogaster
acaaactttgcca

SEQ ID NO: 570026 - DNA, 13 bp, D. melanogaster
acaaactttgtga

SEQ ID NO: 570027 - DNA, 13 bp, D. melanogaster
acaaacttttatt

SEQ ID NO: 570028 - DNA, 13 bp, D. melanogaster
acaaacttttcca

SEQ ID NO: 570029 - DNA, 13 bp, D. melanogaster
acaaacttttcgc

SEQ ID NO: 570030 - DNA, 14 bp, D. melanogaster
acaaagaaaatgca

SEQ ID NO: 570031 - DNA, 13 bp, D. melanogaster
acaaagaaaattt

SEQ ID NO: 570032 - DNA, 13 bp, D. melanogaster
acaaagaaactct

SEQ ID NO: 570033 - DNA, 13 bp, D. melanogaster
acaaagaaagttt

SEQ ID NO: 570034 - DNA, 13 bp, D. melanogaster
acaaagaaatatg

SEQ ID NO: 570035 - DNA, 13 bp, D. melanogaster
acaaagaaatcag

SEQ ID NO: 570036 - DNA, 13 bp, D. melanogaster
acaaagaaattat

SEQ ID NO: 570037 - DNA, 13 bp, D. melanogaster
acaaagaagaatt

SEQ ID NO: 570038 - DNA, 13 bp, D. melanogaster
acaaagaatttgc

SEQ ID NO: 570039 - DNA, 13 bp, D. melanogaster
acaaagacgcagc

SEQ ID NO: 570040 - DNA, 14 bp, D. melanogaster
acaaagactccaat

SEQ ID NO: 570041 - DNA, 14 bp, D. melanogaster
acaaagagctgaaa

SEQ ID NO: 570042 - DNA, 13 bp, D. melanogaster
acaaagatacttg

SEQ ID NO: 570043 - DNA, 14 bp, D. melanogaster
acaaagatacttgg

SEQ ID NO: 570044 - DNA, 13 bp, D. melanogaster
acaaagatattta

SEQ ID NO: 570045 - DNA, 13 bp, D. melanogaster
acaaagcaaaatg

SEQ ID NO: 570046 - DNA, 13 bp, D. melanogaster
acaaagcatttaa

SEQ ID NO: 570047 - DNA, 13 bp, D. melanogaster
acaaagccaaagc

SEQ ID NO: 570048 - DNA, 13 bp, D. melanogaster
acaaagcgaagag

SEQ ID NO: 570049 - DNA, 13 bp, D. melanogaster
acaaagctgaaaa

SEQ ID NO: 570050 - DNA, 13 bp, D. melanogaster
acaaagctgttca

SEQ ID NO: 570051 - DNA, 13 bp, D. melanogaster
acaaaggaaatgc

SEQ ID NO: 570052 - DNA, 14 bp, D. melanogaster
acaaaggaaatttt

SEQ ID NO: 570053 - DNA, 13 bp, D. melanogaster
acaaaggaatttt

SEQ ID NO: 570054 - DNA, 13 bp, D. melanogaster
acaaaggcaaaat

SEQ ID NO: 570055 - DNA, 13 bp, D. melanogaster
acaaaggcaaagc

SEQ ID NO: 570056 - DNA, 13 bp, D. melanogaster
acaaaggcaaata

SEQ ID NO: 570057 - DNA, 13 bp, D. melanogaster
acaaaggcagcaa

SEQ ID NO: 570058 - DNA, 13 bp, D. melanogaster
acaaaggcataaa

SEQ ID NO: 570059 - DNA, 13 bp, D. melanogaster
acaaaggccacaa

SEQ ID NO: 570060 - DNA, 13 bp, D. melanogaster
acaaaggcgaaat

SEQ ID NO: 570061 - DNA, 13 bp, D. melanogaster
acaaaggctaaaa

SEQ ID NO: 570062 - DNA, 13 bp, D. melanogaster
acaaagggcgctc

SEQ ID NO: 570063 - DNA, 13 bp, D. melanogaster
acaaaggtgctgc

SEQ ID NO: 570064 - DNA, 13 bp, D. melanogaster
acaaagtaaatat

SEQ ID NO: 570065 - DNA, 13 bp, D. melanogaster
acaaagtaattta

SEQ ID NO: 570066 - DNA, 13 bp, D. melanogaster
acaaagtataagt

SEQ ID NO: 570067 - DNA, 14 bp, D. melanogaster
acaaagtataagtg

SEQ ID NO: 570068 - DNA, 13 bp, D. melanogaster
acaaagtatatta

SEQ ID NO: 570069 - DNA, 13 bp, D. melanogaster
acaaagtcaaaca

SEQ ID NO: 570070 - DNA, 13 bp, D. melanogaster
acaaagtcaattt

SEQ ID NO: 570071 - DNA, 13 bp, D. melanogaster
acaaagtgaaaac

SEQ ID NO: 570072 - DNA, 13 bp, D. melanogaster
acaaagtgaaata

SEQ ID NO: 570073 - DNA, 13 bp, D. melanogaster
acaaagtgcaatt

SEQ ID NO: 570074 - DNA, 13 bp, D. melanogaster
acaaagtgcattt

SEQ ID NO: 570075 - DNA, 13 bp, D. melanogaster
acaaagtgccaaa

SEQ ID NO: 570076 - DNA, 13 bp, D. melanogaster
acaaagtgctgcc

SEQ ID NO: 570077 - DNA, 14 bp, D. melanogaster
acaaagtggacaaa

SEQ ID NO: 570078 - DNA, 13 bp, D. melanogaster
acaaagtggcatc

SEQ ID NO: 570079 - DNA, 13 bp, D. melanogaster
acaaagtggccaa

SEQ ID NO: 570080 - DNA, 13 bp, D. melanogaster
acaaagtgttaaa

SEQ ID NO: 570081 - DNA, 13 bp, D. melanogaster
acaaagttaaatt

SEQ ID NO: 570082 - DNA, 13 bp, D. melanogaster
acaaagttgaaaa

SEQ ID NO: 570083 - DNA, 13 bp, D. melanogaster
acaaagttggcca

SEQ ID NO: 570084 - DNA, 13 bp, D. melanogaster
acaaagtttattt

SEQ ID NO: 570085 - DNA, 13 bp, D. melanogaster
acaaagttttttg

SEQ ID NO: 570086 - DNA, 13 bp, D. melanogaster
acaaataaaagtg

SEQ ID NO: 570087 - DNA, 13 bp, D. melanogaster
acaaataaacgag

SEQ ID NO: 570088 - DNA, 13 bp, D. melanogaster
acaaataaagcca

SEQ ID NO: 570089 - DNA, 13 bp, D. melanogaster
acaaataaagttg

SEQ ID NO: 570090 - DNA, 13 bp, D. melanogaster
acaaataaatatg

SEQ ID NO: 570091 - DNA, 14 bp, D. melanogaster
acaaataaatattg

SEQ ID NO: 570092 - DNA, 13 bp, D. melanogaster
acaaataaatgag

SEQ ID NO: 570093 - DNA, 13 bp, D. melanogaster
acaaataaatgga

SEQ ID NO: 570094 - DNA, 13 bp, D. melanogaster
acaaataaatgtg

SEQ ID NO: 570095 - DNA, 13 bp, D. melanogaster
acaaataaattag

SEQ ID NO: 570096 - DNA, 13 bp, D. melanogaster
acaaataaattga

SEQ ID NO: 570097 - DNA, 13 bp, D. melanogaster
acaaataaatttg

SEQ ID NO: 570098 - DNA, 13 bp, D. melanogaster
acaaataacattt

SEQ ID NO: 570099 - DNA, 13 bp, D. melanogaster
acaaataagaatg

SEQ ID NO: 570100 - DNA, 13 bp, D. melanogaster
acaaataattgaa

SEQ ID NO: 570101 - DNA, 13 bp, D. melanogaster
acaaataattgtt

SEQ ID NO: 570102 - DNA, 13 bp, D. melanogaster
acaaataatttct

SEQ ID NO: 570103 - DNA, 14 bp, D. melanogaster
acaaatacaaattg

SEQ ID NO: 570104 - DNA, 13 bp, D. melanogaster
acaaatacaagca

SEQ ID NO: 570105 - DNA, 13 bp, D. melanogaster
acaaatacaagta

SEQ ID NO: 570106 - DNA, 13 bp, D. melanogaster
acaaatacacttt

SEQ ID NO: 570107 - DNA, 13 bp, D. melanogaster
acaaatacatatg

SEQ ID NO: 570108 - DNA, 13 bp, D. melanogaster
acaaatacatatt

SEQ ID NO: 570109 - DNA, 13 bp, D. melanogaster
acaaatacatttc

SEQ ID NO: 570110 - DNA, 13 bp, D. melanogaster
acaaatacatttt

SEQ ID NO: 570111 - DNA, 14 bp, D. melanogaster
acaaatacatttta

SEQ ID NO: 570112 - DNA, 13 bp, D. melanogaster
acaaatacgaaat

SEQ ID NO: 570113 - DNA, 13 bp, D. melanogaster
acaaatacgaata

SEQ ID NO: 570114 - DNA, 13 bp, D. melanogaster
acaaatacgcaca

SEQ ID NO: 570115 - DNA, 14 bp, D. melanogaster
acaaatactaatac

SEQ ID NO: 570116 - DNA, 13 bp, D. melanogaster
acaaatactttca

SEQ ID NO: 570117 - DNA, 13 bp, D. melanogaster
acaaatagaaatg

SEQ ID NO: 570118 - DNA, 14 bp, D. melanogaster
acaaatagaatgaa

SEQ ID NO: 570119 - DNA, 13 bp, D. melanogaster
acaaatagattca

SEQ ID NO: 570120 - DNA, 13 bp, D. melanogaster
acaaatagcaaat

SEQ ID NO: 570121 - DNA, 13 bp, D. melanogaster
acaaatatataga

SEQ ID NO: 570122 - DNA, 13 bp, D. melanogaster
acaaatatatgca

SEQ ID NO: 570123 - DNA, 13 bp, D. melanogaster
acaaatatatgta

SEQ ID NO: 570124 - DNA, 13 bp, D. melanogaster
acaaatatatgtg

SEQ ID NO: 570125 - DNA, 13 bp, D. melanogaster
acaaatatattct

SEQ ID NO: 570126 - DNA, 13 bp, D. melanogaster
acaaatatcgaaa

SEQ ID NO: 570127 - DNA, 13 bp, D. melanogaster
acaaatatcttaa

SEQ ID NO: 570128 - DNA, 13 bp, D. melanogaster
acaaatatgataa

SEQ ID NO: 570129 - DNA, 13 bp, D. melanogaster
acaaatatgcaaa

SEQ ID NO: 570130 - DNA, 13 bp, D. melanogaster
acaaatatgtaca

SEQ ID NO: 570131 - DNA, 14 bp, D. melanogaster
acaaatatgtatat

SEQ ID NO: 570132 - DNA, 14 bp, D. melanogaster
acaaatatgtatgt

SEQ ID NO: 570133 - DNA, 13 bp, D. melanogaster
acaaatatgtgta

SEQ ID NO: 570134 - DNA, 13 bp, D. melanogaster
acaaatattcaca

SEQ ID NO: 570135 - DNA, 13 bp, D. melanogaster
acaaatattccaa

SEQ ID NO: 570136 - DNA, 13 bp, D. melanogaster
acaaatattctaa

SEQ ID NO: 570137 - DNA, 14 bp, D. melanogaster
acaaatattctaat

SEQ ID NO: 570138 - DNA, 13 bp, D. melanogaster
acaaatattctta

SEQ ID NO: 570139 - DNA, 13 bp, D. melanogaster
acaaatattgaaa

SEQ ID NO: 570140 - DNA, 13 bp, D. melanogaster
acaaatattgcat

SEQ ID NO: 570141 - DNA, 13 bp, D. melanogaster
acaaatattgcca

SEQ ID NO: 570142 - DNA, 13 bp, D. melanogaster
acaaatattgtaa

SEQ ID NO: 570143 - DNA, 14 bp, D. melanogaster
acaaatattgtttt

SEQ ID NO: 570144 - DNA, 13 bp, D. melanogaster
acaaatatttaga

SEQ ID NO: 570145 - DNA, 13 bp, D. melanogaster
acaaatatttatg

SEQ ID NO: 570146 - DNA, 14 bp, D. melanogaster
acaaatatttcatt

SEQ ID NO: 570147 - DNA, 14 bp, D. melanogaster
acaaatatttgaaa

SEQ ID NO: 570148 - DNA, 13 bp, D. melanogaster
acaaatatttgca

SEQ ID NO: 570149 - DNA, 13 bp, D. melanogaster
acaaatatttgga

SEQ ID NO: 570150 - DNA, 13 bp, D. melanogaster
acaaatatttgtt

SEQ ID NO: 570151 - DNA, 14 bp, D. melanogaster
acaaatattttcaa

SEQ ID NO: 570152 - DNA, 13 bp, D. melanogaster
acaaatattttgt

SEQ ID NO: 570153 - DNA, 13 bp, D. melanogaster
acaaatcaaagcc

SEQ ID NO: 570154 - DNA, 13 bp, D. melanogaster
acaaatcaaagtt

SEQ ID NO: 570155 - DNA, 13 bp, D. melanogaster
acaaatcaagttg

SEQ ID NO: 570156 - DNA, 13 bp, D. melanogaster
acaaatcaatcag

SEQ ID NO: 570157 - DNA, 13 bp, D. melanogaster
acaaatcaatcga

SEQ ID NO: 570158 - DNA, 13 bp, D. melanogaster
acaaatcatcaat

SEQ ID NO: 570159 - DNA, 13 bp, D. melanogaster
acaaatcattgac

SEQ ID NO: 570160 - DNA, 13 bp, D. melanogaster
acaaatcatttta

SEQ ID NO: 570161 - DNA, 13 bp, D. melanogaster
acaaatccaattt

SEQ ID NO: 570162 - DNA, 13 bp, D. melanogaster
acaaatccagcct

SEQ ID NO: 570163 - DNA, 13 bp, D. melanogaster
acaaatcgaaaac

SEQ ID NO: 570164 - DNA, 14 bp, D. melanogaster
acaaatcgaaaaca

SEQ ID NO: 570165 - DNA, 13 bp, D. melanogaster
acaaatcgaaaag

SEQ ID NO: 570166 - DNA, 13 bp, D. melanogaster
acaaatcgaaatc

SEQ ID NO: 570167 - DNA, 13 bp, D. melanogaster
acaaatcgaaatg

SEQ ID NO: 570168 - DNA, 13 bp, D. melanogaster
acaaatcgagcaa

SEQ ID NO: 570169 - DNA, 13 bp, D. melanogaster
acaaatcgcacaa

SEQ ID NO: 570170 - DNA, 13 bp, D. melanogaster
acaaatcgtaaaa

SEQ ID NO: 570171 - DNA, 14 bp, D. melanogaster
acaaatctagtata

SEQ ID NO: 570172 - DNA, 13 bp, D. melanogaster
acaaatcttaaag

SEQ ID NO: 570173 - DNA, 13 bp, D. melanogaster
acaaatcttaaat

SEQ ID NO: 570174 - DNA, 13 bp, D. melanogaster
acaaatcttttaa

SEQ ID NO: 570175 - DNA, 13 bp, D. melanogaster
acaaatgaaattc

SEQ ID NO: 570176 - DNA, 13 bp, D. melanogaster
acaaatgaagcaa

SEQ ID NO: 570177 - DNA, 13 bp, D. melanogaster
acaaatgaattgg

SEQ ID NO: 570178 - DNA, 13 bp, D. melanogaster
acaaatgaatttc

SEQ ID NO: 570179 - DNA, 13 bp, D. melanogaster
acaaatgacaaat

SEQ ID NO: 570180 - DNA, 13 bp, D. melanogaster
acaaatgacgagg

SEQ ID NO: 570181 - DNA, 13 bp, D. melanogaster
acaaatgactttt

SEQ ID NO: 570182 - DNA, 13 bp, D. melanogaster
acaaatgatgtcc

SEQ ID NO: 570183 - DNA, 13 bp, D. melanogaster
acaaatgcaaaca

SEQ ID NO: 570184 - DNA, 14 bp, D. melanogaster
acaaatgcaaattt

SEQ ID NO: 570185 - DNA, 14 bp, D. melanogaster
acaaatgcaacaaa

SEQ ID NO: 570186 - DNA, 13 bp, D. melanogaster
acaaatgcaactc

SEQ ID NO: 570187 - DNA, 13 bp, D. melanogaster
acaaatgcacaga

SEQ ID NO: 570188 - DNA, 13 bp, D. melanogaster
acaaatgcacata

SEQ ID NO: 570189 - DNA, 13 bp, D. melanogaster
acaaatgcagaca

SEQ ID NO: 570190 - DNA, 13 bp, D. melanogaster
acaaatgcagata

SEQ ID NO: 570191 - DNA, 13 bp, D. melanogaster
acaaatgcataca

SEQ ID NO: 570192 - DNA, 13 bp, D. melanogaster
acaaatgccaaaa

SEQ ID NO: 570193 - DNA, 13 bp, D. melanogaster
acaaatgccaaag

SEQ ID NO: 570194 - DNA, 13 bp, D. melanogaster
acaaatgccacaa

SEQ ID NO: 570195 - DNA, 13 bp, D. melanogaster
acaaatggacaaa

SEQ ID NO: 570196 - DNA, 13 bp, D. melanogaster
acaaatggcaaag

SEQ ID NO: 570197 - DNA, 13 bp, D. melanogaster
acaaatggcaaat

SEQ ID NO: 570198 - DNA, 13 bp, D. melanogaster
acaaatggccaaa

SEQ ID NO: 570199 - DNA, 13 bp, D. melanogaster
acaaatggccatt

SEQ ID NO: 570200 - DNA, 13 bp, D. melanogaster
acaaatgggccaa

SEQ ID NO: 570201 - DNA, 13 bp, D. melanogaster
acaaatgtaaatt

SEQ ID NO: 570202 - DNA, 13 bp, D. melanogaster
acaaatgtaatta

SEQ ID NO: 570203 - DNA, 13 bp, D. melanogaster
acaaatgtatatg

SEQ ID NO: 570204 - DNA, 13 bp, D. melanogaster
acaaatgtatgta

SEQ ID NO: 570205 - DNA, 13 bp, D. melanogaster
acaaatgtattta

SEQ ID NO: 570206 - DNA, 13 bp, D. melanogaster
acaaatgtcaaat

SEQ ID NO: 570207 - DNA, 13 bp, D. melanogaster
acaaatgtgagtt

SEQ ID NO: 570208 - DNA, 13 bp, D. melanogaster
acaaatgtgcaaa

SEQ ID NO: 570209 - DNA, 13 bp, D. melanogaster
acaaatgtgccaa

SEQ ID NO: 570210 - DNA, 13 bp, D. melanogaster
acaaatgtggcaa

SEQ ID NO: 570211 - DNA, 13 bp, D. melanogaster
acaaatgtgtgtg

SEQ ID NO: 570212 - DNA, 13 bp, D. melanogaster
acaaatgttaaat

SEQ ID NO: 570213 - DNA, 13 bp, D. melanogaster
acaaatgttcaaa

SEQ ID NO: 570214 - DNA, 13 bp, D. melanogaster
acaaatgttgtaa

SEQ ID NO: 570215 - DNA, 13 bp, D. melanogaster
acaaatgtttaaa

SEQ ID NO: 570216 - DNA, 13 bp, D. melanogaster
acaaatgtttgtt

SEQ ID NO: 570217 - DNA, 13 bp, D. melanogaster
acaaatgttttgc

SEQ ID NO: 570218 - DNA, 13 bp, D. melanogaster
acaaatgtttttg

SEQ ID NO: 570219 - DNA, 13 bp, D. melanogaster
acaaattaaaagc

SEQ ID NO: 570220 - DNA, 14 bp, D. melanogaster
acaaattaaaagca

SEQ ID NO: 570221 - DNA, 14 bp, D. melanogaster
acaaattaaaattg

SEQ ID NO: 570222 - DNA, 13 bp, D. melanogaster
acaaattaaatgc

SEQ ID NO: 570223 - DNA, 13 bp, D. melanogaster
acaaattaacatt

SEQ ID NO: 570224 - DNA, 13 bp, D. melanogaster
acaaattaatgaa

SEQ ID NO: 570225 - DNA, 13 bp, D. melanogaster
acaaattaattag

SEQ ID NO: 570226 - DNA, 13 bp, D. melanogaster
acaaattaattcg

SEQ ID NO: 570227 - DNA, 13 bp, D. melanogaster
acaaattaattgt

SEQ ID NO: 570228 - DNA, 13 bp, D. melanogaster
acaaattacaatt

SEQ ID NO: 570229 - DNA, 13 bp, D. melanogaster
acaaattacgaaa

SEQ ID NO: 570230 - DNA, 13 bp, D. melanogaster
acaaattacttaa

SEQ ID NO: 570231 - DNA, 13 bp, D. melanogaster
acaaattagtttt

SEQ ID NO: 570232 - DNA, 13 bp, D. melanogaster
acaaattatgaaa

SEQ ID NO: 570233 - DNA, 13 bp, D. melanogaster
acaaattattaca

SEQ ID NO: 570234 - DNA, 13 bp, D. melanogaster
acaaattattgaa

SEQ ID NO: 570235 - DNA, 13 bp, D. melanogaster
acaaattattgca

SEQ ID NO: 570236 - DNA, 13 bp, D. melanogaster
acaaattatttga

SEQ ID NO: 570237 - DNA, 13 bp, D. melanogaster
acaaattatttgt

SEQ ID NO: 570238 - DNA, 13 bp, D. melanogaster
acaaattattttc

SEQ ID NO: 570239 - DNA, 13 bp, D. melanogaster
acaaattcaattg

SEQ ID NO: 570240 - DNA, 13 bp, D. melanogaster
acaaattcacttt

SEQ ID NO: 570241 - DNA, 13 bp, D. melanogaster
acaaattcattaa

SEQ ID NO: 570242 - DNA, 13 bp, D. melanogaster
acaaattcattat

SEQ ID NO: 570243 - DNA, 13 bp, D. melanogaster
acaaattcattta

SEQ ID NO: 570244 - DNA, 13 bp, D. melanogaster
acaaattcatttg

SEQ ID NO: 570245 - DNA, 13 bp, D. melanogaster
acaaattccaatt

SEQ ID NO: 570246 - DNA, 13 bp, D. melanogaster
acaaattcccatt

SEQ ID NO: 570247 - DNA, 13 bp, D. melanogaster
acaaattcgaaaa

SEQ ID NO: 570248 - DNA, 13 bp, D. melanogaster
acaaattcgaaga

SEQ ID NO: 570249 - DNA, 14 bp, D. melanogaster
acaaattcgaagat

SEQ ID NO: 570250 - DNA, 13 bp, D. melanogaster
acaaattcgattt

SEQ ID NO: 570251 - DNA, 13 bp, D. melanogaster
acaaattctaatt

SEQ ID NO: 570252 - DNA, 13 bp, D. melanogaster
acaaattcttcaa

SEQ ID NO: 570253 - DNA, 14 bp, D. melanogaster
acaaattcttcata

SEQ ID NO: 570254 - DNA, 13 bp, D. melanogaster
acaaattgaaaat

SEQ ID NO: 570255 - DNA, 14 bp, D. melanogaster
acaaattgaaaatg

SEQ ID NO: 570256 - DNA, 13 bp, D. melanogaster
acaaattgaaagt

SEQ ID NO: 570257 - DNA, 13 bp, D. melanogaster
acaaattgaaatc

SEQ ID NO: 570258 - DNA, 13 bp, D. melanogaster
acaaattgaacaa

SEQ ID NO: 570259 - DNA, 13 bp, D. melanogaster
acaaattgaataa

SEQ ID NO: 570260 - DNA, 14 bp, D. melanogaster
acaaattgaataaa

SEQ ID NO: 570261 - DNA, 13 bp, D. melanogaster
acaaattgaatta

SEQ ID NO: 570262 - DNA, 13 bp, D. melanogaster
acaaattgacaaa

SEQ ID NO: 570263 - DNA, 13 bp, D. melanogaster
acaaattgagtta

SEQ ID NO: 570264 - DNA, 13 bp, D. melanogaster
acaaattgataaa

SEQ ID NO: 570265 - DNA, 14 bp, D. melanogaster
acaaattgataaaa

SEQ ID NO: 570266 - DNA, 14 bp, D. melanogaster
acaaattgatttat

SEQ ID NO: 570267 - DNA, 13 bp, D. melanogaster
acaaattgatttg

SEQ ID NO: 570268 - DNA, 13 bp, D. melanogaster
acaaattgcaaaa

SEQ ID NO: 570269 - DNA, 13 bp, D. melanogaster
acaaattgcaact

SEQ ID NO: 570270 - DNA, 13 bp, D. melanogaster
acaaattgcaatt

SEQ ID NO: 570271 - DNA, 13 bp, D. melanogaster
acaaattgcacaa

SEQ ID NO: 570272 - DNA, 13 bp, D. melanogaster
acaaattgcactt

SEQ ID NO: 570273 - DNA, 14 bp, D. melanogaster
acaaattgcagaaa

SEQ ID NO: 570274 - DNA, 13 bp, D. melanogaster
acaaattgcaggc

SEQ ID NO: 570275 - DNA, 13 bp, D. melanogaster
acaaattgcattg

SEQ ID NO: 570276 - DNA, 13 bp, D. melanogaster
acaaattgcattt

SEQ ID NO: 570277 - DNA, 13 bp, D. melanogaster
acaaattgccatt

SEQ ID NO: 570278 - DNA, 13 bp, D. melanogaster
acaaattgcgcat

SEQ ID NO: 570279 - DNA, 13 bp, D. melanogaster
acaaattggaaaa

SEQ ID NO: 570280 - DNA, 13 bp, D. melanogaster
acaaattggaatt

SEQ ID NO: 570281 - DNA, 13 bp, D. melanogaster
acaaattggcaaa

SEQ ID NO: 570282 - DNA, 13 bp, D. melanogaster
acaaattgtaaac

SEQ ID NO: 570283 - DNA, 13 bp, D. melanogaster
acaaattgtaaat

SEQ ID NO: 570284 - DNA, 14 bp, D. melanogaster
acaaattgtaatta

SEQ ID NO: 570285 - DNA, 13 bp, D. melanogaster
acaaattgtattt

SEQ ID NO: 570286 - DNA, 13 bp, D. melanogaster
acaaattgttaaa

SEQ ID NO: 570287 - DNA, 13 bp, D. melanogaster
acaaattgttatg

SEQ ID NO: 570288 - DNA, 13 bp, D. melanogaster
acaaattgttatt

SEQ ID NO: 570289 - DNA, 13 bp, D. melanogaster
acaaattgttgaa

SEQ ID NO: 570290 - DNA, 13 bp, D. melanogaster
acaaattgttggc

SEQ ID NO: 570291 - DNA, 13 bp, D. melanogaster
acaaattgttgtt

SEQ ID NO: 570292 - DNA, 13 bp, D. melanogaster
acaaatttaaaag

SEQ ID NO: 570293 - DNA, 13 bp, D. melanogaster
acaaatttaatca

SEQ ID NO: 570294 - DNA, 13 bp, D. melanogaster
acaaatttaatgt

SEQ ID NO: 570295 - DNA, 13 bp, D. melanogaster
acaaatttatcaa

SEQ ID NO: 570296 - DNA, 13 bp, D. melanogaster
acaaatttatgaa

SEQ ID NO: 570297 - DNA, 13 bp, D. melanogaster
acaaatttattca

SEQ ID NO: 570298 - DNA, 13 bp, D. melanogaster
acaaatttattgc

SEQ ID NO: 570299 - DNA, 14 bp, D. melanogaster
acaaatttattgct

SEQ ID NO: 570300 - DNA, 13 bp, D. melanogaster
acaaatttcaagt

SEQ ID NO: 570301 - DNA, 14 bp, D. melanogaster
acaaatttcaatag

SEQ ID NO: 570302 - DNA, 13 bp, D. melanogaster
acaaatttcacat

SEQ ID NO: 570303 - DNA, 13 bp, D. melanogaster
acaaatttcataa

SEQ ID NO: 570304 - DNA, 13 bp, D. melanogaster
acaaatttccaca

SEQ ID NO: 570305 - DNA, 13 bp, D. melanogaster
acaaatttccttt

SEQ ID NO: 570306 - DNA, 13 bp, D. melanogaster
acaaatttcgaaa

SEQ ID NO: 570307 - DNA, 13 bp, D. melanogaster
acaaatttcgctt

SEQ ID NO: 570308 - DNA, 13 bp, D. melanogaster
acaaatttgaaat

SEQ ID NO: 570309 - DNA, 13 bp, D. melanogaster
acaaatttgaatt

SEQ ID NO: 570310 - DNA, 13 bp, D. melanogaster
acaaatttgattt

SEQ ID NO: 570311 - DNA, 13 bp, D. melanogaster
acaaatttgcaac

SEQ ID NO: 570312 - DNA, 13 bp, D. melanogaster
acaaatttgcact

SEQ ID NO: 570313 - DNA, 13 bp, D. melanogaster
acaaatttgcatt

SEQ ID NO: 570314 - DNA, 13 bp, D. melanogaster
acaaatttgtata

SEQ ID NO: 570315 - DNA, 13 bp, D. melanogaster
acaaattttaaag

SEQ ID NO: 570316 - DNA, 13 bp, D. melanogaster
acaaattttactc

SEQ ID NO: 570317 - DNA, 13 bp, D. melanogaster
acaaattttagaa

SEQ ID NO: 570318 - DNA, 14 bp, D. melanogaster
acaaattttagaac

SEQ ID NO: 570319 - DNA, 14 bp, D. melanogaster
acaaattttagtaa

SEQ ID NO: 570320 - DNA, 13 bp, D. melanogaster
acaaattttatgc

SEQ ID NO: 570321 - DNA, 13 bp, D. melanogaster
acaaattttcaaa

SEQ ID NO: 570322 - DNA, 13 bp, D. melanogaster
acaaattttcagc

SEQ ID NO: 570323 - DNA, 14 bp, D. melanogaster
acaaattttccata

SEQ ID NO: 570324 - DNA, 13 bp, D. melanogaster
acaaattttcctt

SEQ ID NO: 570325 - DNA, 13 bp, D. melanogaster
acaaattttctaa

SEQ ID NO: 570326 - DNA, 13 bp, D. melanogaster
acaaattttctta

SEQ ID NO: 570327 - DNA, 13 bp, D. melanogaster
acaaattttgaat

SEQ ID NO: 570328 - DNA, 14 bp, D. melanogaster
acaaattttgcatt

SEQ ID NO: 570329 - DNA, 13 bp, D. melanogaster
acaaattttggtt

SEQ ID NO: 570330 - DNA, 13 bp, D. melanogaster
acaaattttgtgc

SEQ ID NO: 570331 - DNA, 13 bp, D. melanogaster
acaaattttgttt

SEQ ID NO: 570332 - DNA, 13 bp, D. melanogaster
acaaatttttatg

SEQ ID NO: 570333 - DNA, 13 bp, D. melanogaster
acaaatttttcaa

SEQ ID NO: 570334 - DNA, 13 bp, D. melanogaster
acaaatttttctc

SEQ ID NO: 570335 - DNA, 13 bp, D. melanogaster
acaaatttttggg

SEQ ID NO: 570336 - DNA, 13 bp, D. melanogaster
acaaattttttac

SEQ ID NO: 570337 - DNA, 13 bp, D. melanogaster
acaaattttttga

SEQ ID NO: 570338 - DNA, 13 bp, D. melanogaster
acaacaaaaactg

SEQ ID NO: 570339 - DNA, 13 bp, D. melanogaster
acaacaaaagcgt

SEQ ID NO: 570340 - DNA, 13 bp, D. melanogaster
acaacaaaagtcg

SEQ ID NO: 570341 - DNA, 13 bp, D. melanogaster
acaacaaaagtgg

SEQ ID NO: 570342 - DNA, 13 bp, D. melanogaster
acaacaaaatagc

SEQ ID NO: 570343 - DNA, 13 bp, D. melanogaster
acaacaaaatcga

SEQ ID NO: 570344 - DNA, 13 bp, D. melanogaster
acaacaaaatgag

SEQ ID NO: 570345 - DNA, 13 bp, D. melanogaster
acaacaaaatgcc

SEQ ID NO: 570346 - DNA, 13 bp, D. melanogaster
acaacaaaatttt

SEQ ID NO: 570347 - DNA, 14 bp, D. melanogaster
acaacaaacatttt

SEQ ID NO: 570348 - DNA, 13 bp, D. melanogaster
acaacaaactgaa

SEQ ID NO: 570349 - DNA, 13 bp, D. melanogaster
acaacaaactttg

SEQ ID NO: 570350 - DNA, 13 bp, D. melanogaster
acaacaaactttt

SEQ ID NO: 570351 - DNA, 13 bp, D. melanogaster
acaacaaagcaat

SEQ ID NO: 570352 - DNA, 13 bp, D. melanogaster
acaacaaaggatg

SEQ ID NO: 570353 - DNA, 13 bp, D. melanogaster
acaacaaaggcag

SEQ ID NO: 570354 - DNA, 14 bp, D. melanogaster
acaacaaaggcagc

SEQ ID NO: 570355 - DNA, 13 bp, D. melanogaster
acaacaaaggcga

SEQ ID NO: 570356 - DNA, 13 bp, D. melanogaster
acaacaaagtcaa

SEQ ID NO: 570357 - DNA, 14 bp, D. melanogaster
acaacaaagtcaat

SEQ ID NO: 570358 - DNA, 13 bp, D. melanogaster
acaacaaagtggc

SEQ ID NO: 570359 - DNA, 13 bp, D. melanogaster
acaacaaatattt

SEQ ID NO: 570360 - DNA, 13 bp, D. melanogaster
acaacaaatcatt

SEQ ID NO: 570361 - DNA, 13 bp, D. melanogaster
acaacaaatgaat

SEQ ID NO: 570362 - DNA, 13 bp, D. melanogaster
acaacaaatgcaa

SEQ ID NO: 570363 - DNA, 13 bp, D. melanogaster
acaacaaatgcag

SEQ ID NO: 570364 - DNA, 13 bp, D. melanogaster
acaacaaatggca

SEQ ID NO: 570365 - DNA, 13 bp, D. melanogaster
acaacaaattagc

SEQ ID NO: 570366 - DNA, 13 bp, D. melanogaster
acaacaaattatg

SEQ ID NO: 570367 - DNA, 13 bp, D. melanogaster
acaacaaattcca

SEQ ID NO: 570368 - DNA, 14 bp, D. melanogaster
acaacaaattgcca

SEQ ID NO: 570369 - DNA, 13 bp, D. melanogaster
acaacaaattgct

SEQ ID NO: 570370 - DNA, 13 bp, D. melanogaster
acaacaaattgtg

SEQ ID NO: 570371 - DNA, 13 bp, D. melanogaster
acaacaaattgtt

SEQ ID NO: 570372 - DNA, 14 bp, D. melanogaster
acaacaaattgttt

SEQ ID NO: 570373 - DNA, 13 bp, D. melanogaster
acaacaaatttca

SEQ ID NO: 570374 - DNA, 13 bp, D. melanogaster
acaacaaattttt

SEQ ID NO: 570375 - DNA, 14 bp, D. melanogaster
acaacaacaaaagt

SEQ ID NO: 570376 - DNA, 14 bp, D. melanogaster
acaacaacaaaatg

SEQ ID NO: 570377 - DNA, 13 bp, D. melanogaster
acaacaacaaagt

SEQ ID NO: 570378 - DNA, 13 bp, D. melanogaster
acaacaacaaatg

SEQ ID NO: 570379 - DNA, 14 bp, D. melanogaster
acaacaacaacatg

SEQ ID NO: 570380 - DNA, 14 bp, D. melanogaster
acaacaacaactgc

SEQ ID NO: 570381 - DNA, 14 bp, D. melanogaster
acaacaacaactgg

SEQ ID NO: 570382 - DNA, 13 bp, D. melanogaster
acaacaacaatag

SEQ ID NO: 570383 - DNA, 15 bp, D. melanogaster
acaacaacaatagca

SEQ ID NO: 570384 - DNA, 14 bp, D. melanogaster
acaacaacaatgaa

SEQ ID NO: 570385 - DNA, 14 bp, D. melanogaster
acaacaacaatgag

SEQ ID NO: 570386 - DNA, 13 bp, D. melanogaster
acaacaacaatgc

SEQ ID NO: 570387 - DNA, 13 bp, D. melanogaster
acaacaacaatgg

SEQ ID NO: 570388 - DNA, 14 bp, D. melanogaster
acaacaacaatggc

SEQ ID NO: 570389 - DNA, 13 bp, D. melanogaster
acaacaacaattg

SEQ ID NO: 570390 - DNA, 14 bp, D. melanogaster
acaacaacaattgc

SEQ ID NO: 570391 - DNA, 13 bp, D. melanogaster
acaacaacactgt

SEQ ID NO: 570392 - DNA, 13 bp, D. melanogaster
acaacaacagatg

SEQ ID NO: 570393 - DNA, 14 bp, D. melanogaster
acaacaacagcaat

SEQ ID NO: 570394 - DNA, 18 bp, D. melanogaster
acaacaacagcagcaaca

SEQ ID NO: 570395 - DNA, 13 bp, D. melanogaster
acaacaacagcat

SEQ ID NO: 570396 - DNA, 14 bp, D. melanogaster
acaacaacagcatc

SEQ ID NO: 570397 - DNA, 15 bp, D. melanogaster
acaacaacagcgaca

SEQ ID NO: 570398 - DNA, 13 bp, D. melanogaster
acaacaacagcta

SEQ ID NO: 570399 - DNA, 13 bp, D. melanogaster
acaacaacaggca

SEQ ID NO: 570400 - DNA, 13 bp, D. melanogaster
acaacaacatctc

SEQ ID NO: 570401 - DNA, 13 bp, D. melanogaster
acaacaacgaaat

SEQ ID NO: 570402 - DNA, 14 bp, D. melanogaster
acaacaacgacatc

SEQ ID NO: 570403 - DNA, 13 bp, D. melanogaster
acaacaactctat

SEQ ID NO: 570404 - DNA, 13 bp, D. melanogaster
acaacaactgaaa

SEQ ID NO: 570405 - DNA, 13 bp, D. melanogaster
acaacaactgcac

SEQ ID NO: 570406 - DNA, 13 bp, D. melanogaster
acaacaactgctg

SEQ ID NO: 570407 - DNA, 13 bp, D. melanogaster
acaacaactggca

SEQ ID NO: 570408 - DNA, 13 bp, D. melanogaster
acaacaactggcg

SEQ ID NO: 570409 - DNA, 13 bp, D. melanogaster
acaacaagaatac

SEQ ID NO: 570410 - DNA, 13 bp, D. melanogaster
acaacaagatcaa

SEQ ID NO: 570411 - DNA, 14 bp, D. melanogaster
acaacaagccaaat

SEQ ID NO: 570412 - DNA, 13 bp, D. melanogaster
acaacaagctaaa

SEQ ID NO: 570413 - DNA, 13 bp, D. melanogaster
acaacaaggacga

SEQ ID NO: 570414 - DNA, 13 bp, D. melanogaster
acaacaagtccaa

SEQ ID NO: 570415 - DNA, 13 bp, D. melanogaster
acaacaagtgaaa

SEQ ID NO: 570416 - DNA, 13 bp, D. melanogaster
acaacaagtggaa

SEQ ID NO: 570417 - DNA, 13 bp, D. melanogaster
acaacaataatgc

SEQ ID NO: 570418 - DNA, 13 bp, D. melanogaster
acaacaatatatt

SEQ ID NO: 570419 - DNA, 13 bp, D. melanogaster
acaacaatgaaca

SEQ ID NO: 570420 - DNA, 13 bp, D. melanogaster
acaacaatgacaa

SEQ ID NO: 570421 - DNA, 13 bp, D. melanogaster
acaacaatgcaaa

SEQ ID NO: 570422 - DNA, 13 bp, D. melanogaster
acaacaatgcaac

SEQ ID NO: 570423 - DNA, 13 bp, D. melanogaster
acaacaatgccag

SEQ ID NO: 570424 - DNA, 13 bp, D. melanogaster
acaacaatggcaa

SEQ ID NO: 570425 - DNA, 13 bp, D. melanogaster
acaacaatgtctt

SEQ ID NO: 570426 - DNA, 14 bp, D. melanogaster
acaacaattacaat

SEQ ID NO: 570427 - DNA, 13 bp, D. melanogaster
acaacaattatta

SEQ ID NO: 570428 - DNA, 13 bp, D. melanogaster
acaacaattgcaa

SEQ ID NO: 570429 - DNA, 14 bp, D. melanogaster
acaacaattgcaat

SEQ ID NO: 570430 - DNA, 13 bp, D. melanogaster
acaacaattgcag

SEQ ID NO: 570431 - DNA, 13 bp, D. melanogaster
acaacaattgcca

SEQ ID NO: 570432 - DNA, 13 bp, D. melanogaster
acaacaattgttg

SEQ ID NO: 570433 - DNA, 13 bp, D. melanogaster
acaacaatttaca

SEQ ID NO: 570434 - DNA, 13 bp, D. melanogaster
acaacaatttcag

SEQ ID NO: 570435 - DNA, 13 bp, D. melanogaster
acaacaatttcat

SEQ ID NO: 570436 - DNA, 13 bp, D. melanogaster
acaacaatttctt

SEQ ID NO: 570437 - DNA, 13 bp, D. melanogaster
acaacaatttgaa

SEQ ID NO: 570438 - DNA, 13 bp, D. melanogaster
acaacaattttac

SEQ ID NO: 570439 - DNA, 13 bp, D. melanogaster
acaacacaatttt

SEQ ID NO: 570440 - DNA, 13 bp, D. melanogaster
acaacacagctta

SEQ ID NO: 570441 - DNA, 13 bp, D. melanogaster
acaacacataact

SEQ ID NO: 570442 - DNA, 13 bp, D. melanogaster
acaacaccagtag

SEQ ID NO: 570443 - DNA, 13 bp, D. melanogaster
acaacactgcgta

SEQ ID NO: 570444 - DNA, 13 bp, D. melanogaster
acaacagagaaat

SEQ ID NO: 570445 - DNA, 13 bp, D. melanogaster
acaacagagcaag

SEQ ID NO: 570446 - DNA, 13 bp, D. melanogaster
acaacagaggatt

SEQ ID NO: 570447 - DNA, 14 bp, D. melanogaster
acaacagcaacaat

SEQ ID NO: 570448 - DNA, 14 bp, D. melanogaster
acaacagcaacatt

SEQ ID NO: 570449 - DNA, 13 bp, D. melanogaster
acaacagcaacta

SEQ ID NO: 570450 - DNA, 13 bp, D. melanogaster
acaacagcaagag

SEQ ID NO: 570451 - DNA, 14 bp, D. melanogaster
acaacagcaataac

SEQ ID NO: 570452 - DNA, 13 bp, D. melanogaster
acaacagcagcga

SEQ ID NO: 570453 - DNA, 13 bp, D. melanogaster
acaacagcgacag

SEQ ID NO: 570454 - DNA, 14 bp, D. melanogaster
acaacagcgacagc

SEQ ID NO: 570455 - DNA, 13 bp, D. melanogaster
acaacagcggaaa

SEQ ID NO: 570456 - DNA, 13 bp, D. melanogaster
acaacagctgctg

SEQ ID NO: 570457 - DNA, 13 bp, D. melanogaster
acaacaggcagat

SEQ ID NO: 570458 - DNA, 13 bp, D. melanogaster
acaacagttacag

SEQ ID NO: 570459 - DNA, 13 bp, D. melanogaster
acaacatacaatt

SEQ ID NO: 570460 - DNA, 13 bp, D. melanogaster
acaacatatattt

SEQ ID NO: 570461 - DNA, 13 bp, D. melanogaster
acaacatatgtat

SEQ ID NO: 570462 - DNA, 13 bp, D. melanogaster
acaacatattcaa

SEQ ID NO: 570463 - DNA, 13 bp, D. melanogaster
acaacatatttaa

SEQ ID NO: 570464 - DNA, 13 bp, D. melanogaster
acaacatattttt

SEQ ID NO: 570465 - DNA, 14 bp, D. melanogaster
acaacatcaacttc

SEQ ID NO: 570466 - DNA, 13 bp, D. melanogaster
acaacatcatcaa

SEQ ID NO: 570467 - DNA, 13 bp, D. melanogaster
acaacatgaagtt

SEQ ID NO: 570468 - DNA, 13 bp, D. melanogaster
acaacatgcaaat

SEQ ID NO: 570469 - DNA, 13 bp, D. melanogaster
acaacatgcaaca

SEQ ID NO: 570470 - DNA, 13 bp, D. melanogaster
acaacatggatga

SEQ ID NO: 570471 - DNA, 13 bp, D. melanogaster
acaacattaacat

SEQ ID NO: 570472 - DNA, 13 bp, D. melanogaster
acaacattattta

SEQ ID NO: 570473 - DNA, 13 bp, D. melanogaster
acaacattgaaat

SEQ ID NO: 570474 - DNA, 14 bp, D. melanogaster
acaacattgccata

SEQ ID NO: 570475 - DNA, 13 bp, D. melanogaster
acaacattgtcat

SEQ ID NO: 570476 - DNA, 14 bp, D. melanogaster
acaacattgtcatc

SEQ ID NO: 570477 - DNA, 13 bp, D. melanogaster
acaacatttgaat

SEQ ID NO: 570478 - DNA, 13 bp, D. melanogaster
acaacattttaaa

SEQ ID NO: 570479 - DNA, 13 bp, D. melanogaster
acaacatttttga

SEQ ID NO: 570480 - DNA, 13 bp, D. melanogaster
acaacatttttta

SEQ ID NO: 570481 - DNA, 13 bp, D. melanogaster
acaaccaaaattc

SEQ ID NO: 570482 - DNA, 13 bp, D. melanogaster
acaaccaactact

SEQ ID NO: 570483 - DNA, 13 bp, D. melanogaster
acaaccaatacta

SEQ ID NO: 570484 - DNA, 13 bp, D. melanogaster
acaaccagacact

SEQ ID NO: 570485 - DNA, 13 bp, D. melanogaster
acaacccattcca

SEQ ID NO: 570486 - DNA, 13 bp, D. melanogaster
acaacccctcgct

SEQ ID NO: 570487 - DNA, 13 bp, D. melanogaster
acaaccgattttg

SEQ ID NO: 570488 - DNA, 13 bp, D. melanogaster
acaacctaaagtt

SEQ ID NO: 570489 - DNA, 13 bp, D. melanogaster
acaaccttgagca

SEQ ID NO: 570490 - DNA, 13 bp, D. melanogaster
acaacgacaacga

SEQ ID NO: 570491 - DNA, 14 bp, D. melanogaster
acaacgacaacgac

SEQ ID NO: 570492 - DNA, 13 bp, D. melanogaster
acaacgacaacgg

SEQ ID NO: 570493 - DNA, 13 bp, D. melanogaster
acaacgacaatgt

SEQ ID NO: 570494 - DNA, 14 bp, D. melanogaster
acaacgacatcagc

SEQ ID NO: 570495 - DNA, 13 bp, D. melanogaster
acaacgacattgt

SEQ ID NO: 570496 - DNA, 13 bp, D. melanogaster
acaacgatcgatc

SEQ ID NO: 570497 - DNA, 13 bp, D. melanogaster
acaacgatgacga

SEQ ID NO: 570498 - DNA, 14 bp, D. melanogaster
acaacgcaaatata

SEQ ID NO: 570499 - DNA, 13 bp, D. melanogaster
acaacgccaagaa

SEQ ID NO: 570500 - DNA, 13 bp, D. melanogaster
acaacgccgatct

SEQ ID NO: 570501 - DNA, 14 bp, D. melanogaster
acaacgcggcgtat

SEQ ID NO: 570502 - DNA, 13 bp, D. melanogaster
acaacggaaataa

SEQ ID NO: 570503 - DNA, 13 bp, D. melanogaster
acaacggcaacaa

SEQ ID NO: 570504 - DNA, 13 bp, D. melanogaster
acaacggcaacag

SEQ ID NO: 570505 - DNA, 13 bp, D. melanogaster
acaacggcgacaa

SEQ ID NO: 570506 - DNA, 13 bp, D. melanogaster
acaactaacaatt

SEQ ID NO: 570507 - DNA, 13 bp, D. melanogaster
acaactaactaac

SEQ ID NO: 570508 - DNA, 13 bp, D. melanogaster
acaactaattaat

SEQ ID NO: 570509 - DNA, 13 bp, D. melanogaster
acaactaatttat

SEQ ID NO: 570510 - DNA, 13 bp, D. melanogaster
acaactacaacag

SEQ ID NO: 570511 - DNA, 14 bp, D. melanogaster
acaactacaacaga

SEQ ID NO: 570512 - DNA, 13 bp, D. melanogaster
acaactacagcaa

SEQ ID NO: 570513 - DNA, 13 bp, D. melanogaster
acaactactacta

SEQ ID NO: 570514 - DNA, 14 bp, D. melanogaster
acaactactactac

SEQ ID NO: 570515 - DNA, 13 bp, D. melanogaster
acaactactttct

SEQ ID NO: 570516 - DNA, 13 bp, D. melanogaster
acaactatctgct

SEQ ID NO: 570517 - DNA, 13 bp, D. melanogaster
acaactatttaaa

SEQ ID NO: 570518 - DNA, 13 bp, D. melanogaster
acaactattttaa

SEQ ID NO: 570519 - DNA, 13 bp, D. melanogaster
acaactcaatcaa

SEQ ID NO: 570520 - DNA, 13 bp, D. melanogaster
acaactgaaaaag

SEQ ID NO: 570521 - DNA, 13 bp, D. melanogaster
acaactgaacaac

SEQ ID NO: 570522 - DNA, 13 bp, D. melanogaster
acaactgaacgtg

SEQ ID NO: 570523 - DNA, 13 bp, D. melanogaster
acaactgcaaaaa

SEQ ID NO: 570524 - DNA, 13 bp, D. melanogaster
acaactgcaactg

SEQ ID NO: 570525 - DNA, 14 bp, D. melanogaster
acaactgcaactgc

SEQ ID NO: 570526 - DNA, 13 bp, D. melanogaster
acaactgcgaact

SEQ ID NO: 570527 - DNA, 13 bp, D. melanogaster
acaactgttcaaa

SEQ ID NO: 570528 - DNA, 13 bp, D. melanogaster
acaactgtttccg

SEQ ID NO: 570529 - DNA, 13 bp, D. melanogaster
acaacttaaatat

SEQ ID NO: 570530 - DNA, 13 bp, D. melanogaster
acaacttacaact

SEQ ID NO: 570531 - DNA, 13 bp, D. melanogaster
acaacttcataga

SEQ ID NO: 570532 - DNA, 13 bp, D. melanogaster
acaacttccaaat

SEQ ID NO: 570533 - DNA, 13 bp, D. melanogaster
acaacttcgtggt

SEQ ID NO: 570534 - DNA, 13 bp, D. melanogaster
acaacttgccaaa

SEQ ID NO: 570535 - DNA, 13 bp, D. melanogaster
acaactttaaact

SEQ ID NO: 570536 - DNA, 13 bp, D. melanogaster
acaactttaaatt

SEQ ID NO: 570537 - DNA, 13 bp, D. melanogaster
acaactttacaac

SEQ ID NO: 570538 - DNA, 13 bp, D. melanogaster
acaactttatgtg

SEQ ID NO: 570539 - DNA, 13 bp, D. melanogaster
acaactttcaatt

SEQ ID NO: 570540 - DNA, 13 bp, D. melanogaster
acaactttcattt

SEQ ID NO: 570541 - DNA, 13 bp, D. melanogaster
acaactttgaaaa

SEQ ID NO: 570542 - DNA, 13 bp, D. melanogaster
acaactttgattt

SEQ ID NO: 570543 - DNA, 13 bp, D. melanogaster
acaactttgttgt

SEQ ID NO: 570544 - DNA, 13 bp, D. melanogaster
acaactttgtttt

SEQ ID NO: 570545 - DNA, 13 bp, D. melanogaster
acaacttttaaaa

SEQ ID NO: 570546 - DNA, 13 bp, D. melanogaster
acaacttttaagt

SEQ ID NO: 570547 - DNA, 13 bp, D. melanogaster
acaacttttggca

SEQ ID NO: 570548 - DNA, 14 bp, D. melanogaster
acaacttttgtaat

SEQ ID NO: 570549 - DNA, 13 bp, D. melanogaster
acaactttttaca

SEQ ID NO: 570550 - DNA, 14 bp, D. melanogaster
acaactttttcaaa

SEQ ID NO: 570551 - DNA, 13 bp, D. melanogaster
acaactttttgca

SEQ ID NO: 570552 - DNA, 14 bp, D. melanogaster
acaactttttgcca

SEQ ID NO: 570553 - DNA, 13 bp, D. melanogaster
acaacttttttgc

SEQ ID NO: 570554 - DNA, 13 bp, D. melanogaster
acaagaaaatgtt

SEQ ID NO: 570555 - DNA, 13 bp, D. melanogaster
acaagaaaattat

SEQ ID NO: 570556 - DNA, 13 bp, D. melanogaster
acaagaaactgct

SEQ ID NO: 570557 - DNA, 14 bp, D. melanogaster
acaagaaactgcta

SEQ ID NO: 570558 - DNA, 13 bp, D. melanogaster
acaagaaatatat

SEQ ID NO: 570559 - DNA, 13 bp, D. melanogaster
acaagaaatatga

SEQ ID NO: 570560 - DNA, 13 bp, D. melanogaster
acaagaaatggat

SEQ ID NO: 570561 - DNA, 13 bp, D. melanogaster
acaagaaattttg

SEQ ID NO: 570562 - DNA, 13 bp, D. melanogaster
acaagaacgctag

SEQ ID NO: 570563 - DNA, 13 bp, D. melanogaster
acaagaagaggac

SEQ ID NO: 570564 - DNA, 13 bp, D. melanogaster
acaagaagttgaa

SEQ ID NO: 570565 - DNA, 13 bp, D. melanogaster
acaagacaacatt

SEQ ID NO: 570566 - DNA, 13 bp, D. melanogaster
acaagacgagcgc

SEQ ID NO: 570567 - DNA, 13 bp, D. melanogaster
acaagagacgaga

SEQ ID NO: 570568 - DNA, 13 bp, D. melanogaster
acaagagcgaaag

SEQ ID NO: 570569 - DNA, 13 bp, D. melanogaster
acaagatattttt

SEQ ID NO: 570570 - DNA, 13 bp, D. melanogaster
acaagatcacaat

SEQ ID NO: 570571 - DNA, 13 bp, D. melanogaster
acaagattaaata

SEQ ID NO: 570572 - DNA, 13 bp, D. melanogaster
acaagattacaca

SEQ ID NO: 570573 - DNA, 13 bp, D. melanogaster
acaagattttatt

SEQ ID NO: 570574 - DNA, 13 bp, D. melanogaster
acaagcaaaagtt

SEQ ID NO: 570575 - DNA, 13 bp, D. melanogaster
acaagcaaataca

SEQ ID NO: 570576 - DNA, 14 bp, D. melanogaster
acaagcaaatacaa

SEQ ID NO: 570577 - DNA, 13 bp, D. melanogaster
acaagcaaatgaa

SEQ ID NO: 570578 - DNA, 13 bp, D. melanogaster
acaagcaaattaa

SEQ ID NO: 570579 - DNA, 13 bp, D. melanogaster
acaagcaaattgc

SEQ ID NO: 570580 - DNA, 13 bp, D. melanogaster
acaagcaacaaat

SEQ ID NO: 570581 - DNA, 14 bp, D. melanogaster
acaagcaagcaaat

SEQ ID NO: 570582 - DNA, 13 bp, D. melanogaster
acaagcaattaaa

SEQ ID NO: 570583 - DNA, 13 bp, D. melanogaster
acaagcacaagca

SEQ ID NO: 570584 - DNA, 13 bp, D. melanogaster
acaagcacacacg

SEQ ID NO: 570585 - DNA, 13 bp, D. melanogaster
acaagcacacaga

SEQ ID NO: 570586 - DNA, 13 bp, D. melanogaster
acaagcacacgca

SEQ ID NO: 570587 - DNA, 15 bp, D. melanogaster
acaagcactcaacaa

SEQ ID NO: 570588 - DNA, 13 bp, D. melanogaster
acaagcacttcac

SEQ ID NO: 570589 - DNA, 13 bp, D. melanogaster
acaagcagcagca

SEQ ID NO: 570590 - DNA, 13 bp, D. melanogaster
acaagcatacaca

SEQ ID NO: 570591 - DNA, 13 bp, D. melanogaster
acaagcatttagt

SEQ ID NO: 570592 - DNA, 13 bp, D. melanogaster
acaagcatttgta

SEQ ID NO: 570593 - DNA, 13 bp, D. melanogaster
acaagccaataaa

SEQ ID NO: 570594 - DNA, 13 bp, D. melanogaster
acaagcccaagtt

SEQ ID NO: 570595 - DNA, 14 bp, D. melanogaster
acaagccgaaaaat

SEQ ID NO: 570596 - DNA, 13 bp, D. melanogaster
acaagccgcacaa

SEQ ID NO: 570597 - DNA, 14 bp, D. melanogaster
acaagcctaccaaa

SEQ ID NO: 570598 - DNA, 13 bp, D. melanogaster
acaagccttttaa

SEQ ID NO: 570599 - DNA, 13 bp, D. melanogaster
acaagccttttca

SEQ ID NO: 570600 - DNA, 13 bp, D. melanogaster
acaagcgaaactt

SEQ ID NO: 570601 - DNA, 13 bp, D. melanogaster
acaagcgaaccaa

SEQ ID NO: 570602 - DNA, 13 bp, D. melanogaster
acaagcgaatgca

SEQ ID NO: 570603 - DNA, 14 bp, D. melanogaster
acaagcgaatgcaa

SEQ ID NO: 570604 - DNA, 13 bp, D. melanogaster
acaagcgcaatta

SEQ ID NO: 570605 - DNA, 13 bp, D. melanogaster
acaagcgcacaca

SEQ ID NO: 570606 - DNA, 13 bp, D. melanogaster
acaagcgctcgac

SEQ ID NO: 570607 - DNA, 13 bp, D. melanogaster
acaagcggcaaca

SEQ ID NO: 570608 - DNA, 13 bp, D. melanogaster
acaagctaaatat

SEQ ID NO: 570609 - DNA, 13 bp, D. melanogaster
acaagctccagaa

SEQ ID NO: 570610 - DNA, 13 bp, D. melanogaster
acaagctgagcta

SEQ ID NO: 570611 - DNA, 13 bp, D. melanogaster
acaagctgccaca

SEQ ID NO: 570612 - DNA, 13 bp, D. melanogaster
acaagctggcaaa

SEQ ID NO: 570613 - DNA, 13 bp, D. melanogaster
acaaggaaaacat

SEQ ID NO: 570614 - DNA, 13 bp, D. melanogaster
acaaggaaagttt

SEQ ID NO: 570615 - DNA, 13 bp, D. melanogaster
acaaggaacccat

SEQ ID NO: 570616 - DNA, 13 bp, D. melanogaster
acaaggacacaca

SEQ ID NO: 570617 - DNA, 13 bp, D. melanogaster
acaaggacgagga

SEQ ID NO: 570618 - DNA, 13 bp, D. melanogaster
acaaggacgataa

SEQ ID NO: 570619 - DNA, 13 bp, D. melanogaster
acaaggagcagga

SEQ ID NO: 570620 - DNA, 13 bp, D. melanogaster
acaaggagggcat

SEQ ID NO: 570621 - DNA, 13 bp, D. melanogaster
acaaggcacacac

SEQ ID NO: 570622 - DNA, 13 bp, D. melanogaster
acaaggcgtccgc

SEQ ID NO: 570623 - DNA, 13 bp, D. melanogaster
acaaggctttgga

SEQ ID NO: 570624 - DNA, 13 bp, D. melanogaster
acaaggtcttgct

SEQ ID NO: 570625 - DNA, 13 bp, D. melanogaster
acaaggtggaaaa

SEQ ID NO: 570626 - DNA, 13 bp, D. melanogaster
acaaggtgtaaaa

SEQ ID NO: 570627 - DNA, 13 bp, D. melanogaster
acaagtaaataat

SEQ ID NO: 570628 - DNA, 13 bp, D. melanogaster
acaagtacaagta

SEQ ID NO: 570629 - DNA, 14 bp, D. melanogaster
acaagtacaagtac

SEQ ID NO: 570630 - DNA, 13 bp, D. melanogaster
acaagtacacaaa

SEQ ID NO: 570631 - DNA, 13 bp, D. melanogaster
acaagtacatata

SEQ ID NO: 570632 - DNA, 13 bp, D. melanogaster
acaagtatcctgg

SEQ ID NO: 570633 - DNA, 14 bp, D. melanogaster
acaagtatgcaaat

SEQ ID NO: 570634 - DNA, 13 bp, D. melanogaster
acaagtcaaacaa

SEQ ID NO: 570635 - DNA, 13 bp, D. melanogaster
acaagtccatatt

SEQ ID NO: 570636 - DNA, 13 bp, D. melanogaster
acaagtcgaacaa

SEQ ID NO: 570637 - DNA, 13 bp, D. melanogaster
acaagtgaaacta

SEQ ID NO: 570638 - DNA, 13 bp, D. melanogaster
acaagtgaaatat

SEQ ID NO: 570639 - DNA, 13 bp, D. melanogaster
acaagtgcaaaaa

SEQ ID NO: 570640 - DNA, 13 bp, D. melanogaster
acaagtgcaaaat

SEQ ID NO: 570641 - DNA, 13 bp, D. melanogaster
acaagtgcaaaca

SEQ ID NO: 570642 - DNA, 13 bp, D. melanogaster
acaagtgcagcaa

SEQ ID NO: 570643 - DNA, 14 bp, D. melanogaster
acaagtgcatttgt

SEQ ID NO: 570644 - DNA, 13 bp, D. melanogaster
acaagtggaaaac

SEQ ID NO: 570645 - DNA, 13 bp, D. melanogaster
acaagtggccaag

SEQ ID NO: 570646 - DNA, 13 bp, D. melanogaster
acaagtgtcttaa

SEQ ID NO: 570647 - DNA, 13 bp, D. melanogaster
acaagtgtttatt

SEQ ID NO: 570648 - DNA, 13 bp, D. melanogaster
acaagtgtttttc

SEQ ID NO: 570649 - DNA, 13 bp, D. melanogaster
acaagttatattt

SEQ ID NO: 570650 - DNA, 13 bp, D. melanogaster
acaagttgaaaat

SEQ ID NO: 570651 - DNA, 13 bp, D. melanogaster
acaagttgaagcc

SEQ ID NO: 570652 - DNA, 13 bp, D. melanogaster
acaagttgcattt

SEQ ID NO: 570653 - DNA, 13 bp, D. melanogaster
acaagttgccaaa

SEQ ID NO: 570654 - DNA, 13 bp, D. melanogaster
acaagttggaaaa

SEQ ID NO: 570655 - DNA, 14 bp, D. melanogaster
acaagttggtatct

SEQ ID NO: 570656 - DNA, 13 bp, D. melanogaster
acaagtttattaa

SEQ ID NO: 570657 - DNA, 13 bp, D. melanogaster
acaagtttattat

SEQ ID NO: 570658 - DNA, 13 bp, D. melanogaster
acaagtttatttt

SEQ ID NO: 570659 - DNA, 13 bp, D. melanogaster
acaagttttaaaa

SEQ ID NO: 570660 - DNA, 13 bp, D. melanogaster
acaagttttccat

SEQ ID NO: 570661 - DNA, 13 bp, D. melanogaster
acaagtttttaaa

SEQ ID NO: 570662 - DNA, 13 bp, D. melanogaster
acaagtttttgca

SEQ ID NO: 570663 - DNA, 13 bp, D. melanogaster
acaataaaacgtt

SEQ ID NO: 570664 - DNA, 14 bp, D. melanogaster
acaataaaacgttt

SEQ ID NO: 570665 - DNA, 13 bp, D. melanogaster
acaataaaagcga

SEQ ID NO: 570666 - DNA, 13 bp, D. melanogaster
acaataaaatgct

SEQ ID NO: 570667 - DNA, 13 bp, D. melanogaster
acaataaacattt

SEQ ID NO: 570668 - DNA, 13 bp, D. melanogaster
acaataaactgaa

SEQ ID NO: 570669 - DNA, 13 bp, D. melanogaster
acaataaacttca

SEQ ID NO: 570670 - DNA, 13 bp, D. melanogaster
acaataaagattt

SEQ ID NO: 570671 - DNA, 13 bp, D. melanogaster
acaataaagcgaa

SEQ ID NO: 570672 - DNA, 13 bp, D. melanogaster
acaataaagtgaa

SEQ ID NO: 570673 - DNA, 13 bp, D. melanogaster
acaataaagtttt

SEQ ID NO: 570674 - DNA, 14 bp, D. melanogaster
acaataaataaagc

SEQ ID NO: 570675 - DNA, 14 bp, D. melanogaster
acaataaataaatg

SEQ ID NO: 570676 - DNA, 13 bp, D. melanogaster
acaataaatattg

SEQ ID NO: 570677 - DNA, 13 bp, D. melanogaster
acaataaatgaat

SEQ ID NO: 570678 - DNA, 13 bp, D. melanogaster
acaataaatgcta

SEQ ID NO: 570679 - DNA, 13 bp, D. melanogaster
acaataaatgtaa

SEQ ID NO: 570680 - DNA, 13 bp, D. melanogaster
acaataaatgttt

SEQ ID NO: 570681 - DNA, 13 bp, D. melanogaster
acaataaattcca

SEQ ID NO: 570682 - DNA, 14 bp, D. melanogaster
acaataacaaaagc

SEQ ID NO: 570683 - DNA, 14 bp, D. melanogaster
acaataacaacaag

SEQ ID NO: 570684 - DNA, 14 bp, D. melanogaster
acaataacaactat

SEQ ID NO: 570685 - DNA, 13 bp, D. melanogaster
acaataacaatgg

SEQ ID NO: 570686 - DNA, 13 bp, D. melanogaster
acaataacaattc

SEQ ID NO: 570687 - DNA, 13 bp, D. melanogaster
acaataacattta

SEQ ID NO: 570688 - DNA, 14 bp, D. melanogaster
acaataacgaaaat

SEQ ID NO: 570689 - DNA, 13 bp, D. melanogaster
acaataatcttaa

SEQ ID NO: 570690 - DNA, 13 bp, D. melanogaster
acaataatggcag

SEQ ID NO: 570691 - DNA, 14 bp, D. melanogaster
acaataattatgta

SEQ ID NO: 570692 - DNA, 13 bp, D. melanogaster
acaataattgtaa

SEQ ID NO: 570693 - DNA, 13 bp, D. melanogaster
acaataatttgca

SEQ ID NO: 570694 - DNA, 13 bp, D. melanogaster
acaataattttgt

SEQ ID NO: 570695 - DNA, 13 bp, D. melanogaster
acaataatttttc

SEQ ID NO: 570696 - DNA, 13 bp, D. melanogaster
acaatacaaattt

SEQ ID NO: 570697 - DNA, 13 bp, D. melanogaster
acaatacaatatt

SEQ ID NO: 570698 - DNA, 13 bp, D. melanogaster
acaatacagttct

SEQ ID NO: 570699 - DNA, 13 bp, D. melanogaster
acaatacatttta

SEQ ID NO: 570700 - DNA, 13 bp, D. melanogaster
acaataccacgct

SEQ ID NO: 570701 - DNA, 13 bp, D. melanogaster
acaatacccactt

SEQ ID NO: 570702 - DNA, 13 bp, D. melanogaster
acaatactataca

SEQ ID NO: 570703 - DNA, 14 bp, D. melanogaster
acaatactatacag

SEQ ID NO: 570704 - DNA, 13 bp, D. melanogaster
acaatactttaca

SEQ ID NO: 570705 - DNA, 13 bp, D. melanogaster
acaatagaattat

SEQ ID NO: 570706 - DNA, 13 bp, D. melanogaster
acaatagcaacaa

SEQ ID NO: 570707 - DNA, 13 bp, D. melanogaster
acaatagcaacct

SEQ ID NO: 570708 - DNA, 13 bp, D. melanogaster
acaatagcaataa

SEQ ID NO: 570709 - DNA, 13 bp, D. melanogaster
acaatagccaaat

SEQ ID NO: 570710 - DNA, 13 bp, D. melanogaster
acaatagtcgaaa

SEQ ID NO: 570711 - DNA, 13 bp, D. melanogaster
acaatagttgatt

SEQ ID NO: 570712 - DNA, 14 bp, D. melanogaster
acaatataaagtat

SEQ ID NO: 570713 - DNA, 13 bp, D. melanogaster
acaatataaatgt

SEQ ID NO: 570714 - DNA, 13 bp, D. melanogaster
acaatatagaatt

SEQ ID NO: 570715 - DNA, 13 bp, D. melanogaster
acaatatagcttc

SEQ ID NO: 570716 - DNA, 13 bp, D. melanogaster
acaatatatatac

SEQ ID NO: 570717 - DNA, 13 bp, D. melanogaster
acaatatattcaa

SEQ ID NO: 570718 - DNA, 13 bp, D. melanogaster
acaatatattgta

SEQ ID NO: 570719 - DNA, 13 bp, D. melanogaster
acaatatattttc

SEQ ID NO: 570720 - DNA, 13 bp, D. melanogaster
acaatatcaattt

SEQ ID NO: 570721 - DNA, 13 bp, D. melanogaster
acaatattaacag

SEQ ID NO: 570722 - DNA, 13 bp, D. melanogaster
acaatattacact

SEQ ID NO: 570723 - DNA, 14 bp, D. melanogaster
acaatattacactt

SEQ ID NO: 570724 - DNA, 13 bp, D. melanogaster
acaatattattac

SEQ ID NO: 570725 - DNA, 13 bp, D. melanogaster
acaatattgaaat

SEQ ID NO: 570726 - DNA, 13 bp, D. melanogaster
acaatattgattt

SEQ ID NO: 570727 - DNA, 13 bp, D. melanogaster
acaatatttgaaa

SEQ ID NO: 570728 - DNA, 13 bp, D. melanogaster
acaatatttgcat

SEQ ID NO: 570729 - DNA, 14 bp, D. melanogaster
acaatatttgtatt

SEQ ID NO: 570730 - DNA, 13 bp, D. melanogaster
acaatattttcaa

SEQ ID NO: 570731 - DNA, 13 bp, D. melanogaster
acaatattttcca

SEQ ID NO: 570732 - DNA, 13 bp, D. melanogaster
acaatcaaatgaa

SEQ ID NO: 570733 - DNA, 13 bp, D. melanogaster
acaatcaacagag

SEQ ID NO: 570734 - DNA, 14 bp, D. melanogaster
acaatcaacagaga

SEQ ID NO: 570735 - DNA, 14 bp, D. melanogaster
acaatcagcagcaa

SEQ ID NO: 570736 - DNA, 13 bp, D. melanogaster
acaatcataattt

SEQ ID NO: 570737 - DNA, 14 bp, D. melanogaster
acaatcatcatcat

SEQ ID NO: 570738 - DNA, 13 bp, D. melanogaster
acaatcccaatcc

SEQ ID NO: 570739 - DNA, 13 bp, D. melanogaster
acaatcgaacgaa

SEQ ID NO: 570740 - DNA, 13 bp, D. melanogaster
acaatcgcacaca

SEQ ID NO: 570741 - DNA, 13 bp, D. melanogaster
acaatcggaaaac

SEQ ID NO: 570742 - DNA, 14 bp, D. melanogaster
acaatcggaaaaca

SEQ ID NO: 570743 - DNA, 13 bp, D. melanogaster
acaatctcagccc

SEQ ID NO: 570744 - DNA, 13 bp, D. melanogaster
acaatctccaaaa

SEQ ID NO: 570745 - DNA, 13 bp, D. melanogaster
acaatcttttaaa

SEQ ID NO: 570746 - DNA, 13 bp, D. melanogaster
acaatcttttgca

SEQ ID NO: 570747 - DNA, 13 bp, D. melanogaster
acaatgaaaacac

SEQ ID NO: 570748 - DNA, 13 bp, D. melanogaster
acaatgaaaacga

SEQ ID NO: 570749 - DNA, 13 bp, D. melanogaster
acaatgaaaatga

SEQ ID NO: 570750 - DNA, 13 bp, D. melanogaster
acaatgaaacgac

SEQ ID NO: 570751 - DNA, 13 bp, D. melanogaster
acaatgaaaggaa

SEQ ID NO: 570752 - DNA, 13 bp, D. melanogaster
acaatgaaatatg

SEQ ID NO: 570753 - DNA, 13 bp, D. melanogaster
acaatgaaattga

SEQ ID NO: 570754 - DNA, 13 bp, D. melanogaster
acaatgaagacaa

SEQ ID NO: 570755 - DNA, 13 bp, D. melanogaster
acaatgaattatt

SEQ ID NO: 570756 - DNA, 13 bp, D. melanogaster
acaatgacaacaa

SEQ ID NO: 570757 - DNA, 13 bp, D. melanogaster
acaatgacaatgg

SEQ ID NO: 570758 - DNA, 13 bp, D. melanogaster
acaatgacagcaa

SEQ ID NO: 570759 - DNA, 13 bp, D. melanogaster
acaatgataataa

SEQ ID NO: 570760 - DNA, 13 bp, D. melanogaster
acaatgatctgat

SEQ ID NO: 570761 - DNA, 13 bp, D. melanogaster
acaatgatgatga

SEQ ID NO: 570762 - DNA, 13 bp, D. melanogaster
acaatgattttat

SEQ ID NO: 570763 - DNA, 13 bp, D. melanogaster
acaatgcaaacaa

SEQ ID NO: 570764 - DNA, 13 bp, D. melanogaster
acaatgcaaatta

SEQ ID NO: 570765 - DNA, 13 bp, D. melanogaster
acaatgcaaattg

SEQ ID NO: 570766 - DNA, 13 bp, D. melanogaster
acaatgcaataaa

SEQ ID NO: 570767 - DNA, 13 bp, D. melanogaster
acaatgcacacaa

SEQ ID NO: 570768 - DNA, 13 bp, D. melanogaster
acaatgcataaat

SEQ ID NO: 570769 - DNA, 13 bp, D. melanogaster
acaatgcatactt

SEQ ID NO: 570770 - DNA, 13 bp, D. melanogaster
acaatgccaaaca

SEQ ID NO: 570771 - DNA, 13 bp, D. melanogaster
acaatgccacaaa

SEQ ID NO: 570772 - DNA, 13 bp, D. melanogaster
acaatgccacaat

SEQ ID NO: 570773 - DNA, 13 bp, D. melanogaster
acaatgccagcga

SEQ ID NO: 570774 - DNA, 13 bp, D. melanogaster
acaatgccatctt

SEQ ID NO: 570775 - DNA, 13 bp, D. melanogaster
acaatgcctccga

SEQ ID NO: 570776 - DNA, 13 bp, D. melanogaster
acaatgcggtgtg

SEQ ID NO: 570777 - DNA, 13 bp, D. melanogaster
acaatgcttaaaa

SEQ ID NO: 570778 - DNA, 13 bp, D. melanogaster
acaatgcttttca

SEQ ID NO: 570779 - DNA, 13 bp, D. melanogaster
acaatggaaacaa

SEQ ID NO: 570780 - DNA, 13 bp, D. melanogaster
acaatggaaattc

SEQ ID NO: 570781 - DNA, 13 bp, D. melanogaster
acaatggacaatg

SEQ ID NO: 570782 - DNA, 13 bp, D. melanogaster
acaatggcaaaaa

SEQ ID NO: 570783 - DNA, 13 bp, D. melanogaster
acaatggcaaata

SEQ ID NO: 570784 - DNA, 13 bp, D. melanogaster
acaatggcaacaa

SEQ ID NO: 570785 - DNA, 14 bp, D. melanogaster
acaatggcaacaac

SEQ ID NO: 570786 - DNA, 13 bp, D. melanogaster
acaatggcaatga

SEQ ID NO: 570787 - DNA, 13 bp, D. melanogaster
acaatggcaatta

SEQ ID NO: 570788 - DNA, 13 bp, D. melanogaster
acaatggcacaaa

SEQ ID NO: 570789 - DNA, 13 bp, D. melanogaster
acaatggccaaat

SEQ ID NO: 570790 - DNA, 13 bp, D. melanogaster
acaatggccaaca

SEQ ID NO: 570791 - DNA, 13 bp, D. melanogaster
acaatggccacaa

SEQ ID NO: 570792 - DNA, 13 bp, D. melanogaster
acaatggccagca

SEQ ID NO: 570793 - DNA, 13 bp, D. melanogaster
acaatggccagga

SEQ ID NO: 570794 - DNA, 13 bp, D. melanogaster
acaatggctgcca

SEQ ID NO: 570795 - DNA, 13 bp, D. melanogaster
acaatgggcacaa

SEQ ID NO: 570796 - DNA, 13 bp, D. melanogaster
acaatgggttgct

SEQ ID NO: 570797 - DNA, 13 bp, D. melanogaster
acaatggtctatg

SEQ ID NO: 570798 - DNA, 14 bp, D. melanogaster
acaatggtttcttt

SEQ ID NO: 570799 - DNA, 13 bp, D. melanogaster
acaatgtcaaaga

SEQ ID NO: 570800 - DNA, 13 bp, D. melanogaster
acaatgtcaactt

SEQ ID NO: 570801 - DNA, 13 bp, D. melanogaster
acaatgtcgttgt

SEQ ID NO: 570802 - DNA, 13 bp, D. melanogaster
acaatgtgaacaa

SEQ ID NO: 570803 - DNA, 13 bp, D. melanogaster
acaatgtgcaaca

SEQ ID NO: 570804 - DNA, 13 bp, D. melanogaster
acaatgtgttata

SEQ ID NO: 570805 - DNA, 13 bp, D. melanogaster
acaatgtttaaaa

SEQ ID NO: 570806 - DNA, 13 bp, D. melanogaster
acaatgttttttt

SEQ ID NO: 570807 - DNA, 13 bp, D. melanogaster
acaattaaaaacg

SEQ ID NO: 570808 - DNA, 13 bp, D. melanogaster
acaattaaaactt

SEQ ID NO: 570809 - DNA, 13 bp, D. melanogaster
acaattaaacacg

SEQ ID NO: 570810 - DNA, 13 bp, D. melanogaster
acaattaatatga

SEQ ID NO: 570811 - DNA, 13 bp, D. melanogaster
acaattaatcatt

SEQ ID NO: 570812 - DNA, 13 bp, D. melanogaster
acaattacaaatt

SEQ ID NO: 570813 - DNA, 13 bp, D. melanogaster
acaattacaatta

SEQ ID NO: 570814 - DNA, 13 bp, D. melanogaster
acaattacaattg

SEQ ID NO: 570815 - DNA, 13 bp, D. melanogaster
acaattacattaa

SEQ ID NO: 570816 - DNA, 13 bp, D. melanogaster
acaattaccagaa

SEQ ID NO: 570817 - DNA, 13 bp, D. melanogaster
acaattacctgat

SEQ ID NO: 570818 - DNA, 13 bp, D. melanogaster
acaattagccaaa

SEQ ID NO: 570819 - DNA, 14 bp, D. melanogaster
acaattagtattat

SEQ ID NO: 570820 - DNA, 13 bp, D. melanogaster
acaattatagcca

SEQ ID NO: 570821 - DNA, 13 bp, D. melanogaster
acaattatgcaaa

SEQ ID NO: 570822 - DNA, 13 bp, D. melanogaster
acaattatgtcat

SEQ ID NO: 570823 - DNA, 13 bp, D. melanogaster
acaattattcaat

SEQ ID NO: 570824 - DNA, 13 bp, D. melanogaster
acaattattgatt

SEQ ID NO: 570825 - DNA, 13 bp, D. melanogaster
acaattatttatc

SEQ ID NO: 570826 - DNA, 13 bp, D. melanogaster
acaattatttgat

SEQ ID NO: 570827 - DNA, 13 bp, D. melanogaster
acaattatttttc

SEQ ID NO: 570828 - DNA, 13 bp, D. melanogaster
acaattcaataat

SEQ ID NO: 570829 - DNA, 14 bp, D. melanogaster
acaattcaatatga

SEQ ID NO: 570830 - DNA, 13 bp, D. melanogaster
acaattcatattt

SEQ ID NO: 570831 - DNA, 13 bp, D. melanogaster
acaattccaaaat

SEQ ID NO: 570832 - DNA, 13 bp, D. melanogaster
acaattccatctg

SEQ ID NO: 570833 - DNA, 13 bp, D. melanogaster
acaattcccaaac

SEQ ID NO: 570834 - DNA, 13 bp, D. melanogaster
acaattctaaatt

SEQ ID NO: 570835 - DNA, 13 bp, D. melanogaster
acaattcttatgt

SEQ ID NO: 570836 - DNA, 14 bp, D. melanogaster
acaattcttatgta

SEQ ID NO: 570837 - DNA, 13 bp, D. melanogaster
acaattgaaaagc

SEQ ID NO: 570838 - DNA, 13 bp, D. melanogaster
acaattgaaaagt

SEQ ID NO: 570839 - DNA, 13 bp, D. melanogaster
acaattgaataat

SEQ ID NO: 570840 - DNA, 13 bp, D. melanogaster
acaattgaatatt

SEQ ID NO: 570841 - DNA, 13 bp, D. melanogaster
acaattgaatgaa

SEQ ID NO: 570842 - DNA, 13 bp, D. melanogaster
acaattgaattaa

SEQ ID NO: 570843 - DNA, 13 bp, D. melanogaster
acaattgaattta

SEQ ID NO: 570844 - DNA, 13 bp, D. melanogaster
acaattgacactg

SEQ ID NO: 570845 - DNA, 13 bp, D. melanogaster
acaattgattaaa

SEQ ID NO: 570846 - DNA, 13 bp, D. melanogaster
acaattgcaaatg

SEQ ID NO: 570847 - DNA, 13 bp, D. melanogaster
acaattgcaactg

SEQ ID NO: 570848 - DNA, 13 bp, D. melanogaster
acaattgcaattg

SEQ ID NO: 570849 - DNA, 13 bp, D. melanogaster
acaattgcacaaa

SEQ ID NO: 570850 - DNA, 13 bp, D. melanogaster
acaattggaaaat

SEQ ID NO: 570851 - DNA, 13 bp, D. melanogaster
acaattgtatttc

SEQ ID NO: 570852 - DNA, 13 bp, D. melanogaster
acaattgtatttt

SEQ ID NO: 570853 - DNA, 13 bp, D. melanogaster
acaattgttgcaa

SEQ ID NO: 570854 - DNA, 13 bp, D. melanogaster
acaatttaaaact

SEQ ID NO: 570855 - DNA, 13 bp, D. melanogaster
acaatttaagcaa

SEQ ID NO: 570856 - DNA, 13 bp, D. melanogaster
acaatttaattgt

SEQ ID NO: 570857 - DNA, 13 bp, D. melanogaster
acaatttacaaat

SEQ ID NO: 570858 - DNA, 13 bp, D. melanogaster
acaatttacaatt

SEQ ID NO: 570859 - DNA, 13 bp, D. melanogaster
acaatttacacaa

SEQ ID NO: 570860 - DNA, 13 bp, D. melanogaster
acaatttacatat

SEQ ID NO: 570861 - DNA, 13 bp, D. melanogaster
acaatttacctta

SEQ ID NO: 570862 - DNA, 13 bp, D. melanogaster
acaatttacttaa

SEQ ID NO: 570863 - DNA, 13 bp, D. melanogaster
acaatttagttaa

SEQ ID NO: 570864 - DNA, 13 bp, D. melanogaster
acaatttatcaat

SEQ ID NO: 570865 - DNA, 13 bp, D. melanogaster
acaatttatgaaa

SEQ ID NO: 570866 - DNA, 13 bp, D. melanogaster
acaatttatgcaa

SEQ ID NO: 570867 - DNA, 13 bp, D. melanogaster
acaatttatttac

SEQ ID NO: 570868 - DNA, 14 bp, D. melanogaster
acaatttattttca

SEQ ID NO: 570869 - DNA, 13 bp, D. melanogaster
acaatttcaactt

SEQ ID NO: 570870 - DNA, 13 bp, D. melanogaster
acaatttcaataa

SEQ ID NO: 570871 - DNA, 13 bp, D. melanogaster
acaatttcaatag

SEQ ID NO: 570872 - DNA, 13 bp, D. melanogaster
acaatttcaattg

SEQ ID NO: 570873 - DNA, 13 bp, D. melanogaster
acaatttcacaaa

SEQ ID NO: 570874 - DNA, 13 bp, D. melanogaster
acaatttcacatt

SEQ ID NO: 570875 - DNA, 13 bp, D. melanogaster
acaatttcataat

SEQ ID NO: 570876 - DNA, 13 bp, D. melanogaster
acaatttcatatt

SEQ ID NO: 570877 - DNA, 13 bp, D. melanogaster
acaatttcattaa

SEQ ID NO: 570878 - DNA, 14 bp, D. melanogaster
acaatttcattaaa

SEQ ID NO: 570879 - DNA, 13 bp, D. melanogaster
acaatttcattat

SEQ ID NO: 570880 - DNA, 13 bp, D. melanogaster
acaatttcattta

SEQ ID NO: 570881 - DNA, 13 bp, D. melanogaster
acaatttccaaaa

SEQ ID NO: 570882 - DNA, 13 bp, D. melanogaster
acaatttccaaag

SEQ ID NO: 570883 - DNA, 14 bp, D. melanogaster
acaatttcctacaa

SEQ ID NO: 570884 - DNA, 13 bp, D. melanogaster
acaatttcgcatt

SEQ ID NO: 570885 - DNA, 13 bp, D. melanogaster
acaatttctacaa

SEQ ID NO: 570886 - DNA, 13 bp, D. melanogaster
acaatttctatgt

SEQ ID NO: 570887 - DNA, 13 bp, D. melanogaster
acaatttctttat

SEQ ID NO: 570888 - DNA, 13 bp, D. melanogaster
acaatttctttgc

SEQ ID NO: 570889 - DNA, 13 bp, D. melanogaster
acaatttctttgt

SEQ ID NO: 570890 - DNA, 13 bp, D. melanogaster
acaatttgaaaag

SEQ ID NO: 570891 - DNA, 13 bp, D. melanogaster
acaatttgaaagt

SEQ ID NO: 570892 - DNA, 13 bp, D. melanogaster
acaatttgaaata

SEQ ID NO: 570893 - DNA, 13 bp, D. melanogaster
acaatttgaatgc

SEQ ID NO: 570894 - DNA, 13 bp, D. melanogaster
acaatttgaatta

SEQ ID NO: 570895 - DNA, 13 bp, D. melanogaster
acaatttgataaa

SEQ ID NO: 570896 - DNA, 13 bp, D. melanogaster
acaatttgatatt

SEQ ID NO: 570897 - DNA, 13 bp, D. melanogaster
acaatttgcagca

SEQ ID NO: 570898 - DNA, 13 bp, D. melanogaster
acaatttgcataa

SEQ ID NO: 570899 - DNA, 13 bp, D. melanogaster
acaatttgcattt

SEQ ID NO: 570900 - DNA, 14 bp, D. melanogaster
acaatttgcatttg

SEQ ID NO: 570901 - DNA, 13 bp, D. melanogaster
acaatttgccaaa

SEQ ID NO: 570902 - DNA, 13 bp, D. melanogaster
acaatttgccaac

SEQ ID NO: 570903 - DNA, 13 bp, D. melanogaster
acaatttgctgaa

SEQ ID NO: 570904 - DNA, 13 bp, D. melanogaster
acaatttgctttt

SEQ ID NO: 570905 - DNA, 13 bp, D. melanogaster
acaatttggaaaa

SEQ ID NO: 570906 - DNA, 13 bp, D. melanogaster
acaatttggatgg

SEQ ID NO: 570907 - DNA, 13 bp, D. melanogaster
acaatttggtttc

SEQ ID NO: 570908 - DNA, 13 bp, D. melanogaster
acaatttgtaaaa

SEQ ID NO: 570909 - DNA, 13 bp, D. melanogaster
acaatttgtacat

SEQ ID NO: 570910 - DNA, 14 bp, D. melanogaster
acaatttgtacatt

SEQ ID NO: 570911 - DNA, 13 bp, D. melanogaster
acaatttgtactc

SEQ ID NO: 570912 - DNA, 13 bp, D. melanogaster
acaatttgtactt

SEQ ID NO: 570913 - DNA, 13 bp, D. melanogaster
acaatttgtcaac

SEQ ID NO: 570914 - DNA, 13 bp, D. melanogaster
acaatttgtcaca

SEQ ID NO: 570915 - DNA, 13 bp, D. melanogaster
acaatttgtggaa

SEQ ID NO: 570916 - DNA, 13 bp, D. melanogaster
acaatttgtggca

SEQ ID NO: 570917 - DNA, 13 bp, D. melanogaster
acaatttgttaaa

SEQ ID NO: 570918 - DNA, 13 bp, D. melanogaster
acaatttgttcaa

SEQ ID NO: 570919 - DNA, 14 bp, D. melanogaster
acaatttgttcaaa

SEQ ID NO: 570920 - DNA, 13 bp, D. melanogaster
acaatttgttgtt

SEQ ID NO: 570921 - DNA, 13 bp, D. melanogaster
acaatttgtttaa

SEQ ID NO: 570922 - DNA, 13 bp, D. melanogaster
acaatttgtttac

SEQ ID NO: 570923 - DNA, 14 bp, D. melanogaster
acaatttgttttat

SEQ ID NO: 570924 - DNA, 13 bp, D. melanogaster
acaatttgttttt

SEQ ID NO: 570925 - DNA, 13 bp, D. melanogaster
acaattttaaaca

SEQ ID NO: 570926 - DNA, 13 bp, D. melanogaster
acaattttaaggt

SEQ ID NO: 570927 - DNA, 13 bp, D. melanogaster
acaattttacaat

SEQ ID NO: 570928 - DNA, 14 bp, D. melanogaster
acaattttatagct

SEQ ID NO: 570929 - DNA, 13 bp, D. melanogaster
acaattttatgac

SEQ ID NO: 570930 - DNA, 13 bp, D. melanogaster
acaattttatttg

SEQ ID NO: 570931 - DNA, 13 bp, D. melanogaster
acaattttcaatc

SEQ ID NO: 570932 - DNA, 14 bp, D. melanogaster
acaattttcaattt

SEQ ID NO: 570933 - DNA, 13 bp, D. melanogaster
acaattttcactt

SEQ ID NO: 570934 - DNA, 13 bp, D. melanogaster
acaattttccaaa

SEQ ID NO: 570935 - DNA, 13 bp, D. melanogaster
acaattttccaac

SEQ ID NO: 570936 - DNA, 13 bp, D. melanogaster
acaattttccaat

SEQ ID NO: 570937 - DNA, 13 bp, D. melanogaster
acaattttcgcag

SEQ ID NO: 570938 - DNA, 14 bp, D. melanogaster
acaattttgaaaaa

SEQ ID NO: 570939 - DNA, 13 bp, D. melanogaster
acaattttgaata

SEQ ID NO: 570940 - DNA, 13 bp, D. melanogaster
acaattttgactt

SEQ ID NO: 570941 - DNA, 13 bp, D. melanogaster
acaattttgattt

SEQ ID NO: 570942 - DNA, 13 bp, D. melanogaster
acaattttgcaaa

SEQ ID NO: 570943 - DNA, 13 bp, D. melanogaster
acaattttgcata

SEQ ID NO: 570944 - DNA, 13 bp, D. melanogaster
acaattttgcatt

SEQ ID NO: 570945 - DNA, 13 bp, D. melanogaster
acaattttgcttt

SEQ ID NO: 570946 - DNA, 13 bp, D. melanogaster
acaattttgtata

SEQ ID NO: 570947 - DNA, 14 bp, D. melanogaster
acaattttgtgtgc

SEQ ID NO: 570948 - DNA, 13 bp, D. melanogaster
acaatttttacaa

SEQ ID NO: 570949 - DNA, 13 bp, D. melanogaster
acaatttttcgca

SEQ ID NO: 570950 - DNA, 13 bp, D. melanogaster
acaatttttgaat

SEQ ID NO: 570951 - DNA, 13 bp, D. melanogaster
acaatttttgcat

SEQ ID NO: 570952 - DNA, 13 bp, D. melanogaster
acaatttttgtgc

SEQ ID NO: 570953 - DNA, 14 bp, D. melanogaster
acaatttttgttta

SEQ ID NO: 570954 - DNA, 13 bp, D. melanogaster
acaattttttaag

SEQ ID NO: 570955 - DNA, 13 bp, D. melanogaster
acaattttttcca

SEQ ID NO: 570956 - DNA, 13 bp, D. melanogaster
acaattttttcgt

SEQ ID NO: 570957 - DNA, 14 bp, D. melanogaster
acaattttttcgta

SEQ ID NO: 570958 - DNA, 13 bp, D. melanogaster
acaattttttggc

SEQ ID NO: 570959 - DNA, 14 bp, D. melanogaster
acaattttttggcc

SEQ ID NO: 570960 - DNA, 13 bp, D. melanogaster
acaattttttgtt

SEQ ID NO: 570961 - DNA, 14 bp, D. melanogaster
acaattttttgttt

SEQ ID NO: 570962 - DNA, 13 bp, D. melanogaster
acaatttttttcg

SEQ ID NO: 570963 - DNA, 13 bp, D. melanogaster
acaatttttttgc

SEQ ID NO: 570964 - DNA, 13 bp, D. melanogaster
acacaaaaactgc

SEQ ID NO: 570965 - DNA, 13 bp, D. melanogaster
acacaaaaagtat

SEQ ID NO: 570966 - DNA, 13 bp, D. melanogaster
acacaaaaagttg

SEQ ID NO: 570967 - DNA, 13 bp, D. melanogaster
acacaaaaattgt

SEQ ID NO: 570968 - DNA, 13 bp, D. melanogaster
acacaaaacactt

SEQ ID NO: 570969 - DNA, 13 bp, D. melanogaster
acacaaaactgaa

SEQ ID NO: 570970 - DNA, 13 bp, D. melanogaster
acacaaaagtaat

SEQ ID NO: 570971 - DNA, 13 bp, D. melanogaster
acacaaaagtcaa

SEQ ID NO: 570972 - DNA, 13 bp, D. melanogaster
acacaaaagttaa

SEQ ID NO: 570973 - DNA, 13 bp, D. melanogaster
acacaaaatactc

SEQ ID NO: 570974 - DNA, 13 bp, D. melanogaster
acacaaaatattt

SEQ ID NO: 570975 - DNA, 13 bp, D. melanogaster
acacaaaattgtc

SEQ ID NO: 570976 - DNA, 13 bp, D. melanogaster
acacaaaatttat

SEQ ID NO: 570977 - DNA, 13 bp, D. melanogaster
acacaaacacatg

SEQ ID NO: 570978 - DNA, 14 bp, D. melanogaster
acacaaacacatgc

SEQ ID NO: 570979 - DNA, 13 bp, D. melanogaster
acacaaacacatt

SEQ ID NO: 570980 - DNA, 13 bp, D. melanogaster
acacaaacaggca

SEQ ID NO: 570981 - DNA, 13 bp, D. melanogaster
acacaaacgcact

SEQ ID NO: 570982 - DNA, 13 bp, D. melanogaster
acacaaacttcta

SEQ ID NO: 570983 - DNA, 13 bp, D. melanogaster
acacaaaggacac

SEQ ID NO: 570984 - DNA, 13 bp, D. melanogaster
acacaaagtgtaa

SEQ ID NO: 570985 - DNA, 13 bp, D. melanogaster
acacaaatacacg

SEQ ID NO: 570986 - DNA, 13 bp, D. melanogaster
acacaaatacaga

SEQ ID NO: 570987 - DNA, 14 bp, D. melanogaster
acacaaatatgttt

SEQ ID NO: 570988 - DNA, 13 bp, D. melanogaster
acacaaatcaaag

SEQ ID NO: 570989 - DNA, 13 bp, D. melanogaster
acacaaatcaatt

SEQ ID NO: 570990 - DNA, 13 bp, D. melanogaster
acacaaattaatt

SEQ ID NO: 570991 - DNA, 13 bp, D. melanogaster
acacaaattatta

SEQ ID NO: 570992 - DNA, 13 bp, D. melanogaster
acacaaattgttg

SEQ ID NO: 570993 - DNA, 13 bp, D. melanogaster
acacaacaaactt

SEQ ID NO: 570994 - DNA, 13 bp, D. melanogaster
acacaacaaattg

SEQ ID NO: 570995 - DNA, 13 bp, D. melanogaster
acacaactgaaaa

SEQ ID NO: 570996 - DNA, 13 bp, D. melanogaster
acacaacttaaat

SEQ ID NO: 570997 - DNA, 13 bp, D. melanogaster
acacaacttgttg

SEQ ID NO: 570998 - DNA, 13 bp, D. melanogaster
acacaagaactca

SEQ ID NO: 570999 - DNA, 13 bp, D. melanogaster
acacaagatcaca

SEQ ID NO: 571000 - DNA, 13 bp, D. melanogaster
acacaagcaagca

SEQ ID NO: 571001 - DNA, 14 bp, D. melanogaster
acacaagcacacat

SEQ ID NO: 571002 - DNA, 13 bp, D. melanogaster
acacaagctgtaa

SEQ ID NO: 571003 - DNA, 14 bp, D. melanogaster
acacaagtcgagat

SEQ ID NO: 571004 - DNA, 13 bp, D. melanogaster
acacaagttggta

SEQ ID NO: 571005 - DNA, 13 bp, D. melanogaster
acacaatgaaaac

SEQ ID NO: 571006 - DNA, 13 bp, D. melanogaster
acacaatgccaca

SEQ ID NO: 571007 - DNA, 13 bp, D. melanogaster
acacaatggaaaa

SEQ ID NO: 571008 - DNA, 13 bp, D. melanogaster
acacaattaatta

SEQ ID NO: 571009 - DNA, 13 bp, D. melanogaster
acacaattcaaat

SEQ ID NO: 571010 - DNA, 13 bp, D. melanogaster
acacaattgaagt

SEQ ID NO: 571011 - DNA, 14 bp, D. melanogaster
acacaattgaagta

SEQ ID NO: 571012 - DNA, 13 bp, D. melanogaster
acacaattgataa

SEQ ID NO: 571013 - DNA, 13 bp, D. melanogaster
acacaatttcaat

SEQ ID NO: 571014 - DNA, 13 bp, D. melanogaster
acacaatttgtat

SEQ ID NO: 571015 - DNA, 13 bp, D. melanogaster
acacaattttcaa

SEQ ID NO: 571016 - DNA, 13 bp, D. melanogaster
acacaattttttc

SEQ ID NO: 571017 - DNA, 13 bp, D. melanogaster
acacacaaaaatg

SEQ ID NO: 571018 - DNA, 13 bp, D. melanogaster
acacacaaaattt

SEQ ID NO: 571019 - DNA, 13 bp, D. melanogaster
acacacaaacatg

SEQ ID NO: 571020 - DNA, 13 bp, D. melanogaster
acacacaaataga

SEQ ID NO: 571021 - DNA, 13 bp, D. melanogaster
acacacaaatgtg

SEQ ID NO: 571022 - DNA, 13 bp, D. melanogaster
acacacaaattta

SEQ ID NO: 571023 - DNA, 14 bp, D. melanogaster
acacacaagcgcac

SEQ ID NO: 571024 - DNA, 13 bp, D. melanogaster
acacacaagtaca

SEQ ID NO: 571025 - DNA, 13 bp, D. melanogaster
acacacaatcata

SEQ ID NO: 571026 - DNA, 13 bp, D. melanogaster
acacacaatggcc

SEQ ID NO: 571027 - DNA, 14 bp, D. melanogaster
acacacacaaaatg

SEQ ID NO: 571028 - DNA, 13 bp, D. melanogaster
acacacacaaatg

SEQ ID NO: 571029 - DNA, 14 bp, D. melanogaster
acacacacaaatgc

SEQ ID NO: 571030 - DNA, 13 bp, D. melanogaster
acacacacaaatt

SEQ ID NO: 571031 - DNA, 13 bp, D. melanogaster
acacacacaagcg

SEQ ID NO: 571032 - DNA, 14 bp, D. melanogaster
acacacacaagcgc

SEQ ID NO: 571033 - DNA, 13 bp, D. melanogaster
acacacacaagct

SEQ ID NO: 571034 - DNA, 13 bp, D. melanogaster
acacacacaagtg

SEQ ID NO: 571035 - DNA, 13 bp, D. melanogaster
acacacacaatgg

SEQ ID NO: 571036 - DNA, 14 bp, D. melanogaster
acacacacacaagt

SEQ ID NO: 571037 - DNA, 14 bp, D. melanogaster
acacacacacagag

SEQ ID NO: 571038 - DNA, 13 bp, D. melanogaster
acacacacacagg

SEQ ID NO: 571039 - DNA, 16 bp, D. melanogaster
acacacacacaggcac

SEQ ID NO: 571040 - DNA, 13 bp, D. melanogaster
acacacacacagt

SEQ ID NO: 571041 - DNA, 14 bp, D. melanogaster
acacacacacagtg

SEQ ID NO: 571042 - DNA, 14 bp, D. melanogaster
acacacacacatag

SEQ ID NO: 571043 - DNA, 14 bp, D. melanogaster
acacacacacatct

SEQ ID NO: 571044 - DNA, 13 bp, D. melanogaster
acacacacacgag

SEQ ID NO: 571045 - DNA, 14 bp, D. melanogaster
acacacacacgcag

SEQ ID NO: 571046 - DNA, 14 bp, D. melanogaster
acacacacacgcat

SEQ ID NO: 571047 - DNA, 14 bp, D. melanogaster
acacacacacgcga

SEQ ID NO: 571048 - DNA, 14 bp, D. melanogaster
acacacacacgcgg

SEQ ID NO: 571049 - DNA, 14 bp, D. melanogaster
acacacacacgcgt

SEQ ID NO: 571050 - DNA, 13 bp, D. melanogaster
acacacacacgga

SEQ ID NO: 571051 - DNA, 14 bp, D. melanogaster
acacacacacggag

SEQ ID NO: 571052 - DNA, 13 bp, D. melanogaster
acacacacacggc

SEQ ID NO: 571053 - DNA, 14 bp, D. melanogaster
acacacacacggca

SEQ ID NO: 571054 - DNA, 14 bp, D. melanogaster
acacacacactaat

SEQ ID NO: 571055 - DNA, 13 bp, D. melanogaster
acacacacactat

SEQ ID NO: 571056 - DNA, 14 bp, D. melanogaster
acacacacactcag

SEQ ID NO: 571057 - DNA, 13 bp, D. melanogaster
acacacacactcg

SEQ ID NO: 571058 - DNA, 14 bp, D. melanogaster
acacacacactcgt

SEQ ID NO: 571059 - DNA, 13 bp, D. melanogaster
acacacacactct

SEQ ID NO: 571060 - DNA, 14 bp, D. melanogaster
acacacacactctc

SEQ ID NO: 571061 - DNA, 13 bp, D. melanogaster
acacacacacttg

SEQ ID NO: 571062 - DNA, 14 bp, D. melanogaster
acacacacacttgt

SEQ ID NO: 571063 - DNA, 13 bp, D. melanogaster
acacacacagaag

SEQ ID NO: 571064 - DNA, 13 bp, D. melanogaster
acacacacagacg

SEQ ID NO: 571065 - DNA, 13 bp, D. melanogaster
acacacacagagc

SEQ ID NO: 571066 - DNA, 13 bp, D. melanogaster
acacacacagagg

SEQ ID NO: 571067 - DNA, 14 bp, D. melanogaster
acacacacagatac

SEQ ID NO: 571068 - DNA, 13 bp, D. melanogaster
acacacacagatg

SEQ ID NO: 571069 - DNA, 14 bp, D. melanogaster
acacacacagcagc

SEQ ID NO: 571070 - DNA, 14 bp, D. melanogaster
acacacacagccat

SEQ ID NO: 571071 - DNA, 14 bp, D. melanogaster
acacacacagcgaa

SEQ ID NO: 571072 - DNA, 13 bp, D. melanogaster
acacacacagctc

SEQ ID NO: 571073 - DNA, 13 bp, D. melanogaster
acacacacaggac

SEQ ID NO: 571074 - DNA, 14 bp, D. melanogaster
acacacacaggcac

SEQ ID NO: 571075 - DNA, 13 bp, D. melanogaster
acacacacagtgc

SEQ ID NO: 571076 - DNA, 13 bp, D. melanogaster
acacacacagtgg

SEQ ID NO: 571077 - DNA, 13 bp, D. melanogaster
acacacacataag

SEQ ID NO: 571078 - DNA, 14 bp, D. melanogaster
acacacacatacag

SEQ ID NO: 571079 - DNA, 14 bp, D. melanogaster
acacacacatacgc

SEQ ID NO: 571080 - DNA, 13 bp, D. melanogaster
acacacacatact

SEQ ID NO: 571081 - DNA, 14 bp, D. melanogaster
acacacacatactc

SEQ ID NO: 571082 - DNA, 13 bp, D. melanogaster
acacacacataga

SEQ ID NO: 571083 - DNA, 14 bp, D. melanogaster
acacacacatagac

SEQ ID NO: 571084 - DNA, 13 bp, D. melanogaster
acacacacatatc

SEQ ID NO: 571085 - DNA, 13 bp, D. melanogaster
acacacacatatg

SEQ ID NO: 571086 - DNA, 14 bp, D. melanogaster
acacacacatatgg

SEQ ID NO: 571087 - DNA, 13 bp, D. melanogaster
acacacacatcga

SEQ ID NO: 571088 - DNA, 13 bp, D. melanogaster
acacacacatcgc

SEQ ID NO: 571089 - DNA, 13 bp, D. melanogaster
acacacacatcta

SEQ ID NO: 571090 - DNA, 13 bp, D. melanogaster
acacacacatctg

SEQ ID NO: 571091 - DNA, 13 bp, D. melanogaster
acacacacatgca

SEQ ID NO: 571092 - DNA, 14 bp, D. melanogaster
acacacacatgcat

SEQ ID NO: 571093 - DNA, 13 bp, D. melanogaster
acacacacatgcc

SEQ ID NO: 571094 - DNA, 13 bp, D. melanogaster
acacacacatgcg

SEQ ID NO: 571095 - DNA, 14 bp, D. melanogaster
acacacacatgcgc

SEQ ID NO: 571096 - DNA, 13 bp, D. melanogaster
acacacacatgct

SEQ ID NO: 571097 - DNA, 13 bp, D. melanogaster
acacacacatgga

SEQ ID NO: 571098 - DNA, 13 bp, D. melanogaster
acacacacatggg

SEQ ID NO: 571099 - DNA, 13 bp, D. melanogaster
acacacacatgtc

SEQ ID NO: 571100 - DNA, 13 bp, D. melanogaster
acacacacatgtg

SEQ ID NO: 571101 - DNA, 14 bp, D. melanogaster
acacacacatgtgc

SEQ ID NO: 571102 - DNA, 14 bp, D. melanogaster
acacacacatgtgg

SEQ ID NO: 571103 - DNA, 14 bp, D. melanogaster
acacacacatgtgt

SEQ ID NO: 571104 - DNA, 13 bp, D. melanogaster
acacacacattaa

SEQ ID NO: 571105 - DNA, 13 bp, D. melanogaster
acacacacattat

SEQ ID NO: 571106 - DNA, 13 bp, D. melanogaster
acacacacattca

SEQ ID NO: 571107 - DNA, 14 bp, D. melanogaster
acacacacattcac

SEQ ID NO: 571108 - DNA, 13 bp, D. melanogaster
acacacacattct

SEQ ID NO: 571109 - DNA, 13 bp, D. melanogaster
acacacacattgg

SEQ ID NO: 571110 - DNA, 13 bp, D. melanogaster
acacacacattta

SEQ ID NO: 571111 - DNA, 14 bp, D. melanogaster
acacacacatttac

SEQ ID NO: 571112 - DNA, 14 bp, D. melanogaster
acacacacatttat

SEQ ID NO: 571113 - DNA, 13 bp, D. melanogaster
acacacacatttc

SEQ ID NO: 571114 - DNA, 13 bp, D. melanogaster
acacacacatttg

SEQ ID NO: 571115 - DNA, 13 bp, D. melanogaster
acacacacatttt

SEQ ID NO: 571116 - DNA, 13 bp, D. melanogaster
acacacaccagcg

SEQ ID NO: 571117 - DNA, 13 bp, D. melanogaster
acacacacgaaat

SEQ ID NO: 571118 - DNA, 13 bp, D. melanogaster
acacacacgagca

SEQ ID NO: 571119 - DNA, 14 bp, D. melanogaster
acacacacgcacag

SEQ ID NO: 571120 - DNA, 14 bp, D. melanogaster
acacacacgcacat

SEQ ID NO: 571121 - DNA, 13 bp, D. melanogaster
acacacacgcact

SEQ ID NO: 571122 - DNA, 13 bp, D. melanogaster
acacacacgcaga

SEQ ID NO: 571123 - DNA, 14 bp, D. melanogaster
acacacacgcagac

SEQ ID NO: 571124 - DNA, 13 bp, D. melanogaster
acacacacgcagc

SEQ ID NO: 571125 - DNA, 13 bp, D. melanogaster
acacacacgcagg

SEQ ID NO: 571126 - DNA, 14 bp, D. melanogaster
acacacacgcaggc

SEQ ID NO: 571127 - DNA, 13 bp, D. melanogaster
acacacacgcgcc

SEQ ID NO: 571128 - DNA, 15 bp, D. melanogaster
acacacacgcgcgcg

SEQ ID NO: 571129 - DNA, 13 bp, D. melanogaster
acacacacgctcg

SEQ ID NO: 571130 - DNA, 13 bp, D. melanogaster
acacacacgctta

SEQ ID NO: 571131 - DNA, 13 bp, D. melanogaster
acacacacggaaa

SEQ ID NO: 571132 - DNA, 13 bp, D. melanogaster
acacacacgggca

SEQ ID NO: 571133 - DNA, 13 bp, D. melanogaster
acacacacgtaca

SEQ ID NO: 571134 - DNA, 13 bp, D. melanogaster
acacacacgtacg

SEQ ID NO: 571135 - DNA, 13 bp, D. melanogaster
acacacacgtgca

SEQ ID NO: 571136 - DNA, 16 bp, D. melanogaster
acacacactcacgcac

SEQ ID NO: 571137 - DNA, 13 bp, D. melanogaster
acacacactcact

SEQ ID NO: 571138 - DNA, 14 bp, D. melanogaster
acacacactcactt

SEQ ID NO: 571139 - DNA, 13 bp, D. melanogaster
acacacactcgaa

SEQ ID NO: 571140 - DNA, 13 bp, D. melanogaster
acacacactcgag

SEQ ID NO: 571141 - DNA, 14 bp, D. melanogaster
acacacactcgcag

SEQ ID NO: 571142 - DNA, 13 bp, D. melanogaster
acacacactcgct

SEQ ID NO: 571143 - DNA, 13 bp, D. melanogaster
acacacactctaa

SEQ ID NO: 571144 - DNA, 14 bp, D. melanogaster
acacacactctctc

SEQ ID NO: 571145 - DNA, 13 bp, D. melanogaster
acacacactctta

SEQ ID NO: 571146 - DNA, 13 bp, D. melanogaster
acacacactggcg

SEQ ID NO: 571147 - DNA, 13 bp, D. melanogaster
acacacacttact

SEQ ID NO: 571148 - DNA, 14 bp, D. melanogaster
acacacacttgcac

SEQ ID NO: 571149 - DNA, 13 bp, D. melanogaster
acacacactttca

SEQ ID NO: 571150 - DNA, 13 bp, D. melanogaster
acacacactttgc

SEQ ID NO: 571151 - DNA, 13 bp, D. melanogaster
acacacacttttc

SEQ ID NO: 571152 - DNA, 13 bp, D. melanogaster
acacacagacagg

SEQ ID NO: 571153 - DNA, 13 bp, D. melanogaster
acacacagacatt

SEQ ID NO: 571154 - DNA, 13 bp, D. melanogaster
acacacagacgca

SEQ ID NO: 571155 - DNA, 13 bp, D. melanogaster
acacacagagcga

SEQ ID NO: 571156 - DNA, 13 bp, D. melanogaster
acacacagataaa

SEQ ID NO: 571157 - DNA, 13 bp, D. melanogaster
acacacagatata

SEQ ID NO: 571158 - DNA, 13 bp, D. melanogaster
acacacagatgca

SEQ ID NO: 571159 - DNA, 13 bp, D. melanogaster
acacacagcacag

SEQ ID NO: 571160 - DNA, 13 bp, D. melanogaster
acacacagccagc

SEQ ID NO: 571161 - DNA, 13 bp, D. melanogaster
acacacagcgaca

SEQ ID NO: 571162 - DNA, 13 bp, D. melanogaster
acacacagctgca

SEQ ID NO: 571163 - DNA, 13 bp, D. melanogaster
acacacaggcgca

SEQ ID NO: 571164 - DNA, 13 bp, D. melanogaster
acacacataaagc

SEQ ID NO: 571165 - DNA, 14 bp, D. melanogaster
acacacatacaaag

SEQ ID NO: 571166 - DNA, 13 bp, D. melanogaster
acacacatacaat

SEQ ID NO: 571167 - DNA, 13 bp, D. melanogaster
acacacatacacg

SEQ ID NO: 571168 - DNA, 14 bp, D. melanogaster
acacacatacacgc

SEQ ID NO: 571169 - DNA, 14 bp, D. melanogaster
acacacatacacgt

SEQ ID NO: 571170 - DNA, 13 bp, D. melanogaster
acacacatacact

SEQ ID NO: 571171 - DNA, 13 bp, D. melanogaster
acacacatacaga

SEQ ID NO: 571172 - DNA, 14 bp, D. melanogaster
acacacatacagac

SEQ ID NO: 571173 - DNA, 13 bp, D. melanogaster
acacacatacata

SEQ ID NO: 571174 - DNA, 13 bp, D. melanogaster
acacacatacatg

SEQ ID NO: 571175 - DNA, 13 bp, D. melanogaster
acacacatactca

SEQ ID NO: 571176 - DNA, 13 bp, D. melanogaster
acacacatactcg

SEQ ID NO: 571177 - DNA, 14 bp, D. melanogaster
acacacatatacac

SEQ ID NO: 571178 - DNA, 13 bp, D. melanogaster
acacacatatatg

SEQ ID NO: 571179 - DNA, 13 bp, D. melanogaster
acacacatatgaa

SEQ ID NO: 571180 - DNA, 14 bp, D. melanogaster
acacacatatgcat

SEQ ID NO: 571181 - DNA, 14 bp, D. melanogaster
acacacatatgtat

SEQ ID NO: 571182 - DNA, 13 bp, D. melanogaster
acacacatccata

SEQ ID NO: 571183 - DNA, 14 bp, D. melanogaster
acacacatccatac

SEQ ID NO: 571184 - DNA, 13 bp, D. melanogaster
acacacatgaaaa

SEQ ID NO: 571185 - DNA, 13 bp, D. melanogaster
acacacatgccca

SEQ ID NO: 571186 - DNA, 13 bp, D. melanogaster
acacacatgcgca

SEQ ID NO: 571187 - DNA, 13 bp, D. melanogaster
acacacatgtcct

SEQ ID NO: 571188 - DNA, 13 bp, D. melanogaster
acacacatgtgcg

SEQ ID NO: 571189 - DNA, 13 bp, D. melanogaster
acacacatgtggg

SEQ ID NO: 571190 - DNA, 13 bp, D. melanogaster
acacacatgtgta

SEQ ID NO: 571191 - DNA, 13 bp, D. melanogaster
acacacatgtgtg

SEQ ID NO: 571192 - DNA, 13 bp, D. melanogaster
acacacattcata

SEQ ID NO: 571193 - DNA, 14 bp, D. melanogaster
acacacattcgcat

SEQ ID NO: 571194 - DNA, 13 bp, D. melanogaster
acacacattcgct

SEQ ID NO: 571195 - DNA, 13 bp, D. melanogaster
acacacatttata

SEQ ID NO: 571196 - DNA, 13 bp, D. melanogaster
acacacatttatt

SEQ ID NO: 571197 - DNA, 14 bp, D. melanogaster
acacacatttattt

SEQ ID NO: 571198 - DNA, 13 bp, D. melanogaster
acacacattttgt

SEQ ID NO: 571199 - DNA, 13 bp, D. melanogaster
acacacatttttg

SEQ ID NO: 571200 - DNA, 13 bp, D. melanogaster
acacacctaagaa

SEQ ID NO: 571201 - DNA, 14 bp, D. melanogaster
acacacctaagaaa

SEQ ID NO: 571202 - DNA, 13 bp, D. melanogaster
acacacgagcaca

SEQ ID NO: 571203 - DNA, 14 bp, D. melanogaster
acacacgcacacag

SEQ ID NO: 571204 - DNA, 14 bp, D. melanogaster
acacacgcacacat

SEQ ID NO: 571205 - DNA, 13 bp, D. melanogaster
acacacgcacacg

SEQ ID NO: 571206 - DNA, 14 bp, D. melanogaster
acacacgcacacgc

SEQ ID NO: 571207 - DNA, 14 bp, D. melanogaster
acacacgcacacgt

SEQ ID NO: 571208 - DNA, 13 bp, D. melanogaster
acacacgcacact

SEQ ID NO: 571209 - DNA, 14 bp, D. melanogaster
acacacgcacactc

SEQ ID NO: 571210 - DNA, 14 bp, D. melanogaster
acacacgcacactt

SEQ ID NO: 571211 - DNA, 13 bp, D. melanogaster
acacacgcacagg

SEQ ID NO: 571212 - DNA, 13 bp, D. melanogaster
acacacgcacatt

SEQ ID NO: 571213 - DNA, 13 bp, D. melanogaster
acacacgcacgca

SEQ ID NO: 571214 - DNA, 14 bp, D. melanogaster
acacacgcacgcaa

SEQ ID NO: 571215 - DNA, 14 bp, D. melanogaster
acacacgcacgcac

SEQ ID NO: 571216 - DNA, 15 bp, D. melanogaster
acacacgcacgcaca

SEQ ID NO: 571217 - DNA, 14 bp, D. melanogaster
acacacgcacgcat

SEQ ID NO: 571218 - DNA, 14 bp, D. melanogaster
acacacgcagacac

SEQ ID NO: 571219 - DNA, 13 bp, D. melanogaster
acacacgcataca

SEQ ID NO: 571220 - DNA, 14 bp, D. melanogaster
acacacgcatacac

SEQ ID NO: 571221 - DNA, 13 bp, D. melanogaster
acacacgcatacg

SEQ ID NO: 571222 - DNA, 13 bp, D. melanogaster
acacacgcgcaca

SEQ ID NO: 571223 - DNA, 14 bp, D. melanogaster
acacacgcgcacac

SEQ ID NO: 571224 - DNA, 13 bp, D. melanogaster
acacacgcgcgca

SEQ ID NO: 571225 - DNA, 13 bp, D. melanogaster
acacacggacaca

SEQ ID NO: 571226 - DNA, 14 bp, D. melanogaster
acacacggacacac

SEQ ID NO: 571227 - DNA, 13 bp, D. melanogaster
acacacgggcaca

SEQ ID NO: 571228 - DNA, 13 bp, D. melanogaster
acacactacacat

SEQ ID NO: 571229 - DNA, 13 bp, D. melanogaster
acacactatatat

SEQ ID NO: 571230 - DNA, 13 bp, D. melanogaster
acacactcacacg

SEQ ID NO: 571231 - DNA, 13 bp, D. melanogaster
acacactcacact

SEQ ID NO: 571232 - DNA, 14 bp, D. melanogaster
acacactcacactt

SEQ ID NO: 571233 - DNA, 13 bp, D. melanogaster
acacactcacgca

SEQ ID NO: 571234 - DNA, 14 bp, D. melanogaster
acacactcactcac

SEQ ID NO: 571235 - DNA, 13 bp, D. melanogaster
acacactcactta

SEQ ID NO: 571236 - DNA, 13 bp, D. melanogaster
acacactcgcaaa

SEQ ID NO: 571237 - DNA, 13 bp, D. melanogaster
acacactcgctca

SEQ ID NO: 571238 - DNA, 13 bp, D. melanogaster
acacactcgtaca

SEQ ID NO: 571239 - DNA, 13 bp, D. melanogaster
acacactctctct

SEQ ID NO: 571240 - DNA, 13 bp, D. melanogaster
acacactcttgct

SEQ ID NO: 571241 - DNA, 13 bp, D. melanogaster
acacactgccaca

SEQ ID NO: 571242 - DNA, 13 bp, D. melanogaster
acacactggaaaa

SEQ ID NO: 571243 - DNA, 13 bp, D. melanogaster
acacactggcaca

SEQ ID NO: 571244 - DNA, 13 bp, D. melanogaster
acacacttaaaca

SEQ ID NO: 571245 - DNA, 13 bp, D. melanogaster
acacacttacaca

SEQ ID NO: 571246 - DNA, 13 bp, D. melanogaster
acacacttacgca

SEQ ID NO: 571247 - DNA, 13 bp, D. melanogaster
acacacttataca

SEQ ID NO: 571248 - DNA, 13 bp, D. melanogaster
acacacttgaaaa

SEQ ID NO: 571249 - DNA, 13 bp, D. melanogaster
acacacttgcaaa

SEQ ID NO: 571250 - DNA, 13 bp, D. melanogaster
acacacttttgag

SEQ ID NO: 571251 - DNA, 13 bp, D. melanogaster
acacagaaaatat

SEQ ID NO: 571252 - DNA, 14 bp, D. melanogaster
acacagaaagaaat

SEQ ID NO: 571253 - DNA, 13 bp, D. melanogaster
acacagaaataca

SEQ ID NO: 571254 - DNA, 13 bp, D. melanogaster
acacagaacacag

SEQ ID NO: 571255 - DNA, 13 bp, D. melanogaster
acacagaagcaca

SEQ ID NO: 571256 - DNA, 13 bp, D. melanogaster
acacagacacaag

SEQ ID NO: 571257 - DNA, 13 bp, D. melanogaster
acacagacacaga

SEQ ID NO: 571258 - DNA, 13 bp, D. melanogaster
acacagacagaca

SEQ ID NO: 571259 - DNA, 13 bp, D. melanogaster
acacagacgcacg

SEQ ID NO: 571260 - DNA, 13 bp, D. melanogaster
acacagagagaga

SEQ ID NO: 571261 - DNA, 13 bp, D. melanogaster
acacagagataca

SEQ ID NO: 571262 - DNA, 13 bp, D. melanogaster
acacagagcgaaa

SEQ ID NO: 571263 - DNA, 13 bp, D. melanogaster
acacagaggcaca

SEQ ID NO: 571264 - DNA, 13 bp, D. melanogaster
acacagatacaaa

SEQ ID NO: 571265 - DNA, 14 bp, D. melanogaster
acacagatacaaat

SEQ ID NO: 571266 - DNA, 13 bp, D. melanogaster
acacagatacacc

SEQ ID NO: 571267 - DNA, 13 bp, D. melanogaster
acacagatacaga

SEQ ID NO: 571268 - DNA, 14 bp, D. melanogaster
acacagatacagat

SEQ ID NO: 571269 - DNA, 13 bp, D. melanogaster
acacagatacgca

SEQ ID NO: 571270 - DNA, 14 bp, D. melanogaster
acacagatacgcac

SEQ ID NO: 571271 - DNA, 13 bp, D. melanogaster
acacagatacgcg

SEQ ID NO: 571272 - DNA, 13 bp, D. melanogaster
acacagatactcg

SEQ ID NO: 571273 - DNA, 13 bp, D. melanogaster
acacagatacttt

SEQ ID NO: 571274 - DNA, 13 bp, D. melanogaster
acacagatataca

SEQ ID NO: 571275 - DNA, 13 bp, D. melanogaster
acacagatatata

SEQ ID NO: 571276 - DNA, 13 bp, D. melanogaster
acacagcaacact

SEQ ID NO: 571277 - DNA, 13 bp, D. melanogaster
acacagcatttgt

SEQ ID NO: 571278 - DNA, 13 bp, D. melanogaster
acacagcgagaaa

SEQ ID NO: 571279 - DNA, 14 bp, D. melanogaster
acacagcgagaaat

SEQ ID NO: 571280 - DNA, 13 bp, D. melanogaster
acacagctgcaaa

SEQ ID NO: 571281 - DNA, 13 bp, D. melanogaster
acacagctttaag

SEQ ID NO: 571282 - DNA, 13 bp, D. melanogaster
acacaggcaacta

SEQ ID NO: 571283 - DNA, 13 bp, D. melanogaster
acacaggcacaca

SEQ ID NO: 571284 - DNA, 13 bp, D. melanogaster
acacaggcacaga

SEQ ID NO: 571285 - DNA, 13 bp, D. melanogaster
acacagggagaaa

SEQ ID NO: 571286 - DNA, 13 bp, D. melanogaster
acacagtataaat

SEQ ID NO: 571287 - DNA, 13 bp, D. melanogaster
acacagtgagaaa

SEQ ID NO: 571288 - DNA, 13 bp, D. melanogaster
acacagtgcctaa

SEQ ID NO: 571289 - DNA, 13 bp, D. melanogaster
acacataaaacga

SEQ ID NO: 571290 - DNA, 13 bp, D. melanogaster
acacataaatatt

SEQ ID NO: 571291 - DNA, 13 bp, D. melanogaster
acacataaattgc

SEQ ID NO: 571292 - DNA, 13 bp, D. melanogaster
acacataacacat

SEQ ID NO: 571293 - DNA, 13 bp, D. melanogaster
acacataagcaca

SEQ ID NO: 571294 - DNA, 13 bp, D. melanogaster
acacatacacaag

SEQ ID NO: 571295 - DNA, 14 bp, D. melanogaster
acacatacacaagc

SEQ ID NO: 571296 - DNA, 14 bp, D. melanogaster
acacatacacacag

SEQ ID NO: 571297 - DNA, 14 bp, D. melanogaster
acacatacacacat

SEQ ID NO: 571298 - DNA, 13 bp, D. melanogaster
acacatacacact

SEQ ID NO: 571299 - DNA, 13 bp, D. melanogaster
acacatacacagc

SEQ ID NO: 571300 - DNA, 13 bp, D. melanogaster
acacatacacagg

SEQ ID NO: 571301 - DNA, 14 bp, D. melanogaster
acacatacacatat

SEQ ID NO: 571302 - DNA, 13 bp, D. melanogaster
acacatacacatg

SEQ ID NO: 571303 - DNA, 13 bp, D. melanogaster
acacatacacatt

SEQ ID NO: 571304 - DNA, 13 bp, D. melanogaster
acacatacactcg

SEQ ID NO: 571305 - DNA, 14 bp, D. melanogaster
acacatacactcgc

SEQ ID NO: 571306 - DNA, 13 bp, D. melanogaster
acacatacacttg

SEQ ID NO: 571307 - DNA, 13 bp, D. melanogaster
acacatacataca

SEQ ID NO: 571308 - DNA, 14 bp, D. melanogaster
acacatacatacgt

SEQ ID NO: 571309 - DNA, 13 bp, D. melanogaster
acacatacatact

SEQ ID NO: 571310 - DNA, 14 bp, D. melanogaster
acacatacatatac

SEQ ID NO: 571311 - DNA, 14 bp, D. melanogaster
acacatacatatat

SEQ ID NO: 571312 - DNA, 13 bp, D. melanogaster
acacatacatatt

SEQ ID NO: 571313 - DNA, 14 bp, D. melanogaster
acacatacatattt

SEQ ID NO: 571314 - DNA, 13 bp, D. melanogaster
acacatacgaaaa

SEQ ID NO: 571315 - DNA, 14 bp, D. melanogaster
acacatacgccatg

SEQ ID NO: 571316 - DNA, 13 bp, D. melanogaster
acacatactcgca

SEQ ID NO: 571317 - DNA, 13 bp, D. melanogaster
acacatatacaat

SEQ ID NO: 571318 - DNA, 13 bp, D. melanogaster
acacatatacaca

SEQ ID NO: 571319 - DNA, 14 bp, D. melanogaster
acacatatacacac

SEQ ID NO: 571320 - DNA, 14 bp, D. melanogaster
acacatatacacat

SEQ ID NO: 571321 - DNA, 13 bp, D. melanogaster
acacatatacaga

SEQ ID NO: 571322 - DNA, 13 bp, D. melanogaster
acacatatataca

SEQ ID NO: 571323 - DNA, 14 bp, D. melanogaster
acacatatatatgt

SEQ ID NO: 571324 - DNA, 14 bp, D. melanogaster
acacatatatgtat

SEQ ID NO: 571325 - DNA, 13 bp, D. melanogaster
acacatatatgtg

SEQ ID NO: 571326 - DNA, 13 bp, D. melanogaster
acacatatattat

SEQ ID NO: 571327 - DNA, 13 bp, D. melanogaster
acacatatatttg

SEQ ID NO: 571328 - DNA, 13 bp, D. melanogaster
acacatatgcaaa

SEQ ID NO: 571329 - DNA, 14 bp, D. melanogaster
acacatatgtatat

SEQ ID NO: 571330 - DNA, 13 bp, D. melanogaster
acacatatgtgta

SEQ ID NO: 571331 - DNA, 13 bp, D. melanogaster
acacatatttata

SEQ ID NO: 571332 - DNA, 13 bp, D. melanogaster
acacatatttatt

SEQ ID NO: 571333 - DNA, 13 bp, D. melanogaster
acacatatttgtg

SEQ ID NO: 571334 - DNA, 13 bp, D. melanogaster
acacatattttat

SEQ ID NO: 571335 - DNA, 13 bp, D. melanogaster
acacatattttct

SEQ ID NO: 571336 - DNA, 13 bp, D. melanogaster
acacatatttttt

SEQ ID NO: 571337 - DNA, 13 bp, D. melanogaster
acacatcaatttg

SEQ ID NO: 571338 - DNA, 14 bp, D. melanogaster
acacatcatatctt

SEQ ID NO: 571339 - DNA, 13 bp, D. melanogaster
acacatcatcatc

SEQ ID NO: 571340 - DNA, 13 bp, D. melanogaster
acacatccacatc

SEQ ID NO: 571341 - DNA, 14 bp, D. melanogaster
acacatccacatcc

SEQ ID NO: 571342 - DNA, 13 bp, D. melanogaster
acacatcgatcat

SEQ ID NO: 571343 - DNA, 13 bp, D. melanogaster
acacatgaaaata

SEQ ID NO: 571344 - DNA, 13 bp, D. melanogaster
acacatgcaaatg

SEQ ID NO: 571345 - DNA, 13 bp, D. melanogaster
acacatgcaaatt

SEQ ID NO: 571346 - DNA, 13 bp, D. melanogaster
acacatgcacaac

SEQ ID NO: 571347 - DNA, 13 bp, D. melanogaster
acacatgcacacg

SEQ ID NO: 571348 - DNA, 14 bp, D. melanogaster
acacatgcacacgc

SEQ ID NO: 571349 - DNA, 13 bp, D. melanogaster
acacatgcacagc

SEQ ID NO: 571350 - DNA, 13 bp, D. melanogaster
acacatgcacgca

SEQ ID NO: 571351 - DNA, 13 bp, D. melanogaster
acacatgcataca

SEQ ID NO: 571352 - DNA, 13 bp, D. melanogaster
acacatgcatgtg

SEQ ID NO: 571353 - DNA, 15 bp, D. melanogaster
acacatgggtgtttc

SEQ ID NO: 571354 - DNA, 13 bp, D. melanogaster
acacatgtccaaa

SEQ ID NO: 571355 - DNA, 13 bp, D. melanogaster
acacatgtcgtat

SEQ ID NO: 571356 - DNA, 13 bp, D. melanogaster
acacatgtgtaca

SEQ ID NO: 571357 - DNA, 13 bp, D. melanogaster
acacattatactc

SEQ ID NO: 571358 - DNA, 14 bp, D. melanogaster
acacattatactca

SEQ ID NO: 571359 - DNA, 13 bp, D. melanogaster
acacattcagatt

SEQ ID NO: 571360 - DNA, 13 bp, D. melanogaster
acacattcattca

SEQ ID NO: 571361 - DNA, 13 bp, D. melanogaster
acacattcatttt

SEQ ID NO: 571362 - DNA, 14 bp, D. melanogaster
acacattcattttc

SEQ ID NO: 571363 - DNA, 13 bp, D. melanogaster
acacattcgcaca

SEQ ID NO: 571364 - DNA, 13 bp, D. melanogaster
acacattctattt

SEQ ID NO: 571365 - DNA, 13 bp, D. melanogaster
acacatttaaaca

SEQ ID NO: 571366 - DNA, 13 bp, D. melanogaster
acacatttaaatt

SEQ ID NO: 571367 - DNA, 13 bp, D. melanogaster
acacatttaatgc

SEQ ID NO: 571368 - DNA, 13 bp, D. melanogaster
acacatttacaca

SEQ ID NO: 571369 - DNA, 14 bp, D. melanogaster
acacatttatattt

SEQ ID NO: 571370 - DNA, 13 bp, D. melanogaster
acacatttattta

SEQ ID NO: 571371 - DNA, 13 bp, D. melanogaster
acacatttatttt

SEQ ID NO: 571372 - DNA, 13 bp, D. melanogaster
acacatttcaaat

SEQ ID NO: 571373 - DNA, 13 bp, D. melanogaster
acacatttcaatt

SEQ ID NO: 571374 - DNA, 13 bp, D. melanogaster
acacatttcattt

SEQ ID NO: 571375 - DNA, 13 bp, D. melanogaster
acacatttccaat

SEQ ID NO: 571376 - DNA, 13 bp, D. melanogaster
acacatttcccaa

SEQ ID NO: 571377 - DNA, 13 bp, D. melanogaster
acacatttcgaaa

SEQ ID NO: 571378 - DNA, 13 bp, D. melanogaster
acacatttctttt

SEQ ID NO: 571379 - DNA, 13 bp, D. melanogaster
acacatttgaaaa

SEQ ID NO: 571380 - DNA, 13 bp, D. melanogaster
acacatttgttta

SEQ ID NO: 571381 - DNA, 13 bp, D. melanogaster
acacatttgtttg

SEQ ID NO: 571382 - DNA, 14 bp, D. melanogaster
acacattttaatta

SEQ ID NO: 571383 - DNA, 13 bp, D. melanogaster
acacattttattg

SEQ ID NO: 571384 - DNA, 14 bp, D. melanogaster
acacattttattta

SEQ ID NO: 571385 - DNA, 13 bp, D. melanogaster
acacattttcaat

SEQ ID NO: 571386 - DNA, 13 bp, D. melanogaster
acacattttcctt

SEQ ID NO: 571387 - DNA, 13 bp, D. melanogaster
acacattttgtgg

SEQ ID NO: 571388 - DNA, 14 bp, D. melanogaster
acacatttttaaat

SEQ ID NO: 571389 - DNA, 13 bp, D. melanogaster
acacatttttcaa

SEQ ID NO: 571390 - DNA, 13 bp, D. melanogaster
acacatttttcca

SEQ ID NO: 571391 - DNA, 13 bp, D. melanogaster
acacatttttctt

SEQ ID NO: 571392 - DNA, 13 bp, D. melanogaster
acaccaaacagtg

SEQ ID NO: 571393 - DNA, 14 bp, D. melanogaster
acaccaaatatgaa

SEQ ID NO: 571394 - DNA, 14 bp, D. melanogaster
acaccaaggatcag

SEQ ID NO: 571395 - DNA, 13 bp, D. melanogaster
acaccaaggcata

SEQ ID NO: 571396 - DNA, 13 bp, D. melanogaster
acaccaatcgatt

SEQ ID NO: 571397 - DNA, 13 bp, D. melanogaster
acaccacaattca

SEQ ID NO: 571398 - DNA, 13 bp, D. melanogaster
acaccaccctgca

SEQ ID NO: 571399 - DNA, 13 bp, D. melanogaster
acaccagcaacat

SEQ ID NO: 571400 - DNA, 13 bp, D. melanogaster
acaccagcagcaa

SEQ ID NO: 571401 - DNA, 14 bp, D. melanogaster
acaccagccaccag

SEQ ID NO: 571402 - DNA, 13 bp, D. melanogaster
acaccagtagaaa

SEQ ID NO: 571403 - DNA, 13 bp, D. melanogaster
acaccagtttggg

SEQ ID NO: 571404 - DNA, 13 bp, D. melanogaster
acaccatcaccag

SEQ ID NO: 571405 - DNA, 13 bp, D. melanogaster
acaccatcggtag

SEQ ID NO: 571406 - DNA, 13 bp, D. melanogaster
acaccatttattt

SEQ ID NO: 571407 - DNA, 13 bp, D. melanogaster
acacccacacttt

SEQ ID NO: 571408 - DNA, 13 bp, D. melanogaster
acacccccattca

SEQ ID NO: 571409 - DNA, 13 bp, D. melanogaster
acacccgaaatat

SEQ ID NO: 571410 - DNA, 13 bp, D. melanogaster
acaccctgctcct

SEQ ID NO: 571411 - DNA, 13 bp, D. melanogaster
acaccctgtatac

SEQ ID NO: 571412 - DNA, 13 bp, D. melanogaster
acaccgcatccgg

SEQ ID NO: 571413 - DNA, 13 bp, D. melanogaster
acaccgcattgtg

SEQ ID NO: 571414 - DNA, 13 bp, D. melanogaster
acaccgcattttt

SEQ ID NO: 571415 - DNA, 13 bp, D. melanogaster
acaccgcccccat

SEQ ID NO: 571416 - DNA, 14 bp, D. melanogaster
acaccgggcgaagt

SEQ ID NO: 571417 - DNA, 13 bp, D. melanogaster
acaccgttgacaa

SEQ ID NO: 571418 - DNA, 13 bp, D. melanogaster
acacctacataca

SEQ ID NO: 571419 - DNA, 13 bp, D. melanogaster
acacctaccagct

SEQ ID NO: 571420 - DNA, 13 bp, D. melanogaster
acacctatatata

SEQ ID NO: 571421 - DNA, 14 bp, D. melanogaster
acacctccggtggc

SEQ ID NO: 571422 - DNA, 13 bp, D. melanogaster
acacgaaaataat

SEQ ID NO: 571423 - DNA, 13 bp, D. melanogaster
acacgaaaatatt

SEQ ID NO: 571424 - DNA, 13 bp, D. melanogaster
acacgaaactgta

SEQ ID NO: 571425 - DNA, 13 bp, D. melanogaster
acacgaaatcgaa

SEQ ID NO: 571426 - DNA, 13 bp, D. melanogaster
acacgaatatatt

SEQ ID NO: 571427 - DNA, 13 bp, D. melanogaster
acacgacaaaggt

SEQ ID NO: 571428 - DNA, 13 bp, D. melanogaster
acacgatctttgg

SEQ ID NO: 571429 - DNA, 13 bp, D. melanogaster
acacgattaatgt

SEQ ID NO: 571430 - DNA, 14 bp, D. melanogaster
acacgcacacaaag

SEQ ID NO: 571431 - DNA, 14 bp, D. melanogaster
acacgcacacacat

SEQ ID NO: 571432 - DNA, 13 bp, D. melanogaster
acacgcacacacg

SEQ ID NO: 571433 - DNA, 13 bp, D. melanogaster
acacgcacacact

SEQ ID NO: 571434 - DNA, 13 bp, D. melanogaster
acacgcacacaga

SEQ ID NO: 571435 - DNA, 13 bp, D. melanogaster
acacgcacacagc

SEQ ID NO: 571436 - DNA, 13 bp, D. melanogaster
acacgcacacata

SEQ ID NO: 571437 - DNA, 14 bp, D. melanogaster
acacgcacacatag

SEQ ID NO: 571438 - DNA, 13 bp, D. melanogaster
acacgcacacatg

SEQ ID NO: 571439 - DNA, 14 bp, D. melanogaster
acacgcacacttat

SEQ ID NO: 571440 - DNA, 13 bp, D. melanogaster
acacgcacagaca

SEQ ID NO: 571441 - DNA, 13 bp, D. melanogaster
acacgcacagcac

SEQ ID NO: 571442 - DNA, 14 bp, D. melanogaster
acacgcacagcacg

SEQ ID NO: 571443 - DNA, 13 bp, D. melanogaster
acacgcacataca

SEQ ID NO: 571444 - DNA, 13 bp, D. melanogaster
acacgcacatgca

SEQ ID NO: 571445 - DNA, 13 bp, D. melanogaster
acacgcacgcacg

SEQ ID NO: 571446 - DNA, 13 bp, D. melanogaster
acacgcacgcata

SEQ ID NO: 571447 - DNA, 13 bp, D. melanogaster
acacgcagagaaa

SEQ ID NO: 571448 - DNA, 13 bp, D. melanogaster
acacgcagcgaaa

SEQ ID NO: 571449 - DNA, 14 bp, D. melanogaster
acacgcatacacac

SEQ ID NO: 571450 - DNA, 13 bp, D. melanogaster
acacgcatacgca

SEQ ID NO: 571451 - DNA, 13 bp, D. melanogaster
acacgcccacact

SEQ ID NO: 571452 - DNA, 13 bp, D. melanogaster
acacgcccacatt

SEQ ID NO: 571453 - DNA, 13 bp, D. melanogaster
acacgcgcacaca

SEQ ID NO: 571454 - DNA, 13 bp, D. melanogaster
acacgcgcgcaca

SEQ ID NO: 571455 - DNA, 14 bp, D. melanogaster
acacggaaagaaat

SEQ ID NO: 571456 - DNA, 14 bp, D. melanogaster
acacggacacacac

SEQ ID NO: 571457 - DNA, 13 bp, D. melanogaster
acacggagaaaat

SEQ ID NO: 571458 - DNA, 13 bp, D. melanogaster
acacggagagaaa

SEQ ID NO: 571459 - DNA, 13 bp, D. melanogaster
acacggatacgga

SEQ ID NO: 571460 - DNA, 13 bp, D. melanogaster
acacggcattgcg

SEQ ID NO: 571461 - DNA, 13 bp, D. melanogaster
acacggcgtatac

SEQ ID NO: 571462 - DNA, 13 bp, D. melanogaster
acacggcgtatgc

SEQ ID NO: 571463 - DNA, 13 bp, D. melanogaster
acacggtgaaaaa

SEQ ID NO: 571464 - DNA, 13 bp, D. melanogaster
acacgtacacaca

SEQ ID NO: 571465 - DNA, 13 bp, D. melanogaster
acacgtacaccac

SEQ ID NO: 571466 - DNA, 13 bp, D. melanogaster
acacgtacacgta

SEQ ID NO: 571467 - DNA, 14 bp, D. melanogaster
acacgtacatacat

SEQ ID NO: 571468 - DNA, 13 bp, D. melanogaster
acacgtatatatg

SEQ ID NO: 571469 - DNA, 13 bp, D. melanogaster
acacgtgtgtgtg

SEQ ID NO: 571470 - DNA, 13 bp, D. melanogaster
acacgtttcaata

SEQ ID NO: 571471 - DNA, 13 bp, D. melanogaster
acacgtttttggc

SEQ ID NO: 571472 - DNA, 13 bp, D. melanogaster
acactaaattcat

SEQ ID NO: 571473 - DNA, 13 bp, D. melanogaster
acactaacaagac

SEQ ID NO: 571474 - DNA, 13 bp, D. melanogaster
acactaacacact

SEQ ID NO: 571475 - DNA, 13 bp, D. melanogaster
acactaacatatt

SEQ ID NO: 571476 - DNA, 13 bp, D. melanogaster
acactaattacag

SEQ ID NO: 571477 - DNA, 13 bp, D. melanogaster
acactacactaca

SEQ ID NO: 571478 - DNA, 13 bp, D. melanogaster
acactagaataat

SEQ ID NO: 571479 - DNA, 13 bp, D. melanogaster
acactagcacaca

SEQ ID NO: 571480 - DNA, 13 bp, D. melanogaster
acactatactata

SEQ ID NO: 571481 - DNA, 13 bp, D. melanogaster
acactattcttga

SEQ ID NO: 571482 - DNA, 13 bp, D. melanogaster
acactattttgac

SEQ ID NO: 571483 - DNA, 13 bp, D. melanogaster
acactcaaccggg

SEQ ID NO: 571484 - DNA, 13 bp, D. melanogaster
acactcacacaat

SEQ ID NO: 571485 - DNA, 13 bp, D. melanogaster
acactcacacacg

SEQ ID NO: 571486 - DNA, 13 bp, D. melanogaster
acactcacacatg

SEQ ID NO: 571487 - DNA, 13 bp, D. melanogaster
acactcacacatt

SEQ ID NO: 571488 - DNA, 13 bp, D. melanogaster
acactcacatgca

SEQ ID NO: 571489 - DNA, 14 bp, D. melanogaster
acactcactcacac

SEQ ID NO: 571490 - DNA, 13 bp, D. melanogaster
acactcagaaaaa

SEQ ID NO: 571491 - DNA, 13 bp, D. melanogaster
acactcagatgtc

SEQ ID NO: 571492 - DNA, 13 bp, D. melanogaster
acactcagcgaaa

SEQ ID NO: 571493 - DNA, 13 bp, D. melanogaster
acactcattgatt

SEQ ID NO: 571494 - DNA, 13 bp, D. melanogaster
acactcattgttt

SEQ ID NO: 571495 - DNA, 13 bp, D. melanogaster
acactccacactc

SEQ ID NO: 571496 - DNA, 13 bp, D. melanogaster
acactccagccaa

SEQ ID NO: 571497 - DNA, 13 bp, D. melanogaster
acactcgaaaaaa

SEQ ID NO: 571498 - DNA, 13 bp, D. melanogaster
acactcgaaacaa

SEQ ID NO: 571499 - DNA, 14 bp, D. melanogaster
acactcgaacacac

SEQ ID NO: 571500 - DNA, 13 bp, D. melanogaster
acactcgaagaaa

SEQ ID NO: 571501 - DNA, 14 bp, D. melanogaster
acactcgaagaaat

SEQ ID NO: 571502 - DNA, 13 bp, D. melanogaster
acactcgcacaca

SEQ ID NO: 571503 - DNA, 14 bp, D. melanogaster
acactcgcacacac

SEQ ID NO: 571504 - DNA, 13 bp, D. melanogaster
acactcgcactca

SEQ ID NO: 571505 - DNA, 13 bp, D. melanogaster
acactcgcagaaa

SEQ ID NO: 571506 - DNA, 14 bp, D. melanogaster
acactcgcagaaaa

SEQ ID NO: 571507 - DNA, 13 bp, D. melanogaster
acactcgcattca

SEQ ID NO: 571508 - DNA, 13 bp, D. melanogaster
acactcgcgccca

SEQ ID NO: 571509 - DNA, 13 bp, D. melanogaster
acactcggaaaaa

SEQ ID NO: 571510 - DNA, 13 bp, D. melanogaster
acactctacactc

SEQ ID NO: 571511 - DNA, 13 bp, D. melanogaster
acactctcaacaa

SEQ ID NO: 571512 - DNA, 13 bp, D. melanogaster
acactcttcgact

SEQ ID NO: 571513 - DNA, 13 bp, D. melanogaster
acactctttcaat

SEQ ID NO: 571514 - DNA, 13 bp, D. melanogaster
acactgaaaaaag

SEQ ID NO: 571515 - DNA, 13 bp, D. melanogaster
acactgaaaacaa

SEQ ID NO: 571516 - DNA, 14 bp, D. melanogaster
acactgaaaacaaa

SEQ ID NO: 571517 - DNA, 13 bp, D. melanogaster
acactgaaaataa

SEQ ID NO: 571518 - DNA, 13 bp, D. melanogaster
acactgaaacaaa

SEQ ID NO: 571519 - DNA, 13 bp, D. melanogaster
acactgaaagaaa

SEQ ID NO: 571520 - DNA, 13 bp, D. melanogaster
acactgaacaaaa

SEQ ID NO: 571521 - DNA, 13 bp, D. melanogaster
acactgaacgaaa

SEQ ID NO: 571522 - DNA, 13 bp, D. melanogaster
acactgaactcaa

SEQ ID NO: 571523 - DNA, 13 bp, D. melanogaster
acactgaagaaaa

SEQ ID NO: 571524 - DNA, 13 bp, D. melanogaster
acactgaaggaag

SEQ ID NO: 571525 - DNA, 13 bp, D. melanogaster
acactgacaaaaa

SEQ ID NO: 571526 - DNA, 13 bp, D. melanogaster
acactgacagaaa

SEQ ID NO: 571527 - DNA, 13 bp, D. melanogaster
acactgagaaaaa

SEQ ID NO: 571528 - DNA, 14 bp, D. melanogaster
acactgagaaaaaa

SEQ ID NO: 571529 - DNA, 14 bp, D. melanogaster
acactgagaaaaat

SEQ ID NO: 571530 - DNA, 13 bp, D. melanogaster
acactgagaacaa

SEQ ID NO: 571531 - DNA, 13 bp, D. melanogaster
acactgagagaaa

SEQ ID NO: 571532 - DNA, 14 bp, D. melanogaster
acactgagagaaaa

SEQ ID NO: 571533 - DNA, 14 bp, D. melanogaster
acactgagagaaat

SEQ ID NO: 571534 - DNA, 13 bp, D. melanogaster
acactgagcgaaa

SEQ ID NO: 571535 - DNA, 14 bp, D. melanogaster
acactgagcgaaaa

SEQ ID NO: 571536 - DNA, 14 bp, D. melanogaster
acactgagcgaaat

SEQ ID NO: 571537 - DNA, 13 bp, D. melanogaster
acactgagggaaa

SEQ ID NO: 571538 - DNA, 14 bp, D. melanogaster
acactgagggaaaa

SEQ ID NO: 571539 - DNA, 13 bp, D. melanogaster
acactgcaagaaa

SEQ ID NO: 571540 - DNA, 13 bp, D. melanogaster
acactgcaataac

SEQ ID NO: 571541 - DNA, 13 bp, D. melanogaster
acactgcacgaaa

SEQ ID NO: 571542 - DNA, 13 bp, D. melanogaster
acactgcactctc

SEQ ID NO: 571543 - DNA, 13 bp, D. melanogaster
acactgcagtaca

SEQ ID NO: 571544 - DNA, 13 bp, D. melanogaster
acactgccacaca

SEQ ID NO: 571545 - DNA, 13 bp, D. melanogaster
acactgccagaaa

SEQ ID NO: 571546 - DNA, 13 bp, D. melanogaster
acactgcgaaaaa

SEQ ID NO: 571547 - DNA, 13 bp, D. melanogaster
acactgcgagaaa

SEQ ID NO: 571548 - DNA, 14 bp, D. melanogaster
acactgcgagaaaa

SEQ ID NO: 571549 - DNA, 14 bp, D. melanogaster
acactgcgagaaat

SEQ ID NO: 571550 - DNA, 14 bp, D. melanogaster
acactgcgcgaaaa

SEQ ID NO: 571551 - DNA, 13 bp, D. melanogaster
acactgcgtatga

SEQ ID NO: 571552 - DNA, 14 bp, D. melanogaster
acactgcgtatgag

SEQ ID NO: 571553 - DNA, 13 bp, D. melanogaster
acactggaaaaaa

SEQ ID NO: 571554 - DNA, 14 bp, D. melanogaster
acactggaaaaaaa

SEQ ID NO: 571555 - DNA, 14 bp, D. melanogaster
acactggaaaaatc

SEQ ID NO: 571556 - DNA, 13 bp, D. melanogaster
acactggaaataa

SEQ ID NO: 571557 - DNA, 13 bp, D. melanogaster
acactggactgga

SEQ ID NO: 571558 - DNA, 14 bp, D. melanogaster
acactggactggaa

SEQ ID NO: 571559 - DNA, 13 bp, D. melanogaster
acactggcaaaaa

SEQ ID NO: 571560 - DNA, 13 bp, D. melanogaster
acactggcacact

SEQ ID NO: 571561 - DNA, 13 bp, D. melanogaster
acactggcgcaca

SEQ ID NO: 571562 - DNA, 13 bp, D. melanogaster
acactgggaaaaa

SEQ ID NO: 571563 - DNA, 13 bp, D. melanogaster
acactgggagaaa

SEQ ID NO: 571564 - DNA, 13 bp, D. melanogaster
acactgtgaaata

SEQ ID NO: 571565 - DNA, 14 bp, D. melanogaster
acactgtgaaataa

SEQ ID NO: 571566 - DNA, 13 bp, D. melanogaster
acactgtgcaaaa

SEQ ID NO: 571567 - DNA, 13 bp, D. melanogaster
acactgtgcaaca

SEQ ID NO: 571568 - DNA, 14 bp, D. melanogaster
acacttaaattaat

SEQ ID NO: 571569 - DNA, 13 bp, D. melanogaster
acacttaatattt

SEQ ID NO: 571570 - DNA, 13 bp, D. melanogaster
acacttaattgaa

SEQ ID NO: 571571 - DNA, 14 bp, D. melanogaster
acacttacacacac

SEQ ID NO: 571572 - DNA, 13 bp, D. melanogaster
acacttacataca

SEQ ID NO: 571573 - DNA, 13 bp, D. melanogaster
acacttagagaaa

SEQ ID NO: 571574 - DNA, 13 bp, D. melanogaster
acacttatgtaca

SEQ ID NO: 571575 - DNA, 13 bp, D. melanogaster
acacttattgtta

SEQ ID NO: 571576 - DNA, 13 bp, D. melanogaster
acacttgaaaaaa

SEQ ID NO: 571577 - DNA, 14 bp, D. melanogaster
acacttgaaaaaat

SEQ ID NO: 571578 - DNA, 13 bp, D. melanogaster
acacttgaaaaat

SEQ ID NO: 571579 - DNA, 13 bp, D. melanogaster
acacttgaataaa

SEQ ID NO: 571580 - DNA, 13 bp, D. melanogaster
acacttgacttta

SEQ ID NO: 571581 - DNA, 15 bp, D. melanogaster
acacttgatctggca

SEQ ID NO: 571582 - DNA, 13 bp, D. melanogaster
acacttgcacaca

SEQ ID NO: 571583 - DNA, 13 bp, D. melanogaster
acacttgccacac

SEQ ID NO: 571584 - DNA, 14 bp, D. melanogaster
acacttggaaaaat

SEQ ID NO: 571585 - DNA, 13 bp, D. melanogaster
acacttggccaaa

SEQ ID NO: 571586 - DNA, 13 bp, D. melanogaster
acacttggcgaaa

SEQ ID NO: 571587 - DNA, 13 bp, D. melanogaster
acacttgggaaaa

SEQ ID NO: 571588 - DNA, 13 bp, D. melanogaster
acacttgtgttta

SEQ ID NO: 571589 - DNA, 13 bp, D. melanogaster
acacttgttatgc

SEQ ID NO: 571590 - DNA, 13 bp, D. melanogaster
acactttaaatgc

SEQ ID NO: 571591 - DNA, 13 bp, D. melanogaster
acactttaataaa

SEQ ID NO: 571592 - DNA, 13 bp, D. melanogaster
acactttaattaa

SEQ ID NO: 571593 - DNA, 13 bp, D. melanogaster
acactttcaattg

SEQ ID NO: 571594 - DNA, 13 bp, D. melanogaster
acactttcacaca

SEQ ID NO: 571595 - DNA, 13 bp, D. melanogaster
acactttcacttt

SEQ ID NO: 571596 - DNA, 13 bp, D. melanogaster
acactttgaaaaa

SEQ ID NO: 571597 - DNA, 13 bp, D. melanogaster
acactttgaaata

SEQ ID NO: 571598 - DNA, 13 bp, D. melanogaster
acactttgatcat

SEQ ID NO: 571599 - DNA, 13 bp, D. melanogaster
acactttggccac

SEQ ID NO: 571600 - DNA, 13 bp, D. melanogaster
acactttgttgca

SEQ ID NO: 571601 - DNA, 13 bp, D. melanogaster
acactttgttttt

SEQ ID NO: 571602 - DNA, 13 bp, D. melanogaster
acacttttcacat

SEQ ID NO: 571603 - DNA, 13 bp, D. melanogaster
acacttttccatt

SEQ ID NO: 571604 - DNA, 13 bp, D. melanogaster
acacttttgaaaa

SEQ ID NO: 571605 - DNA, 14 bp, D. melanogaster
acacttttgaaaat

SEQ ID NO: 571606 - DNA, 14 bp, D. melanogaster
acacttttgaacaa

SEQ ID NO: 571607 - DNA, 13 bp, D. melanogaster
acacttttgataa

SEQ ID NO: 571608 - DNA, 14 bp, D. melanogaster
acacttttgctttt

SEQ ID NO: 571609 - DNA, 13 bp, D. melanogaster
acacttttgttta

SEQ ID NO: 571610 - DNA, 13 bp, D. melanogaster
acactttttaaaa

SEQ ID NO: 571611 - DNA, 13 bp, D. melanogaster
acacttttttgtg

SEQ ID NO: 571612 - DNA, 13 bp, D. melanogaster
acagaaaaaattt

SEQ ID NO: 571613 - DNA, 14 bp, D. melanogaster
acagaaaaaccaat

SEQ ID NO: 571614 - DNA, 13 bp, D. melanogaster
acagaaaaatatc

SEQ ID NO: 571615 - DNA, 13 bp, D. melanogaster
acagaaaaatgcg

SEQ ID NO: 571616 - DNA, 13 bp, D. melanogaster
acagaaaaatggg

SEQ ID NO: 571617 - DNA, 13 bp, D. melanogaster
acagaaaaatttg

SEQ ID NO: 571618 - DNA, 13 bp, D. melanogaster
acagaaaacttaa

SEQ ID NO: 571619 - DNA, 13 bp, D. melanogaster
acagaaaagtttt

SEQ ID NO: 571620 - DNA, 14 bp, D. melanogaster
acagaaaataaatt

SEQ ID NO: 571621 - DNA, 13 bp, D. melanogaster
acagaaaataatt

SEQ ID NO: 571622 - DNA, 13 bp, D. melanogaster
acagaaaataccc

SEQ ID NO: 571623 - DNA, 13 bp, D. melanogaster
acagaaaatcaat

SEQ ID NO: 571624 - DNA, 13 bp, D. melanogaster
acagaaaatggaa

SEQ ID NO: 571625 - DNA, 13 bp, D. melanogaster
acagaaaattaat

SEQ ID NO: 571626 - DNA, 13 bp, D. melanogaster
acagaaaattcag

SEQ ID NO: 571627 - DNA, 13 bp, D. melanogaster
acagaaaattctt

SEQ ID NO: 571628 - DNA, 14 bp, D. melanogaster
acagaaaattcttg

SEQ ID NO: 571629 - DNA, 13 bp, D. melanogaster
acagaaaatttat

SEQ ID NO: 571630 - DNA, 13 bp, D. melanogaster
acagaaaatttta

SEQ ID NO: 571631 - DNA, 14 bp, D. melanogaster
acagaaaattttat

SEQ ID NO: 571632 - DNA, 13 bp, D. melanogaster
acagaaacaatgc

SEQ ID NO: 571633 - DNA, 13 bp, D. melanogaster
acagaaacagata

SEQ ID NO: 571634 - DNA, 13 bp, D. melanogaster
acagaaacaggca

SEQ ID NO: 571635 - DNA, 14 bp, D. melanogaster
acagaaacaggcag

SEQ ID NO: 571636 - DNA, 13 bp, D. melanogaster
acagaaacagtaa

SEQ ID NO: 571637 - DNA, 13 bp, D. melanogaster
acagaaacatttt

SEQ ID NO: 571638 - DNA, 13 bp, D. melanogaster
acagaaacctaaa

SEQ ID NO: 571639 - DNA, 13 bp, D. melanogaster
acagaaactgaaa

SEQ ID NO: 571640 - DNA, 13 bp, D. melanogaster
acagaaagaaatt

SEQ ID NO: 571641 - DNA, 13 bp, D. melanogaster
acagaaatagaag

SEQ ID NO: 571642 - DNA, 14 bp, D. melanogaster
acagaaatagaaga

SEQ ID NO: 571643 - DNA, 13 bp, D. melanogaster
acagaaatatatt

SEQ ID NO: 571644 - DNA, 13 bp, D. melanogaster
acagaaatattaa

SEQ ID NO: 571645 - DNA, 13 bp, D. melanogaster
acagaaatattta

SEQ ID NO: 571646 - DNA, 13 bp, D. melanogaster
acagaaatcagaa

SEQ ID NO: 571647 - DNA, 13 bp, D. melanogaster
acagaaatcgaaa

SEQ ID NO: 571648 - DNA, 13 bp, D. melanogaster
acagaaattaact

SEQ ID NO: 571649 - DNA, 13 bp, D. melanogaster
acagaaattttca

SEQ ID NO: 571650 - DNA, 14 bp, D. melanogaster
acagaacaacacat

SEQ ID NO: 571651 - DNA, 14 bp, D. melanogaster
acagaacaagaatt

SEQ ID NO: 571652 - DNA, 13 bp, D. melanogaster
acagaacagaact

SEQ ID NO: 571653 - DNA, 13 bp, D. melanogaster
acagaaccaatat

SEQ ID NO: 571654 - DNA, 13 bp, D. melanogaster
acagaaccatttc

SEQ ID NO: 571655 - DNA, 14 bp, D. melanogaster
acagaagcagaagc

SEQ ID NO: 571656 - DNA, 13 bp, D. melanogaster
acagaagcagcag

SEQ ID NO: 571657 - DNA, 14 bp, D. melanogaster
acagaagcagcagc

SEQ ID NO: 571658 - DNA, 15 bp, D. melanogaster
acagaagcagcagca

SEQ ID NO: 571659 - DNA, 13 bp, D. melanogaster
acagaatacagaa

SEQ ID NO: 571660 - DNA, 13 bp, D. melanogaster
acagaatggggaa

SEQ ID NO: 571661 - DNA, 13 bp, D. melanogaster
acagaattatgaa

SEQ ID NO: 571662 - DNA, 13 bp, D. melanogaster
acagaattccttg

SEQ ID NO: 571663 - DNA, 13 bp, D. melanogaster
acagaatttaatt

SEQ ID NO: 571664 - DNA, 13 bp, D. melanogaster
acagaattttaaa

SEQ ID NO: 571665 - DNA, 13 bp, D. melanogaster
acagacaaaggag

SEQ ID NO: 571666 - DNA, 13 bp, D. melanogaster
acagacaacacat

SEQ ID NO: 571667 - DNA, 13 bp, D. melanogaster
acagacaacagac

SEQ ID NO: 571668 - DNA, 13 bp, D. melanogaster
acagacacacgca

SEQ ID NO: 571669 - DNA, 13 bp, D. melanogaster
acagacacataca

SEQ ID NO: 571670 - DNA, 13 bp, D. melanogaster
acagacagaagga

SEQ ID NO: 571671 - DNA, 13 bp, D. melanogaster
acagacagacaac

SEQ ID NO: 571672 - DNA, 14 bp, D. melanogaster
acagacagacacac

SEQ ID NO: 571673 - DNA, 13 bp, D. melanogaster
acagacagacaga

SEQ ID NO: 571674 - DNA, 14 bp, D. melanogaster
acagacagacagat

SEQ ID NO: 571675 - DNA, 14 bp, D. melanogaster
acagacagacaggc

SEQ ID NO: 571676 - DNA, 13 bp, D. melanogaster
acagacagacatg

SEQ ID NO: 571677 - DNA, 13 bp, D. melanogaster
acagacagatgga

SEQ ID NO: 571678 - DNA, 13 bp, D. melanogaster
acagacagccaga

SEQ ID NO: 571679 - DNA, 13 bp, D. melanogaster
acagacatttatt

SEQ ID NO: 571680 - DNA, 13 bp, D. melanogaster
acagaccagagca

SEQ ID NO: 571681 - DNA, 13 bp, D. melanogaster
acagaccatagac

SEQ ID NO: 571682 - DNA, 13 bp, D. melanogaster
acagacgcagaca

SEQ ID NO: 571683 - DNA, 13 bp, D. melanogaster
acagacggacaga

SEQ ID NO: 571684 - DNA, 14 bp, D. melanogaster
acagacggacagac

SEQ ID NO: 571685 - DNA, 13 bp, D. melanogaster
acagacggacatg

SEQ ID NO: 571686 - DNA, 14 bp, D. melanogaster
acagacggacggac

SEQ ID NO: 571687 - DNA, 13 bp, D. melanogaster
acagactttattc

SEQ ID NO: 571688 - DNA, 13 bp, D. melanogaster
acagagaaaaatt

SEQ ID NO: 571689 - DNA, 13 bp, D. melanogaster
acagagaaatatt

SEQ ID NO: 571690 - DNA, 13 bp, D. melanogaster
acagagacacaca

SEQ ID NO: 571691 - DNA, 13 bp, D. melanogaster
acagagacagaca

SEQ ID NO: 571692 - DNA, 13 bp, D. melanogaster
acagagacagaga

SEQ ID NO: 571693 - DNA, 14 bp, D. melanogaster
acagagacagagac

SEQ ID NO: 571694 - DNA, 13 bp, D. melanogaster
acagagacggagc

SEQ ID NO: 571695 - DNA, 13 bp, D. melanogaster
acagagacggagg

SEQ ID NO: 571696 - DNA, 13 bp, D. melanogaster
acagagacgtgga

SEQ ID NO: 571697 - DNA, 13 bp, D. melanogaster
acagagactttcc

SEQ ID NO: 571698 - DNA, 13 bp, D. melanogaster
acagagagcgaaa

SEQ ID NO: 571699 - DNA, 13 bp, D. melanogaster
acagagagcgaga

SEQ ID NO: 571700 - DNA, 13 bp, D. melanogaster
acagagatacaaa

SEQ ID NO: 571701 - DNA, 13 bp, D. melanogaster
acagagatagaga

SEQ ID NO: 571702 - DNA, 13 bp, D. melanogaster
acagagcacacag

SEQ ID NO: 571703 - DNA, 14 bp, D. melanogaster
acagagcaggagct

SEQ ID NO: 571704 - DNA, 13 bp, D. melanogaster
acagagccaacaa

SEQ ID NO: 571705 - DNA, 13 bp, D. melanogaster
acagaggaagcag

SEQ ID NO: 571706 - DNA, 13 bp, D. melanogaster
acagaggaatctc

SEQ ID NO: 571707 - DNA, 13 bp, D. melanogaster
acagaggacgagg

SEQ ID NO: 571708 - DNA, 13 bp, D. melanogaster
acagaggcaacaa

SEQ ID NO: 571709 - DNA, 13 bp, D. melanogaster
acagaggccattt

SEQ ID NO: 571710 - DNA, 13 bp, D. melanogaster
acagaggtggtca

SEQ ID NO: 571711 - DNA, 13 bp, D. melanogaster
acagagtgtttgc

SEQ ID NO: 571712 - DNA, 13 bp, D. melanogaster
acagataaagata

SEQ ID NO: 571713 - DNA, 13 bp, D. melanogaster
acagatacaaaat

SEQ ID NO: 571714 - DNA, 13 bp, D. melanogaster
acagatacaattt

SEQ ID NO: 571715 - DNA, 13 bp, D. melanogaster
acagatacagaaa

SEQ ID NO: 571716 - DNA, 14 bp, D. melanogaster
acagatacagacac

SEQ ID NO: 571717 - DNA, 15 bp, D. melanogaster
acagatacagatact

SEQ ID NO: 571718 - DNA, 14 bp, D. melanogaster
acagatacagatat

SEQ ID NO: 571719 - DNA, 13 bp, D. melanogaster
acagatacagatg

SEQ ID NO: 571720 - DNA, 13 bp, D. melanogaster
acagatacagatt

SEQ ID NO: 571721 - DNA, 14 bp, D. melanogaster
acagatacagattc

SEQ ID NO: 571722 - DNA, 13 bp, D. melanogaster
acagatacagcta

SEQ ID NO: 571723 - DNA, 13 bp, D. melanogaster
acagatacattta

SEQ ID NO: 571724 - DNA, 14 bp, D. melanogaster
acagatacatttgt

SEQ ID NO: 571725 - DNA, 13 bp, D. melanogaster
acagatacgaaac

SEQ ID NO: 571726 - DNA, 13 bp, D. melanogaster
acagatactaaag

SEQ ID NO: 571727 - DNA, 13 bp, D. melanogaster
acagatactcgaa

SEQ ID NO: 571728 - DNA, 13 bp, D. melanogaster
acagatagagata

SEQ ID NO: 571729 - DNA, 14 bp, D. melanogaster
acagatagagatac

SEQ ID NO: 571730 - DNA, 13 bp, D. melanogaster
acagatatacata

SEQ ID NO: 571731 - DNA, 14 bp, D. melanogaster
acagatatagatat

SEQ ID NO: 571732 - DNA, 13 bp, D. melanogaster
acagatatataca

SEQ ID NO: 571733 - DNA, 13 bp, D. melanogaster
acagatatatata

SEQ ID NO: 571734 - DNA, 14 bp, D. melanogaster
acagatatatatat

SEQ ID NO: 571735 - DNA, 13 bp, D. melanogaster
acagatatatatg

SEQ ID NO: 571736 - DNA, 13 bp, D. melanogaster
acagatatatgta

SEQ ID NO: 571737 - DNA, 14 bp, D. melanogaster
acagatatatgtat

SEQ ID NO: 571738 - DNA, 13 bp, D. melanogaster
acagatattaata

SEQ ID NO: 571739 - DNA, 13 bp, D. melanogaster
acagatccacagt

SEQ ID NO: 571740 - DNA, 13 bp, D. melanogaster
acagatgcagata

SEQ ID NO: 571741 - DNA, 14 bp, D. melanogaster
acagatgcagatac

SEQ ID NO: 571742 - DNA, 14 bp, D. melanogaster
acagatgcagatgc

SEQ ID NO: 571743 - DNA, 15 bp, D. melanogaster
acagatgcagatgca

SEQ ID NO: 571744 - DNA, 13 bp, D. melanogaster
acagatgctccac

SEQ ID NO: 571745 - DNA, 13 bp, D. melanogaster
acagatggacgga

SEQ ID NO: 571746 - DNA, 13 bp, D. melanogaster
acagatggcgcca

SEQ ID NO: 571747 - DNA, 13 bp, D. melanogaster
acagatgtacata

SEQ ID NO: 571748 - DNA, 14 bp, D. melanogaster
acagatgtttgttt

SEQ ID NO: 571749 - DNA, 14 bp, D. melanogaster
acagattcagatac

SEQ ID NO: 571750 - DNA, 13 bp, D. melanogaster
acagattcagatt

SEQ ID NO: 571751 - DNA, 13 bp, D. melanogaster
acagattcccact

SEQ ID NO: 571752 - DNA, 13 bp, D. melanogaster
acagattctagag

SEQ ID NO: 571753 - DNA, 13 bp, D. melanogaster
acagatttaatta

SEQ ID NO: 571754 - DNA, 13 bp, D. melanogaster
acagatttccggc

SEQ ID NO: 571755 - DNA, 13 bp, D. melanogaster
acagattttattt

SEQ ID NO: 571756 - DNA, 13 bp, D. melanogaster
acagcaaaaacat

SEQ ID NO: 571757 - DNA, 13 bp, D. melanogaster
acagcaaaatggc

SEQ ID NO: 571758 - DNA, 13 bp, D. melanogaster
acagcaaacaatg

SEQ ID NO: 571759 - DNA, 13 bp, D. melanogaster
acagcaaacatat

SEQ ID NO: 571760 - DNA, 13 bp, D. melanogaster
acagcaaactaca

SEQ ID NO: 571761 - DNA, 13 bp, D. melanogaster
acagcaaagcatg

SEQ ID NO: 571762 - DNA, 13 bp, D. melanogaster
acagcaaataaat

SEQ ID NO: 571763 - DNA, 13 bp, D. melanogaster
acagcaaatagca

SEQ ID NO: 571764 - DNA, 13 bp, D. melanogaster
acagcaaattgca

SEQ ID NO: 571765 - DNA, 13 bp, D. melanogaster
acagcaaattgtt

SEQ ID NO: 571766 - DNA, 13 bp, D. melanogaster
acagcaaatttat

SEQ ID NO: 571767 - DNA, 14 bp, D. melanogaster
acagcaacaacatt

SEQ ID NO: 571768 - DNA, 13 bp, D. melanogaster
acagcaacaacga

SEQ ID NO: 571769 - DNA, 13 bp, D. melanogaster
acagcaacaacta

SEQ ID NO: 571770 - DNA, 13 bp, D. melanogaster
acagcaacaactt

SEQ ID NO: 571771 - DNA, 13 bp, D. melanogaster
acagcaacaataa

SEQ ID NO: 571772 - DNA, 14 bp, D. melanogaster
acagcaacaataac

SEQ ID NO: 571773 - DNA, 13 bp, D. melanogaster
acagcaacaatag

SEQ ID NO: 571774 - DNA, 13 bp, D. melanogaster
acagcaacaattg

SEQ ID NO: 571775 - DNA, 13 bp, D. melanogaster
acagcaacagcaa

SEQ ID NO: 571776 - DNA, 16 bp, D. melanogaster
acagcaacagcagcaa

SEQ ID NO: 571777 - DNA, 13 bp, D. melanogaster
acagcaacagcca

SEQ ID NO: 571778 - DNA, 13 bp, D. melanogaster
acagcaacagcta

SEQ ID NO: 571779 - DNA, 14 bp, D. melanogaster
acagcaacatcagc

SEQ ID NO: 571780 - DNA, 15 bp, D. melanogaster
acagcaacatcagca

SEQ ID NO: 571781 - DNA, 13 bp, D. melanogaster
acagcaacatcat

SEQ ID NO: 571782 - DNA, 13 bp, D. melanogaster
acagcaacatgac

SEQ ID NO: 571783 - DNA, 13 bp, D. melanogaster
acagcaacatgtt

SEQ ID NO: 571784 - DNA, 13 bp, D. melanogaster
acagcaacggaaa

SEQ ID NO: 571785 - DNA, 13 bp, D. melanogaster
acagcaactgcaa

SEQ ID NO: 571786 - DNA, 13 bp, D. melanogaster
acagcaattaatt

SEQ ID NO: 571787 - DNA, 13 bp, D. melanogaster
acagcaattagca

SEQ ID NO: 571788 - DNA, 13 bp, D. melanogaster
acagcacaccatc

SEQ ID NO: 571789 - DNA, 13 bp, D. melanogaster
acagcacagcaca

SEQ ID NO: 571790 - DNA, 14 bp, D. melanogaster
acagcagaatgcaa

SEQ ID NO: 571791 - DNA, 13 bp, D. melanogaster
acagcagatgtat

SEQ ID NO: 571792 - DNA, 16 bp, D. melanogaster
acagcagcaacaacag

SEQ ID NO: 571793 - DNA, 21 bp, D. melanogaster
acagcagcaacaacagcagca

SEQ ID NO: 571794 - DNA, 14 bp, D. melanogaster
acagcagcaacaat

SEQ ID NO: 571795 - DNA, 13 bp, D. melanogaster
acagcagcaacac

SEQ ID NO: 571796 - DNA, 14 bp, D. melanogaster
acagcagcaacagc

SEQ ID NO: 571797 - DNA, 13 bp, D. melanogaster
acagcagcaacat

SEQ ID NO: 571798 - DNA, 13 bp, D. melanogaster
acagcagcaacca

SEQ ID NO: 571799 - DNA, 13 bp, D. melanogaster
acagcagcaataa

SEQ ID NO: 571800 - DNA, 13 bp, D. melanogaster
acagcagcaattt

SEQ ID NO: 571801 - DNA, 13 bp, D. melanogaster
acagcagcacaaa

SEQ ID NO: 571802 - DNA, 13 bp, D. melanogaster
acagcagcagaaa

SEQ ID NO: 571803 - DNA, 13 bp, D. melanogaster
acagcagcagcaa

SEQ ID NO: 571804 - DNA, 14 bp, D. melanogaster
acagcagcagcaaa

SEQ ID NO: 571805 - DNA, 14 bp, D. melanogaster
acagcagcagcaac

SEQ ID NO: 571806 - DNA, 15 bp, D. melanogaster
acagcagcagcaact

SEQ ID NO: 571807 - DNA, 14 bp, D. melanogaster
acagcagcagcaag

SEQ ID NO: 571808 - DNA, 14 bp, D. melanogaster
acagcagcagcaca

SEQ ID NO: 571809 - DNA, 14 bp, D. melanogaster
acagcagcagcaga

SEQ ID NO: 571810 - DNA, 15 bp, D. melanogaster
acagcagcagcagcc

SEQ ID NO: 571811 - DNA, 14 bp, D. melanogaster
acagcagcagcagg

SEQ ID NO: 571812 - DNA, 15 bp, D. melanogaster
acagcagcagcagga

SEQ ID NO: 571813 - DNA, 14 bp, D. melanogaster
acagcagcagcatc

SEQ ID NO: 571814 - DNA, 13 bp, D. melanogaster
acagcagcagccg

SEQ ID NO: 571815 - DNA, 13 bp, D. melanogaster
acagcagcagcga

SEQ ID NO: 571816 - DNA, 13 bp, D. melanogaster
acagcagcaggaa

SEQ ID NO: 571817 - DNA, 13 bp, D. melanogaster
acagcagcaggag

SEQ ID NO: 571818 - DNA, 14 bp, D. melanogaster
acagcagcaggagc

SEQ ID NO: 571819 - DNA, 13 bp, D. melanogaster
acagcagcagtgg

SEQ ID NO: 571820 - DNA, 13 bp, D. melanogaster
acagcagcataaa

SEQ ID NO: 571821 - DNA, 14 bp, D. melanogaster
acagcagccatgcc

SEQ ID NO: 571822 - DNA, 13 bp, D. melanogaster
acagcagccgcaa

SEQ ID NO: 571823 - DNA, 13 bp, D. melanogaster
acagcagccgcag

SEQ ID NO: 571824 - DNA, 14 bp, D. melanogaster
acagcagccgcagc

SEQ ID NO: 571825 - DNA, 13 bp, D. melanogaster
acagcagcgaaaa

SEQ ID NO: 571826 - DNA, 14 bp, D. melanogaster
acagcagcgaggga

SEQ ID NO: 571827 - DNA, 13 bp, D. melanogaster
acagcagcggcaa

SEQ ID NO: 571828 - DNA, 13 bp, D. melanogaster
acagcagctggca

SEQ ID NO: 571829 - DNA, 15 bp, D. melanogaster
acagcagtagcaaca

SEQ ID NO: 571830 - DNA, 13 bp, D. melanogaster
acagcatcataaa

SEQ ID NO: 571831 - DNA, 13 bp, D. melanogaster
acagcattatcat

SEQ ID NO: 571832 - DNA, 13 bp, D. melanogaster
acagcatttaaat

SEQ ID NO: 571833 - DNA, 13 bp, D. melanogaster
acagcatttgata

SEQ ID NO: 571834 - DNA, 14 bp, D. melanogaster
acagcatttgataa

SEQ ID NO: 571835 - DNA, 14 bp, D. melanogaster
acagccaaataaaa

SEQ ID NO: 571836 - DNA, 13 bp, D. melanogaster
acagccaacagcc

SEQ ID NO: 571837 - DNA, 14 bp, D. melanogaster
acagccaacagcca

SEQ ID NO: 571838 - DNA, 13 bp, D. melanogaster
acagccaacgttc

SEQ ID NO: 571839 - DNA, 13 bp, D. melanogaster
acagccacaaaat

SEQ ID NO: 571840 - DNA, 13 bp, D. melanogaster
acagccacagcca

SEQ ID NO: 571841 - DNA, 13 bp, D. melanogaster
acagccacatcaa

SEQ ID NO: 571842 - DNA, 13 bp, D. melanogaster
acagccacatcca

SEQ ID NO: 571843 - DNA, 13 bp, D. melanogaster
acagccacgccca

SEQ ID NO: 571844 - DNA, 13 bp, D. melanogaster
acagccagccaaa

SEQ ID NO: 571845 - DNA, 13 bp, D. melanogaster
acagccagccagc

SEQ ID NO: 571846 - DNA, 13 bp, D. melanogaster
acagccagcgaaa

SEQ ID NO: 571847 - DNA, 14 bp, D. melanogaster
acagccattaatag

SEQ ID NO: 571848 - DNA, 13 bp, D. melanogaster
acagccatttgca

SEQ ID NO: 571849 - DNA, 13 bp, D. melanogaster
acagccatttttc

SEQ ID NO: 571850 - DNA, 13 bp, D. melanogaster
acagccctgaaca

SEQ ID NO: 571851 - DNA, 13 bp, D. melanogaster
acagccgtttgga

SEQ ID NO: 571852 - DNA, 13 bp, D. melanogaster
acagcctaaaagt

SEQ ID NO: 571853 - DNA, 13 bp, D. melanogaster
acagccttgattg

SEQ ID NO: 571854 - DNA, 13 bp, D. melanogaster
acagccttggttc

SEQ ID NO: 571855 - DNA, 13 bp, D. melanogaster
acagcgaaaataa

SEQ ID NO: 571856 - DNA, 14 bp, D. melanogaster
acagcgaaatattt

SEQ ID NO: 571857 - DNA, 13 bp, D. melanogaster
acagcgaaatgaa

SEQ ID NO: 571858 - DNA, 13 bp, D. melanogaster
acagcgaacacaa

SEQ ID NO: 571859 - DNA, 15 bp, D. melanogaster
acagcgaacagctct

SEQ ID NO: 571860 - DNA, 14 bp, D. melanogaster
acagcgacaacaac

SEQ ID NO: 571861 - DNA, 14 bp, D. melanogaster
acagcgacaacagg

SEQ ID NO: 571862 - DNA, 13 bp, D. melanogaster
acagcgacagcaa

SEQ ID NO: 571863 - DNA, 13 bp, D. melanogaster
acagcgacagcag

SEQ ID NO: 571864 - DNA, 13 bp, D. melanogaster
acagcgacagcga

SEQ ID NO: 571865 - DNA, 13 bp, D. melanogaster
acagcgagaaaat

SEQ ID NO: 571866 - DNA, 15 bp, D. melanogaster
acagcgatcaactga

SEQ ID NO: 571867 - DNA, 13 bp, D. melanogaster
acagcgcaattaa

SEQ ID NO: 571868 - DNA, 13 bp, D. melanogaster
acagcggcaacag

SEQ ID NO: 571869 - DNA, 14 bp, D. melanogaster
acagcggcaacagc

SEQ ID NO: 571870 - DNA, 13 bp, D. melanogaster
acagcggcagcag

SEQ ID NO: 571871 - DNA, 14 bp, D. melanogaster
acagcggcagcagc

SEQ ID NO: 571872 - DNA, 13 bp, D. melanogaster
acagctaaaggta

SEQ ID NO: 571873 - DNA, 13 bp, D. melanogaster
acagctacaaaaa

SEQ ID NO: 571874 - DNA, 14 bp, D. melanogaster
acagctacagatac

SEQ ID NO: 571875 - DNA, 13 bp, D. melanogaster
acagctacagcaa

SEQ ID NO: 571876 - DNA, 13 bp, D. melanogaster
acagctcagctca

SEQ ID NO: 571877 - DNA, 13 bp, D. melanogaster
acagctcgagttt

SEQ ID NO: 571878 - DNA, 13 bp, D. melanogaster
acagctctagaat

SEQ ID NO: 571879 - DNA, 13 bp, D. melanogaster
acagctgaagcac

SEQ ID NO: 571880 - DNA, 13 bp, D. melanogaster
acagctgagtgag

SEQ ID NO: 571881 - DNA, 13 bp, D. melanogaster
acagctgcaaaat

SEQ ID NO: 571882 - DNA, 14 bp, D. melanogaster
acagctgcagttcc

SEQ ID NO: 571883 - DNA, 13 bp, D. melanogaster
acagctgcagttt

SEQ ID NO: 571884 - DNA, 13 bp, D. melanogaster
acagctgcggtca

SEQ ID NO: 571885 - DNA, 14 bp, D. melanogaster
acagctgcggtcaa

SEQ ID NO: 571886 - DNA, 13 bp, D. melanogaster
acagctgctgctg

SEQ ID NO: 571887 - DNA, 14 bp, D. melanogaster
acagctgctgctgc

SEQ ID NO: 571888 - DNA, 13 bp, D. melanogaster
acagctggagagg

SEQ ID NO: 571889 - DNA, 13 bp, D. melanogaster
acagctggcacag

SEQ ID NO: 571890 - DNA, 13 bp, D. melanogaster
acagctggcgcgg

SEQ ID NO: 571891 - DNA, 13 bp, D. melanogaster
acagctggtaaaa

SEQ ID NO: 571892 - DNA, 13 bp, D. melanogaster
acagctgtcaaaa

SEQ ID NO: 571893 - DNA, 13 bp, D. melanogaster
acagctgtgatca

SEQ ID NO: 571894 - DNA, 13 bp, D. melanogaster
acagctgtgttca

SEQ ID NO: 571895 - DNA, 13 bp, D. melanogaster
acagctgtttgtg

SEQ ID NO: 571896 - DNA, 13 bp, D. melanogaster
acagcttcctttt

SEQ ID NO: 571897 - DNA, 13 bp, D. melanogaster
acagctttttaaa

SEQ ID NO: 571898 - DNA, 13 bp, D. melanogaster
acaggaaaatatt

SEQ ID NO: 571899 - DNA, 13 bp, D. melanogaster
acaggaaacggaa

SEQ ID NO: 571900 - DNA, 13 bp, D. melanogaster
acaggaaatgctg

SEQ ID NO: 571901 - DNA, 13 bp, D. melanogaster
acaggaagacaac

SEQ ID NO: 571902 - DNA, 13 bp, D. melanogaster
acaggaagtaaaa

SEQ ID NO: 571903 - DNA, 13 bp, D. melanogaster
acaggaatttaat

SEQ ID NO: 571904 - DNA, 14 bp, D. melanogaster
acaggaatttaata

SEQ ID NO: 571905 - DNA, 14 bp, D. melanogaster
acaggacacaggac

SEQ ID NO: 571906 - DNA, 14 bp, D. melanogaster
acaggacaggacag

SEQ ID NO: 571907 - DNA, 13 bp, D. melanogaster
acaggacgaagga

SEQ ID NO: 571908 - DNA, 14 bp, D. melanogaster
acaggacgaaggac

SEQ ID NO: 571909 - DNA, 13 bp, D. melanogaster
acaggagcaacaa

SEQ ID NO: 571910 - DNA, 13 bp, D. melanogaster
acaggagcaacag

SEQ ID NO: 571911 - DNA, 13 bp, D. melanogaster
acaggagcagcag

SEQ ID NO: 571912 - DNA, 14 bp, D. melanogaster
acaggagcagcagc

SEQ ID NO: 571913 - DNA, 13 bp, D. melanogaster
acaggagcagcca

SEQ ID NO: 571914 - DNA, 13 bp, D. melanogaster
acaggagcaggaa

SEQ ID NO: 571915 - DNA, 14 bp, D. melanogaster
acaggagcaggagc

SEQ ID NO: 571916 - DNA, 13 bp, D. melanogaster
acaggagctgaat

SEQ ID NO: 571917 - DNA, 14 bp, D. melanogaster
acaggatcaacaat

SEQ ID NO: 571918 - DNA, 13 bp, D. melanogaster
acaggcaaaagga

SEQ ID NO: 571919 - DNA, 13 bp, D. melanogaster
acaggcaacaaca

SEQ ID NO: 571920 - DNA, 14 bp, D. melanogaster
acaggcagaaggaa

SEQ ID NO: 571921 - DNA, 13 bp, D. melanogaster
acaggcaggcttt

SEQ ID NO: 571922 - DNA, 13 bp, D. melanogaster
acaggcatttgac

SEQ ID NO: 571923 - DNA, 13 bp, D. melanogaster
acagggaaaataa

SEQ ID NO: 571924 - DNA, 13 bp, D. melanogaster
acagggacaggga

SEQ ID NO: 571925 - DNA, 13 bp, D. melanogaster
acagggcagcttt

SEQ ID NO: 571926 - DNA, 13 bp, D. melanogaster
acagggccaaaaa

SEQ ID NO: 571927 - DNA, 13 bp, D. melanogaster
acaggtagaagga

SEQ ID NO: 571928 - DNA, 14 bp, D. melanogaster
acaggtagaaggaa

SEQ ID NO: 571929 - DNA, 13 bp, D. melanogaster
acaggtgcagata

SEQ ID NO: 571930 - DNA, 13 bp, D. melanogaster
acagtaacaacaa

SEQ ID NO: 571931 - DNA, 14 bp, D. melanogaster
acagtaacaacaac

SEQ ID NO: 571932 - DNA, 13 bp, D. melanogaster
acagtaacataac

SEQ ID NO: 571933 - DNA, 13 bp, D. melanogaster
acagtaggaaaat

SEQ ID NO: 571934 - DNA, 13 bp, D. melanogaster
acagtagtggctt

SEQ ID NO: 571935 - DNA, 13 bp, D. melanogaster
acagtatatatat

SEQ ID NO: 571936 - DNA, 14 bp, D. melanogaster
acagtattataata

SEQ ID NO: 571937 - DNA, 13 bp, D. melanogaster
acagtattgcttt

SEQ ID NO: 571938 - DNA, 13 bp, D. melanogaster
acagtattttaac

SEQ ID NO: 571939 - DNA, 13 bp, D. melanogaster
acagtcaaacttc

SEQ ID NO: 571940 - DNA, 14 bp, D. melanogaster
acagtcacacacac

SEQ ID NO: 571941 - DNA, 13 bp, D. melanogaster
acagtcagtcagt

SEQ ID NO: 571942 - DNA, 13 bp, D. melanogaster
acagtcgcaaaag

SEQ ID NO: 571943 - DNA, 13 bp, D. melanogaster
acagtcgctcagt

SEQ ID NO: 571944 - DNA, 13 bp, D. melanogaster
acagtcgcttcat

SEQ ID NO: 571945 - DNA, 13 bp, D. melanogaster
acagtgaaaaatg

SEQ ID NO: 571946 - DNA, 13 bp, D. melanogaster
acagtgaaagaaa

SEQ ID NO: 571947 - DNA, 13 bp, D. melanogaster
acagtgaacaccc

SEQ ID NO: 571948 - DNA, 13 bp, D. melanogaster
acagtgaagcctc

SEQ ID NO: 571949 - DNA, 13 bp, D. melanogaster
acagtgagcactc

SEQ ID NO: 571950 - DNA, 13 bp, D. melanogaster
acagtgcacagtg

SEQ ID NO: 571951 - DNA, 13 bp, D. melanogaster
acagtgcgtatac

SEQ ID NO: 571952 - DNA, 13 bp, D. melanogaster
acagtgcgtatga

SEQ ID NO: 571953 - DNA, 14 bp, D. melanogaster
acagtgcgtatgat

SEQ ID NO: 571954 - DNA, 14 bp, D. melanogaster
acagtgcgtatgcg

SEQ ID NO: 571955 - DNA, 14 bp, D. melanogaster
acagtgcgtttcat

SEQ ID NO: 571956 - DNA, 13 bp, D. melanogaster
acagtggaagtgg

SEQ ID NO: 571957 - DNA, 13 bp, D. melanogaster
acagtggacactg

SEQ ID NO: 571958 - DNA, 13 bp, D. melanogaster
acagtggagcctc

SEQ ID NO: 571959 - DNA, 13 bp, D. melanogaster
acagtggcaaaaa

SEQ ID NO: 571960 - DNA, 13 bp, D. melanogaster
acagtggcagcaa

SEQ ID NO: 571961 - DNA, 13 bp, D. melanogaster
acagtggcagtgg

SEQ ID NO: 571962 - DNA, 13 bp, D. melanogaster
acagtgggacaaa

SEQ ID NO: 571963 - DNA, 13 bp, D. melanogaster
acagtgggcgcca

SEQ ID NO: 571964 - DNA, 13 bp, D. melanogaster
acagtgggcgtgg

SEQ ID NO: 571965 - DNA, 13 bp, D. melanogaster
acagtgggtctca

SEQ ID NO: 571966 - DNA, 13 bp, D. melanogaster
acagtggtcgcca

SEQ ID NO: 571967 - DNA, 13 bp, D. melanogaster
acagtgtgctaag

SEQ ID NO: 571968 - DNA, 14 bp, D. melanogaster
acagtgtgtgtgtg

SEQ ID NO: 571969 - DNA, 13 bp, D. melanogaster
acagtgtttgttt

SEQ ID NO: 571970 - DNA, 13 bp, D. melanogaster
acagttcatttac

SEQ ID NO: 571971 - DNA, 13 bp, D. melanogaster
acagttcttacat

SEQ ID NO: 571972 - DNA, 13 bp, D. melanogaster
acagttgagaaga

SEQ ID NO: 571973 - DNA, 13 bp, D. melanogaster
acagttgcaccaa

SEQ ID NO: 571974 - DNA, 13 bp, D. melanogaster
acagttgccaaaa

SEQ ID NO: 571975 - DNA, 13 bp, D. melanogaster
acagttgcggtca

SEQ ID NO: 571976 - DNA, 13 bp, D. melanogaster
acagttggaaaaa

SEQ ID NO: 571977 - DNA, 13 bp, D. melanogaster
acagttggcaaca

SEQ ID NO: 571978 - DNA, 13 bp, D. melanogaster
acagttggccaac

SEQ ID NO: 571979 - DNA, 13 bp, D. melanogaster
acagttggcccaa

SEQ ID NO: 571980 - DNA, 13 bp, D. melanogaster
acagttgtctgct

SEQ ID NO: 571981 - DNA, 13 bp, D. melanogaster
acagtttaaaaaa

SEQ ID NO: 571982 - DNA, 13 bp, D. melanogaster
acagtttgaaaga

SEQ ID NO: 571983 - DNA, 14 bp, D. melanogaster
acagtttgaaatta

SEQ ID NO: 571984 - DNA, 18 bp, D. melanogaster
acagtttgattggaaatt

SEQ ID NO: 571985 - DNA, 13 bp, D. melanogaster
acagttttaaatt

SEQ ID NO: 571986 - DNA, 13 bp, D. melanogaster
acagttttcaatt

SEQ ID NO: 571987 - DNA, 13 bp, D. melanogaster
acagttttgaaaa

SEQ ID NO: 571988 - DNA, 14 bp, D. melanogaster
acagttttgaaaaa

SEQ ID NO: 571989 - DNA, 13 bp, D. melanogaster
acagtttttcaat

SEQ ID NO: 571990 - DNA, 13 bp, D. melanogaster
acagtttttcatt

SEQ ID NO: 571991 - DNA, 13 bp, D. melanogaster
acagtttttcttt

SEQ ID NO: 571992 - DNA, 13 bp, D. melanogaster
acagtttttggtc

SEQ ID NO: 571993 - DNA, 13 bp, D. melanogaster
acataaaaacttt

SEQ ID NO: 571994 - DNA, 13 bp, D. melanogaster
acataaaaagcat

SEQ ID NO: 571995 - DNA, 13 bp, D. melanogaster
acataaaaaggca

SEQ ID NO: 571996 - DNA, 13 bp, D. melanogaster
acataaaaatgat

SEQ ID NO: 571997 - DNA, 13 bp, D. melanogaster
acataaaacactt

SEQ ID NO: 571998 - DNA, 13 bp, D. melanogaster
acataaaacattt

SEQ ID NO: 571999 - DNA, 14 bp, D. melanogaster
acataaaacatttt

SEQ ID NO: 572000 - DNA, 13 bp, D. melanogaster
acataaaagccaa

SEQ ID NO: 572001 - DNA, 13 bp, D. melanogaster
acataaaatatcg

SEQ ID NO: 572002 - DNA, 13 bp, D. melanogaster
acataaaatgttt

SEQ ID NO: 572003 - DNA, 13 bp, D. melanogaster
acataaaattgat

SEQ ID NO: 572004 - DNA, 13 bp, D. melanogaster
acataaacatatt

SEQ ID NO: 572005 - DNA, 13 bp, D. melanogaster
acataaacatgta

SEQ ID NO: 572006 - DNA, 13 bp, D. melanogaster
acataaacatttg

SEQ ID NO: 572007 - DNA, 13 bp, D. melanogaster
acataaacatttt

SEQ ID NO: 572008 - DNA, 13 bp, D. melanogaster
acataaagaaatt

SEQ ID NO: 572009 - DNA, 13 bp, D. melanogaster
acataaagccaaa

SEQ ID NO: 572010 - DNA, 13 bp, D. melanogaster
acataaagtaaat

SEQ ID NO: 572011 - DNA, 13 bp, D. melanogaster
acataaagtaatt

SEQ ID NO: 572012 - DNA, 13 bp, D. melanogaster
acataaagtatat

SEQ ID NO: 572013 - DNA, 13 bp, D. melanogaster
acataaagtccaa

SEQ ID NO: 572014 - DNA, 13 bp, D. melanogaster
acataaagtggct

SEQ ID NO: 572015 - DNA, 13 bp, D. melanogaster
acataaagttttt

SEQ ID NO: 572016 - DNA, 14 bp, D. melanogaster
acataaataaaagt

SEQ ID NO: 572017 - DNA, 13 bp, D. melanogaster
acataaataaatg

SEQ ID NO: 572018 - DNA, 13 bp, D. melanogaster
acataaataattc

SEQ ID NO: 572019 - DNA, 13 bp, D. melanogaster
acataaatacaag

SEQ ID NO: 572020 - DNA, 13 bp, D. melanogaster
acataaatatatc

SEQ ID NO: 572021 - DNA, 13 bp, D. melanogaster
acataaatatctt

SEQ ID NO: 572022 - DNA, 13 bp, D. melanogaster
acataaatatgta

SEQ ID NO: 572023 - DNA, 13 bp, D. melanogaster
acataaatatgtg

SEQ ID NO: 572024 - DNA, 13 bp, D. melanogaster
acataaatattca

SEQ ID NO: 572025 - DNA, 13 bp, D. melanogaster
acataaatcacat

SEQ ID NO: 572026 - DNA, 13 bp, D. melanogaster
acataaatctaat

SEQ ID NO: 572027 - DNA, 13 bp, D. melanogaster
acataaatctcaa

SEQ ID NO: 572028 - DNA, 13 bp, D. melanogaster
acataaatctttg

SEQ ID NO: 572029 - DNA, 13 bp, D. melanogaster
acataaatgaaat

SEQ ID NO: 572030 - DNA, 13 bp, D. melanogaster
acataaatgaata

SEQ ID NO: 572031 - DNA, 13 bp, D. melanogaster
acataaatgtcta

SEQ ID NO: 572032 - DNA, 13 bp, D. melanogaster
acataaattgctt

SEQ ID NO: 572033 - DNA, 13 bp, D. melanogaster
acataaattgttt

SEQ ID NO: 572034 - DNA, 13 bp, D. melanogaster
acataaatttatg

SEQ ID NO: 572035 - DNA, 14 bp, D. melanogaster
acataacataacat

SEQ ID NO: 572036 - DNA, 14 bp, D. melanogaster
acataacatacata

SEQ ID NO: 572037 - DNA, 13 bp, D. melanogaster
acataacatatgt

SEQ ID NO: 572038 - DNA, 13 bp, D. melanogaster
acataaccacata

SEQ ID NO: 572039 - DNA, 13 bp, D. melanogaster
acataacctcaaa

SEQ ID NO: 572040 - DNA, 13 bp, D. melanogaster
acataacggccag

SEQ ID NO: 572041 - DNA, 13 bp, D. melanogaster
acataactagatt

SEQ ID NO: 572042 - DNA, 14 bp, D. melanogaster
acataactagatta

SEQ ID NO: 572043 - DNA, 14 bp, D. melanogaster
acataagcaaaaat

SEQ ID NO: 572044 - DNA, 13 bp, D. melanogaster
acataagcacaca

SEQ ID NO: 572045 - DNA, 13 bp, D. melanogaster
acataagcacata

SEQ ID NO: 572046 - DNA, 13 bp, D. melanogaster
acataagcccagc

SEQ ID NO: 572047 - DNA, 13 bp, D. melanogaster
acataagctactg

SEQ ID NO: 572048 - DNA, 13 bp, D. melanogaster
acataagtatata

SEQ ID NO: 572049 - DNA, 13 bp, D. melanogaster
acataagtatgta

SEQ ID NO: 572050 - DNA, 13 bp, D. melanogaster
acataataaagga

SEQ ID NO: 572051 - DNA, 13 bp, D. melanogaster
acataataatcat

SEQ ID NO: 572052 - DNA, 13 bp, D. melanogaster
acataataccagc

SEQ ID NO: 572053 - DNA, 13 bp, D. melanogaster
acataatcaattt

SEQ ID NO: 572054 - DNA, 13 bp, D. melanogaster
acataatcataat

SEQ ID NO: 572055 - DNA, 13 bp, D. melanogaster
acataatgaaaat

SEQ ID NO: 572056 - DNA, 13 bp, D. melanogaster
acataatgtgggt

SEQ ID NO: 572057 - DNA, 13 bp, D. melanogaster
acataattataca

SEQ ID NO: 572058 - DNA, 13 bp, D. melanogaster
acataattatgca

SEQ ID NO: 572059 - DNA, 13 bp, D. melanogaster
acataattgatac

SEQ ID NO: 572060 - DNA, 13 bp, D. melanogaster
acataattgcaaa

SEQ ID NO: 572061 - DNA, 14 bp, D. melanogaster
acataattgtatat

SEQ ID NO: 572062 - DNA, 13 bp, D. melanogaster
acataatttgtaa

SEQ ID NO: 572063 - DNA, 13 bp, D. melanogaster
acataatttgttt

SEQ ID NO: 572064 - DNA, 13 bp, D. melanogaster
acatacaaatatg

SEQ ID NO: 572065 - DNA, 13 bp, D. melanogaster
acatacaaatgat

SEQ ID NO: 572066 - DNA, 13 bp, D. melanogaster
acatacaaatgta

SEQ ID NO: 572067 - DNA, 13 bp, D. melanogaster
acatacaaattta

SEQ ID NO: 572068 - DNA, 13 bp, D. melanogaster
acatacaacaaag

SEQ ID NO: 572069 - DNA, 13 bp, D. melanogaster
acatacaacacat

SEQ ID NO: 572070 - DNA, 13 bp, D. melanogaster
acatacaacatac

SEQ ID NO: 572071 - DNA, 13 bp, D. melanogaster
acatacaatatat

SEQ ID NO: 572072 - DNA, 14 bp, D. melanogaster
acatacacacacat

SEQ ID NO: 572073 - DNA, 14 bp, D. melanogaster
acatacacacacgt

SEQ ID NO: 572074 - DNA, 13 bp, D. melanogaster
acatacacacaga

SEQ ID NO: 572075 - DNA, 13 bp, D. melanogaster
acatacacacagc

SEQ ID NO: 572076 - DNA, 13 bp, D. melanogaster
acatacacacgca

SEQ ID NO: 572077 - DNA, 14 bp, D. melanogaster
acatacacacgcac

SEQ ID NO: 572078 - DNA, 14 bp, D. melanogaster
acatacacactcac

SEQ ID NO: 572079 - DNA, 13 bp, D. melanogaster
acatacacactcg

SEQ ID NO: 572080 - DNA, 13 bp, D. melanogaster
acatacacataca

SEQ ID NO: 572081 - DNA, 14 bp, D. melanogaster
acatacacatacat

SEQ ID NO: 572082 - DNA, 13 bp, D. melanogaster
acatacacatacg

SEQ ID NO: 572083 - DNA, 13 bp, D. melanogaster
acatacacatata

SEQ ID NO: 572084 - DNA, 14 bp, D. melanogaster
acatacacatatat

SEQ ID NO: 572085 - DNA, 13 bp, D. melanogaster
acatacacatatg

SEQ ID NO: 572086 - DNA, 13 bp, D. melanogaster
acatacacatatt

SEQ ID NO: 572087 - DNA, 13 bp, D. melanogaster
acatacacatcca

SEQ ID NO: 572088 - DNA, 13 bp, D. melanogaster
acatacacatgta

SEQ ID NO: 572089 - DNA, 14 bp, D. melanogaster
acatacacatgtac

SEQ ID NO: 572090 - DNA, 13 bp, D. melanogaster
acatacacatgtg

SEQ ID NO: 572091 - DNA, 13 bp, D. melanogaster
acatacacattta

SEQ ID NO: 572092 - DNA, 13 bp, D. melanogaster
acatacactcaca

SEQ ID NO: 572093 - DNA, 13 bp, D. melanogaster
acatacacttaca

SEQ ID NO: 572094 - DNA, 13 bp, D. melanogaster
acatacagacaca

SEQ ID NO: 572095 - DNA, 13 bp, D. melanogaster
acatacagacata

SEQ ID NO: 572096 - DNA, 13 bp, D. melanogaster
acatacagataca

SEQ ID NO: 572097 - DNA, 14 bp, D. melanogaster
acatacagatacag

SEQ ID NO: 572098 - DNA, 13 bp, D. melanogaster
acatacagatgca

SEQ ID NO: 572099 - DNA, 13 bp, D. melanogaster
acatacagttgtc

SEQ ID NO: 572100 - DNA, 13 bp, D. melanogaster
acatacagtttgt

SEQ ID NO: 572101 - DNA, 13 bp, D. melanogaster
acatacataaatg

SEQ ID NO: 572102 - DNA, 13 bp, D. melanogaster
acatacataacta

SEQ ID NO: 572103 - DNA, 13 bp, D. melanogaster
acatacataagta

SEQ ID NO: 572104 - DNA, 13 bp, D. melanogaster
acatacataagtg

SEQ ID NO: 572105 - DNA, 13 bp, D. melanogaster
acatacataagtt

SEQ ID NO: 572106 - DNA, 13 bp, D. melanogaster
acatacatacaac

SEQ ID NO: 572107 - DNA, 13 bp, D. melanogaster
acatacatacaag

SEQ ID NO: 572108 - DNA, 14 bp, D. melanogaster
acatacatacaata

SEQ ID NO: 572109 - DNA, 13 bp, D. melanogaster
acatacatacaca

SEQ ID NO: 572110 - DNA, 13 bp, D. melanogaster
acatacatacata

SEQ ID NO: 572111 - DNA, 14 bp, D. melanogaster
acatacatacatac

SEQ ID NO: 572112 - DNA, 17 bp, D. melanogaster
acatacatacatattta

SEQ ID NO: 572113 - DNA, 13 bp, D. melanogaster
acatacatacatc

SEQ ID NO: 572114 - DNA, 14 bp, D. melanogaster
acatacatacatcc

SEQ ID NO: 572115 - DNA, 14 bp, D. melanogaster
acatacatacatct

SEQ ID NO: 572116 - DNA, 14 bp, D. melanogaster
acatacatacattg

SEQ ID NO: 572117 - DNA, 13 bp, D. melanogaster
acatacatacgca

SEQ ID NO: 572118 - DNA, 15 bp, D. melanogaster
acatacatacgtaca

SEQ ID NO: 572119 - DNA, 13 bp, D. melanogaster
acatacatactta

SEQ ID NO: 572120 - DNA, 13 bp, D. melanogaster
acatacatagata

SEQ ID NO: 572121 - DNA, 14 bp, D. melanogaster
acatacatagatac

SEQ ID NO: 572122 - DNA, 14 bp, D. melanogaster
acatacataggtat

SEQ ID NO: 572123 - DNA, 13 bp, D. melanogaster
acatacatataag

SEQ ID NO: 572124 - DNA, 13 bp, D. melanogaster
acatacatatacg

SEQ ID NO: 572125 - DNA, 13 bp, D. melanogaster
acatacatatagt

SEQ ID NO: 572126 - DNA, 14 bp, D. melanogaster
acatacatatatgc

SEQ ID NO: 572127 - DNA, 14 bp, D. melanogaster
acatacatatatgt

SEQ ID NO: 572128 - DNA, 13 bp, D. melanogaster
acatacatatatt

SEQ ID NO: 572129 - DNA, 14 bp, D. melanogaster
acatacatatattc

SEQ ID NO: 572130 - DNA, 13 bp, D. melanogaster
acatacatatcta

SEQ ID NO: 572131 - DNA, 13 bp, D. melanogaster
acatacatatgaa

SEQ ID NO: 572132 - DNA, 13 bp, D. melanogaster
acatacatatgca

SEQ ID NO: 572133 - DNA, 13 bp, D. melanogaster
acatacatatgta

SEQ ID NO: 572134 - DNA, 15 bp, D. melanogaster
acatacatatgtaaa

SEQ ID NO: 572135 - DNA, 14 bp, D. melanogaster
acatacatatgtag

SEQ ID NO: 572136 - DNA, 13 bp, D. melanogaster
acatacatatgtg

SEQ ID NO: 572137 - DNA, 14 bp, D. melanogaster
acatacatatgtga

SEQ ID NO: 572138 - DNA, 14 bp, D. melanogaster
acatacatatgtgt

SEQ ID NO: 572139 - DNA, 13 bp, D. melanogaster
acatacatattgc

SEQ ID NO: 572140 - DNA, 13 bp, D. melanogaster
acatacatatttt

SEQ ID NO: 572141 - DNA, 14 bp, D. melanogaster
acatacatattttt

SEQ ID NO: 572142 - DNA, 13 bp, D. melanogaster
acatacatcatat

SEQ ID NO: 572143 - DNA, 13 bp, D. melanogaster
acatacatgcaca

SEQ ID NO: 572144 - DNA, 13 bp, D. melanogaster
acatacatgcatg

SEQ ID NO: 572145 - DNA, 13 bp, D. melanogaster
acatacatgtaca

SEQ ID NO: 572146 - DNA, 13 bp, D. melanogaster
acatacatgtgtg

SEQ ID NO: 572147 - DNA, 13 bp, D. melanogaster
acatacatttata

SEQ ID NO: 572148 - DNA, 13 bp, D. melanogaster
acatacatttgca

SEQ ID NO: 572149 - DNA, 14 bp, D. melanogaster
acatacatttgtat

SEQ ID NO: 572150 - DNA, 13 bp, D. melanogaster
acatacattttaa

SEQ ID NO: 572151 - DNA, 13 bp, D. melanogaster
acatacatttttt

SEQ ID NO: 572152 - DNA, 14 bp, D. melanogaster
acatacattttttg

SEQ ID NO: 572153 - DNA, 13 bp, D. melanogaster
acatacctacata

SEQ ID NO: 572154 - DNA, 14 bp, D. melanogaster
acatacgtacatat

SEQ ID NO: 572155 - DNA, 13 bp, D. melanogaster
acatacgtagatg

SEQ ID NO: 572156 - DNA, 13 bp, D. melanogaster
acatacgtataca

SEQ ID NO: 572157 - DNA, 13 bp, D. melanogaster
acatacgtatatg

SEQ ID NO: 572158 - DNA, 13 bp, D. melanogaster
acatacgtatgta

SEQ ID NO: 572159 - DNA, 14 bp, D. melanogaster
acatacgtatgtat

SEQ ID NO: 572160 - DNA, 13 bp, D. melanogaster
acatactacatac

SEQ ID NO: 572161 - DNA, 13 bp, D. melanogaster
acatactacatct

SEQ ID NO: 572162 - DNA, 13 bp, D. melanogaster
acatactcacaca

SEQ ID NO: 572163 - DNA, 13 bp, D. melanogaster
acatactcgcaca

SEQ ID NO: 572164 - DNA, 13 bp, D. melanogaster
acatactcgtata

SEQ ID NO: 572165 - DNA, 13 bp, D. melanogaster
acatactggccat

SEQ ID NO: 572166 - DNA, 13 bp, D. melanogaster
acatactgttttt

SEQ ID NO: 572167 - DNA, 13 bp, D. melanogaster
acatacttaaata

SEQ ID NO: 572168 - DNA, 13 bp, D. melanogaster
acatacttatata

SEQ ID NO: 572169 - DNA, 13 bp, D. melanogaster
acatactttattt

SEQ ID NO: 572170 - DNA, 13 bp, D. melanogaster
acatactttttaa

SEQ ID NO: 572171 - DNA, 13 bp, D. melanogaster
acatagaaattgt

SEQ ID NO: 572172 - DNA, 13 bp, D. melanogaster
acatagatacaaa

SEQ ID NO: 572173 - DNA, 13 bp, D. melanogaster
acatagatacaca

SEQ ID NO: 572174 - DNA, 13 bp, D. melanogaster
acatagatataga

SEQ ID NO: 572175 - DNA, 13 bp, D. melanogaster
acatagcaacaaa

SEQ ID NO: 572176 - DNA, 13 bp, D. melanogaster
acatagccgaaaa

SEQ ID NO: 572177 - DNA, 13 bp, D. melanogaster
acatagcgtcaat

SEQ ID NO: 572178 - DNA, 13 bp, D. melanogaster
acatagtacatat

SEQ ID NO: 572179 - DNA, 13 bp, D. melanogaster
acatataaacatt

SEQ ID NO: 572180 - DNA, 13 bp, D. melanogaster
acatataaagtaa

SEQ ID NO: 572181 - DNA, 13 bp, D. melanogaster
acatataaatatg

SEQ ID NO: 572182 - DNA, 13 bp, D. melanogaster
acatataaatgta

SEQ ID NO: 572183 - DNA, 13 bp, D. melanogaster
acatataacaatt

SEQ ID NO: 572184 - DNA, 13 bp, D. melanogaster
acatataatatgt

SEQ ID NO: 572185 - DNA, 13 bp, D. melanogaster
acatatacaatac

SEQ ID NO: 572186 - DNA, 13 bp, D. melanogaster
acatatacacaca

SEQ ID NO: 572187 - DNA, 14 bp, D. melanogaster
acatatacacacat

SEQ ID NO: 572188 - DNA, 13 bp, D. melanogaster
acatatacacata

SEQ ID NO: 572189 - DNA, 13 bp, D. melanogaster
acatatacataca

SEQ ID NO: 572190 - DNA, 14 bp, D. melanogaster
acatatacatacac

SEQ ID NO: 572191 - DNA, 13 bp, D. melanogaster
acatatacatact

SEQ ID NO: 572192 - DNA, 13 bp, D. melanogaster
acatatacatata

SEQ ID NO: 572193 - DNA, 14 bp, D. melanogaster
acatatacatatat

SEQ ID NO: 572194 - DNA, 15 bp, D. melanogaster
acatatacatatatg

SEQ ID NO: 572195 - DNA, 13 bp, D. melanogaster
acatatacgagta

SEQ ID NO: 572196 - DNA, 14 bp, D. melanogaster
acatatacgcgttc

SEQ ID NO: 572197 - DNA, 13 bp, D. melanogaster
acatatacgtata

SEQ ID NO: 572198 - DNA, 13 bp, D. melanogaster
acatatactacat

SEQ ID NO: 572199 - DNA, 13 bp, D. melanogaster
acatatactcgta

SEQ ID NO: 572200 - DNA, 13 bp, D. melanogaster
acatatacttaca

SEQ ID NO: 572201 - DNA, 13 bp, D. melanogaster
acatatacttatt

SEQ ID NO: 572202 - DNA, 13 bp, D. melanogaster
acatatagtacat

SEQ ID NO: 572203 - DNA, 13 bp, D. melanogaster
acatatataacat

SEQ ID NO: 572204 - DNA, 13 bp, D. melanogaster
acatatataacta

SEQ ID NO: 572205 - DNA, 13 bp, D. melanogaster
acatatataatac

SEQ ID NO: 572206 - DNA, 13 bp, D. melanogaster
acatatatacaca

SEQ ID NO: 572207 - DNA, 13 bp, D. melanogaster
acatatatacacg

SEQ ID NO: 572208 - DNA, 13 bp, D. melanogaster
acatatatacata

SEQ ID NO: 572209 - DNA, 14 bp, D. melanogaster
acatatatacatac

SEQ ID NO: 572210 - DNA, 16 bp, D. melanogaster
acatatatacatacat

SEQ ID NO: 572211 - DNA, 14 bp, D. melanogaster
acatatatacatat

SEQ ID NO: 572212 - DNA, 13 bp, D. melanogaster
acatatatacatg

SEQ ID NO: 572213 - DNA, 14 bp, D. melanogaster
acatatatacatgt

SEQ ID NO: 572214 - DNA, 13 bp, D. melanogaster
acatatataccaa

SEQ ID NO: 572215 - DNA, 13 bp, D. melanogaster
acatatatactca

SEQ ID NO: 572216 - DNA, 13 bp, D. melanogaster
acatatatacttt

SEQ ID NO: 572217 - DNA, 13 bp, D. melanogaster
acatatatagagt

SEQ ID NO: 572218 - DNA, 13 bp, D. melanogaster
acatatatagtat

SEQ ID NO: 572219 - DNA, 14 bp, D. melanogaster
acatatatatagat

SEQ ID NO: 572220 - DNA, 13 bp, D. melanogaster
acatatatatagc

SEQ ID NO: 572221 - DNA, 14 bp, D. melanogaster
acatatatatatac

SEQ ID NO: 572222 - DNA, 13 bp, D. melanogaster
acatatatatatg

SEQ ID NO: 572223 - DNA, 14 bp, D. melanogaster
acatatatatatgg

SEQ ID NO: 572224 - DNA, 14 bp, D. melanogaster
acatatatatattg

SEQ ID NO: 572225 - DNA, 13 bp, D. melanogaster
acatatatatcat

SEQ ID NO: 572226 - DNA, 13 bp, D. melanogaster
acatatatatcca

SEQ ID NO: 572227 - DNA, 13 bp, D. melanogaster
acatatatatcct

SEQ ID NO: 572228 - DNA, 13 bp, D. melanogaster
acatatatatgta

SEQ ID NO: 572229 - DNA, 14 bp, D. melanogaster
acatatatatgtat

SEQ ID NO: 572230 - DNA, 13 bp, D. melanogaster
acatatatatgtg

SEQ ID NO: 572231 - DNA, 14 bp, D. melanogaster
acatatatatgttt

SEQ ID NO: 572232 - DNA, 13 bp, D. melanogaster
acatatatattca

SEQ ID NO: 572233 - DNA, 13 bp, D. melanogaster
acatatatatttc

SEQ ID NO: 572234 - DNA, 13 bp, D. melanogaster
acatatatcaaat

SEQ ID NO: 572235 - DNA, 13 bp, D. melanogaster
acatatatcacat

SEQ ID NO: 572236 - DNA, 13 bp, D. melanogaster
acatatatccaaa

SEQ ID NO: 572237 - DNA, 14 bp, D. melanogaster
acatatatctatat

SEQ ID NO: 572238 - DNA, 13 bp, D. melanogaster
acatatatctatg

SEQ ID NO: 572239 - DNA, 13 bp, D. melanogaster
acatatatgaatg

SEQ ID NO: 572240 - DNA, 14 bp, D. melanogaster
acatatatgcaaat

SEQ ID NO: 572241 - DNA, 13 bp, D. melanogaster
acatatatgcact

SEQ ID NO: 572242 - DNA, 14 bp, D. melanogaster
acatatatgcatac

SEQ ID NO: 572243 - DNA, 13 bp, D. melanogaster
acatatatgcgaa

SEQ ID NO: 572244 - DNA, 13 bp, D. melanogaster
acatatatgtacc

SEQ ID NO: 572245 - DNA, 14 bp, D. melanogaster
acatatatgtagat

SEQ ID NO: 572246 - DNA, 13 bp, D. melanogaster
acatatatgtatt

SEQ ID NO: 572247 - DNA, 13 bp, D. melanogaster
acatatatgtgtg

SEQ ID NO: 572248 - DNA, 13 bp, D. melanogaster
acatatatttaca

SEQ ID NO: 572249 - DNA, 13 bp, D. melanogaster
acatatatttctt

SEQ ID NO: 572250 - DNA, 14 bp, D. melanogaster
acatatatttgtat

SEQ ID NO: 572251 - DNA, 13 bp, D. melanogaster
acatatattttgt

SEQ ID NO: 572252 - DNA, 13 bp, D. melanogaster
acatatcaaatta

SEQ ID NO: 572253 - DNA, 14 bp, D. melanogaster
acatatctacatat

SEQ ID NO: 572254 - DNA, 13 bp, D. melanogaster
acatatctataaa

SEQ ID NO: 572255 - DNA, 13 bp, D. melanogaster
acatatctatata

SEQ ID NO: 572256 - DNA, 13 bp, D. melanogaster
acatatctatgta

SEQ ID NO: 572257 - DNA, 13 bp, D. melanogaster
acatatgaataat

SEQ ID NO: 572258 - DNA, 13 bp, D. melanogaster
acatatgatttat

SEQ ID NO: 572259 - DNA, 13 bp, D. melanogaster
acatatgcaaatg

SEQ ID NO: 572260 - DNA, 13 bp, D. melanogaster
acatatgcacata

SEQ ID NO: 572261 - DNA, 13 bp, D. melanogaster
acatatgcagaaa

SEQ ID NO: 572262 - DNA, 13 bp, D. melanogaster
acatatgcataaa

SEQ ID NO: 572263 - DNA, 14 bp, D. melanogaster
acatatgcatacat

SEQ ID NO: 572264 - DNA, 13 bp, D. melanogaster
acatatgcatatg

SEQ ID NO: 572265 - DNA, 13 bp, D. melanogaster
acatatgcattta

SEQ ID NO: 572266 - DNA, 13 bp, D. melanogaster
acatatgcgcata

SEQ ID NO: 572267 - DNA, 13 bp, D. melanogaster
acatatgctcaaa

SEQ ID NO: 572268 - DNA, 13 bp, D. melanogaster
acatatgcttaaa

SEQ ID NO: 572269 - DNA, 14 bp, D. melanogaster
acatatgtaaataa

SEQ ID NO: 572270 - DNA, 13 bp, D. melanogaster
acatatgtaaatg

SEQ ID NO: 572271 - DNA, 13 bp, D. melanogaster
acatatgtaagtt

SEQ ID NO: 572272 - DNA, 13 bp, D. melanogaster
acatatgtacaca

SEQ ID NO: 572273 - DNA, 14 bp, D. melanogaster
acatatgtacacat

SEQ ID NO: 572274 - DNA, 13 bp, D. melanogaster
acatatgtacata

SEQ ID NO: 572275 - DNA, 14 bp, D. melanogaster
acatatgtacataa

SEQ ID NO: 572276 - DNA, 16 bp, D. melanogaster
acatatgtacatacat

SEQ ID NO: 572277 - DNA, 18 bp, D. melanogaster
acatatgtacatatgtat

SEQ ID NO: 572278 - DNA, 13 bp, D. melanogaster
acatatgtacatg

SEQ ID NO: 572279 - DNA, 13 bp, D. melanogaster
acatatgtacgta

SEQ ID NO: 572280 - DNA, 13 bp, D. melanogaster
acatatgtacgtt

SEQ ID NO: 572281 - DNA, 14 bp, D. melanogaster
acatatgtaggtat

SEQ ID NO: 572282 - DNA, 14 bp, D. melanogaster
acatatgtataaat

SEQ ID NO: 572283 - DNA, 13 bp, D. melanogaster
acatatgtatacc

SEQ ID NO: 572284 - DNA, 13 bp, D. melanogaster
acatatgtatacg

SEQ ID NO: 572285 - DNA, 13 bp, D. melanogaster
acatatgtatagt

SEQ ID NO: 572286 - DNA, 14 bp, D. melanogaster
acatatgtatatac

SEQ ID NO: 572287 - DNA, 15 bp, D. melanogaster
acatatgtatatata

SEQ ID NO: 572288 - DNA, 14 bp, D. melanogaster
acatatgtatatcc

SEQ ID NO: 572289 - DNA, 14 bp, D. melanogaster
acatatgtatatct

SEQ ID NO: 572290 - DNA, 13 bp, D. melanogaster
acatatgtatatt

SEQ ID NO: 572291 - DNA, 13 bp, D. melanogaster
acatatgtatctc

SEQ ID NO: 572292 - DNA, 13 bp, D. melanogaster
acatatgtatctt

SEQ ID NO: 572293 - DNA, 14 bp, D. melanogaster
acatatgtatgaat

SEQ ID NO: 572294 - DNA, 14 bp, D. melanogaster
acatatgtatgtaa

SEQ ID NO: 572295 - DNA, 14 bp, D. melanogaster
acatatgtatgtag

SEQ ID NO: 572296 - DNA, 14 bp, D. melanogaster
acatatgtatgtgc

SEQ ID NO: 572297 - DNA, 14 bp, D. melanogaster
acatatgtatgttc

SEQ ID NO: 572298 - DNA, 13 bp, D. melanogaster
acatatgtattta

SEQ ID NO: 572299 - DNA, 14 bp, D. melanogaster
acatatgtgtacat

SEQ ID NO: 572300 - DNA, 13 bp, D. melanogaster
acatatgtgtgca

SEQ ID NO: 572301 - DNA, 13 bp, D. melanogaster
acatatgtgtttg

SEQ ID NO: 572302 - DNA, 14 bp, D. melanogaster
acatatgtttgtat

SEQ ID NO: 572303 - DNA, 13 bp, D. melanogaster
acatattaaaaag

SEQ ID NO: 572304 - DNA, 13 bp, D. melanogaster
acatattaattac

SEQ ID NO: 572305 - DNA, 13 bp, D. melanogaster
acatattcaaata

SEQ ID NO: 572306 - DNA, 13 bp, D. melanogaster
acatattcaactt

SEQ ID NO: 572307 - DNA, 13 bp, D. melanogaster
acatattcgcaca

SEQ ID NO: 572308 - DNA, 13 bp, D. melanogaster
acatattctttaa

SEQ ID NO: 572309 - DNA, 13 bp, D. melanogaster
acatattgataaa

SEQ ID NO: 572310 - DNA, 13 bp, D. melanogaster
acatattgcagaa

SEQ ID NO: 572311 - DNA, 13 bp, D. melanogaster
acatattgtatat

SEQ ID NO: 572312 - DNA, 13 bp, D. melanogaster
acatatttaaaca

SEQ ID NO: 572313 - DNA, 13 bp, D. melanogaster
acatatttacaca

SEQ ID NO: 572314 - DNA, 14 bp, D. melanogaster
acatatttacacat

SEQ ID NO: 572315 - DNA, 13 bp, D. melanogaster
acatatttacatt

SEQ ID NO: 572316 - DNA, 13 bp, D. melanogaster
acatatttactgt

SEQ ID NO: 572317 - DNA, 13 bp, D. melanogaster
acatatttactta

SEQ ID NO: 572318 - DNA, 14 bp, D. melanogaster
acatatttacttat

SEQ ID NO: 572319 - DNA, 13 bp, D. melanogaster
acatatttatagc

SEQ ID NO: 572320 - DNA, 13 bp, D. melanogaster
acatatttatgaa

SEQ ID NO: 572321 - DNA, 13 bp, D. melanogaster
acatatttatgta

SEQ ID NO: 572322 - DNA, 14 bp, D. melanogaster
acatatttatgtac

SEQ ID NO: 572323 - DNA, 13 bp, D. melanogaster
acatatttattga

SEQ ID NO: 572324 - DNA, 13 bp, D. melanogaster
acatatttattgc

SEQ ID NO: 572325 - DNA, 14 bp, D. melanogaster
acatatttattttg

SEQ ID NO: 572326 - DNA, 13 bp, D. melanogaster
acatatttcaata

SEQ ID NO: 572327 - DNA, 13 bp, D. melanogaster
acatatttcaatt

SEQ ID NO: 572328 - DNA, 13 bp, D. melanogaster
acatatttcactt

SEQ ID NO: 572329 - DNA, 13 bp, D. melanogaster
acatatttcattt

SEQ ID NO: 572330 - DNA, 13 bp, D. melanogaster
acatatttctttg

SEQ ID NO: 572331 - DNA, 13 bp, D. melanogaster
acatatttgattt

SEQ ID NO: 572332 - DNA, 13 bp, D. melanogaster
acatatttgcaaa

SEQ ID NO: 572333 - DNA, 14 bp, D. melanogaster
acatatttgtatat

SEQ ID NO: 572334 - DNA, 14 bp, D. melanogaster
acatatttgtgttt

SEQ ID NO: 572335 - DNA, 13 bp, D. melanogaster
acatattttaaac

SEQ ID NO: 572336 - DNA, 13 bp, D. melanogaster
acatattttactt

SEQ ID NO: 572337 - DNA, 13 bp, D. melanogaster
acatattttatag

SEQ ID NO: 572338 - DNA, 13 bp, D. melanogaster
acatattttatgg

SEQ ID NO: 572339 - DNA, 13 bp, D. melanogaster
acatattttattg

SEQ ID NO: 572340 - DNA, 14 bp, D. melanogaster
acatattttatttg

SEQ ID NO: 572341 - DNA, 13 bp, D. melanogaster
acatattttccaa

SEQ ID NO: 572342 - DNA, 13 bp, D. melanogaster
acatattttctac

SEQ ID NO: 572343 - DNA, 13 bp, D. melanogaster
acatattttctat

SEQ ID NO: 572344 - DNA, 13 bp, D. melanogaster
acatattttgtaa

SEQ ID NO: 572345 - DNA, 13 bp, D. melanogaster
acatattttgtat

SEQ ID NO: 572346 - DNA, 13 bp, D. melanogaster
acatattttgtta

SEQ ID NO: 572347 - DNA, 14 bp, D. melanogaster
acatattttgttac

SEQ ID NO: 572348 - DNA, 13 bp, D. melanogaster
acatatttttaca

SEQ ID NO: 572349 - DNA, 13 bp, D. melanogaster
acatatttttact

SEQ ID NO: 572350 - DNA, 13 bp, D. melanogaster
acatatttttcga

SEQ ID NO: 572351 - DNA, 13 bp, D. melanogaster
acatatttttctg

SEQ ID NO: 572352 - DNA, 13 bp, D. melanogaster
acatatttttgat

SEQ ID NO: 572353 - DNA, 13 bp, D. melanogaster
acatattttttgg

SEQ ID NO: 572354 - DNA, 13 bp, D. melanogaster
acatattttttgt

SEQ ID NO: 572355 - DNA, 14 bp, D. melanogaster
acatattttttgtt

SEQ ID NO: 572356 - DNA, 13 bp, D. melanogaster
acatcaaaatatt

SEQ ID NO: 572357 - DNA, 13 bp, D. melanogaster
acatcaaaatgta

SEQ ID NO: 572358 - DNA, 13 bp, D. melanogaster
acatcaaagcaaa

SEQ ID NO: 572359 - DNA, 13 bp, D. melanogaster
acatcaaatatat

SEQ ID NO: 572360 - DNA, 13 bp, D. melanogaster
acatcaaattatt

SEQ ID NO: 572361 - DNA, 13 bp, D. melanogaster
acatcaatcaatt

SEQ ID NO: 572362 - DNA, 13 bp, D. melanogaster
acatcaattattt

SEQ ID NO: 572363 - DNA, 13 bp, D. melanogaster
acatcaatttaat

SEQ ID NO: 572364 - DNA, 13 bp, D. melanogaster
acatcaatttatt

SEQ ID NO: 572365 - DNA, 14 bp, D. melanogaster
acatcacgtatacg

SEQ ID NO: 572366 - DNA, 13 bp, D. melanogaster
acatcagcaacaa

SEQ ID NO: 572367 - DNA, 13 bp, D. melanogaster
acatcagcaattg

SEQ ID NO: 572368 - DNA, 13 bp, D. melanogaster
acatcagcagcaa

SEQ ID NO: 572369 - DNA, 13 bp, D. melanogaster
acatcagcatcat

SEQ ID NO: 572370 - DNA, 14 bp, D. melanogaster
acatcagcttcttc

SEQ ID NO: 572371 - DNA, 13 bp, D. melanogaster
acatcagttgcat

SEQ ID NO: 572372 - DNA, 13 bp, D. melanogaster
acatcataaaatt

SEQ ID NO: 572373 - DNA, 13 bp, D. melanogaster
acatcataatcat

SEQ ID NO: 572374 - DNA, 13 bp, D. melanogaster
acatcatacatat

SEQ ID NO: 572375 - DNA, 13 bp, D. melanogaster
acatcatattgaa

SEQ ID NO: 572376 - DNA, 13 bp, D. melanogaster
acatcatcaaaat

SEQ ID NO: 572377 - DNA, 13 bp, D. melanogaster
acatcatcaaatt

SEQ ID NO: 572378 - DNA, 13 bp, D. melanogaster
acatcatcagcaa

SEQ ID NO: 572379 - DNA, 15 bp, D. melanogaster
acatcatcatcatcg

SEQ ID NO: 572380 - DNA, 13 bp, D. melanogaster
acatcatcatctt

SEQ ID NO: 572381 - DNA, 13 bp, D. melanogaster
acatcatcattat

SEQ ID NO: 572382 - DNA, 14 bp, D. melanogaster
acatcatcgtcatc

SEQ ID NO: 572383 - DNA, 13 bp, D. melanogaster
acatcatctacat

SEQ ID NO: 572384 - DNA, 13 bp, D. melanogaster
acatcatgatttt

SEQ ID NO: 572385 - DNA, 13 bp, D. melanogaster
acatcattaaaat

SEQ ID NO: 572386 - DNA, 13 bp, D. melanogaster
acatcattatcat

SEQ ID NO: 572387 - DNA, 13 bp, D. melanogaster
acatcattatttt

SEQ ID NO: 572388 - DNA, 13 bp, D. melanogaster
acatcattctcaa

SEQ ID NO: 572389 - DNA, 13 bp, D. melanogaster
acatcattttgaa

SEQ ID NO: 572390 - DNA, 15 bp, D. melanogaster
acatcattttgaaaa

SEQ ID NO: 572391 - DNA, 13 bp, D. melanogaster
acatccaaatcaa

SEQ ID NO: 572392 - DNA, 14 bp, D. melanogaster
acatccaaatcaag

SEQ ID NO: 572393 - DNA, 14 bp, D. melanogaster
acatccaatcattt

SEQ ID NO: 572394 - DNA, 13 bp, D. melanogaster
acatccacagcca

SEQ ID NO: 572395 - DNA, 14 bp, D. melanogaster
acatccacatccag

SEQ ID NO: 572396 - DNA, 13 bp, D. melanogaster
acatccaccagct

SEQ ID NO: 572397 - DNA, 13 bp, D. melanogaster
acatccactctgt

SEQ ID NO: 572398 - DNA, 15 bp, D. melanogaster
acatccacttggatt

SEQ ID NO: 572399 - DNA, 13 bp, D. melanogaster
acatccagaaaaa

SEQ ID NO: 572400 - DNA, 13 bp, D. melanogaster
acatccagggaaa

SEQ ID NO: 572401 - DNA, 13 bp, D. melanogaster
acatccagtaatg

SEQ ID NO: 572402 - DNA, 13 bp, D. melanogaster
acatccagttagc

SEQ ID NO: 572403 - DNA, 13 bp, D. melanogaster
acatccatatgta

SEQ ID NO: 572404 - DNA, 13 bp, D. melanogaster
acatccatccaca

SEQ ID NO: 572405 - DNA, 13 bp, D. melanogaster
acatccgcacctc

SEQ ID NO: 572406 - DNA, 13 bp, D. melanogaster
acatccgcatcca

SEQ ID NO: 572407 - DNA, 13 bp, D. melanogaster
acatccgcatccg

SEQ ID NO: 572408 - DNA, 14 bp, D. melanogaster
acatccgcatccgc

SEQ ID NO: 572409 - DNA, 13 bp, D. melanogaster
acatccgctgccg

SEQ ID NO: 572410 - DNA, 13 bp, D. melanogaster
acatcctcatcct

SEQ ID NO: 572411 - DNA, 14 bp, D. melanogaster
acatcctcatcctc

SEQ ID NO: 572412 - DNA, 13 bp, D. melanogaster
acatcctccttga

SEQ ID NO: 572413 - DNA, 13 bp, D. melanogaster
acatcctgaatgc

SEQ ID NO: 572414 - DNA, 13 bp, D. melanogaster
acatccttgcatg

SEQ ID NO: 572415 - DNA, 13 bp, D. melanogaster
acatcctttaaag

SEQ ID NO: 572416 - DNA, 13 bp, D. melanogaster
acatcgaacgcga

SEQ ID NO: 572417 - DNA, 13 bp, D. melanogaster
acatcgaactact

SEQ ID NO: 572418 - DNA, 14 bp, D. melanogaster
acatcgacatcgac

SEQ ID NO: 572419 - DNA, 13 bp, D. melanogaster
acatcgacatttt

SEQ ID NO: 572420 - DNA, 13 bp, D. melanogaster
acatcgacgtaat

SEQ ID NO: 572421 - DNA, 13 bp, D. melanogaster
acatcgattcaat

SEQ ID NO: 572422 - DNA, 13 bp, D. melanogaster
acatcgcaggaac

SEQ ID NO: 572423 - DNA, 13 bp, D. melanogaster
acatcgccatcgc

SEQ ID NO: 572424 - DNA, 13 bp, D. melanogaster
acatcggaggatc

SEQ ID NO: 572425 - DNA, 13 bp, D. melanogaster
acatcggatcagg

SEQ ID NO: 572426 - DNA, 13 bp, D. melanogaster
acatcgtcaaaat

SEQ ID NO: 572427 - DNA, 13 bp, D. melanogaster
acatcgtcagcaa

SEQ ID NO: 572428 - DNA, 13 bp, D. melanogaster
acatcgtccacat

SEQ ID NO: 572429 - DNA, 13 bp, D. melanogaster
acatcgttaaata

SEQ ID NO: 572430 - DNA, 13 bp, D. melanogaster
acatctaatgagt

SEQ ID NO: 572431 - DNA, 13 bp, D. melanogaster
acatctacatcca

SEQ ID NO: 572432 - DNA, 13 bp, D. melanogaster
acatctccatctc

SEQ ID NO: 572433 - DNA, 13 bp, D. melanogaster
acatctgcatctg

SEQ ID NO: 572434 - DNA, 13 bp, D. melanogaster
acatctgcctatc

SEQ ID NO: 572435 - DNA, 13 bp, D. melanogaster
acatcttaaactt

SEQ ID NO: 572436 - DNA, 13 bp, D. melanogaster
acatcttcgcatt

SEQ ID NO: 572437 - DNA, 13 bp, D. melanogaster
acatcttttccaa

SEQ ID NO: 572438 - DNA, 13 bp, D. melanogaster
acatgaaaaatac

SEQ ID NO: 572439 - DNA, 14 bp, D. melanogaster
acatgaaaaatact

SEQ ID NO: 572440 - DNA, 13 bp, D. melanogaster
acatgaaaatgaa

SEQ ID NO: 572441 - DNA, 13 bp, D. melanogaster
acatgaaaatgga

SEQ ID NO: 572442 - DNA, 13 bp, D. melanogaster
acatgaaaattaa

SEQ ID NO: 572443 - DNA, 13 bp, D. melanogaster
acatgaaaattgc

SEQ ID NO: 572444 - DNA, 14 bp, D. melanogaster
acatgaaacgtttt

SEQ ID NO: 572445 - DNA, 13 bp, D. melanogaster
acatgaaattcat

SEQ ID NO: 572446 - DNA, 13 bp, D. melanogaster
acatgaacacgaa

SEQ ID NO: 572447 - DNA, 13 bp, D. melanogaster
acatgaagaactt

SEQ ID NO: 572448 - DNA, 13 bp, D. melanogaster
acatgaatattaa

SEQ ID NO: 572449 - DNA, 14 bp, D. melanogaster
acatgaatttcatg

SEQ ID NO: 572450 - DNA, 13 bp, D. melanogaster
acatgaatttgat

SEQ ID NO: 572451 - DNA, 14 bp, D. melanogaster
acatgacacacaca

SEQ ID NO: 572452 - DNA, 13 bp, D. melanogaster
acatgacatgaca

SEQ ID NO: 572453 - DNA, 13 bp, D. melanogaster
acatgagtcagtc

SEQ ID NO: 572454 - DNA, 13 bp, D. melanogaster
acatgataataaa

SEQ ID NO: 572455 - DNA, 13 bp, D. melanogaster
acatgatcaccca

SEQ ID NO: 572456 - DNA, 13 bp, D. melanogaster
acatgatgatcca

SEQ ID NO: 572457 - DNA, 13 bp, D. melanogaster
acatgatgatgat

SEQ ID NO: 572458 - DNA, 13 bp, D. melanogaster
acatgattccatt

SEQ ID NO: 572459 - DNA, 13 bp, D. melanogaster
acatgattgaagt

SEQ ID NO: 572460 - DNA, 13 bp, D. melanogaster
acatgcaaaacat

SEQ ID NO: 572461 - DNA, 13 bp, D. melanogaster
acatgcaaacaaa

SEQ ID NO: 572462 - DNA, 13 bp, D. melanogaster
acatgcaaatgca

SEQ ID NO: 572463 - DNA, 13 bp, D. melanogaster
acatgcaaatgga

SEQ ID NO: 572464 - DNA, 13 bp, D. melanogaster
acatgcaaatggc

SEQ ID NO: 572465 - DNA, 13 bp, D. melanogaster
acatgcaacaaaa

SEQ ID NO: 572466 - DNA, 13 bp, D. melanogaster
acatgcaacaaca

SEQ ID NO: 572467 - DNA, 13 bp, D. melanogaster
acatgcaacacat

SEQ ID NO: 572468 - DNA, 13 bp, D. melanogaster
acatgcaacattt

SEQ ID NO: 572469 - DNA, 13 bp, D. melanogaster
acatgcaactgca

SEQ ID NO: 572470 - DNA, 13 bp, D. melanogaster
acatgcaataaaa

SEQ ID NO: 572471 - DNA, 13 bp, D. melanogaster
acatgcaatacca

SEQ ID NO: 572472 - DNA, 13 bp, D. melanogaster
acatgcaatttaa

SEQ ID NO: 572473 - DNA, 13 bp, D. melanogaster
acatgcacaaaca

SEQ ID NO: 572474 - DNA, 13 bp, D. melanogaster
acatgcacacaca

SEQ ID NO: 572475 - DNA, 14 bp, D. melanogaster
acatgcacacacat

SEQ ID NO: 572476 - DNA, 13 bp, D. melanogaster
acatgcacacatg

SEQ ID NO: 572477 - DNA, 13 bp, D. melanogaster
acatgcacataaa

SEQ ID NO: 572478 - DNA, 13 bp, D. melanogaster
acatgcacatcca

SEQ ID NO: 572479 - DNA, 13 bp, D. melanogaster
acatgcacatgca

SEQ ID NO: 572480 - DNA, 13 bp, D. melanogaster
acatgcacttaca

SEQ ID NO: 572481 - DNA, 13 bp, D. melanogaster
acatgcagatgca

SEQ ID NO: 572482 - DNA, 13 bp, D. melanogaster
acatgcagcagca

SEQ ID NO: 572483 - DNA, 13 bp, D. melanogaster
acatgcagcatgc

SEQ ID NO: 572484 - DNA, 13 bp, D. melanogaster
acatgcataaaca

SEQ ID NO: 572485 - DNA, 13 bp, D. melanogaster
acatgcataaata

SEQ ID NO: 572486 - DNA, 13 bp, D. melanogaster
acatgcatacaaa

SEQ ID NO: 572487 - DNA, 13 bp, D. melanogaster
acatgcatacata

SEQ ID NO: 572488 - DNA, 14 bp, D. melanogaster
acatgcatatgcat

SEQ ID NO: 572489 - DNA, 13 bp, D. melanogaster
acatgcatattta

SEQ ID NO: 572490 - DNA, 13 bp, D. melanogaster
acatgcatatttg

SEQ ID NO: 572491 - DNA, 13 bp, D. melanogaster
acatgcatatttt

SEQ ID NO: 572492 - DNA, 13 bp, D. melanogaster
acatgcattaaaa

SEQ ID NO: 572493 - DNA, 13 bp, D. melanogaster
acatgcatttaat

SEQ ID NO: 572494 - DNA, 13 bp, D. melanogaster
acatgccaatgaa

SEQ ID NO: 572495 - DNA, 14 bp, D. melanogaster
acatgccaatgaaa

SEQ ID NO: 572496 - DNA, 13 bp, D. melanogaster
acatgccacaaat

SEQ ID NO: 572497 - DNA, 13 bp, D. melanogaster
acatgccacatgc

SEQ ID NO: 572498 - DNA, 14 bp, D. melanogaster
acatgccacgcccc

SEQ ID NO: 572499 - DNA, 13 bp, D. melanogaster
acatgccacttgc

SEQ ID NO: 572500 - DNA, 13 bp, D. melanogaster
acatgcctcgctc

SEQ ID NO: 572501 - DNA, 13 bp, D. melanogaster
acatgcctggaac

SEQ ID NO: 572502 - DNA, 13 bp, D. melanogaster
acatgctgcaaac

SEQ ID NO: 572503 - DNA, 14 bp, D. melanogaster
acatgcttaaaaat

SEQ ID NO: 572504 - DNA, 13 bp, D. melanogaster
acatggaaaattg

SEQ ID NO: 572505 - DNA, 13 bp, D. melanogaster
acatggaaatgtt

SEQ ID NO: 572506 - DNA, 13 bp, D. melanogaster
acatggaatggct

SEQ ID NO: 572507 - DNA, 13 bp, D. melanogaster
acatggaattggc

SEQ ID NO: 572508 - DNA, 13 bp, D. melanogaster
acatggagaaaaa

SEQ ID NO: 572509 - DNA, 13 bp, D. melanogaster
acatggagaagaa

SEQ ID NO: 572510 - DNA, 13 bp, D. melanogaster
acatggatgccaa

SEQ ID NO: 572511 - DNA, 13 bp, D. melanogaster
acatggatttgaa

SEQ ID NO: 572512 - DNA, 13 bp, D. melanogaster
acatggcacacat

SEQ ID NO: 572513 - DNA, 13 bp, D. melanogaster
acatggcacatgg

SEQ ID NO: 572514 - DNA, 13 bp, D. melanogaster
acatggccaaaac

SEQ ID NO: 572515 - DNA, 13 bp, D. melanogaster
acatggccaaaat

SEQ ID NO: 572516 - DNA, 13 bp, D. melanogaster
acatggccaacag

SEQ ID NO: 572517 - DNA, 13 bp, D. melanogaster
acatggccaagtg

SEQ ID NO: 572518 - DNA, 13 bp, D. melanogaster
acatggccagatc

SEQ ID NO: 572519 - DNA, 14 bp, D. melanogaster
acatggccagatcg

SEQ ID NO: 572520 - DNA, 13 bp, D. melanogaster
acatggccagcaa

SEQ ID NO: 572521 - DNA, 13 bp, D. melanogaster
acatggccagttc

SEQ ID NO: 572522 - DNA, 14 bp, D. melanogaster
acatggccagttcg

SEQ ID NO: 572523 - DNA, 13 bp, D. melanogaster
acatggccataaa

SEQ ID NO: 572524 - DNA, 13 bp, D. melanogaster
acatggcgagtga

SEQ ID NO: 572525 - DNA, 13 bp, D. melanogaster
acatggcgcaggc

SEQ ID NO: 572526 - DNA, 13 bp, D. melanogaster
acatggcgtatga

SEQ ID NO: 572527 - DNA, 14 bp, D. melanogaster
acatggcgtatgag

SEQ ID NO: 572528 - DNA, 14 bp, D. melanogaster
acatggcgtatgtg

SEQ ID NO: 572529 - DNA, 13 bp, D. melanogaster
acatgggcaaaaa

SEQ ID NO: 572530 - DNA, 14 bp, D. melanogaster
acatgggtcaacaa

SEQ ID NO: 572531 - DNA, 13 bp, D. melanogaster
acatggtacatat

SEQ ID NO: 572532 - DNA, 13 bp, D. melanogaster
acatggtcaagtt

SEQ ID NO: 572533 - DNA, 14 bp, D. melanogaster
acatggtcaccgcc

SEQ ID NO: 572534 - DNA, 13 bp, D. melanogaster
acatggttttctt

SEQ ID NO: 572535 - DNA, 13 bp, D. melanogaster
acatgtaaattaa

SEQ ID NO: 572536 - DNA, 13 bp, D. melanogaster
acatgtaatttaa

SEQ ID NO: 572537 - DNA, 13 bp, D. melanogaster
acatgtacacaca

SEQ ID NO: 572538 - DNA, 13 bp, D. melanogaster
acatgtacataaa

SEQ ID NO: 572539 - DNA, 14 bp, D. melanogaster
acatgtacatatac

SEQ ID NO: 572540 - DNA, 13 bp, D. melanogaster
acatgtacatatg

SEQ ID NO: 572541 - DNA, 13 bp, D. melanogaster
acatgtacatgta

SEQ ID NO: 572542 - DNA, 13 bp, D. melanogaster
acatgtataaata

SEQ ID NO: 572543 - DNA, 14 bp, D. melanogaster
acatgtatatatat

SEQ ID NO: 572544 - DNA, 13 bp, D. melanogaster
acatgtatgtata

SEQ ID NO: 572545 - DNA, 14 bp, D. melanogaster
acatgtatgtatat

SEQ ID NO: 572546 - DNA, 13 bp, D. melanogaster
acatgtatttaaa

SEQ ID NO: 572547 - DNA, 13 bp, D. melanogaster
acatgtatttata

SEQ ID NO: 572548 - DNA, 13 bp, D. melanogaster
acatgtccaaaaa

SEQ ID NO: 572549 - DNA, 13 bp, D. melanogaster
acatgtctttcaa

SEQ ID NO: 572550 - DNA, 13 bp, D. melanogaster
acatgtgcatata

SEQ ID NO: 572551 - DNA, 13 bp, D. melanogaster
acatgtgcatgtg

SEQ ID NO: 572552 - DNA, 13 bp, D. melanogaster
acatgtgtaattt

SEQ ID NO: 572553 - DNA, 13 bp, D. melanogaster
acatgtgtatgca

SEQ ID NO: 572554 - DNA, 13 bp, D. melanogaster
acatgtgtatgta

SEQ ID NO: 572555 - DNA, 14 bp, D. melanogaster
acatgtgtgtcagt

SEQ ID NO: 572556 - DNA, 13 bp, D. melanogaster
acatgtgtgtgtg

SEQ ID NO: 572557 - DNA, 14 bp, D. melanogaster
acatgtgtgtgtgt

SEQ ID NO: 572558 - DNA, 13 bp, D. melanogaster
acatgttcgcaat

SEQ ID NO: 572559 - DNA, 13 bp, D. melanogaster
acatgttgcattt

SEQ ID NO: 572560 - DNA, 13 bp, D. melanogaster
acatgtttactta

SEQ ID NO: 572561 - DNA, 13 bp, D. melanogaster
acattaaaaacgt

SEQ ID NO: 572562 - DNA, 13 bp, D. melanogaster
acattaaaaagga

SEQ ID NO: 572563 - DNA, 13 bp, D. melanogaster
acattaaaagtgt

SEQ ID NO: 572564 - DNA, 13 bp, D. melanogaster
acattaaaatgaa

SEQ ID NO: 572565 - DNA, 13 bp, D. melanogaster
acattaaaatgcc

SEQ ID NO: 572566 - DNA, 13 bp, D. melanogaster
acattaaagttac

SEQ ID NO: 572567 - DNA, 13 bp, D. melanogaster
acattaaagtttt

SEQ ID NO: 572568 - DNA, 13 bp, D. melanogaster
acattaaatcaag

SEQ ID NO: 572569 - DNA, 13 bp, D. melanogaster
acattaaatgaaa

SEQ ID NO: 572570 - DNA, 13 bp, D. melanogaster
acattaaatgcaa

SEQ ID NO: 572571 - DNA, 13 bp, D. melanogaster
acattaacaattt

SEQ ID NO: 572572 - DNA, 13 bp, D. melanogaster
acattaacattaa

SEQ ID NO: 572573 - DNA, 13 bp, D. melanogaster
acattaagacgac

SEQ ID NO: 572574 - DNA, 14 bp, D. melanogaster
acattaagacttaa

SEQ ID NO: 572575 - DNA, 13 bp, D. melanogaster
acattaatttcaa

SEQ ID NO: 572576 - DNA, 13 bp, D. melanogaster
acattaattttga

SEQ ID NO: 572577 - DNA, 14 bp, D. melanogaster
acattaattttgaa

SEQ ID NO: 572578 - DNA, 13 bp, D. melanogaster
acattacacacac

SEQ ID NO: 572579 - DNA, 13 bp, D. melanogaster
acattacacattt

SEQ ID NO: 572580 - DNA, 13 bp, D. melanogaster
acattacattgag

SEQ ID NO: 572581 - DNA, 14 bp, D. melanogaster
acattacgcatacg

SEQ ID NO: 572582 - DNA, 13 bp, D. melanogaster
acattacgtatac

SEQ ID NO: 572583 - DNA, 13 bp, D. melanogaster
acattacttgttt

SEQ ID NO: 572584 - DNA, 13 bp, D. melanogaster
acattaggaacaa

SEQ ID NO: 572585 - DNA, 13 bp, D. melanogaster
acattatacatat

SEQ ID NO: 572586 - DNA, 13 bp, D. melanogaster
acattatagaaat

SEQ ID NO: 572587 - DNA, 13 bp, D. melanogaster
acattatatatac

SEQ ID NO: 572588 - DNA, 13 bp, D. melanogaster
acattatatgtat

SEQ ID NO: 572589 - DNA, 13 bp, D. melanogaster
acattatgtattt

SEQ ID NO: 572590 - DNA, 13 bp, D. melanogaster
acattatgtcgtt

SEQ ID NO: 572591 - DNA, 13 bp, D. melanogaster
acattattacatt

SEQ ID NO: 572592 - DNA, 13 bp, D. melanogaster
acattattatcat

SEQ ID NO: 572593 - DNA, 13 bp, D. melanogaster
acattattgaaat

SEQ ID NO: 572594 - DNA, 13 bp, D. melanogaster
acattatttttag

SEQ ID NO: 572595 - DNA, 13 bp, D. melanogaster
acattcaaaatat

SEQ ID NO: 572596 - DNA, 13 bp, D. melanogaster
acattcaaatgca

SEQ ID NO: 572597 - DNA, 13 bp, D. melanogaster
acattcaaattca

SEQ ID NO: 572598 - DNA, 13 bp, D. melanogaster
acattcaaccatt

SEQ ID NO: 572599 - DNA, 13 bp, D. melanogaster
acattcaactttt

SEQ ID NO: 572600 - DNA, 13 bp, D. melanogaster
acattcaaggcat

SEQ ID NO: 572601 - DNA, 14 bp, D. melanogaster
acattcaaggcata

SEQ ID NO: 572602 - DNA, 13 bp, D. melanogaster
acattcaatattt

SEQ ID NO: 572603 - DNA, 13 bp, D. melanogaster
acattcaattcaa

SEQ ID NO: 572604 - DNA, 13 bp, D. melanogaster
acattcacacaca

SEQ ID NO: 572605 - DNA, 14 bp, D. melanogaster
acattcacacacac

SEQ ID NO: 572606 - DNA, 13 bp, D. melanogaster
acattcacattca

SEQ ID NO: 572607 - DNA, 13 bp, D. melanogaster
acattcacattcg

SEQ ID NO: 572608 - DNA, 13 bp, D. melanogaster
acattcacattta

SEQ ID NO: 572609 - DNA, 13 bp, D. melanogaster
acattcagattct

SEQ ID NO: 572610 - DNA, 13 bp, D. melanogaster
acattcatacata

SEQ ID NO: 572611 - DNA, 13 bp, D. melanogaster
acattcatattta

SEQ ID NO: 572612 - DNA, 14 bp, D. melanogaster
acattccaaaaaat

SEQ ID NO: 572613 - DNA, 13 bp, D. melanogaster
acattccagttct

SEQ ID NO: 572614 - DNA, 13 bp, D. melanogaster
acattcccattcc

SEQ ID NO: 572615 - DNA, 13 bp, D. melanogaster
acattccccattt

SEQ ID NO: 572616 - DNA, 13 bp, D. melanogaster
acattcgcatttt

SEQ ID NO: 572617 - DNA, 13 bp, D. melanogaster
acattcgctgttg

SEQ ID NO: 572618 - DNA, 13 bp, D. melanogaster
acattcgcttaag

SEQ ID NO: 572619 - DNA, 14 bp, D. melanogaster
acattctatttgaa

SEQ ID NO: 572620 - DNA, 13 bp, D. melanogaster
acattctcttaaa

SEQ ID NO: 572621 - DNA, 14 bp, D. melanogaster
acattctgcaaaat

SEQ ID NO: 572622 - DNA, 13 bp, D. melanogaster
acattctgcagtt

SEQ ID NO: 572623 - DNA, 13 bp, D. melanogaster
acattctggcaac

SEQ ID NO: 572624 - DNA, 13 bp, D. melanogaster
acattcttaaaaa

SEQ ID NO: 572625 - DNA, 13 bp, D. melanogaster
acattcttatctc

SEQ ID NO: 572626 - DNA, 13 bp, D. melanogaster
acattcttcagtt

SEQ ID NO: 572627 - DNA, 13 bp, D. melanogaster
acattctttaaaa

SEQ ID NO: 572628 - DNA, 13 bp, D. melanogaster
acattcttttgtt

SEQ ID NO: 572629 - DNA, 13 bp, D. melanogaster
acattgaaaaaat

SEQ ID NO: 572630 - DNA, 13 bp, D. melanogaster
acattgaaaacaa

SEQ ID NO: 572631 - DNA, 13 bp, D. melanogaster
acattgaaaagaa

SEQ ID NO: 572632 - DNA, 13 bp, D. melanogaster
acattgaaaagat

SEQ ID NO: 572633 - DNA, 13 bp, D. melanogaster
acattgaaaatgc

SEQ ID NO: 572634 - DNA, 13 bp, D. melanogaster
acattgaaagatt

SEQ ID NO: 572635 - DNA, 13 bp, D. melanogaster
acattgaaagcaa

SEQ ID NO: 572636 - DNA, 13 bp, D. melanogaster
acattgaaattta

SEQ ID NO: 572637 - DNA, 13 bp, D. melanogaster
acattgaactaca

SEQ ID NO: 572638 - DNA, 13 bp, D. melanogaster
acattgaactgga

SEQ ID NO: 572639 - DNA, 13 bp, D. melanogaster
acattgaacttga

SEQ ID NO: 572640 - DNA, 13 bp, D. melanogaster
acattgagaaaaa

SEQ ID NO: 572641 - DNA, 13 bp, D. melanogaster
acattgatatatt

SEQ ID NO: 572642 - DNA, 13 bp, D. melanogaster
acattgatgccaa

SEQ ID NO: 572643 - DNA, 13 bp, D. melanogaster
acattgatttaat

SEQ ID NO: 572644 - DNA, 13 bp, D. melanogaster
acattgcaaaaat

SEQ ID NO: 572645 - DNA, 13 bp, D. melanogaster
acattgcaattta

SEQ ID NO: 572646 - DNA, 13 bp, D. melanogaster
acattgcagttga

SEQ ID NO: 572647 - DNA, 13 bp, D. melanogaster
acattgcatatat

SEQ ID NO: 572648 - DNA, 13 bp, D. melanogaster
acattgcattgca

SEQ ID NO: 572649 - DNA, 13 bp, D. melanogaster
acattgccattgc

SEQ ID NO: 572650 - DNA, 14 bp, D. melanogaster
acattgcgcatacg

SEQ ID NO: 572651 - DNA, 13 bp, D. melanogaster
acattgcgtatac

SEQ ID NO: 572652 - DNA, 14 bp, D. melanogaster
acattgcgtatacg

SEQ ID NO: 572653 - DNA, 13 bp, D. melanogaster
acattgcgtatgc

SEQ ID NO: 572654 - DNA, 14 bp, D. melanogaster
acattgcgtatgcg

SEQ ID NO: 572655 - DNA, 13 bp, D. melanogaster
acattgctcttca

SEQ ID NO: 572656 - DNA, 13 bp, D. melanogaster
acattgcttatat

SEQ ID NO: 572657 - DNA, 13 bp, D. melanogaster
acattggcattgt

SEQ ID NO: 572658 - DNA, 14 bp, D. melanogaster
acattggcgtttgt

SEQ ID NO: 572659 - DNA, 14 bp, D. melanogaster
acattgtaaataaa

SEQ ID NO: 572660 - DNA, 13 bp, D. melanogaster
acattgtacagga

SEQ ID NO: 572661 - DNA, 13 bp, D. melanogaster
acattgtatgtat

SEQ ID NO: 572662 - DNA, 13 bp, D. melanogaster
acattgtcatccc

SEQ ID NO: 572663 - DNA, 13 bp, D. melanogaster
acattgtgggcat

SEQ ID NO: 572664 - DNA, 14 bp, D. melanogaster
acattgtgggcatg

SEQ ID NO: 572665 - DNA, 13 bp, D. melanogaster
acattgttgccgc

SEQ ID NO: 572666 - DNA, 13 bp, D. melanogaster
acattgtttaatt

SEQ ID NO: 572667 - DNA, 13 bp, D. melanogaster
acattgttttgtt

SEQ ID NO: 572668 - DNA, 13 bp, D. melanogaster
acattgtttttaa

SEQ ID NO: 572669 - DNA, 13 bp, D. melanogaster
acattgtttttat

SEQ ID NO: 572670 - DNA, 13 bp, D. melanogaster
acatttaaaaaag

SEQ ID NO: 572671 - DNA, 13 bp, D. melanogaster
acatttaaaagaa

SEQ ID NO: 572672 - DNA, 13 bp, D. melanogaster
acatttaaaatct

SEQ ID NO: 572673 - DNA, 13 bp, D. melanogaster
acatttaaaatgc

SEQ ID NO: 572674 - DNA, 13 bp, D. melanogaster
acatttaaaattc

SEQ ID NO: 572675 - DNA, 13 bp, D. melanogaster
acatttaaacttt

SEQ ID NO: 572676 - DNA, 13 bp, D. melanogaster
acatttaaataga

SEQ ID NO: 572677 - DNA, 13 bp, D. melanogaster
acatttaaatcaa

SEQ ID NO: 572678 - DNA, 13 bp, D. melanogaster
acatttaacaata

SEQ ID NO: 572679 - DNA, 13 bp, D. melanogaster
acatttaacataa

SEQ ID NO: 572680 - DNA, 13 bp, D. melanogaster
acatttaagttaa

SEQ ID NO: 572681 - DNA, 13 bp, D. melanogaster
acatttaattgaa

SEQ ID NO: 572682 - DNA, 13 bp, D. melanogaster
acatttaattgca

SEQ ID NO: 572683 - DNA, 13 bp, D. melanogaster
acatttaattgtt

SEQ ID NO: 572684 - DNA, 13 bp, D. melanogaster
acatttaattttc

SEQ ID NO: 572685 - DNA, 13 bp, D. melanogaster
acatttacaaaat

SEQ ID NO: 572686 - DNA, 13 bp, D. melanogaster
acatttacaaaca

SEQ ID NO: 572687 - DNA, 14 bp, D. melanogaster
acatttacaaatac

SEQ ID NO: 572688 - DNA, 13 bp, D. melanogaster
acatttacaatat

SEQ ID NO: 572689 - DNA, 13 bp, D. melanogaster
acatttacacaca

SEQ ID NO: 572690 - DNA, 13 bp, D. melanogaster
acatttacagata

SEQ ID NO: 572691 - DNA, 14 bp, D. melanogaster
acatttacagatac

SEQ ID NO: 572692 - DNA, 13 bp, D. melanogaster
acatttacataca

SEQ ID NO: 572693 - DNA, 14 bp, D. melanogaster
acatttacatatat

SEQ ID NO: 572694 - DNA, 13 bp, D. melanogaster
acatttacattaa

SEQ ID NO: 572695 - DNA, 13 bp, D. melanogaster
acatttacatttt

SEQ ID NO: 572696 - DNA, 13 bp, D. melanogaster
acatttaccacaa

SEQ ID NO: 572697 - DNA, 13 bp, D. melanogaster
acatttacggaaa

SEQ ID NO: 572698 - DNA, 13 bp, D. melanogaster
acatttataaatg

SEQ ID NO: 572699 - DNA, 14 bp, D. melanogaster
acatttatacatat

SEQ ID NO: 572700 - DNA, 13 bp, D. melanogaster
acatttatactta

SEQ ID NO: 572701 - DNA, 13 bp, D. melanogaster
acatttatattgt

SEQ ID NO: 572702 - DNA, 13 bp, D. melanogaster
acatttatcaaaa

SEQ ID NO: 572703 - DNA, 13 bp, D. melanogaster
acatttatcattt

SEQ ID NO: 572704 - DNA, 13 bp, D. melanogaster
acatttatccatt

SEQ ID NO: 572705 - DNA, 13 bp, D. melanogaster
acatttatctgca

SEQ ID NO: 572706 - DNA, 13 bp, D. melanogaster
acatttatgaaat

SEQ ID NO: 572707 - DNA, 13 bp, D. melanogaster
acatttatgattt

SEQ ID NO: 572708 - DNA, 14 bp, D. melanogaster
acatttatgcaaat

SEQ ID NO: 572709 - DNA, 13 bp, D. melanogaster
acatttatggcgg

SEQ ID NO: 572710 - DNA, 14 bp, D. melanogaster
acatttatggcggg

SEQ ID NO: 572711 - DNA, 13 bp, D. melanogaster
acatttatgtttg

SEQ ID NO: 572712 - DNA, 13 bp, D. melanogaster
acatttattcatt

SEQ ID NO: 572713 - DNA, 13 bp, D. melanogaster
acatttattgaca

SEQ ID NO: 572714 - DNA, 13 bp, D. melanogaster
acatttattgcat

SEQ ID NO: 572715 - DNA, 13 bp, D. melanogaster
acatttatttcca

SEQ ID NO: 572716 - DNA, 13 bp, D. melanogaster
acatttatttcgc

SEQ ID NO: 572717 - DNA, 13 bp, D. melanogaster
acatttatttttg

SEQ ID NO: 572718 - DNA, 13 bp, D. melanogaster
acatttcaaaatt

SEQ ID NO: 572719 - DNA, 13 bp, D. melanogaster
acatttcaaatgt

SEQ ID NO: 572720 - DNA, 13 bp, D. melanogaster
acatttcaaattt

SEQ ID NO: 572721 - DNA, 13 bp, D. melanogaster
acatttcaattaa

SEQ ID NO: 572722 - DNA, 14 bp, D. melanogaster
acatttcaattaaa

SEQ ID NO: 572723 - DNA, 13 bp, D. melanogaster
acatttcaatttc

SEQ ID NO: 572724 - DNA, 13 bp, D. melanogaster
acatttcaatttg

SEQ ID NO: 572725 - DNA, 14 bp, D. melanogaster
acatttcaatttgc

SEQ ID NO: 572726 - DNA, 13 bp, D. melanogaster
acatttcacacat

SEQ ID NO: 572727 - DNA, 13 bp, D. melanogaster
acatttcacattt

SEQ ID NO: 572728 - DNA, 13 bp, D. melanogaster
acatttcactttt

SEQ ID NO: 572729 - DNA, 13 bp, D. melanogaster
acatttcataaat

SEQ ID NO: 572730 - DNA, 13 bp, D. melanogaster
acatttcatattc

SEQ ID NO: 572731 - DNA, 13 bp, D. melanogaster
acatttcatattt

SEQ ID NO: 572732 - DNA, 13 bp, D. melanogaster
acatttcattgca

SEQ ID NO: 572733 - DNA, 13 bp, D. melanogaster
acatttcattttc

SEQ ID NO: 572734 - DNA, 13 bp, D. melanogaster
acatttccacaaa

SEQ ID NO: 572735 - DNA, 13 bp, D. melanogaster
acatttccacatt

SEQ ID NO: 572736 - DNA, 13 bp, D. melanogaster
acatttccatcat

SEQ ID NO: 572737 - DNA, 14 bp, D. melanogaster
acatttccatgttt

SEQ ID NO: 572738 - DNA, 13 bp, D. melanogaster
acatttccatttt

SEQ ID NO: 572739 - DNA, 13 bp, D. melanogaster
acatttccccatt

SEQ ID NO: 572740 - DNA, 13 bp, D. melanogaster
acatttcgaattg

SEQ ID NO: 572741 - DNA, 13 bp, D. melanogaster
acatttcgaattt

SEQ ID NO: 572742 - DNA, 13 bp, D. melanogaster
acatttcgtgttt

SEQ ID NO: 572743 - DNA, 13 bp, D. melanogaster
acatttcgttttt

SEQ ID NO: 572744 - DNA, 14 bp, D. melanogaster
acatttctaaatgt

SEQ ID NO: 572745 - DNA, 14 bp, D. melanogaster
acatttctggcttc

SEQ ID NO: 572746 - DNA, 13 bp, D. melanogaster
acatttcttagta

SEQ ID NO: 572747 - DNA, 13 bp, D. melanogaster
acatttgaaaaat

SEQ ID NO: 572748 - DNA, 13 bp, D. melanogaster
acatttgaaaatc

SEQ ID NO: 572749 - DNA, 13 bp, D. melanogaster
acatttgaaagtc

SEQ ID NO: 572750 - DNA, 13 bp, D. melanogaster
acatttgaaattt

SEQ ID NO: 572751 - DNA, 13 bp, D. melanogaster
acatttgaatatt

SEQ ID NO: 572752 - DNA, 13 bp, D. melanogaster
acatttgataaca

SEQ ID NO: 572753 - DNA, 13 bp, D. melanogaster
acatttgataatt

SEQ ID NO: 572754 - DNA, 13 bp, D. melanogaster
acatttgatagtt

SEQ ID NO: 572755 - DNA, 13 bp, D. melanogaster
acatttgattgaa

SEQ ID NO: 572756 - DNA, 13 bp, D. melanogaster
acatttgcatatc

SEQ ID NO: 572757 - DNA, 13 bp, D. melanogaster
acatttgcatatg

SEQ ID NO: 572758 - DNA, 13 bp, D. melanogaster
acatttgcatgcg

SEQ ID NO: 572759 - DNA, 13 bp, D. melanogaster
acatttgcatttg

SEQ ID NO: 572760 - DNA, 14 bp, D. melanogaster
acatttgcatttga

SEQ ID NO: 572761 - DNA, 13 bp, D. melanogaster
acatttgccacat

SEQ ID NO: 572762 - DNA, 13 bp, D. melanogaster
acatttgccagcc

SEQ ID NO: 572763 - DNA, 13 bp, D. melanogaster
acatttggcaaac

SEQ ID NO: 572764 - DNA, 13 bp, D. melanogaster
acatttggccagc

SEQ ID NO: 572765 - DNA, 13 bp, D. melanogaster
acatttggccatt

SEQ ID NO: 572766 - DNA, 13 bp, D. melanogaster
acatttgtaatat

SEQ ID NO: 572767 - DNA, 13 bp, D. melanogaster
acatttgtcaaaa

SEQ ID NO: 572768 - DNA, 13 bp, D. melanogaster
acatttgtcaagc

SEQ ID NO: 572769 - DNA, 13 bp, D. melanogaster
acatttgtgaccc

SEQ ID NO: 572770 - DNA, 13 bp, D. melanogaster
acatttgtgtgtg

SEQ ID NO: 572771 - DNA, 13 bp, D. melanogaster
acatttgttaaat

SEQ ID NO: 572772 - DNA, 13 bp, D. melanogaster
acatttgttattt

SEQ ID NO: 572773 - DNA, 13 bp, D. melanogaster
acatttgttgttt

SEQ ID NO: 572774 - DNA, 13 bp, D. melanogaster
acatttgttttgg

SEQ ID NO: 572775 - DNA, 13 bp, D. melanogaster
acattttaaaatg

SEQ ID NO: 572776 - DNA, 13 bp, D. melanogaster
acattttaaagca

SEQ ID NO: 572777 - DNA, 13 bp, D. melanogaster
acattttaaatgg

SEQ ID NO: 572778 - DNA, 13 bp, D. melanogaster
acattttaaatgt

SEQ ID NO: 572779 - DNA, 13 bp, D. melanogaster
acattttaagtaa

SEQ ID NO: 572780 - DNA, 13 bp, D. melanogaster
acattttaagtat

SEQ ID NO: 572781 - DNA, 13 bp, D. melanogaster
acattttaataca

SEQ ID NO: 572782 - DNA, 13 bp, D. melanogaster
acattttaattac

SEQ ID NO: 572783 - DNA, 13 bp, D. melanogaster
acattttacaaaa

SEQ ID NO: 572784 - DNA, 13 bp, D. melanogaster
acattttacaata

SEQ ID NO: 572785 - DNA, 13 bp, D. melanogaster
acattttacataa

SEQ ID NO: 572786 - DNA, 13 bp, D. melanogaster
acattttacatac

SEQ ID NO: 572787 - DNA, 13 bp, D. melanogaster
acattttacatat

SEQ ID NO: 572788 - DNA, 14 bp, D. melanogaster
acattttacattta

SEQ ID NO: 572789 - DNA, 13 bp, D. melanogaster
acattttagaaat

SEQ ID NO: 572790 - DNA, 13 bp, D. melanogaster
acattttagtaaa

SEQ ID NO: 572791 - DNA, 13 bp, D. melanogaster
acattttagtatt

SEQ ID NO: 572792 - DNA, 13 bp, D. melanogaster
acattttagtttg

SEQ ID NO: 572793 - DNA, 13 bp, D. melanogaster
acattttataaac

SEQ ID NO: 572794 - DNA, 13 bp, D. melanogaster
acattttatagaa

SEQ ID NO: 572795 - DNA, 13 bp, D. melanogaster
acattttatagca

SEQ ID NO: 572796 - DNA, 14 bp, D. melanogaster
acattttatagttt

SEQ ID NO: 572797 - DNA, 13 bp, D. melanogaster
acattttatgttg

SEQ ID NO: 572798 - DNA, 13 bp, D. melanogaster
acattttattagc

SEQ ID NO: 572799 - DNA, 13 bp, D. melanogaster
acattttattcga

SEQ ID NO: 572800 - DNA, 13 bp, D. melanogaster
acattttattgaa

SEQ ID NO: 572801 - DNA, 13 bp, D. melanogaster
acattttattgtt

SEQ ID NO: 572802 - DNA, 14 bp, D. melanogaster
acattttatttgca

SEQ ID NO: 572803 - DNA, 13 bp, D. melanogaster
acattttatttgg

SEQ ID NO: 572804 - DNA, 13 bp, D. melanogaster
acattttatttgt

SEQ ID NO: 572805 - DNA, 13 bp, D. melanogaster
acattttcaaaaa

SEQ ID NO: 572806 - DNA, 14 bp, D. melanogaster
acattttcaaaaag

SEQ ID NO: 572807 - DNA, 13 bp, D. melanogaster
acattttcaaaca

SEQ ID NO: 572808 - DNA, 13 bp, D. melanogaster
acattttcaaata

SEQ ID NO: 572809 - DNA, 14 bp, D. melanogaster
acattttcaaatta

SEQ ID NO: 572810 - DNA, 13 bp, D. melanogaster
acattttcaatga

SEQ ID NO: 572811 - DNA, 13 bp, D. melanogaster
acattttcaatgt

SEQ ID NO: 572812 - DNA, 13 bp, D. melanogaster
acattttcaatta

SEQ ID NO: 572813 - DNA, 13 bp, D. melanogaster
acattttcacaaa

SEQ ID NO: 572814 - DNA, 14 bp, D. melanogaster
acattttcacattt

SEQ ID NO: 572815 - DNA, 13 bp, D. melanogaster
acattttcagttt

SEQ ID NO: 572816 - DNA, 13 bp, D. melanogaster
acattttcataaa

SEQ ID NO: 572817 - DNA, 13 bp, D. melanogaster
acattttcatata

SEQ ID NO: 572818 - DNA, 13 bp, D. melanogaster
acattttccaagc

SEQ ID NO: 572819 - DNA, 13 bp, D. melanogaster
acattttccacac

SEQ ID NO: 572820 - DNA, 13 bp, D. melanogaster
acattttccacat

SEQ ID NO: 572821 - DNA, 13 bp, D. melanogaster
acattttccagca

SEQ ID NO: 572822 - DNA, 13 bp, D. melanogaster
acattttccagga

SEQ ID NO: 572823 - DNA, 13 bp, D. melanogaster
acattttccataa

SEQ ID NO: 572824 - DNA, 13 bp, D. melanogaster
acattttcccaac

SEQ ID NO: 572825 - DNA, 13 bp, D. melanogaster
acattttcccaca

SEQ ID NO: 572826 - DNA, 13 bp, D. melanogaster
acattttccccat

SEQ ID NO: 572827 - DNA, 13 bp, D. melanogaster
acattttccgatt

SEQ ID NO: 572828 - DNA, 13 bp, D. melanogaster
acattttccgttt

SEQ ID NO: 572829 - DNA, 13 bp, D. melanogaster
acattttcctaaa

SEQ ID NO: 572830 - DNA, 13 bp, D. melanogaster
acattttcctgtt

SEQ ID NO: 572831 - DNA, 13 bp, D. melanogaster
acattttcgaatt

SEQ ID NO: 572832 - DNA, 14 bp, D. melanogaster
acattttcgaatta

SEQ ID NO: 572833 - DNA, 13 bp, D. melanogaster
acattttcgcatt

SEQ ID NO: 572834 - DNA, 13 bp, D. melanogaster
acattttcggttt

SEQ ID NO: 572835 - DNA, 13 bp, D. melanogaster
acattttcgtttg

SEQ ID NO: 572836 - DNA, 13 bp, D. melanogaster
acattttctatta

SEQ ID NO: 572837 - DNA, 14 bp, D. melanogaster
acattttctattag

SEQ ID NO: 572838 - DNA, 13 bp, D. melanogaster
acattttcttcaa

SEQ ID NO: 572839 - DNA, 13 bp, D. melanogaster
acattttcttgct

SEQ ID NO: 572840 - DNA, 13 bp, D. melanogaster
acattttgaaagc

SEQ ID NO: 572841 - DNA, 13 bp, D. melanogaster
acattttgaaata

SEQ ID NO: 572842 - DNA, 13 bp, D. melanogaster
acattttgaataa

SEQ ID NO: 572843 - DNA, 13 bp, D. melanogaster
acattttgaatat

SEQ ID NO: 572844 - DNA, 13 bp, D. melanogaster
acattttgacagc

SEQ ID NO: 572845 - DNA, 14 bp, D. melanogaster
acattttgacattt

SEQ ID NO: 572846 - DNA, 13 bp, D. melanogaster
acattttgataaa

SEQ ID NO: 572847 - DNA, 13 bp, D. melanogaster
acattttgattat

SEQ ID NO: 572848 - DNA, 13 bp, D. melanogaster
acattttgattta

SEQ ID NO: 572849 - DNA, 13 bp, D. melanogaster
acattttgatttc

SEQ ID NO: 572850 - DNA, 13 bp, D. melanogaster
acattttgcaaaa

SEQ ID NO: 572851 - DNA, 13 bp, D. melanogaster
acattttgcacat

SEQ ID NO: 572852 - DNA, 13 bp, D. melanogaster
acattttgcactt

SEQ ID NO: 572853 - DNA, 13 bp, D. melanogaster
acattttgcagat

SEQ ID NO: 572854 - DNA, 13 bp, D. melanogaster
acattttgcagct

SEQ ID NO: 572855 - DNA, 13 bp, D. melanogaster
acattttgcattc

SEQ ID NO: 572856 - DNA, 14 bp, D. melanogaster
acattttgcatttt

SEQ ID NO: 572857 - DNA, 13 bp, D. melanogaster
acattttgccagc

SEQ ID NO: 572858 - DNA, 13 bp, D. melanogaster
acattttgccgca

SEQ ID NO: 572859 - DNA, 13 bp, D. melanogaster
acattttgcggca

SEQ ID NO: 572860 - DNA, 14 bp, D. melanogaster
acattttgctttgc

SEQ ID NO: 572861 - DNA, 13 bp, D. melanogaster
acattttggaaaa

SEQ ID NO: 572862 - DNA, 13 bp, D. melanogaster
acattttggcaac

SEQ ID NO: 572863 - DNA, 13 bp, D. melanogaster
acattttggcagc

SEQ ID NO: 572864 - DNA, 13 bp, D. melanogaster
acattttggcatt

SEQ ID NO: 572865 - DNA, 13 bp, D. melanogaster
acattttggccac

SEQ ID NO: 572866 - DNA, 13 bp, D. melanogaster
acattttgtaaac

SEQ ID NO: 572867 - DNA, 13 bp, D. melanogaster
acattttgtaaat

SEQ ID NO: 572868 - DNA, 13 bp, D. melanogaster
acattttgtaata

SEQ ID NO: 572869 - DNA, 13 bp, D. melanogaster
acattttgtatta

SEQ ID NO: 572870 - DNA, 13 bp, D. melanogaster
acattttgtggaa

SEQ ID NO: 572871 - DNA, 13 bp, D. melanogaster
acattttgttaaa

SEQ ID NO: 572872 - DNA, 13 bp, D. melanogaster
acattttgtttat

SEQ ID NO: 572873 - DNA, 14 bp, D. melanogaster
acattttgtttata

SEQ ID NO: 572874 - DNA, 14 bp, D. melanogaster
acattttgtttatt

SEQ ID NO: 572875 - DNA, 13 bp, D. melanogaster
acattttgtttgg

SEQ ID NO: 572876 - DNA, 13 bp, D. melanogaster
acattttgttttc

SEQ ID NO: 572877 - DNA, 14 bp, D. melanogaster
acattttgttttcc

SEQ ID NO: 572878 - DNA, 13 bp, D. melanogaster
acatttttaaaag

SEQ ID NO: 572879 - DNA, 13 bp, D. melanogaster
acatttttaaact

SEQ ID NO: 572880 - DNA, 13 bp, D. melanogaster
acatttttaagaa

SEQ ID NO: 572881 - DNA, 13 bp, D. melanogaster
acatttttaagat

SEQ ID NO: 572882 - DNA, 13 bp, D. melanogaster
acatttttaatac

SEQ ID NO: 572883 - DNA, 13 bp, D. melanogaster
acatttttaatgt

SEQ ID NO: 572884 - DNA, 13 bp, D. melanogaster
acatttttaattg

SEQ ID NO: 572885 - DNA, 13 bp, D. melanogaster
acatttttacaac

SEQ ID NO: 572886 - DNA, 13 bp, D. melanogaster
acatttttacaga

SEQ ID NO: 572887 - DNA, 13 bp, D. melanogaster
acatttttacatt

SEQ ID NO: 572888 - DNA, 13 bp, D. melanogaster
acatttttaccaa

SEQ ID NO: 572889 - DNA, 13 bp, D. melanogaster
acatttttactta

SEQ ID NO: 572890 - DNA, 13 bp, D. melanogaster
acatttttagaaa

SEQ ID NO: 572891 - DNA, 13 bp, D. melanogaster
acatttttatcaa

SEQ ID NO: 572892 - DNA, 13 bp, D. melanogaster
acatttttatgtg

SEQ ID NO: 572893 - DNA, 13 bp, D. melanogaster
acatttttatgtt

SEQ ID NO: 572894 - DNA, 14 bp, D. melanogaster
acatttttattgcc

SEQ ID NO: 572895 - DNA, 13 bp, D. melanogaster
acatttttcaaaa

SEQ ID NO: 572896 - DNA, 13 bp, D. melanogaster
acatttttcaaat

SEQ ID NO: 572897 - DNA, 13 bp, D. melanogaster
acatttttcaact

SEQ ID NO: 572898 - DNA, 13 bp, D. melanogaster
acatttttcaatt

SEQ ID NO: 572899 - DNA, 13 bp, D. melanogaster
acatttttcacac

SEQ ID NO: 572900 - DNA, 13 bp, D. melanogaster
acatttttcagaa

SEQ ID NO: 572901 - DNA, 13 bp, D. melanogaster
acatttttcagtt

SEQ ID NO: 572902 - DNA, 13 bp, D. melanogaster
acatttttcataa

SEQ ID NO: 572903 - DNA, 13 bp, D. melanogaster
acatttttccaaa

SEQ ID NO: 572904 - DNA, 14 bp, D. melanogaster
acatttttccaaat

SEQ ID NO: 572905 - DNA, 13 bp, D. melanogaster
acatttttcccca

SEQ ID NO: 572906 - DNA, 13 bp, D. melanogaster
acatttttcgatt

SEQ ID NO: 572907 - DNA, 13 bp, D. melanogaster
acatttttctaat

SEQ ID NO: 572908 - DNA, 13 bp, D. melanogaster
acatttttctgca

SEQ ID NO: 572909 - DNA, 13 bp, D. melanogaster
acatttttctgga

SEQ ID NO: 572910 - DNA, 13 bp, D. melanogaster
acatttttcttaa

SEQ ID NO: 572911 - DNA, 13 bp, D. melanogaster
acatttttgaaat

SEQ ID NO: 572912 - DNA, 14 bp, D. melanogaster
acatttttgaattt

SEQ ID NO: 572913 - DNA, 13 bp, D. melanogaster
acatttttgataa

SEQ ID NO: 572914 - DNA, 13 bp, D. melanogaster
acatttttgatta

SEQ ID NO: 572915 - DNA, 13 bp, D. melanogaster
acatttttgcaac

SEQ ID NO: 572916 - DNA, 14 bp, D. melanogaster
acatttttgcattt

SEQ ID NO: 572917 - DNA, 13 bp, D. melanogaster
acatttttgctaa

SEQ ID NO: 572918 - DNA, 13 bp, D. melanogaster
acatttttgctga

SEQ ID NO: 572919 - DNA, 13 bp, D. melanogaster
acatttttgcttt

SEQ ID NO: 572920 - DNA, 13 bp, D. melanogaster
acatttttggcac

SEQ ID NO: 572921 - DNA, 13 bp, D. melanogaster
acatttttggcag

SEQ ID NO: 572922 - DNA, 13 bp, D. melanogaster
acatttttggtca

SEQ ID NO: 572923 - DNA, 13 bp, D. melanogaster
acatttttggttt

SEQ ID NO: 572924 - DNA, 14 bp, D. melanogaster
acatttttggtttc

SEQ ID NO: 572925 - DNA, 13 bp, D. melanogaster
acatttttgtatt

SEQ ID NO: 572926 - DNA, 13 bp, D. melanogaster
acatttttgtgaa

SEQ ID NO: 572927 - DNA, 13 bp, D. melanogaster
acatttttgtgct

SEQ ID NO: 572928 - DNA, 13 bp, D. melanogaster
acatttttgtggc

SEQ ID NO: 572929 - DNA, 14 bp, D. melanogaster
acatttttgttatt

SEQ ID NO: 572930 - DNA, 14 bp, D. melanogaster
acatttttgtttgt

SEQ ID NO: 572931 - DNA, 13 bp, D. melanogaster
acattttttaaac

SEQ ID NO: 572932 - DNA, 13 bp, D. melanogaster
acattttttatac

SEQ ID NO: 572933 - DNA, 13 bp, D. melanogaster
acattttttcaaa

SEQ ID NO: 572934 - DNA, 13 bp, D. melanogaster
acattttttctca

SEQ ID NO: 572935 - DNA, 13 bp, D. melanogaster
acattttttgata

SEQ ID NO: 572936 - DNA, 13 bp, D. melanogaster
acattttttgcaa

SEQ ID NO: 572937 - DNA, 13 bp, D. melanogaster
acattttttgctg

SEQ ID NO: 572938 - DNA, 13 bp, D. melanogaster
acattttttggca

SEQ ID NO: 572939 - DNA, 13 bp, D. melanogaster
acattttttggct

SEQ ID NO: 572940 - DNA, 13 bp, D. melanogaster
acattttttgtaa

SEQ ID NO: 572941 - DNA, 13 bp, D. melanogaster
acatttttttagt

SEQ ID NO: 572942 - DNA, 14 bp, D. melanogaster
acatttttttggtt

SEQ ID NO: 572943 - DNA, 13 bp, D. melanogaster
accaaaaaaatgt

SEQ ID NO: 572944 - DNA, 13 bp, D. melanogaster
accaaaaaatcga

SEQ ID NO: 572945 - DNA, 13 bp, D. melanogaster
accaaaaaatgtg

SEQ ID NO: 572946 - DNA, 14 bp, D. melanogaster
accaaaaacactgt

SEQ ID NO: 572947 - DNA, 13 bp, D. melanogaster
accaaaaacactt

SEQ ID NO: 572948 - DNA, 13 bp, D. melanogaster
accaaaaacattt

SEQ ID NO: 572949 - DNA, 13 bp, D. melanogaster
accaaaaactgtg

SEQ ID NO: 572950 - DNA, 14 bp, D. melanogaster
accaaaaactgtgc

SEQ ID NO: 572951 - DNA, 13 bp, D. melanogaster
accaaaaacttca

SEQ ID NO: 572952 - DNA, 14 bp, D. melanogaster
accaaaaacttcag

SEQ ID NO: 572953 - DNA, 13 bp, D. melanogaster
accaaaaactttg

SEQ ID NO: 572954 - DNA, 13 bp, D. melanogaster
accaaaaatatcg

SEQ ID NO: 572955 - DNA, 13 bp, D. melanogaster
accaaaaatattt

SEQ ID NO: 572956 - DNA, 14 bp, D. melanogaster
accaaaaatgcaaa

SEQ ID NO: 572957 - DNA, 13 bp, D. melanogaster
accaaaaatggtc

SEQ ID NO: 572958 - DNA, 13 bp, D. melanogaster
accaaaaatgttt

SEQ ID NO: 572959 - DNA, 13 bp, D. melanogaster
accaaaaattcca

SEQ ID NO: 572960 - DNA, 13 bp, D. melanogaster
accaaaacaaatg

SEQ ID NO: 572961 - DNA, 14 bp, D. melanogaster
accaaaacaaatgt

SEQ ID NO: 572962 - DNA, 13 bp, D. melanogaster
accaaaacatttt

SEQ ID NO: 572963 - DNA, 14 bp, D. melanogaster
accaaaacatttta

SEQ ID NO: 572964 - DNA, 14 bp, D. melanogaster
accaaaacccattt

SEQ ID NO: 572965 - DNA, 13 bp, D. melanogaster
accaaaataacgg

SEQ ID NO: 572966 - DNA, 13 bp, D. melanogaster
accaaaatatatg

SEQ ID NO: 572967 - DNA, 13 bp, D. melanogaster
accaaaatcgaaa

SEQ ID NO: 572968 - DNA, 13 bp, D. melanogaster
accaaaatgaata

SEQ ID NO: 572969 - DNA, 13 bp, D. melanogaster
accaaaatgaatg

SEQ ID NO: 572970 - DNA, 13 bp, D. melanogaster
accaaaatgcctt

SEQ ID NO: 572971 - DNA, 13 bp, D. melanogaster
accaaaatggaaa

SEQ ID NO: 572972 - DNA, 13 bp, D. melanogaster
accaaaattattg

SEQ ID NO: 572973 - DNA, 14 bp, D. melanogaster
accaaaattattgg

SEQ ID NO: 572974 - DNA, 13 bp, D. melanogaster
accaaaattgaaa

SEQ ID NO: 572975 - DNA, 13 bp, D. melanogaster
accaaaattgcca

SEQ ID NO: 572976 - DNA, 14 bp, D. melanogaster
accaaaattgccaa

SEQ ID NO: 572977 - DNA, 14 bp, D. melanogaster
accaaacaaaatgt

SEQ ID NO: 572978 - DNA, 13 bp, D. melanogaster
accaaacaaatga

SEQ ID NO: 572979 - DNA, 14 bp, D. melanogaster
accaaacaatccag

SEQ ID NO: 572980 - DNA, 13 bp, D. melanogaster
accaaacacaatt

SEQ ID NO: 572981 - DNA, 13 bp, D. melanogaster
accaaaccgaaat

SEQ ID NO: 572982 - DNA, 13 bp, D. melanogaster
accaaactgaaaa

SEQ ID NO: 572983 - DNA, 13 bp, D. melanogaster
accaaacttaaat

SEQ ID NO: 572984 - DNA, 13 bp, D. melanogaster
accaaagaaaccg

SEQ ID NO: 572985 - DNA, 13 bp, D. melanogaster
accaaagaaagtg

SEQ ID NO: 572986 - DNA, 13 bp, D. melanogaster
accaaagaaatag

SEQ ID NO: 572987 - DNA, 14 bp, D. melanogaster
accaaagaaatgca

SEQ ID NO: 572988 - DNA, 13 bp, D. melanogaster
accaaagaagtcc

SEQ ID NO: 572989 - DNA, 14 bp, D. melanogaster
accaaagacactag

SEQ ID NO: 572990 - DNA, 13 bp, D. melanogaster
accaaagcaaatt

SEQ ID NO: 572991 - DNA, 13 bp, D. melanogaster
accaaagctggtg

SEQ ID NO: 572992 - DNA, 13 bp, D. melanogaster
accaaaggaccaa

SEQ ID NO: 572993 - DNA, 13 bp, D. melanogaster
accaaagtcaaag

SEQ ID NO: 572994 - DNA, 13 bp, D. melanogaster
accaaataaaagt

SEQ ID NO: 572995 - DNA, 13 bp, D. melanogaster
accaaataaagat

SEQ ID NO: 572996 - DNA, 13 bp, D. melanogaster
accaaataaatag

SEQ ID NO: 572997 - DNA, 13 bp, D. melanogaster
accaaataaatgt

SEQ ID NO: 572998 - DNA, 13 bp, D. melanogaster
accaaatactgca

SEQ ID NO: 572999 - DNA, 13 bp, D. melanogaster
accaaatattatc

SEQ ID NO: 573000 - DNA, 13 bp, D. melanogaster
accaaatattttg

SEQ ID NO: 573001 - DNA, 13 bp, D. melanogaster
accaaatattttt

SEQ ID NO: 573002 - DNA, 13 bp, D. melanogaster
accaaatcaaatt

SEQ ID NO: 573003 - DNA, 13 bp, D. melanogaster
accaaatcaggag

SEQ ID NO: 573004 - DNA, 14 bp, D. melanogaster
accaaatcaggagc

SEQ ID NO: 573005 - DNA, 13 bp, D. melanogaster
accaaatccaaat

SEQ ID NO: 573006 - DNA, 13 bp, D. melanogaster
accaaatcctatt

SEQ ID NO: 573007 - DNA, 13 bp, D. melanogaster
accaaatcgaatc

SEQ ID NO: 573008 - DNA, 13 bp, D. melanogaster
accaaatgaaact

SEQ ID NO: 573009 - DNA, 13 bp, D. melanogaster
accaaatgaaatt

SEQ ID NO: 573010 - DNA, 14 bp, D. melanogaster
accaaatgaaattc

SEQ ID NO: 573011 - DNA, 13 bp, D. melanogaster
accaaatgaactg

SEQ ID NO: 573012 - DNA, 13 bp, D. melanogaster
accaaatgcaatt

SEQ ID NO: 573013 - DNA, 13 bp, D. melanogaster
accaaatggcaca

SEQ ID NO: 573014 - DNA, 13 bp, D. melanogaster
accaaatgtaaaa

SEQ ID NO: 573015 - DNA, 13 bp, D. melanogaster
accaaatgtataa

SEQ ID NO: 573016 - DNA, 14 bp, D. melanogaster
accaaatgtcccaa

SEQ ID NO: 573017 - DNA, 13 bp, D. melanogaster
accaaattattac

SEQ ID NO: 573018 - DNA, 13 bp, D. melanogaster
accaaattcaatt

SEQ ID NO: 573019 - DNA, 13 bp, D. melanogaster
accaaattccaag

SEQ ID NO: 573020 - DNA, 13 bp, D. melanogaster
accaaattgagag

SEQ ID NO: 573021 - DNA, 13 bp, D. melanogaster
accaaattgtatt

SEQ ID NO: 573022 - DNA, 13 bp, D. melanogaster
accaacaaattgc

SEQ ID NO: 573023 - DNA, 13 bp, D. melanogaster
accaacaaatttc

SEQ ID NO: 573024 - DNA, 13 bp, D. melanogaster
accaacaacggca

SEQ ID NO: 573025 - DNA, 13 bp, D. melanogaster
accaacaactgaa

SEQ ID NO: 573026 - DNA, 13 bp, D. melanogaster
accaacaagaaat

SEQ ID NO: 573027 - DNA, 14 bp, D. melanogaster
accaacaagaagtt

SEQ ID NO: 573028 - DNA, 13 bp, D. melanogaster
accaacacaatta

SEQ ID NO: 573029 - DNA, 13 bp, D. melanogaster
accaacacattta

SEQ ID NO: 573030 - DNA, 14 bp, D. melanogaster
accaacactaccta

SEQ ID NO: 573031 - DNA, 13 bp, D. melanogaster
accaacagaccag

SEQ ID NO: 573032 - DNA, 13 bp, D. melanogaster
accaacagatgcc

SEQ ID NO: 573033 - DNA, 13 bp, D. melanogaster
accaacatcagca

SEQ ID NO: 573034 - DNA, 13 bp, D. melanogaster
accaacattaaca

SEQ ID NO: 573035 - DNA, 13 bp, D. melanogaster
accaaccagattg

SEQ ID NO: 573036 - DNA, 13 bp, D. melanogaster
accaaccagccag

SEQ ID NO: 573037 - DNA, 13 bp, D. melanogaster
accaaccatccat

SEQ ID NO: 573038 - DNA, 14 bp, D. melanogaster
accaaccgaccgac

SEQ ID NO: 573039 - DNA, 13 bp, D. melanogaster
accaacgagtggt

SEQ ID NO: 573040 - DNA, 13 bp, D. melanogaster
accaacggaatta

SEQ ID NO: 573041 - DNA, 13 bp, D. melanogaster
accaacttaaaga

SEQ ID NO: 573042 - DNA, 13 bp, D. melanogaster
accaacttcaacg

SEQ ID NO: 573043 - DNA, 13 bp, D. melanogaster
accaagaaagtta

SEQ ID NO: 573044 - DNA, 13 bp, D. melanogaster
accaagcgaacag

SEQ ID NO: 573045 - DNA, 13 bp, D. melanogaster
accaagctcttta

SEQ ID NO: 573046 - DNA, 14 bp, D. melanogaster
accaagctctttaa

SEQ ID NO: 573047 - DNA, 13 bp, D. melanogaster
accaaggacaacc

SEQ ID NO: 573048 - DNA, 13 bp, D. melanogaster
accaaggaccaaa

SEQ ID NO: 573049 - DNA, 13 bp, D. melanogaster
accaaggtccagg

SEQ ID NO: 573050 - DNA, 13 bp, D. melanogaster
accaagtctctgt

SEQ ID NO: 573051 - DNA, 13 bp, D. melanogaster
accaataaatgaa

SEQ ID NO: 573052 - DNA, 13 bp, D. melanogaster
accaatacaatta

SEQ ID NO: 573053 - DNA, 13 bp, D. melanogaster
accaataccaata

SEQ ID NO: 573054 - DNA, 14 bp, D. melanogaster
accaataccaatac

SEQ ID NO: 573055 - DNA, 13 bp, D. melanogaster
accaataccaatg

SEQ ID NO: 573056 - DNA, 14 bp, D. melanogaster
accaatagcaaata

SEQ ID NO: 573057 - DNA, 13 bp, D. melanogaster
accaatatatgcc

SEQ ID NO: 573058 - DNA, 13 bp, D. melanogaster
accaatcccaatc

SEQ ID NO: 573059 - DNA, 13 bp, D. melanogaster
accaatcgaatgc

SEQ ID NO: 573060 - DNA, 13 bp, D. melanogaster
accaatctagctt

SEQ ID NO: 573061 - DNA, 13 bp, D. melanogaster
accaatctggacc

SEQ ID NO: 573062 - DNA, 13 bp, D. melanogaster
accaatggtatca

SEQ ID NO: 573063 - DNA, 13 bp, D. melanogaster
accaattccaaat

SEQ ID NO: 573064 - DNA, 13 bp, D. melanogaster
accaattcgaatt

SEQ ID NO: 573065 - DNA, 14 bp, D. melanogaster
accaattgagaaca

SEQ ID NO: 573066 - DNA, 13 bp, D. melanogaster
accaatttaaaat

SEQ ID NO: 573067 - DNA, 13 bp, D. melanogaster
accaatttaaata

SEQ ID NO: 573068 - DNA, 13 bp, D. melanogaster
accaatttataaa

SEQ ID NO: 573069 - DNA, 13 bp, D. melanogaster
accaatttgattg

SEQ ID NO: 573070 - DNA, 13 bp, D. melanogaster
accaatttgcata

SEQ ID NO: 573071 - DNA, 13 bp, D. melanogaster
accaatttggatt

SEQ ID NO: 573072 - DNA, 13 bp, D. melanogaster
accacaaaaatgc

SEQ ID NO: 573073 - DNA, 13 bp, D. melanogaster
accacaaaatgca

SEQ ID NO: 573074 - DNA, 13 bp, D. melanogaster
accacaattcaat

SEQ ID NO: 573075 - DNA, 13 bp, D. melanogaster
accacagcatgtt

SEQ ID NO: 573076 - DNA, 13 bp, D. melanogaster
accacagctgcag

SEQ ID NO: 573077 - DNA, 13 bp, D. melanogaster
accacatccacat

SEQ ID NO: 573078 - DNA, 14 bp, D. melanogaster
accacatccacatc

SEQ ID NO: 573079 - DNA, 13 bp, D. melanogaster
accacatgaccca

SEQ ID NO: 573080 - DNA, 13 bp, D. melanogaster
accacattggccg

SEQ ID NO: 573081 - DNA, 13 bp, D. melanogaster
accaccacaattt

SEQ ID NO: 573082 - DNA, 13 bp, D. melanogaster
accaccactattt

SEQ ID NO: 573083 - DNA, 13 bp, D. melanogaster
accaccagatcaa

SEQ ID NO: 573084 - DNA, 13 bp, D. melanogaster
accaccagcaata

SEQ ID NO: 573085 - DNA, 14 bp, D. melanogaster
accaccagcaataa

SEQ ID NO: 573086 - DNA, 14 bp, D. melanogaster
accaccatcatcat

SEQ ID NO: 573087 - DNA, 13 bp, D. melanogaster
accaccattcagt

SEQ ID NO: 573088 - DNA, 13 bp, D. melanogaster
accacccactgcc

SEQ ID NO: 573089 - DNA, 13 bp, D. melanogaster
accaccgcccact

SEQ ID NO: 573090 - DNA, 13 bp, D. melanogaster
accacctcgtcct

SEQ ID NO: 573091 - DNA, 14 bp, D. melanogaster
accacctcgtcctc

SEQ ID NO: 573092 - DNA, 13 bp, D. melanogaster
accacgaagttgt

SEQ ID NO: 573093 - DNA, 13 bp, D. melanogaster
accacgatgtgat

SEQ ID NO: 573094 - DNA, 13 bp, D. melanogaster
accacgcccacat

SEQ ID NO: 573095 - DNA, 13 bp, D. melanogaster
accacgcccactc

SEQ ID NO: 573096 - DNA, 14 bp, D. melanogaster
accacgcccactca

SEQ ID NO: 573097 - DNA, 13 bp, D. melanogaster
accacgcccactt

SEQ ID NO: 573098 - DNA, 13 bp, D. melanogaster
accacgccccctt

SEQ ID NO: 573099 - DNA, 13 bp, D. melanogaster
accactactacta

SEQ ID NO: 573100 - DNA, 13 bp, D. melanogaster
accactatacaca

SEQ ID NO: 573101 - DNA, 13 bp, D. melanogaster
accactattacgg

SEQ ID NO: 573102 - DNA, 14 bp, D. melanogaster
accactatttttac

SEQ ID NO: 573103 - DNA, 13 bp, D. melanogaster
accactcccgaaa

SEQ ID NO: 573104 - DNA, 13 bp, D. melanogaster
accactcgagtat

SEQ ID NO: 573105 - DNA, 13 bp, D. melanogaster
accactgaaccac

SEQ ID NO: 573106 - DNA, 14 bp, D. melanogaster
accactgaaccacc

SEQ ID NO: 573107 - DNA, 13 bp, D. melanogaster
accactgagccac

SEQ ID NO: 573108 - DNA, 13 bp, D. melanogaster
accactgcaccac

SEQ ID NO: 573109 - DNA, 13 bp, D. melanogaster
accactgtggagg

SEQ ID NO: 573110 - DNA, 13 bp, D. melanogaster
accactgtggcag

SEQ ID NO: 573111 - DNA, 13 bp, D. melanogaster
accactgttaatc

SEQ ID NO: 573112 - DNA, 13 bp, D. melanogaster
accactttcttct

SEQ ID NO: 573113 - DNA, 14 bp, D. melanogaster
accagaaaatgcaa

SEQ ID NO: 573114 - DNA, 13 bp, D. melanogaster
accagaaaccgaa

SEQ ID NO: 573115 - DNA, 14 bp, D. melanogaster
accagaaatcgcca

SEQ ID NO: 573116 - DNA, 13 bp, D. melanogaster
accagaacaatat

SEQ ID NO: 573117 - DNA, 13 bp, D. melanogaster
accagaacatgct

SEQ ID NO: 573118 - DNA, 13 bp, D. melanogaster
accagaagtggca

SEQ ID NO: 573119 - DNA, 14 bp, D. melanogaster
accagaatcaagga

SEQ ID NO: 573120 - DNA, 13 bp, D. melanogaster
accagaatcaatt

SEQ ID NO: 573121 - DNA, 13 bp, D. melanogaster
accagaatcagaa

SEQ ID NO: 573122 - DNA, 13 bp, D. melanogaster
accagacaaactt

SEQ ID NO: 573123 - DNA, 13 bp, D. melanogaster
accagaccagacc

SEQ ID NO: 573124 - DNA, 13 bp, D. melanogaster
accagagaccaga

SEQ ID NO: 573125 - DNA, 13 bp, D. melanogaster
accagagcaggga

SEQ ID NO: 573126 - DNA, 13 bp, D. melanogaster
accagatacagat

SEQ ID NO: 573127 - DNA, 13 bp, D. melanogaster
accagatagaact

SEQ ID NO: 573128 - DNA, 13 bp, D. melanogaster
accagatcaaaag

SEQ ID NO: 573129 - DNA, 13 bp, D. melanogaster
accagatcgactc

SEQ ID NO: 573130 - DNA, 13 bp, D. melanogaster
accagcaaaatta

SEQ ID NO: 573131 - DNA, 14 bp, D. melanogaster
accagcaaaattaa

SEQ ID NO: 573132 - DNA, 13 bp, D. melanogaster
accagcaaccagc

SEQ ID NO: 573133 - DNA, 14 bp, D. melanogaster
accagcaaggcaaa

SEQ ID NO: 573134 - DNA, 13 bp, D. melanogaster
accagcaccagca

SEQ ID NO: 573135 - DNA, 13 bp, D. melanogaster
accagcagacgtt

SEQ ID NO: 573136 - DNA, 13 bp, D. melanogaster
accagcagcaaca

SEQ ID NO: 573137 - DNA, 14 bp, D. melanogaster
accagcagcaacaa

SEQ ID NO: 573138 - DNA, 14 bp, D. melanogaster
accagcagcaacag

SEQ ID NO: 573139 - DNA, 13 bp, D. melanogaster
accagcagcacca

SEQ ID NO: 573140 - DNA, 19 bp, D. melanogaster
accagcagcagaagcagca

SEQ ID NO: 573141 - DNA, 13 bp, D. melanogaster
accagcagcttcc

SEQ ID NO: 573142 - DNA, 13 bp, D. melanogaster
accagcattaaca

SEQ ID NO: 573143 - DNA, 14 bp, D. melanogaster
accagccaaaaggg

SEQ ID NO: 573144 - DNA, 13 bp, D. melanogaster
accagccaaccag

SEQ ID NO: 573145 - DNA, 13 bp, D. melanogaster
accagccaccaga

SEQ ID NO: 573146 - DNA, 13 bp, D. melanogaster
accagccaccagc

SEQ ID NO: 573147 - DNA, 13 bp, D. melanogaster
accagccagccag

SEQ ID NO: 573148 - DNA, 13 bp, D. melanogaster
accagccagccat

SEQ ID NO: 573149 - DNA, 13 bp, D. melanogaster
accagccgctcga

SEQ ID NO: 573150 - DNA, 13 bp, D. melanogaster
accagctaccagc

SEQ ID NO: 573151 - DNA, 14 bp, D. melanogaster
accagctaccagct

SEQ ID NO: 573152 - DNA, 13 bp, D. melanogaster
accagctgagata

SEQ ID NO: 573153 - DNA, 13 bp, D. melanogaster
accagctgaggca

SEQ ID NO: 573154 - DNA, 13 bp, D. melanogaster
accagctgccaac

SEQ ID NO: 573155 - DNA, 13 bp, D. melanogaster
accagctgcttaa

SEQ ID NO: 573156 - DNA, 13 bp, D. melanogaster
accagcttaaaag

SEQ ID NO: 573157 - DNA, 14 bp, D. melanogaster
accagcttaaaagc

SEQ ID NO: 573158 - DNA, 14 bp, D. melanogaster
accagctttggtca

SEQ ID NO: 573159 - DNA, 14 bp, D. melanogaster
accaggaaattcaa

SEQ ID NO: 573160 - DNA, 13 bp, D. melanogaster
accaggaccagga

SEQ ID NO: 573161 - DNA, 14 bp, D. melanogaster
accaggaccaggac

SEQ ID NO: 573162 - DNA, 13 bp, D. melanogaster
accaggcgaacag

SEQ ID NO: 573163 - DNA, 13 bp, D. melanogaster
accagggttctgg

SEQ ID NO: 573164 - DNA, 13 bp, D. melanogaster
accaggtcatttt

SEQ ID NO: 573165 - DNA, 13 bp, D. melanogaster
accaggtcctggc

SEQ ID NO: 573166 - DNA, 13 bp, D. melanogaster
accagtaccagta

SEQ ID NO: 573167 - DNA, 14 bp, D. melanogaster
accagtaccagtac

SEQ ID NO: 573168 - DNA, 13 bp, D. melanogaster
accagtagaaaag

SEQ ID NO: 573169 - DNA, 13 bp, D. melanogaster
accagtggcatac

SEQ ID NO: 573170 - DNA, 13 bp, D. melanogaster
accagttaccagt

SEQ ID NO: 573171 - DNA, 13 bp, D. melanogaster
accagttccacca

SEQ ID NO: 573172 - DNA, 13 bp, D. melanogaster
accagttggccag

SEQ ID NO: 573173 - DNA, 13 bp, D. melanogaster
accagttgggaaa

SEQ ID NO: 573174 - DNA, 14 bp, D. melanogaster
accagtttgaattt

SEQ ID NO: 573175 - DNA, 13 bp, D. melanogaster
accagtttttttt

SEQ ID NO: 573176 - DNA, 13 bp, D. melanogaster
accataaaaacga

SEQ ID NO: 573177 - DNA, 13 bp, D. melanogaster
accataaaatgca

SEQ ID NO: 573178 - DNA, 13 bp, D. melanogaster
accataaataatg

SEQ ID NO: 573179 - DNA, 13 bp, D. melanogaster
accataaattaat

SEQ ID NO: 573180 - DNA, 13 bp, D. melanogaster
accataaattatt

SEQ ID NO: 573181 - DNA, 13 bp, D. melanogaster
accataaccataa

SEQ ID NO: 573182 - DNA, 13 bp, D. melanogaster
accataactataa

SEQ ID NO: 573183 - DNA, 13 bp, D. melanogaster
accataatggcca

SEQ ID NO: 573184 - DNA, 13 bp, D. melanogaster
accataattaatg

SEQ ID NO: 573185 - DNA, 13 bp, D. melanogaster
accataattataa

SEQ ID NO: 573186 - DNA, 14 bp, D. melanogaster
accatacatatatg

SEQ ID NO: 573187 - DNA, 13 bp, D. melanogaster
accataccatata

SEQ ID NO: 573188 - DNA, 13 bp, D. melanogaster
accatacccatac

SEQ ID NO: 573189 - DNA, 14 bp, D. melanogaster
accatatacatata

SEQ ID NO: 573190 - DNA, 13 bp, D. melanogaster
accatatatacaa

SEQ ID NO: 573191 - DNA, 13 bp, D. melanogaster
accatatatatac

SEQ ID NO: 573192 - DNA, 14 bp, D. melanogaster
accatatatgtata

SEQ ID NO: 573193 - DNA, 13 bp, D. melanogaster
accatatatttta

SEQ ID NO: 573194 - DNA, 13 bp, D. melanogaster
accatatcagcta

SEQ ID NO: 573195 - DNA, 13 bp, D. melanogaster
accatatccataa

SEQ ID NO: 573196 - DNA, 13 bp, D. melanogaster
accatatttttta

SEQ ID NO: 573197 - DNA, 13 bp, D. melanogaster
accatcaaaaatt

SEQ ID NO: 573198 - DNA, 13 bp, D. melanogaster
accatcaaccatt

SEQ ID NO: 573199 - DNA, 13 bp, D. melanogaster
accatccaaccat

SEQ ID NO: 573200 - DNA, 14 bp, D. melanogaster
accatccatccatc

SEQ ID NO: 573201 - DNA, 13 bp, D. melanogaster
accatccatccca

SEQ ID NO: 573202 - DNA, 13 bp, D. melanogaster
accatcgaccatc

SEQ ID NO: 573203 - DNA, 13 bp, D. melanogaster
accatcgacgtct

SEQ ID NO: 573204 - DNA, 13 bp, D. melanogaster
accatcgcaagca

SEQ ID NO: 573205 - DNA, 13 bp, D. melanogaster
accatcgccatca

SEQ ID NO: 573206 - DNA, 13 bp, D. melanogaster
accatctaccatc

SEQ ID NO: 573207 - DNA, 13 bp, D. melanogaster
accatctatttca

SEQ ID NO: 573208 - DNA, 13 bp, D. melanogaster
accatgagattac

SEQ ID NO: 573209 - DNA, 13 bp, D. melanogaster
accatgatgatga

SEQ ID NO: 573210 - DNA, 13 bp, D. melanogaster
accatggactgca

SEQ ID NO: 573211 - DNA, 13 bp, D. melanogaster
accatggtaacca

SEQ ID NO: 573212 - DNA, 13 bp, D. melanogaster
accatgtaaattc

SEQ ID NO: 573213 - DNA, 13 bp, D. melanogaster
accattaaaacag

SEQ ID NO: 573214 - DNA, 13 bp, D. melanogaster
accattaaaacgg

SEQ ID NO: 573215 - DNA, 13 bp, D. melanogaster
accattaaaatta

SEQ ID NO: 573216 - DNA, 13 bp, D. melanogaster
accattaacccat

SEQ ID NO: 573217 - DNA, 13 bp, D. melanogaster
accattaagctgg

SEQ ID NO: 573218 - DNA, 13 bp, D. melanogaster
accattaattaaa

SEQ ID NO: 573219 - DNA, 13 bp, D. melanogaster
accattaccatca

SEQ ID NO: 573220 - DNA, 13 bp, D. melanogaster
accattaccatta

SEQ ID NO: 573221 - DNA, 13 bp, D. melanogaster
accattcgccatt

SEQ ID NO: 573222 - DNA, 13 bp, D. melanogaster
accattgaacagg

SEQ ID NO: 573223 - DNA, 13 bp, D. melanogaster
accattgcagcag

SEQ ID NO: 573224 - DNA, 13 bp, D. melanogaster
accattgccattg

SEQ ID NO: 573225 - DNA, 13 bp, D. melanogaster
accattgggtttt

SEQ ID NO: 573226 - DNA, 13 bp, D. melanogaster
accattgtaaaaa

SEQ ID NO: 573227 - DNA, 14 bp, D. melanogaster
accattgtaaaaaa

SEQ ID NO: 573228 - DNA, 13 bp, D. melanogaster
accattgtaagcc

SEQ ID NO: 573229 - DNA, 13 bp, D. melanogaster
accattgtagcca

SEQ ID NO: 573230 - DNA, 13 bp, D. melanogaster
accattgtcaatg

SEQ ID NO: 573231 - DNA, 14 bp, D. melanogaster
accattgtcaatgt

SEQ ID NO: 573232 - DNA, 13 bp, D. melanogaster
accatttaaaact

SEQ ID NO: 573233 - DNA, 13 bp, D. melanogaster
accatttaaatat

SEQ ID NO: 573234 - DNA, 13 bp, D. melanogaster
accatttaaatta

SEQ ID NO: 573235 - DNA, 13 bp, D. melanogaster
accatttaacatt

SEQ ID NO: 573236 - DNA, 13 bp, D. melanogaster
accatttaattat

SEQ ID NO: 573237 - DNA, 13 bp, D. melanogaster
accatttaattca

SEQ ID NO: 573238 - DNA, 13 bp, D. melanogaster
accatttaattta

SEQ ID NO: 573239 - DNA, 13 bp, D. melanogaster
accatttacaaaa

SEQ ID NO: 573240 - DNA, 13 bp, D. melanogaster
accatttaccatt

SEQ ID NO: 573241 - DNA, 13 bp, D. melanogaster
accatttccattt

SEQ ID NO: 573242 - DNA, 13 bp, D. melanogaster
accatttgattta

SEQ ID NO: 573243 - DNA, 13 bp, D. melanogaster
accatttgctgag

SEQ ID NO: 573244 - DNA, 13 bp, D. melanogaster
accatttgtacag

SEQ ID NO: 573245 - DNA, 13 bp, D. melanogaster
accatttgtattt

SEQ ID NO: 573246 - DNA, 13 bp, D. melanogaster
accatttgtttat

SEQ ID NO: 573247 - DNA, 13 bp, D. melanogaster
accattttaatta

SEQ ID NO: 573248 - DNA, 13 bp, D. melanogaster
accattttatact

SEQ ID NO: 573249 - DNA, 13 bp, D. melanogaster
accattttggcag

SEQ ID NO: 573250 - DNA, 14 bp, D. melanogaster
accatttttagcca

SEQ ID NO: 573251 - DNA, 14 bp, D. melanogaster
accatttttggcca

SEQ ID NO: 573252 - DNA, 13 bp, D. melanogaster
accatttttgttt

SEQ ID NO: 573253 - DNA, 13 bp, D. melanogaster
accattttttgca

SEQ ID NO: 573254 - DNA, 13 bp, D. melanogaster
accattttttgtt

SEQ ID NO: 573255 - DNA, 14 bp, D. melanogaster
acccaaaaattaat

SEQ ID NO: 573256 - DNA, 14 bp, D. melanogaster
acccaaaagaactt

SEQ ID NO: 573257 - DNA, 13 bp, D. melanogaster
acccaaaagtaaa

SEQ ID NO: 573258 - DNA, 13 bp, D. melanogaster
acccaaaataaag

SEQ ID NO: 573259 - DNA, 13 bp, D. melanogaster
acccaaaatgaaa

SEQ ID NO: 573260 - DNA, 13 bp, D. melanogaster
acccaaatatata

SEQ ID NO: 573261 - DNA, 13 bp, D. melanogaster
acccaaatcggag

SEQ ID NO: 573262 - DNA, 13 bp, D. melanogaster
acccaaatgaaat

SEQ ID NO: 573263 - DNA, 13 bp, D. melanogaster
acccaaattctgg

SEQ ID NO: 573264 - DNA, 14 bp, D. melanogaster
acccaaattctggt

SEQ ID NO: 573265 - DNA, 14 bp, D. melanogaster
acccaactgcaagg

SEQ ID NO: 573266 - DNA, 13 bp, D. melanogaster
acccaagaaaaat

SEQ ID NO: 573267 - DNA, 13 bp, D. melanogaster
acccaagaaaatc

SEQ ID NO: 573268 - DNA, 13 bp, D. melanogaster
acccaagaaatca

SEQ ID NO: 573269 - DNA, 13 bp, D. melanogaster
acccaagagcgag

SEQ ID NO: 573270 - DNA, 13 bp, D. melanogaster
acccaagcccaag

SEQ ID NO: 573271 - DNA, 14 bp, D. melanogaster
acccaagcccaagt

SEQ ID NO: 573272 - DNA, 13 bp, D. melanogaster
acccaataacttc

SEQ ID NO: 573273 - DNA, 14 bp, D. melanogaster
acccaataacttca

SEQ ID NO: 573274 - DNA, 13 bp, D. melanogaster
acccaatagagga

SEQ ID NO: 573275 - DNA, 13 bp, D. melanogaster
acccaatccaatc

SEQ ID NO: 573276 - DNA, 13 bp, D. melanogaster
acccaatcctcca

SEQ ID NO: 573277 - DNA, 13 bp, D. melanogaster
acccaatctatgg

SEQ ID NO: 573278 - DNA, 13 bp, D. melanogaster
acccaatgtcaca

SEQ ID NO: 573279 - DNA, 13 bp, D. melanogaster
acccaattaccca

SEQ ID NO: 573280 - DNA, 13 bp, D. melanogaster
acccaatttcgtt

SEQ ID NO: 573281 - DNA, 13 bp, D. melanogaster
acccaattttttt

SEQ ID NO: 573282 - DNA, 13 bp, D. melanogaster
acccacacacatg

SEQ ID NO: 573283 - DNA, 13 bp, D. melanogaster
acccacatatata

SEQ ID NO: 573284 - DNA, 13 bp, D. melanogaster
acccacatgcaca

SEQ ID NO: 573285 - DNA, 13 bp, D. melanogaster
acccacattatgt

SEQ ID NO: 573286 - DNA, 13 bp, D. melanogaster
acccacccacatg

SEQ ID NO: 573287 - DNA, 13 bp, D. melanogaster
acccacccacctg

SEQ ID NO: 573288 - DNA, 13 bp, D. melanogaster
acccacccactgg

SEQ ID NO: 573289 - DNA, 13 bp, D. melanogaster
acccacccacttg

SEQ ID NO: 573290 - DNA, 13 bp, D. melanogaster
acccacccatgtg

SEQ ID NO: 573291 - DNA, 14 bp, D. melanogaster
acccaccgcccact

SEQ ID NO: 573292 - DNA, 14 bp, D. melanogaster
acccaccgcccatc

SEQ ID NO: 573293 - DNA, 13 bp, D. melanogaster
acccactcgaaaa

SEQ ID NO: 573294 - DNA, 13 bp, D. melanogaster
acccactgaacca

SEQ ID NO: 573295 - DNA, 14 bp, D. melanogaster
acccactgccaccc

SEQ ID NO: 573296 - DNA, 13 bp, D. melanogaster
acccactgcggcg

SEQ ID NO: 573297 - DNA, 13 bp, D. melanogaster
acccacttccact

SEQ ID NO: 573298 - DNA, 13 bp, D. melanogaster
acccacttgcgca

SEQ ID NO: 573299 - DNA, 13 bp, D. melanogaster
acccacttttccc

SEQ ID NO: 573300 - DNA, 13 bp, D. melanogaster
acccagaagagcg

SEQ ID NO: 573301 - DNA, 13 bp, D. melanogaster
acccagacatggg

SEQ ID NO: 573302 - DNA, 13 bp, D. melanogaster
acccagacccaga

SEQ ID NO: 573303 - DNA, 13 bp, D. melanogaster
acccagacggggg

SEQ ID NO: 573304 - DNA, 13 bp, D. melanogaster
acccagactccaa

SEQ ID NO: 573305 - DNA, 13 bp, D. melanogaster
acccagacttcag

SEQ ID NO: 573306 - DNA, 13 bp, D. melanogaster
acccagagatggg

SEQ ID NO: 573307 - DNA, 13 bp, D. melanogaster
acccagatttcag

SEQ ID NO: 573308 - DNA, 13 bp, D. melanogaster
acccagccaggag

SEQ ID NO: 573309 - DNA, 13 bp, D. melanogaster
acccagtacccag

SEQ ID NO: 573310 - DNA, 13 bp, D. melanogaster
acccagttccaca

SEQ ID NO: 573311 - DNA, 13 bp, D. melanogaster
acccagttcctca

SEQ ID NO: 573312 - DNA, 13 bp, D. melanogaster
acccagtttgcca

SEQ ID NO: 573313 - DNA, 13 bp, D. melanogaster
acccatacaaatt

SEQ ID NO: 573314 - DNA, 13 bp, D. melanogaster
acccatacataca

SEQ ID NO: 573315 - DNA, 14 bp, D. melanogaster
acccatacccattc

SEQ ID NO: 573316 - DNA, 13 bp, D. melanogaster
acccatagcccag

SEQ ID NO: 573317 - DNA, 13 bp, D. melanogaster
acccatataccca

SEQ ID NO: 573318 - DNA, 13 bp, D. melanogaster
acccatattaaaa

SEQ ID NO: 573319 - DNA, 14 bp, D. melanogaster
acccatattaaaag

SEQ ID NO: 573320 - DNA, 13 bp, D. melanogaster
acccatcatcatc

SEQ ID NO: 573321 - DNA, 13 bp, D. melanogaster
acccatccatcca

SEQ ID NO: 573322 - DNA, 13 bp, D. melanogaster
acccatgaccagc

SEQ ID NO: 573323 - DNA, 13 bp, D. melanogaster
acccatgccaccc

SEQ ID NO: 573324 - DNA, 13 bp, D. melanogaster
acccattcccatc

SEQ ID NO: 573325 - DNA, 13 bp, D. melanogaster
acccattcccatt

SEQ ID NO: 573326 - DNA, 14 bp, D. melanogaster
acccattcccattc

SEQ ID NO: 573327 - DNA, 13 bp, D. melanogaster
acccattgccatt

SEQ ID NO: 573328 - DNA, 13 bp, D. melanogaster
acccatttaccca

SEQ ID NO: 573329 - DNA, 13 bp, D. melanogaster
acccatttatgct

SEQ ID NO: 573330 - DNA, 13 bp, D. melanogaster
acccatttcccat

SEQ ID NO: 573331 - DNA, 13 bp, D. melanogaster
acccattttaata

SEQ ID NO: 573332 - DNA, 13 bp, D. melanogaster
acccattttccgc

SEQ ID NO: 573333 - DNA, 13 bp, D. melanogaster
acccattttgggt

SEQ ID NO: 573334 - DNA, 13 bp, D. melanogaster
accccaatccggc

SEQ ID NO: 573335 - DNA, 13 bp, D. melanogaster
accccagatacaa

SEQ ID NO: 573336 - DNA, 13 bp, D. melanogaster
accccatatgaga

SEQ ID NO: 573337 - DNA, 13 bp, D. melanogaster
acccccagccata

SEQ ID NO: 573338 - DNA, 13 bp, D. melanogaster
accccgtttgtaa

SEQ ID NO: 573339 - DNA, 13 bp, D. melanogaster
accccgtttgttt

SEQ ID NO: 573340 - DNA, 13 bp, D. melanogaster
acccctacagcat

SEQ ID NO: 573341 - DNA, 13 bp, D. melanogaster
acccctattaagc

SEQ ID NO: 573342 - DNA, 13 bp, D. melanogaster
accccttaaaaaa

SEQ ID NO: 573343 - DNA, 16 bp, D. melanogaster
accccttacaaaaaat

SEQ ID NO: 573344 - DNA, 13 bp, D. melanogaster
accccttaccaaa

SEQ ID NO: 573345 - DNA, 13 bp, D. melanogaster
acccgaggcctgc

SEQ ID NO: 573346 - DNA, 13 bp, D. melanogaster
acccgatccgatc

SEQ ID NO: 573347 - DNA, 13 bp, D. melanogaster
acccgcacataca

SEQ ID NO: 573348 - DNA, 13 bp, D. melanogaster
acccggtgaccca

SEQ ID NO: 573349 - DNA, 13 bp, D. melanogaster
acccgttactcgt

SEQ ID NO: 573350 - DNA, 13 bp, D. melanogaster
accctcaccttca

SEQ ID NO: 573351 - DNA, 13 bp, D. melanogaster
accctgcctaaaa

SEQ ID NO: 573352 - DNA, 13 bp, D. melanogaster
accctggtagcca

SEQ ID NO: 573353 - DNA, 13 bp, D. melanogaster
accctggtataca

SEQ ID NO: 573354 - DNA, 13 bp, D. melanogaster
acccttcatttct

SEQ ID NO: 573355 - DNA, 13 bp, D. melanogaster
acccttgcagttc

SEQ ID NO: 573356 - DNA, 14 bp, D. melanogaster
accctttcccaagc

SEQ ID NO: 573357 - DNA, 13 bp, D. melanogaster
accctttggtggg

SEQ ID NO: 573358 - DNA, 13 bp, D. melanogaster
acccttttacttt

SEQ ID NO: 573359 - DNA, 13 bp, D. melanogaster
accgaaaaaaggg

SEQ ID NO: 573360 - DNA, 13 bp, D. melanogaster
accgaaaaatatt

SEQ ID NO: 573361 - DNA, 14 bp, D. melanogaster
accgaaaaccgaaa

SEQ ID NO: 573362 - DNA, 13 bp, D. melanogaster
accgaaaataaat

SEQ ID NO: 573363 - DNA, 13 bp, D. melanogaster
accgaaaatataa

SEQ ID NO: 573364 - DNA, 13 bp, D. melanogaster
accgaaaatgcaa

SEQ ID NO: 573365 - DNA, 13 bp, D. melanogaster
accgaaaccgaat

SEQ ID NO: 573366 - DNA, 13 bp, D. melanogaster
accgaaacgaaac

SEQ ID NO: 573367 - DNA, 14 bp, D. melanogaster
accgaaacgaaacg

SEQ ID NO: 573368 - DNA, 13 bp, D. melanogaster
accgaaagccaaa

SEQ ID NO: 573369 - DNA, 13 bp, D. melanogaster
accgaaatcggaa

SEQ ID NO: 573370 - DNA, 14 bp, D. melanogaster
accgaaatcggaag

SEQ ID NO: 573371 - DNA, 13 bp, D. melanogaster
accgaaatctggg

SEQ ID NO: 573372 - DNA, 13 bp, D. melanogaster
accgaaatggaaa

SEQ ID NO: 573373 - DNA, 13 bp, D. melanogaster
accgaacaatcaa

SEQ ID NO: 573374 - DNA, 13 bp, D. melanogaster
accgaaccgaatc

SEQ ID NO: 573375 - DNA, 13 bp, D. melanogaster
accgaacgagctc

SEQ ID NO: 573376 - DNA, 13 bp, D. melanogaster
accgaactgaacc

SEQ ID NO: 573377 - DNA, 13 bp, D. melanogaster
accgaatattttt

SEQ ID NO: 573378 - DNA, 16 bp, D. melanogaster
accgaatatttttgaa

SEQ ID NO: 573379 - DNA, 13 bp, D. melanogaster
accgaatccgaat

SEQ ID NO: 573380 - DNA, 14 bp, D. melanogaster
accgaatccgaatc

SEQ ID NO: 573381 - DNA, 14 bp, D. melanogaster
accgaatcgaatcg

SEQ ID NO: 573382 - DNA, 13 bp, D. melanogaster
accgaatgacacc

SEQ ID NO: 573383 - DNA, 13 bp, D. melanogaster
accgaatgcaatt

SEQ ID NO: 573384 - DNA, 13 bp, D. melanogaster
accgacaaaacga

SEQ ID NO: 573385 - DNA, 13 bp, D. melanogaster
accgacaactact

SEQ ID NO: 573386 - DNA, 13 bp, D. melanogaster
accgacaagaact

SEQ ID NO: 573387 - DNA, 13 bp, D. melanogaster
accgacaatccca

SEQ ID NO: 573388 - DNA, 13 bp, D. melanogaster
accgaccaccgac

SEQ ID NO: 573389 - DNA, 13 bp, D. melanogaster
accgaccgaccaa

SEQ ID NO: 573390 - DNA, 14 bp, D. melanogaster
accgaccgaccgac

SEQ ID NO: 573391 - DNA, 14 bp, D. melanogaster
accgactgactgac

SEQ ID NO: 573392 - DNA, 14 bp, D. melanogaster
accgagctgaacaa

SEQ ID NO: 573393 - DNA, 14 bp, D. melanogaster
accgagcttctaat

SEQ ID NO: 573394 - DNA, 13 bp, D. melanogaster
accgataaaggta

SEQ ID NO: 573395 - DNA, 13 bp, D. melanogaster
accgattaccatg

SEQ ID NO: 573396 - DNA, 14 bp, D. melanogaster
accgattatttttt

SEQ ID NO: 573397 - DNA, 13 bp, D. melanogaster
accgattcaatgc

SEQ ID NO: 573398 - DNA, 14 bp, D. melanogaster
accgattcaatgcg

SEQ ID NO: 573399 - DNA, 13 bp, D. melanogaster
accgattctcctt

SEQ ID NO: 573400 - DNA, 13 bp, D. melanogaster
accgattgcttaa

SEQ ID NO: 573401 - DNA, 14 bp, D. melanogaster
accgattgcttaat

SEQ ID NO: 573402 - DNA, 13 bp, D. melanogaster
accgatttagatg

SEQ ID NO: 573403 - DNA, 13 bp, D. melanogaster
accgatttgcggt

SEQ ID NO: 573404 - DNA, 13 bp, D. melanogaster
accgcaaaaagtt

SEQ ID NO: 573405 - DNA, 13 bp, D. melanogaster
accgcaaaagcca

SEQ ID NO: 573406 - DNA, 13 bp, D. melanogaster
accgcaaaagttt

SEQ ID NO: 573407 - DNA, 13 bp, D. melanogaster
accgcaaactgcc

SEQ ID NO: 573408 - DNA, 13 bp, D. melanogaster
accgcaaagcaaa

SEQ ID NO: 573409 - DNA, 13 bp, D. melanogaster
accgcaatattac

SEQ ID NO: 573410 - DNA, 14 bp, D. melanogaster
accgcaattaaatc

SEQ ID NO: 573411 - DNA, 14 bp, D. melanogaster
accgcaccgcaccg

SEQ ID NO: 573412 - DNA, 13 bp, D. melanogaster
accgcaggccaaa

SEQ ID NO: 573413 - DNA, 13 bp, D. melanogaster
accgcatttttct

SEQ ID NO: 573414 - DNA, 13 bp, D. melanogaster
accgccagatggc

SEQ ID NO: 573415 - DNA, 13 bp, D. melanogaster
accgcccaaaact

SEQ ID NO: 573416 - DNA, 13 bp, D. melanogaster
accgcccaaatat

SEQ ID NO: 573417 - DNA, 13 bp, D. melanogaster
accgcccatcgcc

SEQ ID NO: 573418 - DNA, 13 bp, D. melanogaster
accgccctctatg

SEQ ID NO: 573419 - DNA, 13 bp, D. melanogaster
accgccgcagtgg

SEQ ID NO: 573420 - DNA, 13 bp, D. melanogaster
accgccggaagtc

SEQ ID NO: 573421 - DNA, 13 bp, D. melanogaster
accgctcgatgtc

SEQ ID NO: 573422 - DNA, 14 bp, D. melanogaster
accgcttgaagaac

SEQ ID NO: 573423 - DNA, 13 bp, D. melanogaster
accgcttttccgc

SEQ ID NO: 573424 - DNA, 13 bp, D. melanogaster
accggaaacggaa

SEQ ID NO: 573425 - DNA, 14 bp, D. melanogaster
accggaaacggaaa

SEQ ID NO: 573426 - DNA, 13 bp, D. melanogaster
accggaaccggaa

SEQ ID NO: 573427 - DNA, 13 bp, D. melanogaster
accggaagcggaa

SEQ ID NO: 573428 - DNA, 13 bp, D. melanogaster
accggatgtgact

SEQ ID NO: 573429 - DNA, 14 bp, D. melanogaster
accggcaattcaaa

SEQ ID NO: 573430 - DNA, 13 bp, D. melanogaster
accggctgcgcca

SEQ ID NO: 573431 - DNA, 14 bp, D. melanogaster
accggctgcgccag

SEQ ID NO: 573432 - DNA, 13 bp, D. melanogaster
accgggactgcca

SEQ ID NO: 573433 - DNA, 13 bp, D. melanogaster
accgggcgaagtg

SEQ ID NO: 573434 - DNA, 13 bp, D. melanogaster
accggtgacatca

SEQ ID NO: 573435 - DNA, 13 bp, D. melanogaster
accgtagaaatgg

SEQ ID NO: 573436 - DNA, 13 bp, D. melanogaster
accgtgacaaagg

SEQ ID NO: 573437 - DNA, 13 bp, D. melanogaster
accgtgacagtcg

SEQ ID NO: 573438 - DNA, 65 bp, D. melanogaster
accgtgccggtcttcaattccctgtgggccgtattcaccgtttgctccggaagggaaactacgca

SEQ ID NO: 573439 - DNA, 13 bp, D. melanogaster
accgttagcagtg

SEQ ID NO: 573440 - DNA, 13 bp, D. melanogaster
accgttataatgg

SEQ ID NO: 573441 - DNA, 13 bp, D. melanogaster
accgtttacacat

SEQ ID NO: 573442 - DNA, 13 bp, D. melanogaster
acctaaaaacgaa

SEQ ID NO: 573443 - DNA, 13 bp, D. melanogaster
acctaaaaagaag

SEQ ID NO: 573444 - DNA, 13 bp, D. melanogaster
acctaaatattta

SEQ ID NO: 573445 - DNA, 13 bp, D. melanogaster
acctaaatatttt

SEQ ID NO: 573446 - DNA, 13 bp, D. melanogaster
acctaaatttata

SEQ ID NO: 573447 - DNA, 13 bp, D. melanogaster
acctaacccagtt

SEQ ID NO: 573448 - DNA, 14 bp, D. melanogaster
acctaacccagttc

SEQ ID NO: 573449 - DNA, 13 bp, D. melanogaster
acctaatttaaat

SEQ ID NO: 573450 - DNA, 13 bp, D. melanogaster
acctacatacata

SEQ ID NO: 573451 - DNA, 13 bp, D. melanogaster
acctacctaccta

SEQ ID NO: 573452 - DNA, 13 bp, D. melanogaster
acctacgagacca

SEQ ID NO: 573453 - DNA, 13 bp, D. melanogaster
acctactggtgac

SEQ ID NO: 573454 - DNA, 13 bp, D. melanogaster
acctacttaaaga

SEQ ID NO: 573455 - DNA, 13 bp, D. melanogaster
acctatacctata

SEQ ID NO: 573456 - DNA, 13 bp, D. melanogaster
acctatatatata

SEQ ID NO: 573457 - DNA, 13 bp, D. melanogaster
acctatccaaatt

SEQ ID NO: 573458 - DNA, 14 bp, D. melanogaster
acctatgcaaatat

SEQ ID NO: 573459 - DNA, 13 bp, D. melanogaster
acctatgtaaaat

SEQ ID NO: 573460 - DNA, 13 bp, D. melanogaster
acctatgtactta

SEQ ID NO: 573461 - DNA, 13 bp, D. melanogaster
acctatgtatgta

SEQ ID NO: 573462 - DNA, 13 bp, D. melanogaster
acctatgtcgatt

SEQ ID NO: 573463 - DNA, 13 bp, D. melanogaster
acctattactact

SEQ ID NO: 573464 - DNA, 13 bp, D. melanogaster
acctatttattta

SEQ ID NO: 573465 - DNA, 14 bp, D. melanogaster
acctcaaattaaac

SEQ ID NO: 573466 - DNA, 13 bp, D. melanogaster
acctcaactgcaa

SEQ ID NO: 573467 - DNA, 14 bp, D. melanogaster
acctcactcagctg

SEQ ID NO: 573468 - DNA, 13 bp, D. melanogaster
acctcatcgacat

SEQ ID NO: 573469 - DNA, 13 bp, D. melanogaster
acctccacaacgt

SEQ ID NO: 573470 - DNA, 13 bp, D. melanogaster
acctccacctcta

SEQ ID NO: 573471 - DNA, 13 bp, D. melanogaster
acctcggccagaa

SEQ ID NO: 573472 - DNA, 13 bp, D. melanogaster
acctcgttttttc

SEQ ID NO: 573473 - DNA, 14 bp, D. melanogaster
acctctaatttatt

SEQ ID NO: 573474 - DNA, 13 bp, D. melanogaster
acctctgctctgt

SEQ ID NO: 573475 - DNA, 13 bp, D. melanogaster
acctcttctttaa

SEQ ID NO: 573476 - DNA, 14 bp, D. melanogaster
acctctttaaaata

SEQ ID NO: 573477 - DNA, 13 bp, D. melanogaster
acctgaaccagtt

SEQ ID NO: 573478 - DNA, 13 bp, D. melanogaster
acctgaacctgaa

SEQ ID NO: 573479 - DNA, 13 bp, D. melanogaster
acctgatcgactt

SEQ ID NO: 573480 - DNA, 14 bp, D. melanogaster
acctgcaaaaactt

SEQ ID NO: 573481 - DNA, 13 bp, D. melanogaster
acctgcaggccgt

SEQ ID NO: 573482 - DNA, 14 bp, D. melanogaster
acctgccacctgcc

SEQ ID NO: 573483 - DNA, 15 bp, D. melanogaster
acctgcgcaggtgaa

SEQ ID NO: 573484 - DNA, 13 bp, D. melanogaster
acctggagcagtg

SEQ ID NO: 573485 - DNA, 13 bp, D. melanogaster
acctggatgcatt

SEQ ID NO: 573486 - DNA, 13 bp, D. melanogaster
acctggcaaccct

SEQ ID NO: 573487 - DNA, 13 bp, D. melanogaster
acctggcagactg

SEQ ID NO: 573488 - DNA, 13 bp, D. melanogaster
acctggccaaaaa

SEQ ID NO: 573489 - DNA, 13 bp, D. melanogaster
acctggcctcaca

SEQ ID NO: 573490 - DNA, 13 bp, D. melanogaster
acctgtaaagaaa

SEQ ID NO: 573491 - DNA, 13 bp, D. melanogaster
acctgtatctgta

SEQ ID NO: 573492 - DNA, 13 bp, D. melanogaster
acctgtccgtttg

SEQ ID NO: 573493 - DNA, 13 bp, D. melanogaster
acctgttcgatgg

SEQ ID NO: 573494 - DNA, 13 bp, D. melanogaster
acctgttgtaatt

SEQ ID NO: 573495 - DNA, 14 bp, D. melanogaster
acctgttgtcgctg

SEQ ID NO: 573496 - DNA, 13 bp, D. melanogaster
accttaaacaaca

SEQ ID NO: 573497 - DNA, 13 bp, D. melanogaster
accttaaactata

SEQ ID NO: 573498 - DNA, 13 bp, D. melanogaster
accttaagaagaa

SEQ ID NO: 573499 - DNA, 14 bp, D. melanogaster
accttaagtttttc

SEQ ID NO: 573500 - DNA, 13 bp, D. melanogaster
accttaccttacc

SEQ ID NO: 573501 - DNA, 13 bp, D. melanogaster
accttagcatgga

SEQ ID NO: 573502 - DNA, 13 bp, D. melanogaster
accttataacacc

SEQ ID NO: 573503 - DNA, 13 bp, D. melanogaster
accttatctctgg

SEQ ID NO: 573504 - DNA, 13 bp, D. melanogaster
accttcatataga

SEQ ID NO: 573505 - DNA, 13 bp, D. melanogaster
accttcgagtgga

SEQ ID NO: 573506 - DNA, 13 bp, D. melanogaster
accttgcagccaa

SEQ ID NO: 573507 - DNA, 13 bp, D. melanogaster
accttggcaaaac

SEQ ID NO: 573508 - DNA, 13 bp, D. melanogaster
accttggccaagg

SEQ ID NO: 573509 - DNA, 13 bp, D. melanogaster
accttggccagtt

SEQ ID NO: 573510 - DNA, 13 bp, D. melanogaster
accttggcctatg

SEQ ID NO: 573511 - DNA, 13 bp, D. melanogaster
acctttatatata

SEQ ID NO: 573512 - DNA, 13 bp, D. melanogaster
acctttcaagttc

SEQ ID NO: 573513 - DNA, 13 bp, D. melanogaster
acctttcacacta

SEQ ID NO: 573514 - DNA, 13 bp, D. melanogaster
acctttcaccttt

SEQ ID NO: 573515 - DNA, 14 bp, D. melanogaster
acctttcataataa

SEQ ID NO: 573516 - DNA, 13 bp, D. melanogaster
acctttccatcta

SEQ ID NO: 573517 - DNA, 13 bp, D. melanogaster
accttttaaatat

SEQ ID NO: 573518 - DNA, 13 bp, D. melanogaster
accttttaaattg

SEQ ID NO: 573519 - DNA, 13 bp, D. melanogaster
accttttattgaa

SEQ ID NO: 573520 - DNA, 13 bp, D. melanogaster
accttttgaacgg

SEQ ID NO: 573521 - DNA, 13 bp, D. melanogaster
accttttgcaaaa

SEQ ID NO: 573522 - DNA, 13 bp, D. melanogaster
accttttgggcca

SEQ ID NO: 573523 - DNA, 13 bp, D. melanogaster
accttttgtagaa

SEQ ID NO: 573524 - DNA, 13 bp, D. melanogaster
acctttttaaaaa

SEQ ID NO: 573525 - DNA, 13 bp, D. melanogaster
accttttttatga

SEQ ID NO: 573526 - DNA, 13 bp, D. melanogaster
accttttttggcc

SEQ ID NO: 573527 - DNA, 13 bp, D. melanogaster
acgaaaaaacggt

SEQ ID NO: 573528 - DNA, 14 bp, D. melanogaster
acgaaaaaattatt

SEQ ID NO: 573529 - DNA, 13 bp, D. melanogaster
acgaaaaacccat

SEQ ID NO: 573530 - DNA, 13 bp, D. melanogaster
acgaaaaagtttg

SEQ ID NO: 573531 - DNA, 13 bp, D. melanogaster
acgaaaaatattt

SEQ ID NO: 573532 - DNA, 13 bp, D. melanogaster
acgaaaaatcgaa

SEQ ID NO: 573533 - DNA, 13 bp, D. melanogaster
acgaaaaattcaa

SEQ ID NO: 573534 - DNA, 14 bp, D. melanogaster
acgaaaaattcaaa

SEQ ID NO: 573535 - DNA, 13 bp, D. melanogaster
acgaaaacataca

SEQ ID NO: 573536 - DNA, 13 bp, D. melanogaster
acgaaaacatttc

SEQ ID NO: 573537 - DNA, 13 bp, D. melanogaster
acgaaaacgaaat

SEQ ID NO: 573538 - DNA, 13 bp, D. melanogaster
acgaaaagaaatc

SEQ ID NO: 573539 - DNA, 13 bp, D. melanogaster
acgaaaagtagtg

SEQ ID NO: 573540 - DNA, 13 bp, D. melanogaster
acgaaaataagtt

SEQ ID NO: 573541 - DNA, 13 bp, D. melanogaster
acgaaaatattta

SEQ ID NO: 573542 - DNA, 13 bp, D. melanogaster
acgaaaatatttg

SEQ ID NO: 573543 - DNA, 13 bp, D. melanogaster
acgaaaatgttgc

SEQ ID NO: 573544 - DNA, 13 bp, D. melanogaster
acgaaaatgttgg

SEQ ID NO: 573545 - DNA, 13 bp, D. melanogaster
acgaaaatgttta

SEQ ID NO: 573546 - DNA, 13 bp, D. melanogaster
acgaaaattataa

SEQ ID NO: 573547 - DNA, 13 bp, D. melanogaster
acgaaaattattt

SEQ ID NO: 573548 - DNA, 13 bp, D. melanogaster
acgaaaattccgt

SEQ ID NO: 573549 - DNA, 13 bp, D. melanogaster
acgaaaatttcaa

SEQ ID NO: 573550 - DNA, 13 bp, D. melanogaster
acgaaacaataca

SEQ ID NO: 573551 - DNA, 13 bp, D. melanogaster
acgaaaccaaatg

SEQ ID NO: 573552 - DNA, 13 bp, D. melanogaster
acgaaactgaaac

SEQ ID NO: 573553 - DNA, 13 bp, D. melanogaster
acgaaactgtaga

SEQ ID NO: 573554 - DNA, 13 bp, D. melanogaster
acgaaactgtgcg

SEQ ID NO: 573555 - DNA, 13 bp, D. melanogaster
acgaaagaaaagt

SEQ ID NO: 573556 - DNA, 14 bp, D. melanogaster
acgaaagaaaagta

SEQ ID NO: 573557 - DNA, 13 bp, D. melanogaster
acgaaagaagtta

SEQ ID NO: 573558 - DNA, 13 bp, D. melanogaster
acgaaagacttag

SEQ ID NO: 573559 - DNA, 13 bp, D. melanogaster
acgaaagcgaaac

SEQ ID NO: 573560 - DNA, 13 bp, D. melanogaster
acgaaagcgaaag

SEQ ID NO: 573561 - DNA, 13 bp, D. melanogaster
acgaaatacaaat

SEQ ID NO: 573562 - DNA, 13 bp, D. melanogaster
acgaaatatatat

SEQ ID NO: 573563 - DNA, 13 bp, D. melanogaster
acgaaatatatta

SEQ ID NO: 573564 - DNA, 13 bp, D. melanogaster
acgaaatatattt

SEQ ID NO: 573565 - DNA, 13 bp, D. melanogaster
acgaaatattttt

SEQ ID NO: 573566 - DNA, 13 bp, D. melanogaster
acgaaatcaaact

SEQ ID NO: 573567 - DNA, 14 bp, D. melanogaster
acgaaatcaaactt

SEQ ID NO: 573568 - DNA, 13 bp, D. melanogaster
acgaaatcaaatt

SEQ ID NO: 573569 - DNA, 13 bp, D. melanogaster
acgaaatcaatat

SEQ ID NO: 573570 - DNA, 13 bp, D. melanogaster
acgaaatgaaatt

SEQ ID NO: 573571 - DNA, 13 bp, D. melanogaster
acgaaatgaataa

SEQ ID NO: 573572 - DNA, 14 bp, D. melanogaster
acgaaatgaataaa

SEQ ID NO: 573573 - DNA, 13 bp, D. melanogaster
acgaaatgcaaaa

SEQ ID NO: 573574 - DNA, 13 bp, D. melanogaster
acgaaatgcctgc

SEQ ID NO: 573575 - DNA, 13 bp, D. melanogaster
acgaaatggaatg

SEQ ID NO: 573576 - DNA, 13 bp, D. melanogaster
acgaaatgggttt

SEQ ID NO: 573577 - DNA, 13 bp, D. melanogaster
acgaaattaaaac

SEQ ID NO: 573578 - DNA, 13 bp, D. melanogaster
acgaaattagttt

SEQ ID NO: 573579 - DNA, 13 bp, D. melanogaster
acgaaattcaaat

SEQ ID NO: 573580 - DNA, 13 bp, D. melanogaster
acgaaattgaata

SEQ ID NO: 573581 - DNA, 13 bp, D. melanogaster
acgaaattgaatt

SEQ ID NO: 573582 - DNA, 13 bp, D. melanogaster
acgaaattggcaa

SEQ ID NO: 573583 - DNA, 14 bp, D. melanogaster
acgaaattggccaa

SEQ ID NO: 573584 - DNA, 13 bp, D. melanogaster
acgaacaattaaa

SEQ ID NO: 573585 - DNA, 13 bp, D. melanogaster
acgaacactccac

SEQ ID NO: 573586 - DNA, 13 bp, D. melanogaster
acgaacagacgga

SEQ ID NO: 573587 - DNA, 13 bp, D. melanogaster
acgaacagcagca

SEQ ID NO: 573588 - DNA, 13 bp, D. melanogaster
acgaacaggacga

SEQ ID NO: 573589 - DNA, 13 bp, D. melanogaster
acgaaccctcttc

SEQ ID NO: 573590 - DNA, 13 bp, D. melanogaster
acgaacgaaataa

SEQ ID NO: 573591 - DNA, 13 bp, D. melanogaster
acgaacgacagac

SEQ ID NO: 573592 - DNA, 13 bp, D. melanogaster
acgaacgatatgt

SEQ ID NO: 573593 - DNA, 13 bp, D. melanogaster
acgaactcaacga

SEQ ID NO: 573594 - DNA, 14 bp, D. melanogaster
acgaactcaacgag

SEQ ID NO: 573595 - DNA, 13 bp, D. melanogaster
acgaagacaatca

SEQ ID NO: 573596 - DNA, 13 bp, D. melanogaster
acgaagagcgcaa

SEQ ID NO: 573597 - DNA, 13 bp, D. melanogaster
acgaagagttcga

SEQ ID NO: 573598 - DNA, 13 bp, D. melanogaster
acgaaggacgaag

SEQ ID NO: 573599 - DNA, 13 bp, D. melanogaster
acgaaggacgagg

SEQ ID NO: 573600 - DNA, 13 bp, D. melanogaster
acgaaggcaatgt

SEQ ID NO: 573601 - DNA, 13 bp, D. melanogaster
acgaagtcaaaaa

SEQ ID NO: 573602 - DNA, 13 bp, D. melanogaster
acgaatacacaca

SEQ ID NO: 573603 - DNA, 13 bp, D. melanogaster
acgaatacgaata

SEQ ID NO: 573604 - DNA, 14 bp, D. melanogaster
acgaatatatatat

SEQ ID NO: 573605 - DNA, 13 bp, D. melanogaster
acgaatctagtat

SEQ ID NO: 573606 - DNA, 14 bp, D. melanogaster
acgaatctagtata

SEQ ID NO: 573607 - DNA, 13 bp, D. melanogaster
acgaatgcaacat

SEQ ID NO: 573608 - DNA, 14 bp, D. melanogaster
acgaattagtgaaa

SEQ ID NO: 573609 - DNA, 14 bp, D. melanogaster
acgaattatcaaag

SEQ ID NO: 573610 - DNA, 13 bp, D. melanogaster
acgaattgaccaa

SEQ ID NO: 573611 - DNA, 13 bp, D. melanogaster
acgaattgtcttt

SEQ ID NO: 573612 - DNA, 13 bp, D. melanogaster
acgaatttaatat

SEQ ID NO: 573613 - DNA, 13 bp, D. melanogaster
acgaatttacatg

SEQ ID NO: 573614 - DNA, 13 bp, D. melanogaster
acgaatttatttg

SEQ ID NO: 573615 - DNA, 13 bp, D. melanogaster
acgacaaaaagcg

SEQ ID NO: 573616 - DNA, 13 bp, D. melanogaster
acgacaaacaatt

SEQ ID NO: 573617 - DNA, 13 bp, D. melanogaster
acgacaaaggtca

SEQ ID NO: 573618 - DNA, 14 bp, D. melanogaster
acgacaacaacaat

SEQ ID NO: 573619 - DNA, 14 bp, D. melanogaster
acgacaacaacagc

SEQ ID NO: 573620 - DNA, 13 bp, D. melanogaster
acgacaacaataa

SEQ ID NO: 573621 - DNA, 13 bp, D. melanogaster
acgacaacgacac

SEQ ID NO: 573622 - DNA, 14 bp, D. melanogaster
acgacaacgacact

SEQ ID NO: 573623 - DNA, 14 bp, D. melanogaster
acgacaacgacgac

SEQ ID NO: 573624 - DNA, 13 bp, D. melanogaster
acgacaactacaa

SEQ ID NO: 573625 - DNA, 13 bp, D. melanogaster
acgacaagtcgaa

SEQ ID NO: 573626 - DNA, 13 bp, D. melanogaster
acgacaatttcaa

SEQ ID NO: 573627 - DNA, 13 bp, D. melanogaster
acgacagcaacaa

SEQ ID NO: 573628 - DNA, 14 bp, D. melanogaster
acgacagcaacaac

SEQ ID NO: 573629 - DNA, 13 bp, D. melanogaster
acgacagcaacat

SEQ ID NO: 573630 - DNA, 13 bp, D. melanogaster
acgacccagacgg

SEQ ID NO: 573631 - DNA, 13 bp, D. melanogaster
acgacctcttcaa

SEQ ID NO: 573632 - DNA, 13 bp, D. melanogaster
acgacgacaacga

SEQ ID NO: 573633 - DNA, 13 bp, D. melanogaster
acgacgacgacat

SEQ ID NO: 573634 - DNA, 14 bp, D. melanogaster
acgacgacgacgac

SEQ ID NO: 573635 - DNA, 14 bp, D. melanogaster
acgacgacgatgac

SEQ ID NO: 573636 - DNA, 13 bp, D. melanogaster
acgacgacgatgg

SEQ ID NO: 573637 - DNA, 14 bp, D. melanogaster
acgacgacggcgac

SEQ ID NO: 573638 - DNA, 13 bp, D. melanogaster
acgacgagccggg

SEQ ID NO: 573639 - DNA, 13 bp, D. melanogaster
acgacgatgatgc

SEQ ID NO: 573640 - DNA, 13 bp, D. melanogaster
acgacggcacggt

SEQ ID NO: 573641 - DNA, 13 bp, D. melanogaster
acgacggcgacga

SEQ ID NO: 573642 - DNA, 13 bp, D. melanogaster
acgactacagaaa

SEQ ID NO: 573643 - DNA, 14 bp, D. melanogaster
acgactacagaaaa

SEQ ID NO: 573644 - DNA, 13 bp, D. melanogaster
acgactatatttc

SEQ ID NO: 573645 - DNA, 13 bp, D. melanogaster
acgactatcagat

SEQ ID NO: 573646 - DNA, 13 bp, D. melanogaster
acgactccaaaca

SEQ ID NO: 573647 - DNA, 13 bp, D. melanogaster
acgactgctgctg

SEQ ID NO: 573648 - DNA, 13 bp, D. melanogaster
acgacttgattat

SEQ ID NO: 573649 - DNA, 13 bp, D. melanogaster
acgactttattct

SEQ ID NO: 573650 - DNA, 13 bp, D. melanogaster
acgagaaatttca

SEQ ID NO: 573651 - DNA, 13 bp, D. melanogaster
acgagaacaaagt

SEQ ID NO: 573652 - DNA, 13 bp, D. melanogaster
acgagaacgagaa

SEQ ID NO: 573653 - DNA, 13 bp, D. melanogaster
acgagaccactcg

SEQ ID NO: 573654 - DNA, 14 bp, D. melanogaster
acgagacgagacga

SEQ ID NO: 573655 - DNA, 13 bp, D. melanogaster
acgagagagcgag

SEQ ID NO: 573656 - DNA, 13 bp, D. melanogaster
acgagagccgagc

SEQ ID NO: 573657 - DNA, 13 bp, D. melanogaster
acgagagtagtga

SEQ ID NO: 573658 - DNA, 13 bp, D. melanogaster
acgagatgaaatc

SEQ ID NO: 573659 - DNA, 13 bp, D. melanogaster
acgagatggccaa

SEQ ID NO: 573660 - DNA, 13 bp, D. melanogaster
acgagcacacaca

SEQ ID NO: 573661 - DNA, 14 bp, D. melanogaster
acgagccatttcaa

SEQ ID NO: 573662 - DNA, 13 bp, D. melanogaster
acgagctcaacga

SEQ ID NO: 573663 - DNA, 14 bp, D. melanogaster
acgagctcaacgag

SEQ ID NO: 573664 - DNA, 13 bp, D. melanogaster
acgaggaaataaa

SEQ ID NO: 573665 - DNA, 13 bp, D. melanogaster
acgaggaaatgaa

SEQ ID NO: 573666 - DNA, 13 bp, D. melanogaster
acgaggcgtatga

SEQ ID NO: 573667 - DNA, 14 bp, D. melanogaster
acgaggcgtatgag

SEQ ID NO: 573668 - DNA, 13 bp, D. melanogaster
acgaggcgtatgc

SEQ ID NO: 573669 - DNA, 13 bp, D. melanogaster
acgagggtggttt

SEQ ID NO: 573670 - DNA, 13 bp, D. melanogaster
acgagtaacgagt

SEQ ID NO: 573671 - DNA, 13 bp, D. melanogaster
acgagtaacgggt

SEQ ID NO: 573672 - DNA, 14 bp, D. melanogaster
acgagtaacgggta

SEQ ID NO: 573673 - DNA, 13 bp, D. melanogaster
acgagtacgagta

SEQ ID NO: 573674 - DNA, 13 bp, D. melanogaster
acgagtatatatg

SEQ ID NO: 573675 - DNA, 13 bp, D. melanogaster
acgagtatatgta

SEQ ID NO: 573676 - DNA, 13 bp, D. melanogaster
acgagtatctgat

SEQ ID NO: 573677 - DNA, 13 bp, D. melanogaster
acgagtatgtaca

SEQ ID NO: 573678 - DNA, 13 bp, D. melanogaster
acgagtgtgtgtg

SEQ ID NO: 573679 - DNA, 13 bp, D. melanogaster
acgagttcaacga

SEQ ID NO: 573680 - DNA, 14 bp, D. melanogaster
acgagttcaacgag

SEQ ID NO: 573681 - DNA, 13 bp, D. melanogaster
acgagttcattag

SEQ ID NO: 573682 - DNA, 13 bp, D. melanogaster
acgagttggttaa

SEQ ID NO: 573683 - DNA, 13 bp, D. melanogaster
acgataaattgat

SEQ ID NO: 573684 - DNA, 13 bp, D. melanogaster
acgataagctcaa

SEQ ID NO: 573685 - DNA, 13 bp, D. melanogaster
acgataatgatga

SEQ ID NO: 573686 - DNA, 14 bp, D. melanogaster
acgataatgatgat

SEQ ID NO: 573687 - DNA, 13 bp, D. melanogaster
acgataatggtca

SEQ ID NO: 573688 - DNA, 13 bp, D. melanogaster
acgatacaagcaa

SEQ ID NO: 573689 - DNA, 13 bp, D. melanogaster
acgatatacgata

SEQ ID NO: 573690 - DNA, 13 bp, D. melanogaster
acgatatagtgga

SEQ ID NO: 573691 - DNA, 13 bp, D. melanogaster
acgatatggaatt

SEQ ID NO: 573692 - DNA, 13 bp, D. melanogaster
acgatcacgaatt

SEQ ID NO: 573693 - DNA, 13 bp, D. melanogaster
acgatccaattca

SEQ ID NO: 573694 - DNA, 13 bp, D. melanogaster
acgatctaacgct

SEQ ID NO: 573695 - DNA, 13 bp, D. melanogaster
acgatcttcagcg

SEQ ID NO: 573696 - DNA, 13 bp, D. melanogaster
acgatgacgacaa

SEQ ID NO: 573697 - DNA, 14 bp, D. melanogaster
acgatgacgacgac

SEQ ID NO: 573698 - DNA, 13 bp, D. melanogaster
acgatgacgatga

SEQ ID NO: 573699 - DNA, 14 bp, D. melanogaster
acgatgacgatgat

SEQ ID NO: 573700 - DNA, 13 bp, D. melanogaster
acgatgataatga

SEQ ID NO: 573701 - DNA, 13 bp, D. melanogaster
acgatgatgaaga

SEQ ID NO: 573702 - DNA, 13 bp, D. melanogaster
acgatgatgacga

SEQ ID NO: 573703 - DNA, 13 bp, D. melanogaster
acgatgatgctga

SEQ ID NO: 573704 - DNA, 13 bp, D. melanogaster
acgatggaagatg

SEQ ID NO: 573705 - DNA, 13 bp, D. melanogaster
acgatggaatgct

SEQ ID NO: 573706 - DNA, 13 bp, D. melanogaster
acgatggcaaaaa

SEQ ID NO: 573707 - DNA, 13 bp, D. melanogaster
acgatggcgatga

SEQ ID NO: 573708 - DNA, 13 bp, D. melanogaster
acgatgtgggggc

SEQ ID NO: 573709 - DNA, 13 bp, D. melanogaster
acgatgtgtgtgt

SEQ ID NO: 573710 - DNA, 13 bp, D. melanogaster
acgatgttattgc

SEQ ID NO: 573711 - DNA, 13 bp, D. melanogaster
acgattaaaacca

SEQ ID NO: 573712 - DNA, 13 bp, D. melanogaster
acgattacgatta

SEQ ID NO: 573713 - DNA, 13 bp, D. melanogaster
acgattagcttta

SEQ ID NO: 573714 - DNA, 13 bp, D. melanogaster
acgattctaaatt

SEQ ID NO: 573715 - DNA, 14 bp, D. melanogaster
acgatttaaatcca

SEQ ID NO: 573716 - DNA, 13 bp, D. melanogaster
acgatttatatac

SEQ ID NO: 573717 - DNA, 13 bp, D. melanogaster
acgatttcatcat

SEQ ID NO: 573718 - DNA, 13 bp, D. melanogaster
acgatttcgaagt

SEQ ID NO: 573719 - DNA, 13 bp, D. melanogaster
acgattttaaata

SEQ ID NO: 573720 - DNA, 13 bp, D. melanogaster
acgattttaagca

SEQ ID NO: 573721 - DNA, 13 bp, D. melanogaster
acgattttgcaat

SEQ ID NO: 573722 - DNA, 13 bp, D. melanogaster
acgattttggact

SEQ ID NO: 573723 - DNA, 13 bp, D. melanogaster
acgattttgttaa

SEQ ID NO: 573724 - DNA, 13 bp, D. melanogaster
acgattttttgaa

SEQ ID NO: 573725 - DNA, 14 bp, D. melanogaster
acgattttttgaac

SEQ ID NO: 573726 - DNA, 13 bp, D. melanogaster
acgattttttggc

SEQ ID NO: 573727 - DNA, 13 bp, D. melanogaster
acgatttttttaa

SEQ ID NO: 573728 - DNA, 13 bp, D. melanogaster
acgcaaacataaa

SEQ ID NO: 573729 - DNA, 15 bp, D. melanogaster
acgcaaacgggctgc

SEQ ID NO: 573730 - DNA, 13 bp, D. melanogaster
acgcaaactaaaa

SEQ ID NO: 573731 - DNA, 14 bp, D. melanogaster
acgcaaactaaaaa

SEQ ID NO: 573732 - DNA, 13 bp, D. melanogaster
acgcaaataaaca

SEQ ID NO: 573733 - DNA, 13 bp, D. melanogaster
acgcaaatgcaaa

SEQ ID NO: 573734 - DNA, 13 bp, D. melanogaster
acgcaacaaactg

SEQ ID NO: 573735 - DNA, 13 bp, D. melanogaster
acgcaacaataaa

SEQ ID NO: 573736 - DNA, 13 bp, D. melanogaster
acgcaacgcaacg

SEQ ID NO: 573737 - DNA, 13 bp, D. melanogaster
acgcaatcacgga

SEQ ID NO: 573738 - DNA, 13 bp, D. melanogaster
acgcaatcgccaa

SEQ ID NO: 573739 - DNA, 13 bp, D. melanogaster
acgcaatgcaaaa

SEQ ID NO: 573740 - DNA, 13 bp, D. melanogaster
acgcaattttctt

SEQ ID NO: 573741 - DNA, 13 bp, D. melanogaster
acgcacacaaata

SEQ ID NO: 573742 - DNA, 13 bp, D. melanogaster
acgcacacacact

SEQ ID NO: 573743 - DNA, 13 bp, D. melanogaster
acgcacacacaga

SEQ ID NO: 573744 - DNA, 13 bp, D. melanogaster
acgcacacacatg

SEQ ID NO: 573745 - DNA, 14 bp, D. melanogaster
acgcacacacgcac

SEQ ID NO: 573746 - DNA, 14 bp, D. melanogaster
acgcacacactcac

SEQ ID NO: 573747 - DNA, 13 bp, D. melanogaster
acgcacacactta

SEQ ID NO: 573748 - DNA, 14 bp, D. melanogaster
acgcacacacttac

SEQ ID NO: 573749 - DNA, 13 bp, D. melanogaster
acgcacacacttg

SEQ ID NO: 573750 - DNA, 13 bp, D. melanogaster
acgcacacacttt

SEQ ID NO: 573751 - DNA, 14 bp, D. melanogaster
acgcacacatacac

SEQ ID NO: 573752 - DNA, 15 bp, D. melanogaster
acgcacacatacaca

SEQ ID NO: 573753 - DNA, 13 bp, D. melanogaster
acgcacacatgca

SEQ ID NO: 573754 - DNA, 14 bp, D. melanogaster
acgcacacatgcac

SEQ ID NO: 573755 - DNA, 13 bp, D. melanogaster
acgcacacatgtg

SEQ ID NO: 573756 - DNA, 13 bp, D. melanogaster
acgcacacattca

SEQ ID NO: 573757 - DNA, 13 bp, D. melanogaster
acgcacacgacaa

SEQ ID NO: 573758 - DNA, 14 bp, D. melanogaster
acgcacacgacaat

SEQ ID NO: 573759 - DNA, 13 bp, D. melanogaster
acgcacacgcacg

SEQ ID NO: 573760 - DNA, 13 bp, D. melanogaster
acgcacactcact

SEQ ID NO: 573761 - DNA, 13 bp, D. melanogaster
acgcacactcgaa

SEQ ID NO: 573762 - DNA, 13 bp, D. melanogaster
acgcacagacaca

SEQ ID NO: 573763 - DNA, 13 bp, D. melanogaster
acgcacataaaaa

SEQ ID NO: 573764 - DNA, 13 bp, D. melanogaster
acgcacataaaat

SEQ ID NO: 573765 - DNA, 14 bp, D. melanogaster
acgcacatacacac

SEQ ID NO: 573766 - DNA, 13 bp, D. melanogaster
acgcacatttcgg

SEQ ID NO: 573767 - DNA, 14 bp, D. melanogaster
acgcacatttcggt

SEQ ID NO: 573768 - DNA, 13 bp, D. melanogaster
acgcacgcacaca

SEQ ID NO: 573769 - DNA, 14 bp, D. melanogaster
acgcacgcacacaa

SEQ ID NO: 573770 - DNA, 14 bp, D. melanogaster
acgcacgcacacag

SEQ ID NO: 573771 - DNA, 13 bp, D. melanogaster
acgcacgcacact

SEQ ID NO: 573772 - DNA, 13 bp, D. melanogaster
acgcacgcacgca

SEQ ID NO: 573773 - DNA, 14 bp, D. melanogaster
acgcacgcacgcac

SEQ ID NO: 573774 - DNA, 13 bp, D. melanogaster
acgcactcacaca

SEQ ID NO: 573775 - DNA, 13 bp, D. melanogaster
acgcactgtttgc

SEQ ID NO: 573776 - DNA, 14 bp, D. melanogaster
acgcagacacacac

SEQ ID NO: 573777 - DNA, 13 bp, D. melanogaster
acgcagagctgcc

SEQ ID NO: 573778 - DNA, 13 bp, D. melanogaster
acgcagcaaacat

SEQ ID NO: 573779 - DNA, 13 bp, D. melanogaster
acgcagcatcagc

SEQ ID NO: 573780 - DNA, 13 bp, D. melanogaster
acgcagcgtatgc

SEQ ID NO: 573781 - DNA, 13 bp, D. melanogaster
acgcagcgtgtgc

SEQ ID NO: 573782 - DNA, 13 bp, D. melanogaster
acgcagcgttgac

SEQ ID NO: 573783 - DNA, 13 bp, D. melanogaster
acgcagctcaagt

SEQ ID NO: 573784 - DNA, 13 bp, D. melanogaster
acgcagctgcaga

SEQ ID NO: 573785 - DNA, 13 bp, D. melanogaster
acgcaggacgaag

SEQ ID NO: 573786 - DNA, 13 bp, D. melanogaster
acgcaggcagcca

SEQ ID NO: 573787 - DNA, 14 bp, D. melanogaster
acgcagggcaacaa

SEQ ID NO: 573788 - DNA, 13 bp, D. melanogaster
acgcagtggaaac

SEQ ID NO: 573789 - DNA, 13 bp, D. melanogaster
acgcagtgtgggc

SEQ ID NO: 573790 - DNA, 13 bp, D. melanogaster
acgcataaaattt

SEQ ID NO: 573791 - DNA, 13 bp, D. melanogaster
acgcataattctg

SEQ ID NO: 573792 - DNA, 13 bp, D. melanogaster
acgcatacgcagc

SEQ ID NO: 573793 - DNA, 13 bp, D. melanogaster
acgcatacgccat

SEQ ID NO: 573794 - DNA, 14 bp, D. melanogaster
acgcatacgccccg

SEQ ID NO: 573795 - DNA, 15 bp, D. melanogaster
acgcatacgccgcgt

SEQ ID NO: 573796 - DNA, 13 bp, D. melanogaster
acgcatacgcctc

SEQ ID NO: 573797 - DNA, 13 bp, D. melanogaster
acgcatttgcatt

SEQ ID NO: 573798 - DNA, 13 bp, D. melanogaster
acgcatttttgtg

SEQ ID NO: 573799 - DNA, 13 bp, D. melanogaster
acgccaaaaacgt

SEQ ID NO: 573800 - DNA, 14 bp, D. melanogaster
acgccaaaaacgtg

SEQ ID NO: 573801 - DNA, 13 bp, D. melanogaster
acgccaacgccaa

SEQ ID NO: 573802 - DNA, 13 bp, D. melanogaster
acgccaagggctt

SEQ ID NO: 573803 - DNA, 13 bp, D. melanogaster
acgccaatgtcaa

SEQ ID NO: 573804 - DNA, 13 bp, D. melanogaster
acgccacgttgca

SEQ ID NO: 573805 - DNA, 13 bp, D. melanogaster
acgccacttcctt

SEQ ID NO: 573806 - DNA, 14 bp, D. melanogaster
acgccagcaagaag

SEQ ID NO: 573807 - DNA, 13 bp, D. melanogaster
acgccagcagcgg

SEQ ID NO: 573808 - DNA, 13 bp, D. melanogaster
acgccatcgccat

SEQ ID NO: 573809 - DNA, 14 bp, D. melanogaster
acgccatcgccatc

SEQ ID NO: 573810 - DNA, 13 bp, D. melanogaster
acgccatcggtat

SEQ ID NO: 573811 - DNA, 13 bp, D. melanogaster
acgccatgtgcgc

SEQ ID NO: 573812 - DNA, 13 bp, D. melanogaster
acgccattttgtg

SEQ ID NO: 573813 - DNA, 13 bp, D. melanogaster
acgcccacaaact

SEQ ID NO: 573814 - DNA, 13 bp, D. melanogaster
acgcccacaaagc

SEQ ID NO: 573815 - DNA, 13 bp, D. melanogaster
acgcccacaaatt

SEQ ID NO: 573816 - DNA, 13 bp, D. melanogaster
acgcccacaagcc

SEQ ID NO: 573817 - DNA, 14 bp, D. melanogaster
acgcccacaagccg

SEQ ID NO: 573818 - DNA, 13 bp, D. melanogaster
acgcccacacctt

SEQ ID NO: 573819 - DNA, 13 bp, D. melanogaster
acgcccacacttt

SEQ ID NO: 573820 - DNA, 13 bp, D. melanogaster
acgcccacatttt

SEQ ID NO: 573821 - DNA, 13 bp, D. melanogaster
acgcccacgcaca

SEQ ID NO: 573822 - DNA, 13 bp, D. melanogaster
acgcccactccaa

SEQ ID NO: 573823 - DNA, 13 bp, D. melanogaster
acgcccactctaa

SEQ ID NO: 573824 - DNA, 14 bp, D. melanogaster
acgcccacttttcc

SEQ ID NO: 573825 - DNA, 13 bp, D. melanogaster
acgcccacttttg

SEQ ID NO: 573826 - DNA, 13 bp, D. melanogaster
acgcccacttttt

SEQ ID NO: 573827 - DNA, 14 bp, D. melanogaster
acgcccagctgaca

SEQ ID NO: 573828 - DNA, 13 bp, D. melanogaster
acgcccattctaa

SEQ ID NO: 573829 - DNA, 13 bp, D. melanogaster
acgccccctcaaa

SEQ ID NO: 573830 - DNA, 13 bp, D. melanogaster
acgcccccttcgc

SEQ ID NO: 573831 - DNA, 13 bp, D. melanogaster
acgcccccttttc

SEQ ID NO: 573832 - DNA, 14 bp, D. melanogaster
acgcccccttttcg

SEQ ID NO: 573833 - DNA, 13 bp, D. melanogaster
acgccccttcgcc

SEQ ID NO: 573834 - DNA, 13 bp, D. melanogaster
acgcccgaagaga

SEQ ID NO: 573835 - DNA, 13 bp, D. melanogaster
acgccgcgtgtgc

SEQ ID NO: 573836 - DNA, 13 bp, D. melanogaster
acgccggcagagc

SEQ ID NO: 573837 - DNA, 13 bp, D. melanogaster
acgccggcagagg

SEQ ID NO: 573838 - DNA, 13 bp, D. melanogaster
acgcctacacttt

SEQ ID NO: 573839 - DNA, 13 bp, D. melanogaster
acgcctcttttta

SEQ ID NO: 573840 - DNA, 14 bp, D. melanogaster
acgcctgctgcgcc

SEQ ID NO: 573841 - DNA, 13 bp, D. melanogaster
acgcgagcacaaa

SEQ ID NO: 573842 - DNA, 13 bp, D. melanogaster
acgcgcacgcaca

SEQ ID NO: 573843 - DNA, 14 bp, D. melanogaster
acgcggcgtatacg

SEQ ID NO: 573844 - DNA, 14 bp, D. melanogaster
acgcggcgtatgag

SEQ ID NO: 573845 - DNA, 13 bp, D. melanogaster
acgcggcgtatgc

SEQ ID NO: 573846 - DNA, 14 bp, D. melanogaster
acgcggcgtatgcg

SEQ ID NO: 573847 - DNA, 13 bp, D. melanogaster
acgcgtatatgtg

SEQ ID NO: 573848 - DNA, 14 bp, D. melanogaster
acgcgtgtgtgtgt

SEQ ID NO: 573849 - DNA, 14 bp, D. melanogaster
acgctaataaatat

SEQ ID NO: 573850 - DNA, 13 bp, D. melanogaster
acgctcacacaca

SEQ ID NO: 573851 - DNA, 14 bp, D. melanogaster
acgctcacacacac

SEQ ID NO: 573852 - DNA, 13 bp, D. melanogaster
acgctctctctct

SEQ ID NO: 573853 - DNA, 14 bp, D. melanogaster
acgctctctctctc

SEQ ID NO: 573854 - DNA, 13 bp, D. melanogaster
acgctgccacgcc

SEQ ID NO: 573855 - DNA, 14 bp, D. melanogaster
acgctgccacgccc

SEQ ID NO: 573856 - DNA, 13 bp, D. melanogaster
acgctggccaacg

SEQ ID NO: 573857 - DNA, 14 bp, D. melanogaster
acgctggccaacgc

SEQ ID NO: 573858 - DNA, 13 bp, D. melanogaster
acgctggccgctg

SEQ ID NO: 573859 - DNA, 13 bp, D. melanogaster
acgcttccttgag

SEQ ID NO: 573860 - DNA, 13 bp, D. melanogaster
acgcttcgtggca

SEQ ID NO: 573861 - DNA, 13 bp, D. melanogaster
acgcttgctgaat

SEQ ID NO: 573862 - DNA, 13 bp, D. melanogaster
acgcttttcaaat

SEQ ID NO: 573863 - DNA, 13 bp, D. melanogaster
acgcttttccagc

SEQ ID NO: 573864 - DNA, 13 bp, D. melanogaster
acgcttttggcca

SEQ ID NO: 573865 - DNA, 13 bp, D. melanogaster
acggaaaaatcga

SEQ ID NO: 573866 - DNA, 13 bp, D. melanogaster
acggaaaacaaat

SEQ ID NO: 573867 - DNA, 13 bp, D. melanogaster
acggaaaagcaca

SEQ ID NO: 573868 - DNA, 13 bp, D. melanogaster
acggaaaagtata

SEQ ID NO: 573869 - DNA, 13 bp, D. melanogaster
acggaaaatcgaa

SEQ ID NO: 573870 - DNA, 13 bp, D. melanogaster
acggaaaatgcga

SEQ ID NO: 573871 - DNA, 13 bp, D. melanogaster
acggaaacacaca

SEQ ID NO: 573872 - DNA, 14 bp, D. melanogaster
acggaaacggaaat

SEQ ID NO: 573873 - DNA, 13 bp, D. melanogaster
acggaaactggcc

SEQ ID NO: 573874 - DNA, 13 bp, D. melanogaster
acggaaatgaaaa

SEQ ID NO: 573875 - DNA, 13 bp, D. melanogaster
acggaaatgaaat

SEQ ID NO: 573876 - DNA, 13 bp, D. melanogaster
acggaaatgccaa

SEQ ID NO: 573877 - DNA, 14 bp, D. melanogaster
acggaaatgccaat

SEQ ID NO: 573878 - DNA, 13 bp, D. melanogaster
acggaaccattga

SEQ ID NO: 573879 - DNA, 13 bp, D. melanogaster
acggaaccggagt

SEQ ID NO: 573880 - DNA, 14 bp, D. melanogaster
acggaacggaacgg

SEQ ID NO: 573881 - DNA, 13 bp, D. melanogaster
acggaactgcatc

SEQ ID NO: 573882 - DNA, 14 bp, D. melanogaster
acggaacttaagga

SEQ ID NO: 573883 - DNA, 14 bp, D. melanogaster
acggaatacaaaaa

SEQ ID NO: 573884 - DNA, 13 bp, D. melanogaster
acggaatcggaat

SEQ ID NO: 573885 - DNA, 13 bp, D. melanogaster
acggaatgcaaaa

SEQ ID NO: 573886 - DNA, 13 bp, D. melanogaster
acggacaaaatga

SEQ ID NO: 573887 - DNA, 13 bp, D. melanogaster
acggacaaacgga

SEQ ID NO: 573888 - DNA, 13 bp, D. melanogaster
acggacaaatgga

SEQ ID NO: 573889 - DNA, 13 bp, D. melanogaster
acggacacacaca

SEQ ID NO: 573890 - DNA, 13 bp, D. melanogaster
acggacagacaaa

SEQ ID NO: 573891 - DNA, 13 bp, D. melanogaster
acggacagacgga

SEQ ID NO: 573892 - DNA, 14 bp, D. melanogaster
acggacagacggac

SEQ ID NO: 573893 - DNA, 13 bp, D. melanogaster
acggacaggcgga

SEQ ID NO: 573894 - DNA, 13 bp, D. melanogaster
acggacaggtgga

SEQ ID NO: 573895 - DNA, 13 bp, D. melanogaster
acggacatacgga

SEQ ID NO: 573896 - DNA, 13 bp, D. melanogaster
acggacatgacca

SEQ ID NO: 573897 - DNA, 14 bp, D. melanogaster
acggacatgaccag

SEQ ID NO: 573898 - DNA, 13 bp, D. melanogaster
acggacatggcca

SEQ ID NO: 573899 - DNA, 14 bp, D. melanogaster
acggacatggccag

SEQ ID NO: 573900 - DNA, 13 bp, D. melanogaster
acggacatggcta

SEQ ID NO: 573901 - DNA, 13 bp, D. melanogaster
acggacatgggaa

SEQ ID NO: 573902 - DNA, 13 bp, D. melanogaster
acggacatggtca

SEQ ID NO: 573903 - DNA, 13 bp, D. melanogaster
acggacgacggac

SEQ ID NO: 573904 - DNA, 13 bp, D. melanogaster
acggacggacaaa

SEQ ID NO: 573905 - DNA, 14 bp, D. melanogaster
acggacggacaaac

SEQ ID NO: 573906 - DNA, 13 bp, D. melanogaster
acggacggacagg

SEQ ID NO: 573907 - DNA, 13 bp, D. melanogaster
acggacggacgga

SEQ ID NO: 573908 - DNA, 14 bp, D. melanogaster
acggacggacggac

SEQ ID NO: 573909 - DNA, 13 bp, D. melanogaster
acggactaacgaa

SEQ ID NO: 573910 - DNA, 13 bp, D. melanogaster
acggagaaaaata

SEQ ID NO: 573911 - DNA, 13 bp, D. melanogaster
acggagacagacg

SEQ ID NO: 573912 - DNA, 13 bp, D. melanogaster
acggagatcgaaa

SEQ ID NO: 573913 - DNA, 13 bp, D. melanogaster
acggagcacggag

SEQ ID NO: 573914 - DNA, 13 bp, D. melanogaster
acggaggactcga

SEQ ID NO: 573915 - DNA, 13 bp, D. melanogaster
acggatacgaaac

SEQ ID NO: 573916 - DNA, 14 bp, D. melanogaster
acggatacgaaaca

SEQ ID NO: 573917 - DNA, 14 bp, D. melanogaster
acggatacggatac

SEQ ID NO: 573918 - DNA, 13 bp, D. melanogaster
acggatatatata

SEQ ID NO: 573919 - DNA, 13 bp, D. melanogaster
acggatatctctg

SEQ ID NO: 573920 - DNA, 13 bp, D. melanogaster
acggatgaatatg

SEQ ID NO: 573921 - DNA, 13 bp, D. melanogaster
acggatgcggatg

SEQ ID NO: 573922 - DNA, 14 bp, D. melanogaster
acggatgcggatgc

SEQ ID NO: 573923 - DNA, 13 bp, D. melanogaster
acggatggacgga

SEQ ID NO: 573924 - DNA, 15 bp, D. melanogaster
acggatttggcggtt

SEQ ID NO: 573925 - DNA, 13 bp, D. melanogaster
acggcaaaaagtt

SEQ ID NO: 573926 - DNA, 13 bp, D. melanogaster
acggcaaacggca

SEQ ID NO: 573927 - DNA, 13 bp, D. melanogaster
acggcaacaaatt

SEQ ID NO: 573928 - DNA, 13 bp, D. melanogaster
acggcaacaacaa

SEQ ID NO: 573929 - DNA, 14 bp, D. melanogaster
acggcaacaacaaa

SEQ ID NO: 573930 - DNA, 14 bp, D. melanogaster
acggcaacaacaat

SEQ ID NO: 573931 - DNA, 14 bp, D. melanogaster
acggcaacggcaac

SEQ ID NO: 573932 - DNA, 13 bp, D. melanogaster
acggcaactaatg

SEQ ID NO: 573933 - DNA, 13 bp, D. melanogaster
acggcaagaaaat

SEQ ID NO: 573934 - DNA, 13 bp, D. melanogaster
acggcaataaaaa

SEQ ID NO: 573935 - DNA, 13 bp, D. melanogaster
acggcaccatatt

SEQ ID NO: 573936 - DNA, 13 bp, D. melanogaster
acggcacttgttc

SEQ ID NO: 573937 - DNA, 14 bp, D. melanogaster
acggcagcaacagc

SEQ ID NO: 573938 - DNA, 13 bp, D. melanogaster
acggcagcaacat

SEQ ID NO: 573939 - DNA, 14 bp, D. melanogaster
acggcagcaacatc

SEQ ID NO: 573940 - DNA, 14 bp, D. melanogaster
acggcagcagcaac

SEQ ID NO: 573941 - DNA, 13 bp, D. melanogaster
acggcagcagcag

SEQ ID NO: 573942 - DNA, 13 bp, D. melanogaster
acggcagcggcaa

SEQ ID NO: 573943 - DNA, 13 bp, D. melanogaster
acggcatcctgcg

SEQ ID NO: 573944 - DNA, 13 bp, D. melanogaster
acggccaaaatta

SEQ ID NO: 573945 - DNA, 13 bp, D. melanogaster
acggccaacaatg

SEQ ID NO: 573946 - DNA, 13 bp, D. melanogaster
acggccacaccaa

SEQ ID NO: 573947 - DNA, 13 bp, D. melanogaster
acggccacgccca

SEQ ID NO: 573948 - DNA, 14 bp, D. melanogaster
acggccacgcccac

SEQ ID NO: 573949 - DNA, 13 bp, D. melanogaster
acggccagcaact

SEQ ID NO: 573950 - DNA, 13 bp, D. melanogaster
acggccattaaaa

SEQ ID NO: 573951 - DNA, 13 bp, D. melanogaster
acggcggagagag

SEQ ID NO: 573952 - DNA, 13 bp, D. melanogaster
acggcggcaacat

SEQ ID NO: 573953 - DNA, 14 bp, D. melanogaster
acggcggtgtttaa

SEQ ID NO: 573954 - DNA, 13 bp, D. melanogaster
acggcgtcaaaat

SEQ ID NO: 573955 - DNA, 13 bp, D. melanogaster
acggctatcagct

SEQ ID NO: 573956 - DNA, 13 bp, D. melanogaster
acggctgccttca

SEQ ID NO: 573957 - DNA, 13 bp, D. melanogaster
acggctgcgctgc

SEQ ID NO: 573958 - DNA, 13 bp, D. melanogaster
acggcttcgagga

SEQ ID NO: 573959 - DNA, 13 bp, D. melanogaster
acgggagagcaaa

SEQ ID NO: 573960 - DNA, 13 bp, D. melanogaster
acgggcggtggcg

SEQ ID NO: 573961 - DNA, 13 bp, D. melanogaster
acgggcttcggca

SEQ ID NO: 573962 - DNA, 13 bp, D. melanogaster
acggggcgtatac

SEQ ID NO: 573963 - DNA, 14 bp, D. melanogaster
acggggcgtatacg

SEQ ID NO: 573964 - DNA, 13 bp, D. melanogaster
acggggcgtatga

SEQ ID NO: 573965 - DNA, 14 bp, D. melanogaster
acggggcgtatgcg

SEQ ID NO: 573966 - DNA, 13 bp, D. melanogaster
acgggggcgtggc

SEQ ID NO: 573967 - DNA, 13 bp, D. melanogaster
acgggtataagaa

SEQ ID NO: 573968 - DNA, 13 bp, D. melanogaster
acggtcacactgc

SEQ ID NO: 573969 - DNA, 13 bp, D. melanogaster
acggtcgccatgt

SEQ ID NO: 573970 - DNA, 13 bp, D. melanogaster
acggtgccatttt

SEQ ID NO: 573971 - DNA, 14 bp, D. melanogaster
acggtggcaccgcc

SEQ ID NO: 573972 - DNA, 13 bp, D. melanogaster
acggtgtttgccc

SEQ ID NO: 573973 - DNA, 13 bp, D. melanogaster
acggttaccaaaa

SEQ ID NO: 573974 - DNA, 13 bp, D. melanogaster
acgtaaataaata

SEQ ID NO: 573975 - DNA, 13 bp, D. melanogaster
acgtaacgtaacg

SEQ ID NO: 573976 - DNA, 13 bp, D. melanogaster
acgtaagaaaatg

SEQ ID NO: 573977 - DNA, 13 bp, D. melanogaster
acgtacaaatcga

SEQ ID NO: 573978 - DNA, 13 bp, D. melanogaster
acgtacaactttt

SEQ ID NO: 573979 - DNA, 13 bp, D. melanogaster
acgtacatacaca

SEQ ID NO: 573980 - DNA, 14 bp, D. melanogaster
acgtacatacatac

SEQ ID NO: 573981 - DNA, 13 bp, D. melanogaster
acgtacatataca

SEQ ID NO: 573982 - DNA, 13 bp, D. melanogaster
acgtacatatatg

SEQ ID NO: 573983 - DNA, 13 bp, D. melanogaster
acgtacatatgta

SEQ ID NO: 573984 - DNA, 13 bp, D. melanogaster
acgtacatatgtg

SEQ ID NO: 573985 - DNA, 13 bp, D. melanogaster
acgtacgtatata

SEQ ID NO: 573986 - DNA, 13 bp, D. melanogaster
acgtagtgacgaa

SEQ ID NO: 573987 - DNA, 13 bp, D. melanogaster
acgtatacatatg

SEQ ID NO: 573988 - DNA, 13 bp, D. melanogaster
acgtatacgcaat

SEQ ID NO: 573989 - DNA, 14 bp, D. melanogaster
acgtatacgcactg

SEQ ID NO: 573990 - DNA, 13 bp, D. melanogaster
acgtatacgcagt

SEQ ID NO: 573991 - DNA, 13 bp, D. melanogaster
acgtatacgtaat

SEQ ID NO: 573992 - DNA, 14 bp, D. melanogaster
acgtatatgtatat

SEQ ID NO: 573993 - DNA, 14 bp, D. melanogaster
acgtatatgtatgt

SEQ ID NO: 573994 - DNA, 13 bp, D. melanogaster
acgtatctgtatc

SEQ ID NO: 573995 - DNA, 13 bp, D. melanogaster
acgtatgcgcaat

SEQ ID NO: 573996 - DNA, 13 bp, D. melanogaster
acgtatgtacata

SEQ ID NO: 573997 - DNA, 13 bp, D. melanogaster
acgtatgtatgta

SEQ ID NO: 573998 - DNA, 13 bp, D. melanogaster
acgtattcctaaa

SEQ ID NO: 573999 - DNA, 13 bp, D. melanogaster
acgtcaacgtcaa

SEQ ID NO: 574000 - DNA, 13 bp, D. melanogaster
acgtcactggcgg

SEQ ID NO: 574001 - DNA, 13 bp, D. melanogaster
acgtcagcgcggc

SEQ ID NO: 574002 - DNA, 13 bp, D. melanogaster
acgtcatcatcat

SEQ ID NO: 574003 - DNA, 13 bp, D. melanogaster
acgtcatcccagt

SEQ ID NO: 574004 - DNA, 13 bp, D. melanogaster
acgtcatcggcac

SEQ ID NO: 574005 - DNA, 13 bp, D. melanogaster
acgtccacgtcca

SEQ ID NO: 574006 - DNA, 13 bp, D. melanogaster
acgtcgacgtcgc

SEQ ID NO: 574007 - DNA, 14 bp, D. melanogaster
acgtcgacgtcgct

SEQ ID NO: 574008 - DNA, 14 bp, D. melanogaster
acgtcgacgtcggc

SEQ ID NO: 574009 - DNA, 13 bp, D. melanogaster
acgtcgactgcgg

SEQ ID NO: 574010 - DNA, 13 bp, D. melanogaster
acgtcgagatctc

SEQ ID NO: 574011 - DNA, 14 bp, D. melanogaster
acgtcgagatctca

SEQ ID NO: 574012 - DNA, 13 bp, D. melanogaster
acgtcggaaaact

SEQ ID NO: 574013 - DNA, 13 bp, D. melanogaster
acgtctataatta

SEQ ID NO: 574014 - DNA, 13 bp, D. melanogaster
acgtctcaatttc

SEQ ID NO: 574015 - DNA, 13 bp, D. melanogaster
acgtgaaaagtgc

SEQ ID NO: 574016 - DNA, 13 bp, D. melanogaster
acgtgaacaatgc

SEQ ID NO: 574017 - DNA, 13 bp, D. melanogaster
acgtgcaacgtgc

SEQ ID NO: 574018 - DNA, 13 bp, D. melanogaster
acgtgcagacatt

SEQ ID NO: 574019 - DNA, 13 bp, D. melanogaster
acgtgccaaaaaa

SEQ ID NO: 574020 - DNA, 15 bp, D. melanogaster
acgtgccaaaaaaaa

SEQ ID NO: 574021 - DNA, 13 bp, D. melanogaster
acgtgccacgccc

SEQ ID NO: 574022 - DNA, 14 bp, D. melanogaster
acgtgcgtgtgtgt

SEQ ID NO: 574023 - DNA, 13 bp, D. melanogaster
acgtggacgagtt

SEQ ID NO: 574024 - DNA, 13 bp, D. melanogaster
acgtggcgatgac

SEQ ID NO: 574025 - DNA, 13 bp, D. melanogaster
acgtggctttcac

SEQ ID NO: 574026 - DNA, 14 bp, D. melanogaster
acgtgtcgtatacg

SEQ ID NO: 574027 - DNA, 13 bp, D. melanogaster
acgtgtcgtatgc

SEQ ID NO: 574028 - DNA, 14 bp, D. melanogaster
acgtgtcgtatgcg

SEQ ID NO: 574029 - DNA, 13 bp, D. melanogaster
acgtgtgcgtgtg

SEQ ID NO: 574030 - DNA, 14 bp, D. melanogaster
acgtgtgcgtgtgt

SEQ ID NO: 574031 - DNA, 14 bp, D. melanogaster
acgtgtgtgtgtgc

SEQ ID NO: 574032 - DNA, 13 bp, D. melanogaster
acgtgtttctttc

SEQ ID NO: 574033 - DNA, 13 bp, D. melanogaster
acgttaaacaaca

SEQ ID NO: 574034 - DNA, 13 bp, D. melanogaster
acgttaagtggtg

SEQ ID NO: 574035 - DNA, 13 bp, D. melanogaster
acgttaattaggc

SEQ ID NO: 574036 - DNA, 13 bp, D. melanogaster
acgttacctcgtc

SEQ ID NO: 574037 - DNA, 14 bp, D. melanogaster
acgttacgtatacg

SEQ ID NO: 574038 - DNA, 13 bp, D. melanogaster
acgttattattat

SEQ ID NO: 574039 - DNA, 14 bp, D. melanogaster
acgttattttaaaa

SEQ ID NO: 574040 - DNA, 13 bp, D. melanogaster
acgttcagttgtt

SEQ ID NO: 574041 - DNA, 13 bp, D. melanogaster
acgttcatacgga

SEQ ID NO: 574042 - DNA, 14 bp, D. melanogaster
acgttcatacggac

SEQ ID NO: 574043 - DNA, 13 bp, D. melanogaster
acgttcattacag

SEQ ID NO: 574044 - DNA, 13 bp, D. melanogaster
acgttcctttaaa

SEQ ID NO: 574045 - DNA, 13 bp, D. melanogaster
acgttcgacttct

SEQ ID NO: 574046 - DNA, 13 bp, D. melanogaster
acgttctcagcga

SEQ ID NO: 574047 - DNA, 13 bp, D. melanogaster
acgttgaataaaa

SEQ ID NO: 574048 - DNA, 13 bp, D. melanogaster
acgttgatttttt

SEQ ID NO: 574049 - DNA, 14 bp, D. melanogaster
acgttgcgtatacg

SEQ ID NO: 574050 - DNA, 14 bp, D. melanogaster
acgttgcgtatgcg

SEQ ID NO: 574051 - DNA, 13 bp, D. melanogaster
acgttgggcgcca

SEQ ID NO: 574052 - DNA, 13 bp, D. melanogaster
acgttgtggaggt

SEQ ID NO: 574053 - DNA, 13 bp, D. melanogaster
acgttgtgttttt

SEQ ID NO: 574054 - DNA, 14 bp, D. melanogaster
acgttgttgttgtt

SEQ ID NO: 574055 - DNA, 13 bp, D. melanogaster
acgtttaacaagt

SEQ ID NO: 574056 - DNA, 13 bp, D. melanogaster
acgtttacgctaa

SEQ ID NO: 574057 - DNA, 13 bp, D. melanogaster
acgtttatacgga

SEQ ID NO: 574058 - DNA, 13 bp, D. melanogaster
acgtttatatata

SEQ ID NO: 574059 - DNA, 13 bp, D. melanogaster
acgtttgcccacc

SEQ ID NO: 574060 - DNA, 13 bp, D. melanogaster
acgtttgcctgca

SEQ ID NO: 574061 - DNA, 13 bp, D. melanogaster
acgtttgctgcat

SEQ ID NO: 574062 - DNA, 14 bp, D. melanogaster
acgtttgctgcatc

SEQ ID NO: 574063 - DNA, 13 bp, D. melanogaster
acgtttggataca

SEQ ID NO: 574064 - DNA, 13 bp, D. melanogaster
acgttttagtttt

SEQ ID NO: 574065 - DNA, 13 bp, D. melanogaster
acgttttattatt

SEQ ID NO: 574066 - DNA, 13 bp, D. melanogaster
acgttttcaagaa

SEQ ID NO: 574067 - DNA, 13 bp, D. melanogaster
acgttttctattt

SEQ ID NO: 574068 - DNA, 13 bp, D. melanogaster
acgttttctggcg

SEQ ID NO: 574069 - DNA, 13 bp, D. melanogaster
acgttttggccat

SEQ ID NO: 574070 - DNA, 13 bp, D. melanogaster
acgttttgtagca

SEQ ID NO: 574071 - DNA, 13 bp, D. melanogaster
acgttttgtattt

SEQ ID NO: 574072 - DNA, 13 bp, D. melanogaster
acgtttttaatgt

SEQ ID NO: 574073 - DNA, 13 bp, D. melanogaster
acgtttttatatt

SEQ ID NO: 574074 - DNA, 13 bp, D. melanogaster
acgtttttatttg

SEQ ID NO: 574075 - DNA, 14 bp, D. melanogaster
acgttttttaatgt

SEQ ID NO: 574076 - DNA, 13 bp, D. melanogaster
actaaaaaatgta

SEQ ID NO: 574077 - DNA, 13 bp, D. melanogaster
actaaaaaccgaa

SEQ ID NO: 574078 - DNA, 13 bp, D. melanogaster
actaaaaatagat

SEQ ID NO: 574079 - DNA, 13 bp, D. melanogaster
actaaaaatttga

SEQ ID NO: 574080 - DNA, 13 bp, D. melanogaster
actaaaacagcaa

SEQ ID NO: 574081 - DNA, 13 bp, D. melanogaster
actaaaactttaa

SEQ ID NO: 574082 - DNA, 13 bp, D. melanogaster
actaaaagcaatt

SEQ ID NO: 574083 - DNA, 13 bp, D. melanogaster
actaaaagtaaac

SEQ ID NO: 574084 - DNA, 13 bp, D. melanogaster
actaaaatcaatt

SEQ ID NO: 574085 - DNA, 13 bp, D. melanogaster
actaaaatgattt

SEQ ID NO: 574086 - DNA, 13 bp, D. melanogaster
actaaaatttgtc

SEQ ID NO: 574087 - DNA, 13 bp, D. melanogaster
actaaaatttgtt

SEQ ID NO: 574088 - DNA, 13 bp, D. melanogaster
actaaacaaaatg

SEQ ID NO: 574089 - DNA, 13 bp, D. melanogaster
actaaacatattt

SEQ ID NO: 574090 - DNA, 13 bp, D. melanogaster
actaaacgaaaat

SEQ ID NO: 574091 - DNA, 13 bp, D. melanogaster
actaaagaaattt

SEQ ID NO: 574092 - DNA, 13 bp, D. melanogaster
actaaagaagtcg

SEQ ID NO: 574093 - DNA, 13 bp, D. melanogaster
actaaagaatatt

SEQ ID NO: 574094 - DNA, 13 bp, D. melanogaster
actaaagcaaaca

SEQ ID NO: 574095 - DNA, 13 bp, D. melanogaster
actaaaggaaaag

SEQ ID NO: 574096 - DNA, 13 bp, D. melanogaster
actaaaggagatc

SEQ ID NO: 574097 - DNA, 13 bp, D. melanogaster
actaaataagtaa

SEQ ID NO: 574098 - DNA, 13 bp, D. melanogaster
actaaatacttaa

SEQ ID NO: 574099 - DNA, 14 bp, D. melanogaster
actaaatgaattta

SEQ ID NO: 574100 - DNA, 13 bp, D. melanogaster
actaaatggaaaa

SEQ ID NO: 574101 - DNA, 13 bp, D. melanogaster
actaaatggattt

SEQ ID NO: 574102 - DNA, 13 bp, D. melanogaster
actaaattctttt

SEQ ID NO: 574103 - DNA, 13 bp, D. melanogaster
actaaatttgatt

SEQ ID NO: 574104 - DNA, 13 bp, D. melanogaster
actaacaataagt

SEQ ID NO: 574105 - DNA, 13 bp, D. melanogaster
actaacaattatt

SEQ ID NO: 574106 - DNA, 13 bp, D. melanogaster
actaacaccagca

SEQ ID NO: 574107 - DNA, 13 bp, D. melanogaster
actaacactaaag

SEQ ID NO: 574108 - DNA, 13 bp, D. melanogaster
actaacagatttt

SEQ ID NO: 574109 - DNA, 13 bp, D. melanogaster
actaacatatata

SEQ ID NO: 574110 - DNA, 14 bp, D. melanogaster
actaacgaaataaa

SEQ ID NO: 574111 - DNA, 13 bp, D. melanogaster
actaactaaatgt

SEQ ID NO: 574112 - DNA, 14 bp, D. melanogaster
actaactaactaat

SEQ ID NO: 574113 - DNA, 13 bp, D. melanogaster
actaactaacttt

SEQ ID NO: 574114 - DNA, 13 bp, D. melanogaster
actaactaagtta

SEQ ID NO: 574115 - DNA, 13 bp, D. melanogaster
actaagaaattat

SEQ ID NO: 574116 - DNA, 13 bp, D. melanogaster
actaagcgaaaaa

SEQ ID NO: 574117 - DNA, 14 bp, D. melanogaster
actaataaacttga

SEQ ID NO: 574118 - DNA, 13 bp, D. melanogaster
actaataaatgta

SEQ ID NO: 574119 - DNA, 13 bp, D. melanogaster
actaatagaaaat

SEQ ID NO: 574120 - DNA, 13 bp, D. melanogaster
actaatagaaata

SEQ ID NO: 574121 - DNA, 13 bp, D. melanogaster
actaatcccagtt

SEQ ID NO: 574122 - DNA, 13 bp, D. melanogaster
actaatcgaagca

SEQ ID NO: 574123 - DNA, 13 bp, D. melanogaster
actaatgaatatt

SEQ ID NO: 574124 - DNA, 13 bp, D. melanogaster
actaatgaattta

SEQ ID NO: 574125 - DNA, 13 bp, D. melanogaster
actaatgaggaag

SEQ ID NO: 574126 - DNA, 13 bp, D. melanogaster
actaatgatcaat

SEQ ID NO: 574127 - DNA, 14 bp, D. melanogaster
actaatgtacatct

SEQ ID NO: 574128 - DNA, 13 bp, D. melanogaster
actaatgttatca

SEQ ID NO: 574129 - DNA, 13 bp, D. melanogaster
actaattaaatga

SEQ ID NO: 574130 - DNA, 13 bp, D. melanogaster
actaattaaattc

SEQ ID NO: 574131 - DNA, 13 bp, D. melanogaster
actaattagcaaa

SEQ ID NO: 574132 - DNA, 14 bp, D. melanogaster
actaattattttgt

SEQ ID NO: 574133 - DNA, 13 bp, D. melanogaster
actaattgaattg

SEQ ID NO: 574134 - DNA, 13 bp, D. melanogaster
actaattgccaag

SEQ ID NO: 574135 - DNA, 13 bp, D. melanogaster
actaatttccatt

SEQ ID NO: 574136 - DNA, 13 bp, D. melanogaster
actacaaaaagtg

SEQ ID NO: 574137 - DNA, 13 bp, D. melanogaster
actacaaaagccg

SEQ ID NO: 574138 - DNA, 13 bp, D. melanogaster
actacaaaatatt

SEQ ID NO: 574139 - DNA, 13 bp, D. melanogaster
actacaaaattat

SEQ ID NO: 574140 - DNA, 13 bp, D. melanogaster
actacaaactatt

SEQ ID NO: 574141 - DNA, 13 bp, D. melanogaster
actacaagctgag

SEQ ID NO: 574142 - DNA, 13 bp, D. melanogaster
actacaatacata

SEQ ID NO: 574143 - DNA, 14 bp, D. melanogaster
actacaatatatat

SEQ ID NO: 574144 - DNA, 13 bp, D. melanogaster
actacactgaagg

SEQ ID NO: 574145 - DNA, 13 bp, D. melanogaster
actacagaaaagt

SEQ ID NO: 574146 - DNA, 13 bp, D. melanogaster
actacagaacaag

SEQ ID NO: 574147 - DNA, 13 bp, D. melanogaster
actacagatccaa

SEQ ID NO: 574148 - DNA, 13 bp, D. melanogaster
actacagcagatg

SEQ ID NO: 574149 - DNA, 13 bp, D. melanogaster
actacaggaagtt

SEQ ID NO: 574150 - DNA, 13 bp, D. melanogaster
actacagtaccca

SEQ ID NO: 574151 - DNA, 15 bp, D. melanogaster
actacatacatacat

SEQ ID NO: 574152 - DNA, 14 bp, D. melanogaster
actacatacatata

SEQ ID NO: 574153 - DNA, 13 bp, D. melanogaster
actacatagcata

SEQ ID NO: 574154 - DNA, 13 bp, D. melanogaster
actacatatatgt

SEQ ID NO: 574155 - DNA, 13 bp, D. melanogaster
actacatcagaag

SEQ ID NO: 574156 - DNA, 14 bp, D. melanogaster
actacatttagaaa

SEQ ID NO: 574157 - DNA, 13 bp, D. melanogaster
actaccaattggt

SEQ ID NO: 574158 - DNA, 13 bp, D. melanogaster
actaccactacca

SEQ ID NO: 574159 - DNA, 14 bp, D. melanogaster
actaccactaccac

SEQ ID NO: 574160 - DNA, 13 bp, D. melanogaster
actaccagggcat

SEQ ID NO: 574161 - DNA, 13 bp, D. melanogaster
actaccctgtact

SEQ ID NO: 574162 - DNA, 13 bp, D. melanogaster
actaccgaaaatt

SEQ ID NO: 574163 - DNA, 13 bp, D. melanogaster
actaccttcaaaa

SEQ ID NO: 574164 - DNA, 13 bp, D. melanogaster
actacgaaccgat

SEQ ID NO: 574165 - DNA, 13 bp, D. melanogaster
actacgcccatcc

SEQ ID NO: 574166 - DNA, 13 bp, D. melanogaster
actactacaaaac

SEQ ID NO: 574167 - DNA, 13 bp, D. melanogaster
actactacaacaa

SEQ ID NO: 574168 - DNA, 14 bp, D. melanogaster
actactacaacaac

SEQ ID NO: 574169 - DNA, 14 bp, D. melanogaster
actactacaactac

SEQ ID NO: 574170 - DNA, 13 bp, D. melanogaster
actactactacaa

SEQ ID NO: 574171 - DNA, 13 bp, D. melanogaster
actactactacca

SEQ ID NO: 574172 - DNA, 13 bp, D. melanogaster
actactactactg

SEQ ID NO: 574173 - DNA, 13 bp, D. melanogaster
actactacttcta

SEQ ID NO: 574174 - DNA, 13 bp, D. melanogaster
actactattacta

SEQ ID NO: 574175 - DNA, 13 bp, D. melanogaster
actactccaacaa

SEQ ID NO: 574176 - DNA, 13 bp, D. melanogaster
actactgcagcat

SEQ ID NO: 574177 - DNA, 13 bp, D. melanogaster
actactggacaga

SEQ ID NO: 574178 - DNA, 13 bp, D. melanogaster
actactttaaaaa

SEQ ID NO: 574179 - DNA, 13 bp, D. melanogaster
actactttaaaat

SEQ ID NO: 574180 - DNA, 14 bp, D. melanogaster
actactttaagcac

SEQ ID NO: 574181 - DNA, 13 bp, D. melanogaster
actactttctgca

SEQ ID NO: 574182 - DNA, 13 bp, D. melanogaster
actacttttaatt

SEQ ID NO: 574183 - DNA, 13 bp, D. melanogaster
actacttttgatt

SEQ ID NO: 574184 - DNA, 13 bp, D. melanogaster
actagaacaactg

SEQ ID NO: 574185 - DNA, 13 bp, D. melanogaster
actagaataacaa

SEQ ID NO: 574186 - DNA, 13 bp, D. melanogaster
actagaattattc

SEQ ID NO: 574187 - DNA, 13 bp, D. melanogaster
actagactacatt

SEQ ID NO: 574188 - DNA, 13 bp, D. melanogaster
actagacttggag

SEQ ID NO: 574189 - DNA, 13 bp, D. melanogaster
actagattcattg

SEQ ID NO: 574190 - DNA, 13 bp, D. melanogaster
actataaaaactt

SEQ ID NO: 574191 - DNA, 13 bp, D. melanogaster
actataaaacaag

SEQ ID NO: 574192 - DNA, 13 bp, D. melanogaster
actataaacgaaa

SEQ ID NO: 574193 - DNA, 13 bp, D. melanogaster
actataaactata

SEQ ID NO: 574194 - DNA, 13 bp, D. melanogaster
actataaatatca

SEQ ID NO: 574195 - DNA, 13 bp, D. melanogaster
actataaccacca

SEQ ID NO: 574196 - DNA, 13 bp, D. melanogaster
actataacttttt

SEQ ID NO: 574197 - DNA, 13 bp, D. melanogaster
actatacatacat

SEQ ID NO: 574198 - DNA, 13 bp, D. melanogaster
actatacatattt

SEQ ID NO: 574199 - DNA, 14 bp, D. melanogaster
actatactgttgta

SEQ ID NO: 574200 - DNA, 14 bp, D. melanogaster
actatagaatgcca

SEQ ID NO: 574201 - DNA, 13 bp, D. melanogaster
actatagcattct

SEQ ID NO: 574202 - DNA, 13 bp, D. melanogaster
actatagcatttt

SEQ ID NO: 574203 - DNA, 14 bp, D. melanogaster
actatataaagtat

SEQ ID NO: 574204 - DNA, 13 bp, D. melanogaster
actatatacatac

SEQ ID NO: 574205 - DNA, 14 bp, D. melanogaster
actatatacataca

SEQ ID NO: 574206 - DNA, 14 bp, D. melanogaster
actatatatacata

SEQ ID NO: 574207 - DNA, 13 bp, D. melanogaster
actatatatacca

SEQ ID NO: 574208 - DNA, 13 bp, D. melanogaster
actatatatacta

SEQ ID NO: 574209 - DNA, 13 bp, D. melanogaster
actatatatagta

SEQ ID NO: 574210 - DNA, 13 bp, D. melanogaster
actatatatatac

SEQ ID NO: 574211 - DNA, 14 bp, D. melanogaster
actatatatataca

SEQ ID NO: 574212 - DNA, 13 bp, D. melanogaster
actatatatgcat

SEQ ID NO: 574213 - DNA, 14 bp, D. melanogaster
actatatatgtaca

SEQ ID NO: 574214 - DNA, 14 bp, D. melanogaster
actatatatgtata

SEQ ID NO: 574215 - DNA, 13 bp, D. melanogaster
actatatcatata

SEQ ID NO: 574216 - DNA, 13 bp, D. melanogaster
actatatgtatgt

SEQ ID NO: 574217 - DNA, 13 bp, D. melanogaster
actatattgaaca

SEQ ID NO: 574218 - DNA, 13 bp, D. melanogaster
actatatttgtat

SEQ ID NO: 574219 - DNA, 15 bp, D. melanogaster
actatcaacaagtgc

SEQ ID NO: 574220 - DNA, 13 bp, D. melanogaster
actatcaacgaaa

SEQ ID NO: 574221 - DNA, 13 bp, D. melanogaster
actatcaatattt

SEQ ID NO: 574222 - DNA, 13 bp, D. melanogaster
actatcacccagc

SEQ ID NO: 574223 - DNA, 13 bp, D. melanogaster
actatcagatacc

SEQ ID NO: 574224 - DNA, 14 bp, D. melanogaster
actatcagatacct

SEQ ID NO: 574225 - DNA, 13 bp, D. melanogaster
actatcagatact

SEQ ID NO: 574226 - DNA, 13 bp, D. melanogaster
actatcatatctt

SEQ ID NO: 574227 - DNA, 13 bp, D. melanogaster
actatccctatca

SEQ ID NO: 574228 - DNA, 14 bp, D. melanogaster
actatcgatgcagc

SEQ ID NO: 574229 - DNA, 13 bp, D. melanogaster
actatcgccaaat

SEQ ID NO: 574230 - DNA, 13 bp, D. melanogaster
actatcgtggtag

SEQ ID NO: 574231 - DNA, 13 bp, D. melanogaster
actatctatgtat

SEQ ID NO: 574232 - DNA, 13 bp, D. melanogaster
actatctcaagac

SEQ ID NO: 574233 - DNA, 13 bp, D. melanogaster
actatgaaaaaat

SEQ ID NO: 574234 - DNA, 13 bp, D. melanogaster
actatgaaataaa

SEQ ID NO: 574235 - DNA, 13 bp, D. melanogaster
actatgagttgca

SEQ ID NO: 574236 - DNA, 13 bp, D. melanogaster
actatgatgacga

SEQ ID NO: 574237 - DNA, 13 bp, D. melanogaster
actatgcaccgga

SEQ ID NO: 574238 - DNA, 13 bp, D. melanogaster
actatggatgcag

SEQ ID NO: 574239 - DNA, 13 bp, D. melanogaster
actatggcacata

SEQ ID NO: 574240 - DNA, 14 bp, D. melanogaster
actatggcacatat

SEQ ID NO: 574241 - DNA, 13 bp, D. melanogaster
actatgtatgtac

SEQ ID NO: 574242 - DNA, 14 bp, D. melanogaster
actatgtgaccaag

SEQ ID NO: 574243 - DNA, 13 bp, D. melanogaster
actattaactatt

SEQ ID NO: 574244 - DNA, 13 bp, D. melanogaster
actattaagccat

SEQ ID NO: 574245 - DNA, 13 bp, D. melanogaster
actattactacta

SEQ ID NO: 574246 - DNA, 13 bp, D. melanogaster
actattactattt

SEQ ID NO: 574247 - DNA, 13 bp, D. melanogaster
actattatacacg

SEQ ID NO: 574248 - DNA, 13 bp, D. melanogaster
actattattagtt

SEQ ID NO: 574249 - DNA, 13 bp, D. melanogaster
actattattgttg

SEQ ID NO: 574250 - DNA, 13 bp, D. melanogaster
actattatttgga

SEQ ID NO: 574251 - DNA, 13 bp, D. melanogaster
actattattttga

SEQ ID NO: 574252 - DNA, 13 bp, D. melanogaster
actattgtagtaa

SEQ ID NO: 574253 - DNA, 13 bp, D. melanogaster
actattgtttata

SEQ ID NO: 574254 - DNA, 13 bp, D. melanogaster
actatttaaaaac

SEQ ID NO: 574255 - DNA, 14 bp, D. melanogaster
actatttaacttca

SEQ ID NO: 574256 - DNA, 13 bp, D. melanogaster
actatttatatac

SEQ ID NO: 574257 - DNA, 13 bp, D. melanogaster
actatttatgtat

SEQ ID NO: 574258 - DNA, 14 bp, D. melanogaster
actatttctaagct

SEQ ID NO: 574259 - DNA, 14 bp, D. melanogaster
actatttgcccttc

SEQ ID NO: 574260 - DNA, 13 bp, D. melanogaster
actatttgttatt

SEQ ID NO: 574261 - DNA, 13 bp, D. melanogaster
actatttgttgtt

SEQ ID NO: 574262 - DNA, 13 bp, D. melanogaster
actatttgtttaa

SEQ ID NO: 574263 - DNA, 13 bp, D. melanogaster
actattttaatga

SEQ ID NO: 574264 - DNA, 13 bp, D. melanogaster
actattttactat

SEQ ID NO: 574265 - DNA, 13 bp, D. melanogaster
actattttgactt

SEQ ID NO: 574266 - DNA, 13 bp, D. melanogaster
actattttgcata

SEQ ID NO: 574267 - DNA, 13 bp, D. melanogaster
actatttttaagt

SEQ ID NO: 574268 - DNA, 13 bp, D. melanogaster
actatttttatga

SEQ ID NO: 574269 - DNA, 14 bp, D. melanogaster
actatttttatgat

SEQ ID NO: 574270 - DNA, 13 bp, D. melanogaster
actatttttatgt

SEQ ID NO: 574271 - DNA, 14 bp, D. melanogaster
actatttttatgta

SEQ ID NO: 574272 - DNA, 13 bp, D. melanogaster
actcaaaaaaatg

SEQ ID NO: 574273 - DNA, 13 bp, D. melanogaster
actcaaaaacatc

SEQ ID NO: 574274 - DNA, 13 bp, D. melanogaster
actcaaaaattat

SEQ ID NO: 574275 - DNA, 14 bp, D. melanogaster
actcaaaaattatt

SEQ ID NO: 574276 - DNA, 13 bp, D. melanogaster
actcaaaacagcc

SEQ ID NO: 574277 - DNA, 13 bp, D. melanogaster
actcaaaacattt

SEQ ID NO: 574278 - DNA, 14 bp, D. melanogaster
actcaaaacgcaca

SEQ ID NO: 574279 - DNA, 13 bp, D. melanogaster
actcaaaactcaa

SEQ ID NO: 574280 - DNA, 13 bp, D. melanogaster
actcaaaatattt

SEQ ID NO: 574281 - DNA, 14 bp, D. melanogaster
actcaaactcaaac

SEQ ID NO: 574282 - DNA, 13 bp, D. melanogaster
actcaaagccaac

SEQ ID NO: 574283 - DNA, 13 bp, D. melanogaster
actcaaaggaaat

SEQ ID NO: 574284 - DNA, 13 bp, D. melanogaster
actcaaatatata

SEQ ID NO: 574285 - DNA, 13 bp, D. melanogaster
actcaaatcaaat

SEQ ID NO: 574286 - DNA, 13 bp, D. melanogaster
actcaaattctga

SEQ ID NO: 574287 - DNA, 13 bp, D. melanogaster
actcaaattgaat

SEQ ID NO: 574288 - DNA, 13 bp, D. melanogaster
actcaaatttttt

SEQ ID NO: 574289 - DNA, 13 bp, D. melanogaster
actcaacaatttt

SEQ ID NO: 574290 - DNA, 13 bp, D. melanogaster
actcaaccaacct

SEQ ID NO: 574291 - DNA, 13 bp, D. melanogaster
actcaactcaact

SEQ ID NO: 574292 - DNA, 13 bp, D. melanogaster
actcaactcgact

SEQ ID NO: 574293 - DNA, 14 bp, D. melanogaster
actcaactcgactc

SEQ ID NO: 574294 - DNA, 13 bp, D. melanogaster
actcaactgaaaa

SEQ ID NO: 574295 - DNA, 13 bp, D. melanogaster
actcaactgaaat

SEQ ID NO: 574296 - DNA, 13 bp, D. melanogaster
actcaacttcaaa

SEQ ID NO: 574297 - DNA, 13 bp, D. melanogaster
actcaataaattt

SEQ ID NO: 574298 - DNA, 13 bp, D. melanogaster
actcaatgccctt

SEQ ID NO: 574299 - DNA, 14 bp, D. melanogaster
actcaatgcccttc

SEQ ID NO: 574300 - DNA, 13 bp, D. melanogaster
actcaattaactt

SEQ ID NO: 574301 - DNA, 13 bp, D. melanogaster
actcaattataaa

SEQ ID NO: 574302 - DNA, 13 bp, D. melanogaster
actcaattgattt

SEQ ID NO: 574303 - DNA, 13 bp, D. melanogaster
actcaatttaaat

SEQ ID NO: 574304 - DNA, 13 bp, D. melanogaster
actcaatttatat

SEQ ID NO: 574305 - DNA, 13 bp, D. melanogaster
actcaattttaaa

SEQ ID NO: 574306 - DNA, 13 bp, D. melanogaster
actcacaaaatcc

SEQ ID NO: 574307 - DNA, 13 bp, D. melanogaster
actcacacaaata

SEQ ID NO: 574308 - DNA, 14 bp, D. melanogaster
actcacacacacat

SEQ ID NO: 574309 - DNA, 13 bp, D. melanogaster
actcacacagacg

SEQ ID NO: 574310 - DNA, 14 bp, D. melanogaster
actcacacagatac

SEQ ID NO: 574311 - DNA, 13 bp, D. melanogaster
actcacacaggca

SEQ ID NO: 574312 - DNA, 13 bp, D. melanogaster
actcacacataca

SEQ ID NO: 574313 - DNA, 13 bp, D. melanogaster
actcacacatgca

SEQ ID NO: 574314 - DNA, 14 bp, D. melanogaster
actcacacatgcac

SEQ ID NO: 574315 - DNA, 14 bp, D. melanogaster
actcacacgcacac

SEQ ID NO: 574316 - DNA, 13 bp, D. melanogaster
actcacagacaca

SEQ ID NO: 574317 - DNA, 14 bp, D. melanogaster
actcacagcaaaaa

SEQ ID NO: 574318 - DNA, 13 bp, D. melanogaster
actcacatacaca

SEQ ID NO: 574319 - DNA, 14 bp, D. melanogaster
actcacatggcgca

SEQ ID NO: 574320 - DNA, 13 bp, D. melanogaster
actcacattcaca

SEQ ID NO: 574321 - DNA, 13 bp, D. melanogaster
actcactcactct

SEQ ID NO: 574322 - DNA, 13 bp, D. melanogaster
actcagacacaca

SEQ ID NO: 574323 - DNA, 13 bp, D. melanogaster
actcagatactca

SEQ ID NO: 574324 - DNA, 13 bp, D. melanogaster
actcagatttttc

SEQ ID NO: 574325 - DNA, 14 bp, D. melanogaster
actcagctcagctc

SEQ ID NO: 574326 - DNA, 13 bp, D. melanogaster
actcaggactcag

SEQ ID NO: 574327 - DNA, 14 bp, D. melanogaster
actcaggactcagg

SEQ ID NO: 574328 - DNA, 13 bp, D. melanogaster
actcaggcaacga

SEQ ID NO: 574329 - DNA, 13 bp, D. melanogaster
actcagtcactca

SEQ ID NO: 574330 - DNA, 13 bp, D. melanogaster
actcagtttttgc

SEQ ID NO: 574331 - DNA, 13 bp, D. melanogaster
actcataattaaa

SEQ ID NO: 574332 - DNA, 13 bp, D. melanogaster
actcatacacaca

SEQ ID NO: 574333 - DNA, 14 bp, D. melanogaster
actcatacgcaacg

SEQ ID NO: 574334 - DNA, 14 bp, D. melanogaster
actcatacgccccg

SEQ ID NO: 574335 - DNA, 13 bp, D. melanogaster
actcatactcata

SEQ ID NO: 574336 - DNA, 14 bp, D. melanogaster
actcatactcatac

SEQ ID NO: 574337 - DNA, 13 bp, D. melanogaster
actcatatattca

SEQ ID NO: 574338 - DNA, 13 bp, D. melanogaster
actcatatttttc

SEQ ID NO: 574339 - DNA, 13 bp, D. melanogaster
actcatcatcatc

SEQ ID NO: 574340 - DNA, 14 bp, D. melanogaster
actcatcatcatca

SEQ ID NO: 574341 - DNA, 13 bp, D. melanogaster
actcatcatttat

SEQ ID NO: 574342 - DNA, 13 bp, D. melanogaster
actcatctcacaa

SEQ ID NO: 574343 - DNA, 13 bp, D. melanogaster
actcattattaat

SEQ ID NO: 574344 - DNA, 13 bp, D. melanogaster
actcattcactca

SEQ ID NO: 574345 - DNA, 13 bp, D. melanogaster
actcatttaaata

SEQ ID NO: 574346 - DNA, 13 bp, D. melanogaster
actcatttgaaat

SEQ ID NO: 574347 - DNA, 13 bp, D. melanogaster
actcatttgcata

SEQ ID NO: 574348 - DNA, 13 bp, D. melanogaster
actcatttgtttt

SEQ ID NO: 574349 - DNA, 13 bp, D. melanogaster
actccaaactcca

SEQ ID NO: 574350 - DNA, 13 bp, D. melanogaster
actccaacaactg

SEQ ID NO: 574351 - DNA, 14 bp, D. melanogaster
actccaactccaac

SEQ ID NO: 574352 - DNA, 13 bp, D. melanogaster
actccaactccca

SEQ ID NO: 574353 - DNA, 14 bp, D. melanogaster
actccaactgtctg

SEQ ID NO: 574354 - DNA, 13 bp, D. melanogaster
actccaatagcgc

SEQ ID NO: 574355 - DNA, 13 bp, D. melanogaster
actccacaaatct

SEQ ID NO: 574356 - DNA, 13 bp, D. melanogaster
actccacactcca

SEQ ID NO: 574357 - DNA, 13 bp, D. melanogaster
actccactccaca

SEQ ID NO: 574358 - DNA, 14 bp, D. melanogaster
actccactccactc

SEQ ID NO: 574359 - DNA, 13 bp, D. melanogaster
actccagcctcaa

SEQ ID NO: 574360 - DNA, 13 bp, D. melanogaster
actccagctccag

SEQ ID NO: 574361 - DNA, 13 bp, D. melanogaster
actccagctcctt

SEQ ID NO: 574362 - DNA, 13 bp, D. melanogaster
actccataaaaac

SEQ ID NO: 574363 - DNA, 13 bp, D. melanogaster
actccatactcca

SEQ ID NO: 574364 - DNA, 13 bp, D. melanogaster
actccatctccat

SEQ ID NO: 574365 - DNA, 14 bp, D. melanogaster
actccatgttacat

SEQ ID NO: 574366 - DNA, 14 bp, D. melanogaster
actccattccattc

SEQ ID NO: 574367 - DNA, 13 bp, D. melanogaster
actcccagatgac

SEQ ID NO: 574368 - DNA, 13 bp, D. melanogaster
actccgactccga

SEQ ID NO: 574369 - DNA, 13 bp, D. melanogaster
actccgattccga

SEQ ID NO: 574370 - DNA, 13 bp, D. melanogaster
actcctcgaactg

SEQ ID NO: 574371 - DNA, 13 bp, D. melanogaster
actcctgcaacat

SEQ ID NO: 574372 - DNA, 14 bp, D. melanogaster
actccttcatcgac

SEQ ID NO: 574373 - DNA, 13 bp, D. melanogaster
actcctttttaat

SEQ ID NO: 574374 - DNA, 13 bp, D. melanogaster
actccttttttgt

SEQ ID NO: 574375 - DNA, 13 bp, D. melanogaster
actcgaaaaaatt

SEQ ID NO: 574376 - DNA, 13 bp, D. melanogaster
actcgaaaaagta

SEQ ID NO: 574377 - DNA, 14 bp, D. melanogaster
actcgaaaaagtag

SEQ ID NO: 574378 - DNA, 13 bp, D. melanogaster
actcgaaaataaa

SEQ ID NO: 574379 - DNA, 13 bp, D. melanogaster
actcgaaacaaaa

SEQ ID NO: 574380 - DNA, 13 bp, D. melanogaster
actcgaaataaat

SEQ ID NO: 574381 - DNA, 13 bp, D. melanogaster
actcgaaatcgaa

SEQ ID NO: 574382 - DNA, 13 bp, D. melanogaster
actcgaacacaca

SEQ ID NO: 574383 - DNA, 13 bp, D. melanogaster
actcgaactcgaa

SEQ ID NO: 574384 - DNA, 14 bp, D. melanogaster
actcgaactcgaac

SEQ ID NO: 574385 - DNA, 13 bp, D. melanogaster
actcgaagaaaat

SEQ ID NO: 574386 - DNA, 13 bp, D. melanogaster
actcgaaggccac

SEQ ID NO: 574387 - DNA, 13 bp, D. melanogaster
actcgaatcgaat

SEQ ID NO: 574388 - DNA, 13 bp, D. melanogaster
actcgaatggaac

SEQ ID NO: 574389 - DNA, 13 bp, D. melanogaster
actcgactccact

SEQ ID NO: 574390 - DNA, 13 bp, D. melanogaster
actcgactcgact

SEQ ID NO: 574391 - DNA, 14 bp, D. melanogaster
actcgactcgactc

SEQ ID NO: 574392 - DNA, 13 bp, D. melanogaster
actcgacttgact

SEQ ID NO: 574393 - DNA, 13 bp, D. melanogaster
actcgagtcgagt

SEQ ID NO: 574394 - DNA, 13 bp, D. melanogaster
actcgagtgccac

SEQ ID NO: 574395 - DNA, 13 bp, D. melanogaster
actcgagtgtgtg

SEQ ID NO: 574396 - DNA, 14 bp, D. melanogaster
actcgatcaaacgc

SEQ ID NO: 574397 - DNA, 14 bp, D. melanogaster
actcgcacacacat

SEQ ID NO: 574398 - DNA, 13 bp, D. melanogaster
actcgcacacact

SEQ ID NO: 574399 - DNA, 13 bp, D. melanogaster
actcgcacactca

SEQ ID NO: 574400 - DNA, 14 bp, D. melanogaster
actcgcacgcacac

SEQ ID NO: 574401 - DNA, 14 bp, D. melanogaster
actcgcactcgcac

SEQ ID NO: 574402 - DNA, 13 bp, D. melanogaster
actcgccacgcac

SEQ ID NO: 574403 - DNA, 13 bp, D. melanogaster
actcgccatctga

SEQ ID NO: 574404 - DNA, 13 bp, D. melanogaster
actcgcccacaca

SEQ ID NO: 574405 - DNA, 13 bp, D. melanogaster
actcgctctctct

SEQ ID NO: 574406 - DNA, 13 bp, D. melanogaster
actcgctttgcac

SEQ ID NO: 574407 - DNA, 13 bp, D. melanogaster
actcggaaaaaaa

SEQ ID NO: 574408 - DNA, 13 bp, D. melanogaster
actcggaaaaaat

SEQ ID NO: 574409 - DNA, 13 bp, D. melanogaster
actcggaatcgga

SEQ ID NO: 574410 - DNA, 13 bp, D. melanogaster
actcggacttgga

SEQ ID NO: 574411 - DNA, 14 bp, D. melanogaster
actcggaggaaaag

SEQ ID NO: 574412 - DNA, 14 bp, D. melanogaster
actcggctattgat

SEQ ID NO: 574413 - DNA, 13 bp, D. melanogaster
actcggtatcttt

SEQ ID NO: 574414 - DNA, 13 bp, D. melanogaster
actcggttgccct

SEQ ID NO: 574415 - DNA, 13 bp, D. melanogaster
actcgtatatata

SEQ ID NO: 574416 - DNA, 13 bp, D. melanogaster
actcgtccaagtc

SEQ ID NO: 574417 - DNA, 13 bp, D. melanogaster
actcgtggcccaa

SEQ ID NO: 574418 - DNA, 13 bp, D. melanogaster
actcgttttatgt

SEQ ID NO: 574419 - DNA, 13 bp, D. melanogaster
actctaaaatatg

SEQ ID NO: 574420 - DNA, 13 bp, D. melanogaster
actctaatgacaa

SEQ ID NO: 574421 - DNA, 13 bp, D. melanogaster
actctactctact

SEQ ID NO: 574422 - DNA, 13 bp, D. melanogaster
actctatatatat

SEQ ID NO: 574423 - DNA, 14 bp, D. melanogaster
actctatatatata

SEQ ID NO: 574424 - DNA, 13 bp, D. melanogaster
actctatatattt

SEQ ID NO: 574425 - DNA, 13 bp, D. melanogaster
actctcaacaagc

SEQ ID NO: 574426 - DNA, 13 bp, D. melanogaster
actctcaatttgg

SEQ ID NO: 574427 - DNA, 13 bp, D. melanogaster
actctccaggcaa

SEQ ID NO: 574428 - DNA, 13 bp, D. melanogaster
actctgaactctg

SEQ ID NO: 574429 - DNA, 13 bp, D. melanogaster
actctgcagtttc

SEQ ID NO: 574430 - DNA, 13 bp, D. melanogaster
actctgcatttaa

SEQ ID NO: 574431 - DNA, 13 bp, D. melanogaster
actctgccgcaac

SEQ ID NO: 574432 - DNA, 13 bp, D. melanogaster
actctgctgataa

SEQ ID NO: 574433 - DNA, 14 bp, D. melanogaster
actctgctgataaa

SEQ ID NO: 574434 - DNA, 13 bp, D. melanogaster
actctgtgctgct

SEQ ID NO: 574435 - DNA, 13 bp, D. melanogaster
actctgtttgtat

SEQ ID NO: 574436 - DNA, 13 bp, D. melanogaster
actcttccgcatg

SEQ ID NO: 574437 - DNA, 13 bp, D. melanogaster
actcttcgcccac

SEQ ID NO: 574438 - DNA, 13 bp, D. melanogaster
actctttaacatt

SEQ ID NO: 574439 - DNA, 13 bp, D. melanogaster
actctttatgttt

SEQ ID NO: 574440 - DNA, 13 bp, D. melanogaster
actctttgagttc

SEQ ID NO: 574441 - DNA, 13 bp, D. melanogaster
actgaaaaactaa

SEQ ID NO: 574442 - DNA, 13 bp, D. melanogaster
actgaaaaactga

SEQ ID NO: 574443 - DNA, 13 bp, D. melanogaster
actgaaaaatatt

SEQ ID NO: 574444 - DNA, 13 bp, D. melanogaster
actgaaaaatgtt

SEQ ID NO: 574445 - DNA, 13 bp, D. melanogaster
actgaaaacaaat

SEQ ID NO: 574446 - DNA, 13 bp, D. melanogaster
actgaaaacaaca

SEQ ID NO: 574447 - DNA, 13 bp, D. melanogaster
actgaaaacaatt

SEQ ID NO: 574448 - DNA, 14 bp, D. melanogaster
actgaaaacagaaa

SEQ ID NO: 574449 - DNA, 13 bp, D. melanogaster
actgaaaaccaaa

SEQ ID NO: 574450 - DNA, 13 bp, D. melanogaster
actgaaaactaaa

SEQ ID NO: 574451 - DNA, 13 bp, D. melanogaster
actgaaaagaaac

SEQ ID NO: 574452 - DNA, 13 bp, D. melanogaster
actgaaaagttca

SEQ ID NO: 574453 - DNA, 14 bp, D. melanogaster
actgaaaagttcaa

SEQ ID NO: 574454 - DNA, 13 bp, D. melanogaster
actgaaaataaac

SEQ ID NO: 574455 - DNA, 13 bp, D. melanogaster
actgaaaataact

SEQ ID NO: 574456 - DNA, 13 bp, D. melanogaster
actgaaaatgcaa

SEQ ID NO: 574457 - DNA, 13 bp, D. melanogaster
actgaaaccgaaa

SEQ ID NO: 574458 - DNA, 13 bp, D. melanogaster
actgaaaccgaag

SEQ ID NO: 574459 - DNA, 14 bp, D. melanogaster
actgaaaccgtttt

SEQ ID NO: 574460 - DNA, 13 bp, D. melanogaster
actgaaacgaaat

SEQ ID NO: 574461 - DNA, 13 bp, D. melanogaster
actgaaactaaaa

SEQ ID NO: 574462 - DNA, 13 bp, D. melanogaster
actgaaactcaaa

SEQ ID NO: 574463 - DNA, 14 bp, D. melanogaster
actgaaactgaaat

SEQ ID NO: 574464 - DNA, 14 bp, D. melanogaster
actgaaactgaagc

SEQ ID NO: 574465 - DNA, 13 bp, D. melanogaster
actgaaactgaat

SEQ ID NO: 574466 - DNA, 14 bp, D. melanogaster
actgaaactgaatc

SEQ ID NO: 574467 - DNA, 13 bp, D. melanogaster
actgaaactgaga

SEQ ID NO: 574468 - DNA, 13 bp, D. melanogaster
actgaaagaaata

SEQ ID NO: 574469 - DNA, 13 bp, D. melanogaster
actgaaagaaatc

SEQ ID NO: 574470 - DNA, 13 bp, D. melanogaster
actgaaagccaaa

SEQ ID NO: 574471 - DNA, 13 bp, D. melanogaster
actgaaagcgttg

SEQ ID NO: 574472 - DNA, 13 bp, D. melanogaster
actgaaagctgaa

SEQ ID NO: 574473 - DNA, 13 bp, D. melanogaster
actgaaaggaaaa

SEQ ID NO: 574474 - DNA, 13 bp, D. melanogaster
actgaaagtagca

SEQ ID NO: 574475 - DNA, 13 bp, D. melanogaster
actgaaagtgaaa

SEQ ID NO: 574476 - DNA, 13 bp, D. melanogaster
actgaaataaaat

SEQ ID NO: 574477 - DNA, 14 bp, D. melanogaster
actgaaataattga

SEQ ID NO: 574478 - DNA, 13 bp, D. melanogaster
actgaaatacaaa

SEQ ID NO: 574479 - DNA, 13 bp, D. melanogaster
actgaaatatatg

SEQ ID NO: 574480 - DNA, 13 bp, D. melanogaster
actgaaatcaaaa

SEQ ID NO: 574481 - DNA, 13 bp, D. melanogaster
actgaaatgaaaa

SEQ ID NO: 574482 - DNA, 13 bp, D. melanogaster
actgaaatgaaat

SEQ ID NO: 574483 - DNA, 13 bp, D. melanogaster
actgaaatgcaaa

SEQ ID NO: 574484 - DNA, 13 bp, D. melanogaster
actgaaattaaaa

SEQ ID NO: 574485 - DNA, 13 bp, D. melanogaster
actgaaattaatt

SEQ ID NO: 574486 - DNA, 13 bp, D. melanogaster
actgaacactgaa

SEQ ID NO: 574487 - DNA, 13 bp, D. melanogaster
actgaaccaccga

SEQ ID NO: 574488 - DNA, 13 bp, D. melanogaster
actgaacccaaga

SEQ ID NO: 574489 - DNA, 13 bp, D. melanogaster
actgaactcaact

SEQ ID NO: 574490 - DNA, 13 bp, D. melanogaster
actgaactgaaaa

SEQ ID NO: 574491 - DNA, 13 bp, D. melanogaster
actgaactgaaat

SEQ ID NO: 574492 - DNA, 13 bp, D. melanogaster
actgaactgaagc

SEQ ID NO: 574493 - DNA, 13 bp, D. melanogaster
actgaagacggca

SEQ ID NO: 574494 - DNA, 14 bp, D. melanogaster
actgaagacggcaa

SEQ ID NO: 574495 - DNA, 13 bp, D. melanogaster
actgaagagttta

SEQ ID NO: 574496 - DNA, 13 bp, D. melanogaster
actgaagctgagt

SEQ ID NO: 574497 - DNA, 13 bp, D. melanogaster
actgaataaatat

SEQ ID NO: 574498 - DNA, 13 bp, D. melanogaster
actgaatacaaaa

SEQ ID NO: 574499 - DNA, 13 bp, D. melanogaster
actgaatactgaa

SEQ ID NO: 574500 - DNA, 13 bp, D. melanogaster
actgaatgagtga

SEQ ID NO: 574501 - DNA, 13 bp, D. melanogaster
actgaatgcgcag

SEQ ID NO: 574502 - DNA, 13 bp, D. melanogaster
actgaatggaatc

SEQ ID NO: 574503 - DNA, 13 bp, D. melanogaster
actgaattattta

SEQ ID NO: 574504 - DNA, 13 bp, D. melanogaster
actgaatttaaaa

SEQ ID NO: 574505 - DNA, 13 bp, D. melanogaster
actgaatttattt

SEQ ID NO: 574506 - DNA, 13 bp, D. melanogaster
actgaattttcat

SEQ ID NO: 574507 - DNA, 14 bp, D. melanogaster
actgaattttcttt

SEQ ID NO: 574508 - DNA, 13 bp, D. melanogaster
actgacacacatg

SEQ ID NO: 574509 - DNA, 14 bp, D. melanogaster
actgacacacatgt

SEQ ID NO: 574510 - DNA, 14 bp, D. melanogaster
actgacaccagcag

SEQ ID NO: 574511 - DNA, 13 bp, D. melanogaster
actgacccagaaa

SEQ ID NO: 574512 - DNA, 13 bp, D. melanogaster
actgacggactga

SEQ ID NO: 574513 - DNA, 14 bp, D. melanogaster
actgactaactgac

SEQ ID NO: 574514 - DNA, 13 bp, D. melanogaster
actgactgactga

SEQ ID NO: 574515 - DNA, 14 bp, D. melanogaster
actgactgactgcc

SEQ ID NO: 574516 - DNA, 13 bp, D. melanogaster
actgacttaagta

SEQ ID NO: 574517 - DNA, 13 bp, D. melanogaster
actgactttcttg

SEQ ID NO: 574518 - DNA, 13 bp, D. melanogaster
actgagaaaaact

SEQ ID NO: 574519 - DNA, 13 bp, D. melanogaster
actgagaaaaatc

SEQ ID NO: 574520 - DNA, 13 bp, D. melanogaster
actgagaactttg

SEQ ID NO: 574521 - DNA, 13 bp, D. melanogaster
actgagaaggcaa

SEQ ID NO: 574522 - DNA, 14 bp, D. melanogaster
actgagactgagac

SEQ ID NO: 574523 - DNA, 13 bp, D. melanogaster
actgagagaaaaa

SEQ ID NO: 574524 - DNA, 13 bp, D. melanogaster
actgagagaaaat

SEQ ID NO: 574525 - DNA, 14 bp, D. melanogaster
actgagagaaaatt

SEQ ID NO: 574526 - DNA, 13 bp, D. melanogaster
actgagagaaaca

SEQ ID NO: 574527 - DNA, 13 bp, D. melanogaster
actgagcgaaata

SEQ ID NO: 574528 - DNA, 13 bp, D. melanogaster
actgagctgagct

SEQ ID NO: 574529 - DNA, 13 bp, D. melanogaster
actgaggaaaatt

SEQ ID NO: 574530 - DNA, 13 bp, D. melanogaster
actgaggaatttg

SEQ ID NO: 574531 - DNA, 14 bp, D. melanogaster
actgagtatatata

SEQ ID NO: 574532 - DNA, 13 bp, D. melanogaster
actgataaaagtg

SEQ ID NO: 574533 - DNA, 13 bp, D. melanogaster
actgataactgat

SEQ ID NO: 574534 - DNA, 13 bp, D. melanogaster
actgataataact

SEQ ID NO: 574535 - DNA, 13 bp, D. melanogaster
actgatactgata

SEQ ID NO: 574536 - DNA, 14 bp, D. melanogaster
actgatactgatac

SEQ ID NO: 574537 - DNA, 13 bp, D. melanogaster
actgatgatgatg

SEQ ID NO: 574538 - DNA, 14 bp, D. melanogaster
actgatgatgatga

SEQ ID NO: 574539 - DNA, 13 bp, D. melanogaster
actgatgctgatg

SEQ ID NO: 574540 - DNA, 14 bp, D. melanogaster
actgattgattgat

SEQ ID NO: 574541 - DNA, 13 bp, D. melanogaster
actgattgctttt

SEQ ID NO: 574542 - DNA, 13 bp, D. melanogaster
actgattgtttct

SEQ ID NO: 574543 - DNA, 13 bp, D. melanogaster
actgatttctttg

SEQ ID NO: 574544 - DNA, 13 bp, D. melanogaster
actgattttattt

SEQ ID NO: 574545 - DNA, 13 bp, D. melanogaster
actgattttgaac

SEQ ID NO: 574546 - DNA, 14 bp, D. melanogaster
actgattttgaact

SEQ ID NO: 574547 - DNA, 14 bp, D. melanogaster
actgattttgtaaa

SEQ ID NO: 574548 - DNA, 13 bp, D. melanogaster
actgcaaaaaaat

SEQ ID NO: 574549 - DNA, 13 bp, D. melanogaster
actgcaaaaacaa

SEQ ID NO: 574550 - DNA, 13 bp, D. melanogaster
actgcaaaaatat

SEQ ID NO: 574551 - DNA, 14 bp, D. melanogaster
actgcaaaacaaaa

SEQ ID NO: 574552 - DNA, 13 bp, D. melanogaster
actgcaaaatgaa

SEQ ID NO: 574553 - DNA, 13 bp, D. melanogaster
actgcaaacaaaa

SEQ ID NO: 574554 - DNA, 13 bp, D. melanogaster
actgcaaactaca

SEQ ID NO: 574555 - DNA, 13 bp, D. melanogaster
actgcaaataaaa

SEQ ID NO: 574556 - DNA, 13 bp, D. melanogaster
actgcaaatgaaa

SEQ ID NO: 574557 - DNA, 13 bp, D. melanogaster
actgcaaatgcaa

SEQ ID NO: 574558 - DNA, 13 bp, D. melanogaster
actgcaaattaaa

SEQ ID NO: 574559 - DNA, 13 bp, D. melanogaster
actgcaaattgaa

SEQ ID NO: 574560 - DNA, 13 bp, D. melanogaster
actgcaaattgca

SEQ ID NO: 574561 - DNA, 13 bp, D. melanogaster
actgcaacaaaag

SEQ ID NO: 574562 - DNA, 13 bp, D. melanogaster
actgcaacacgca

SEQ ID NO: 574563 - DNA, 13 bp, D. melanogaster
actgcaacagcaa

SEQ ID NO: 574564 - DNA, 13 bp, D. melanogaster
actgcaacattgt

SEQ ID NO: 574565 - DNA, 13 bp, D. melanogaster
actgcaactgaaa

SEQ ID NO: 574566 - DNA, 13 bp, D. melanogaster
actgcaactgcat

SEQ ID NO: 574567 - DNA, 13 bp, D. melanogaster
actgcaactgctg

SEQ ID NO: 574568 - DNA, 13 bp, D. melanogaster
actgcaagaaaaa

SEQ ID NO: 574569 - DNA, 13 bp, D. melanogaster
actgcaagaaatt

SEQ ID NO: 574570 - DNA, 13 bp, D. melanogaster
actgcaagagtgt

SEQ ID NO: 574571 - DNA, 13 bp, D. melanogaster
actgcaaggaaaa

SEQ ID NO: 574572 - DNA, 14 bp, D. melanogaster
actgcaaggaaaac

SEQ ID NO: 574573 - DNA, 13 bp, D. melanogaster
actgcaagggtgg

SEQ ID NO: 574574 - DNA, 13 bp, D. melanogaster
actgcaagtgcaa

SEQ ID NO: 574575 - DNA, 14 bp, D. melanogaster
actgcaatgtcttc

SEQ ID NO: 574576 - DNA, 13 bp, D. melanogaster
actgcaattgaaa

SEQ ID NO: 574577 - DNA, 13 bp, D. melanogaster
actgcaattgcaa

SEQ ID NO: 574578 - DNA, 14 bp, D. melanogaster
actgcaattgcaac

SEQ ID NO: 574579 - DNA, 13 bp, D. melanogaster
actgcaattgcat

SEQ ID NO: 574580 - DNA, 13 bp, D. melanogaster
actgcaattgctg

SEQ ID NO: 574581 - DNA, 13 bp, D. melanogaster
actgcaattggca

SEQ ID NO: 574582 - DNA, 13 bp, D. melanogaster
actgcaattgttt

SEQ ID NO: 574583 - DNA, 13 bp, D. melanogaster
actgcaatttgtt

SEQ ID NO: 574584 - DNA, 14 bp, D. melanogaster
actgcacagccatt

SEQ ID NO: 574585 - DNA, 13 bp, D. melanogaster
actgcactgaaaa

SEQ ID NO: 574586 - DNA, 13 bp, D. melanogaster
actgcactgcact

SEQ ID NO: 574587 - DNA, 14 bp, D. melanogaster
actgcactgcactg

SEQ ID NO: 574588 - DNA, 13 bp, D. melanogaster
actgcacttaatt

SEQ ID NO: 574589 - DNA, 13 bp, D. melanogaster
actgcactttttc

SEQ ID NO: 574590 - DNA, 14 bp, D. melanogaster
actgcactttttca

SEQ ID NO: 574591 - DNA, 14 bp, D. melanogaster
actgcagaatgtgg

SEQ ID NO: 574592 - DNA, 13 bp, D. melanogaster
actgcagcaactg

SEQ ID NO: 574593 - DNA, 15 bp, D. melanogaster
actgcagcagcagca

SEQ ID NO: 574594 - DNA, 13 bp, D. melanogaster
actgcagcagcat

SEQ ID NO: 574595 - DNA, 14 bp, D. melanogaster
actgcagcagcatt

SEQ ID NO: 574596 - DNA, 15 bp, D. melanogaster
actgcagcagctctt

SEQ ID NO: 574597 - DNA, 13 bp, D. melanogaster
actgcagcgcaat

SEQ ID NO: 574598 - DNA, 13 bp, D. melanogaster
actgcagtagtta

SEQ ID NO: 574599 - DNA, 13 bp, D. melanogaster
actgcagttgcag

SEQ ID NO: 574600 - DNA, 13 bp, D. melanogaster
actgcagtttgca

SEQ ID NO: 574601 - DNA, 13 bp, D. melanogaster
actgcagttttat

SEQ ID NO: 574602 - DNA, 13 bp, D. melanogaster
actgcataaatat

SEQ ID NO: 574603 - DNA, 13 bp, D. melanogaster
actgcataataaa

SEQ ID NO: 574604 - DNA, 13 bp, D. melanogaster
actgcatatatat

SEQ ID NO: 574605 - DNA, 14 bp, D. melanogaster
actgcatctgcacc

SEQ ID NO: 574606 - DNA, 13 bp, D. melanogaster
actgcatctgcat

SEQ ID NO: 574607 - DNA, 13 bp, D. melanogaster
actgcatttaaaa

SEQ ID NO: 574608 - DNA, 13 bp, D. melanogaster
actgcatttgatt

SEQ ID NO: 574609 - DNA, 13 bp, D. melanogaster
actgcattttaat

SEQ ID NO: 574610 - DNA, 13 bp, D. melanogaster
actgccaaaaaaa

SEQ ID NO: 574611 - DNA, 13 bp, D. melanogaster
actgccaaaaaat

SEQ ID NO: 574612 - DNA, 13 bp, D. melanogaster
actgccaaaaagt

SEQ ID NO: 574613 - DNA, 13 bp, D. melanogaster
actgccaaaatta

SEQ ID NO: 574614 - DNA, 13 bp, D. melanogaster
actgccaaatggc

SEQ ID NO: 574615 - DNA, 13 bp, D. melanogaster
actgccaactgcc

SEQ ID NO: 574616 - DNA, 13 bp, D. melanogaster
actgccaactggc

SEQ ID NO: 574617 - DNA, 13 bp, D. melanogaster
actgccacaacat

SEQ ID NO: 574618 - DNA, 13 bp, D. melanogaster
actgccacaccca

SEQ ID NO: 574619 - DNA, 14 bp, D. melanogaster
actgccacacccac

SEQ ID NO: 574620 - DNA, 13 bp, D. melanogaster
actgccacccacc

SEQ ID NO: 574621 - DNA, 14 bp, D. melanogaster
actgccacgcccaa

SEQ ID NO: 574622 - DNA, 14 bp, D. melanogaster
actgccactcccac

SEQ ID NO: 574623 - DNA, 13 bp, D. melanogaster
actgccactgcaa

SEQ ID NO: 574624 - DNA, 13 bp, D. melanogaster
actgccactgcca

SEQ ID NO: 574625 - DNA, 14 bp, D. melanogaster
actgccactgccac

SEQ ID NO: 574626 - DNA, 14 bp, D. melanogaster
actgccactgccgc

SEQ ID NO: 574627 - DNA, 13 bp, D. melanogaster
actgccactgctg

SEQ ID NO: 574628 - DNA, 14 bp, D. melanogaster
actgccactgctgc

SEQ ID NO: 574629 - DNA, 13 bp, D. melanogaster
actgccactggca

SEQ ID NO: 574630 - DNA, 13 bp, D. melanogaster
actgccagaaaaa

SEQ ID NO: 574631 - DNA, 13 bp, D. melanogaster
actgccagcaaaa

SEQ ID NO: 574632 - DNA, 13 bp, D. melanogaster
actgccagcagca

SEQ ID NO: 574633 - DNA, 13 bp, D. melanogaster
actgccatttcca

SEQ ID NO: 574634 - DNA, 13 bp, D. melanogaster
actgcccactgcc

SEQ ID NO: 574635 - DNA, 13 bp, D. melanogaster
actgccctctttc

SEQ ID NO: 574636 - DNA, 13 bp, D. melanogaster
actgccgctgctg

SEQ ID NO: 574637 - DNA, 13 bp, D. melanogaster
actgcgaaaataa

SEQ ID NO: 574638 - DNA, 13 bp, D. melanogaster
actgcgacaaaaa

SEQ ID NO: 574639 - DNA, 13 bp, D. melanogaster
actgcgactgcaa

SEQ ID NO: 574640 - DNA, 14 bp, D. melanogaster
actgcgactgcgac

SEQ ID NO: 574641 - DNA, 13 bp, D. melanogaster
actgcgactgtga

SEQ ID NO: 574642 - DNA, 13 bp, D. melanogaster
actgcgagaaaat

SEQ ID NO: 574643 - DNA, 14 bp, D. melanogaster
actgcgagaaaatg

SEQ ID NO: 574644 - DNA, 13 bp, D. melanogaster
actgcgagaaatc

SEQ ID NO: 574645 - DNA, 13 bp, D. melanogaster
actgcgagaaatg

SEQ ID NO: 574646 - DNA, 13 bp, D. melanogaster
actgcgattgcga

SEQ ID NO: 574647 - DNA, 13 bp, D. melanogaster
actgcgcatgcgc

SEQ ID NO: 574648 - DNA, 13 bp, D. melanogaster
actgcgccaattg

SEQ ID NO: 574649 - DNA, 14 bp, D. melanogaster
actgcgccaattgc

SEQ ID NO: 574650 - DNA, 13 bp, D. melanogaster
actgcgccagtaa

SEQ ID NO: 574651 - DNA, 13 bp, D. melanogaster
actgcgctgcata

SEQ ID NO: 574652 - DNA, 13 bp, D. melanogaster
actgctcattccg

SEQ ID NO: 574653 - DNA, 13 bp, D. melanogaster
actgctcctgctc

SEQ ID NO: 574654 - DNA, 14 bp, D. melanogaster
actgctcctgctgc

SEQ ID NO: 574655 - DNA, 13 bp, D. melanogaster
actgctcgcaaat

SEQ ID NO: 574656 - DNA, 13 bp, D. melanogaster
actgctcggctct

SEQ ID NO: 574657 - DNA, 13 bp, D. melanogaster
actgctgatgatg

SEQ ID NO: 574658 - DNA, 13 bp, D. melanogaster
actgctgcactgc

SEQ ID NO: 574659 - DNA, 14 bp, D. melanogaster
actgctgcactgcc

SEQ ID NO: 574660 - DNA, 13 bp, D. melanogaster
actgctgctcctg

SEQ ID NO: 574661 - DNA, 14 bp, D. melanogaster
actgctgctcctgc

SEQ ID NO: 574662 - DNA, 14 bp, D. melanogaster
actgctgctgagaa

SEQ ID NO: 574663 - DNA, 13 bp, D. melanogaster
actgctgctgcct

SEQ ID NO: 574664 - DNA, 13 bp, D. melanogaster
actgctgctgcta

SEQ ID NO: 574665 - DNA, 14 bp, D. melanogaster
actgctgctgctgc

SEQ ID NO: 574666 - DNA, 14 bp, D. melanogaster
actgctgctgctgt

SEQ ID NO: 574667 - DNA, 13 bp, D. melanogaster
actgctgctgttg

SEQ ID NO: 574668 - DNA, 13 bp, D. melanogaster
actgctgcttctg

SEQ ID NO: 574669 - DNA, 13 bp, D. melanogaster
actgctgcttctt

SEQ ID NO: 574670 - DNA, 13 bp, D. melanogaster
actgctggccaaa

SEQ ID NO: 574671 - DNA, 13 bp, D. melanogaster
actgctgtacagt

SEQ ID NO: 574672 - DNA, 13 bp, D. melanogaster
actgctgtgctca

SEQ ID NO: 574673 - DNA, 14 bp, D. melanogaster
actgctgttgctgc

SEQ ID NO: 574674 - DNA, 13 bp, D. melanogaster
actgctgttgttg

SEQ ID NO: 574675 - DNA, 13 bp, D. melanogaster
actgcttctgctg

SEQ ID NO: 574676 - DNA, 13 bp, D. melanogaster
actgcttcttaag

SEQ ID NO: 574677 - DNA, 13 bp, D. melanogaster
actgctttgacat

SEQ ID NO: 574678 - DNA, 13 bp, D. melanogaster
actgcttttgaac

SEQ ID NO: 574679 - DNA, 13 bp, D. melanogaster
actggaaaaaatc

SEQ ID NO: 574680 - DNA, 13 bp, D. melanogaster
actggaaaaaatt

SEQ ID NO: 574681 - DNA, 13 bp, D. melanogaster
actggaaaaacac

SEQ ID NO: 574682 - DNA, 13 bp, D. melanogaster
actggaaaaatct

SEQ ID NO: 574683 - DNA, 13 bp, D. melanogaster
actggaaaccgaa

SEQ ID NO: 574684 - DNA, 13 bp, D. melanogaster
actggaaactgaa

SEQ ID NO: 574685 - DNA, 14 bp, D. melanogaster
actggaaactggaa

SEQ ID NO: 574686 - DNA, 13 bp, D. melanogaster
actggaaatcaaa

SEQ ID NO: 574687 - DNA, 13 bp, D. melanogaster
actggaaatgaaa

SEQ ID NO: 574688 - DNA, 13 bp, D. melanogaster
actggaaatggaa

SEQ ID NO: 574689 - DNA, 14 bp, D. melanogaster
actggaagcaggga

SEQ ID NO: 574690 - DNA, 13 bp, D. melanogaster
actggaagtggaa

SEQ ID NO: 574691 - DNA, 14 bp, D. melanogaster
actggaataccttt

SEQ ID NO: 574692 - DNA, 13 bp, D. melanogaster
actggaatagatt

SEQ ID NO: 574693 - DNA, 13 bp, D. melanogaster
actggaatagttt

SEQ ID NO: 574694 - DNA, 13 bp, D. melanogaster
actggaatgtgcg

SEQ ID NO: 574695 - DNA, 13 bp, D. melanogaster
actggaccaattt

SEQ ID NO: 574696 - DNA, 13 bp, D. melanogaster
actggactacaaa

SEQ ID NO: 574697 - DNA, 13 bp, D. melanogaster
actggagaatttc

SEQ ID NO: 574698 - DNA, 13 bp, D. melanogaster
actggagctgatt

SEQ ID NO: 574699 - DNA, 13 bp, D. melanogaster
actggaggaggct

SEQ ID NO: 574700 - DNA, 13 bp, D. melanogaster
actggatgaaggc

SEQ ID NO: 574701 - DNA, 13 bp, D. melanogaster
actggcaaaaaaa

SEQ ID NO: 574702 - DNA, 13 bp, D. melanogaster
actggcaaaaagt

SEQ ID NO: 574703 - DNA, 13 bp, D. melanogaster
actggcaaaaata

SEQ ID NO: 574704 - DNA, 13 bp, D. melanogaster
actggcaaacaga

SEQ ID NO: 574705 - DNA, 13 bp, D. melanogaster
actggcaaataaa

SEQ ID NO: 574706 - DNA, 14 bp, D. melanogaster
actggcaaataccc

SEQ ID NO: 574707 - DNA, 13 bp, D. melanogaster
actggcaaatgga

SEQ ID NO: 574708 - DNA, 13 bp, D. melanogaster
actggcaacattt

SEQ ID NO: 574709 - DNA, 14 bp, D. melanogaster
actggcaactgcca

SEQ ID NO: 574710 - DNA, 13 bp, D. melanogaster
actggcaactgga

SEQ ID NO: 574711 - DNA, 13 bp, D. melanogaster
actggcaactggg

SEQ ID NO: 574712 - DNA, 13 bp, D. melanogaster
actggcaacttgc

SEQ ID NO: 574713 - DNA, 13 bp, D. melanogaster
actggcaatggca

SEQ ID NO: 574714 - DNA, 13 bp, D. melanogaster
actggcacacaca

SEQ ID NO: 574715 - DNA, 13 bp, D. melanogaster
actggcacacata

SEQ ID NO: 574716 - DNA, 13 bp, D. melanogaster
actggcactggca

SEQ ID NO: 574717 - DNA, 14 bp, D. melanogaster
actggcactggcac

SEQ ID NO: 574718 - DNA, 13 bp, D. melanogaster
actggcagaaatt

SEQ ID NO: 574719 - DNA, 13 bp, D. melanogaster
actggcattttaa

SEQ ID NO: 574720 - DNA, 13 bp, D. melanogaster
actggccaaaaaa

SEQ ID NO: 574721 - DNA, 13 bp, D. melanogaster
actggccaaaatg

SEQ ID NO: 574722 - DNA, 13 bp, D. melanogaster
actggccaactgc

SEQ ID NO: 574723 - DNA, 13 bp, D. melanogaster
actggccaactgg

SEQ ID NO: 574724 - DNA, 14 bp, D. melanogaster
actggccacgccca

SEQ ID NO: 574725 - DNA, 13 bp, D. melanogaster
actggccagcaga

SEQ ID NO: 574726 - DNA, 13 bp, D. melanogaster
actggcgactggc

SEQ ID NO: 574727 - DNA, 13 bp, D. melanogaster
actggcgcccaac

SEQ ID NO: 574728 - DNA, 13 bp, D. melanogaster
actggcgcccgaa

SEQ ID NO: 574729 - DNA, 13 bp, D. melanogaster
actggcgctgcga

SEQ ID NO: 574730 - DNA, 13 bp, D. melanogaster
actggctaactgg

SEQ ID NO: 574731 - DNA, 14 bp, D. melanogaster
actggctctcaaat

SEQ ID NO: 574732 - DNA, 13 bp, D. melanogaster
actggctgactga

SEQ ID NO: 574733 - DNA, 13 bp, D. melanogaster
actggctgctgct

SEQ ID NO: 574734 - DNA, 13 bp, D. melanogaster
actggctggggtc

SEQ ID NO: 574735 - DNA, 13 bp, D. melanogaster
actggcttaaaat

SEQ ID NO: 574736 - DNA, 13 bp, D. melanogaster
actggctttcgtc

SEQ ID NO: 574737 - DNA, 13 bp, D. melanogaster
actgggaaaagct

SEQ ID NO: 574738 - DNA, 13 bp, D. melanogaster
actgggaactgga

SEQ ID NO: 574739 - DNA, 13 bp, D. melanogaster
actgggaagtgga

SEQ ID NO: 574740 - DNA, 16 bp, D. melanogaster
actgggactgggactg

SEQ ID NO: 574741 - DNA, 13 bp, D. melanogaster
actgggagaaaaa

SEQ ID NO: 574742 - DNA, 13 bp, D. melanogaster
actgggagaaatg

SEQ ID NO: 574743 - DNA, 13 bp, D. melanogaster
actgggagccatc

SEQ ID NO: 574744 - DNA, 13 bp, D. melanogaster
actgggagctggg

SEQ ID NO: 574745 - DNA, 13 bp, D. melanogaster
actgggattggga

SEQ ID NO: 574746 - DNA, 13 bp, D. melanogaster
actgggcaaaaag

SEQ ID NO: 574747 - DNA, 13 bp, D. melanogaster
actgggcaactgg

SEQ ID NO: 574748 - DNA, 13 bp, D. melanogaster
actgggcgaaaaa

SEQ ID NO: 574749 - DNA, 13 bp, D. melanogaster
actggtactggta

SEQ ID NO: 574750 - DNA, 14 bp, D. melanogaster
actggtgatggtcg

SEQ ID NO: 574751 - DNA, 13 bp, D. melanogaster
actggtggaaagg

SEQ ID NO: 574752 - DNA, 13 bp, D. melanogaster
actggtgtgtgag

SEQ ID NO: 574753 - DNA, 14 bp, D. melanogaster
actggtttataatt

SEQ ID NO: 574754 - DNA, 13 bp, D. melanogaster
actggtttggggt

SEQ ID NO: 574755 - DNA, 13 bp, D. melanogaster
actgtaaaaataa

SEQ ID NO: 574756 - DNA, 13 bp, D. melanogaster
actgtaaaaatat

SEQ ID NO: 574757 - DNA, 13 bp, D. melanogaster
actgtaaaatcag

SEQ ID NO: 574758 - DNA, 13 bp, D. melanogaster
actgtaaaattat

SEQ ID NO: 574759 - DNA, 13 bp, D. melanogaster
actgtaaactgta

SEQ ID NO: 574760 - DNA, 13 bp, D. melanogaster
actgtaaataaat

SEQ ID NO: 574761 - DNA, 13 bp, D. melanogaster
actgtaaattgta

SEQ ID NO: 574762 - DNA, 14 bp, D. melanogaster
actgtaatttaatt

SEQ ID NO: 574763 - DNA, 13 bp, D. melanogaster
actgtacagcagt

SEQ ID NO: 574764 - DNA, 13 bp, D. melanogaster
actgtaccgcctc

SEQ ID NO: 574765 - DNA, 13 bp, D. melanogaster
actgtatattttt

SEQ ID NO: 574766 - DNA, 13 bp, D. melanogaster
actgtatctgcat

SEQ ID NO: 574767 - DNA, 13 bp, D. melanogaster
actgtatgccatc

SEQ ID NO: 574768 - DNA, 13 bp, D. melanogaster
actgtatttgaat

SEQ ID NO: 574769 - DNA, 13 bp, D. melanogaster
actgtcaaaaaat

SEQ ID NO: 574770 - DNA, 13 bp, D. melanogaster
actgtcaagaaac

SEQ ID NO: 574771 - DNA, 13 bp, D. melanogaster
actgtcaagtgca

SEQ ID NO: 574772 - DNA, 14 bp, D. melanogaster
actgtcacgcccac

SEQ ID NO: 574773 - DNA, 13 bp, D. melanogaster
actgtctaaatat

SEQ ID NO: 574774 - DNA, 13 bp, D. melanogaster
actgtctgtctgt

SEQ ID NO: 574775 - DNA, 13 bp, D. melanogaster
actgtgaaaaaat

SEQ ID NO: 574776 - DNA, 13 bp, D. melanogaster
actgtgaaaaata

SEQ ID NO: 574777 - DNA, 13 bp, D. melanogaster
actgtgaaaaatc

SEQ ID NO: 574778 - DNA, 14 bp, D. melanogaster
actgtgaaaaatct

SEQ ID NO: 574779 - DNA, 13 bp, D. melanogaster
actgtgagccata

SEQ ID NO: 574780 - DNA, 13 bp, D. melanogaster
actgtgcaaaaaa

SEQ ID NO: 574781 - DNA, 13 bp, D. melanogaster
actgtgcaacaaa

SEQ ID NO: 574782 - DNA, 13 bp, D. melanogaster
actgtgccctgtt

SEQ ID NO: 574783 - DNA, 13 bp, D. melanogaster
actgtgcgaaaaa

SEQ ID NO: 574784 - DNA, 13 bp, D. melanogaster
actgtggatctgt

SEQ ID NO: 574785 - DNA, 15 bp, D. melanogaster
actgttaacagccag

SEQ ID NO: 574786 - DNA, 13 bp, D. melanogaster
actgttattattt

SEQ ID NO: 574787 - DNA, 13 bp, D. melanogaster
actgttcatacaa

SEQ ID NO: 574788 - DNA, 13 bp, D. melanogaster
actgttctttggt

SEQ ID NO: 574789 - DNA, 13 bp, D. melanogaster
actgttgcagtgc

SEQ ID NO: 574790 - DNA, 13 bp, D. melanogaster
actgttggccaaa

SEQ ID NO: 574791 - DNA, 14 bp, D. melanogaster
actgttgttacggc

SEQ ID NO: 574792 - DNA, 13 bp, D. melanogaster
actgttgttgttg

SEQ ID NO: 574793 - DNA, 14 bp, D. melanogaster
actgttgttgttgt

SEQ ID NO: 574794 - DNA, 13 bp, D. melanogaster
actgtttaaaatg

SEQ ID NO: 574795 - DNA, 13 bp, D. melanogaster
actgtttaacccc

SEQ ID NO: 574796 - DNA, 13 bp, D. melanogaster
actgtttacaaat

SEQ ID NO: 574797 - DNA, 13 bp, D. melanogaster
actgtttcaaatt

SEQ ID NO: 574798 - DNA, 13 bp, D. melanogaster
actgtttcactaa

SEQ ID NO: 574799 - DNA, 13 bp, D. melanogaster
actgtttggagtc

SEQ ID NO: 574800 - DNA, 13 bp, D. melanogaster
actgtttggtgta

SEQ ID NO: 574801 - DNA, 13 bp, D. melanogaster
actgtttgtttgt

SEQ ID NO: 574802 - DNA, 14 bp, D. melanogaster
actgttttcaggca

SEQ ID NO: 574803 - DNA, 16 bp, D. melanogaster
actgttttgagcagct

SEQ ID NO: 574804 - DNA, 13 bp, D. melanogaster
actgttttgatac

SEQ ID NO: 574805 - DNA, 13 bp, D. melanogaster
actgttttgtgca

SEQ ID NO: 574806 - DNA, 13 bp, D. melanogaster
actgtttttatgt

SEQ ID NO: 574807 - DNA, 13 bp, D. melanogaster
actgtttttatta

SEQ ID NO: 574808 - DNA, 13 bp, D. melanogaster
acttaaaaaactt

SEQ ID NO: 574809 - DNA, 13 bp, D. melanogaster
acttaaaaacctt

SEQ ID NO: 574810 - DNA, 13 bp, D. melanogaster
acttaaaaatatg

SEQ ID NO: 574811 - DNA, 13 bp, D. melanogaster
acttaaaaatgca

SEQ ID NO: 574812 - DNA, 13 bp, D. melanogaster
acttaaaaatgta

SEQ ID NO: 574813 - DNA, 13 bp, D. melanogaster
acttaaaacgaaa

SEQ ID NO: 574814 - DNA, 13 bp, D. melanogaster
acttaaaacgcaa

SEQ ID NO: 574815 - DNA, 13 bp, D. melanogaster
acttaaaacttat

SEQ ID NO: 574816 - DNA, 13 bp, D. melanogaster
acttaaaagcctt

SEQ ID NO: 574817 - DNA, 14 bp, D. melanogaster
acttaaaagcctta

SEQ ID NO: 574818 - DNA, 13 bp, D. melanogaster
acttaaaatcaat

SEQ ID NO: 574819 - DNA, 14 bp, D. melanogaster
acttaaacattttt

SEQ ID NO: 574820 - DNA, 13 bp, D. melanogaster
acttaaactttaa

SEQ ID NO: 574821 - DNA, 13 bp, D. melanogaster
acttaaacttttt

SEQ ID NO: 574822 - DNA, 13 bp, D. melanogaster
acttaaagaagaa

SEQ ID NO: 574823 - DNA, 15 bp, D. melanogaster
acttaaagatgatga

SEQ ID NO: 574824 - DNA, 13 bp, D. melanogaster
acttaaagcaaaa

SEQ ID NO: 574825 - DNA, 15 bp, D. melanogaster
acttaaagcaataaa

SEQ ID NO: 574826 - DNA, 13 bp, D. melanogaster
acttaaagccaaa

SEQ ID NO: 574827 - DNA, 13 bp, D. melanogaster
acttaaagtccac

SEQ ID NO: 574828 - DNA, 13 bp, D. melanogaster
acttaaagttttt

SEQ ID NO: 574829 - DNA, 13 bp, D. melanogaster
acttaaataaatc

SEQ ID NO: 574830 - DNA, 13 bp, D. melanogaster
acttaaatataga

SEQ ID NO: 574831 - DNA, 13 bp, D. melanogaster
acttaaatcattt

SEQ ID NO: 574832 - DNA, 13 bp, D. melanogaster
acttaaatgaaat

SEQ ID NO: 574833 - DNA, 13 bp, D. melanogaster
acttaaatgcaaa

SEQ ID NO: 574834 - DNA, 13 bp, D. melanogaster
acttaaatggaaa

SEQ ID NO: 574835 - DNA, 13 bp, D. melanogaster
acttaaattaact

SEQ ID NO: 574836 - DNA, 13 bp, D. melanogaster
acttaaattacat

SEQ ID NO: 574837 - DNA, 13 bp, D. melanogaster
acttaaattagtt

SEQ ID NO: 574838 - DNA, 13 bp, D. melanogaster
acttaaattattc

SEQ ID NO: 574839 - DNA, 13 bp, D. melanogaster
acttaaattattg

SEQ ID NO: 574840 - DNA, 13 bp, D. melanogaster
acttaaattcaat

SEQ ID NO: 574841 - DNA, 13 bp, D. melanogaster
acttaaattcatt

SEQ ID NO: 574842 - DNA, 13 bp, D. melanogaster
acttaacaagttt

SEQ ID NO: 574843 - DNA, 13 bp, D. melanogaster
acttaaccatatc

SEQ ID NO: 574844 - DNA, 13 bp, D. melanogaster
acttaacctaaat

SEQ ID NO: 574845 - DNA, 13 bp, D. melanogaster
acttaactaattt

SEQ ID NO: 574846 - DNA, 13 bp, D. melanogaster
acttaacttaaat

SEQ ID NO: 574847 - DNA, 13 bp, D. melanogaster
acttaacttaagt

SEQ ID NO: 574848 - DNA, 13 bp, D. melanogaster
acttaacttaatt

SEQ ID NO: 574849 - DNA, 13 bp, D. melanogaster
acttaactttatt

SEQ ID NO: 574850 - DNA, 13 bp, D. melanogaster
acttaacttttta

SEQ ID NO: 574851 - DNA, 13 bp, D. melanogaster
acttaagcatttt

SEQ ID NO: 574852 - DNA, 13 bp, D. melanogaster
acttaagtaaata

SEQ ID NO: 574853 - DNA, 13 bp, D. melanogaster
acttaagttaaaa

SEQ ID NO: 574854 - DNA, 13 bp, D. melanogaster
acttaagttaagt

SEQ ID NO: 574855 - DNA, 13 bp, D. melanogaster
acttaagttaatt

SEQ ID NO: 574856 - DNA, 13 bp, D. melanogaster
acttaagtttttt

SEQ ID NO: 574857 - DNA, 13 bp, D. melanogaster
acttaataaatgt

SEQ ID NO: 574858 - DNA, 13 bp, D. melanogaster
acttaatacaaat

SEQ ID NO: 574859 - DNA, 13 bp, D. melanogaster
acttaatacatat

SEQ ID NO: 574860 - DNA, 13 bp, D. melanogaster
acttaatagtcat

SEQ ID NO: 574861 - DNA, 13 bp, D. melanogaster
acttaatataaca

SEQ ID NO: 574862 - DNA, 13 bp, D. melanogaster
acttaatatttca

SEQ ID NO: 574863 - DNA, 13 bp, D. melanogaster
acttaatgaaaat

SEQ ID NO: 574864 - DNA, 13 bp, D. melanogaster
acttaatgaataa

SEQ ID NO: 574865 - DNA, 13 bp, D. melanogaster
acttaatgcaatt

SEQ ID NO: 574866 - DNA, 13 bp, D. melanogaster
acttaattactta

SEQ ID NO: 574867 - DNA, 13 bp, D. melanogaster
acttaattagttg

SEQ ID NO: 574868 - DNA, 13 bp, D. melanogaster
acttaattgaaat

SEQ ID NO: 574869 - DNA, 13 bp, D. melanogaster
acttaattgaatt

SEQ ID NO: 574870 - DNA, 13 bp, D. melanogaster
acttaattgcttt

SEQ ID NO: 574871 - DNA, 13 bp, D. melanogaster
acttaattgtaat

SEQ ID NO: 574872 - DNA, 13 bp, D. melanogaster
acttaatttaatg

SEQ ID NO: 574873 - DNA, 13 bp, D. melanogaster
acttaatttcatt

SEQ ID NO: 574874 - DNA, 13 bp, D. melanogaster
acttaatttgtta

SEQ ID NO: 574875 - DNA, 13 bp, D. melanogaster
acttaattttgca

SEQ ID NO: 574876 - DNA, 13 bp, D. melanogaster
acttacaactttt

SEQ ID NO: 574877 - DNA, 13 bp, D. melanogaster
acttacaatccga

SEQ ID NO: 574878 - DNA, 13 bp, D. melanogaster
acttacaattttg

SEQ ID NO: 574879 - DNA, 14 bp, D. melanogaster
acttacacacacac

SEQ ID NO: 574880 - DNA, 13 bp, D. melanogaster
acttacacataca

SEQ ID NO: 574881 - DNA, 13 bp, D. melanogaster
acttacacttaca

SEQ ID NO: 574882 - DNA, 14 bp, D. melanogaster
acttacacttacac

SEQ ID NO: 574883 - DNA, 13 bp, D. melanogaster
acttacatacata

SEQ ID NO: 574884 - DNA, 14 bp, D. melanogaster
acttacatacatat

SEQ ID NO: 574885 - DNA, 13 bp, D. melanogaster
acttacatatatg

SEQ ID NO: 574886 - DNA, 13 bp, D. melanogaster
acttacatttata

SEQ ID NO: 574887 - DNA, 13 bp, D. melanogaster
acttacatttatt

SEQ ID NO: 574888 - DNA, 13 bp, D. melanogaster
acttagccaaatt

SEQ ID NO: 574889 - DNA, 13 bp, D. melanogaster
acttagccattct

SEQ ID NO: 574890 - DNA, 13 bp, D. melanogaster
acttagctgatgt

SEQ ID NO: 574891 - DNA, 13 bp, D. melanogaster
acttagcttaaag

SEQ ID NO: 574892 - DNA, 13 bp, D. melanogaster
acttagtgatagt

SEQ ID NO: 574893 - DNA, 13 bp, D. melanogaster
acttagttgccat

SEQ ID NO: 574894 - DNA, 13 bp, D. melanogaster
acttagtttgctc

SEQ ID NO: 574895 - DNA, 13 bp, D. melanogaster
acttataaaaagt

SEQ ID NO: 574896 - DNA, 13 bp, D. melanogaster
acttatacatttt

SEQ ID NO: 574897 - DNA, 14 bp, D. melanogaster
acttatacttatac

SEQ ID NO: 574898 - DNA, 13 bp, D. melanogaster
acttatatagcaa

SEQ ID NO: 574899 - DNA, 13 bp, D. melanogaster
acttatatcctaa

SEQ ID NO: 574900 - DNA, 13 bp, D. melanogaster
acttatattttcc

SEQ ID NO: 574901 - DNA, 13 bp, D. melanogaster
acttatgcaaaag

SEQ ID NO: 574902 - DNA, 13 bp, D. melanogaster
acttatgcacacc

SEQ ID NO: 574903 - DNA, 13 bp, D. melanogaster
acttatggcagca

SEQ ID NO: 574904 - DNA, 13 bp, D. melanogaster
acttatgtaaata

SEQ ID NO: 574905 - DNA, 13 bp, D. melanogaster
acttatgtacata

SEQ ID NO: 574906 - DNA, 14 bp, D. melanogaster
acttatgtacatac

SEQ ID NO: 574907 - DNA, 13 bp, D. melanogaster
acttatgtataag

SEQ ID NO: 574908 - DNA, 13 bp, D. melanogaster
acttatgtatata

SEQ ID NO: 574909 - DNA, 14 bp, D. melanogaster
acttatgtatgtgt

SEQ ID NO: 574910 - DNA, 13 bp, D. melanogaster
acttatgtatgtt

SEQ ID NO: 574911 - DNA, 13 bp, D. melanogaster
acttattactttc

SEQ ID NO: 574912 - DNA, 14 bp, D. melanogaster
acttattactttcg

SEQ ID NO: 574913 - DNA, 13 bp, D. melanogaster
acttattatgcca

SEQ ID NO: 574914 - DNA, 13 bp, D. melanogaster
acttattcaaaat

SEQ ID NO: 574915 - DNA, 13 bp, D. melanogaster
acttattgcgctt

SEQ ID NO: 574916 - DNA, 13 bp, D. melanogaster
acttattggtctg

SEQ ID NO: 574917 - DNA, 13 bp, D. melanogaster
acttattgtattt

SEQ ID NO: 574918 - DNA, 13 bp, D. melanogaster
acttatttacata

SEQ ID NO: 574919 - DNA, 13 bp, D. melanogaster
acttatttattag

SEQ ID NO: 574920 - DNA, 13 bp, D. melanogaster
acttattttaagt

SEQ ID NO: 574921 - DNA, 13 bp, D. melanogaster
acttattttgtat

SEQ ID NO: 574922 - DNA, 13 bp, D. melanogaster
acttcaaaaatat

SEQ ID NO: 574923 - DNA, 13 bp, D. melanogaster
acttcaaaagaaa

SEQ ID NO: 574924 - DNA, 14 bp, D. melanogaster
acttcaaaaggtat

SEQ ID NO: 574925 - DNA, 13 bp, D. melanogaster
acttcaaaataat

SEQ ID NO: 574926 - DNA, 13 bp, D. melanogaster
acttcaaaattat

SEQ ID NO: 574927 - DNA, 13 bp, D. melanogaster
acttcaaagtcat

SEQ ID NO: 574928 - DNA, 13 bp, D. melanogaster
acttcaaataata

SEQ ID NO: 574929 - DNA, 13 bp, D. melanogaster
acttcaaatcaaa

SEQ ID NO: 574930 - DNA, 13 bp, D. melanogaster
acttcaaatgcaa

SEQ ID NO: 574931 - DNA, 13 bp, D. melanogaster
acttcaaatttat

SEQ ID NO: 574932 - DNA, 13 bp, D. melanogaster
acttcaacagcac

SEQ ID NO: 574933 - DNA, 13 bp, D. melanogaster
acttcaagaaagt

SEQ ID NO: 574934 - DNA, 13 bp, D. melanogaster
acttcaagttcaa

SEQ ID NO: 574935 - DNA, 13 bp, D. melanogaster
acttcaataattt

SEQ ID NO: 574936 - DNA, 13 bp, D. melanogaster
acttcaattgaaa

SEQ ID NO: 574937 - DNA, 13 bp, D. melanogaster
acttcaattgtgt

SEQ ID NO: 574938 - DNA, 13 bp, D. melanogaster
acttcaatttgca

SEQ ID NO: 574939 - DNA, 13 bp, D. melanogaster
acttcaccaaatt

SEQ ID NO: 574940 - DNA, 13 bp, D. melanogaster
acttcaccgcccc

SEQ ID NO: 574941 - DNA, 13 bp, D. melanogaster
acttcacctattt

SEQ ID NO: 574942 - DNA, 14 bp, D. melanogaster
acttcacttcactt

SEQ ID NO: 574943 - DNA, 13 bp, D. melanogaster
acttcacttcatt

SEQ ID NO: 574944 - DNA, 13 bp, D. melanogaster
acttcactttgca

SEQ ID NO: 574945 - DNA, 13 bp, D. melanogaster
acttcagtagctt

SEQ ID NO: 574946 - DNA, 13 bp, D. melanogaster
acttcagtgatgg

SEQ ID NO: 574947 - DNA, 13 bp, D. melanogaster
acttcagttcagt

SEQ ID NO: 574948 - DNA, 13 bp, D. melanogaster
acttcataaattt

SEQ ID NO: 574949 - DNA, 13 bp, D. melanogaster
acttcataatttt

SEQ ID NO: 574950 - DNA, 13 bp, D. melanogaster
acttcatagactt

SEQ ID NO: 574951 - DNA, 13 bp, D. melanogaster
acttcatcatcat

SEQ ID NO: 574952 - DNA, 13 bp, D. melanogaster
acttcatgccgat

SEQ ID NO: 574953 - DNA, 13 bp, D. melanogaster
acttcatgttatt

SEQ ID NO: 574954 - DNA, 13 bp, D. melanogaster
acttcatgttgtc

SEQ ID NO: 574955 - DNA, 13 bp, D. melanogaster
acttcattaaaaa

SEQ ID NO: 574956 - DNA, 13 bp, D. melanogaster
acttcattaattg

SEQ ID NO: 574957 - DNA, 13 bp, D. melanogaster
acttcattattta

SEQ ID NO: 574958 - DNA, 14 bp, D. melanogaster
acttcattgcagca

SEQ ID NO: 574959 - DNA, 13 bp, D. melanogaster
acttcatttacta

SEQ ID NO: 574960 - DNA, 13 bp, D. melanogaster
acttcatttgaaa

SEQ ID NO: 574961 - DNA, 13 bp, D. melanogaster
acttcatttgcaa

SEQ ID NO: 574962 - DNA, 13 bp, D. melanogaster
acttcatttgtgt

SEQ ID NO: 574963 - DNA, 13 bp, D. melanogaster
acttccaacttcc

SEQ ID NO: 574964 - DNA, 13 bp, D. melanogaster
acttccacatcca

SEQ ID NO: 574965 - DNA, 13 bp, D. melanogaster
acttccactagct

SEQ ID NO: 574966 - DNA, 13 bp, D. melanogaster
acttccactccac

SEQ ID NO: 574967 - DNA, 13 bp, D. melanogaster
acttccactcgac

SEQ ID NO: 574968 - DNA, 13 bp, D. melanogaster
acttccactgttc

SEQ ID NO: 574969 - DNA, 13 bp, D. melanogaster
acttccacttccg

SEQ ID NO: 574970 - DNA, 13 bp, D. melanogaster
acttccacttcct

SEQ ID NO: 574971 - DNA, 13 bp, D. melanogaster
acttccagtggca

SEQ ID NO: 574972 - DNA, 14 bp, D. melanogaster
acttccatttccac

SEQ ID NO: 574973 - DNA, 13 bp, D. melanogaster
acttcccacttcc

SEQ ID NO: 574974 - DNA, 13 bp, D. melanogaster
acttccgcttccg

SEQ ID NO: 574975 - DNA, 13 bp, D. melanogaster
acttccgtttccg

SEQ ID NO: 574976 - DNA, 14 bp, D. melanogaster
acttccgtttccgc

SEQ ID NO: 574977 - DNA, 14 bp, D. melanogaster
acttccgtttcctg

SEQ ID NO: 574978 - DNA, 13 bp, D. melanogaster
acttcctcaaggt

SEQ ID NO: 574979 - DNA, 13 bp, D. melanogaster
acttccttatcaa

SEQ ID NO: 574980 - DNA, 13 bp, D. melanogaster
acttccttcgctg

SEQ ID NO: 574981 - DNA, 14 bp, D. melanogaster
acttccttcgctgc

SEQ ID NO: 574982 - DNA, 13 bp, D. melanogaster
acttccttttaaa

SEQ ID NO: 574983 - DNA, 13 bp, D. melanogaster
acttcgaaatcgt

SEQ ID NO: 574984 - DNA, 13 bp, D. melanogaster
acttcgctcttct

SEQ ID NO: 574985 - DNA, 13 bp, D. melanogaster
acttcggaatttt

SEQ ID NO: 574986 - DNA, 13 bp, D. melanogaster
acttcgtcagcgg

SEQ ID NO: 574987 - DNA, 13 bp, D. melanogaster
acttctaaaaata

SEQ ID NO: 574988 - DNA, 13 bp, D. melanogaster
acttctacaattt

SEQ ID NO: 574989 - DNA, 13 bp, D. melanogaster
acttctactttat

SEQ ID NO: 574990 - DNA, 14 bp, D. melanogaster
acttctattataat

SEQ ID NO: 574991 - DNA, 13 bp, D. melanogaster
acttctgcttttg

SEQ ID NO: 574992 - DNA, 13 bp, D. melanogaster
acttctggattcc

SEQ ID NO: 574993 - DNA, 13 bp, D. melanogaster
acttctggcttga

SEQ ID NO: 574994 - DNA, 13 bp, D. melanogaster
acttcttaaattt

SEQ ID NO: 574995 - DNA, 14 bp, D. melanogaster
acttcttaaatttc

SEQ ID NO: 574996 - DNA, 13 bp, D. melanogaster
acttcttcatatt

SEQ ID NO: 574997 - DNA, 14 bp, D. melanogaster
acttcttcatattg

SEQ ID NO: 574998 - DNA, 13 bp, D. melanogaster
acttcttccagtg

SEQ ID NO: 574999 - DNA, 13 bp, D. melanogaster
acttcttccttat

SEQ ID NO: 575000 - DNA, 14 bp, D. melanogaster
acttcttggaattt

SEQ ID NO: 575001 - DNA, 13 bp, D. melanogaster
acttcttggccaa

SEQ ID NO: 575002 - DNA, 13 bp, D. melanogaster
acttcttgtatct

SEQ ID NO: 575003 - DNA, 13 bp, D. melanogaster
acttctttccaaa

SEQ ID NO: 575004 - DNA, 13 bp, D. melanogaster
acttctttttgct

SEQ ID NO: 575005 - DNA, 13 bp, D. melanogaster
acttgaaaaaatt

SEQ ID NO: 575006 - DNA, 13 bp, D. melanogaster
acttgaaaaataa

SEQ ID NO: 575007 - DNA, 13 bp, D. melanogaster
acttgaaaaatat

SEQ ID NO: 575008 - DNA, 13 bp, D. melanogaster
acttgaaaagttt

SEQ ID NO: 575009 - DNA, 13 bp, D. melanogaster
acttgaaaatata

SEQ ID NO: 575010 - DNA, 13 bp, D. melanogaster
acttgaaaattga

SEQ ID NO: 575011 - DNA, 14 bp, D. melanogaster
acttgaaaattgag

SEQ ID NO: 575012 - DNA, 13 bp, D. melanogaster
acttgaaacaaaa

SEQ ID NO: 575013 - DNA, 13 bp, D. melanogaster
acttgaaactaaa

SEQ ID NO: 575014 - DNA, 13 bp, D. melanogaster
acttgaaactttg

SEQ ID NO: 575015 - DNA, 13 bp, D. melanogaster
acttgaaagtttt

SEQ ID NO: 575016 - DNA, 13 bp, D. melanogaster
acttgaaatataa

SEQ ID NO: 575017 - DNA, 13 bp, D. melanogaster
acttgaaatatat

SEQ ID NO: 575018 - DNA, 13 bp, D. melanogaster
acttgaaatcgaa

SEQ ID NO: 575019 - DNA, 13 bp, D. melanogaster
acttgaaatgcaa

SEQ ID NO: 575020 - DNA, 13 bp, D. melanogaster
acttgaaattaaa

SEQ ID NO: 575021 - DNA, 13 bp, D. melanogaster
acttgaaattaat

SEQ ID NO: 575022 - DNA, 13 bp, D. melanogaster
acttgaaattcat

SEQ ID NO: 575023 - DNA, 13 bp, D. melanogaster
acttgaaattcta

SEQ ID NO: 575024 - DNA, 13 bp, D. melanogaster
acttgaaatttat

SEQ ID NO: 575025 - DNA, 13 bp, D. melanogaster
acttgaaattttt

SEQ ID NO: 575026 - DNA, 13 bp, D. melanogaster
acttgaacaattt

SEQ ID NO: 575027 - DNA, 13 bp, D. melanogaster
acttgaacatttt

SEQ ID NO: 575028 - DNA, 13 bp, D. melanogaster
acttgaactaatt

SEQ ID NO: 575029 - DNA, 13 bp, D. melanogaster
acttgaacttgaa

SEQ ID NO: 575030 - DNA, 13 bp, D. melanogaster
acttgaactttgt

SEQ ID NO: 575031 - DNA, 13 bp, D. melanogaster
acttgaagaaata

SEQ ID NO: 575032 - DNA, 13 bp, D. melanogaster
acttgaataaata

SEQ ID NO: 575033 - DNA, 13 bp, D. melanogaster
acttgaatatata

SEQ ID NO: 575034 - DNA, 13 bp, D. melanogaster
acttgaatatatt

SEQ ID NO: 575035 - DNA, 13 bp, D. melanogaster
acttgaatgcaaa

SEQ ID NO: 575036 - DNA, 14 bp, D. melanogaster
acttgaatgcaaat

SEQ ID NO: 575037 - DNA, 14 bp, D. melanogaster
acttgactatttat

SEQ ID NO: 575038 - DNA, 13 bp, D. melanogaster
acttgacttgact

SEQ ID NO: 575039 - DNA, 13 bp, D. melanogaster
acttgacttggcc

SEQ ID NO: 575040 - DNA, 13 bp, D. melanogaster
acttgactttgac

SEQ ID NO: 575041 - DNA, 13 bp, D. melanogaster
acttgagcaaatt

SEQ ID NO: 575042 - DNA, 13 bp, D. melanogaster
acttgagctgcaa

SEQ ID NO: 575043 - DNA, 13 bp, D. melanogaster
acttgagctgcgt

SEQ ID NO: 575044 - DNA, 13 bp, D. melanogaster
acttgatttgatt

SEQ ID NO: 575045 - DNA, 13 bp, D. melanogaster
acttgatttttaa

SEQ ID NO: 575046 - DNA, 13 bp, D. melanogaster
acttgcaaaaaat

SEQ ID NO: 575047 - DNA, 13 bp, D. melanogaster
acttgcaaacaaa

SEQ ID NO: 575048 - DNA, 13 bp, D. melanogaster
acttgcaacaaat

SEQ ID NO: 575049 - DNA, 14 bp, D. melanogaster
acttgcaacttgca

SEQ ID NO: 575050 - DNA, 13 bp, D. melanogaster
acttgcaatattt

SEQ ID NO: 575051 - DNA, 13 bp, D. melanogaster
acttgcaattaat

SEQ ID NO: 575052 - DNA, 13 bp, D. melanogaster
acttgcaccacta

SEQ ID NO: 575053 - DNA, 13 bp, D. melanogaster
acttgcacttgct

SEQ ID NO: 575054 - DNA, 13 bp, D. melanogaster
acttgcagataaa

SEQ ID NO: 575055 - DNA, 14 bp, D. melanogaster
acttgcagcagcaa

SEQ ID NO: 575056 - DNA, 13 bp, D. melanogaster
acttgcaggccct

SEQ ID NO: 575057 - DNA, 13 bp, D. melanogaster
acttgcatacata

SEQ ID NO: 575058 - DNA, 13 bp, D. melanogaster
acttgcatatata

SEQ ID NO: 575059 - DNA, 13 bp, D. melanogaster
acttgcattttat

SEQ ID NO: 575060 - DNA, 13 bp, D. melanogaster
acttgcatttttt

SEQ ID NO: 575061 - DNA, 13 bp, D. melanogaster
acttgccaaaata

SEQ ID NO: 575062 - DNA, 13 bp, D. melanogaster
acttgccacatgc

SEQ ID NO: 575063 - DNA, 13 bp, D. melanogaster
acttgccacttgg

SEQ ID NO: 575064 - DNA, 13 bp, D. melanogaster
acttgccagcaaa

SEQ ID NO: 575065 - DNA, 13 bp, D. melanogaster
acttgctaaatgt

SEQ ID NO: 575066 - DNA, 13 bp, D. melanogaster
acttgctattcgt

SEQ ID NO: 575067 - DNA, 13 bp, D. melanogaster
acttgctgcaaaa

SEQ ID NO: 575068 - DNA, 13 bp, D. melanogaster
acttggaaaaata

SEQ ID NO: 575069 - DNA, 13 bp, D. melanogaster
acttggaaaaatt

SEQ ID NO: 575070 - DNA, 13 bp, D. melanogaster
acttggaaaattt

SEQ ID NO: 575071 - DNA, 13 bp, D. melanogaster
acttggaaatcca

SEQ ID NO: 575072 - DNA, 13 bp, D. melanogaster
acttggaactggg

SEQ ID NO: 575073 - DNA, 13 bp, D. melanogaster
acttggaacttgg

SEQ ID NO: 575074 - DNA, 13 bp, D. melanogaster
acttggagccatt

SEQ ID NO: 575075 - DNA, 14 bp, D. melanogaster
acttggattaacta

SEQ ID NO: 575076 - DNA, 14 bp, D. melanogaster
acttggattataat

SEQ ID NO: 575077 - DNA, 13 bp, D. melanogaster
acttggcaaaaaa

SEQ ID NO: 575078 - DNA, 13 bp, D. melanogaster
acttggcaaacaa

SEQ ID NO: 575079 - DNA, 13 bp, D. melanogaster
acttggcaaactt

SEQ ID NO: 575080 - DNA, 14 bp, D. melanogaster
acttggcaacttgg

SEQ ID NO: 575081 - DNA, 13 bp, D. melanogaster
acttggcactttt

SEQ ID NO: 575082 - DNA, 13 bp, D. melanogaster
acttggcagatac

SEQ ID NO: 575083 - DNA, 14 bp, D. melanogaster
acttggcagatccc

SEQ ID NO: 575084 - DNA, 13 bp, D. melanogaster
acttggcatattt

SEQ ID NO: 575085 - DNA, 13 bp, D. melanogaster
acttggccaaaaa

SEQ ID NO: 575086 - DNA, 14 bp, D. melanogaster
acttggccaaaatg

SEQ ID NO: 575087 - DNA, 13 bp, D. melanogaster
acttggccaaatg

SEQ ID NO: 575088 - DNA, 13 bp, D. melanogaster
acttggccaacac

SEQ ID NO: 575089 - DNA, 13 bp, D. melanogaster
acttggccaactg

SEQ ID NO: 575090 - DNA, 13 bp, D. melanogaster
acttggccaactt

SEQ ID NO: 575091 - DNA, 13 bp, D. melanogaster
acttggccacaaa

SEQ ID NO: 575092 - DNA, 13 bp, D. melanogaster
acttggccacatt

SEQ ID NO: 575093 - DNA, 13 bp, D. melanogaster
acttggccacttt

SEQ ID NO: 575094 - DNA, 13 bp, D. melanogaster
acttggccagaag

SEQ ID NO: 575095 - DNA, 13 bp, D. melanogaster
acttggccagcaa

SEQ ID NO: 575096 - DNA, 13 bp, D. melanogaster
acttggccagcca

SEQ ID NO: 575097 - DNA, 13 bp, D. melanogaster
acttggccagctt

SEQ ID NO: 575098 - DNA, 13 bp, D. melanogaster
acttggccataaa

SEQ ID NO: 575099 - DNA, 14 bp, D. melanogaster
acttggccataaat

SEQ ID NO: 575100 - DNA, 13 bp, D. melanogaster
acttggccatttg

SEQ ID NO: 575101 - DNA, 13 bp, D. melanogaster
acttggcccaaaa

SEQ ID NO: 575102 - DNA, 13 bp, D. melanogaster
acttggcgcacag

SEQ ID NO: 575103 - DNA, 13 bp, D. melanogaster
acttggctaacaa

SEQ ID NO: 575104 - DNA, 13 bp, D. melanogaster
acttggctggctg

SEQ ID NO: 575105 - DNA, 13 bp, D. melanogaster
acttggctggctt

SEQ ID NO: 575106 - DNA, 13 bp, D. melanogaster
acttggcttggct

SEQ ID NO: 575107 - DNA, 13 bp, D. melanogaster
acttggctttaat

SEQ ID NO: 575108 - DNA, 13 bp, D. melanogaster
acttgggctggga

SEQ ID NO: 575109 - DNA, 13 bp, D. melanogaster
acttgggcttgta

SEQ ID NO: 575110 - DNA, 13 bp, D. melanogaster
acttggttttcta

SEQ ID NO: 575111 - DNA, 13 bp, D. melanogaster
acttgtaaacaaa

SEQ ID NO: 575112 - DNA, 13 bp, D. melanogaster
acttgtaaataaa

SEQ ID NO: 575113 - DNA, 14 bp, D. melanogaster
acttgtaaataaac

SEQ ID NO: 575114 - DNA, 13 bp, D. melanogaster
acttgtaaattaa

SEQ ID NO: 575115 - DNA, 13 bp, D. melanogaster
acttgtaaatttt

SEQ ID NO: 575116 - DNA, 13 bp, D. melanogaster
acttgtacatata

SEQ ID NO: 575117 - DNA, 13 bp, D. melanogaster
acttgtacttgta

SEQ ID NO: 575118 - DNA, 13 bp, D. melanogaster
acttgtagagttt

SEQ ID NO: 575119 - DNA, 13 bp, D. melanogaster
acttgtatatata

SEQ ID NO: 575120 - DNA, 13 bp, D. melanogaster
acttgtatgattt

SEQ ID NO: 575121 - DNA, 14 bp, D. melanogaster
acttgtatgattta

SEQ ID NO: 575122 - DNA, 13 bp, D. melanogaster
acttgtgcatttt

SEQ ID NO: 575123 - DNA, 13 bp, D. melanogaster
acttgtgtgccat

SEQ ID NO: 575124 - DNA, 13 bp, D. melanogaster
acttgttaaacgt

SEQ ID NO: 575125 - DNA, 13 bp, D. melanogaster
acttgttcaattt

SEQ ID NO: 575126 - DNA, 13 bp, D. melanogaster
acttgttcatttt

SEQ ID NO: 575127 - DNA, 13 bp, D. melanogaster
acttgttgaaaat

SEQ ID NO: 575128 - DNA, 13 bp, D. melanogaster
acttgttgatagt

SEQ ID NO: 575129 - DNA, 14 bp, D. melanogaster
acttgttgatagtt

SEQ ID NO: 575130 - DNA, 13 bp, D. melanogaster
acttgttgttgcc

SEQ ID NO: 575131 - DNA, 14 bp, D. melanogaster
acttgttgttgccc

SEQ ID NO: 575132 - DNA, 13 bp, D. melanogaster
acttgttgttgtt

SEQ ID NO: 575133 - DNA, 14 bp, D. melanogaster
acttgttgttgttg

SEQ ID NO: 575134 - DNA, 14 bp, D. melanogaster
acttgtttaaacaa

SEQ ID NO: 575135 - DNA, 13 bp, D. melanogaster
acttgtttaattt

SEQ ID NO: 575136 - DNA, 13 bp, D. melanogaster
acttgtttataaa

SEQ ID NO: 575137 - DNA, 14 bp, D. melanogaster
acttgtttatttat

SEQ ID NO: 575138 - DNA, 13 bp, D. melanogaster
acttgtttgtttg

SEQ ID NO: 575139 - DNA, 13 bp, D. melanogaster
acttgttttccaa

SEQ ID NO: 575140 - DNA, 14 bp, D. melanogaster
acttgtttttcgct

SEQ ID NO: 575141 - DNA, 13 bp, D. melanogaster
acttgtttttgaa

SEQ ID NO: 575142 - DNA, 13 bp, D. melanogaster
acttgtttttgga

SEQ ID NO: 575143 - DNA, 14 bp, D. melanogaster
acttgtttttggag

SEQ ID NO: 575144 - DNA, 13 bp, D. melanogaster
actttaaaaacat

SEQ ID NO: 575145 - DNA, 13 bp, D. melanogaster
actttaaaagcaa

SEQ ID NO: 575146 - DNA, 13 bp, D. melanogaster
actttaaaagcga

SEQ ID NO: 575147 - DNA, 13 bp, D. melanogaster
actttaaaagcta

SEQ ID NO: 575148 - DNA, 13 bp, D. melanogaster
actttaaaagctt

SEQ ID NO: 575149 - DNA, 13 bp, D. melanogaster
actttaaaagtta

SEQ ID NO: 575150 - DNA, 13 bp, D. melanogaster
actttaaaatcaa

SEQ ID NO: 575151 - DNA, 13 bp, D. melanogaster
actttaaaccatt

SEQ ID NO: 575152 - DNA, 13 bp, D. melanogaster
actttaaactatt

SEQ ID NO: 575153 - DNA, 13 bp, D. melanogaster
actttaaacttta

SEQ ID NO: 575154 - DNA, 13 bp, D. melanogaster
actttaaactttt

SEQ ID NO: 575155 - DNA, 13 bp, D. melanogaster
actttaaagacta

SEQ ID NO: 575156 - DNA, 13 bp, D. melanogaster
actttaaagcctt

SEQ ID NO: 575157 - DNA, 13 bp, D. melanogaster
actttaaagctta

SEQ ID NO: 575158 - DNA, 13 bp, D. melanogaster
actttaaaggaaa

SEQ ID NO: 575159 - DNA, 13 bp, D. melanogaster
actttaaagtaat

SEQ ID NO: 575160 - DNA, 13 bp, D. melanogaster
actttaaagtgta

SEQ ID NO: 575161 - DNA, 13 bp, D. melanogaster
actttaaagttgg

SEQ ID NO: 575162 - DNA, 13 bp, D. melanogaster
actttaaatactt

SEQ ID NO: 575163 - DNA, 14 bp, D. melanogaster
actttaaatatacg

SEQ ID NO: 575164 - DNA, 13 bp, D. melanogaster
actttaaatatga

SEQ ID NO: 575165 - DNA, 13 bp, D. melanogaster
actttaaatcgaa

SEQ ID NO: 575166 - DNA, 13 bp, D. melanogaster
actttaaatgcaa

SEQ ID NO: 575167 - DNA, 14 bp, D. melanogaster
actttaaatgcaat

SEQ ID NO: 575168 - DNA, 13 bp, D. melanogaster
actttaaatgcca

SEQ ID NO: 575169 - DNA, 13 bp, D. melanogaster
actttaaattaag

SEQ ID NO: 575170 - DNA, 14 bp, D. melanogaster
actttaaattgaaa

SEQ ID NO: 575171 - DNA, 13 bp, D. melanogaster
actttaaatttgt

SEQ ID NO: 575172 - DNA, 13 bp, D. melanogaster
actttaacaaaat

SEQ ID NO: 575173 - DNA, 13 bp, D. melanogaster
actttaactttga

SEQ ID NO: 575174 - DNA, 13 bp, D. melanogaster
actttaagatgcg

SEQ ID NO: 575175 - DNA, 13 bp, D. melanogaster
actttaagatttg

SEQ ID NO: 575176 - DNA, 13 bp, D. melanogaster
actttaagcacat

SEQ ID NO: 575177 - DNA, 13 bp, D. melanogaster
actttaagcattt

SEQ ID NO: 575178 - DNA, 13 bp, D. melanogaster
actttaagtgaaa

SEQ ID NO: 575179 - DNA, 13 bp, D. melanogaster
actttaagttgaa

SEQ ID NO: 575180 - DNA, 13 bp, D. melanogaster
actttaagtttaa

SEQ ID NO: 575181 - DNA, 13 bp, D. melanogaster
actttaataaacg

SEQ ID NO: 575182 - DNA, 13 bp, D. melanogaster
actttaatacttt

SEQ ID NO: 575183 - DNA, 13 bp, D. melanogaster
actttaatgaaat

SEQ ID NO: 575184 - DNA, 13 bp, D. melanogaster
actttaatgcttt

SEQ ID NO: 575185 - DNA, 13 bp, D. melanogaster
actttaatgtaat

SEQ ID NO: 575186 - DNA, 13 bp, D. melanogaster
actttaattacaa

SEQ ID NO: 575187 - DNA, 13 bp, D. melanogaster
actttaattgaat

SEQ ID NO: 575188 - DNA, 13 bp, D. melanogaster
actttaattgcca

SEQ ID NO: 575189 - DNA, 13 bp, D. melanogaster
actttaattggta

SEQ ID NO: 575190 - DNA, 13 bp, D. melanogaster
actttaatttgcc

SEQ ID NO: 575191 - DNA, 13 bp, D. melanogaster
actttaatttgta

SEQ ID NO: 575192 - DNA, 13 bp, D. melanogaster
actttaattttcc

SEQ ID NO: 575193 - DNA, 13 bp, D. melanogaster
actttacacattt

SEQ ID NO: 575194 - DNA, 13 bp, D. melanogaster
actttacacttgg

SEQ ID NO: 575195 - DNA, 14 bp, D. melanogaster
actttacatacaaa

SEQ ID NO: 575196 - DNA, 13 bp, D. melanogaster
actttacatgcaa

SEQ ID NO: 575197 - DNA, 13 bp, D. melanogaster
actttacctcatt

SEQ ID NO: 575198 - DNA, 13 bp, D. melanogaster
actttactttaat

SEQ ID NO: 575199 - DNA, 13 bp, D. melanogaster
actttagaaaact

SEQ ID NO: 575200 - DNA, 13 bp, D. melanogaster
actttagttttaa

SEQ ID NO: 575201 - DNA, 13 bp, D. melanogaster
actttataaacaa

SEQ ID NO: 575202 - DNA, 13 bp, D. melanogaster
actttatacatat

SEQ ID NO: 575203 - DNA, 13 bp, D. melanogaster
actttatatgtat

SEQ ID NO: 575204 - DNA, 13 bp, D. melanogaster
actttatatttga

SEQ ID NO: 575205 - DNA, 13 bp, D. melanogaster
actttatcctatt

SEQ ID NO: 575206 - DNA, 13 bp, D. melanogaster
actttatgacttt

SEQ ID NO: 575207 - DNA, 13 bp, D. melanogaster
actttatgcaaat

SEQ ID NO: 575208 - DNA, 14 bp, D. melanogaster
actttatgccaaaa

SEQ ID NO: 575209 - DNA, 13 bp, D. melanogaster
actttatgtgcgc

SEQ ID NO: 575210 - DNA, 13 bp, D. melanogaster
actttatgtgtgc

SEQ ID NO: 575211 - DNA, 14 bp, D. melanogaster
actttatgtgtgca

SEQ ID NO: 575212 - DNA, 13 bp, D. melanogaster
actttatgttctt

SEQ ID NO: 575213 - DNA, 13 bp, D. melanogaster
actttatgtttta

SEQ ID NO: 575214 - DNA, 13 bp, D. melanogaster
actttattacttg

SEQ ID NO: 575215 - DNA, 13 bp, D. melanogaster
actttattccttc

SEQ ID NO: 575216 - DNA, 13 bp, D. melanogaster
actttattctttg

SEQ ID NO: 575217 - DNA, 13 bp, D. melanogaster
actttattgaatt

SEQ ID NO: 575218 - DNA, 13 bp, D. melanogaster
actttattgcatt

SEQ ID NO: 575219 - DNA, 13 bp, D. melanogaster
actttattgtcga

SEQ ID NO: 575220 - DNA, 13 bp, D. melanogaster
actttatttccat

SEQ ID NO: 575221 - DNA, 13 bp, D. melanogaster
actttatttgctt

SEQ ID NO: 575222 - DNA, 13 bp, D. melanogaster
actttattttcaa

SEQ ID NO: 575223 - DNA, 13 bp, D. melanogaster
actttcaaaacta

SEQ ID NO: 575224 - DNA, 13 bp, D. melanogaster
actttcaaatgtt

SEQ ID NO: 575225 - DNA, 13 bp, D. melanogaster
actttcaacttaa

SEQ ID NO: 575226 - DNA, 13 bp, D. melanogaster
actttcaagttat

SEQ ID NO: 575227 - DNA, 13 bp, D. melanogaster
actttcaatgcag

SEQ ID NO: 575228 - DNA, 13 bp, D. melanogaster
actttcactgcca

SEQ ID NO: 575229 - DNA, 13 bp, D. melanogaster
actttcactttat

SEQ ID NO: 575230 - DNA, 13 bp, D. melanogaster
actttcacttttc

SEQ ID NO: 575231 - DNA, 13 bp, D. melanogaster
actttcaggactt

SEQ ID NO: 575232 - DNA, 13 bp, D. melanogaster
actttcagtccgt

SEQ ID NO: 575233 - DNA, 13 bp, D. melanogaster
actttcagtcgac

SEQ ID NO: 575234 - DNA, 13 bp, D. melanogaster
actttcatatgca

SEQ ID NO: 575235 - DNA, 13 bp, D. melanogaster
actttcattatta

SEQ ID NO: 575236 - DNA, 13 bp, D. melanogaster
actttcatttgca

SEQ ID NO: 575237 - DNA, 13 bp, D. melanogaster
actttcattttaa

SEQ ID NO: 575238 - DNA, 13 bp, D. melanogaster
actttcattttgt

SEQ ID NO: 575239 - DNA, 13 bp, D. melanogaster
actttccacaacg

SEQ ID NO: 575240 - DNA, 13 bp, D. melanogaster
actttccacattt

SEQ ID NO: 575241 - DNA, 13 bp, D. melanogaster
actttccacccac

SEQ ID NO: 575242 - DNA, 13 bp, D. melanogaster
actttccacttgc

SEQ ID NO: 575243 - DNA, 13 bp, D. melanogaster
actttccactttt

SEQ ID NO: 575244 - DNA, 14 bp, D. melanogaster
actttccacttttc

SEQ ID NO: 575245 - DNA, 13 bp, D. melanogaster
actttccatggca

SEQ ID NO: 575246 - DNA, 14 bp, D. melanogaster
actttccatgtccc

SEQ ID NO: 575247 - DNA, 13 bp, D. melanogaster
actttcccacttt

SEQ ID NO: 575248 - DNA, 13 bp, D. melanogaster
actttccctactc

SEQ ID NO: 575249 - DNA, 13 bp, D. melanogaster
actttccgaaagc

SEQ ID NO: 575250 - DNA, 13 bp, D. melanogaster
actttcgatttca

SEQ ID NO: 575251 - DNA, 13 bp, D. melanogaster
actttcgattttt

SEQ ID NO: 575252 - DNA, 13 bp, D. melanogaster
actttcgtgctca

SEQ ID NO: 575253 - DNA, 13 bp, D. melanogaster
actttctactctt

SEQ ID NO: 575254 - DNA, 13 bp, D. melanogaster
actttctactttc

SEQ ID NO: 575255 - DNA, 14 bp, D. melanogaster
actttctattttgt

SEQ ID NO: 575256 - DNA, 13 bp, D. melanogaster
actttctgcaatt

SEQ ID NO: 575257 - DNA, 13 bp, D. melanogaster
actttctgctgct

SEQ ID NO: 575258 - DNA, 13 bp, D. melanogaster
actttctggcatt

SEQ ID NO: 575259 - DNA, 13 bp, D. melanogaster
actttctggcttt

SEQ ID NO: 575260 - DNA, 13 bp, D. melanogaster
actttcttgcttg

SEQ ID NO: 575261 - DNA, 14 bp, D. melanogaster
actttctttatgaa

SEQ ID NO: 575262 - DNA, 13 bp, D. melanogaster
actttctttggtg

SEQ ID NO: 575263 - DNA, 13 bp, D. melanogaster
actttgaaaaaca

SEQ ID NO: 575264 - DNA, 13 bp, D. melanogaster
actttgaaaaatg

SEQ ID NO: 575265 - DNA, 13 bp, D. melanogaster
actttgaaaacaa

SEQ ID NO: 575266 - DNA, 13 bp, D. melanogaster
actttgaaaatta

SEQ ID NO: 575267 - DNA, 13 bp, D. melanogaster
actttgaaataaa

SEQ ID NO: 575268 - DNA, 13 bp, D. melanogaster
actttgaacttga

SEQ ID NO: 575269 - DNA, 13 bp, D. melanogaster
actttgaactttg

SEQ ID NO: 575270 - DNA, 13 bp, D. melanogaster
actttgaactttt

SEQ ID NO: 575271 - DNA, 13 bp, D. melanogaster
actttgaatatat

SEQ ID NO: 575272 - DNA, 13 bp, D. melanogaster
actttgaatgcca

SEQ ID NO: 575273 - DNA, 13 bp, D. melanogaster
actttgaattaaa

SEQ ID NO: 575274 - DNA, 13 bp, D. melanogaster
actttgacaaatt

SEQ ID NO: 575275 - DNA, 13 bp, D. melanogaster
actttgaccactt

SEQ ID NO: 575276 - DNA, 14 bp, D. melanogaster
actttgactttggc

SEQ ID NO: 575277 - DNA, 13 bp, D. melanogaster
actttgacttttt

SEQ ID NO: 575278 - DNA, 13 bp, D. melanogaster
actttgagaattg

SEQ ID NO: 575279 - DNA, 13 bp, D. melanogaster
actttgagattgt

SEQ ID NO: 575280 - DNA, 13 bp, D. melanogaster
actttgaggccca

SEQ ID NO: 575281 - DNA, 13 bp, D. melanogaster
actttgatattaa

SEQ ID NO: 575282 - DNA, 13 bp, D. melanogaster
actttgatgatat

SEQ ID NO: 575283 - DNA, 14 bp, D. melanogaster
actttgatgatatt

SEQ ID NO: 575284 - DNA, 13 bp, D. melanogaster
actttgattaaaa

SEQ ID NO: 575285 - DNA, 13 bp, D. melanogaster
actttgattgaca

SEQ ID NO: 575286 - DNA, 13 bp, D. melanogaster
actttgattgcaa

SEQ ID NO: 575287 - DNA, 13 bp, D. melanogaster
actttgattggcc

SEQ ID NO: 575288 - DNA, 14 bp, D. melanogaster
actttgattggcct

SEQ ID NO: 575289 - DNA, 13 bp, D. melanogaster
actttgatttatg

SEQ ID NO: 575290 - DNA, 13 bp, D. melanogaster
actttgatttatt

SEQ ID NO: 575291 - DNA, 13 bp, D. melanogaster
actttgatttcaa

SEQ ID NO: 575292 - DNA, 13 bp, D. melanogaster
actttgatttgat

SEQ ID NO: 575293 - DNA, 14 bp, D. melanogaster
actttgatttgttt

SEQ ID NO: 575294 - DNA, 13 bp, D. melanogaster
actttgattttat

SEQ ID NO: 575295 - DNA, 13 bp, D. melanogaster
actttgatttttg

SEQ ID NO: 575296 - DNA, 13 bp, D. melanogaster
actttgcaattaa

SEQ ID NO: 575297 - DNA, 13 bp, D. melanogaster
actttgcacaatg

SEQ ID NO: 575298 - DNA, 13 bp, D. melanogaster
actttgcagctca

SEQ ID NO: 575299 - DNA, 14 bp, D. melanogaster
actttgcagctcaa

SEQ ID NO: 575300 - DNA, 13 bp, D. melanogaster
actttgcatgcaa

SEQ ID NO: 575301 - DNA, 14 bp, D. melanogaster
actttgcattttaa

SEQ ID NO: 575302 - DNA, 13 bp, D. melanogaster
actttgccaaaaa

SEQ ID NO: 575303 - DNA, 13 bp, D. melanogaster
actttgccaaaat

SEQ ID NO: 575304 - DNA, 13 bp, D. melanogaster
actttgccaaatt

SEQ ID NO: 575305 - DNA, 13 bp, D. melanogaster
actttgccagcaa

SEQ ID NO: 575306 - DNA, 13 bp, D. melanogaster
actttgccagcca

SEQ ID NO: 575307 - DNA, 13 bp, D. melanogaster
actttgccataaa

SEQ ID NO: 575308 - DNA, 13 bp, D. melanogaster
actttgccattgc

SEQ ID NO: 575309 - DNA, 13 bp, D. melanogaster
actttgccatttt

SEQ ID NO: 575310 - DNA, 13 bp, D. melanogaster
actttgccccact

SEQ ID NO: 575311 - DNA, 13 bp, D. melanogaster
actttgccttcgg

SEQ ID NO: 575312 - DNA, 13 bp, D. melanogaster
actttgcgatgac

SEQ ID NO: 575313 - DNA, 14 bp, D. melanogaster
actttgcgatgacg

SEQ ID NO: 575314 - DNA, 13 bp, D. melanogaster
actttgctccttt

SEQ ID NO: 575315 - DNA, 13 bp, D. melanogaster
actttgctgcgtt

SEQ ID NO: 575316 - DNA, 13 bp, D. melanogaster
actttgctggcaa

SEQ ID NO: 575317 - DNA, 13 bp, D. melanogaster
actttgcttaatt

SEQ ID NO: 575318 - DNA, 13 bp, D. melanogaster
actttgctttcaa

SEQ ID NO: 575319 - DNA, 13 bp, D. melanogaster
actttggaaaaaa

SEQ ID NO: 575320 - DNA, 13 bp, D. melanogaster
actttggaaaata

SEQ ID NO: 575321 - DNA, 14 bp, D. melanogaster
actttggaacaatt

SEQ ID NO: 575322 - DNA, 13 bp, D. melanogaster
actttggcaaaca

SEQ ID NO: 575323 - DNA, 13 bp, D. melanogaster
actttggcacttg

SEQ ID NO: 575324 - DNA, 13 bp, D. melanogaster
actttggcatttg

SEQ ID NO: 575325 - DNA, 13 bp, D. melanogaster
actttggcatttt

SEQ ID NO: 575326 - DNA, 13 bp, D. melanogaster
actttggccaaat

SEQ ID NO: 575327 - DNA, 13 bp, D. melanogaster
actttggccaaca

SEQ ID NO: 575328 - DNA, 13 bp, D. melanogaster
actttggccaagt

SEQ ID NO: 575329 - DNA, 13 bp, D. melanogaster
actttggccataa

SEQ ID NO: 575330 - DNA, 13 bp, D. melanogaster
actttggctggca

SEQ ID NO: 575331 - DNA, 13 bp, D. melanogaster
actttggctttgg

SEQ ID NO: 575332 - DNA, 14 bp, D. melanogaster
actttggctttggc

SEQ ID NO: 575333 - DNA, 13 bp, D. melanogaster
actttggcttttc

SEQ ID NO: 575334 - DNA, 13 bp, D. melanogaster
actttgggagttc

SEQ ID NO: 575335 - DNA, 13 bp, D. melanogaster
actttgggccaaa

SEQ ID NO: 575336 - DNA, 13 bp, D. melanogaster
actttgggccaac

SEQ ID NO: 575337 - DNA, 13 bp, D. melanogaster
actttgggccaca

SEQ ID NO: 575338 - DNA, 13 bp, D. melanogaster
actttgtaaattt

SEQ ID NO: 575339 - DNA, 13 bp, D. melanogaster
actttgtaattta

SEQ ID NO: 575340 - DNA, 13 bp, D. melanogaster
actttgtataagc

SEQ ID NO: 575341 - DNA, 13 bp, D. melanogaster
actttgtatatat

SEQ ID NO: 575342 - DNA, 13 bp, D. melanogaster
actttgtcgaatg

SEQ ID NO: 575343 - DNA, 13 bp, D. melanogaster
actttgtgccaaa

SEQ ID NO: 575344 - DNA, 13 bp, D. melanogaster
actttgtgcgttg

SEQ ID NO: 575345 - DNA, 13 bp, D. melanogaster
actttgtggcttt

SEQ ID NO: 575346 - DNA, 13 bp, D. melanogaster
actttgtgtgata

SEQ ID NO: 575347 - DNA, 13 bp, D. melanogaster
actttgtgtgtgt

SEQ ID NO: 575348 - DNA, 13 bp, D. melanogaster
actttgtgtttaa

SEQ ID NO: 575349 - DNA, 13 bp, D. melanogaster
actttgttagttt

SEQ ID NO: 575350 - DNA, 13 bp, D. melanogaster
actttgttcacct

SEQ ID NO: 575351 - DNA, 13 bp, D. melanogaster
actttgttgccgc

SEQ ID NO: 575352 - DNA, 13 bp, D. melanogaster
actttgttggcca

SEQ ID NO: 575353 - DNA, 13 bp, D. melanogaster
actttgttggctt

SEQ ID NO: 575354 - DNA, 13 bp, D. melanogaster
actttgttgttgc

SEQ ID NO: 575355 - DNA, 13 bp, D. melanogaster
actttgttgttgt

SEQ ID NO: 575356 - DNA, 13 bp, D. melanogaster
actttgtttactt

SEQ ID NO: 575357 - DNA, 13 bp, D. melanogaster
actttgttttgat

SEQ ID NO: 575358 - DNA, 13 bp, D. melanogaster
acttttaaaaaac

SEQ ID NO: 575359 - DNA, 13 bp, D. melanogaster
acttttaaaaagt

SEQ ID NO: 575360 - DNA, 13 bp, D. melanogaster
acttttaaaatac

SEQ ID NO: 575361 - DNA, 13 bp, D. melanogaster
acttttaaacgga

SEQ ID NO: 575362 - DNA, 13 bp, D. melanogaster
acttttaaataca

SEQ ID NO: 575363 - DNA, 13 bp, D. melanogaster
acttttaaatgaa

SEQ ID NO: 575364 - DNA, 13 bp, D. melanogaster
acttttaaatgat

SEQ ID NO: 575365 - DNA, 14 bp, D. melanogaster
acttttaaatgatt

SEQ ID NO: 575366 - DNA, 13 bp, D. melanogaster
acttttaacaacc

SEQ ID NO: 575367 - DNA, 13 bp, D. melanogaster
acttttaaccaaa

SEQ ID NO: 575368 - DNA, 13 bp, D. melanogaster
acttttaactatt

SEQ ID NO: 575369 - DNA, 13 bp, D. melanogaster
acttttaactgaa

SEQ ID NO: 575370 - DNA, 13 bp, D. melanogaster
acttttaagcaat

SEQ ID NO: 575371 - DNA, 13 bp, D. melanogaster
acttttaagcacc

SEQ ID NO: 575372 - DNA, 13 bp, D. melanogaster
acttttaatgtaa

SEQ ID NO: 575373 - DNA, 13 bp, D. melanogaster
acttttaattagt

SEQ ID NO: 575374 - DNA, 13 bp, D. melanogaster
acttttaattcaa

SEQ ID NO: 575375 - DNA, 13 bp, D. melanogaster
acttttaattgat

SEQ ID NO: 575376 - DNA, 14 bp, D. melanogaster
acttttaattgatt

SEQ ID NO: 575377 - DNA, 13 bp, D. melanogaster
acttttaatttgt

SEQ ID NO: 575378 - DNA, 13 bp, D. melanogaster
acttttacaaaga

SEQ ID NO: 575379 - DNA, 14 bp, D. melanogaster
acttttactttgca

SEQ ID NO: 575380 - DNA, 13 bp, D. melanogaster
acttttacttttg

SEQ ID NO: 575381 - DNA, 13 bp, D. melanogaster
acttttagcattt

SEQ ID NO: 575382 - DNA, 13 bp, D. melanogaster
acttttagctttt

SEQ ID NO: 575383 - DNA, 13 bp, D. melanogaster
acttttaggctgt

SEQ ID NO: 575384 - DNA, 13 bp, D. melanogaster
acttttatagttt

SEQ ID NO: 575385 - DNA, 13 bp, D. melanogaster
acttttatgagct

SEQ ID NO: 575386 - DNA, 13 bp, D. melanogaster
acttttattcgcc

SEQ ID NO: 575387 - DNA, 13 bp, D. melanogaster
acttttattgaga

SEQ ID NO: 575388 - DNA, 13 bp, D. melanogaster
acttttattgctg

SEQ ID NO: 575389 - DNA, 13 bp, D. melanogaster
acttttatttggt

SEQ ID NO: 575390 - DNA, 13 bp, D. melanogaster
acttttcaaaaaa

SEQ ID NO: 575391 - DNA, 13 bp, D. melanogaster
acttttcaaagtt

SEQ ID NO: 575392 - DNA, 13 bp, D. melanogaster
acttttcaaatat

SEQ ID NO: 575393 - DNA, 13 bp, D. melanogaster
acttttcaacaaa

SEQ ID NO: 575394 - DNA, 13 bp, D. melanogaster
acttttcaacgaa

SEQ ID NO: 575395 - DNA, 14 bp, D. melanogaster
acttttcaacgaat

SEQ ID NO: 575396 - DNA, 13 bp, D. melanogaster
acttttcaatgaa

SEQ ID NO: 575397 - DNA, 13 bp, D. melanogaster
acttttcactttc

SEQ ID NO: 575398 - DNA, 13 bp, D. melanogaster
acttttcagcgaa

SEQ ID NO: 575399 - DNA, 13 bp, D. melanogaster
acttttcagtttt

SEQ ID NO: 575400 - DNA, 13 bp, D. melanogaster
acttttcataatt

SEQ ID NO: 575401 - DNA, 13 bp, D. melanogaster
acttttcattaat

SEQ ID NO: 575402 - DNA, 13 bp, D. melanogaster
acttttcattcat

SEQ ID NO: 575403 - DNA, 13 bp, D. melanogaster
acttttcatttaa

SEQ ID NO: 575404 - DNA, 13 bp, D. melanogaster
acttttcatttga

SEQ ID NO: 575405 - DNA, 13 bp, D. melanogaster
acttttccaaaat

SEQ ID NO: 575406 - DNA, 13 bp, D. melanogaster
acttttccaaata

SEQ ID NO: 575407 - DNA, 13 bp, D. melanogaster
acttttccaactg

SEQ ID NO: 575408 - DNA, 13 bp, D. melanogaster
acttttccaccca

SEQ ID NO: 575409 - DNA, 13 bp, D. melanogaster
acttttccagcca

SEQ ID NO: 575410 - DNA, 13 bp, D. melanogaster
acttttccagctt

SEQ ID NO: 575411 - DNA, 13 bp, D. melanogaster
acttttccagttt

SEQ ID NO: 575412 - DNA, 13 bp, D. melanogaster
acttttccgactt

SEQ ID NO: 575413 - DNA, 13 bp, D. melanogaster
acttttccgcttt

SEQ ID NO: 575414 - DNA, 13 bp, D. melanogaster
acttttcctgctg

SEQ ID NO: 575415 - DNA, 13 bp, D. melanogaster
acttttcgaaatt

SEQ ID NO: 575416 - DNA, 13 bp, D. melanogaster
acttttcgacact

SEQ ID NO: 575417 - DNA, 13 bp, D. melanogaster
acttttcgacttt

SEQ ID NO: 575418 - DNA, 13 bp, D. melanogaster
acttttcgcaaaa

SEQ ID NO: 575419 - DNA, 13 bp, D. melanogaster
acttttcgccatt

SEQ ID NO: 575420 - DNA, 13 bp, D. melanogaster
acttttctcccag

SEQ ID NO: 575421 - DNA, 13 bp, D. melanogaster
acttttctgattt

SEQ ID NO: 575422 - DNA, 13 bp, D. melanogaster
acttttcttggcc

SEQ ID NO: 575423 - DNA, 13 bp, D. melanogaster
acttttgaaaaaa

SEQ ID NO: 575424 - DNA, 13 bp, D. melanogaster
acttttgaaaaac

SEQ ID NO: 575425 - DNA, 13 bp, D. melanogaster
acttttgaaaaag

SEQ ID NO: 575426 - DNA, 13 bp, D. melanogaster
acttttgaaaaat

SEQ ID NO: 575427 - DNA, 14 bp, D. melanogaster
acttttgaaaaatg

SEQ ID NO: 575428 - DNA, 13 bp, D. melanogaster
acttttgaaaata

SEQ ID NO: 575429 - DNA, 13 bp, D. melanogaster
acttttgaaatat

SEQ ID NO: 575430 - DNA, 13 bp, D. melanogaster
acttttgaaattt

SEQ ID NO: 575431 - DNA, 13 bp, D. melanogaster
acttttgaacaat

SEQ ID NO: 575432 - DNA, 14 bp, D. melanogaster
acttttgaacaatt

SEQ ID NO: 575433 - DNA, 13 bp, D. melanogaster
acttttgaagtta

SEQ ID NO: 575434 - DNA, 13 bp, D. melanogaster
acttttgaattcg

SEQ ID NO: 575435 - DNA, 13 bp, D. melanogaster
acttttgaatttt

SEQ ID NO: 575436 - DNA, 13 bp, D. melanogaster
acttttgagaaat

SEQ ID NO: 575437 - DNA, 13 bp, D. melanogaster
acttttgataaaa

SEQ ID NO: 575438 - DNA, 13 bp, D. melanogaster
acttttgatcttc

SEQ ID NO: 575439 - DNA, 13 bp, D. melanogaster
acttttgattata

SEQ ID NO: 575440 - DNA, 13 bp, D. melanogaster
acttttgcaaaag

SEQ ID NO: 575441 - DNA, 13 bp, D. melanogaster
acttttgcaacaa

SEQ ID NO: 575442 - DNA, 13 bp, D. melanogaster
acttttgcaataa

SEQ ID NO: 575443 - DNA, 13 bp, D. melanogaster
acttttgcaattt

SEQ ID NO: 575444 - DNA, 14 bp, D. melanogaster
acttttgcaattta

SEQ ID NO: 575445 - DNA, 13 bp, D. melanogaster
acttttgcactaa

SEQ ID NO: 575446 - DNA, 13 bp, D. melanogaster
acttttgcagcag

SEQ ID NO: 575447 - DNA, 13 bp, D. melanogaster
acttttgccaaaa

SEQ ID NO: 575448 - DNA, 13 bp, D. melanogaster
acttttgccaaat

SEQ ID NO: 575449 - DNA, 13 bp, D. melanogaster
acttttgccaatt

SEQ ID NO: 575450 - DNA, 13 bp, D. melanogaster
acttttgccacaa

SEQ ID NO: 575451 - DNA, 13 bp, D. melanogaster
acttttgccactg

SEQ ID NO: 575452 - DNA, 13 bp, D. melanogaster
acttttgccagca

SEQ ID NO: 575453 - DNA, 13 bp, D. melanogaster
acttttgccagtc

SEQ ID NO: 575454 - DNA, 13 bp, D. melanogaster
acttttgccattg

SEQ ID NO: 575455 - DNA, 13 bp, D. melanogaster
acttttgccctca

SEQ ID NO: 575456 - DNA, 13 bp, D. melanogaster
acttttgccggca

SEQ ID NO: 575457 - DNA, 13 bp, D. melanogaster
acttttgcgctcg

SEQ ID NO: 575458 - DNA, 13 bp, D. melanogaster
acttttgctggca

SEQ ID NO: 575459 - DNA, 13 bp, D. melanogaster
acttttgctgttt

SEQ ID NO: 575460 - DNA, 13 bp, D. melanogaster
acttttgctttgg

SEQ ID NO: 575461 - DNA, 13 bp, D. melanogaster
acttttggcaaat

SEQ ID NO: 575462 - DNA, 13 bp, D. melanogaster
acttttggcattt

SEQ ID NO: 575463 - DNA, 13 bp, D. melanogaster
acttttggcccaa

SEQ ID NO: 575464 - DNA, 13 bp, D. melanogaster
acttttgggccaa

SEQ ID NO: 575465 - DNA, 13 bp, D. melanogaster
acttttgtattat

SEQ ID NO: 575466 - DNA, 13 bp, D. melanogaster
acttttgtcaaat

SEQ ID NO: 575467 - DNA, 13 bp, D. melanogaster
acttttgtgcttt

SEQ ID NO: 575468 - DNA, 13 bp, D. melanogaster
acttttgtgtcaa

SEQ ID NO: 575469 - DNA, 13 bp, D. melanogaster
acttttgtgtttg

SEQ ID NO: 575470 - DNA, 13 bp, D. melanogaster
acttttgttgatt

SEQ ID NO: 575471 - DNA, 13 bp, D. melanogaster
acttttgttgcca

SEQ ID NO: 575472 - DNA, 14 bp, D. melanogaster
acttttgttgttgt

SEQ ID NO: 575473 - DNA, 13 bp, D. melanogaster
acttttgtttcat

SEQ ID NO: 575474 - DNA, 13 bp, D. melanogaster
acttttgtttgga

SEQ ID NO: 575475 - DNA, 13 bp, D. melanogaster
acttttgttttaa

SEQ ID NO: 575476 - DNA, 13 bp, D. melanogaster
acttttgttttag

SEQ ID NO: 575477 - DNA, 13 bp, D. melanogaster
actttttaaaatc

SEQ ID NO: 575478 - DNA, 13 bp, D. melanogaster
actttttaaatga

SEQ ID NO: 575479 - DNA, 13 bp, D. melanogaster
actttttaacaaa

SEQ ID NO: 575480 - DNA, 13 bp, D. melanogaster
actttttaactat

SEQ ID NO: 575481 - DNA, 13 bp, D. melanogaster
actttttaatcaa

SEQ ID NO: 575482 - DNA, 14 bp, D. melanogaster
actttttaatgaaa

SEQ ID NO: 575483 - DNA, 13 bp, D. melanogaster
actttttaatgca

SEQ ID NO: 575484 - DNA, 13 bp, D. melanogaster
actttttacaata

SEQ ID NO: 575485 - DNA, 13 bp, D. melanogaster
actttttacaatt

SEQ ID NO: 575486 - DNA, 14 bp, D. melanogaster
actttttacaattg

SEQ ID NO: 575487 - DNA, 13 bp, D. melanogaster
actttttagagca

SEQ ID NO: 575488 - DNA, 13 bp, D. melanogaster
actttttatagaa

SEQ ID NO: 575489 - DNA, 13 bp, D. melanogaster
actttttatatac

SEQ ID NO: 575490 - DNA, 13 bp, D. melanogaster
actttttatgctg

SEQ ID NO: 575491 - DNA, 13 bp, D. melanogaster
actttttattcca

SEQ ID NO: 575492 - DNA, 13 bp, D. melanogaster
actttttcaactt

SEQ ID NO: 575493 - DNA, 14 bp, D. melanogaster
actttttcacaatt

SEQ ID NO: 575494 - DNA, 13 bp, D. melanogaster
actttttcacatt

SEQ ID NO: 575495 - DNA, 13 bp, D. melanogaster
actttttcattga

SEQ ID NO: 575496 - DNA, 13 bp, D. melanogaster
actttttccaatt

SEQ ID NO: 575497 - DNA, 13 bp, D. melanogaster
actttttccacaa

SEQ ID NO: 575498 - DNA, 13 bp, D. melanogaster
actttttccactt

SEQ ID NO: 575499 - DNA, 13 bp, D. melanogaster
actttttcgaaaa

SEQ ID NO: 575500 - DNA, 13 bp, D. melanogaster
actttttcgcttt

SEQ ID NO: 575501 - DNA, 13 bp, D. melanogaster
actttttctcagt

SEQ ID NO: 575502 - DNA, 13 bp, D. melanogaster
actttttctggat

SEQ ID NO: 575503 - DNA, 13 bp, D. melanogaster
actttttctttgc

SEQ ID NO: 575504 - DNA, 13 bp, D. melanogaster
actttttgaaaat

SEQ ID NO: 575505 - DNA, 14 bp, D. melanogaster
actttttgaatgat

SEQ ID NO: 575506 - DNA, 13 bp, D. melanogaster
actttttgattta

SEQ ID NO: 575507 - DNA, 13 bp, D. melanogaster
actttttgatttc

SEQ ID NO: 575508 - DNA, 13 bp, D. melanogaster
actttttgcaaaa

SEQ ID NO: 575509 - DNA, 13 bp, D. melanogaster
actttttgcacaa

SEQ ID NO: 575510 - DNA, 13 bp, D. melanogaster
actttttgcatat

SEQ ID NO: 575511 - DNA, 13 bp, D. melanogaster
actttttgccaac

SEQ ID NO: 575512 - DNA, 13 bp, D. melanogaster
actttttgccacg

SEQ ID NO: 575513 - DNA, 13 bp, D. melanogaster
actttttgccatc

SEQ ID NO: 575514 - DNA, 13 bp, D. melanogaster
actttttgccttg

SEQ ID NO: 575515 - DNA, 13 bp, D. melanogaster
actttttgctgct

SEQ ID NO: 575516 - DNA, 13 bp, D. melanogaster
actttttggcaaa

SEQ ID NO: 575517 - DNA, 13 bp, D. melanogaster
actttttggcagc

SEQ ID NO: 575518 - DNA, 14 bp, D. melanogaster
actttttggcagcc

SEQ ID NO: 575519 - DNA, 14 bp, D. melanogaster
actttttggccaaa

SEQ ID NO: 575520 - DNA, 13 bp, D. melanogaster
actttttggccca

SEQ ID NO: 575521 - DNA, 13 bp, D. melanogaster
actttttggctaa

SEQ ID NO: 575522 - DNA, 14 bp, D. melanogaster
actttttggctttt

SEQ ID NO: 575523 - DNA, 13 bp, D. melanogaster
actttttgtgctg

SEQ ID NO: 575524 - DNA, 13 bp, D. melanogaster
actttttgtgggc

SEQ ID NO: 575525 - DNA, 14 bp, D. melanogaster
actttttgtgtgtg

SEQ ID NO: 575526 - DNA, 14 bp, D. melanogaster
actttttgttgttg

SEQ ID NO: 575527 - DNA, 13 bp, D. melanogaster
actttttgtttgc

SEQ ID NO: 575528 - DNA, 14 bp, D. melanogaster
actttttgttttcc

SEQ ID NO: 575529 - DNA, 13 bp, D. melanogaster
acttttttaatca

SEQ ID NO: 575530 - DNA, 13 bp, D. melanogaster
acttttttaatga

SEQ ID NO: 575531 - DNA, 13 bp, D. melanogaster
acttttttatatg

SEQ ID NO: 575532 - DNA, 13 bp, D. melanogaster
acttttttatgca

SEQ ID NO: 575533 - DNA, 13 bp, D. melanogaster
acttttttatggc

SEQ ID NO: 575534 - DNA, 13 bp, D. melanogaster
acttttttcaaaa

SEQ ID NO: 575535 - DNA, 13 bp, D. melanogaster
acttttttgaaaa

SEQ ID NO: 575536 - DNA, 14 bp, D. melanogaster
acttttttgacatt

SEQ ID NO: 575537 - DNA, 13 bp, D. melanogaster
acttttttggcaa

SEQ ID NO: 575538 - DNA, 13 bp, D. melanogaster
actttttttcgag

SEQ ID NO: 575539 - DNA, 14 bp, D. melanogaster
agaaaaaaacattt

SEQ ID NO: 575540 - DNA, 14 bp, D. melanogaster
agaaaaaaactttt

SEQ ID NO: 575541 - DNA, 14 bp, D. melanogaster
agaaaaaacttgaa

SEQ ID NO: 575542 - DNA, 14 bp, D. melanogaster
agaaaaaagttcaa

SEQ ID NO: 575543 - DNA, 13 bp, D. melanogaster
agaaaaaatgtgc

SEQ ID NO: 575544 - DNA, 13 bp, D. melanogaster
agaaaaacacttg

SEQ ID NO: 575545 - DNA, 13 bp, D. melanogaster
agaaaaacatatg

SEQ ID NO: 575546 - DNA, 13 bp, D. melanogaster
agaaaaactactc

SEQ ID NO: 575547 - DNA, 13 bp, D. melanogaster
agaaaaactatta

SEQ ID NO: 575548 - DNA, 13 bp, D. melanogaster
agaaaaacttata

SEQ ID NO: 575549 - DNA, 13 bp, D. melanogaster
agaaaaactttaa

SEQ ID NO: 575550 - DNA, 13 bp, D. melanogaster
agaaaaacttttc

SEQ ID NO: 575551 - DNA, 13 bp, D. melanogaster
agaaaaacttttg

SEQ ID NO: 575552 - DNA, 13 bp, D. melanogaster
agaaaaagaactt

SEQ ID NO: 575553 - DNA, 13 bp, D. melanogaster
agaaaaagatttt

SEQ ID NO: 575554 - DNA, 13 bp, D. melanogaster
agaaaaagttgtt

SEQ ID NO: 575555 - DNA, 13 bp, D. melanogaster
agaaaaagtttta

SEQ ID NO: 575556 - DNA, 13 bp, D. melanogaster
agaaaaatacttt

SEQ ID NO: 575557 - DNA, 13 bp, D. melanogaster
agaaaaatatgtt

SEQ ID NO: 575558 - DNA, 13 bp, D. melanogaster
agaaaaatatttc

SEQ ID NO: 575559 - DNA, 13 bp, D. melanogaster
agaaaaatatttg

SEQ ID NO: 575560 - DNA, 13 bp, D. melanogaster
agaaaaatcaatg

SEQ ID NO: 575561 - DNA, 14 bp, D. melanogaster
agaaaaatcaattt

SEQ ID NO: 575562 - DNA, 13 bp, D. melanogaster
agaaaaatcatat

SEQ ID NO: 575563 - DNA, 13 bp, D. melanogaster
agaaaaatcgatt

SEQ ID NO: 575564 - DNA, 14 bp, D. melanogaster
agaaaaatgcattt

SEQ ID NO: 575565 - DNA, 13 bp, D. melanogaster
agaaaaatgccca

SEQ ID NO: 575566 - DNA, 13 bp, D. melanogaster
agaaaaatgccga

SEQ ID NO: 575567 - DNA, 13 bp, D. melanogaster
agaaaaatggctg

SEQ ID NO: 575568 - DNA, 13 bp, D. melanogaster
agaaaaatgtgca

SEQ ID NO: 575569 - DNA, 13 bp, D. melanogaster
agaaaaatgtgta

SEQ ID NO: 575570 - DNA, 14 bp, D. melanogaster
agaaaaatgttgaa

SEQ ID NO: 575571 - DNA, 13 bp, D. melanogaster
agaaaaatgttta

SEQ ID NO: 575572 - DNA, 13 bp, D. melanogaster
agaaaaatgtttc

SEQ ID NO: 575573 - DNA, 13 bp, D. melanogaster
agaaaaatgtttg

SEQ ID NO: 575574 - DNA, 13 bp, D. melanogaster
agaaaaattcaat

SEQ ID NO: 575575 - DNA, 13 bp, D. melanogaster
agaaaaattccga

SEQ ID NO: 575576 - DNA, 13 bp, D. melanogaster
agaaaaatttgta

SEQ ID NO: 575577 - DNA, 14 bp, D. melanogaster
agaaaaatttgtag

SEQ ID NO: 575578 - DNA, 14 bp, D. melanogaster
agaaaaattttcca

SEQ ID NO: 575579 - DNA, 13 bp, D. melanogaster
agaaaacaaatgt

SEQ ID NO: 575580 - DNA, 13 bp, D. melanogaster
agaaaacaaattg

SEQ ID NO: 575581 - DNA, 13 bp, D. melanogaster
agaaaacaaattt

SEQ ID NO: 575582 - DNA, 13 bp, D. melanogaster
agaaaacaacttt

SEQ ID NO: 575583 - DNA, 13 bp, D. melanogaster
agaaaacactttc

SEQ ID NO: 575584 - DNA, 13 bp, D. melanogaster
agaaaacattaat

SEQ ID NO: 575585 - DNA, 13 bp, D. melanogaster
agaaaacatttaa

SEQ ID NO: 575586 - DNA, 13 bp, D. melanogaster
agaaaacattttc

SEQ ID NO: 575587 - DNA, 13 bp, D. melanogaster
agaaaaccattta

SEQ ID NO: 575588 - DNA, 13 bp, D. melanogaster
agaaaaccatttt

SEQ ID NO: 575589 - DNA, 13 bp, D. melanogaster
agaaaacccttac

SEQ ID NO: 575590 - DNA, 13 bp, D. melanogaster
agaaaaccgaaat

SEQ ID NO: 575591 - DNA, 14 bp, D. melanogaster
agaaaacggaaatg

SEQ ID NO: 575592 - DNA, 13 bp, D. melanogaster
agaaaacgtcgcg

SEQ ID NO: 575593 - DNA, 13 bp, D. melanogaster
agaaaacgtttaa

SEQ ID NO: 575594 - DNA, 13 bp, D. melanogaster
agaaaactactaa

SEQ ID NO: 575595 - DNA, 14 bp, D. melanogaster
agaaaactatttaa

SEQ ID NO: 575596 - DNA, 13 bp, D. melanogaster
agaaaactcaaat

SEQ ID NO: 575597 - DNA, 13 bp, D. melanogaster
agaaaactcaacg

SEQ ID NO: 575598 - DNA, 13 bp, D. melanogaster
agaaaactgaatt

SEQ ID NO: 575599 - DNA, 13 bp, D. melanogaster
agaaaactgattt

SEQ ID NO: 575600 - DNA, 14 bp, D. melanogaster
agaaaactgatttt

SEQ ID NO: 575601 - DNA, 13 bp, D. melanogaster
agaaaactgcctt

SEQ ID NO: 575602 - DNA, 13 bp, D. melanogaster
agaaaactggaaa

SEQ ID NO: 575603 - DNA, 13 bp, D. melanogaster
agaaaactggttt

SEQ ID NO: 575604 - DNA, 13 bp, D. melanogaster
agaaaacttgcca

SEQ ID NO: 575605 - DNA, 13 bp, D. melanogaster
agaaaactttaaa

SEQ ID NO: 575606 - DNA, 13 bp, D. melanogaster
agaaaactttgcc

SEQ ID NO: 575607 - DNA, 13 bp, D. melanogaster
agaaaacttttgt

SEQ ID NO: 575608 - DNA, 13 bp, D. melanogaster
agaaaagactatt

SEQ ID NO: 575609 - DNA, 13 bp, D. melanogaster
agaaaagatttat

SEQ ID NO: 575610 - DNA, 13 bp, D. melanogaster
agaaaagcaaagt

SEQ ID NO: 575611 - DNA, 13 bp, D. melanogaster
agaaaagcggcaa

SEQ ID NO: 575612 - DNA, 13 bp, D. melanogaster
agaaaagctgaaa

SEQ ID NO: 575613 - DNA, 13 bp, D. melanogaster
agaaaagctgcag

SEQ ID NO: 575614 - DNA, 13 bp, D. melanogaster
agaaaagcttctg

SEQ ID NO: 575615 - DNA, 13 bp, D. melanogaster
agaaaagcttttt

SEQ ID NO: 575616 - DNA, 13 bp, D. melanogaster
agaaaagggcaat

SEQ ID NO: 575617 - DNA, 13 bp, D. melanogaster
agaaaagtaattt

SEQ ID NO: 575618 - DNA, 13 bp, D. melanogaster
agaaaagtcacaa

SEQ ID NO: 575619 - DNA, 13 bp, D. melanogaster
agaaaagtggcag

SEQ ID NO: 575620 - DNA, 13 bp, D. melanogaster
agaaaagtgtgaa

SEQ ID NO: 575621 - DNA, 14 bp, D. melanogaster
agaaaagttcttaa

SEQ ID NO: 575622 - DNA, 13 bp, D. melanogaster
agaaaagtttttg

SEQ ID NO: 575623 - DNA, 14 bp, D. melanogaster
agaaaataaatgca

SEQ ID NO: 575624 - DNA, 13 bp, D. melanogaster
agaaaataagttt

SEQ ID NO: 575625 - DNA, 14 bp, D. melanogaster
agaaaatacaaatt

SEQ ID NO: 575626 - DNA, 13 bp, D. melanogaster
agaaaatacaatt

SEQ ID NO: 575627 - DNA, 13 bp, D. melanogaster
agaaaataccatt

SEQ ID NO: 575628 - DNA, 13 bp, D. melanogaster
agaaaatactgaa

SEQ ID NO: 575629 - DNA, 13 bp, D. melanogaster
agaaaatagcaca

SEQ ID NO: 575630 - DNA, 13 bp, D. melanogaster
agaaaatagtgca

SEQ ID NO: 575631 - DNA, 14 bp, D. melanogaster
agaaaatagtgcac

SEQ ID NO: 575632 - DNA, 13 bp, D. melanogaster
agaaaatagttta

SEQ ID NO: 575633 - DNA, 13 bp, D. melanogaster
agaaaatataacg

SEQ ID NO: 575634 - DNA, 14 bp, D. melanogaster
agaaaatatatgca

SEQ ID NO: 575635 - DNA, 13 bp, D. melanogaster
agaaaatatcaat

SEQ ID NO: 575636 - DNA, 13 bp, D. melanogaster
agaaaatatgatt

SEQ ID NO: 575637 - DNA, 14 bp, D. melanogaster
agaaaatatgcaaa

SEQ ID NO: 575638 - DNA, 13 bp, D. melanogaster
agaaaatatgcat

SEQ ID NO: 575639 - DNA, 13 bp, D. melanogaster
agaaaatattcaa

SEQ ID NO: 575640 - DNA, 14 bp, D. melanogaster
agaaaatattcaag

SEQ ID NO: 575641 - DNA, 13 bp, D. melanogaster
agaaaatattgat

SEQ ID NO: 575642 - DNA, 13 bp, D. melanogaster
agaaaatattgct

SEQ ID NO: 575643 - DNA, 13 bp, D. melanogaster
agaaaatatttga

SEQ ID NO: 575644 - DNA, 13 bp, D. melanogaster
agaaaatcaaatg

SEQ ID NO: 575645 - DNA, 13 bp, D. melanogaster
agaaaatcaatat

SEQ ID NO: 575646 - DNA, 13 bp, D. melanogaster
agaaaatcaatta

SEQ ID NO: 575647 - DNA, 13 bp, D. melanogaster
agaaaatcaattt

SEQ ID NO: 575648 - DNA, 13 bp, D. melanogaster
agaaaatcattaa

SEQ ID NO: 575649 - DNA, 13 bp, D. melanogaster
agaaaatcccaaa

SEQ ID NO: 575650 - DNA, 13 bp, D. melanogaster
agaaaatcctata

SEQ ID NO: 575651 - DNA, 13 bp, D. melanogaster
agaaaatcgaaat

SEQ ID NO: 575652 - DNA, 13 bp, D. melanogaster
agaaaatcgaatt

SEQ ID NO: 575653 - DNA, 13 bp, D. melanogaster
agaaaatctacaa

SEQ ID NO: 575654 - DNA, 13 bp, D. melanogaster
agaaaatctttta

SEQ ID NO: 575655 - DNA, 13 bp, D. melanogaster
agaaaatgcattg

SEQ ID NO: 575656 - DNA, 13 bp, D. melanogaster
agaaaatgcattt

SEQ ID NO: 575657 - DNA, 13 bp, D. melanogaster
agaaaatgccaaa

SEQ ID NO: 575658 - DNA, 13 bp, D. melanogaster
agaaaatgctgaa

SEQ ID NO: 575659 - DNA, 13 bp, D. melanogaster
agaaaatggccag

SEQ ID NO: 575660 - DNA, 13 bp, D. melanogaster
agaaaatgggaat

SEQ ID NO: 575661 - DNA, 13 bp, D. melanogaster
agaaaatggtaac

SEQ ID NO: 575662 - DNA, 14 bp, D. melanogaster
agaaaatggtaacg

SEQ ID NO: 575663 - DNA, 13 bp, D. melanogaster
agaaaatgtactt

SEQ ID NO: 575664 - DNA, 13 bp, D. melanogaster
agaaaatgtatat

SEQ ID NO: 575665 - DNA, 13 bp, D. melanogaster
agaaaatgtattt

SEQ ID NO: 575666 - DNA, 13 bp, D. melanogaster
agaaaatgtcaac

SEQ ID NO: 575667 - DNA, 13 bp, D. melanogaster
agaaaatgtggaa

SEQ ID NO: 575668 - DNA, 13 bp, D. melanogaster
agaaaatgtggca

SEQ ID NO: 575669 - DNA, 13 bp, D. melanogaster
agaaaatgttaag

SEQ ID NO: 575670 - DNA, 14 bp, D. melanogaster
agaaaatgttgaaa

SEQ ID NO: 575671 - DNA, 13 bp, D. melanogaster
agaaaatgtttaa

SEQ ID NO: 575672 - DNA, 13 bp, D. melanogaster
agaaaattacatt

SEQ ID NO: 575673 - DNA, 13 bp, D. melanogaster
agaaaattacttt

SEQ ID NO: 575674 - DNA, 13 bp, D. melanogaster
agaaaattagttt

SEQ ID NO: 575675 - DNA, 14 bp, D. melanogaster
agaaaattatgaag

SEQ ID NO: 575676 - DNA, 13 bp, D. melanogaster
agaaaattcaatt

SEQ ID NO: 575677 - DNA, 13 bp, D. melanogaster
agaaaattcacaa

SEQ ID NO: 575678 - DNA, 13 bp, D. melanogaster
agaaaattcataa

SEQ ID NO: 575679 - DNA, 13 bp, D. melanogaster
agaaaattcattt

SEQ ID NO: 575680 - DNA, 13 bp, D. melanogaster
agaaaattccaaa

SEQ ID NO: 575681 - DNA, 14 bp, D. melanogaster
agaaaattcttgtt

SEQ ID NO: 575682 - DNA, 13 bp, D. melanogaster
agaaaattgcaaa

SEQ ID NO: 575683 - DNA, 14 bp, D. melanogaster
agaaaattgcaaaa

SEQ ID NO: 575684 - DNA, 13 bp, D. melanogaster
agaaaattgcaat

SEQ ID NO: 575685 - DNA, 13 bp, D. melanogaster
agaaaattgcgtg

SEQ ID NO: 575686 - DNA, 13 bp, D. melanogaster
agaaaattgtaat

SEQ ID NO: 575687 - DNA, 13 bp, D. melanogaster
agaaaattgtcaa

SEQ ID NO: 575688 - DNA, 13 bp, D. melanogaster
agaaaattgtgaa

SEQ ID NO: 575689 - DNA, 13 bp, D. melanogaster
agaaaattgttaa

SEQ ID NO: 575690 - DNA, 13 bp, D. melanogaster
agaaaattgttga

SEQ ID NO: 575691 - DNA, 13 bp, D. melanogaster
agaaaatttcaat

SEQ ID NO: 575692 - DNA, 13 bp, D. melanogaster
agaaaatttcatt

SEQ ID NO: 575693 - DNA, 13 bp, D. melanogaster
agaaaatttgagc

SEQ ID NO: 575694 - DNA, 13 bp, D. melanogaster
agaaaattttagt

SEQ ID NO: 575695 - DNA, 13 bp, D. melanogaster
agaaacaaaagtt

SEQ ID NO: 575696 - DNA, 13 bp, D. melanogaster
agaaacaaaattg

SEQ ID NO: 575697 - DNA, 13 bp, D. melanogaster
agaaacaaacggg

SEQ ID NO: 575698 - DNA, 13 bp, D. melanogaster
agaaacaaatatt

SEQ ID NO: 575699 - DNA, 13 bp, D. melanogaster
agaaacaaattta

SEQ ID NO: 575700 - DNA, 13 bp, D. melanogaster
agaaacaaatttt

SEQ ID NO: 575701 - DNA, 13 bp, D. melanogaster
agaaacaatcagt

SEQ ID NO: 575702 - DNA, 13 bp, D. melanogaster
agaaacaattgaa

SEQ ID NO: 575703 - DNA, 13 bp, D. melanogaster
agaaacaatttaa

SEQ ID NO: 575704 - DNA, 13 bp, D. melanogaster
agaaacacacttt

SEQ ID NO: 575705 - DNA, 13 bp, D. melanogaster
agaaacacattaa

SEQ ID NO: 575706 - DNA, 13 bp, D. melanogaster
agaaacaccattt

SEQ ID NO: 575707 - DNA, 13 bp, D. melanogaster
agaaacagaaact

SEQ ID NO: 575708 - DNA, 13 bp, D. melanogaster
agaaacagaggca

SEQ ID NO: 575709 - DNA, 14 bp, D. melanogaster
agaaacagatacag

SEQ ID NO: 575710 - DNA, 13 bp, D. melanogaster
agaaacaggcagc

SEQ ID NO: 575711 - DNA, 13 bp, D. melanogaster
agaaacaggtcat

SEQ ID NO: 575712 - DNA, 13 bp, D. melanogaster
agaaacatacata

SEQ ID NO: 575713 - DNA, 13 bp, D. melanogaster
agaaacatattct

SEQ ID NO: 575714 - DNA, 13 bp, D. melanogaster
agaaacatcgatg

SEQ ID NO: 575715 - DNA, 13 bp, D. melanogaster
agaaacattacca

SEQ ID NO: 575716 - DNA, 13 bp, D. melanogaster
agaaacatttaag

SEQ ID NO: 575717 - DNA, 13 bp, D. melanogaster
agaaacattttaa

SEQ ID NO: 575718 - DNA, 14 bp, D. melanogaster
agaaacattttaaa

SEQ ID NO: 575719 - DNA, 13 bp, D. melanogaster
agaaacattttat

SEQ ID NO: 575720 - DNA, 13 bp, D. melanogaster
agaaacatttttc

SEQ ID NO: 575721 - DNA, 14 bp, D. melanogaster
agaaaccaaaaatt

SEQ ID NO: 575722 - DNA, 13 bp, D. melanogaster
agaaaccaaagcc

SEQ ID NO: 575723 - DNA, 13 bp, D. melanogaster
agaaaccaaatga

SEQ ID NO: 575724 - DNA, 13 bp, D. melanogaster
agaaaccaaattg

SEQ ID NO: 575725 - DNA, 13 bp, D. melanogaster
agaaaccacaacg

SEQ ID NO: 575726 - DNA, 13 bp, D. melanogaster
agaaaccgatgct

SEQ ID NO: 575727 - DNA, 13 bp, D. melanogaster
agaaaccggatgc

SEQ ID NO: 575728 - DNA, 13 bp, D. melanogaster
agaaacctaaaga

SEQ ID NO: 575729 - DNA, 13 bp, D. melanogaster
agaaacctataga

SEQ ID NO: 575730 - DNA, 13 bp, D. melanogaster
agaaacgataccg

SEQ ID NO: 575731 - DNA, 13 bp, D. melanogaster
agaaacgcacaca

SEQ ID NO: 575732 - DNA, 13 bp, D. melanogaster
agaaacgcacctc

SEQ ID NO: 575733 - DNA, 13 bp, D. melanogaster
agaaacgcattaa

SEQ ID NO: 575734 - DNA, 13 bp, D. melanogaster
agaaactaaagat

SEQ ID NO: 575735 - DNA, 13 bp, D. melanogaster
agaaactaaatat

SEQ ID NO: 575736 - DNA, 13 bp, D. melanogaster
agaaactaactaa

SEQ ID NO: 575737 - DNA, 13 bp, D. melanogaster
agaaactaattta

SEQ ID NO: 575738 - DNA, 13 bp, D. melanogaster
agaaactacacca

SEQ ID NO: 575739 - DNA, 13 bp, D. melanogaster
agaaactagtttt

SEQ ID NO: 575740 - DNA, 13 bp, D. melanogaster
agaaactattaaa

SEQ ID NO: 575741 - DNA, 13 bp, D. melanogaster
agaaactattttc

SEQ ID NO: 575742 - DNA, 13 bp, D. melanogaster
agaaactccattt

SEQ ID NO: 575743 - DNA, 13 bp, D. melanogaster
agaaactcttctt

SEQ ID NO: 575744 - DNA, 13 bp, D. melanogaster
agaaactgaaaag

SEQ ID NO: 575745 - DNA, 13 bp, D. melanogaster
agaaactgaaatt

SEQ ID NO: 575746 - DNA, 14 bp, D. melanogaster
agaaactgatttta

SEQ ID NO: 575747 - DNA, 13 bp, D. melanogaster
agaaacttaaatt

SEQ ID NO: 575748 - DNA, 13 bp, D. melanogaster
agaaacttatcga

SEQ ID NO: 575749 - DNA, 13 bp, D. melanogaster
agaaacttgacaa

SEQ ID NO: 575750 - DNA, 13 bp, D. melanogaster
agaaacttgttta

SEQ ID NO: 575751 - DNA, 13 bp, D. melanogaster
agaaactttttgc

SEQ ID NO: 575752 - DNA, 14 bp, D. melanogaster
agaaagaagccacc

SEQ ID NO: 575753 - DNA, 14 bp, D. melanogaster
agaaagagacggca

SEQ ID NO: 575754 - DNA, 13 bp, D. melanogaster
agaaagagagcgc

SEQ ID NO: 575755 - DNA, 13 bp, D. melanogaster
agaaagatttcac

SEQ ID NO: 575756 - DNA, 13 bp, D. melanogaster
agaaagcaaaagt

SEQ ID NO: 575757 - DNA, 13 bp, D. melanogaster
agaaagcaattaa

SEQ ID NO: 575758 - DNA, 14 bp, D. melanogaster
agaaagccgggcta

SEQ ID NO: 575759 - DNA, 14 bp, D. melanogaster
agaaagcgagatga

SEQ ID NO: 575760 - DNA, 13 bp, D. melanogaster
agaaagctaaatg

SEQ ID NO: 575761 - DNA, 13 bp, D. melanogaster
agaaagcttaaaa

SEQ ID NO: 575762 - DNA, 14 bp, D. melanogaster
agaaagcttaaaaa

SEQ ID NO: 575763 - DNA, 13 bp, D. melanogaster
agaaaggccagct

SEQ ID NO: 575764 - DNA, 13 bp, D. melanogaster
agaaagtagttgt

SEQ ID NO: 575765 - DNA, 14 bp, D. melanogaster
agaaagtatgctat

SEQ ID NO: 575766 - DNA, 13 bp, D. melanogaster
agaaagtattttt

SEQ ID NO: 575767 - DNA, 13 bp, D. melanogaster
agaaagtcagtcg

SEQ ID NO: 575768 - DNA, 13 bp, D. melanogaster
agaaagtgcaaaa

SEQ ID NO: 575769 - DNA, 13 bp, D. melanogaster
agaaagtgctcaa

SEQ ID NO: 575770 - DNA, 13 bp, D. melanogaster
agaaagttaaatt

SEQ ID NO: 575771 - DNA, 14 bp, D. melanogaster
agaaagttggaagt

SEQ ID NO: 575772 - DNA, 13 bp, D. melanogaster
agaaagttggcca

SEQ ID NO: 575773 - DNA, 13 bp, D. melanogaster
agaaagttttaaa

SEQ ID NO: 575774 - DNA, 13 bp, D. melanogaster
agaaagttttcaa

SEQ ID NO: 575775 - DNA, 13 bp, D. melanogaster
agaaagtttttca

SEQ ID NO: 575776 - DNA, 13 bp, D. melanogaster
agaaataaaactg

SEQ ID NO: 575777 - DNA, 13 bp, D. melanogaster
agaaataaattct

SEQ ID NO: 575778 - DNA, 14 bp, D. melanogaster
agaaataaattctt

SEQ ID NO: 575779 - DNA, 13 bp, D. melanogaster
agaaataacaatt

SEQ ID NO: 575780 - DNA, 13 bp, D. melanogaster
agaaataatcaat

SEQ ID NO: 575781 - DNA, 14 bp, D. melanogaster
agaaataatcaatg

SEQ ID NO: 575782 - DNA, 13 bp, D. melanogaster
agaaatacaaatg

SEQ ID NO: 575783 - DNA, 13 bp, D. melanogaster
agaaatacaagcc

SEQ ID NO: 575784 - DNA, 13 bp, D. melanogaster
agaaatacataca

SEQ ID NO: 575785 - DNA, 13 bp, D. melanogaster
agaaatacatttg

SEQ ID NO: 575786 - DNA, 13 bp, D. melanogaster
agaaatacatttt

SEQ ID NO: 575787 - DNA, 13 bp, D. melanogaster
agaaatacgaaat

SEQ ID NO: 575788 - DNA, 13 bp, D. melanogaster
agaaatacttaaa

SEQ ID NO: 575789 - DNA, 14 bp, D. melanogaster
agaaatagatttga

SEQ ID NO: 575790 - DNA, 13 bp, D. melanogaster
agaaatagccaaa

SEQ ID NO: 575791 - DNA, 14 bp, D. melanogaster
agaaatagtatttt

SEQ ID NO: 575792 - DNA, 13 bp, D. melanogaster
agaaatagttgcc

SEQ ID NO: 575793 - DNA, 14 bp, D. melanogaster
agaaatatacattt

SEQ ID NO: 575794 - DNA, 13 bp, D. melanogaster
agaaatatataca

SEQ ID NO: 575795 - DNA, 14 bp, D. melanogaster
agaaatatatacat

SEQ ID NO: 575796 - DNA, 13 bp, D. melanogaster
agaaatatatatc

SEQ ID NO: 575797 - DNA, 13 bp, D. melanogaster
agaaatatatgta

SEQ ID NO: 575798 - DNA, 13 bp, D. melanogaster
agaaatatattca

SEQ ID NO: 575799 - DNA, 13 bp, D. melanogaster
agaaatatattga

SEQ ID NO: 575800 - DNA, 13 bp, D. melanogaster
agaaatatgatcg

SEQ ID NO: 575801 - DNA, 13 bp, D. melanogaster
agaaatatgcaaa

SEQ ID NO: 575802 - DNA, 14 bp, D. melanogaster
agaaatatgcaaat

SEQ ID NO: 575803 - DNA, 13 bp, D. melanogaster
agaaatatgtata

SEQ ID NO: 575804 - DNA, 14 bp, D. melanogaster
agaaatatgtatat

SEQ ID NO: 575805 - DNA, 13 bp, D. melanogaster
agaaatatgtatt

SEQ ID NO: 575806 - DNA, 13 bp, D. melanogaster
agaaatatgtttt

SEQ ID NO: 575807 - DNA, 13 bp, D. melanogaster
agaaatattcaat

SEQ ID NO: 575808 - DNA, 13 bp, D. melanogaster
agaaatattgttt

SEQ ID NO: 575809 - DNA, 13 bp, D. melanogaster
agaaatatttgaa

SEQ ID NO: 575810 - DNA, 13 bp, D. melanogaster
agaaatattttca

SEQ ID NO: 575811 - DNA, 14 bp, D. melanogaster
agaaatattttcaa

SEQ ID NO: 575812 - DNA, 13 bp, D. melanogaster
agaaatcaaatca

SEQ ID NO: 575813 - DNA, 13 bp, D. melanogaster
agaaatcaatatt

SEQ ID NO: 575814 - DNA, 13 bp, D. melanogaster
agaaatcagtttt

SEQ ID NO: 575815 - DNA, 13 bp, D. melanogaster
agaaatcattaat

SEQ ID NO: 575816 - DNA, 13 bp, D. melanogaster
agaaatccaataa

SEQ ID NO: 575817 - DNA, 13 bp, D. melanogaster
agaaatccaggaa

SEQ ID NO: 575818 - DNA, 13 bp, D. melanogaster
agaaatcgaataa

SEQ ID NO: 575819 - DNA, 13 bp, D. melanogaster
agaaatcgagaaa

SEQ ID NO: 575820 - DNA, 13 bp, D. melanogaster
agaaatcggaaaa

SEQ ID NO: 575821 - DNA, 13 bp, D. melanogaster
agaaatcggctgg

SEQ ID NO: 575822 - DNA, 13 bp, D. melanogaster
agaaatcgttttt

SEQ ID NO: 575823 - DNA, 13 bp, D. melanogaster
agaaatctaattt

SEQ ID NO: 575824 - DNA, 13 bp, D. melanogaster
agaaatcttaaat

SEQ ID NO: 575825 - DNA, 13 bp, D. melanogaster
agaaatcttgaat

SEQ ID NO: 575826 - DNA, 14 bp, D. melanogaster
agaaatgaaaaact

SEQ ID NO: 575827 - DNA, 13 bp, D. melanogaster
agaaatgaaacga

SEQ ID NO: 575828 - DNA, 13 bp, D. melanogaster
agaaatgacaaca

SEQ ID NO: 575829 - DNA, 13 bp, D. melanogaster
agaaatgagcaaa

SEQ ID NO: 575830 - DNA, 13 bp, D. melanogaster
agaaatgatttta

SEQ ID NO: 575831 - DNA, 14 bp, D. melanogaster
agaaatgcaaatta

SEQ ID NO: 575832 - DNA, 13 bp, D. melanogaster
agaaatgcattta

SEQ ID NO: 575833 - DNA, 13 bp, D. melanogaster
agaaatgccataa

SEQ ID NO: 575834 - DNA, 14 bp, D. melanogaster
agaaatgcgaaaaa

SEQ ID NO: 575835 - DNA, 13 bp, D. melanogaster
agaaatgctgaaa

SEQ ID NO: 575836 - DNA, 13 bp, D. melanogaster
agaaatgctttta

SEQ ID NO: 575837 - DNA, 14 bp, D. melanogaster
agaaatggaaatgg

SEQ ID NO: 575838 - DNA, 14 bp, D. melanogaster
agaaatggaaattc

SEQ ID NO: 575839 - DNA, 14 bp, D. melanogaster
agaaatggcaacta

SEQ ID NO: 575840 - DNA, 13 bp, D. melanogaster
agaaatggcagaa

SEQ ID NO: 575841 - DNA, 13 bp, D. melanogaster
agaaatggccaaa

SEQ ID NO: 575842 - DNA, 13 bp, D. melanogaster
agaaatggtagaa

SEQ ID NO: 575843 - DNA, 13 bp, D. melanogaster
agaaatgtaaaca

SEQ ID NO: 575844 - DNA, 13 bp, D. melanogaster
agaaatgtaaatt

SEQ ID NO: 575845 - DNA, 13 bp, D. melanogaster
agaaatgtatctt

SEQ ID NO: 575846 - DNA, 13 bp, D. melanogaster
agaaatgtcaact

SEQ ID NO: 575847 - DNA, 14 bp, D. melanogaster
agaaatgtgcaaaa

SEQ ID NO: 575848 - DNA, 13 bp, D. melanogaster
agaaatgtggaaa

SEQ ID NO: 575849 - DNA, 13 bp, D. melanogaster
agaaatgtgtaaa

SEQ ID NO: 575850 - DNA, 13 bp, D. melanogaster
agaaatgttagtt

SEQ ID NO: 575851 - DNA, 13 bp, D. melanogaster
agaaatgtttcat

SEQ ID NO: 575852 - DNA, 13 bp, D. melanogaster
agaaatgttttca

SEQ ID NO: 575853 - DNA, 13 bp, D. melanogaster
agaaattaaaacg

SEQ ID NO: 575854 - DNA, 13 bp, D. melanogaster
agaaattaaatca

SEQ ID NO: 575855 - DNA, 13 bp, D. melanogaster
agaaattaacatt

SEQ ID NO: 575856 - DNA, 14 bp, D. melanogaster
agaaattaacattt

SEQ ID NO: 575857 - DNA, 13 bp, D. melanogaster
agaaattacttta

SEQ ID NO: 575858 - DNA, 13 bp, D. melanogaster
agaaattagcaca

SEQ ID NO: 575859 - DNA, 14 bp, D. melanogaster
agaaattatagcaa

SEQ ID NO: 575860 - DNA, 13 bp, D. melanogaster
agaaattatcttt

SEQ ID NO: 575861 - DNA, 13 bp, D. melanogaster
agaaattattgta

SEQ ID NO: 575862 - DNA, 13 bp, D. melanogaster
agaaattcaattg

SEQ ID NO: 575863 - DNA, 13 bp, D. melanogaster
agaaattccaaaa

SEQ ID NO: 575864 - DNA, 14 bp, D. melanogaster
agaaattccaacca

SEQ ID NO: 575865 - DNA, 13 bp, D. melanogaster
agaaattccaatt

SEQ ID NO: 575866 - DNA, 13 bp, D. melanogaster
agaaattcctgaa

SEQ ID NO: 575867 - DNA, 13 bp, D. melanogaster
agaaattcgaatt

SEQ ID NO: 575868 - DNA, 13 bp, D. melanogaster
agaaattctaaaa

SEQ ID NO: 575869 - DNA, 13 bp, D. melanogaster
agaaattctaatt

SEQ ID NO: 575870 - DNA, 13 bp, D. melanogaster
agaaattctccaa

SEQ ID NO: 575871 - DNA, 13 bp, D. melanogaster
agaaattgaaact

SEQ ID NO: 575872 - DNA, 13 bp, D. melanogaster
agaaattgaagca

SEQ ID NO: 575873 - DNA, 16 bp, D. melanogaster
agaaattgaagcaatt

SEQ ID NO: 575874 - DNA, 13 bp, D. melanogaster
agaaattgcaaaa

SEQ ID NO: 575875 - DNA, 13 bp, D. melanogaster
agaaattgcattt

SEQ ID NO: 575876 - DNA, 13 bp, D. melanogaster
agaaattgccaaa

SEQ ID NO: 575877 - DNA, 14 bp, D. melanogaster
agaaattggaattg

SEQ ID NO: 575878 - DNA, 13 bp, D. melanogaster
agaaattggcaaa

SEQ ID NO: 575879 - DNA, 13 bp, D. melanogaster
agaaattggcaag

SEQ ID NO: 575880 - DNA, 13 bp, D. melanogaster
agaaattgggaaa

SEQ ID NO: 575881 - DNA, 13 bp, D. melanogaster
agaaattgtataa

SEQ ID NO: 575882 - DNA, 13 bp, D. melanogaster
agaaattgttagc

SEQ ID NO: 575883 - DNA, 13 bp, D. melanogaster
agaaatttaagtt

SEQ ID NO: 575884 - DNA, 13 bp, D. melanogaster
agaaatttaatac

SEQ ID NO: 575885 - DNA, 14 bp, D. melanogaster
agaaatttaatttg

SEQ ID NO: 575886 - DNA, 13 bp, D. melanogaster
agaaatttacaag

SEQ ID NO: 575887 - DNA, 13 bp, D. melanogaster
agaaatttgaaat

SEQ ID NO: 575888 - DNA, 13 bp, D. melanogaster
agaaatttgaaca

SEQ ID NO: 575889 - DNA, 13 bp, D. melanogaster
agaaatttgcaca

SEQ ID NO: 575890 - DNA, 13 bp, D. melanogaster
agaaatttggaaa

SEQ ID NO: 575891 - DNA, 13 bp, D. melanogaster
agaaatttgtaga

SEQ ID NO: 575892 - DNA, 13 bp, D. melanogaster
agaaatttgttga

SEQ ID NO: 575893 - DNA, 13 bp, D. melanogaster
agaaattttcttt

SEQ ID NO: 575894 - DNA, 13 bp, D. melanogaster
agaaattttgaat

SEQ ID NO: 575895 - DNA, 13 bp, D. melanogaster
agaaatttttcaa

SEQ ID NO: 575896 - DNA, 13 bp, D. melanogaster
agaacaaaattca

SEQ ID NO: 575897 - DNA, 14 bp, D. melanogaster
agaacaaaattcat

SEQ ID NO: 575898 - DNA, 13 bp, D. melanogaster
agaacaaactggc

SEQ ID NO: 575899 - DNA, 14 bp, D. melanogaster
agaacaaattattt

SEQ ID NO: 575900 - DNA, 14 bp, D. melanogaster
agaacaacaacaat

SEQ ID NO: 575901 - DNA, 13 bp, D. melanogaster
agaacaacaacat

SEQ ID NO: 575902 - DNA, 13 bp, D. melanogaster
agaacaacaacta

SEQ ID NO: 575903 - DNA, 13 bp, D. melanogaster
agaacaacaggtc

SEQ ID NO: 575904 - DNA, 13 bp, D. melanogaster
agaacaaccttga

SEQ ID NO: 575905 - DNA, 13 bp, D. melanogaster
agaacaacttaga

SEQ ID NO: 575906 - DNA, 13 bp, D. melanogaster
agaacaactttat

SEQ ID NO: 575907 - DNA, 13 bp, D. melanogaster
agaacaagagtta

SEQ ID NO: 575908 - DNA, 13 bp, D. melanogaster
agaacaagtaatt

SEQ ID NO: 575909 - DNA, 13 bp, D. melanogaster
agaacaagtatcc

SEQ ID NO: 575910 - DNA, 13 bp, D. melanogaster
agaacaatatatt

SEQ ID NO: 575911 - DNA, 13 bp, D. melanogaster
agaacaatttaaa

SEQ ID NO: 575912 - DNA, 13 bp, D. melanogaster
agaacacttcata

SEQ ID NO: 575913 - DNA, 13 bp, D. melanogaster
agaacagagcaga

SEQ ID NO: 575914 - DNA, 13 bp, D. melanogaster
agaacagtgaaaa

SEQ ID NO: 575915 - DNA, 14 bp, D. melanogaster
agaacagtgaaaaa

SEQ ID NO: 575916 - DNA, 13 bp, D. melanogaster
agaacataaaact

SEQ ID NO: 575917 - DNA, 13 bp, D. melanogaster
agaacataaagtc

SEQ ID NO: 575918 - DNA, 13 bp, D. melanogaster
agaacatacattt

SEQ ID NO: 575919 - DNA, 13 bp, D. melanogaster
agaacatagaaac

SEQ ID NO: 575920 - DNA, 13 bp, D. melanogaster
agaacatatttat

SEQ ID NO: 575921 - DNA, 13 bp, D. melanogaster
agaacatctgcca

SEQ ID NO: 575922 - DNA, 13 bp, D. melanogaster
agaacattttaat

SEQ ID NO: 575923 - DNA, 13 bp, D. melanogaster
agaacattttcaa

SEQ ID NO: 575924 - DNA, 13 bp, D. melanogaster
agaacattttcca

SEQ ID NO: 575925 - DNA, 13 bp, D. melanogaster
agaacattttctt

SEQ ID NO: 575926 - DNA, 14 bp, D. melanogaster
agaaccaacatctc

SEQ ID NO: 575927 - DNA, 13 bp, D. melanogaster
agaaccaatatcg

SEQ ID NO: 575928 - DNA, 13 bp, D. melanogaster
agaaccacacagt

SEQ ID NO: 575929 - DNA, 13 bp, D. melanogaster
agaaccagaaata

SEQ ID NO: 575930 - DNA, 13 bp, D. melanogaster
agaaccagaacca

SEQ ID NO: 575931 - DNA, 13 bp, D. melanogaster
agaaccagagttg

SEQ ID NO: 575932 - DNA, 13 bp, D. melanogaster
agaacccaaatca

SEQ ID NO: 575933 - DNA, 13 bp, D. melanogaster
agaacccaagagc

SEQ ID NO: 575934 - DNA, 14 bp, D. melanogaster
agaacccagaaccc

SEQ ID NO: 575935 - DNA, 13 bp, D. melanogaster
agaaccttattgt

SEQ ID NO: 575936 - DNA, 13 bp, D. melanogaster
agaaccttcgagt

SEQ ID NO: 575937 - DNA, 13 bp, D. melanogaster
agaacgaactcga

SEQ ID NO: 575938 - DNA, 13 bp, D. melanogaster
agaacgacgataa

SEQ ID NO: 575939 - DNA, 14 bp, D. melanogaster
agaacgatggcttg

SEQ ID NO: 575940 - DNA, 13 bp, D. melanogaster
agaacggaaaaat

SEQ ID NO: 575941 - DNA, 13 bp, D. melanogaster
agaacgttgtgga

SEQ ID NO: 575942 - DNA, 13 bp, D. melanogaster
agaactaataaat

SEQ ID NO: 575943 - DNA, 13 bp, D. melanogaster
agaactatatata

SEQ ID NO: 575944 - DNA, 13 bp, D. melanogaster
agaactcacattt

SEQ ID NO: 575945 - DNA, 13 bp, D. melanogaster
agaactcgaacca

SEQ ID NO: 575946 - DNA, 13 bp, D. melanogaster
agaactcttttta

SEQ ID NO: 575947 - DNA, 13 bp, D. melanogaster
agaactgaagaaa

SEQ ID NO: 575948 - DNA, 13 bp, D. melanogaster
agaactgagaaaa

SEQ ID NO: 575949 - DNA, 14 bp, D. melanogaster
agaactgcaggcgt

SEQ ID NO: 575950 - DNA, 13 bp, D. melanogaster
agaactggaatgt

SEQ ID NO: 575951 - DNA, 13 bp, D. melanogaster
agaactgtttgaa

SEQ ID NO: 575952 - DNA, 14 bp, D. melanogaster
agaacttaaaaaga

SEQ ID NO: 575953 - DNA, 13 bp, D. melanogaster
agaacttaaagca

SEQ ID NO: 575954 - DNA, 13 bp, D. melanogaster
agaacttactaaa

SEQ ID NO: 575955 - DNA, 13 bp, D. melanogaster
agaacttattgaa

SEQ ID NO: 575956 - DNA, 13 bp, D. melanogaster
agaacttcaggga

SEQ ID NO: 575957 - DNA, 13 bp, D. melanogaster
agaacttgctatt

SEQ ID NO: 575958 - DNA, 13 bp, D. melanogaster
agaacttgttaaa

SEQ ID NO: 575959 - DNA, 13 bp, D. melanogaster
agaactttaaaac

SEQ ID NO: 575960 - DNA, 13 bp, D. melanogaster
agaactttaaacg

SEQ ID NO: 575961 - DNA, 14 bp, D. melanogaster
agaactttaaacga

SEQ ID NO: 575962 - DNA, 13 bp, D. melanogaster
agaactttcaaaa

SEQ ID NO: 575963 - DNA, 14 bp, D. melanogaster
agaactttcaacga

SEQ ID NO: 575964 - DNA, 14 bp, D. melanogaster
agaactttcagatt

SEQ ID NO: 575965 - DNA, 13 bp, D. melanogaster
agaactttgaact

SEQ ID NO: 575966 - DNA, 14 bp, D. melanogaster
agaactttggcctc

SEQ ID NO: 575967 - DNA, 13 bp, D. melanogaster
agaacttttctga

SEQ ID NO: 575968 - DNA, 13 bp, D. melanogaster
agaacttttcttt

SEQ ID NO: 575969 - DNA, 13 bp, D. melanogaster
agaactttttaaa

SEQ ID NO: 575970 - DNA, 13 bp, D. melanogaster
agaacttttttca

SEQ ID NO: 575971 - DNA, 13 bp, D. melanogaster
agaagaaaaatgc

SEQ ID NO: 575972 - DNA, 13 bp, D. melanogaster
agaagaaactcca

SEQ ID NO: 575973 - DNA, 13 bp, D. melanogaster
agaagaaagtggt

SEQ ID NO: 575974 - DNA, 13 bp, D. melanogaster
agaagaaatcctg

SEQ ID NO: 575975 - DNA, 13 bp, D. melanogaster
agaagaaatttat

SEQ ID NO: 575976 - DNA, 14 bp, D. melanogaster
agaagaacaccaag

SEQ ID NO: 575977 - DNA, 13 bp, D. melanogaster
agaagaagaaact

SEQ ID NO: 575978 - DNA, 13 bp, D. melanogaster
agaagaagcagcc

SEQ ID NO: 575979 - DNA, 13 bp, D. melanogaster
agaagaagcagcg

SEQ ID NO: 575980 - DNA, 14 bp, D. melanogaster
agaagaagcagctg

SEQ ID NO: 575981 - DNA, 15 bp, D. melanogaster
agaagaagcagctgc

SEQ ID NO: 575982 - DNA, 13 bp, D. melanogaster
agaagaagccagc

SEQ ID NO: 575983 - DNA, 13 bp, D. melanogaster
agaagaagcggca

SEQ ID NO: 575984 - DNA, 13 bp, D. melanogaster
agaagaagctaat

SEQ ID NO: 575985 - DNA, 13 bp, D. melanogaster
agaagaagtaaac

SEQ ID NO: 575986 - DNA, 14 bp, D. melanogaster
agaagaatcaaaac

SEQ ID NO: 575987 - DNA, 13 bp, D. melanogaster
agaagagcagcgt

SEQ ID NO: 575988 - DNA, 13 bp, D. melanogaster
agaagaggacaat

SEQ ID NO: 575989 - DNA, 13 bp, D. melanogaster
agaagagtttctt

SEQ ID NO: 575990 - DNA, 13 bp, D. melanogaster
agaagatatatat

SEQ ID NO: 575991 - DNA, 13 bp, D. melanogaster
agaagatattctt

SEQ ID NO: 575992 - DNA, 13 bp, D. melanogaster
agaagatcaaaag

SEQ ID NO: 575993 - DNA, 13 bp, D. melanogaster
agaagatcaacag

SEQ ID NO: 575994 - DNA, 13 bp, D. melanogaster
agaagatcgtaga

SEQ ID NO: 575995 - DNA, 13 bp, D. melanogaster
agaagatcttctt

SEQ ID NO: 575996 - DNA, 13 bp, D. melanogaster
agaagatggcgga

SEQ ID NO: 575997 - DNA, 13 bp, D. melanogaster
agaagatttatca

SEQ ID NO: 575998 - DNA, 13 bp, D. melanogaster
agaagattttcaa

SEQ ID NO: 575999 - DNA, 15 bp, D. melanogaster
agaagcaaattatag

SEQ ID NO: 576000 - DNA, 13 bp, D. melanogaster
agaagcaacagca

SEQ ID NO: 576001 - DNA, 13 bp, D. melanogaster
agaagcaatagaa

SEQ ID NO: 576002 - DNA, 13 bp, D. melanogaster
agaagcaattaaa

SEQ ID NO: 576003 - DNA, 13 bp, D. melanogaster
agaagcagaagca

SEQ ID NO: 576004 - DNA, 14 bp, D. melanogaster
agaagcagaagcag

SEQ ID NO: 576005 - DNA, 13 bp, D. melanogaster
agaagcagaagct

SEQ ID NO: 576006 - DNA, 14 bp, D. melanogaster
agaagcagaggcaa

SEQ ID NO: 576007 - DNA, 13 bp, D. melanogaster
agaagcagcaaca

SEQ ID NO: 576008 - DNA, 22 bp, D. melanogaster
agaagcagcaacaacagcagca

SEQ ID NO: 576009 - DNA, 14 bp, D. melanogaster
agaagcagcagaag

SEQ ID NO: 576010 - DNA, 14 bp, D. melanogaster
agaagcagcagcaa

SEQ ID NO: 576011 - DNA, 13 bp, D. melanogaster
agaagcagcagct

SEQ ID NO: 576012 - DNA, 13 bp, D. melanogaster
agaagcagcagga

SEQ ID NO: 576013 - DNA, 14 bp, D. melanogaster
agaagcagcaggag

SEQ ID NO: 576014 - DNA, 13 bp, D. melanogaster
agaagcagctgcc

SEQ ID NO: 576015 - DNA, 14 bp, D. melanogaster
agaagcagctgcca

SEQ ID NO: 576016 - DNA, 13 bp, D. melanogaster
agaagcaggagca

SEQ ID NO: 576017 - DNA, 13 bp, D. melanogaster
agaagcagtccga

SEQ ID NO: 576018 - DNA, 13 bp, D. melanogaster
agaagcattttaa

SEQ ID NO: 576019 - DNA, 14 bp, D. melanogaster
agaagccaaatcga

SEQ ID NO: 576020 - DNA, 13 bp, D. melanogaster
agaagccaactgg

SEQ ID NO: 576021 - DNA, 14 bp, D. melanogaster
agaagccaccgaac

SEQ ID NO: 576022 - DNA, 13 bp, D. melanogaster
agaagccagaaat

SEQ ID NO: 576023 - DNA, 13 bp, D. melanogaster
agaagcccgcata

SEQ ID NO: 576024 - DNA, 13 bp, D. melanogaster
agaagcccttcaa

SEQ ID NO: 576025 - DNA, 13 bp, D. melanogaster
agaagccgaaagc

SEQ ID NO: 576026 - DNA, 13 bp, D. melanogaster
agaagcgcagaga

SEQ ID NO: 576027 - DNA, 14 bp, D. melanogaster
agaagcgcagagaa

SEQ ID NO: 576028 - DNA, 13 bp, D. melanogaster
agaagcgcataga

SEQ ID NO: 576029 - DNA, 13 bp, D. melanogaster
agaagcggaaaat

SEQ ID NO: 576030 - DNA, 13 bp, D. melanogaster
agaagcggaccaa

SEQ ID NO: 576031 - DNA, 14 bp, D. melanogaster
agaagcggaccaag

SEQ ID NO: 576032 - DNA, 13 bp, D. melanogaster
agaagcggcagaa

SEQ ID NO: 576033 - DNA, 14 bp, D. melanogaster
agaagcgtttccga

SEQ ID NO: 576034 - DNA, 13 bp, D. melanogaster
agaagctaaaacc

SEQ ID NO: 576035 - DNA, 13 bp, D. melanogaster
agaagctaataaa

SEQ ID NO: 576036 - DNA, 13 bp, D. melanogaster
agaagctatagct

SEQ ID NO: 576037 - DNA, 13 bp, D. melanogaster
agaagctcaattc

SEQ ID NO: 576038 - DNA, 14 bp, D. melanogaster
agaagctttacaaa

SEQ ID NO: 576039 - DNA, 13 bp, D. melanogaster
agaaggaaacgtt

SEQ ID NO: 576040 - DNA, 13 bp, D. melanogaster
agaaggaagcgat

SEQ ID NO: 576041 - DNA, 13 bp, D. melanogaster
agaaggaagcgtt

SEQ ID NO: 576042 - DNA, 14 bp, D. melanogaster
agaaggaagcgttt

SEQ ID NO: 576043 - DNA, 13 bp, D. melanogaster
agaaggaagtcaa

SEQ ID NO: 576044 - DNA, 13 bp, D. melanogaster
agaaggaccaaca

SEQ ID NO: 576045 - DNA, 13 bp, D. melanogaster
agaaggagcagcc

SEQ ID NO: 576046 - DNA, 14 bp, D. melanogaster
agaaggagcagcct

SEQ ID NO: 576047 - DNA, 13 bp, D. melanogaster
agaaggcaaaagc

SEQ ID NO: 576048 - DNA, 13 bp, D. melanogaster
agaaggcacccaa

SEQ ID NO: 576049 - DNA, 13 bp, D. melanogaster
agaaggcagcagg

SEQ ID NO: 576050 - DNA, 13 bp, D. melanogaster
agaagggcaaata

SEQ ID NO: 576051 - DNA, 13 bp, D. melanogaster
agaaggggcgtgg

SEQ ID NO: 576052 - DNA, 13 bp, D. melanogaster
agaaggtgggaat

SEQ ID NO: 576053 - DNA, 13 bp, D. melanogaster
agaaggttgagat

SEQ ID NO: 576054 - DNA, 13 bp, D. melanogaster
agaagtaagatga

SEQ ID NO: 576055 - DNA, 13 bp, D. melanogaster
agaagtacatttt

SEQ ID NO: 576056 - DNA, 13 bp, D. melanogaster
agaagtatatata

SEQ ID NO: 576057 - DNA, 13 bp, D. melanogaster
agaagtatttcaa

SEQ ID NO: 576058 - DNA, 13 bp, D. melanogaster
agaagtcattgaa

SEQ ID NO: 576059 - DNA, 13 bp, D. melanogaster
agaagtcattgca

SEQ ID NO: 576060 - DNA, 13 bp, D. melanogaster
agaagtcctgccc

SEQ ID NO: 576061 - DNA, 13 bp, D. melanogaster
agaagtgattcga

SEQ ID NO: 576062 - DNA, 13 bp, D. melanogaster
agaagtgcccgcc

SEQ ID NO: 576063 - DNA, 13 bp, D. melanogaster
agaagtggcagca

SEQ ID NO: 576064 - DNA, 13 bp, D. melanogaster
agaagttagtgga

SEQ ID NO: 576065 - DNA, 13 bp, D. melanogaster
agaagttcttaaa

SEQ ID NO: 576066 - DNA, 13 bp, D. melanogaster
agaagttctttga

SEQ ID NO: 576067 - DNA, 13 bp, D. melanogaster
agaagttctttgg

SEQ ID NO: 576068 - DNA, 13 bp, D. melanogaster
agaagttgaatca

SEQ ID NO: 576069 - DNA, 14 bp, D. melanogaster
agaagttgaatcaa

SEQ ID NO: 576070 - DNA, 13 bp, D. melanogaster
agaagttggccca

SEQ ID NO: 576071 - DNA, 13 bp, D. melanogaster
agaagtttgtgtg

SEQ ID NO: 576072 - DNA, 13 bp, D. melanogaster
agaagttttaaaa

SEQ ID NO: 576073 - DNA, 13 bp, D. melanogaster
agaagtttttcat

SEQ ID NO: 576074 - DNA, 13 bp, D. melanogaster
agaagtttttgtt

SEQ ID NO: 576075 - DNA, 14 bp, D. melanogaster
agaataaaagattc

SEQ ID NO: 576076 - DNA, 13 bp, D. melanogaster
agaataaatgttt

SEQ ID NO: 576077 - DNA, 13 bp, D. melanogaster
agaataagaagca

SEQ ID NO: 576078 - DNA, 14 bp, D. melanogaster
agaataagaagcaa

SEQ ID NO: 576079 - DNA, 13 bp, D. melanogaster
agaatacaggaaa

SEQ ID NO: 576080 - DNA, 13 bp, D. melanogaster
agaatacttggaa

SEQ ID NO: 576081 - DNA, 13 bp, D. melanogaster
agaatactttata

SEQ ID NO: 576082 - DNA, 13 bp, D. melanogaster
agaatatatacaa

SEQ ID NO: 576083 - DNA, 13 bp, D. melanogaster
agaatatatactt

SEQ ID NO: 576084 - DNA, 14 bp, D. melanogaster
agaatatatataca

SEQ ID NO: 576085 - DNA, 13 bp, D. melanogaster
agaatatatatga

SEQ ID NO: 576086 - DNA, 13 bp, D. melanogaster
agaatatcaattt

SEQ ID NO: 576087 - DNA, 13 bp, D. melanogaster
agaatatcgtaat

SEQ ID NO: 576088 - DNA, 13 bp, D. melanogaster
agaatatgatgaa

SEQ ID NO: 576089 - DNA, 13 bp, D. melanogaster
agaatatggagca

SEQ ID NO: 576090 - DNA, 13 bp, D. melanogaster
agaatatgtatat

SEQ ID NO: 576091 - DNA, 13 bp, D. melanogaster
agaatatgtttag

SEQ ID NO: 576092 - DNA, 13 bp, D. melanogaster
agaatattcgaat

SEQ ID NO: 576093 - DNA, 13 bp, D. melanogaster
agaatatttactt

SEQ ID NO: 576094 - DNA, 13 bp, D. melanogaster
agaatatttgtat

SEQ ID NO: 576095 - DNA, 25 bp, D. melanogaster
agaatatttgtcattagagtattca

SEQ ID NO: 576096 - DNA, 13 bp, D. melanogaster
agaatattttgta

SEQ ID NO: 576097 - DNA, 13 bp, D. melanogaster
agaatattttgtt

SEQ ID NO: 576098 - DNA, 13 bp, D. melanogaster
agaatcaaaatta

SEQ ID NO: 576099 - DNA, 13 bp, D. melanogaster
agaatcaaggaca

SEQ ID NO: 576100 - DNA, 13 bp, D. melanogaster
agaatcaattgca

SEQ ID NO: 576101 - DNA, 13 bp, D. melanogaster
agaatcaatttaa

SEQ ID NO: 576102 - DNA, 13 bp, D. melanogaster
agaatcaatttct

SEQ ID NO: 576103 - DNA, 13 bp, D. melanogaster
agaatcagaaata

SEQ ID NO: 576104 - DNA, 13 bp, D. melanogaster
agaatcagaacct

SEQ ID NO: 576105 - DNA, 13 bp, D. melanogaster
agaatcagaatca

SEQ ID NO: 576106 - DNA, 13 bp, D. melanogaster
agaatcagcagca

SEQ ID NO: 576107 - DNA, 13 bp, D. melanogaster
agaatcagccaag

SEQ ID NO: 576108 - DNA, 13 bp, D. melanogaster
agaatccacataa

SEQ ID NO: 576109 - DNA, 13 bp, D. melanogaster
agaatccgaaaga

SEQ ID NO: 576110 - DNA, 13 bp, D. melanogaster
agaatcctctgtt

SEQ ID NO: 576111 - DNA, 13 bp, D. melanogaster
agaatcgaaatcg

SEQ ID NO: 576112 - DNA, 13 bp, D. melanogaster
agaatcgaagaaa

SEQ ID NO: 576113 - DNA, 14 bp, D. melanogaster
agaatcgaatcgaa

SEQ ID NO: 576114 - DNA, 13 bp, D. melanogaster
agaatcggaatca

SEQ ID NO: 576115 - DNA, 14 bp, D. melanogaster
agaatcggaatcgg

SEQ ID NO: 576116 - DNA, 13 bp, D. melanogaster
agaatcggacgga

SEQ ID NO: 576117 - DNA, 13 bp, D. melanogaster
agaatctgagcac

SEQ ID NO: 576118 - DNA, 13 bp, D. melanogaster
agaatctgtatgc

SEQ ID NO: 576119 - DNA, 13 bp, D. melanogaster
agaatctgtgcag

SEQ ID NO: 576120 - DNA, 13 bp, D. melanogaster
agaatcttctttt

SEQ ID NO: 576121 - DNA, 13 bp, D. melanogaster
agaatgaaaactt

SEQ ID NO: 576122 - DNA, 13 bp, D. melanogaster
agaatgaaattat

SEQ ID NO: 576123 - DNA, 13 bp, D. melanogaster
agaatgatgttat

SEQ ID NO: 576124 - DNA, 13 bp, D. melanogaster
agaatgcaagcaa

SEQ ID NO: 576125 - DNA, 13 bp, D. melanogaster
agaatgcatttaa

SEQ ID NO: 576126 - DNA, 13 bp, D. melanogaster
agaatgctatagt

SEQ ID NO: 576127 - DNA, 14 bp, D. melanogaster
agaatgctatagtc

SEQ ID NO: 576128 - DNA, 13 bp, D. melanogaster
agaatgctgagca

SEQ ID NO: 576129 - DNA, 13 bp, D. melanogaster
agaatggaatgga

SEQ ID NO: 576130 - DNA, 13 bp, D. melanogaster
agaatggggaatg

SEQ ID NO: 576131 - DNA, 13 bp, D. melanogaster
agaatgtaaaagc

SEQ ID NO: 576132 - DNA, 13 bp, D. melanogaster
agaatgtaatgtc

SEQ ID NO: 576133 - DNA, 13 bp, D. melanogaster
agaatgtatttat

SEQ ID NO: 576134 - DNA, 13 bp, D. melanogaster
agaatgtatttta

SEQ ID NO: 576135 - DNA, 13 bp, D. melanogaster
agaatgtccgaag

SEQ ID NO: 576136 - DNA, 13 bp, D. melanogaster
agaatgtgaatat

SEQ ID NO: 576137 - DNA, 13 bp, D. melanogaster
agaatgtggcagc

SEQ ID NO: 576138 - DNA, 13 bp, D. melanogaster
agaatgtgtattt

SEQ ID NO: 576139 - DNA, 13 bp, D. melanogaster
agaattataaatg

SEQ ID NO: 576140 - DNA, 13 bp, D. melanogaster
agaattataatag

SEQ ID NO: 576141 - DNA, 14 bp, D. melanogaster
agaattataatagt

SEQ ID NO: 576142 - DNA, 14 bp, D. melanogaster
agaattattatcaa

SEQ ID NO: 576143 - DNA, 13 bp, D. melanogaster
agaattattcatt

SEQ ID NO: 576144 - DNA, 13 bp, D. melanogaster
agaattcaagttt

SEQ ID NO: 576145 - DNA, 13 bp, D. melanogaster
agaattcaattat

SEQ ID NO: 576146 - DNA, 13 bp, D. melanogaster
agaattcagattt

SEQ ID NO: 576147 - DNA, 13 bp, D. melanogaster
agaattccaatac

SEQ ID NO: 576148 - DNA, 13 bp, D. melanogaster
agaattccattag

SEQ ID NO: 576149 - DNA, 14 bp, D. melanogaster
agaattccattagt

SEQ ID NO: 576150 - DNA, 13 bp, D. melanogaster
agaattcccaaat

SEQ ID NO: 576151 - DNA, 13 bp, D. melanogaster
agaattccttggc

SEQ ID NO: 576152 - DNA, 13 bp, D. melanogaster
agaattcgaaaac

SEQ ID NO: 576153 - DNA, 13 bp, D. melanogaster
agaattctgagaa

SEQ ID NO: 576154 - DNA, 13 bp, D. melanogaster
agaattgaagagc

SEQ ID NO: 576155 - DNA, 14 bp, D. melanogaster
agaattgacaattt

SEQ ID NO: 576156 - DNA, 13 bp, D. melanogaster
agaattgagaaca

SEQ ID NO: 576157 - DNA, 13 bp, D. melanogaster
agaattgtgaaat

SEQ ID NO: 576158 - DNA, 13 bp, D. melanogaster
agaatttaatgaa

SEQ ID NO: 576159 - DNA, 13 bp, D. melanogaster
agaatttacataa

SEQ ID NO: 576160 - DNA, 13 bp, D. melanogaster
agaatttattgaa

SEQ ID NO: 576161 - DNA, 13 bp, D. melanogaster
agaatttatttct

SEQ ID NO: 576162 - DNA, 13 bp, D. melanogaster
agaatttcaaaat

SEQ ID NO: 576163 - DNA, 13 bp, D. melanogaster
agaatttcaaatg

SEQ ID NO: 576164 - DNA, 13 bp, D. melanogaster
agaatttcaaatt

SEQ ID NO: 576165 - DNA, 14 bp, D. melanogaster
agaatttcaagttt

SEQ ID NO: 576166 - DNA, 14 bp, D. melanogaster
agaatttccatttt

SEQ ID NO: 576167 - DNA, 13 bp, D. melanogaster
agaatttcttatc

SEQ ID NO: 576168 - DNA, 13 bp, D. melanogaster
agaatttgaatag

SEQ ID NO: 576169 - DNA, 14 bp, D. melanogaster
agaatttgaataga

SEQ ID NO: 576170 - DNA, 13 bp, D. melanogaster
agaatttgcatat

SEQ ID NO: 576171 - DNA, 13 bp, D. melanogaster
agaatttggaaaa

SEQ ID NO: 576172 - DNA, 13 bp, D. melanogaster
agaatttgttaga

SEQ ID NO: 576173 - DNA, 13 bp, D. melanogaster
agaatttgtttta

SEQ ID NO: 576174 - DNA, 13 bp, D. melanogaster
agaattttaaatg

SEQ ID NO: 576175 - DNA, 13 bp, D. melanogaster
agaattttattga

SEQ ID NO: 576176 - DNA, 13 bp, D. melanogaster
agaattttcactt

SEQ ID NO: 576177 - DNA, 13 bp, D. melanogaster
agaattttccgat

SEQ ID NO: 576178 - DNA, 13 bp, D. melanogaster
agaattttccttt

SEQ ID NO: 576179 - DNA, 13 bp, D. melanogaster
agaattttctgtt

SEQ ID NO: 576180 - DNA, 14 bp, D. melanogaster
agaattttctgttt

SEQ ID NO: 576181 - DNA, 13 bp, D. melanogaster
agaattttgaaaa

SEQ ID NO: 576182 - DNA, 14 bp, D. melanogaster
agaatttttaaaga

SEQ ID NO: 576183 - DNA, 14 bp, D. melanogaster
agaatttttaaatg

SEQ ID NO: 576184 - DNA, 13 bp, D. melanogaster
agaatttttcaat

SEQ ID NO: 576185 - DNA, 13 bp, D. melanogaster
agaatttttccaa

SEQ ID NO: 576186 - DNA, 13 bp, D. melanogaster
agacaaaatatat

SEQ ID NO: 576187 - DNA, 13 bp, D. melanogaster
agacaaaatattg

SEQ ID NO: 576188 - DNA, 13 bp, D. melanogaster
agacaaacatttt

SEQ ID NO: 576189 - DNA, 13 bp, D. melanogaster
agacaaagacgca

SEQ ID NO: 576190 - DNA, 13 bp, D. melanogaster
agacaaaggaaat

SEQ ID NO: 576191 - DNA, 13 bp, D. melanogaster
agacaaaggaatt

SEQ ID NO: 576192 - DNA, 15 bp, D. melanogaster
agacaaaggaatttt

SEQ ID NO: 576193 - DNA, 13 bp, D. melanogaster
agacaaaggccaa

SEQ ID NO: 576194 - DNA, 13 bp, D. melanogaster
agacaaatatttg

SEQ ID NO: 576195 - DNA, 13 bp, D. melanogaster
agacaaatgcaaa

SEQ ID NO: 576196 - DNA, 13 bp, D. melanogaster
agacaaatggaaa

SEQ ID NO: 576197 - DNA, 13 bp, D. melanogaster
agacaaattaaat

SEQ ID NO: 576198 - DNA, 13 bp, D. melanogaster
agacaaatttcca

SEQ ID NO: 576199 - DNA, 13 bp, D. melanogaster
agacaaattttaa

SEQ ID NO: 576200 - DNA, 13 bp, D. melanogaster
agacaacaacaat

SEQ ID NO: 576201 - DNA, 13 bp, D. melanogaster
agacaacagcaac

SEQ ID NO: 576202 - DNA, 13 bp, D. melanogaster
agacaacatttat

SEQ ID NO: 576203 - DNA, 13 bp, D. melanogaster
agacaacatttgc

SEQ ID NO: 576204 - DNA, 13 bp, D. melanogaster
agacaacatttta

SEQ ID NO: 576205 - DNA, 13 bp, D. melanogaster
agacaagctccag

SEQ ID NO: 576206 - DNA, 13 bp, D. melanogaster
agacaataaaacc

SEQ ID NO: 576207 - DNA, 13 bp, D. melanogaster
agacaatgcaaat

SEQ ID NO: 576208 - DNA, 13 bp, D. melanogaster
agacaattatttt

SEQ ID NO: 576209 - DNA, 13 bp, D. melanogaster
agacaattcaaag

SEQ ID NO: 576210 - DNA, 13 bp, D. melanogaster
agacaattcaatt

SEQ ID NO: 576211 - DNA, 13 bp, D. melanogaster
agacaattcccaa

SEQ ID NO: 576212 - DNA, 13 bp, D. melanogaster
agacaattgatat

SEQ ID NO: 576213 - DNA, 13 bp, D. melanogaster
agacacaagaact

SEQ ID NO: 576214 - DNA, 13 bp, D. melanogaster
agacacacaatca

SEQ ID NO: 576215 - DNA, 13 bp, D. melanogaster
agacacacacata

SEQ ID NO: 576216 - DNA, 13 bp, D. melanogaster
agacacacacgca

SEQ ID NO: 576217 - DNA, 13 bp, D. melanogaster
agacacacactca

SEQ ID NO: 576218 - DNA, 13 bp, D. melanogaster
agacacacagaca

SEQ ID NO: 576219 - DNA, 13 bp, D. melanogaster
agacacacataca

SEQ ID NO: 576220 - DNA, 13 bp, D. melanogaster
agacacacgcaca

SEQ ID NO: 576221 - DNA, 13 bp, D. melanogaster
agacacagacaca

SEQ ID NO: 576222 - DNA, 13 bp, D. melanogaster
agacacagataca

SEQ ID NO: 576223 - DNA, 13 bp, D. melanogaster
agacacaggcaca

SEQ ID NO: 576224 - DNA, 13 bp, D. melanogaster
agacaccgctggc

SEQ ID NO: 576225 - DNA, 14 bp, D. melanogaster
agacacgcacacac

SEQ ID NO: 576226 - DNA, 13 bp, D. melanogaster
agacacgtgaaat

SEQ ID NO: 576227 - DNA, 13 bp, D. melanogaster
agacactagaatt

SEQ ID NO: 576228 - DNA, 14 bp, D. melanogaster
agacactagaatta

SEQ ID NO: 576229 - DNA, 13 bp, D. melanogaster
agacactggacca

SEQ ID NO: 576230 - DNA, 13 bp, D. melanogaster
agacagaagactc

SEQ ID NO: 576231 - DNA, 13 bp, D. melanogaster
agacagacaccca

SEQ ID NO: 576232 - DNA, 14 bp, D. melanogaster
agacagacagacag

SEQ ID NO: 576233 - DNA, 13 bp, D. melanogaster
agacagacagacg

SEQ ID NO: 576234 - DNA, 13 bp, D. melanogaster
agacagagaacga

SEQ ID NO: 576235 - DNA, 13 bp, D. melanogaster
agacagagacaca

SEQ ID NO: 576236 - DNA, 13 bp, D. melanogaster
agacagagagaca

SEQ ID NO: 576237 - DNA, 13 bp, D. melanogaster
agacagagatggc

SEQ ID NO: 576238 - DNA, 13 bp, D. melanogaster
agacagagcgaga

SEQ ID NO: 576239 - DNA, 13 bp, D. melanogaster
agacagatagata

SEQ ID NO: 576240 - DNA, 13 bp, D. melanogaster
agacagcaacatg

SEQ ID NO: 576241 - DNA, 13 bp, D. melanogaster
agacagcagacag

SEQ ID NO: 576242 - DNA, 13 bp, D. melanogaster
agacagcagcaac

SEQ ID NO: 576243 - DNA, 13 bp, D. melanogaster
agacagcaggcag

SEQ ID NO: 576244 - DNA, 13 bp, D. melanogaster
agacagccaaata

SEQ ID NO: 576245 - DNA, 13 bp, D. melanogaster
agacagccagaca

SEQ ID NO: 576246 - DNA, 14 bp, D. melanogaster
agacagccagacag

SEQ ID NO: 576247 - DNA, 13 bp, D. melanogaster
agacagccagcca

SEQ ID NO: 576248 - DNA, 13 bp, D. melanogaster
agacagctttgat

SEQ ID NO: 576249 - DNA, 13 bp, D. melanogaster
agacaggcagaca

SEQ ID NO: 576250 - DNA, 13 bp, D. melanogaster
agacagggacaga

SEQ ID NO: 576251 - DNA, 13 bp, D. melanogaster
agacagtcagaca

SEQ ID NO: 576252 - DNA, 13 bp, D. melanogaster
agacagttttatt

SEQ ID NO: 576253 - DNA, 13 bp, D. melanogaster
agacatagacgca

SEQ ID NO: 576254 - DNA, 13 bp, D. melanogaster
agacatatacata

SEQ ID NO: 576255 - DNA, 13 bp, D. melanogaster
agacatatatata

SEQ ID NO: 576256 - DNA, 13 bp, D. melanogaster
agacattaaagag

SEQ ID NO: 576257 - DNA, 13 bp, D. melanogaster
agacattatgcca

SEQ ID NO: 576258 - DNA, 13 bp, D. melanogaster
agacattcagaca

SEQ ID NO: 576259 - DNA, 13 bp, D. melanogaster
agacattcgctgt

SEQ ID NO: 576260 - DNA, 14 bp, D. melanogaster
agacattgaaaaga

SEQ ID NO: 576261 - DNA, 13 bp, D. melanogaster
agacatttaaaaa

SEQ ID NO: 576262 - DNA, 13 bp, D. melanogaster
agacatttaaaca

SEQ ID NO: 576263 - DNA, 13 bp, D. melanogaster
agacatttaattt

SEQ ID NO: 576264 - DNA, 13 bp, D. melanogaster
agacatttatgtt

SEQ ID NO: 576265 - DNA, 13 bp, D. melanogaster
agacatttattga

SEQ ID NO: 576266 - DNA, 13 bp, D. melanogaster
agacatttttaaa

SEQ ID NO: 576267 - DNA, 13 bp, D. melanogaster
agacatttttttt

SEQ ID NO: 576268 - DNA, 13 bp, D. melanogaster
agaccaaaaatat

SEQ ID NO: 576269 - DNA, 13 bp, D. melanogaster
agaccaaaacgca

SEQ ID NO: 576270 - DNA, 13 bp, D. melanogaster
agaccaaacaatt

SEQ ID NO: 576271 - DNA, 13 bp, D. melanogaster
agaccaaagacca

SEQ ID NO: 576272 - DNA, 13 bp, D. melanogaster
agaccaaccaggt

SEQ ID NO: 576273 - DNA, 14 bp, D. melanogaster
agaccaagaccaag

SEQ ID NO: 576274 - DNA, 13 bp, D. melanogaster
agaccacagataa

SEQ ID NO: 576275 - DNA, 13 bp, D. melanogaster
agaccacatatac

SEQ ID NO: 576276 - DNA, 13 bp, D. melanogaster
agaccactgtgca

SEQ ID NO: 576277 - DNA, 13 bp, D. melanogaster
agaccactttttg

SEQ ID NO: 576278 - DNA, 13 bp, D. melanogaster
agaccagaaaatg

SEQ ID NO: 576279 - DNA, 13 bp, D. melanogaster
agaccagagacca

SEQ ID NO: 576280 - DNA, 13 bp, D. melanogaster
agaccagtggcat

SEQ ID NO: 576281 - DNA, 13 bp, D. melanogaster
agaccatcggaca

SEQ ID NO: 576282 - DNA, 13 bp, D. melanogaster
agaccattgtcat

SEQ ID NO: 576283 - DNA, 13 bp, D. melanogaster
agaccatttaatt

SEQ ID NO: 576284 - DNA, 13 bp, D. melanogaster
agacccagaccca

SEQ ID NO: 576285 - DNA, 14 bp, D. melanogaster
agacccattttggg

SEQ ID NO: 576286 - DNA, 13 bp, D. melanogaster
agaccccagaccc

SEQ ID NO: 576287 - DNA, 13 bp, D. melanogaster
agaccgagaagaa

SEQ ID NO: 576288 - DNA, 13 bp, D. melanogaster
agaccgctttatt

SEQ ID NO: 576289 - DNA, 13 bp, D. melanogaster
agacctagctata

SEQ ID NO: 576290 - DNA, 14 bp, D. melanogaster
agacgaagacgaag

SEQ ID NO: 576291 - DNA, 13 bp, D. melanogaster
agacgacgacgac

SEQ ID NO: 576292 - DNA, 13 bp, D. melanogaster
agacgagaacgcg

SEQ ID NO: 576293 - DNA, 13 bp, D. melanogaster
agacgataatggt

SEQ ID NO: 576294 - DNA, 13 bp, D. melanogaster
agacgatgacgat

SEQ ID NO: 576295 - DNA, 13 bp, D. melanogaster
agacgattttcgg

SEQ ID NO: 576296 - DNA, 13 bp, D. melanogaster
agacgcagacaca

SEQ ID NO: 576297 - DNA, 13 bp, D. melanogaster
agacgcagcagca

SEQ ID NO: 576298 - DNA, 13 bp, D. melanogaster
agacgcagcgcaa

SEQ ID NO: 576299 - DNA, 13 bp, D. melanogaster
agacgcagctcaa

SEQ ID NO: 576300 - DNA, 13 bp, D. melanogaster
agacgcagtgcaa

SEQ ID NO: 576301 - DNA, 13 bp, D. melanogaster
agacgcattttta

SEQ ID NO: 576302 - DNA, 13 bp, D. melanogaster
agacgcggtcttg

SEQ ID NO: 576303 - DNA, 13 bp, D. melanogaster
agacgctggaaag

SEQ ID NO: 576304 - DNA, 13 bp, D. melanogaster
agacggacatgac

SEQ ID NO: 576305 - DNA, 13 bp, D. melanogaster
agacggagacgga

SEQ ID NO: 576306 - DNA, 14 bp, D. melanogaster
agacggagacggag

SEQ ID NO: 576307 - DNA, 13 bp, D. melanogaster
agacggggaaaat

SEQ ID NO: 576308 - DNA, 13 bp, D. melanogaster
agacggtctcctt

SEQ ID NO: 576309 - DNA, 13 bp, D. melanogaster
agacgtcgatggt

SEQ ID NO: 576310 - DNA, 13 bp, D. melanogaster
agactacaatcta

SEQ ID NO: 576311 - DNA, 13 bp, D. melanogaster
agactatcgccaa

SEQ ID NO: 576312 - DNA, 13 bp, D. melanogaster
agactatgacatt

SEQ ID NO: 576313 - DNA, 13 bp, D. melanogaster
agactcaaaacta

SEQ ID NO: 576314 - DNA, 13 bp, D. melanogaster
agactcatcgcgg

SEQ ID NO: 576315 - DNA, 13 bp, D. melanogaster
agactgaaaatca

SEQ ID NO: 576316 - DNA, 13 bp, D. melanogaster
agactgaagactg

SEQ ID NO: 576317 - DNA, 13 bp, D. melanogaster
agactgagactga

SEQ ID NO: 576318 - DNA, 13 bp, D. melanogaster
agactgatttttt

SEQ ID NO: 576319 - DNA, 13 bp, D. melanogaster
agactggaaaaac

SEQ ID NO: 576320 - DNA, 13 bp, D. melanogaster
agactggaatgga

SEQ ID NO: 576321 - DNA, 13 bp, D. melanogaster
agactggccaact

SEQ ID NO: 576322 - DNA, 13 bp, D. melanogaster
agacttaagcaac

SEQ ID NO: 576323 - DNA, 13 bp, D. melanogaster
agacttaattgac

SEQ ID NO: 576324 - DNA, 13 bp, D. melanogaster
agacttcagcaaa

SEQ ID NO: 576325 - DNA, 13 bp, D. melanogaster
agacttggaggag

SEQ ID NO: 576326 - DNA, 13 bp, D. melanogaster
agactttaaatat

SEQ ID NO: 576327 - DNA, 14 bp, D. melanogaster
agactttaaatata

SEQ ID NO: 576328 - DNA, 13 bp, D. melanogaster
agactttaaatct

SEQ ID NO: 576329 - DNA, 13 bp, D. melanogaster
agactttatccta

SEQ ID NO: 576330 - DNA, 14 bp, D. melanogaster
agactttatcctat

SEQ ID NO: 576331 - DNA, 15 bp, D. melanogaster
agactttcaaatgtt

SEQ ID NO: 576332 - DNA, 13 bp, D. melanogaster
agactttctaggt

SEQ ID NO: 576333 - DNA, 13 bp, D. melanogaster
agactttgtcgaa

SEQ ID NO: 576334 - DNA, 13 bp, D. melanogaster
agactttttaaaa

SEQ ID NO: 576335 - DNA, 13 bp, D. melanogaster
agactttttcatt

SEQ ID NO: 576336 - DNA, 13 bp, D. melanogaster
agagaaaaacatg

SEQ ID NO: 576337 - DNA, 13 bp, D. melanogaster
agagaaaactttc

SEQ ID NO: 576338 - DNA, 13 bp, D. melanogaster
agagaaaatagtt

SEQ ID NO: 576339 - DNA, 13 bp, D. melanogaster
agagaaagccaag

SEQ ID NO: 576340 - DNA, 13 bp, D. melanogaster
agagaaagctcag

SEQ ID NO: 576341 - DNA, 13 bp, D. melanogaster
agagaaagctgtc

SEQ ID NO: 576342 - DNA, 13 bp, D. melanogaster
agagaaatatgtg

SEQ ID NO: 576343 - DNA, 13 bp, D. melanogaster
agagaaatattat

SEQ ID NO: 576344 - DNA, 13 bp, D. melanogaster
agagaaatgcaaa

SEQ ID NO: 576345 - DNA, 13 bp, D. melanogaster
agagaaatttcaa

SEQ ID NO: 576346 - DNA, 13 bp, D. melanogaster
agagaacaatatt

SEQ ID NO: 576347 - DNA, 14 bp, D. melanogaster
agagaacaatatta

SEQ ID NO: 576348 - DNA, 13 bp, D. melanogaster
agagaacaggaac

SEQ ID NO: 576349 - DNA, 13 bp, D. melanogaster
agagaacgaaagc

SEQ ID NO: 576350 - DNA, 13 bp, D. melanogaster
agagaacgctata

SEQ ID NO: 576351 - DNA, 14 bp, D. melanogaster
agagaactacgacc

SEQ ID NO: 576352 - DNA, 13 bp, D. melanogaster
agagaactgcaag

SEQ ID NO: 576353 - DNA, 13 bp, D. melanogaster
agagaaggaagtc

SEQ ID NO: 576354 - DNA, 13 bp, D. melanogaster
agagaagttaaat

SEQ ID NO: 576355 - DNA, 13 bp, D. melanogaster
agagaatactata

SEQ ID NO: 576356 - DNA, 13 bp, D. melanogaster
agagaatagtttg

SEQ ID NO: 576357 - DNA, 13 bp, D. melanogaster
agagaatatatat

SEQ ID NO: 576358 - DNA, 13 bp, D. melanogaster
agagaatcaactg

SEQ ID NO: 576359 - DNA, 13 bp, D. melanogaster
agagaatcaattg

SEQ ID NO: 576360 - DNA, 13 bp, D. melanogaster
agagaatgataag

SEQ ID NO: 576361 - DNA, 13 bp, D. melanogaster
agagaattccctg

SEQ ID NO: 576362 - DNA, 13 bp, D. melanogaster
agagaatttttaa

SEQ ID NO: 576363 - DNA, 13 bp, D. melanogaster
agagacaaagacg

SEQ ID NO: 576364 - DNA, 15 bp, D. melanogaster
agagacaaatgaaat

SEQ ID NO: 576365 - DNA, 13 bp, D. melanogaster
agagacaacagca

SEQ ID NO: 576366 - DNA, 13 bp, D. melanogaster
agagacagacaga

SEQ ID NO: 576367 - DNA, 14 bp, D. melanogaster
agagacagacagac

SEQ ID NO: 576368 - DNA, 14 bp, D. melanogaster
agagacagagacag

SEQ ID NO: 576369 - DNA, 13 bp, D. melanogaster
agagaccaaccag

SEQ ID NO: 576370 - DNA, 13 bp, D. melanogaster
agagacgacgtca

SEQ ID NO: 576371 - DNA, 14 bp, D. melanogaster
agagacgagaacgc

SEQ ID NO: 576372 - DNA, 13 bp, D. melanogaster
agagagaaatttt

SEQ ID NO: 576373 - DNA, 13 bp, D. melanogaster
agagagaacgcta

SEQ ID NO: 576374 - DNA, 13 bp, D. melanogaster
agagagacagaca

SEQ ID NO: 576375 - DNA, 14 bp, D. melanogaster
agagagagagcagc

SEQ ID NO: 576376 - DNA, 13 bp, D. melanogaster
agagagagagcgc

SEQ ID NO: 576377 - DNA, 14 bp, D. melanogaster
agagagagagcgcg

SEQ ID NO: 576378 - DNA, 13 bp, D. melanogaster
agagagagagcta

SEQ ID NO: 576379 - DNA, 13 bp, D. melanogaster
agagagagagctt

SEQ ID NO: 576380 - DNA, 13 bp, D. melanogaster
agagagagatata

SEQ ID NO: 576381 - DNA, 13 bp, D. melanogaster
agagagagcaggc

SEQ ID NO: 576382 - DNA, 13 bp, D. melanogaster
agagagagcgagc

SEQ ID NO: 576383 - DNA, 14 bp, D. melanogaster
agagagagcgagcg

SEQ ID NO: 576384 - DNA, 13 bp, D. melanogaster
agagagagtgagc

SEQ ID NO: 576385 - DNA, 13 bp, D. melanogaster
agagagcaatttt

SEQ ID NO: 576386 - DNA, 13 bp, D. melanogaster
agagagcagcgga

SEQ ID NO: 576387 - DNA, 13 bp, D. melanogaster
agagagcaggcag

SEQ ID NO: 576388 - DNA, 13 bp, D. melanogaster
agagagccagaga

SEQ ID NO: 576389 - DNA, 13 bp, D. melanogaster
agagagcctggag

SEQ ID NO: 576390 - DNA, 14 bp, D. melanogaster
agagagcgagagcg

SEQ ID NO: 576391 - DNA, 13 bp, D. melanogaster
agagagcgagcga

SEQ ID NO: 576392 - DNA, 13 bp, D. melanogaster
agagagcgcaaga

SEQ ID NO: 576393 - DNA, 13 bp, D. melanogaster
agagagtgagagc

SEQ ID NO: 576394 - DNA, 14 bp, D. melanogaster
agagagtgagagcg

SEQ ID NO: 576395 - DNA, 14 bp, D. melanogaster
agagagtgagtgag

SEQ ID NO: 576396 - DNA, 13 bp, D. melanogaster
agagagtgtggag

SEQ ID NO: 576397 - DNA, 13 bp, D. melanogaster
agagataagaact

SEQ ID NO: 576398 - DNA, 13 bp, D. melanogaster
agagataagaatg

SEQ ID NO: 576399 - DNA, 13 bp, D. melanogaster
agagatacaaaga

SEQ ID NO: 576400 - DNA, 13 bp, D. melanogaster
agagatacaaatt

SEQ ID NO: 576401 - DNA, 13 bp, D. melanogaster
agagatatacaaa

SEQ ID NO: 576402 - DNA, 13 bp, D. melanogaster
agagatatagaga

SEQ ID NO: 576403 - DNA, 13 bp, D. melanogaster
agagatatctgca

SEQ ID NO: 576404 - DNA, 13 bp, D. melanogaster
agagatccggcag

SEQ ID NO: 576405 - DNA, 13 bp, D. melanogaster
agagatggaaaat

SEQ ID NO: 576406 - DNA, 13 bp, D. melanogaster
agagatggaaagc

SEQ ID NO: 576407 - DNA, 14 bp, D. melanogaster
agagatggagatgg

SEQ ID NO: 576408 - DNA, 13 bp, D. melanogaster
agagatggccaaa

SEQ ID NO: 576409 - DNA, 13 bp, D. melanogaster
agagatggcgatt

SEQ ID NO: 576410 - DNA, 13 bp, D. melanogaster
agagatgggcaaa

SEQ ID NO: 576411 - DNA, 13 bp, D. melanogaster
agagattaacttt

SEQ ID NO: 576412 - DNA, 13 bp, D. melanogaster
agagattccactc

SEQ ID NO: 576413 - DNA, 13 bp, D. melanogaster
agagcaaaaaatg

SEQ ID NO: 576414 - DNA, 13 bp, D. melanogaster
agagcaaaacttt

SEQ ID NO: 576415 - DNA, 13 bp, D. melanogaster
agagcaaaagagc

SEQ ID NO: 576416 - DNA, 13 bp, D. melanogaster
agagcaaacaata

SEQ ID NO: 576417 - DNA, 13 bp, D. melanogaster
agagcaaacagca

SEQ ID NO: 576418 - DNA, 13 bp, D. melanogaster
agagcaaatgaaa

SEQ ID NO: 576419 - DNA, 13 bp, D. melanogaster
agagcaaattgaa

SEQ ID NO: 576420 - DNA, 13 bp, D. melanogaster
agagcaacaacag

SEQ ID NO: 576421 - DNA, 13 bp, D. melanogaster
agagcaacaacat

SEQ ID NO: 576422 - DNA, 13 bp, D. melanogaster
agagcaacaataa

SEQ ID NO: 576423 - DNA, 13 bp, D. melanogaster
agagcaacaattt

SEQ ID NO: 576424 - DNA, 14 bp, D. melanogaster
agagcaacagcaac

SEQ ID NO: 576425 - DNA, 13 bp, D. melanogaster
agagcaactcaca

SEQ ID NO: 576426 - DNA, 13 bp, D. melanogaster
agagcaactgaac

SEQ ID NO: 576427 - DNA, 15 bp, D. melanogaster
agagcaagaagaatg

SEQ ID NO: 576428 - DNA, 13 bp, D. melanogaster
agagcaagagcaa

SEQ ID NO: 576429 - DNA, 13 bp, D. melanogaster
agagcaagttcag

SEQ ID NO: 576430 - DNA, 13 bp, D. melanogaster
agagcaataaata

SEQ ID NO: 576431 - DNA, 13 bp, D. melanogaster
agagcaataacaa

SEQ ID NO: 576432 - DNA, 13 bp, D. melanogaster
agagcaatggata

SEQ ID NO: 576433 - DNA, 13 bp, D. melanogaster
agagcaattaaat

SEQ ID NO: 576434 - DNA, 13 bp, D. melanogaster
agagcaattagaa

SEQ ID NO: 576435 - DNA, 13 bp, D. melanogaster
agagcacaaaaat

SEQ ID NO: 576436 - DNA, 15 bp, D. melanogaster
agagcacacacacac

SEQ ID NO: 576437 - DNA, 13 bp, D. melanogaster
agagcacgcggag

SEQ ID NO: 576438 - DNA, 13 bp, D. melanogaster
agagcagagcaaa

SEQ ID NO: 576439 - DNA, 13 bp, D. melanogaster
agagcagagcaga

SEQ ID NO: 576440 - DNA, 13 bp, D. melanogaster
agagcagagcagc

SEQ ID NO: 576441 - DNA, 13 bp, D. melanogaster
agagcagcaacaa

SEQ ID NO: 576442 - DNA, 13 bp, D. melanogaster
agagcagcagcca

SEQ ID NO: 576443 - DNA, 13 bp, D. melanogaster
agagcagcggaga

SEQ ID NO: 576444 - DNA, 14 bp, D. melanogaster
agagcagcgtatat

SEQ ID NO: 576445 - DNA, 13 bp, D. melanogaster
agagcagctgaaa

SEQ ID NO: 576446 - DNA, 13 bp, D. melanogaster
agagcaggagcgc

SEQ ID NO: 576447 - DNA, 13 bp, D. melanogaster
agagcatcagcaa

SEQ ID NO: 576448 - DNA, 14 bp, D. melanogaster
agagcatcagcaat

SEQ ID NO: 576449 - DNA, 13 bp, D. melanogaster
agagcattaatca

SEQ ID NO: 576450 - DNA, 13 bp, D. melanogaster
agagcattcaaaa

SEQ ID NO: 576451 - DNA, 14 bp, D. melanogaster
agagccaaaaagac

SEQ ID NO: 576452 - DNA, 13 bp, D. melanogaster
agagccaaaagag

SEQ ID NO: 576453 - DNA, 13 bp, D. melanogaster
agagccaaagcca

SEQ ID NO: 576454 - DNA, 13 bp, D. melanogaster
agagccaaataaa

SEQ ID NO: 576455 - DNA, 13 bp, D. melanogaster
agagccaccacca

SEQ ID NO: 576456 - DNA, 13 bp, D. melanogaster
agagccacttctc

SEQ ID NO: 576457 - DNA, 13 bp, D. melanogaster
agagccagtacat

SEQ ID NO: 576458 - DNA, 14 bp, D. melanogaster
agagccagtgcttt

SEQ ID NO: 576459 - DNA, 13 bp, D. melanogaster
agagccatacaaa

SEQ ID NO: 576460 - DNA, 13 bp, D. melanogaster
agagccccaaaaa

SEQ ID NO: 576461 - DNA, 13 bp, D. melanogaster
agagccgcacaaa

SEQ ID NO: 576462 - DNA, 13 bp, D. melanogaster
agagcctggagcc

SEQ ID NO: 576463 - DNA, 13 bp, D. melanogaster
agagcgaaaaata

SEQ ID NO: 576464 - DNA, 13 bp, D. melanogaster
agagcgaaattac

SEQ ID NO: 576465 - DNA, 13 bp, D. melanogaster
agagcgaagagcg

SEQ ID NO: 576466 - DNA, 13 bp, D. melanogaster
agagcgaagtaaa

SEQ ID NO: 576467 - DNA, 14 bp, D. melanogaster
agagcgaagtaaat

SEQ ID NO: 576468 - DNA, 13 bp, D. melanogaster
agagcgacagaga

SEQ ID NO: 576469 - DNA, 14 bp, D. melanogaster
agagcgacagagag

SEQ ID NO: 576470 - DNA, 13 bp, D. melanogaster
agagcgagacgga

SEQ ID NO: 576471 - DNA, 13 bp, D. melanogaster
agagcgagagagc

SEQ ID NO: 576472 - DNA, 14 bp, D. melanogaster
agagcgagagagca

SEQ ID NO: 576473 - DNA, 14 bp, D. melanogaster
agagcgagagagcg

SEQ ID NO: 576474 - DNA, 13 bp, D. melanogaster
agagcgagagtga

SEQ ID NO: 576475 - DNA, 13 bp, D. melanogaster
agagcgagatagc

SEQ ID NO: 576476 - DNA, 13 bp, D. melanogaster
agagcgagatggc

SEQ ID NO: 576477 - DNA, 13 bp, D. melanogaster
agagcgagcattt

SEQ ID NO: 576478 - DNA, 13 bp, D. melanogaster
agagcgagcgaaa

SEQ ID NO: 576479 - DNA, 13 bp, D. melanogaster
agagcgagcgaga

SEQ ID NO: 576480 - DNA, 14 bp, D. melanogaster
agagcgagcgagag

SEQ ID NO: 576481 - DNA, 13 bp, D. melanogaster
agagcgagcgagc

SEQ ID NO: 576482 - DNA, 14 bp, D. melanogaster
agagcgagcgagcg

SEQ ID NO: 576483 - DNA, 13 bp, D. melanogaster
agagcgagcgcga

SEQ ID NO: 576484 - DNA, 14 bp, D. melanogaster
agagcgagtgagag

SEQ ID NO: 576485 - DNA, 13 bp, D. melanogaster
agagcgcagaaaa

SEQ ID NO: 576486 - DNA, 13 bp, D. melanogaster
agagcggaaaagc

SEQ ID NO: 576487 - DNA, 13 bp, D. melanogaster
agagcggcaaaaa

SEQ ID NO: 576488 - DNA, 13 bp, D. melanogaster
agagcggcaacaa

SEQ ID NO: 576489 - DNA, 14 bp, D. melanogaster
agagcggcagagag

SEQ ID NO: 576490 - DNA, 14 bp, D. melanogaster
agagctaaaagata

SEQ ID NO: 576491 - DNA, 13 bp, D. melanogaster
agagctacaacaa

SEQ ID NO: 576492 - DNA, 13 bp, D. melanogaster
agagctcggagcc

SEQ ID NO: 576493 - DNA, 13 bp, D. melanogaster
agagctgcgaaaa

SEQ ID NO: 576494 - DNA, 13 bp, D. melanogaster
agagctgctgcag

SEQ ID NO: 576495 - DNA, 13 bp, D. melanogaster
agagcttatgcgc

SEQ ID NO: 576496 - DNA, 13 bp, D. melanogaster
agagcttttacga

SEQ ID NO: 576497 - DNA, 13 bp, D. melanogaster
agaggaaaacttt

SEQ ID NO: 576498 - DNA, 13 bp, D. melanogaster
agaggaaaatact

SEQ ID NO: 576499 - DNA, 13 bp, D. melanogaster
agaggaaaatcaa

SEQ ID NO: 576500 - DNA, 13 bp, D. melanogaster
agaggaaatacat

SEQ ID NO: 576501 - DNA, 13 bp, D. melanogaster
agaggaagatctt

SEQ ID NO: 576502 - DNA, 13 bp, D. melanogaster
agaggaatataat

SEQ ID NO: 576503 - DNA, 13 bp, D. melanogaster
agaggatctcagt

SEQ ID NO: 576504 - DNA, 13 bp, D. melanogaster
agaggcaaattta

SEQ ID NO: 576505 - DNA, 13 bp, D. melanogaster
agaggcaacaaca

SEQ ID NO: 576506 - DNA, 13 bp, D. melanogaster
agaggcaactacc

SEQ ID NO: 576507 - DNA, 14 bp, D. melanogaster
agaggcacacgagt

SEQ ID NO: 576508 - DNA, 13 bp, D. melanogaster
agaggcacttttg

SEQ ID NO: 576509 - DNA, 13 bp, D. melanogaster
agaggcagaagca

SEQ ID NO: 576510 - DNA, 13 bp, D. melanogaster
agaggcagaggtg

SEQ ID NO: 576511 - DNA, 14 bp, D. melanogaster
agaggcagcagcag

SEQ ID NO: 576512 - DNA, 13 bp, D. melanogaster
agaggcaggccgc

SEQ ID NO: 576513 - DNA, 13 bp, D. melanogaster
agaggcattaaaa

SEQ ID NO: 576514 - DNA, 13 bp, D. melanogaster
agaggcggatgag

SEQ ID NO: 576515 - DNA, 13 bp, D. melanogaster
agaggcgtctgca

SEQ ID NO: 576516 - DNA, 13 bp, D. melanogaster
agaggctaataaa

SEQ ID NO: 576517 - DNA, 13 bp, D. melanogaster
agaggctaccttc

SEQ ID NO: 576518 - DNA, 13 bp, D. melanogaster
agagggaaatgtt

SEQ ID NO: 576519 - DNA, 13 bp, D. melanogaster
agaggtcataaag

SEQ ID NO: 576520 - DNA, 14 bp, D. melanogaster
agaggtcataaaga

SEQ ID NO: 576521 - DNA, 13 bp, D. melanogaster
agaggtcatcaat

SEQ ID NO: 576522 - DNA, 13 bp, D. melanogaster
agaggtggtcaaa

SEQ ID NO: 576523 - DNA, 13 bp, D. melanogaster
agaggttagtggt

SEQ ID NO: 576524 - DNA, 13 bp, D. melanogaster
agaggtttggcca

SEQ ID NO: 576525 - DNA, 13 bp, D. melanogaster
agagtaaaagagt

SEQ ID NO: 576526 - DNA, 13 bp, D. melanogaster
agagtaacaacaa

SEQ ID NO: 576527 - DNA, 14 bp, D. melanogaster
agagtagtttttga

SEQ ID NO: 576528 - DNA, 14 bp, D. melanogaster
agagtatatatata

SEQ ID NO: 576529 - DNA, 13 bp, D. melanogaster
agagtatctaaag

SEQ ID NO: 576530 - DNA, 14 bp, D. melanogaster
agagtatggcgcaa

SEQ ID NO: 576531 - DNA, 13 bp, D. melanogaster
agagtattcagct

SEQ ID NO: 576532 - DNA, 13 bp, D. melanogaster
agagtatttaata

SEQ ID NO: 576533 - DNA, 13 bp, D. melanogaster
agagtcagagtca

SEQ ID NO: 576534 - DNA, 13 bp, D. melanogaster
agagtccacagtt

SEQ ID NO: 576535 - DNA, 13 bp, D. melanogaster
agagtcgttgaac

SEQ ID NO: 576536 - DNA, 13 bp, D. melanogaster
agagtctgaagaa

SEQ ID NO: 576537 - DNA, 13 bp, D. melanogaster
agagtgacgatga

SEQ ID NO: 576538 - DNA, 13 bp, D. melanogaster
agagtgagacaga

SEQ ID NO: 576539 - DNA, 13 bp, D. melanogaster
agagtgagagagc

SEQ ID NO: 576540 - DNA, 13 bp, D. melanogaster
agagtgagcgaga

SEQ ID NO: 576541 - DNA, 15 bp, D. melanogaster
agagtgcagtgtata

SEQ ID NO: 576542 - DNA, 13 bp, D. melanogaster
agagtggacgtgg

SEQ ID NO: 576543 - DNA, 13 bp, D. melanogaster
agagtggagtgga

SEQ ID NO: 576544 - DNA, 14 bp, D. melanogaster
agagtgggcaaacg

SEQ ID NO: 576545 - DNA, 13 bp, D. melanogaster
agagtgggcgtga

SEQ ID NO: 576546 - DNA, 13 bp, D. melanogaster
agagtgtggagtg

SEQ ID NO: 576547 - DNA, 14 bp, D. melanogaster
agagtgtgtgcgtg

SEQ ID NO: 576548 - DNA, 14 bp, D. melanogaster
agagttagagttag

SEQ ID NO: 576549 - DNA, 13 bp, D. melanogaster
agagttcccagtg

SEQ ID NO: 576550 - DNA, 13 bp, D. melanogaster
agagttgacattt

SEQ ID NO: 576551 - DNA, 13 bp, D. melanogaster
agagttgagtggg

SEQ ID NO: 576552 - DNA, 13 bp, D. melanogaster
agagttgcatttg

SEQ ID NO: 576553 - DNA, 13 bp, D. melanogaster
agagttggaggaa

SEQ ID NO: 576554 - DNA, 13 bp, D. melanogaster
agagttttacaac

SEQ ID NO: 576555 - DNA, 13 bp, D. melanogaster
agagttttcattg

SEQ ID NO: 576556 - DNA, 13 bp, D. melanogaster
agagttttcccaa

SEQ ID NO: 576557 - DNA, 13 bp, D. melanogaster
agagttttgaaaa

SEQ ID NO: 576558 - DNA, 13 bp, D. melanogaster
agataaaaacatt

SEQ ID NO: 576559 - DNA, 13 bp, D. melanogaster
agataaaaagttt

SEQ ID NO: 576560 - DNA, 14 bp, D. melanogaster
agataaaaccaaac

SEQ ID NO: 576561 - DNA, 13 bp, D. melanogaster
agataaacaaact

SEQ ID NO: 576562 - DNA, 13 bp, D. melanogaster
agataaacacaca

SEQ ID NO: 576563 - DNA, 14 bp, D. melanogaster
agataaacgaatgc

SEQ ID NO: 576564 - DNA, 13 bp, D. melanogaster
agataaacgacgc

SEQ ID NO: 576565 - DNA, 13 bp, D. melanogaster
agataaagaattt

SEQ ID NO: 576566 - DNA, 13 bp, D. melanogaster
agataaagataca

SEQ ID NO: 576567 - DNA, 14 bp, D. melanogaster
agataaagatacaa

SEQ ID NO: 576568 - DNA, 13 bp, D. melanogaster
agataaagatatt

SEQ ID NO: 576569 - DNA, 13 bp, D. melanogaster
agataaagtatct

SEQ ID NO: 576570 - DNA, 13 bp, D. melanogaster
agataaagtatta

SEQ ID NO: 576571 - DNA, 14 bp, D. melanogaster
agataaagtattac

SEQ ID NO: 576572 - DNA, 13 bp, D. melanogaster
agataaatccata

SEQ ID NO: 576573 - DNA, 13 bp, D. melanogaster
agataaatgtata

SEQ ID NO: 576574 - DNA, 13 bp, D. melanogaster
agataacaaaatc

SEQ ID NO: 576575 - DNA, 13 bp, D. melanogaster
agataacaattca

SEQ ID NO: 576576 - DNA, 13 bp, D. melanogaster
agataacatacaa

SEQ ID NO: 576577 - DNA, 13 bp, D. melanogaster
agataacattttt

SEQ ID NO: 576578 - DNA, 13 bp, D. melanogaster
agataaccaaatt

SEQ ID NO: 576579 - DNA, 13 bp, D. melanogaster
agataacttttgc

SEQ ID NO: 576580 - DNA, 14 bp, D. melanogaster
agataagataagat

SEQ ID NO: 576581 - DNA, 13 bp, D. melanogaster
agataagcacacg

SEQ ID NO: 576582 - DNA, 13 bp, D. melanogaster
agataaggtaaac

SEQ ID NO: 576583 - DNA, 13 bp, D. melanogaster
agataataatgat

SEQ ID NO: 576584 - DNA, 13 bp, D. melanogaster
agataatcatgtc

SEQ ID NO: 576585 - DNA, 14 bp, D. melanogaster
agataatcatgtcg

SEQ ID NO: 576586 - DNA, 13 bp, D. melanogaster
agataattccaaa

SEQ ID NO: 576587 - DNA, 13 bp, D. melanogaster
agataattgaggc

SEQ ID NO: 576588 - DNA, 13 bp, D. melanogaster
agatacaaaacac

SEQ ID NO: 576589 - DNA, 13 bp, D. melanogaster
agatacaaaatat

SEQ ID NO: 576590 - DNA, 14 bp, D. melanogaster
agatacaaaatatt

SEQ ID NO: 576591 - DNA, 13 bp, D. melanogaster
agatacaaaatgt

SEQ ID NO: 576592 - DNA, 13 bp, D. melanogaster
agatacaaacaca

SEQ ID NO: 576593 - DNA, 13 bp, D. melanogaster
agatacaaagata

SEQ ID NO: 576594 - DNA, 14 bp, D. melanogaster
agatacaaagatac

SEQ ID NO: 576595 - DNA, 13 bp, D. melanogaster
agatacaaagcta

SEQ ID NO: 576596 - DNA, 13 bp, D. melanogaster
agatacaaatata

SEQ ID NO: 576597 - DNA, 14 bp, D. melanogaster
agatacaaatatat

SEQ ID NO: 576598 - DNA, 13 bp, D. melanogaster
agatacaaatatt

SEQ ID NO: 576599 - DNA, 13 bp, D. melanogaster
agatacaaattga

SEQ ID NO: 576600 - DNA, 13 bp, D. melanogaster
agatacaacaaat

SEQ ID NO: 576601 - DNA, 13 bp, D. melanogaster
agatacaagatac

SEQ ID NO: 576602 - DNA, 14 bp, D. melanogaster
agatacaagataca

SEQ ID NO: 576603 - DNA, 14 bp, D. melanogaster
agatacaagatact

SEQ ID NO: 576604 - DNA, 13 bp, D. melanogaster
agatacaatatct

SEQ ID NO: 576605 - DNA, 14 bp, D. melanogaster
agatacaatatctt

SEQ ID NO: 576606 - DNA, 13 bp, D. melanogaster
agatacaattaaa

SEQ ID NO: 576607 - DNA, 13 bp, D. melanogaster
agatacacacact

SEQ ID NO: 576608 - DNA, 13 bp, D. melanogaster
agatacacacaga

SEQ ID NO: 576609 - DNA, 13 bp, D. melanogaster
agatacacacgca

SEQ ID NO: 576610 - DNA, 13 bp, D. melanogaster
agatacacataca

SEQ ID NO: 576611 - DNA, 13 bp, D. melanogaster
agatacagataca

SEQ ID NO: 576612 - DNA, 13 bp, D. melanogaster
agatacagatacc

SEQ ID NO: 576613 - DNA, 14 bp, D. melanogaster
agatacagataccg

SEQ ID NO: 576614 - DNA, 13 bp, D. melanogaster
agatacagatacg

SEQ ID NO: 576615 - DNA, 14 bp, D. melanogaster
agatacagatacga

SEQ ID NO: 576616 - DNA, 14 bp, D. melanogaster
agatacagatacgg

SEQ ID NO: 576617 - DNA, 13 bp, D. melanogaster
agatacagatact

SEQ ID NO: 576618 - DNA, 14 bp, D. melanogaster
agatacagatactt

SEQ ID NO: 576619 - DNA, 13 bp, D. melanogaster
agatacagatgca

SEQ ID NO: 576620 - DNA, 14 bp, D. melanogaster
agatacagatgcag

SEQ ID NO: 576621 - DNA, 13 bp, D. melanogaster
agatacagattca

SEQ ID NO: 576622 - DNA, 14 bp, D. melanogaster
agatacagattcag

SEQ ID NO: 576623 - DNA, 13 bp, D. melanogaster
agatacagattcg

SEQ ID NO: 576624 - DNA, 13 bp, D. melanogaster
agatacagctaca

SEQ ID NO: 576625 - DNA, 13 bp, D. melanogaster
agatacagtatct

SEQ ID NO: 576626 - DNA, 14 bp, D. melanogaster
agatacatacatac

SEQ ID NO: 576627 - DNA, 13 bp, D. melanogaster
agatacatagata

SEQ ID NO: 576628 - DNA, 14 bp, D. melanogaster
agatacatagatac

SEQ ID NO: 576629 - DNA, 14 bp, D. melanogaster
agatacatagatag

SEQ ID NO: 576630 - DNA, 13 bp, D. melanogaster
agatacatataaa

SEQ ID NO: 576631 - DNA, 13 bp, D. melanogaster
agatacatatata

SEQ ID NO: 576632 - DNA, 15 bp, D. melanogaster
agatacatatatata

SEQ ID NO: 576633 - DNA, 13 bp, D. melanogaster
agatacatatatc

SEQ ID NO: 576634 - DNA, 13 bp, D. melanogaster
agatacatatttt

SEQ ID NO: 576635 - DNA, 13 bp, D. melanogaster
agatacatttaat

SEQ ID NO: 576636 - DNA, 13 bp, D. melanogaster
agatacatttaca

SEQ ID NO: 576637 - DNA, 13 bp, D. melanogaster
agatacatttcaa

SEQ ID NO: 576638 - DNA, 13 bp, D. melanogaster
agatacatttgca

SEQ ID NO: 576639 - DNA, 13 bp, D. melanogaster
agatacatttgta

SEQ ID NO: 576640 - DNA, 14 bp, D. melanogaster
agatacatttgtat

SEQ ID NO: 576641 - DNA, 13 bp, D. melanogaster
agataccagatac

SEQ ID NO: 576642 - DNA, 13 bp, D. melanogaster
agataccctttac

SEQ ID NO: 576643 - DNA, 13 bp, D. melanogaster
agatacgagatac

SEQ ID NO: 576644 - DNA, 13 bp, D. melanogaster
agatacggataca

SEQ ID NO: 576645 - DNA, 13 bp, D. melanogaster
agatacgtagata

SEQ ID NO: 576646 - DNA, 13 bp, D. melanogaster
agatactagatac

SEQ ID NO: 576647 - DNA, 13 bp, D. melanogaster
agatactagatat

SEQ ID NO: 576648 - DNA, 13 bp, D. melanogaster
agatactatatat

SEQ ID NO: 576649 - DNA, 14 bp, D. melanogaster
agatactccactta

SEQ ID NO: 576650 - DNA, 13 bp, D. melanogaster
agatactcggata

SEQ ID NO: 576651 - DNA, 14 bp, D. melanogaster
agatactgagatac

SEQ ID NO: 576652 - DNA, 13 bp, D. melanogaster
agatactgtatct

SEQ ID NO: 576653 - DNA, 13 bp, D. melanogaster
agatacttagata

SEQ ID NO: 576654 - DNA, 14 bp, D. melanogaster
agatacttagatac

SEQ ID NO: 576655 - DNA, 13 bp, D. melanogaster
agatactttatta

SEQ ID NO: 576656 - DNA, 13 bp, D. melanogaster
agatacttttgca

SEQ ID NO: 576657 - DNA, 14 bp, D. melanogaster
agatacttttgtat

SEQ ID NO: 576658 - DNA, 13 bp, D. melanogaster
agatactttttaa

SEQ ID NO: 576659 - DNA, 13 bp, D. melanogaster
agatactttttat

SEQ ID NO: 576660 - DNA, 13 bp, D. melanogaster
agatagaaagcat

SEQ ID NO: 576661 - DNA, 13 bp, D. melanogaster
agatagagataca

SEQ ID NO: 576662 - DNA, 13 bp, D. melanogaster
agatagagataga

SEQ ID NO: 576663 - DNA, 14 bp, D. melanogaster
agatagagatagag

SEQ ID NO: 576664 - DNA, 13 bp, D. melanogaster
agatagatacaca

SEQ ID NO: 576665 - DNA, 13 bp, D. melanogaster
agatagatacata

SEQ ID NO: 576666 - DNA, 13 bp, D. melanogaster
agatagatagaga

SEQ ID NO: 576667 - DNA, 13 bp, D. melanogaster
agatagatataca

SEQ ID NO: 576668 - DNA, 14 bp, D. melanogaster
agatagatatagat

SEQ ID NO: 576669 - DNA, 13 bp, D. melanogaster
agatagatatata

SEQ ID NO: 576670 - DNA, 13 bp, D. melanogaster
agatagccaaaaa

SEQ ID NO: 576671 - DNA, 13 bp, D. melanogaster
agatagcgcgaag

SEQ ID NO: 576672 - DNA, 13 bp, D. melanogaster
agatagcttgaaa

SEQ ID NO: 576673 - DNA, 14 bp, D. melanogaster
agatagcttgaaat

SEQ ID NO: 576674 - DNA, 13 bp, D. melanogaster
agatagtaccgct

SEQ ID NO: 576675 - DNA, 13 bp, D. melanogaster
agatagtccataa

SEQ ID NO: 576676 - DNA, 13 bp, D. melanogaster
agatataataaca

SEQ ID NO: 576677 - DNA, 14 bp, D. melanogaster
agatataatcgaat

SEQ ID NO: 576678 - DNA, 13 bp, D. melanogaster
agatatacataga

SEQ ID NO: 576679 - DNA, 13 bp, D. melanogaster
agatatacatata

SEQ ID NO: 576680 - DNA, 14 bp, D. melanogaster
agatatacatatgt

SEQ ID NO: 576681 - DNA, 13 bp, D. melanogaster
agatatagataca

SEQ ID NO: 576682 - DNA, 13 bp, D. melanogaster
agatatagatatg

SEQ ID NO: 576683 - DNA, 13 bp, D. melanogaster
agatatagccaca

SEQ ID NO: 576684 - DNA, 13 bp, D. melanogaster
agatataggaata

SEQ ID NO: 576685 - DNA, 13 bp, D. melanogaster
agatatatacaca

SEQ ID NO: 576686 - DNA, 13 bp, D. melanogaster
agatatatagata

SEQ ID NO: 576687 - DNA, 14 bp, D. melanogaster
agatatatagatag

SEQ ID NO: 576688 - DNA, 14 bp, D. melanogaster
agatatatatatag

SEQ ID NO: 576689 - DNA, 13 bp, D. melanogaster
agatatatatatc

SEQ ID NO: 576690 - DNA, 14 bp, D. melanogaster
agatatatatatct

SEQ ID NO: 576691 - DNA, 13 bp, D. melanogaster
agatatatatatg

SEQ ID NO: 576692 - DNA, 13 bp, D. melanogaster
agatatatatgta

SEQ ID NO: 576693 - DNA, 14 bp, D. melanogaster
agatatatatgtat

SEQ ID NO: 576694 - DNA, 13 bp, D. melanogaster
agatatatatttc

SEQ ID NO: 576695 - DNA, 13 bp, D. melanogaster
agatatatgcata

SEQ ID NO: 576696 - DNA, 13 bp, D. melanogaster
agatatatgtaca

SEQ ID NO: 576697 - DNA, 13 bp, D. melanogaster
agatatatgtatc

SEQ ID NO: 576698 - DNA, 13 bp, D. melanogaster
agatatatgtatg

SEQ ID NO: 576699 - DNA, 14 bp, D. melanogaster
agatatatgtattt

SEQ ID NO: 576700 - DNA, 13 bp, D. melanogaster
agatatatttcaa

SEQ ID NO: 576701 - DNA, 13 bp, D. melanogaster
agatatattttgt

SEQ ID NO: 576702 - DNA, 13 bp, D. melanogaster
agatatcatggca

SEQ ID NO: 576703 - DNA, 13 bp, D. melanogaster
agatatccagata

SEQ ID NO: 576704 - DNA, 13 bp, D. melanogaster
agatatcctataa

SEQ ID NO: 576705 - DNA, 13 bp, D. melanogaster
agatatcgaaagc

SEQ ID NO: 576706 - DNA, 13 bp, D. melanogaster
agatatgacaaga

SEQ ID NO: 576707 - DNA, 14 bp, D. melanogaster
agatatgcaaaaat

SEQ ID NO: 576708 - DNA, 13 bp, D. melanogaster
agatatgtacata

SEQ ID NO: 576709 - DNA, 14 bp, D. melanogaster
agatatgtacatat

SEQ ID NO: 576710 - DNA, 14 bp, D. melanogaster
agatatgtatatat

SEQ ID NO: 576711 - DNA, 13 bp, D. melanogaster
agatatgtgtaaa

SEQ ID NO: 576712 - DNA, 13 bp, D. melanogaster
agatatgttacct

SEQ ID NO: 576713 - DNA, 13 bp, D. melanogaster
agatattaagata

SEQ ID NO: 576714 - DNA, 13 bp, D. melanogaster
agatattagatat

SEQ ID NO: 576715 - DNA, 13 bp, D. melanogaster
agatattcaaaaa

SEQ ID NO: 576716 - DNA, 13 bp, D. melanogaster
agatattcagata

SEQ ID NO: 576717 - DNA, 13 bp, D. melanogaster
agatattccatta

SEQ ID NO: 576718 - DNA, 14 bp, D. melanogaster
agatattctataga

SEQ ID NO: 576719 - DNA, 13 bp, D. melanogaster
agatattgcaaga

SEQ ID NO: 576720 - DNA, 13 bp, D. melanogaster
agatattggaaca

SEQ ID NO: 576721 - DNA, 13 bp, D. melanogaster
agatattggagaa

SEQ ID NO: 576722 - DNA, 14 bp, D. melanogaster
agatattgggaaat

SEQ ID NO: 576723 - DNA, 13 bp, D. melanogaster
agatatttacgaa

SEQ ID NO: 576724 - DNA, 13 bp, D. melanogaster
agatatttatgca

SEQ ID NO: 576725 - DNA, 13 bp, D. melanogaster
agatatttcaaaa

SEQ ID NO: 576726 - DNA, 13 bp, D. melanogaster
agatatttcaaat

SEQ ID NO: 576727 - DNA, 13 bp, D. melanogaster
agatatttgaagg

SEQ ID NO: 576728 - DNA, 13 bp, D. melanogaster
agatatttgaatt

SEQ ID NO: 576729 - DNA, 13 bp, D. melanogaster
agatatttggatg

SEQ ID NO: 576730 - DNA, 13 bp, D. melanogaster
agatatttggcat

SEQ ID NO: 576731 - DNA, 13 bp, D. melanogaster
agatattttcatt

SEQ ID NO: 576732 - DNA, 13 bp, D. melanogaster
agatattttgaaa

SEQ ID NO: 576733 - DNA, 13 bp, D. melanogaster
agatatttttgaa

SEQ ID NO: 576734 - DNA, 13 bp, D. melanogaster
agatatttttgta

SEQ ID NO: 576735 - DNA, 13 bp, D. melanogaster
agatcaaagatca

SEQ ID NO: 576736 - DNA, 13 bp, D. melanogaster
agatcaaatgttt

SEQ ID NO: 576737 - DNA, 13 bp, D. melanogaster
agatcaaatttat

SEQ ID NO: 576738 - DNA, 13 bp, D. melanogaster
agatcaacaggga

SEQ ID NO: 576739 - DNA, 13 bp, D. melanogaster
agatcaagagtta

SEQ ID NO: 576740 - DNA, 13 bp, D. melanogaster
agatcaaggctct

SEQ ID NO: 576741 - DNA, 13 bp, D. melanogaster
agatcaatcatat

SEQ ID NO: 576742 - DNA, 13 bp, D. melanogaster
agatcacaaaata

SEQ ID NO: 576743 - DNA, 13 bp, D. melanogaster
agatcacaaggtc

SEQ ID NO: 576744 - DNA, 13 bp, D. melanogaster
agatcaccaacat

SEQ ID NO: 576745 - DNA, 13 bp, D. melanogaster
agatcacccattt

SEQ ID NO: 576746 - DNA, 13 bp, D. melanogaster
agatcagatttgt

SEQ ID NO: 576747 - DNA, 13 bp, D. melanogaster
agatcataatgat

SEQ ID NO: 576748 - DNA, 13 bp, D. melanogaster
agatcatcatcat

SEQ ID NO: 576749 - DNA, 13 bp, D. melanogaster
agatcatcttaat

SEQ ID NO: 576750 - DNA, 13 bp, D. melanogaster
agatcatttaaat

SEQ ID NO: 576751 - DNA, 13 bp, D. melanogaster
agatcatttaatt

SEQ ID NO: 576752 - DNA, 13 bp, D. melanogaster
agatcattttgca

SEQ ID NO: 576753 - DNA, 13 bp, D. melanogaster
agatccaaaccaa

SEQ ID NO: 576754 - DNA, 13 bp, D. melanogaster
agatccaaagaat

SEQ ID NO: 576755 - DNA, 13 bp, D. melanogaster
agatccagatgca

SEQ ID NO: 576756 - DNA, 13 bp, D. melanogaster
agatccatttaca

SEQ ID NO: 576757 - DNA, 13 bp, D. melanogaster
agatcccagatcc

SEQ ID NO: 576758 - DNA, 13 bp, D. melanogaster
agatcccgatccc

SEQ ID NO: 576759 - DNA, 13 bp, D. melanogaster
agatccctttgct

SEQ ID NO: 576760 - DNA, 13 bp, D. melanogaster
agatcctcaagaa

SEQ ID NO: 576761 - DNA, 13 bp, D. melanogaster
agatcctgctgct

SEQ ID NO: 576762 - DNA, 13 bp, D. melanogaster
agatcgaaatgga

SEQ ID NO: 576763 - DNA, 13 bp, D. melanogaster
agatcgactcggc

SEQ ID NO: 576764 - DNA, 13 bp, D. melanogaster
agatcgagatcga

SEQ ID NO: 576765 - DNA, 13 bp, D. melanogaster
agatcgcaagcga

SEQ ID NO: 576766 - DNA, 13 bp, D. melanogaster
agatcggcagcta

SEQ ID NO: 576767 - DNA, 14 bp, D. melanogaster
agatcgtggagatc

SEQ ID NO: 576768 - DNA, 14 bp, D. melanogaster
agatcgttaagcag

SEQ ID NO: 576769 - DNA, 13 bp, D. melanogaster
agatctattagcc

SEQ ID NO: 576770 - DNA, 13 bp, D. melanogaster
agatctcaacgtt

SEQ ID NO: 576771 - DNA, 13 bp, D. melanogaster
agatctcgacgtt

SEQ ID NO: 576772 - DNA, 13 bp, D. melanogaster
agatctgaaaaca

SEQ ID NO: 576773 - DNA, 14 bp, D. melanogaster
agatctgaaatcca

SEQ ID NO: 576774 - DNA, 13 bp, D. melanogaster
agatctgccaact

SEQ ID NO: 576775 - DNA, 13 bp, D. melanogaster
agatcttaaagat

SEQ ID NO: 576776 - DNA, 13 bp, D. melanogaster
agatcttctccag

SEQ ID NO: 576777 - DNA, 14 bp, D. melanogaster
agatctttagatac

SEQ ID NO: 576778 - DNA, 13 bp, D. melanogaster
agatgaaaaaatc

SEQ ID NO: 576779 - DNA, 13 bp, D. melanogaster
agatgaaaaatgt

SEQ ID NO: 576780 - DNA, 13 bp, D. melanogaster
agatgaaaatgat

SEQ ID NO: 576781 - DNA, 13 bp, D. melanogaster
agatgaaaatgtt

SEQ ID NO: 576782 - DNA, 13 bp, D. melanogaster
agatgaagactgc

SEQ ID NO: 576783 - DNA, 13 bp, D. melanogaster
agatgaatactct

SEQ ID NO: 576784 - DNA, 13 bp, D. melanogaster
agatgaatatata

SEQ ID NO: 576785 - DNA, 13 bp, D. melanogaster
agatgaatgtcaa

SEQ ID NO: 576786 - DNA, 13 bp, D. melanogaster
agatgaattgatt

SEQ ID NO: 576787 - DNA, 13 bp, D. melanogaster
agatgacgcggaa

SEQ ID NO: 576788 - DNA, 13 bp, D. melanogaster
agatgactctaaa

SEQ ID NO: 576789 - DNA, 13 bp, D. melanogaster
agatgacttcaaa

SEQ ID NO: 576790 - DNA, 13 bp, D. melanogaster
agatgagaaatgg

SEQ ID NO: 576791 - DNA, 13 bp, D. melanogaster
agatgagagatcc

SEQ ID NO: 576792 - DNA, 13 bp, D. melanogaster
agatgaggacaca

SEQ ID NO: 576793 - DNA, 14 bp, D. melanogaster
agatgataatatat

SEQ ID NO: 576794 - DNA, 13 bp, D. melanogaster
agatgataatgat

SEQ ID NO: 576795 - DNA, 13 bp, D. melanogaster
agatgatagagag

SEQ ID NO: 576796 - DNA, 13 bp, D. melanogaster
agatgatataata

SEQ ID NO: 576797 - DNA, 13 bp, D. melanogaster
agatgatatcgag

SEQ ID NO: 576798 - DNA, 13 bp, D. melanogaster
agatgatgaagat

SEQ ID NO: 576799 - DNA, 14 bp, D. melanogaster
agatgatgagccag

SEQ ID NO: 576800 - DNA, 13 bp, D. melanogaster
agatgatgatgac

SEQ ID NO: 576801 - DNA, 13 bp, D. melanogaster
agatgatgatgag

SEQ ID NO: 576802 - DNA, 13 bp, D. melanogaster
agatgcaaagata

SEQ ID NO: 576803 - DNA, 13 bp, D. melanogaster
agatgcaaatgaa

SEQ ID NO: 576804 - DNA, 13 bp, D. melanogaster
agatgcagatacg

SEQ ID NO: 576805 - DNA, 13 bp, D. melanogaster
agatgcagatact

SEQ ID NO: 576806 - DNA, 13 bp, D. melanogaster
agatgcagatata

SEQ ID NO: 576807 - DNA, 13 bp, D. melanogaster
agatgcagatgca

SEQ ID NO: 576808 - DNA, 14 bp, D. melanogaster
agatgcagatgcaa

SEQ ID NO: 576809 - DNA, 13 bp, D. melanogaster
agatgcagatgga

SEQ ID NO: 576810 - DNA, 13 bp, D. melanogaster
agatgcaggaaga

SEQ ID NO: 576811 - DNA, 13 bp, D. melanogaster
agatgccaaaaaa

SEQ ID NO: 576812 - DNA, 14 bp, D. melanogaster
agatgccaaatttt

SEQ ID NO: 576813 - DNA, 13 bp, D. melanogaster
agatgcgatacaa

SEQ ID NO: 576814 - DNA, 13 bp, D. melanogaster
agatgctagtaaa

SEQ ID NO: 576815 - DNA, 13 bp, D. melanogaster
agatgctgatgct

SEQ ID NO: 576816 - DNA, 13 bp, D. melanogaster
agatgctgctgct

SEQ ID NO: 576817 - DNA, 14 bp, D. melanogaster
agatgctgctgctg

SEQ ID NO: 576818 - DNA, 13 bp, D. melanogaster
agatgctggtttg

SEQ ID NO: 576819 - DNA, 13 bp, D. melanogaster
agatggaaaagtt

SEQ ID NO: 576820 - DNA, 13 bp, D. melanogaster
agatggaaaatgg

SEQ ID NO: 576821 - DNA, 13 bp, D. melanogaster
agatggaaaattg

SEQ ID NO: 576822 - DNA, 13 bp, D. melanogaster
agatggaaatgaa

SEQ ID NO: 576823 - DNA, 13 bp, D. melanogaster
agatggaaatgga

SEQ ID NO: 576824 - DNA, 14 bp, D. melanogaster
agatggaaatggaa

SEQ ID NO: 576825 - DNA, 14 bp, D. melanogaster
agatggaaatggag

SEQ ID NO: 576826 - DNA, 13 bp, D. melanogaster
agatggagacgga

SEQ ID NO: 576827 - DNA, 14 bp, D. melanogaster
agatggagacggag

SEQ ID NO: 576828 - DNA, 13 bp, D. melanogaster
agatggagagatg

SEQ ID NO: 576829 - DNA, 14 bp, D. melanogaster
agatggagatggag

SEQ ID NO: 576830 - DNA, 13 bp, D. melanogaster
agatggagctgga

SEQ ID NO: 576831 - DNA, 14 bp, D. melanogaster
agatggagctggag

SEQ ID NO: 576832 - DNA, 13 bp, D. melanogaster
agatggaggtgga

SEQ ID NO: 576833 - DNA, 13 bp, D. melanogaster
agatggagttgga

SEQ ID NO: 576834 - DNA, 13 bp, D. melanogaster
agatggatggatg

SEQ ID NO: 576835 - DNA, 13 bp, D. melanogaster
agatggccaaaaa

SEQ ID NO: 576836 - DNA, 13 bp, D. melanogaster
agatggccaaaag

SEQ ID NO: 576837 - DNA, 13 bp, D. melanogaster
agatggccaacag

SEQ ID NO: 576838 - DNA, 14 bp, D. melanogaster
agatggcccaaaaa

SEQ ID NO: 576839 - DNA, 13 bp, D. melanogaster
agatggcgatggc

SEQ ID NO: 576840 - DNA, 13 bp, D. melanogaster
agatggcgcagct

SEQ ID NO: 576841 - DNA, 13 bp, D. melanogaster
agatgggaaaaat

SEQ ID NO: 576842 - DNA, 13 bp, D. melanogaster
agatgggaatggg

SEQ ID NO: 576843 - DNA, 13 bp, D. melanogaster
agatgggcaaacg

SEQ ID NO: 576844 - DNA, 13 bp, D. melanogaster
agatggggaaaat

SEQ ID NO: 576845 - DNA, 13 bp, D. melanogaster
agatggtagatgg

SEQ ID NO: 576846 - DNA, 13 bp, D. melanogaster
agatggtggtgga

SEQ ID NO: 576847 - DNA, 13 bp, D. melanogaster
agatggttttaat

SEQ ID NO: 576848 - DNA, 13 bp, D. melanogaster
agatgtaagaata

SEQ ID NO: 576849 - DNA, 13 bp, D. melanogaster
agatgtacataca

SEQ ID NO: 576850 - DNA, 13 bp, D. melanogaster
agatgtacatata

SEQ ID NO: 576851 - DNA, 13 bp, D. melanogaster
agatgtagatgta

SEQ ID NO: 576852 - DNA, 13 bp, D. melanogaster
agatgtatctgta

SEQ ID NO: 576853 - DNA, 13 bp, D. melanogaster
agatgtatgtata

SEQ ID NO: 576854 - DNA, 14 bp, D. melanogaster
agatgtatgtatgt

SEQ ID NO: 576855 - DNA, 13 bp, D. melanogaster
agatgtgaagaat

SEQ ID NO: 576856 - DNA, 14 bp, D. melanogaster
agatgtgaagaata

SEQ ID NO: 576857 - DNA, 13 bp, D. melanogaster
agatgtggatgca

SEQ ID NO: 576858 - DNA, 14 bp, D. melanogaster
agatgtggatgtgg

SEQ ID NO: 576859 - DNA, 14 bp, D. melanogaster
agatgtgtgtgtgt

SEQ ID NO: 576860 - DNA, 13 bp, D. melanogaster
agatgttatatct

SEQ ID NO: 576861 - DNA, 13 bp, D. melanogaster
agatgttccaatt

SEQ ID NO: 576862 - DNA, 13 bp, D. melanogaster
agatgttgctgtt

SEQ ID NO: 576863 - DNA, 14 bp, D. melanogaster
agatgttgttgtcg

SEQ ID NO: 576864 - DNA, 13 bp, D. melanogaster
agatgtttcgatt

SEQ ID NO: 576865 - DNA, 13 bp, D. melanogaster
agattaaagacta

SEQ ID NO: 576866 - DNA, 14 bp, D. melanogaster
agattaacttttga

SEQ ID NO: 576867 - DNA, 13 bp, D. melanogaster
agattaagcatgc

SEQ ID NO: 576868 - DNA, 13 bp, D. melanogaster
agattaagcgaat

SEQ ID NO: 576869 - DNA, 13 bp, D. melanogaster
agattaagttcta

SEQ ID NO: 576870 - DNA, 13 bp, D. melanogaster
agattacacagac

SEQ ID NO: 576871 - DNA, 13 bp, D. melanogaster
agattacactgga

SEQ ID NO: 576872 - DNA, 13 bp, D. melanogaster
agattacattttt

SEQ ID NO: 576873 - DNA, 14 bp, D. melanogaster
agattacgtatacg

SEQ ID NO: 576874 - DNA, 13 bp, D. melanogaster
agattagaagttg

SEQ ID NO: 576875 - DNA, 14 bp, D. melanogaster
agattagttgaaaa

SEQ ID NO: 576876 - DNA, 13 bp, D. melanogaster
agattatttggga

SEQ ID NO: 576877 - DNA, 13 bp, D. melanogaster
agattatttttga

SEQ ID NO: 576878 - DNA, 13 bp, D. melanogaster
agattcaaagaaa

SEQ ID NO: 576879 - DNA, 13 bp, D. melanogaster
agattcaacgtgg

SEQ ID NO: 576880 - DNA, 13 bp, D. melanogaster
agattcaagcctt

SEQ ID NO: 576881 - DNA, 14 bp, D. melanogaster
agattcaataaata

SEQ ID NO: 576882 - DNA, 13 bp, D. melanogaster
agattcaattcaa

SEQ ID NO: 576883 - DNA, 13 bp, D. melanogaster
agattcagataca

SEQ ID NO: 576884 - DNA, 13 bp, D. melanogaster
agattcagatacg

SEQ ID NO: 576885 - DNA, 13 bp, D. melanogaster
agattcagatgca

SEQ ID NO: 576886 - DNA, 13 bp, D. melanogaster
agattcagattga

SEQ ID NO: 576887 - DNA, 14 bp, D. melanogaster
agattcagattgag

SEQ ID NO: 576888 - DNA, 14 bp, D. melanogaster
agattcagcataca

SEQ ID NO: 576889 - DNA, 13 bp, D. melanogaster
agattccgattcc

SEQ ID NO: 576890 - DNA, 13 bp, D. melanogaster
agattcgatctta

SEQ ID NO: 576891 - DNA, 13 bp, D. melanogaster
agattcggagcaa

SEQ ID NO: 576892 - DNA, 13 bp, D. melanogaster
agattcgttaaaa

SEQ ID NO: 576893 - DNA, 13 bp, D. melanogaster
agattcgttgaaa

SEQ ID NO: 576894 - DNA, 13 bp, D. melanogaster
agattctaaaatt

SEQ ID NO: 576895 - DNA, 13 bp, D. melanogaster
agattctagagac

SEQ ID NO: 576896 - DNA, 14 bp, D. melanogaster
agattctagagaca

SEQ ID NO: 576897 - DNA, 13 bp, D. melanogaster
agattctgtgcgg

SEQ ID NO: 576898 - DNA, 13 bp, D. melanogaster
agattctttgaaa

SEQ ID NO: 576899 - DNA, 13 bp, D. melanogaster
agattgaattaaa

SEQ ID NO: 576900 - DNA, 13 bp, D. melanogaster
agattgagattga

SEQ ID NO: 576901 - DNA, 13 bp, D. melanogaster
agattgagttggc

SEQ ID NO: 576902 - DNA, 13 bp, D. melanogaster
agattgccattct

SEQ ID NO: 576903 - DNA, 13 bp, D. melanogaster
agattgccgcaaa

SEQ ID NO: 576904 - DNA, 13 bp, D. melanogaster
agattgcctctca

SEQ ID NO: 576905 - DNA, 13 bp, D. melanogaster
agattgctggatc

SEQ ID NO: 576906 - DNA, 13 bp, D. melanogaster
agattggacagcc

SEQ ID NO: 576907 - DNA, 13 bp, D. melanogaster
agattgggcaaag

SEQ ID NO: 576908 - DNA, 13 bp, D. melanogaster
agattggtttcaa

SEQ ID NO: 576909 - DNA, 13 bp, D. melanogaster
agattgtgtataa

SEQ ID NO: 576910 - DNA, 13 bp, D. melanogaster
agattgtttccat

SEQ ID NO: 576911 - DNA, 13 bp, D. melanogaster
agatttaaagcca

SEQ ID NO: 576912 - DNA, 13 bp, D. melanogaster
agatttaagtttt

SEQ ID NO: 576913 - DNA, 13 bp, D. melanogaster
agatttacaaatt

SEQ ID NO: 576914 - DNA, 13 bp, D. melanogaster
agatttacagaat

SEQ ID NO: 576915 - DNA, 13 bp, D. melanogaster
agatttacttaac

SEQ ID NO: 576916 - DNA, 13 bp, D. melanogaster
agatttagattta

SEQ ID NO: 576917 - DNA, 14 bp, D. melanogaster
agatttagatttag

SEQ ID NO: 576918 - DNA, 14 bp, D. melanogaster
agatttagatttta

SEQ ID NO: 576919 - DNA, 13 bp, D. melanogaster
agatttatgaaaa

SEQ ID NO: 576920 - DNA, 13 bp, D. melanogaster
agatttattgcta

SEQ ID NO: 576921 - DNA, 13 bp, D. melanogaster
agatttatttcaa

SEQ ID NO: 576922 - DNA, 13 bp, D. melanogaster
agatttatttgat

SEQ ID NO: 576923 - DNA, 13 bp, D. melanogaster
agatttatttggc

SEQ ID NO: 576924 - DNA, 13 bp, D. melanogaster
agatttattttag

SEQ ID NO: 576925 - DNA, 13 bp, D. melanogaster
agatttcagcaaa

SEQ ID NO: 576926 - DNA, 13 bp, D. melanogaster
agatttcattaaa

SEQ ID NO: 576927 - DNA, 14 bp, D. melanogaster
agatttccaataaa

SEQ ID NO: 576928 - DNA, 13 bp, D. melanogaster
agatttcccaggc

SEQ ID NO: 576929 - DNA, 13 bp, D. melanogaster
agatttcgaattc

SEQ ID NO: 576930 - DNA, 13 bp, D. melanogaster
agatttgaataaa

SEQ ID NO: 576931 - DNA, 13 bp, D. melanogaster
agatttgagattt

SEQ ID NO: 576932 - DNA, 13 bp, D. melanogaster
agatttgcataaa

SEQ ID NO: 576933 - DNA, 13 bp, D. melanogaster
agatttggaaatg

SEQ ID NO: 576934 - DNA, 13 bp, D. melanogaster
agatttggatttg

SEQ ID NO: 576935 - DNA, 14 bp, D. melanogaster
agatttgtttacaa

SEQ ID NO: 576936 - DNA, 14 bp, D. melanogaster
agattttaaatgta

SEQ ID NO: 576937 - DNA, 13 bp, D. melanogaster
agattttaagaac

SEQ ID NO: 576938 - DNA, 13 bp, D. melanogaster
agattttagaaaa

SEQ ID NO: 576939 - DNA, 13 bp, D. melanogaster
agattttatcaag

SEQ ID NO: 576940 - DNA, 14 bp, D. melanogaster
agattttcaatttt

SEQ ID NO: 576941 - DNA, 13 bp, D. melanogaster
agattttcagttt

SEQ ID NO: 576942 - DNA, 13 bp, D. melanogaster
agattttccagcg

SEQ ID NO: 576943 - DNA, 13 bp, D. melanogaster
agattttccatat

SEQ ID NO: 576944 - DNA, 13 bp, D. melanogaster
agattttcccaac

SEQ ID NO: 576945 - DNA, 14 bp, D. melanogaster
agattttcccaact

SEQ ID NO: 576946 - DNA, 13 bp, D. melanogaster
agattttctttta

SEQ ID NO: 576947 - DNA, 13 bp, D. melanogaster
agattttgcaaaa

SEQ ID NO: 576948 - DNA, 13 bp, D. melanogaster
agattttggattt

SEQ ID NO: 576949 - DNA, 13 bp, D. melanogaster
agatttttaaaga

SEQ ID NO: 576950 - DNA, 14 bp, D. melanogaster
agatttttcttcgt

SEQ ID NO: 576951 - DNA, 13 bp, D. melanogaster
agatttttgaaaa

SEQ ID NO: 576952 - DNA, 13 bp, D. melanogaster
agatttttgcaaa

SEQ ID NO: 576953 - DNA, 13 bp, D. melanogaster
agattttttaaag

SEQ ID NO: 576954 - DNA, 13 bp, D. melanogaster
agcaaaaaatatt

SEQ ID NO: 576955 - DNA, 13 bp, D. melanogaster
agcaaaaaatcga

SEQ ID NO: 576956 - DNA, 13 bp, D. melanogaster
agcaaaaaatgca

SEQ ID NO: 576957 - DNA, 13 bp, D. melanogaster
agcaaaaacaatt

SEQ ID NO: 576958 - DNA, 14 bp, D. melanogaster
agcaaaaacaatta

SEQ ID NO: 576959 - DNA, 13 bp, D. melanogaster
agcaaaaacattt

SEQ ID NO: 576960 - DNA, 13 bp, D. melanogaster
agcaaaaacgcat

SEQ ID NO: 576961 - DNA, 14 bp, D. melanogaster
agcaaaaacgcatt

SEQ ID NO: 576962 - DNA, 13 bp, D. melanogaster
agcaaaaactacg

SEQ ID NO: 576963 - DNA, 13 bp, D. melanogaster
agcaaaaactgca

SEQ ID NO: 576964 - DNA, 13 bp, D. melanogaster
agcaaaaagcagc

SEQ ID NO: 576965 - DNA, 13 bp, D. melanogaster
agcaaaaagcgca

SEQ ID NO: 576966 - DNA, 13 bp, D. melanogaster
agcaaaaagtaca

SEQ ID NO: 576967 - DNA, 14 bp, D. melanogaster
agcaaaaagtgaaa

SEQ ID NO: 576968 - DNA, 13 bp, D. melanogaster
agcaaaaagttca

SEQ ID NO: 576969 - DNA, 13 bp, D. melanogaster
agcaaaaagttgt

SEQ ID NO: 576970 - DNA, 13 bp, D. melanogaster
agcaaaaataact

SEQ ID NO: 576971 - DNA, 14 bp, D. melanogaster
agcaaaaataactc

SEQ ID NO: 576972 - DNA, 14 bp, D. melanogaster
agcaaaaataatga

SEQ ID NO: 576973 - DNA, 13 bp, D. melanogaster
agcaaaaatacat

SEQ ID NO: 576974 - DNA, 13 bp, D. melanogaster
agcaaaaatattt

SEQ ID NO: 576975 - DNA, 13 bp, D. melanogaster
agcaaaaatcaat

SEQ ID NO: 576976 - DNA, 13 bp, D. melanogaster
agcaaaaatgcaa

SEQ ID NO: 576977 - DNA, 13 bp, D. melanogaster
agcaaaaattaag

SEQ ID NO: 576978 - DNA, 14 bp, D. melanogaster
agcaaaacaaaatt

SEQ ID NO: 576979 - DNA, 13 bp, D. melanogaster
agcaaaacaaact

SEQ ID NO: 576980 - DNA, 15 bp, D. melanogaster
agcaaaacaaactgg

SEQ ID NO: 576981 - DNA, 13 bp, D. melanogaster
agcaaaacaaagt

SEQ ID NO: 576982 - DNA, 13 bp, D. melanogaster
agcaaaacaatat

SEQ ID NO: 576983 - DNA, 13 bp, D. melanogaster
agcaaaacaattt

SEQ ID NO: 576984 - DNA, 13 bp, D. melanogaster
agcaaaacacaat

SEQ ID NO: 576985 - DNA, 13 bp, D. melanogaster
agcaaaacattta

SEQ ID NO: 576986 - DNA, 13 bp, D. melanogaster
agcaaaagaaatg

SEQ ID NO: 576987 - DNA, 14 bp, D. melanogaster
agcaaaagcaaagc

SEQ ID NO: 576988 - DNA, 13 bp, D. melanogaster
agcaaaagcaaat

SEQ ID NO: 576989 - DNA, 13 bp, D. melanogaster
agcaaaagcaacg

SEQ ID NO: 576990 - DNA, 13 bp, D. melanogaster
agcaaaagcagag

SEQ ID NO: 576991 - DNA, 13 bp, D. melanogaster
agcaaaagcagct

SEQ ID NO: 576992 - DNA, 13 bp, D. melanogaster
agcaaaagcatca

SEQ ID NO: 576993 - DNA, 13 bp, D. melanogaster
agcaaaagcattt

SEQ ID NO: 576994 - DNA, 13 bp, D. melanogaster
agcaaaagccaac

SEQ ID NO: 576995 - DNA, 13 bp, D. melanogaster
agcaaaagctaaa

SEQ ID NO: 576996 - DNA, 13 bp, D. melanogaster
agcaaaagtaaat

SEQ ID NO: 576997 - DNA, 13 bp, D. melanogaster
agcaaaagtgttg

SEQ ID NO: 576998 - DNA, 13 bp, D. melanogaster
agcaaaagttaaa

SEQ ID NO: 576999 - DNA, 13 bp, D. melanogaster
agcaaaagttaat

SEQ ID NO: 577000 - DNA, 13 bp, D. melanogaster
agcaaaagttgtt

SEQ ID NO: 577001 - DNA, 13 bp, D. melanogaster
agcaaaagttttg

SEQ ID NO: 577002 - DNA, 13 bp, D. melanogaster
agcaaaagttttt

SEQ ID NO: 577003 - DNA, 13 bp, D. melanogaster
agcaaaatacttt

SEQ ID NO: 577004 - DNA, 13 bp, D. melanogaster
agcaaaatatttc

SEQ ID NO: 577005 - DNA, 14 bp, D. melanogaster
agcaaaatcaaaat

SEQ ID NO: 577006 - DNA, 13 bp, D. melanogaster
agcaaaatcaaat

SEQ ID NO: 577007 - DNA, 13 bp, D. melanogaster
agcaaaatgaaac

SEQ ID NO: 577008 - DNA, 13 bp, D. melanogaster
agcaaaatgaata

SEQ ID NO: 577009 - DNA, 13 bp, D. melanogaster
agcaaaatgccaa

SEQ ID NO: 577010 - DNA, 13 bp, D. melanogaster
agcaaaatgttaa

SEQ ID NO: 577011 - DNA, 14 bp, D. melanogaster
agcaaaatgtttaa

SEQ ID NO: 577012 - DNA, 13 bp, D. melanogaster
agcaaaattaatg

SEQ ID NO: 577013 - DNA, 13 bp, D. melanogaster
agcaaaattgcat

SEQ ID NO: 577014 - DNA, 13 bp, D. melanogaster
agcaaaattgtat

SEQ ID NO: 577015 - DNA, 13 bp, D. melanogaster
agcaaaattttga

SEQ ID NO: 577016 - DNA, 14 bp, D. melanogaster
agcaaacaaaaatt

SEQ ID NO: 577017 - DNA, 13 bp, D. melanogaster
agcaaacaaaagt

SEQ ID NO: 577018 - DNA, 13 bp, D. melanogaster
agcaaacaaaatg

SEQ ID NO: 577019 - DNA, 13 bp, D. melanogaster
agcaaacaaacat

SEQ ID NO: 577020 - DNA, 13 bp, D. melanogaster
agcaaacaaatct

SEQ ID NO: 577021 - DNA, 13 bp, D. melanogaster
agcaaacaaatgg

SEQ ID NO: 577022 - DNA, 13 bp, D. melanogaster
agcaaacaaatta

SEQ ID NO: 577023 - DNA, 13 bp, D. melanogaster
agcaaacaaattt

SEQ ID NO: 577024 - DNA, 13 bp, D. melanogaster
agcaaacaacttt

SEQ ID NO: 577025 - DNA, 13 bp, D. melanogaster
agcaaacaattaa

SEQ ID NO: 577026 - DNA, 13 bp, D. melanogaster
agcaaacaatttt

SEQ ID NO: 577027 - DNA, 13 bp, D. melanogaster
agcaaacacaatt

SEQ ID NO: 577028 - DNA, 13 bp, D. melanogaster
agcaaacacttaa

SEQ ID NO: 577029 - DNA, 13 bp, D. melanogaster
agcaaacagaagc

SEQ ID NO: 577030 - DNA, 13 bp, D. melanogaster
agcaaacagagca

SEQ ID NO: 577031 - DNA, 13 bp, D. melanogaster
agcaaacagcaat

SEQ ID NO: 577032 - DNA, 13 bp, D. melanogaster
agcaaacaggcaa

SEQ ID NO: 577033 - DNA, 13 bp, D. melanogaster
agcaaacagtgaa

SEQ ID NO: 577034 - DNA, 13 bp, D. melanogaster
agcaaacatcaaa

SEQ ID NO: 577035 - DNA, 13 bp, D. melanogaster
agcaaacatgcaa

SEQ ID NO: 577036 - DNA, 13 bp, D. melanogaster
agcaaacatggat

SEQ ID NO: 577037 - DNA, 13 bp, D. melanogaster
agcaaacattaat

SEQ ID NO: 577038 - DNA, 13 bp, D. melanogaster
agcaaacatttaa

SEQ ID NO: 577039 - DNA, 13 bp, D. melanogaster
agcaaacatttca

SEQ ID NO: 577040 - DNA, 13 bp, D. melanogaster
agcaaaccaaaat

SEQ ID NO: 577041 - DNA, 13 bp, D. melanogaster
agcaaacccaatt

SEQ ID NO: 577042 - DNA, 14 bp, D. melanogaster
agcaaacccaattt

SEQ ID NO: 577043 - DNA, 14 bp, D. melanogaster
agcaaacgccaccg

SEQ ID NO: 577044 - DNA, 13 bp, D. melanogaster
agcaaactaaaat

SEQ ID NO: 577045 - DNA, 13 bp, D. melanogaster
agcaaactaagtg

SEQ ID NO: 577046 - DNA, 13 bp, D. melanogaster
agcaaactcaaaa

SEQ ID NO: 577047 - DNA, 13 bp, D. melanogaster
agcaaactgaaaa

SEQ ID NO: 577048 - DNA, 13 bp, D. melanogaster
agcaaactgaatg

SEQ ID NO: 577049 - DNA, 13 bp, D. melanogaster
agcaaactgcaaa

SEQ ID NO: 577050 - DNA, 13 bp, D. melanogaster
agcaaacttaaat

SEQ ID NO: 577051 - DNA, 13 bp, D. melanogaster
agcaaacttgttt

SEQ ID NO: 577052 - DNA, 13 bp, D. melanogaster
agcaaactttaaa

SEQ ID NO: 577053 - DNA, 13 bp, D. melanogaster
agcaaactttgct

SEQ ID NO: 577054 - DNA, 13 bp, D. melanogaster
agcaaacttttaa

SEQ ID NO: 577055 - DNA, 13 bp, D. melanogaster
agcaaacttttta

SEQ ID NO: 577056 - DNA, 13 bp, D. melanogaster
agcaaagaaagcc

SEQ ID NO: 577057 - DNA, 16 bp, D. melanogaster
agcaaagaaagccgaa

SEQ ID NO: 577058 - DNA, 13 bp, D. melanogaster
agcaaagatagat

SEQ ID NO: 577059 - DNA, 14 bp, D. melanogaster
agcaaagcaaagca

SEQ ID NO: 577060 - DNA, 13 bp, D. melanogaster
agcaaagcatttt

SEQ ID NO: 577061 - DNA, 13 bp, D. melanogaster
agcaaaggaaatg

SEQ ID NO: 577062 - DNA, 13 bp, D. melanogaster
agcaaaggaataa

SEQ ID NO: 577063 - DNA, 13 bp, D. melanogaster
agcaaaggcagca

SEQ ID NO: 577064 - DNA, 13 bp, D. melanogaster
agcaaaggccaaa

SEQ ID NO: 577065 - DNA, 13 bp, D. melanogaster
agcaaagggaaat

SEQ ID NO: 577066 - DNA, 13 bp, D. melanogaster
agcaaagggaaca

SEQ ID NO: 577067 - DNA, 14 bp, D. melanogaster
agcaaagggatctg

SEQ ID NO: 577068 - DNA, 13 bp, D. melanogaster
agcaaagggtttt

SEQ ID NO: 577069 - DNA, 13 bp, D. melanogaster
agcaaaggttatc

SEQ ID NO: 577070 - DNA, 13 bp, D. melanogaster
agcaaagtaaaat

SEQ ID NO: 577071 - DNA, 13 bp, D. melanogaster
agcaaagtaaaca

SEQ ID NO: 577072 - DNA, 13 bp, D. melanogaster
agcaaagtcaaaa

SEQ ID NO: 577073 - DNA, 13 bp, D. melanogaster
agcaaagtcaaca

SEQ ID NO: 577074 - DNA, 13 bp, D. melanogaster
agcaaagtttgct

SEQ ID NO: 577075 - DNA, 13 bp, D. melanogaster
agcaaagttttgc

SEQ ID NO: 577076 - DNA, 14 bp, D. melanogaster
agcaaataaaatat

SEQ ID NO: 577077 - DNA, 13 bp, D. melanogaster
agcaaataaagca

SEQ ID NO: 577078 - DNA, 13 bp, D. melanogaster
agcaaataaagtg

SEQ ID NO: 577079 - DNA, 14 bp, D. melanogaster
agcaaataaatatg

SEQ ID NO: 577080 - DNA, 14 bp, D. melanogaster
agcaaataaatatt

SEQ ID NO: 577081 - DNA, 13 bp, D. melanogaster
agcaaataaatca

SEQ ID NO: 577082 - DNA, 14 bp, D. melanogaster
agcaaataaattaa

SEQ ID NO: 577083 - DNA, 13 bp, D. melanogaster
agcaaataacttt

SEQ ID NO: 577084 - DNA, 14 bp, D. melanogaster
agcaaataataaat

SEQ ID NO: 577085 - DNA, 13 bp, D. melanogaster
agcaaataataat

SEQ ID NO: 577086 - DNA, 14 bp, D. melanogaster
agcaaataataata

SEQ ID NO: 577087 - DNA, 13 bp, D. melanogaster
agcaaataattga

SEQ ID NO: 577088 - DNA, 14 bp, D. melanogaster
agcaaatacaaata

SEQ ID NO: 577089 - DNA, 13 bp, D. melanogaster
agcaaatacaaca

SEQ ID NO: 577090 - DNA, 13 bp, D. melanogaster
agcaaatacaata

SEQ ID NO: 577091 - DNA, 13 bp, D. melanogaster
agcaaatacaatt

SEQ ID NO: 577092 - DNA, 13 bp, D. melanogaster
agcaaatagaaat

SEQ ID NO: 577093 - DNA, 13 bp, D. melanogaster
agcaaatagcaaa

SEQ ID NO: 577094 - DNA, 13 bp, D. melanogaster
agcaaatagccaa

SEQ ID NO: 577095 - DNA, 13 bp, D. melanogaster
agcaaatataatt

SEQ ID NO: 577096 - DNA, 13 bp, D. melanogaster
agcaaatatacaa

SEQ ID NO: 577097 - DNA, 13 bp, D. melanogaster
agcaaatatgaaa

SEQ ID NO: 577098 - DNA, 13 bp, D. melanogaster
agcaaatattaaa

SEQ ID NO: 577099 - DNA, 13 bp, D. melanogaster
agcaaatatttga

SEQ ID NO: 577100 - DNA, 14 bp, D. melanogaster
agcaaatatttgca

SEQ ID NO: 577101 - DNA, 13 bp, D. melanogaster
agcaaatcaaaca

SEQ ID NO: 577102 - DNA, 13 bp, D. melanogaster
agcaaatcgaaat

SEQ ID NO: 577103 - DNA, 13 bp, D. melanogaster
agcaaatgaagca

SEQ ID NO: 577104 - DNA, 13 bp, D. melanogaster
agcaaatgaatat

SEQ ID NO: 577105 - DNA, 13 bp, D. melanogaster
agcaaatgaattc

SEQ ID NO: 577106 - DNA, 13 bp, D. melanogaster
agcaaatgagcaa

SEQ ID NO: 577107 - DNA, 13 bp, D. melanogaster
agcaaatgcaaaa

SEQ ID NO: 577108 - DNA, 13 bp, D. melanogaster
agcaaatgcaaat

SEQ ID NO: 577109 - DNA, 13 bp, D. melanogaster
agcaaatgcaatt

SEQ ID NO: 577110 - DNA, 13 bp, D. melanogaster
agcaaatgcacaa

SEQ ID NO: 577111 - DNA, 13 bp, D. melanogaster
agcaaatgcattt

SEQ ID NO: 577112 - DNA, 13 bp, D. melanogaster
agcaaatgcgaaa

SEQ ID NO: 577113 - DNA, 13 bp, D. melanogaster
agcaaatgctctg

SEQ ID NO: 577114 - DNA, 14 bp, D. melanogaster
agcaaatgctctga

SEQ ID NO: 577115 - DNA, 13 bp, D. melanogaster
agcaaatgctgga

SEQ ID NO: 577116 - DNA, 13 bp, D. melanogaster
agcaaatgtaaaa

SEQ ID NO: 577117 - DNA, 13 bp, D. melanogaster
agcaaatgtattt

SEQ ID NO: 577118 - DNA, 13 bp, D. melanogaster
agcaaatgttgca

SEQ ID NO: 577119 - DNA, 13 bp, D. melanogaster
agcaaattaaaag

SEQ ID NO: 577120 - DNA, 13 bp, D. melanogaster
agcaaattaaatt

SEQ ID NO: 577121 - DNA, 13 bp, D. melanogaster
agcaaattaatga

SEQ ID NO: 577122 - DNA, 13 bp, D. melanogaster
agcaaattacaca

SEQ ID NO: 577123 - DNA, 13 bp, D. melanogaster
agcaaattattat

SEQ ID NO: 577124 - DNA, 13 bp, D. melanogaster
agcaaattatttt

SEQ ID NO: 577125 - DNA, 13 bp, D. melanogaster
agcaaattctatt

SEQ ID NO: 577126 - DNA, 15 bp, D. melanogaster
agcaaattctgcaat

SEQ ID NO: 577127 - DNA, 13 bp, D. melanogaster
agcaaattgaaat

SEQ ID NO: 577128 - DNA, 13 bp, D. melanogaster
agcaaattgactt

SEQ ID NO: 577129 - DNA, 13 bp, D. melanogaster
agcaaattgataa

SEQ ID NO: 577130 - DNA, 13 bp, D. melanogaster
agcaaattgcata

SEQ ID NO: 577131 - DNA, 13 bp, D. melanogaster
agcaaattgccat

SEQ ID NO: 577132 - DNA, 13 bp, D. melanogaster
agcaaattgtttg

SEQ ID NO: 577133 - DNA, 13 bp, D. melanogaster
agcaaatttattg

SEQ ID NO: 577134 - DNA, 13 bp, D. melanogaster
agcaaatttcaat

SEQ ID NO: 577135 - DNA, 13 bp, D. melanogaster
agcaaattttcaa

SEQ ID NO: 577136 - DNA, 13 bp, D. melanogaster
agcaaatttttct

SEQ ID NO: 577137 - DNA, 13 bp, D. melanogaster
agcaacaaaaatc

SEQ ID NO: 577138 - DNA, 14 bp, D. melanogaster
agcaacaaaagcag

SEQ ID NO: 577139 - DNA, 13 bp, D. melanogaster
agcaacaaaagcg

SEQ ID NO: 577140 - DNA, 13 bp, D. melanogaster
agcaacaaaagtt

SEQ ID NO: 577141 - DNA, 13 bp, D. melanogaster
agcaacaaaatac

SEQ ID NO: 577142 - DNA, 13 bp, D. melanogaster
agcaacaaaatcg

SEQ ID NO: 577143 - DNA, 13 bp, D. melanogaster
agcaacaaacagc

SEQ ID NO: 577144 - DNA, 13 bp, D. melanogaster
agcaacaaacatt

SEQ ID NO: 577145 - DNA, 13 bp, D. melanogaster
agcaacaaagcca

SEQ ID NO: 577146 - DNA, 13 bp, D. melanogaster
agcaacaaagtgc

SEQ ID NO: 577147 - DNA, 14 bp, D. melanogaster
agcaacaaagtgct

SEQ ID NO: 577148 - DNA, 13 bp, D. melanogaster
agcaacaaatcaa

SEQ ID NO: 577149 - DNA, 13 bp, D. melanogaster
agcaacaaattgc

SEQ ID NO: 577150 - DNA, 13 bp, D. melanogaster
agcaacaaattgt

SEQ ID NO: 577151 - DNA, 14 bp, D. melanogaster
agcaacaacaaaat

SEQ ID NO: 577152 - DNA, 14 bp, D. melanogaster
agcaacaacaaata

SEQ ID NO: 577153 - DNA, 14 bp, D. melanogaster
agcaacaacaaatg

SEQ ID NO: 577154 - DNA, 13 bp, D. melanogaster
agcaacaacaacg

SEQ ID NO: 577155 - DNA, 13 bp, D. melanogaster
agcaacaacaagc

SEQ ID NO: 577156 - DNA, 14 bp, D. melanogaster
agcaacaacaagcc

SEQ ID NO: 577157 - DNA, 15 bp, D. melanogaster
agcaacaacaagcca

SEQ ID NO: 577158 - DNA, 14 bp, D. melanogaster
agcaacaacaatag

SEQ ID NO: 577159 - DNA, 14 bp, D. melanogaster
agcaacaacaatat

SEQ ID NO: 577160 - DNA, 13 bp, D. melanogaster
agcaacaacaatc

SEQ ID NO: 577161 - DNA, 13 bp, D. melanogaster
agcaacaacaatt

SEQ ID NO: 577162 - DNA, 13 bp, D. melanogaster
agcaacaacacag

SEQ ID NO: 577163 - DNA, 13 bp, D. melanogaster
agcaacaacacga

SEQ ID NO: 577164 - DNA, 13 bp, D. melanogaster
agcaacaacagcg

SEQ ID NO: 577165 - DNA, 13 bp, D. melanogaster
agcaacaacagta

SEQ ID NO: 577166 - DNA, 14 bp, D. melanogaster
agcaacaacatcaa

SEQ ID NO: 577167 - DNA, 13 bp, D. melanogaster
agcaacaacatcg

SEQ ID NO: 577168 - DNA, 13 bp, D. melanogaster
agcaacaacattt

SEQ ID NO: 577169 - DNA, 13 bp, D. melanogaster
agcaacaaccgca

SEQ ID NO: 577170 - DNA, 13 bp, D. melanogaster
agcaacaacggca

SEQ ID NO: 577171 - DNA, 13 bp, D. melanogaster
agcaacaagccaa

SEQ ID NO: 577172 - DNA, 13 bp, D. melanogaster
agcaacaagtttt

SEQ ID NO: 577173 - DNA, 13 bp, D. melanogaster
agcaacaataata

SEQ ID NO: 577174 - DNA, 13 bp, D. melanogaster
agcaacaatcaaa

SEQ ID NO: 577175 - DNA, 14 bp, D. melanogaster
agcaacaatggcaa

SEQ ID NO: 577176 - DNA, 13 bp, D. melanogaster
agcaacaattata

SEQ ID NO: 577177 - DNA, 13 bp, D. melanogaster
agcaacaattttc

SEQ ID NO: 577178 - DNA, 14 bp, D. melanogaster
agcaacagcaacac

SEQ ID NO: 577179 - DNA, 13 bp, D. melanogaster
agcaacagcaagg

SEQ ID NO: 577180 - DNA, 13 bp, D. melanogaster
agcaacagcaatt

SEQ ID NO: 577181 - DNA, 14 bp, D. melanogaster
agcaacagcagcat

SEQ ID NO: 577182 - DNA, 13 bp, D. melanogaster
agcaacagcagcc

SEQ ID NO: 577183 - DNA, 13 bp, D. melanogaster
agcaacagcagcg

SEQ ID NO: 577184 - DNA, 13 bp, D. melanogaster
agcaacagcagct

SEQ ID NO: 577185 - DNA, 13 bp, D. melanogaster
agcaacagcatca

SEQ ID NO: 577186 - DNA, 13 bp, D. melanogaster
agcaacagccaca

SEQ ID NO: 577187 - DNA, 13 bp, D. melanogaster
agcaacagcggca

SEQ ID NO: 577188 - DNA, 13 bp, D. melanogaster
agcaacagctaca

SEQ ID NO: 577189 - DNA, 13 bp, D. melanogaster
agcaacagctgtt

SEQ ID NO: 577190 - DNA, 13 bp, D. melanogaster
agcaacaggagga

SEQ ID NO: 577191 - DNA, 13 bp, D. melanogaster
agcaacagtaaca

SEQ ID NO: 577192 - DNA, 13 bp, D. melanogaster
agcaacagtattt

SEQ ID NO: 577193 - DNA, 13 bp, D. melanogaster
agcaacagtgaca

SEQ ID NO: 577194 - DNA, 13 bp, D. melanogaster
agcaacagttgca

SEQ ID NO: 577195 - DNA, 13 bp, D. melanogaster
agcaacataaatt

SEQ ID NO: 577196 - DNA, 13 bp, D. melanogaster
agcaacatacata

SEQ ID NO: 577197 - DNA, 14 bp, D. melanogaster
agcaacatcaacaa

SEQ ID NO: 577198 - DNA, 13 bp, D. melanogaster
agcaacatcaact

SEQ ID NO: 577199 - DNA, 14 bp, D. melanogaster
agcaacatcagcaa

SEQ ID NO: 577200 - DNA, 13 bp, D. melanogaster
agcaacatcagcc

SEQ ID NO: 577201 - DNA, 13 bp, D. melanogaster
agcaacatcagct

SEQ ID NO: 577202 - DNA, 13 bp, D. melanogaster
agcaacatcatca

SEQ ID NO: 577203 - DNA, 14 bp, D. melanogaster
agcaacatgcaaca

SEQ ID NO: 577204 - DNA, 14 bp, D. melanogaster
agcaacatgcagca

SEQ ID NO: 577205 - DNA, 13 bp, D. melanogaster
agcaacatgctgc

SEQ ID NO: 577206 - DNA, 13 bp, D. melanogaster
agcaacatgttgc

SEQ ID NO: 577207 - DNA, 13 bp, D. melanogaster
agcaacatttgtt

SEQ ID NO: 577208 - DNA, 13 bp, D. melanogaster
agcaacattttgc

SEQ ID NO: 577209 - DNA, 13 bp, D. melanogaster
agcaaccagcaac

SEQ ID NO: 577210 - DNA, 13 bp, D. melanogaster
agcaaccagtttt

SEQ ID NO: 577211 - DNA, 13 bp, D. melanogaster
agcaacgaaattg

SEQ ID NO: 577212 - DNA, 13 bp, D. melanogaster
agcaacgacaaca

SEQ ID NO: 577213 - DNA, 13 bp, D. melanogaster
agcaacgagttta

SEQ ID NO: 577214 - DNA, 13 bp, D. melanogaster
agcaacgcacaca

SEQ ID NO: 577215 - DNA, 13 bp, D. melanogaster
agcaacgtgcaac

SEQ ID NO: 577216 - DNA, 13 bp, D. melanogaster
agcaactaaaaca

SEQ ID NO: 577217 - DNA, 13 bp, D. melanogaster
agcaactaaaata

SEQ ID NO: 577218 - DNA, 13 bp, D. melanogaster
agcaactaattaa

SEQ ID NO: 577219 - DNA, 13 bp, D. melanogaster
agcaactcacacc

SEQ ID NO: 577220 - DNA, 13 bp, D. melanogaster
agcaactgaaaaa

SEQ ID NO: 577221 - DNA, 13 bp, D. melanogaster
agcaactgaaaca

SEQ ID NO: 577222 - DNA, 13 bp, D. melanogaster
agcaactgaaact

SEQ ID NO: 577223 - DNA, 13 bp, D. melanogaster
agcaactgatttt

SEQ ID NO: 577224 - DNA, 13 bp, D. melanogaster
agcaactgcaaaa

SEQ ID NO: 577225 - DNA, 13 bp, D. melanogaster
agcaacttgaaaa

SEQ ID NO: 577226 - DNA, 13 bp, D. melanogaster
agcaacttgcaac

SEQ ID NO: 577227 - DNA, 13 bp, D. melanogaster
agcaactttgttt

SEQ ID NO: 577228 - DNA, 13 bp, D. melanogaster
agcaagaaaaatg

SEQ ID NO: 577229 - DNA, 13 bp, D. melanogaster
agcaagaaaagcg

SEQ ID NO: 577230 - DNA, 13 bp, D. melanogaster
agcaagaaagtta

SEQ ID NO: 577231 - DNA, 13 bp, D. melanogaster
agcaagatagaaa

SEQ ID NO: 577232 - DNA, 13 bp, D. melanogaster
agcaagcaaaata

SEQ ID NO: 577233 - DNA, 13 bp, D. melanogaster
agcaagcagcagc

SEQ ID NO: 577234 - DNA, 13 bp, D. melanogaster
agcaagcattgaa

SEQ ID NO: 577235 - DNA, 14 bp, D. melanogaster
agcaagcattgaaa

SEQ ID NO: 577236 - DNA, 13 bp, D. melanogaster
agcaagccagcca

SEQ ID NO: 577237 - DNA, 13 bp, D. melanogaster
agcaagctgagca

SEQ ID NO: 577238 - DNA, 13 bp, D. melanogaster
agcaaggacgaaa

SEQ ID NO: 577239 - DNA, 13 bp, D. melanogaster
agcaagtaaacaa

SEQ ID NO: 577240 - DNA, 13 bp, D. melanogaster
agcaagtgcaagt

SEQ ID NO: 577241 - DNA, 13 bp, D. melanogaster
agcaagttccaca

SEQ ID NO: 577242 - DNA, 13 bp, D. melanogaster
agcaataaaaagt

SEQ ID NO: 577243 - DNA, 13 bp, D. melanogaster
agcaataaaaatc

SEQ ID NO: 577244 - DNA, 13 bp, D. melanogaster
agcaataaataat

SEQ ID NO: 577245 - DNA, 13 bp, D. melanogaster
agcaataaatcaa

SEQ ID NO: 577246 - DNA, 13 bp, D. melanogaster
agcaataaatctt

SEQ ID NO: 577247 - DNA, 13 bp, D. melanogaster
agcaataaatgaa

SEQ ID NO: 577248 - DNA, 13 bp, D. melanogaster
agcaataacaatg

SEQ ID NO: 577249 - DNA, 13 bp, D. melanogaster
agcaataacagca

SEQ ID NO: 577250 - DNA, 13 bp, D. melanogaster
agcaataaccttt

SEQ ID NO: 577251 - DNA, 14 bp, D. melanogaster
agcaataataacaa

SEQ ID NO: 577252 - DNA, 13 bp, D. melanogaster
agcaataattaaa

SEQ ID NO: 577253 - DNA, 13 bp, D. melanogaster
agcaataattaat

SEQ ID NO: 577254 - DNA, 13 bp, D. melanogaster
agcaatacaaata

SEQ ID NO: 577255 - DNA, 13 bp, D. melanogaster
agcaatagcaaaa

SEQ ID NO: 577256 - DNA, 13 bp, D. melanogaster
agcaatagcaaca

SEQ ID NO: 577257 - DNA, 13 bp, D. melanogaster
agcaatagcagca

SEQ ID NO: 577258 - DNA, 14 bp, D. melanogaster
agcaatagcagcag

SEQ ID NO: 577259 - DNA, 13 bp, D. melanogaster
agcaatatatcta

SEQ ID NO: 577260 - DNA, 13 bp, D. melanogaster
agcaatatatttt

SEQ ID NO: 577261 - DNA, 13 bp, D. melanogaster
agcaatattaaaa

SEQ ID NO: 577262 - DNA, 13 bp, D. melanogaster
agcaatattgaca

SEQ ID NO: 577263 - DNA, 13 bp, D. melanogaster
agcaatattttgt

SEQ ID NO: 577264 - DNA, 13 bp, D. melanogaster
agcaatcaaaaat

SEQ ID NO: 577265 - DNA, 14 bp, D. melanogaster
agcaatcaaaaatc

SEQ ID NO: 577266 - DNA, 13 bp, D. melanogaster
agcaatcaaaact

SEQ ID NO: 577267 - DNA, 13 bp, D. melanogaster
agcaatcaaacaa

SEQ ID NO: 577268 - DNA, 13 bp, D. melanogaster
agcaatcaaatgg

SEQ ID NO: 577269 - DNA, 13 bp, D. melanogaster
agcaatcaagtga

SEQ ID NO: 577270 - DNA, 13 bp, D. melanogaster
agcaatcaatcaa

SEQ ID NO: 577271 - DNA, 13 bp, D. melanogaster
agcaatcaattaa

SEQ ID NO: 577272 - DNA, 13 bp, D. melanogaster
agcaatcaatttt

SEQ ID NO: 577273 - DNA, 13 bp, D. melanogaster
agcaatcgagtgg

SEQ ID NO: 577274 - DNA, 13 bp, D. melanogaster
agcaatctcatcc

SEQ ID NO: 577275 - DNA, 13 bp, D. melanogaster
agcaatgaaaatg

SEQ ID NO: 577276 - DNA, 13 bp, D. melanogaster
agcaatgcaaagc

SEQ ID NO: 577277 - DNA, 14 bp, D. melanogaster
agcaatgcaaagcc

SEQ ID NO: 577278 - DNA, 13 bp, D. melanogaster
agcaatgcaaatg

SEQ ID NO: 577279 - DNA, 13 bp, D. melanogaster
agcaatgcaccca

SEQ ID NO: 577280 - DNA, 13 bp, D. melanogaster
agcaatgccaaat

SEQ ID NO: 577281 - DNA, 13 bp, D. melanogaster
agcaatggaaaat

SEQ ID NO: 577282 - DNA, 13 bp, D. melanogaster
agcaatggaaatt

SEQ ID NO: 577283 - DNA, 13 bp, D. melanogaster
agcaatggagtaa

SEQ ID NO: 577284 - DNA, 13 bp, D. melanogaster
agcaatggcaaaa

SEQ ID NO: 577285 - DNA, 13 bp, D. melanogaster
agcaatggcaata

SEQ ID NO: 577286 - DNA, 14 bp, D. melanogaster
agcaattaaaaatt

SEQ ID NO: 577287 - DNA, 13 bp, D. melanogaster
agcaattaaagca

SEQ ID NO: 577288 - DNA, 13 bp, D. melanogaster
agcaattaaataa

SEQ ID NO: 577289 - DNA, 13 bp, D. melanogaster
agcaattaacaaa

SEQ ID NO: 577290 - DNA, 13 bp, D. melanogaster
agcaattaattaa

SEQ ID NO: 577291 - DNA, 13 bp, D. melanogaster
agcaattacaaaa

SEQ ID NO: 577292 - DNA, 13 bp, D. melanogaster
agcaattacaaca

SEQ ID NO: 577293 - DNA, 13 bp, D. melanogaster
agcaattaccgca

SEQ ID NO: 577294 - DNA, 14 bp, D. melanogaster
agcaattagaagaa

SEQ ID NO: 577295 - DNA, 13 bp, D. melanogaster
agcaattagccaa

SEQ ID NO: 577296 - DNA, 13 bp, D. melanogaster
agcaattattttc

SEQ ID NO: 577297 - DNA, 13 bp, D. melanogaster
agcaattcaattt

SEQ ID NO: 577298 - DNA, 13 bp, D. melanogaster
agcaattgaattg

SEQ ID NO: 577299 - DNA, 13 bp, D. melanogaster
agcaattgaattt

SEQ ID NO: 577300 - DNA, 13 bp, D. melanogaster
agcaattgcaaca

SEQ ID NO: 577301 - DNA, 13 bp, D. melanogaster
agcaattgcaatt

SEQ ID NO: 577302 - DNA, 13 bp, D. melanogaster
agcaattgcagga

SEQ ID NO: 577303 - DNA, 13 bp, D. melanogaster
agcaattggaaaa

SEQ ID NO: 577304 - DNA, 14 bp, D. melanogaster
agcaattgtgaaat

SEQ ID NO: 577305 - DNA, 13 bp, D. melanogaster
agcaattgtgatt

SEQ ID NO: 577306 - DNA, 13 bp, D. melanogaster
agcaatttaaaag

SEQ ID NO: 577307 - DNA, 13 bp, D. melanogaster
agcaatttaaatg

SEQ ID NO: 577308 - DNA, 13 bp, D. melanogaster
agcaatttaaatt

SEQ ID NO: 577309 - DNA, 14 bp, D. melanogaster
agcaatttaattaa

SEQ ID NO: 577310 - DNA, 13 bp, D. melanogaster
agcaatttatatg

SEQ ID NO: 577311 - DNA, 13 bp, D. melanogaster
agcaatttatttg

SEQ ID NO: 577312 - DNA, 13 bp, D. melanogaster
agcaatttcaaat

SEQ ID NO: 577313 - DNA, 13 bp, D. melanogaster
agcaatttcattt

SEQ ID NO: 577314 - DNA, 13 bp, D. melanogaster
agcaatttcgaaa

SEQ ID NO: 577315 - DNA, 13 bp, D. melanogaster
agcaatttgccag

SEQ ID NO: 577316 - DNA, 13 bp, D. melanogaster
agcaatttggcaa

SEQ ID NO: 577317 - DNA, 13 bp, D. melanogaster
agcaatttgttaa

SEQ ID NO: 577318 - DNA, 13 bp, D. melanogaster
agcaattttcaca

SEQ ID NO: 577319 - DNA, 13 bp, D. melanogaster
agcaattttccaa

SEQ ID NO: 577320 - DNA, 13 bp, D. melanogaster
agcaatttttaat

SEQ ID NO: 577321 - DNA, 13 bp, D. melanogaster
agcacaaaaagtg

SEQ ID NO: 577322 - DNA, 13 bp, D. melanogaster
agcacaaaaagtt

SEQ ID NO: 577323 - DNA, 13 bp, D. melanogaster
agcacaaaaatta

SEQ ID NO: 577324 - DNA, 13 bp, D. melanogaster
agcacaaaacact

SEQ ID NO: 577325 - DNA, 13 bp, D. melanogaster
agcacaaagccaa

SEQ ID NO: 577326 - DNA, 13 bp, D. melanogaster
agcacaaatagaa

SEQ ID NO: 577327 - DNA, 13 bp, D. melanogaster
agcacaaattact

SEQ ID NO: 577328 - DNA, 13 bp, D. melanogaster
agcacaaattgaa

SEQ ID NO: 577329 - DNA, 13 bp, D. melanogaster
agcacaacaaaat

SEQ ID NO: 577330 - DNA, 13 bp, D. melanogaster
agcacaacaaata

SEQ ID NO: 577331 - DNA, 13 bp, D. melanogaster
agcacaacacgca

SEQ ID NO: 577332 - DNA, 13 bp, D. melanogaster
agcacaacattgt

SEQ ID NO: 577333 - DNA, 13 bp, D. melanogaster
agcacaactgtac

SEQ ID NO: 577334 - DNA, 13 bp, D. melanogaster
agcacaataaaat

SEQ ID NO: 577335 - DNA, 13 bp, D. melanogaster
agcacaataaatg

SEQ ID NO: 577336 - DNA, 13 bp, D. melanogaster
agcacaatgcaaa

SEQ ID NO: 577337 - DNA, 14 bp, D. melanogaster
agcacaattaaaat

SEQ ID NO: 577338 - DNA, 13 bp, D. melanogaster
agcacaattattt

SEQ ID NO: 577339 - DNA, 13 bp, D. melanogaster
agcacacaaaaat

SEQ ID NO: 577340 - DNA, 13 bp, D. melanogaster
agcacacacacat

SEQ ID NO: 577341 - DNA, 13 bp, D. melanogaster
agcacacacatat

SEQ ID NO: 577342 - DNA, 13 bp, D. melanogaster
agcacacattttt

SEQ ID NO: 577343 - DNA, 14 bp, D. melanogaster
agcacacgcacaca

SEQ ID NO: 577344 - DNA, 13 bp, D. melanogaster
agcacactgaaaa

SEQ ID NO: 577345 - DNA, 13 bp, D. melanogaster
agcacagaaaata

SEQ ID NO: 577346 - DNA, 14 bp, D. melanogaster
agcacagcacagca

SEQ ID NO: 577347 - DNA, 14 bp, D. melanogaster
agcacagcagcaac

SEQ ID NO: 577348 - DNA, 13 bp, D. melanogaster
agcacagcagtat

SEQ ID NO: 577349 - DNA, 13 bp, D. melanogaster
agcacagtcaaga

SEQ ID NO: 577350 - DNA, 13 bp, D. melanogaster
agcacatacacac

SEQ ID NO: 577351 - DNA, 14 bp, D. melanogaster
agcacatacataca

SEQ ID NO: 577352 - DNA, 13 bp, D. melanogaster
agcacattaaatt

SEQ ID NO: 577353 - DNA, 13 bp, D. melanogaster
agcacattcgcgc

SEQ ID NO: 577354 - DNA, 13 bp, D. melanogaster
agcacatttaaaa

SEQ ID NO: 577355 - DNA, 13 bp, D. melanogaster
agcacattttcca

SEQ ID NO: 577356 - DNA, 13 bp, D. melanogaster
agcacatttttca

SEQ ID NO: 577357 - DNA, 13 bp, D. melanogaster
agcaccaaactcc

SEQ ID NO: 577358 - DNA, 13 bp, D. melanogaster
agcaccacgacct

SEQ ID NO: 577359 - DNA, 13 bp, D. melanogaster
agcaccagcacca

SEQ ID NO: 577360 - DNA, 13 bp, D. melanogaster
agcacccagcacc

SEQ ID NO: 577361 - DNA, 13 bp, D. melanogaster
agcacctcctcca

SEQ ID NO: 577362 - DNA, 14 bp, D. melanogaster
agcacgcacacaca

SEQ ID NO: 577363 - DNA, 13 bp, D. melanogaster
agcacgccaatta

SEQ ID NO: 577364 - DNA, 13 bp, D. melanogaster
agcacggaaattg

SEQ ID NO: 577365 - DNA, 13 bp, D. melanogaster
agcacggagcacg

SEQ ID NO: 577366 - DNA, 14 bp, D. melanogaster
agcacggcatcctg

SEQ ID NO: 577367 - DNA, 13 bp, D. melanogaster
agcactaagcgaa

SEQ ID NO: 577368 - DNA, 13 bp, D. melanogaster
agcactcagaaga

SEQ ID NO: 577369 - DNA, 13 bp, D. melanogaster
agcactccaaaga

SEQ ID NO: 577370 - DNA, 13 bp, D. melanogaster
agcactcgcacac

SEQ ID NO: 577371 - DNA, 13 bp, D. melanogaster
agcactcggaggc

SEQ ID NO: 577372 - DNA, 13 bp, D. melanogaster
agcactgaaaaaa

SEQ ID NO: 577373 - DNA, 13 bp, D. melanogaster
agcactgagaaaa

SEQ ID NO: 577374 - DNA, 14 bp, D. melanogaster
agcactgagagaaa

SEQ ID NO: 577375 - DNA, 13 bp, D. melanogaster
agcactgcgagaa

SEQ ID NO: 577376 - DNA, 13 bp, D. melanogaster
agcactgtcggca

SEQ ID NO: 577377 - DNA, 13 bp, D. melanogaster
agcacttaaaaga

SEQ ID NO: 577378 - DNA, 13 bp, D. melanogaster
agcacttaattaa

SEQ ID NO: 577379 - DNA, 13 bp, D. melanogaster
agcacttcaattg

SEQ ID NO: 577380 - DNA, 13 bp, D. melanogaster
agcacttgaaaat

SEQ ID NO: 577381 - DNA, 13 bp, D. melanogaster
agcacttgcactt

SEQ ID NO: 577382 - DNA, 13 bp, D. melanogaster
agcacttggaaaa

SEQ ID NO: 577383 - DNA, 13 bp, D. melanogaster
agcactttaaaaa

SEQ ID NO: 577384 - DNA, 13 bp, D. melanogaster
agcactttaattg

SEQ ID NO: 577385 - DNA, 13 bp, D. melanogaster
agcactttcgttt

SEQ ID NO: 577386 - DNA, 13 bp, D. melanogaster
agcacttttcttt

SEQ ID NO: 577387 - DNA, 13 bp, D. melanogaster
agcagaaaaaatg

SEQ ID NO: 577388 - DNA, 13 bp, D. melanogaster
agcagaaaaacta

SEQ ID NO: 577389 - DNA, 13 bp, D. melanogaster
agcagaaaacttt

SEQ ID NO: 577390 - DNA, 13 bp, D. melanogaster
agcagaaaagcag

SEQ ID NO: 577391 - DNA, 13 bp, D. melanogaster
agcagaaaataat

SEQ ID NO: 577392 - DNA, 13 bp, D. melanogaster
agcagaaaatcaa

SEQ ID NO: 577393 - DNA, 13 bp, D. melanogaster
agcagaaaattat

SEQ ID NO: 577394 - DNA, 14 bp, D. melanogaster
agcagaaacacgaa

SEQ ID NO: 577395 - DNA, 13 bp, D. melanogaster
agcagaaacagga

SEQ ID NO: 577396 - DNA, 13 bp, D. melanogaster
agcagaaaccgaa

SEQ ID NO: 577397 - DNA, 13 bp, D. melanogaster
agcagaaaccgat

SEQ ID NO: 577398 - DNA, 13 bp, D. melanogaster
agcagaaataatt

SEQ ID NO: 577399 - DNA, 13 bp, D. melanogaster
agcagaaatataa

SEQ ID NO: 577400 - DNA, 13 bp, D. melanogaster
agcagaaatcaaa

SEQ ID NO: 577401 - DNA, 13 bp, D. melanogaster
agcagaaatgcaa

SEQ ID NO: 577402 - DNA, 13 bp, D. melanogaster
agcagaacagata

SEQ ID NO: 577403 - DNA, 13 bp, D. melanogaster
agcagaacagcag

SEQ ID NO: 577404 - DNA, 13 bp, D. melanogaster
agcagaacatgtg

SEQ ID NO: 577405 - DNA, 13 bp, D. melanogaster
agcagaagcaaca

SEQ ID NO: 577406 - DNA, 13 bp, D. melanogaster
agcagaagcaact

SEQ ID NO: 577407 - DNA, 14 bp, D. melanogaster
agcagaagcagaag

SEQ ID NO: 577408 - DNA, 18 bp, D. melanogaster
agcagaagcagcaacaac

SEQ ID NO: 577409 - DNA, 13 bp, D. melanogaster
agcagaagcagga

SEQ ID NO: 577410 - DNA, 14 bp, D. melanogaster
agcagaagcaggag

SEQ ID NO: 577411 - DNA, 13 bp, D. melanogaster
agcagaagccaaa

SEQ ID NO: 577412 - DNA, 13 bp, D. melanogaster
agcagaagcgaca

SEQ ID NO: 577413 - DNA, 13 bp, D. melanogaster
agcagaagctaaa

SEQ ID NO: 577414 - DNA, 14 bp, D. melanogaster
agcagaagctaaag

SEQ ID NO: 577415 - DNA, 13 bp, D. melanogaster
agcagaagctgaa

SEQ ID NO: 577416 - DNA, 13 bp, D. melanogaster
agcagaagctgca

SEQ ID NO: 577417 - DNA, 13 bp, D. melanogaster
agcagaaggaagc

SEQ ID NO: 577418 - DNA, 14 bp, D. melanogaster
agcagaaggagcag

SEQ ID NO: 577419 - DNA, 13 bp, D. melanogaster
agcagaagtcgat

SEQ ID NO: 577420 - DNA, 13 bp, D. melanogaster
agcagaatataat

SEQ ID NO: 577421 - DNA, 13 bp, D. melanogaster
agcagaattaaaa

SEQ ID NO: 577422 - DNA, 13 bp, D. melanogaster
agcagacaactgt

SEQ ID NO: 577423 - DNA, 13 bp, D. melanogaster
agcagacccaaaa

SEQ ID NO: 577424 - DNA, 13 bp, D. melanogaster
agcagacccaaga

SEQ ID NO: 577425 - DNA, 13 bp, D. melanogaster
agcagacgttttt

SEQ ID NO: 577426 - DNA, 13 bp, D. melanogaster
agcagagaagcag

SEQ ID NO: 577427 - DNA, 13 bp, D. melanogaster
agcagagcaaata

SEQ ID NO: 577428 - DNA, 13 bp, D. melanogaster
agcagagcaacaa

SEQ ID NO: 577429 - DNA, 13 bp, D. melanogaster
agcagagcagagc

SEQ ID NO: 577430 - DNA, 14 bp, D. melanogaster
agcagagcagagca

SEQ ID NO: 577431 - DNA, 13 bp, D. melanogaster
agcagagcagcaa

SEQ ID NO: 577432 - DNA, 13 bp, D. melanogaster
agcagagcagctg

SEQ ID NO: 577433 - DNA, 13 bp, D. melanogaster
agcagaggcaaag

SEQ ID NO: 577434 - DNA, 14 bp, D. melanogaster
agcagaggcaaaga

SEQ ID NO: 577435 - DNA, 13 bp, D. melanogaster
agcagaggcagca

SEQ ID NO: 577436 - DNA, 14 bp, D. melanogaster
agcagataaaaaac

SEQ ID NO: 577437 - DNA, 13 bp, D. melanogaster
agcagataactaa

SEQ ID NO: 577438 - DNA, 13 bp, D. melanogaster
agcagatatagta

SEQ ID NO: 577439 - DNA, 13 bp, D. melanogaster
agcagatcgcgaa

SEQ ID NO: 577440 - DNA, 13 bp, D. melanogaster
agcagatttatca

SEQ ID NO: 577441 - DNA, 13 bp, D. melanogaster
agcagcaaaaaat

SEQ ID NO: 577442 - DNA, 13 bp, D. melanogaster
agcagcaaaaagt

SEQ ID NO: 577443 - DNA, 13 bp, D. melanogaster
agcagcaaaaatg

SEQ ID NO: 577444 - DNA, 14 bp, D. melanogaster
agcagcaaaagcaa

SEQ ID NO: 577445 - DNA, 13 bp, D. melanogaster
agcagcaaaatca

SEQ ID NO: 577446 - DNA, 13 bp, D. melanogaster
agcagcaaagcaa

SEQ ID NO: 577447 - DNA, 13 bp, D. melanogaster
agcagcaacaaag

SEQ ID NO: 577448 - DNA, 24 bp, D. melanogaster
agcagcaacaacagcagcagcaga

SEQ ID NO: 577449 - DNA, 14 bp, D. melanogaster
agcagcaacaactg

SEQ ID NO: 577450 - DNA, 13 bp, D. melanogaster
agcagcaacacaa

SEQ ID NO: 577451 - DNA, 14 bp, D. melanogaster
agcagcaacaccaa

SEQ ID NO: 577452 - DNA, 14 bp, D. melanogaster
agcagcaacagcac

SEQ ID NO: 577453 - DNA, 13 bp, D. melanogaster
agcagcaacagcg

SEQ ID NO: 577454 - DNA, 13 bp, D. melanogaster
agcagcaacagct

SEQ ID NO: 577455 - DNA, 14 bp, D. melanogaster
agcagcaacagctg

SEQ ID NO: 577456 - DNA, 13 bp, D. melanogaster
agcagcaacagtc

SEQ ID NO: 577457 - DNA, 13 bp, D. melanogaster
agcagcaacatcc

SEQ ID NO: 577458 - DNA, 14 bp, D. melanogaster
agcagcaacatcgc

SEQ ID NO: 577459 - DNA, 13 bp, D. melanogaster
agcagcaacatct

SEQ ID NO: 577460 - DNA, 14 bp, D. melanogaster
agcagcaacatgat

SEQ ID NO: 577461 - DNA, 13 bp, D. melanogaster
agcagcaacattt

SEQ ID NO: 577462 - DNA, 13 bp, D. melanogaster
agcagcaacgaaa

SEQ ID NO: 577463 - DNA, 13 bp, D. melanogaster
agcagcaactaca

SEQ ID NO: 577464 - DNA, 13 bp, D. melanogaster
agcagcaactgaa

SEQ ID NO: 577465 - DNA, 13 bp, D. melanogaster
agcagcaactttt

SEQ ID NO: 577466 - DNA, 14 bp, D. melanogaster
agcagcaagaacaa

SEQ ID NO: 577467 - DNA, 14 bp, D. melanogaster
agcagcaagcagca

SEQ ID NO: 577468 - DNA, 13 bp, D. melanogaster
agcagcaaggaca

SEQ ID NO: 577469 - DNA, 13 bp, D. melanogaster
agcagcaataata

SEQ ID NO: 577470 - DNA, 13 bp, D. melanogaster
agcagcaatgcca

SEQ ID NO: 577471 - DNA, 13 bp, D. melanogaster
agcagcaattcat

SEQ ID NO: 577472 - DNA, 13 bp, D. melanogaster
agcagcaatttgt

SEQ ID NO: 577473 - DNA, 13 bp, D. melanogaster
agcagcaattttt

SEQ ID NO: 577474 - DNA, 13 bp, D. melanogaster
agcagcacagcaa

SEQ ID NO: 577475 - DNA, 13 bp, D. melanogaster
agcagcacccaca

SEQ ID NO: 577476 - DNA, 13 bp, D. melanogaster
agcagcactcaga

SEQ ID NO: 577477 - DNA, 13 bp, D. melanogaster
agcagcagaaaac

SEQ ID NO: 577478 - DNA, 13 bp, D. melanogaster
agcagcagaaaag

SEQ ID NO: 577479 - DNA, 13 bp, D. melanogaster
agcagcagaaaga

SEQ ID NO: 577480 - DNA, 13 bp, D. melanogaster
agcagcagaaagt

SEQ ID NO: 577481 - DNA, 13 bp, D. melanogaster
agcagcagaacaa

SEQ ID NO: 577482 - DNA, 14 bp, D. melanogaster
agcagcagaagcaa

SEQ ID NO: 577483 - DNA, 13 bp, D. melanogaster
agcagcagaagct

SEQ ID NO: 577484 - DNA, 13 bp, D. melanogaster
agcagcagaagga

SEQ ID NO: 577485 - DNA, 13 bp, D. melanogaster
agcagcagacaaa

SEQ ID NO: 577486 - DNA, 13 bp, D. melanogaster
agcagcagacaga

SEQ ID NO: 577487 - DNA, 13 bp, D. melanogaster
agcagcagagcag

SEQ ID NO: 577488 - DNA, 13 bp, D. melanogaster
agcagcagaggag

SEQ ID NO: 577489 - DNA, 14 bp, D. melanogaster
agcagcagcaaaat

SEQ ID NO: 577490 - DNA, 14 bp, D. melanogaster
agcagcagcaaatg

SEQ ID NO: 577491 - DNA, 15 bp, D. melanogaster
agcagcagcaacaag

SEQ ID NO: 577492 - DNA, 14 bp, D. melanogaster
agcagcagcaacca

SEQ ID NO: 577493 - DNA, 14 bp, D. melanogaster
agcagcagcaactc

SEQ ID NO: 577494 - DNA, 14 bp, D. melanogaster
agcagcagcaactt

SEQ ID NO: 577495 - DNA, 13 bp, D. melanogaster
agcagcagcaatc

SEQ ID NO: 577496 - DNA, 13 bp, D. melanogaster
agcagcagcaatg

SEQ ID NO: 577497 - DNA, 13 bp, D. melanogaster
agcagcagcacaa

SEQ ID NO: 577498 - DNA, 13 bp, D. melanogaster
agcagcagcacat

SEQ ID NO: 577499 - DNA, 14 bp, D. melanogaster
agcagcagcagaaa

SEQ ID NO: 577500 - DNA, 14 bp, D. melanogaster
agcagcagcagaag

SEQ ID NO: 577501 - DNA, 13 bp, D. melanogaster
agcagcagcagac

SEQ ID NO: 577502 - DNA, 13 bp, D. melanogaster
agcagcagcagat

SEQ ID NO: 577503 - DNA, 13 bp, D. melanogaster
agcagcagcagca

SEQ ID NO: 577504 - DNA, 14 bp, D. melanogaster
agcagcagcagccc

SEQ ID NO: 577505 - DNA, 14 bp, D. melanogaster
agcagcagcagcct

SEQ ID NO: 577506 - DNA, 14 bp, D. melanogaster
agcagcagcagcgc

SEQ ID NO: 577507 - DNA, 14 bp, D. melanogaster
agcagcagcagcgg

SEQ ID NO: 577508 - DNA, 14 bp, D. melanogaster
agcagcagcagcgt

SEQ ID NO: 577509 - DNA, 14 bp, D. melanogaster
agcagcagcagcta

SEQ ID NO: 577510 - DNA, 14 bp, D. melanogaster
agcagcagcagctg

SEQ ID NO: 577511 - DNA, 15 bp, D. melanogaster
agcagcagcagctgc

SEQ ID NO: 577512 - DNA, 14 bp, D. melanogaster
agcagcagcagctt

SEQ ID NO: 577513 - DNA, 14 bp, D. melanogaster
agcagcagcaggat

SEQ ID NO: 577514 - DNA, 14 bp, D. melanogaster
agcagcagcaggcg

SEQ ID NO: 577515 - DNA, 14 bp, D. melanogaster
agcagcagcagtaa

SEQ ID NO: 577516 - DNA, 14 bp, D. melanogaster
agcagcagcagtcg

SEQ ID NO: 577517 - DNA, 14 bp, D. melanogaster
agcagcagcagtgg

SEQ ID NO: 577518 - DNA, 13 bp, D. melanogaster
agcagcagcagtt

SEQ ID NO: 577519 - DNA, 13 bp, D. melanogaster
agcagcagcattt

SEQ ID NO: 577520 - DNA, 13 bp, D. melanogaster
agcagcagccaaa

SEQ ID NO: 577521 - DNA, 13 bp, D. melanogaster
agcagcagccaac

SEQ ID NO: 577522 - DNA, 13 bp, D. melanogaster
agcagcagccaag

SEQ ID NO: 577523 - DNA, 14 bp, D. melanogaster
agcagcagccacaa

SEQ ID NO: 577524 - DNA, 13 bp, D. melanogaster
agcagcagccacc

SEQ ID NO: 577525 - DNA, 13 bp, D. melanogaster
agcagcagccgaa

SEQ ID NO: 577526 - DNA, 13 bp, D. melanogaster
agcagcagccgcc

SEQ ID NO: 577527 - DNA, 13 bp, D. melanogaster
agcagcagccttg

SEQ ID NO: 577528 - DNA, 13 bp, D. melanogaster
agcagcagcgcca

SEQ ID NO: 577529 - DNA, 14 bp, D. melanogaster
agcagcagcggcaa

SEQ ID NO: 577530 - DNA, 13 bp, D. melanogaster
agcagcagctcaa

SEQ ID NO: 577531 - DNA, 13 bp, D. melanogaster
agcagcagctgaa

SEQ ID NO: 577532 - DNA, 13 bp, D. melanogaster
agcagcagctgcc

SEQ ID NO: 577533 - DNA, 13 bp, D. melanogaster
agcagcagctgcg

SEQ ID NO: 577534 - DNA, 13 bp, D. melanogaster
agcagcagctgct

SEQ ID NO: 577535 - DNA, 13 bp, D. melanogaster
agcagcagctggc

SEQ ID NO: 577536 - DNA, 13 bp, D. melanogaster
agcagcagctgtg

SEQ ID NO: 577537 - DNA, 14 bp, D. melanogaster
agcagcaggaaaaa

SEQ ID NO: 577538 - DNA, 13 bp, D. melanogaster
agcagcaggaaat

SEQ ID NO: 577539 - DNA, 13 bp, D. melanogaster
agcagcaggaaca

SEQ ID NO: 577540 - DNA, 14 bp, D. melanogaster
agcagcaggaacag

SEQ ID NO: 577541 - DNA, 13 bp, D. melanogaster
agcagcaggacca

SEQ ID NO: 577542 - DNA, 13 bp, D. melanogaster
agcagcaggacga

SEQ ID NO: 577543 - DNA, 15 bp, D. melanogaster
agcagcaggagcaga

SEQ ID NO: 577544 - DNA, 13 bp, D. melanogaster
agcagcaggaggc

SEQ ID NO: 577545 - DNA, 13 bp, D. melanogaster
agcagcaggatct

SEQ ID NO: 577546 - DNA, 13 bp, D. melanogaster
agcagcaggcggc

SEQ ID NO: 577547 - DNA, 13 bp, D. melanogaster
agcagcagggaaa

SEQ ID NO: 577548 - DNA, 13 bp, D. melanogaster
agcagcagtagca

SEQ ID NO: 577549 - DNA, 14 bp, D. melanogaster
agcagcagtagcag

SEQ ID NO: 577550 - DNA, 13 bp, D. melanogaster
agcagcataaaaa

SEQ ID NO: 577551 - DNA, 13 bp, D. melanogaster
agcagcataaaat

SEQ ID NO: 577552 - DNA, 14 bp, D. melanogaster
agcagcatcagcaa

SEQ ID NO: 577553 - DNA, 13 bp, D. melanogaster
agcagcatcatca

SEQ ID NO: 577554 - DNA, 13 bp, D. melanogaster
agcagcatctgga

SEQ ID NO: 577555 - DNA, 13 bp, D. melanogaster
agcagcattgcca

SEQ ID NO: 577556 - DNA, 13 bp, D. melanogaster
agcagcatttttg

SEQ ID NO: 577557 - DNA, 13 bp, D. melanogaster
agcagccaaagga

SEQ ID NO: 577558 - DNA, 13 bp, D. melanogaster
agcagccaaatgg

SEQ ID NO: 577559 - DNA, 13 bp, D. melanogaster
agcagccaaccaa

SEQ ID NO: 577560 - DNA, 13 bp, D. melanogaster
agcagccaagttg

SEQ ID NO: 577561 - DNA, 13 bp, D. melanogaster
agcagccacaaaa

SEQ ID NO: 577562 - DNA, 13 bp, D. melanogaster
agcagccacctaa

SEQ ID NO: 577563 - DNA, 13 bp, D. melanogaster
agcagccagcaaa

SEQ ID NO: 577564 - DNA, 13 bp, D. melanogaster
agcagccagcaac

SEQ ID NO: 577565 - DNA, 13 bp, D. melanogaster
agcagccagcagc

SEQ ID NO: 577566 - DNA, 14 bp, D. melanogaster
agcagccagcagca

SEQ ID NO: 577567 - DNA, 14 bp, D. melanogaster
agcagccagcagcc

SEQ ID NO: 577568 - DNA, 14 bp, D. melanogaster
agcagccagccagc

SEQ ID NO: 577569 - DNA, 13 bp, D. melanogaster
agcagccagcgaa

SEQ ID NO: 577570 - DNA, 13 bp, D. melanogaster
agcagccaggaca

SEQ ID NO: 577571 - DNA, 13 bp, D. melanogaster
agcagcccaaaaa

SEQ ID NO: 577572 - DNA, 13 bp, D. melanogaster
agcagccccaacg

SEQ ID NO: 577573 - DNA, 13 bp, D. melanogaster
agcagccggaaaa

SEQ ID NO: 577574 - DNA, 13 bp, D. melanogaster
agcagcctcactt

SEQ ID NO: 577575 - DNA, 13 bp, D. melanogaster
agcagcctcatca

SEQ ID NO: 577576 - DNA, 14 bp, D. melanogaster
agcagcctcatcaa

SEQ ID NO: 577577 - DNA, 13 bp, D. melanogaster
agcagcgaaaata

SEQ ID NO: 577578 - DNA, 14 bp, D. melanogaster
agcagcgacaacaa

SEQ ID NO: 577579 - DNA, 13 bp, D. melanogaster
agcagcgcaaaaa

SEQ ID NO: 577580 - DNA, 13 bp, D. melanogaster
agcagcgcagcag

SEQ ID NO: 577581 - DNA, 13 bp, D. melanogaster
agcagcgcagtcg

SEQ ID NO: 577582 - DNA, 13 bp, D. melanogaster
agcagcgccagca

SEQ ID NO: 577583 - DNA, 13 bp, D. melanogaster
agcagcgcctttt

SEQ ID NO: 577584 - DNA, 13 bp, D. melanogaster
agcagcggagcgg

SEQ ID NO: 577585 - DNA, 14 bp, D. melanogaster
agcagcggagcggc

SEQ ID NO: 577586 - DNA, 13 bp, D. melanogaster
agcagcggcaaaa

SEQ ID NO: 577587 - DNA, 13 bp, D. melanogaster
agcagcggcagca

SEQ ID NO: 577588 - DNA, 14 bp, D. melanogaster
agcagcggcagcag

SEQ ID NO: 577589 - DNA, 14 bp, D. melanogaster
agcagcggcagcat

SEQ ID NO: 577590 - DNA, 14 bp, D. melanogaster
agcagcggcagcca

SEQ ID NO: 577591 - DNA, 13 bp, D. melanogaster
agcagcggccaaa

SEQ ID NO: 577592 - DNA, 13 bp, D. melanogaster
agcagcggcgaaa

SEQ ID NO: 577593 - DNA, 13 bp, D. melanogaster
agcagcggcggcg

SEQ ID NO: 577594 - DNA, 13 bp, D. melanogaster
agcagcgggcaaa

SEQ ID NO: 577595 - DNA, 13 bp, D. melanogaster
agcagcgtatata

SEQ ID NO: 577596 - DNA, 13 bp, D. melanogaster
agcagcgtttata

SEQ ID NO: 577597 - DNA, 13 bp, D. melanogaster
agcagctaaaaaa

SEQ ID NO: 577598 - DNA, 14 bp, D. melanogaster
agcagctaattacc

SEQ ID NO: 577599 - DNA, 13 bp, D. melanogaster
agcagctacagca

SEQ ID NO: 577600 - DNA, 13 bp, D. melanogaster
agcagctagcagc

SEQ ID NO: 577601 - DNA, 13 bp, D. melanogaster
agcagctattcac

SEQ ID NO: 577602 - DNA, 13 bp, D. melanogaster
agcagctcaagtg

SEQ ID NO: 577603 - DNA, 13 bp, D. melanogaster
agcagctgaaatt

SEQ ID NO: 577604 - DNA, 13 bp, D. melanogaster
agcagctgacaaa

SEQ ID NO: 577605 - DNA, 13 bp, D. melanogaster
agcagctgcaaaa

SEQ ID NO: 577606 - DNA, 14 bp, D. melanogaster
agcagctgcaaaaa

SEQ ID NO: 577607 - DNA, 13 bp, D. melanogaster
agcagctgcaaat

SEQ ID NO: 577608 - DNA, 13 bp, D. melanogaster
agcagctgcagga

SEQ ID NO: 577609 - DNA, 13 bp, D. melanogaster
agcagctgccaca

SEQ ID NO: 577610 - DNA, 13 bp, D. melanogaster
agcagctgccatt

SEQ ID NO: 577611 - DNA, 13 bp, D. melanogaster
agcagctgccgct

SEQ ID NO: 577612 - DNA, 13 bp, D. melanogaster
agcagctgctcct

SEQ ID NO: 577613 - DNA, 13 bp, D. melanogaster
agcagctgctgca

SEQ ID NO: 577614 - DNA, 13 bp, D. melanogaster
agcagctgctgcc

SEQ ID NO: 577615 - DNA, 13 bp, D. melanogaster
agcagctgctgct

SEQ ID NO: 577616 - DNA, 13 bp, D. melanogaster
agcagctgctgtt

SEQ ID NO: 577617 - DNA, 13 bp, D. melanogaster
agcagctggcagc

SEQ ID NO: 577618 - DNA, 13 bp, D. melanogaster
agcagctgttgcc

SEQ ID NO: 577619 - DNA, 13 bp, D. melanogaster
agcagctgttgtt

SEQ ID NO: 577620 - DNA, 13 bp, D. melanogaster
agcagcttaaaat

SEQ ID NO: 577621 - DNA, 13 bp, D. melanogaster
agcagcttaaata

SEQ ID NO: 577622 - DNA, 14 bp, D. melanogaster
agcagcttgtttaa

SEQ ID NO: 577623 - DNA, 13 bp, D. melanogaster
agcagctttgttc

SEQ ID NO: 577624 - DNA, 13 bp, D. melanogaster
agcaggaaaataa

SEQ ID NO: 577625 - DNA, 13 bp, D. melanogaster
agcaggaacagga

SEQ ID NO: 577626 - DNA, 13 bp, D. melanogaster
agcaggagcaaca

SEQ ID NO: 577627 - DNA, 14 bp, D. melanogaster
agcaggagcaacaa

SEQ ID NO: 577628 - DNA, 13 bp, D. melanogaster
agcaggagcagaa

SEQ ID NO: 577629 - DNA, 14 bp, D. melanogaster
agcaggagcagaag

SEQ ID NO: 577630 - DNA, 14 bp, D. melanogaster
agcaggagcagcag

SEQ ID NO: 577631 - DNA, 13 bp, D. melanogaster
agcaggagcagct

SEQ ID NO: 577632 - DNA, 13 bp, D. melanogaster
agcaggagcagga

SEQ ID NO: 577633 - DNA, 14 bp, D. melanogaster
agcaggagcaggaa

SEQ ID NO: 577634 - DNA, 13 bp, D. melanogaster
agcaggagcaggg

SEQ ID NO: 577635 - DNA, 13 bp, D. melanogaster
agcaggagcgcgc

SEQ ID NO: 577636 - DNA, 13 bp, D. melanogaster
agcaggagctgca

SEQ ID NO: 577637 - DNA, 14 bp, D. melanogaster
agcaggaggagcag

SEQ ID NO: 577638 - DNA, 13 bp, D. melanogaster
agcaggaggagct

SEQ ID NO: 577639 - DNA, 14 bp, D. melanogaster
agcaggaggagctg

SEQ ID NO: 577640 - DNA, 13 bp, D. melanogaster
agcaggcaaacaa

SEQ ID NO: 577641 - DNA, 13 bp, D. melanogaster
agcaggcaacaaa

SEQ ID NO: 577642 - DNA, 13 bp, D. melanogaster
agcaggcaataaa

SEQ ID NO: 577643 - DNA, 13 bp, D. melanogaster
agcaggcagagag

SEQ ID NO: 577644 - DNA, 13 bp, D. melanogaster
agcaggcagcaga

SEQ ID NO: 577645 - DNA, 14 bp, D. melanogaster
agcaggcatttttc

SEQ ID NO: 577646 - DNA, 13 bp, D. melanogaster
agcaggccaccga

SEQ ID NO: 577647 - DNA, 13 bp, D. melanogaster
agcaggcgaaatg

SEQ ID NO: 577648 - DNA, 14 bp, D. melanogaster
agcaggcgaacagc

SEQ ID NO: 577649 - DNA, 13 bp, D. melanogaster
agcagggaaaaca

SEQ ID NO: 577650 - DNA, 13 bp, D. melanogaster
agcagggaaaagc

SEQ ID NO: 577651 - DNA, 14 bp, D. melanogaster
agcaggtccatcct

SEQ ID NO: 577652 - DNA, 13 bp, D. melanogaster
agcaggtggaaaa

SEQ ID NO: 577653 - DNA, 13 bp, D. melanogaster
agcagtaaacaaa

SEQ ID NO: 577654 - DNA, 13 bp, D. melanogaster
agcagtaacagca

SEQ ID NO: 577655 - DNA, 13 bp, D. melanogaster
agcagtacgaatt

SEQ ID NO: 577656 - DNA, 14 bp, D. melanogaster
agcagtagcagcaa

SEQ ID NO: 577657 - DNA, 13 bp, D. melanogaster
agcagtagtagta

SEQ ID NO: 577658 - DNA, 13 bp, D. melanogaster
agcagtatgccac

SEQ ID NO: 577659 - DNA, 14 bp, D. melanogaster
agcagtattaactg

SEQ ID NO: 577660 - DNA, 13 bp, D. melanogaster
agcagtattttta

SEQ ID NO: 577661 - DNA, 13 bp, D. melanogaster
agcagtcaaaaca

SEQ ID NO: 577662 - DNA, 13 bp, D. melanogaster
agcagtcagcagt

SEQ ID NO: 577663 - DNA, 13 bp, D. melanogaster
agcagtccgaaat

SEQ ID NO: 577664 - DNA, 13 bp, D. melanogaster
agcagtcctacta

SEQ ID NO: 577665 - DNA, 13 bp, D. melanogaster
agcagtcgcagca

SEQ ID NO: 577666 - DNA, 13 bp, D. melanogaster
agcagtgctacgg

SEQ ID NO: 577667 - DNA, 14 bp, D. melanogaster
agcagtggcagcag

SEQ ID NO: 577668 - DNA, 13 bp, D. melanogaster
agcagtggcagtg

SEQ ID NO: 577669 - DNA, 14 bp, D. melanogaster
agcagtggcagtgg

SEQ ID NO: 577670 - DNA, 13 bp, D. melanogaster
agcagttaaatta

SEQ ID NO: 577671 - DNA, 13 bp, D. melanogaster
agcagttcatcga

SEQ ID NO: 577672 - DNA, 13 bp, D. melanogaster
agcagttgcattt

SEQ ID NO: 577673 - DNA, 13 bp, D. melanogaster
agcagttgttgtt

SEQ ID NO: 577674 - DNA, 13 bp, D. melanogaster
agcagtttaaatt

SEQ ID NO: 577675 - DNA, 13 bp, D. melanogaster
agcagtttcttgt

SEQ ID NO: 577676 - DNA, 13 bp, D. melanogaster
agcataaaaatgt

SEQ ID NO: 577677 - DNA, 13 bp, D. melanogaster
agcataaaaattg

SEQ ID NO: 577678 - DNA, 13 bp, D. melanogaster
agcataaacaaac

SEQ ID NO: 577679 - DNA, 13 bp, D. melanogaster
agcataaacaatt

SEQ ID NO: 577680 - DNA, 13 bp, D. melanogaster
agcataaagcaaa

SEQ ID NO: 577681 - DNA, 13 bp, D. melanogaster
agcataaatatac

SEQ ID NO: 577682 - DNA, 13 bp, D. melanogaster
agcataaatattt

SEQ ID NO: 577683 - DNA, 13 bp, D. melanogaster
agcataaatgcca

SEQ ID NO: 577684 - DNA, 13 bp, D. melanogaster
agcataaatgccg

SEQ ID NO: 577685 - DNA, 13 bp, D. melanogaster
agcataaattaaa

SEQ ID NO: 577686 - DNA, 13 bp, D. melanogaster
agcataacaacaa

SEQ ID NO: 577687 - DNA, 13 bp, D. melanogaster
agcataagaaaag

SEQ ID NO: 577688 - DNA, 13 bp, D. melanogaster
agcataagaaatc

SEQ ID NO: 577689 - DNA, 13 bp, D. melanogaster
agcataagcaaat

SEQ ID NO: 577690 - DNA, 13 bp, D. melanogaster
agcataatgaaca

SEQ ID NO: 577691 - DNA, 14 bp, D. melanogaster
agcataatgaacag

SEQ ID NO: 577692 - DNA, 13 bp, D. melanogaster
agcataatttttt

SEQ ID NO: 577693 - DNA, 14 bp, D. melanogaster
agcatacagattct

SEQ ID NO: 577694 - DNA, 13 bp, D. melanogaster
agcatacagctct

SEQ ID NO: 577695 - DNA, 14 bp, D. melanogaster
agcatacataaata

SEQ ID NO: 577696 - DNA, 14 bp, D. melanogaster
agcatacatacata

SEQ ID NO: 577697 - DNA, 13 bp, D. melanogaster
agcatacattttt

SEQ ID NO: 577698 - DNA, 13 bp, D. melanogaster
agcataccctttt

SEQ ID NO: 577699 - DNA, 13 bp, D. melanogaster
agcatactttcag

SEQ ID NO: 577700 - DNA, 13 bp, D. melanogaster
agcatacttttga

SEQ ID NO: 577701 - DNA, 13 bp, D. melanogaster
agcatactttttg

SEQ ID NO: 577702 - DNA, 14 bp, D. melanogaster
agcatactttttgg

SEQ ID NO: 577703 - DNA, 13 bp, D. melanogaster
agcatagaggcag

SEQ ID NO: 577704 - DNA, 13 bp, D. melanogaster
agcatagcaaaca

SEQ ID NO: 577705 - DNA, 14 bp, D. melanogaster
agcatagcaaacaa

SEQ ID NO: 577706 - DNA, 13 bp, D. melanogaster
agcatataaaaat

SEQ ID NO: 577707 - DNA, 13 bp, D. melanogaster
agcatatacattt

SEQ ID NO: 577708 - DNA, 14 bp, D. melanogaster
agcatatagatata

SEQ ID NO: 577709 - DNA, 14 bp, D. melanogaster
agcatatagcatat

SEQ ID NO: 577710 - DNA, 15 bp, D. melanogaster
agcatatatatatat

SEQ ID NO: 577711 - DNA, 14 bp, D. melanogaster
agcatatatgtata

SEQ ID NO: 577712 - DNA, 13 bp, D. melanogaster
agcatatattttg

SEQ ID NO: 577713 - DNA, 13 bp, D. melanogaster
agcatatgcaaaa

SEQ ID NO: 577714 - DNA, 13 bp, D. melanogaster
agcatatgcatat

SEQ ID NO: 577715 - DNA, 13 bp, D. melanogaster
agcatatgctgca

SEQ ID NO: 577716 - DNA, 13 bp, D. melanogaster
agcatatgtacat

SEQ ID NO: 577717 - DNA, 13 bp, D. melanogaster
agcatatgtatat

SEQ ID NO: 577718 - DNA, 13 bp, D. melanogaster
agcatatgtgcca

SEQ ID NO: 577719 - DNA, 13 bp, D. melanogaster
agcatatttaatt

SEQ ID NO: 577720 - DNA, 13 bp, D. melanogaster
agcatatttatat

SEQ ID NO: 577721 - DNA, 13 bp, D. melanogaster
agcatattttttt

SEQ ID NO: 577722 - DNA, 13 bp, D. melanogaster
agcatcaacaaaa

SEQ ID NO: 577723 - DNA, 13 bp, D. melanogaster
agcatcagcagaa

SEQ ID NO: 577724 - DNA, 13 bp, D. melanogaster
agcatcagttaaa

SEQ ID NO: 577725 - DNA, 13 bp, D. melanogaster
agcatcataaatg

SEQ ID NO: 577726 - DNA, 13 bp, D. melanogaster
agcatcatcaaca

SEQ ID NO: 577727 - DNA, 13 bp, D. melanogaster
agcatccagcatc

SEQ ID NO: 577728 - DNA, 13 bp, D. melanogaster
agcatcccagcat

SEQ ID NO: 577729 - DNA, 14 bp, D. melanogaster
agcatcccagcatc

SEQ ID NO: 577730 - DNA, 13 bp, D. melanogaster
agcatcgatatat

SEQ ID NO: 577731 - DNA, 13 bp, D. melanogaster
agcatgaaaatga

SEQ ID NO: 577732 - DNA, 13 bp, D. melanogaster
agcatgcaaatgc

SEQ ID NO: 577733 - DNA, 13 bp, D. melanogaster
agcatgcactttg

SEQ ID NO: 577734 - DNA, 14 bp, D. melanogaster
agcatgcttggcca

SEQ ID NO: 577735 - DNA, 14 bp, D. melanogaster
agcatggtggtcac

SEQ ID NO: 577736 - DNA, 13 bp, D. melanogaster
agcatgtgctttt

SEQ ID NO: 577737 - DNA, 13 bp, D. melanogaster
agcatgtggagcg

SEQ ID NO: 577738 - DNA, 14 bp, D. melanogaster
agcatgtggagcgg

SEQ ID NO: 577739 - DNA, 13 bp, D. melanogaster
agcatgtgtgtgt

SEQ ID NO: 577740 - DNA, 13 bp, D. melanogaster
agcattaaaaata

SEQ ID NO: 577741 - DNA, 13 bp, D. melanogaster
agcattaaaatta

SEQ ID NO: 577742 - DNA, 13 bp, D. melanogaster
agcattaaaattg

SEQ ID NO: 577743 - DNA, 13 bp, D. melanogaster
agcattaaacaaa

SEQ ID NO: 577744 - DNA, 14 bp, D. melanogaster
agcattaacaaaac

SEQ ID NO: 577745 - DNA, 13 bp, D. melanogaster
agcattaacaatt

SEQ ID NO: 577746 - DNA, 13 bp, D. melanogaster
agcattaagtttt

SEQ ID NO: 577747 - DNA, 13 bp, D. melanogaster
agcattaatttaa

SEQ ID NO: 577748 - DNA, 13 bp, D. melanogaster
agcattatgggca

SEQ ID NO: 577749 - DNA, 13 bp, D. melanogaster
agcattattggct

SEQ ID NO: 577750 - DNA, 14 bp, D. melanogaster
agcattcaaaaata

SEQ ID NO: 577751 - DNA, 13 bp, D. melanogaster
agcattcaaaaca

SEQ ID NO: 577752 - DNA, 13 bp, D. melanogaster
agcattcaacaaa

SEQ ID NO: 577753 - DNA, 14 bp, D. melanogaster
agcattcccacgct

SEQ ID NO: 577754 - DNA, 13 bp, D. melanogaster
agcattcgaaaaa

SEQ ID NO: 577755 - DNA, 13 bp, D. melanogaster
agcattcgactga

SEQ ID NO: 577756 - DNA, 13 bp, D. melanogaster
agcattcgattgg

SEQ ID NO: 577757 - DNA, 13 bp, D. melanogaster
agcattcgtttat

SEQ ID NO: 577758 - DNA, 14 bp, D. melanogaster
agcattctctcttg

SEQ ID NO: 577759 - DNA, 13 bp, D. melanogaster
agcattctgcaac

SEQ ID NO: 577760 - DNA, 13 bp, D. melanogaster
agcattctgcgaa

SEQ ID NO: 577761 - DNA, 13 bp, D. melanogaster
agcattcttggag

SEQ ID NO: 577762 - DNA, 16 bp, D. melanogaster
agcattgaaagagtgt

SEQ ID NO: 577763 - DNA, 13 bp, D. melanogaster
agcattgaccaca

SEQ ID NO: 577764 - DNA, 13 bp, D. melanogaster
agcattgctcttg

SEQ ID NO: 577765 - DNA, 13 bp, D. melanogaster
agcattggacttt

SEQ ID NO: 577766 - DNA, 13 bp, D. melanogaster
agcattgggccaa

SEQ ID NO: 577767 - DNA, 13 bp, D. melanogaster
agcattggtaatt

SEQ ID NO: 577768 - DNA, 13 bp, D. melanogaster
agcattgttaaag

SEQ ID NO: 577769 - DNA, 13 bp, D. melanogaster
agcattgttttgt

SEQ ID NO: 577770 - DNA, 13 bp, D. melanogaster
agcatttaaatat

SEQ ID NO: 577771 - DNA, 13 bp, D. melanogaster
agcatttaaatgg

SEQ ID NO: 577772 - DNA, 13 bp, D. melanogaster
agcatttaataat

SEQ ID NO: 577773 - DNA, 13 bp, D. melanogaster
agcatttaatcaa

SEQ ID NO: 577774 - DNA, 13 bp, D. melanogaster
agcatttaattga

SEQ ID NO: 577775 - DNA, 14 bp, D. melanogaster
agcatttaatttat

SEQ ID NO: 577776 - DNA, 14 bp, D. melanogaster
agcatttagcattt

SEQ ID NO: 577777 - DNA, 13 bp, D. melanogaster
agcatttatagtt

SEQ ID NO: 577778 - DNA, 13 bp, D. melanogaster
agcatttatgagc

SEQ ID NO: 577779 - DNA, 13 bp, D. melanogaster
agcatttattaaa

SEQ ID NO: 577780 - DNA, 13 bp, D. melanogaster
agcatttcaaaat

SEQ ID NO: 577781 - DNA, 13 bp, D. melanogaster
agcatttcagcat

SEQ ID NO: 577782 - DNA, 13 bp, D. melanogaster
agcatttcatcac

SEQ ID NO: 577783 - DNA, 13 bp, D. melanogaster
agcatttcattca

SEQ ID NO: 577784 - DNA, 14 bp, D. melanogaster
agcatttcatttca

SEQ ID NO: 577785 - DNA, 13 bp, D. melanogaster
agcatttccattt

SEQ ID NO: 577786 - DNA, 13 bp, D. melanogaster
agcatttcccatt

SEQ ID NO: 577787 - DNA, 13 bp, D. melanogaster
agcatttcgaaaa

SEQ ID NO: 577788 - DNA, 13 bp, D. melanogaster
agcatttgaaaaa

SEQ ID NO: 577789 - DNA, 13 bp, D. melanogaster
agcatttgaaaat

SEQ ID NO: 577790 - DNA, 13 bp, D. melanogaster
agcatttgcaaaa

SEQ ID NO: 577791 - DNA, 13 bp, D. melanogaster
agcatttgcataa

SEQ ID NO: 577792 - DNA, 13 bp, D. melanogaster
agcatttgcattt

SEQ ID NO: 577793 - DNA, 14 bp, D. melanogaster
agcatttgcatttg

SEQ ID NO: 577794 - DNA, 13 bp, D. melanogaster
agcatttgccaac

SEQ ID NO: 577795 - DNA, 14 bp, D. melanogaster
agcatttgccaacc

SEQ ID NO: 577796 - DNA, 13 bp, D. melanogaster
agcatttgcccaa

SEQ ID NO: 577797 - DNA, 13 bp, D. melanogaster
agcatttggcatt

SEQ ID NO: 577798 - DNA, 14 bp, D. melanogaster
agcatttggccgga

SEQ ID NO: 577799 - DNA, 13 bp, D. melanogaster
agcattttaaata

SEQ ID NO: 577800 - DNA, 14 bp, D. melanogaster
agcattttaaataa

SEQ ID NO: 577801 - DNA, 13 bp, D. melanogaster
agcattttaaatg

SEQ ID NO: 577802 - DNA, 13 bp, D. melanogaster
agcattttaataa

SEQ ID NO: 577803 - DNA, 13 bp, D. melanogaster
agcattttaattg

SEQ ID NO: 577804 - DNA, 14 bp, D. melanogaster
agcattttatttaa

SEQ ID NO: 577805 - DNA, 14 bp, D. melanogaster
agcattttcaaaaa

SEQ ID NO: 577806 - DNA, 13 bp, D. melanogaster
agcattttccatt

SEQ ID NO: 577807 - DNA, 13 bp, D. melanogaster
agcattttcccca

SEQ ID NO: 577808 - DNA, 13 bp, D. melanogaster
agcattttctctt

SEQ ID NO: 577809 - DNA, 13 bp, D. melanogaster
agcattttctttc

SEQ ID NO: 577810 - DNA, 13 bp, D. melanogaster
agcattttgaatt

SEQ ID NO: 577811 - DNA, 13 bp, D. melanogaster
agcattttgattg

SEQ ID NO: 577812 - DNA, 13 bp, D. melanogaster
agcattttgattt

SEQ ID NO: 577813 - DNA, 13 bp, D. melanogaster
agcattttgcaat

SEQ ID NO: 577814 - DNA, 13 bp, D. melanogaster
agcattttgcaca

SEQ ID NO: 577815 - DNA, 14 bp, D. melanogaster
agcattttgcattt

SEQ ID NO: 577816 - DNA, 13 bp, D. melanogaster
agcattttgccag

SEQ ID NO: 577817 - DNA, 13 bp, D. melanogaster
agcattttgggca

SEQ ID NO: 577818 - DNA, 14 bp, D. melanogaster
agcatttttaaatt

SEQ ID NO: 577819 - DNA, 13 bp, D. melanogaster
agcatttttcaat

SEQ ID NO: 577820 - DNA, 13 bp, D. melanogaster
agcatttttcttt

SEQ ID NO: 577821 - DNA, 13 bp, D. melanogaster
agcatttttgctt

SEQ ID NO: 577822 - DNA, 13 bp, D. melanogaster
agcattttttcaa

SEQ ID NO: 577823 - DNA, 13 bp, D. melanogaster
agccaaaaaatat

SEQ ID NO: 577824 - DNA, 13 bp, D. melanogaster
agccaaaaagacg

SEQ ID NO: 577825 - DNA, 13 bp, D. melanogaster
agccaaaaagcag

SEQ ID NO: 577826 - DNA, 13 bp, D. melanogaster
agccaaaaagcca

SEQ ID NO: 577827 - DNA, 13 bp, D. melanogaster
agccaaaaaggca

SEQ ID NO: 577828 - DNA, 13 bp, D. melanogaster
agccaaaaagtat

SEQ ID NO: 577829 - DNA, 13 bp, D. melanogaster
agccaaaaatgca

SEQ ID NO: 577830 - DNA, 13 bp, D. melanogaster
agccaaaacaata

SEQ ID NO: 577831 - DNA, 13 bp, D. melanogaster
agccaaaacaatt

SEQ ID NO: 577832 - DNA, 13 bp, D. melanogaster
agccaaaactgaa

SEQ ID NO: 577833 - DNA, 13 bp, D. melanogaster
agccaaaagcaac

SEQ ID NO: 577834 - DNA, 13 bp, D. melanogaster
agccaaaagcaat

SEQ ID NO: 577835 - DNA, 13 bp, D. melanogaster
agccaaaagccaa

SEQ ID NO: 577836 - DNA, 13 bp, D. melanogaster
agccaaaagccag

SEQ ID NO: 577837 - DNA, 13 bp, D. melanogaster
agccaaaagtaaa

SEQ ID NO: 577838 - DNA, 13 bp, D. melanogaster
agccaaaagttaa

SEQ ID NO: 577839 - DNA, 13 bp, D. melanogaster
agccaaaatattt

SEQ ID NO: 577840 - DNA, 13 bp, D. melanogaster
agccaaaatccaa

SEQ ID NO: 577841 - DNA, 13 bp, D. melanogaster
agccaaaatgaaa

SEQ ID NO: 577842 - DNA, 13 bp, D. melanogaster
agccaaacaaaat

SEQ ID NO: 577843 - DNA, 13 bp, D. melanogaster
agccaaacaaatg

SEQ ID NO: 577844 - DNA, 13 bp, D. melanogaster
agccaaacaaatt

SEQ ID NO: 577845 - DNA, 13 bp, D. melanogaster
agccaaacaataa

SEQ ID NO: 577846 - DNA, 13 bp, D. melanogaster
agccaaacaattt

SEQ ID NO: 577847 - DNA, 13 bp, D. melanogaster
agccaaacacttg

SEQ ID NO: 577848 - DNA, 13 bp, D. melanogaster
agccaaacagcca

SEQ ID NO: 577849 - DNA, 13 bp, D. melanogaster
agccaaacatttg

SEQ ID NO: 577850 - DNA, 13 bp, D. melanogaster
agccaaaccgaac

SEQ ID NO: 577851 - DNA, 13 bp, D. melanogaster
agccaaacgaaac

SEQ ID NO: 577852 - DNA, 13 bp, D. melanogaster
agccaaactaaaa

SEQ ID NO: 577853 - DNA, 13 bp, D. melanogaster
agccaaactaatt

SEQ ID NO: 577854 - DNA, 13 bp, D. melanogaster
agccaaactattt

SEQ ID NO: 577855 - DNA, 13 bp, D. melanogaster
agccaaactgaaa

SEQ ID NO: 577856 - DNA, 13 bp, D. melanogaster
agccaaagaactt

SEQ ID NO: 577857 - DNA, 14 bp, D. melanogaster
agccaaagaacttc

SEQ ID NO: 577858 - DNA, 13 bp, D. melanogaster
agccaaagatgag

SEQ ID NO: 577859 - DNA, 13 bp, D. melanogaster
agccaaagcaaac

SEQ ID NO: 577860 - DNA, 13 bp, D. melanogaster
agccaaagcaaag

SEQ ID NO: 577861 - DNA, 13 bp, D. melanogaster
agccaaagccaaa

SEQ ID NO: 577862 - DNA, 14 bp, D. melanogaster
agccaaagccaaac

SEQ ID NO: 577863 - DNA, 14 bp, D. melanogaster
agccaaagccaaat

SEQ ID NO: 577864 - DNA, 13 bp, D. melanogaster
agccaaagccaac

SEQ ID NO: 577865 - DNA, 13 bp, D. melanogaster
agccaaagccaag

SEQ ID NO: 577866 - DNA, 13 bp, D. melanogaster
agccaaagccaga

SEQ ID NO: 577867 - DNA, 13 bp, D. melanogaster
agccaaagcgaaa

SEQ ID NO: 577868 - DNA, 13 bp, D. melanogaster
agccaaaggcaaa

SEQ ID NO: 577869 - DNA, 13 bp, D. melanogaster
agccaaaggcaac

SEQ ID NO: 577870 - DNA, 13 bp, D. melanogaster
agccaaagggaaa

SEQ ID NO: 577871 - DNA, 13 bp, D. melanogaster
agccaaagtaaat

SEQ ID NO: 577872 - DNA, 13 bp, D. melanogaster
agccaaagtcaaa

SEQ ID NO: 577873 - DNA, 14 bp, D. melanogaster
agccaaagtcaaag

SEQ ID NO: 577874 - DNA, 13 bp, D. melanogaster
agccaaagtcgaa

SEQ ID NO: 577875 - DNA, 13 bp, D. melanogaster
agccaaagtgcca

SEQ ID NO: 577876 - DNA, 13 bp, D. melanogaster
agccaaagtggca

SEQ ID NO: 577877 - DNA, 13 bp, D. melanogaster
agccaaagttgtt

SEQ ID NO: 577878 - DNA, 13 bp, D. melanogaster
agccaaagttttc

SEQ ID NO: 577879 - DNA, 13 bp, D. melanogaster
agccaaataaaat

SEQ ID NO: 577880 - DNA, 13 bp, D. melanogaster
agccaaataaatc

SEQ ID NO: 577881 - DNA, 13 bp, D. melanogaster
agccaaataaatt

SEQ ID NO: 577882 - DNA, 13 bp, D. melanogaster
agccaaatacaaa

SEQ ID NO: 577883 - DNA, 13 bp, D. melanogaster
agccaaatatttc

SEQ ID NO: 577884 - DNA, 13 bp, D. melanogaster
agccaaatcaaaa

SEQ ID NO: 577885 - DNA, 13 bp, D. melanogaster
agccaaatcaaat

SEQ ID NO: 577886 - DNA, 13 bp, D. melanogaster
agccaaatccaaa

SEQ ID NO: 577887 - DNA, 13 bp, D. melanogaster
agccaaatcgaaa

SEQ ID NO: 577888 - DNA, 13 bp, D. melanogaster
agccaaatgaaaa

SEQ ID NO: 577889 - DNA, 14 bp, D. melanogaster
agccaaatgaaaat

SEQ ID NO: 577890 - DNA, 13 bp, D. melanogaster
agccaaatgaaat

SEQ ID NO: 577891 - DNA, 13 bp, D. melanogaster
agccaaatgcaaa

SEQ ID NO: 577892 - DNA, 13 bp, D. melanogaster
agccaaatgcaat

SEQ ID NO: 577893 - DNA, 13 bp, D. melanogaster
agccaaatgccaa

SEQ ID NO: 577894 - DNA, 13 bp, D. melanogaster
agccaaatggaaa

SEQ ID NO: 577895 - DNA, 13 bp, D. melanogaster
agccaaatggcaa

SEQ ID NO: 577896 - DNA, 13 bp, D. melanogaster
agccaaattaaaa

SEQ ID NO: 577897 - DNA, 13 bp, D. melanogaster
agccaaattcaat

SEQ ID NO: 577898 - DNA, 13 bp, D. melanogaster
agccaaattgaaa

SEQ ID NO: 577899 - DNA, 13 bp, D. melanogaster
agccaaattgaat

SEQ ID NO: 577900 - DNA, 13 bp, D. melanogaster
agccaaattgatg

SEQ ID NO: 577901 - DNA, 13 bp, D. melanogaster
agccaaatttaaa

SEQ ID NO: 577902 - DNA, 13 bp, D. melanogaster
agccaaatttaat

SEQ ID NO: 577903 - DNA, 13 bp, D. melanogaster
agccaacaaaagc

SEQ ID NO: 577904 - DNA, 13 bp, D. melanogaster
agccaacaaaatg

SEQ ID NO: 577905 - DNA, 13 bp, D. melanogaster
agccaacagcagc

SEQ ID NO: 577906 - DNA, 14 bp, D. melanogaster
agccaacagccaac

SEQ ID NO: 577907 - DNA, 13 bp, D. melanogaster
agccaacatcaag

SEQ ID NO: 577908 - DNA, 13 bp, D. melanogaster
agccaaccagcca

SEQ ID NO: 577909 - DNA, 13 bp, D. melanogaster
agccaacgaaaag

SEQ ID NO: 577910 - DNA, 13 bp, D. melanogaster
agccaactaattg

SEQ ID NO: 577911 - DNA, 13 bp, D. melanogaster
agccaactaattt

SEQ ID NO: 577912 - DNA, 14 bp, D. melanogaster
agccaactcaaatt

SEQ ID NO: 577913 - DNA, 13 bp, D. melanogaster
agccaactgaaaa

SEQ ID NO: 577914 - DNA, 13 bp, D. melanogaster
agccaactgcaaa

SEQ ID NO: 577915 - DNA, 13 bp, D. melanogaster
agccaactgccaa

SEQ ID NO: 577916 - DNA, 13 bp, D. melanogaster
agccaactggcca

SEQ ID NO: 577917 - DNA, 13 bp, D. melanogaster
agccaactgggaa

SEQ ID NO: 577918 - DNA, 13 bp, D. melanogaster
agccaagaaaaat

SEQ ID NO: 577919 - DNA, 13 bp, D. melanogaster
agccaagaaaagc

SEQ ID NO: 577920 - DNA, 13 bp, D. melanogaster
agccaagaaaata

SEQ ID NO: 577921 - DNA, 13 bp, D. melanogaster
agccaagaaaatg

SEQ ID NO: 577922 - DNA, 13 bp, D. melanogaster
agccaagacaaac

SEQ ID NO: 577923 - DNA, 13 bp, D. melanogaster
agccaagagccaa

SEQ ID NO: 577924 - DNA, 13 bp, D. melanogaster
agccaagatagaa

SEQ ID NO: 577925 - DNA, 13 bp, D. melanogaster
agccaagcaaaag

SEQ ID NO: 577926 - DNA, 13 bp, D. melanogaster
agccaagcaaatc

SEQ ID NO: 577927 - DNA, 13 bp, D. melanogaster
agccaagcagcca

SEQ ID NO: 577928 - DNA, 13 bp, D. melanogaster
agccaagccaaat

SEQ ID NO: 577929 - DNA, 13 bp, D. melanogaster
agccaagccaagt

SEQ ID NO: 577930 - DNA, 13 bp, D. melanogaster
agccaagcccaaa

SEQ ID NO: 577931 - DNA, 13 bp, D. melanogaster
agccaagccccaa

SEQ ID NO: 577932 - DNA, 13 bp, D. melanogaster
agccaagcgaaaa

SEQ ID NO: 577933 - DNA, 13 bp, D. melanogaster
agccaagcgacag

SEQ ID NO: 577934 - DNA, 13 bp, D. melanogaster
agccaagctgcca

SEQ ID NO: 577935 - DNA, 13 bp, D. melanogaster
agccaaggaaaac

SEQ ID NO: 577936 - DNA, 13 bp, D. melanogaster
agccaaggaaaat

SEQ ID NO: 577937 - DNA, 13 bp, D. melanogaster
agccaagggaaaa

SEQ ID NO: 577938 - DNA, 13 bp, D. melanogaster
agccaagtcaagc

SEQ ID NO: 577939 - DNA, 13 bp, D. melanogaster
agccaagtcaagt

SEQ ID NO: 577940 - DNA, 13 bp, D. melanogaster
agccaagtcgatc

SEQ ID NO: 577941 - DNA, 13 bp, D. melanogaster
agccaagtgaaaa

SEQ ID NO: 577942 - DNA, 13 bp, D. melanogaster
agccaagtgattt

SEQ ID NO: 577943 - DNA, 13 bp, D. melanogaster
agccaagttaaaa

SEQ ID NO: 577944 - DNA, 13 bp, D. melanogaster
agccaagttaata

SEQ ID NO: 577945 - DNA, 13 bp, D. melanogaster
agccaagttcaag

SEQ ID NO: 577946 - DNA, 13 bp, D. melanogaster
agccaagttggca

SEQ ID NO: 577947 - DNA, 13 bp, D. melanogaster
agccaagttggcc

SEQ ID NO: 577948 - DNA, 13 bp, D. melanogaster
agccaataaatta

SEQ ID NO: 577949 - DNA, 13 bp, D. melanogaster
agccaataatgct

SEQ ID NO: 577950 - DNA, 13 bp, D. melanogaster
agccaatatatat

SEQ ID NO: 577951 - DNA, 13 bp, D. melanogaster
agccaatcaatca

SEQ ID NO: 577952 - DNA, 13 bp, D. melanogaster
agccaatccaatc

SEQ ID NO: 577953 - DNA, 14 bp, D. melanogaster
agccaatctagatc

SEQ ID NO: 577954 - DNA, 13 bp, D. melanogaster
agccaatgaaata

SEQ ID NO: 577955 - DNA, 13 bp, D. melanogaster
agccaatgccaaa

SEQ ID NO: 577956 - DNA, 13 bp, D. melanogaster
agccaatgccaat

SEQ ID NO: 577957 - DNA, 13 bp, D. melanogaster
agccaatggaaaa

SEQ ID NO: 577958 - DNA, 13 bp, D. melanogaster
agccaattaaatt

SEQ ID NO: 577959 - DNA, 13 bp, D. melanogaster
agccaattaatta

SEQ ID NO: 577960 - DNA, 13 bp, D. melanogaster
agccaattgaatt

SEQ ID NO: 577961 - DNA, 13 bp, D. melanogaster
agccaatttgtta

SEQ ID NO: 577962 - DNA, 13 bp, D. melanogaster
agccacaaaaatt

SEQ ID NO: 577963 - DNA, 13 bp, D. melanogaster
agccacaaaagtt

SEQ ID NO: 577964 - DNA, 13 bp, D. melanogaster
agccacaaaatgc

SEQ ID NO: 577965 - DNA, 13 bp, D. melanogaster
agccacaaataaa

SEQ ID NO: 577966 - DNA, 13 bp, D. melanogaster
agccacaaatcaa

SEQ ID NO: 577967 - DNA, 13 bp, D. melanogaster
agccacaacaata

SEQ ID NO: 577968 - DNA, 13 bp, D. melanogaster
agccacacaaaag

SEQ ID NO: 577969 - DNA, 13 bp, D. melanogaster
agccacacaaatt

SEQ ID NO: 577970 - DNA, 13 bp, D. melanogaster
agccacagataca

SEQ ID NO: 577971 - DNA, 13 bp, D. melanogaster
agccacagcaaca

SEQ ID NO: 577972 - DNA, 14 bp, D. melanogaster
agccacagcaacaa

SEQ ID NO: 577973 - DNA, 14 bp, D. melanogaster
agccacagcagcag

SEQ ID NO: 577974 - DNA, 13 bp, D. melanogaster
agccacagccaaa

SEQ ID NO: 577975 - DNA, 13 bp, D. melanogaster
agccacagccaca

SEQ ID NO: 577976 - DNA, 13 bp, D. melanogaster
agccacagccttc

SEQ ID NO: 577977 - DNA, 14 bp, D. melanogaster
agccacatgccgag

SEQ ID NO: 577978 - DNA, 13 bp, D. melanogaster
agccacattaaat

SEQ ID NO: 577979 - DNA, 13 bp, D. melanogaster
agccaccaagcca

SEQ ID NO: 577980 - DNA, 13 bp, D. melanogaster
agccaccacatta

SEQ ID NO: 577981 - DNA, 13 bp, D. melanogaster
agccacccactcg

SEQ ID NO: 577982 - DNA, 13 bp, D. melanogaster
agccacccacttt

SEQ ID NO: 577983 - DNA, 13 bp, D. melanogaster
agccacccagcca

SEQ ID NO: 577984 - DNA, 13 bp, D. melanogaster
agccacccatcca

SEQ ID NO: 577985 - DNA, 13 bp, D. melanogaster
agccacgcacaac

SEQ ID NO: 577986 - DNA, 13 bp, D. melanogaster
agccacgcccacg

SEQ ID NO: 577987 - DNA, 13 bp, D. melanogaster
agccacgcccact

SEQ ID NO: 577988 - DNA, 14 bp, D. melanogaster
agccacgcccccat

SEQ ID NO: 577989 - DNA, 13 bp, D. melanogaster
agccacgcccctt

SEQ ID NO: 577990 - DNA, 13 bp, D. melanogaster
agccacggccaaa

SEQ ID NO: 577991 - DNA, 13 bp, D. melanogaster
agccacggcgaaa

SEQ ID NO: 577992 - DNA, 13 bp, D. melanogaster
agccactatcaat

SEQ ID NO: 577993 - DNA, 13 bp, D. melanogaster
agccactcgtgtg

SEQ ID NO: 577994 - DNA, 13 bp, D. melanogaster
agccacttggcag

SEQ ID NO: 577995 - DNA, 13 bp, D. melanogaster
agccacttggcat

SEQ ID NO: 577996 - DNA, 13 bp, D. melanogaster
agccacttttttg

SEQ ID NO: 577997 - DNA, 15 bp, D. melanogaster
agccagaaaaactag

SEQ ID NO: 577998 - DNA, 13 bp, D. melanogaster
agccagaaagcca

SEQ ID NO: 577999 - DNA, 13 bp, D. melanogaster
agccagaaatatt

SEQ ID NO: 578000 - DNA, 14 bp, D. melanogaster
agccagaaatgtgg

SEQ ID NO: 578001 - DNA, 13 bp, D. melanogaster
agccagaaccaga

SEQ ID NO: 578002 - DNA, 13 bp, D. melanogaster
agccagaagccag

SEQ ID NO: 578003 - DNA, 13 bp, D. melanogaster
agccagacaaaca

SEQ ID NO: 578004 - DNA, 13 bp, D. melanogaster
agccagacaattg

SEQ ID NO: 578005 - DNA, 13 bp, D. melanogaster
agccagagccaaa

SEQ ID NO: 578006 - DNA, 13 bp, D. melanogaster
agccagagccaga

SEQ ID NO: 578007 - DNA, 13 bp, D. melanogaster
agccagataaagc

SEQ ID NO: 578008 - DNA, 13 bp, D. melanogaster
agccagcaaacaa

SEQ ID NO: 578009 - DNA, 13 bp, D. melanogaster
agccagcaaattg

SEQ ID NO: 578010 - DNA, 13 bp, D. melanogaster
agccagcaacaaa

SEQ ID NO: 578011 - DNA, 14 bp, D. melanogaster
agccagcaacaaca

SEQ ID NO: 578012 - DNA, 13 bp, D. melanogaster
agccagcaagcca

SEQ ID NO: 578013 - DNA, 13 bp, D. melanogaster
agccagcaattag

SEQ ID NO: 578014 - DNA, 14 bp, D. melanogaster
agccagcaattagt

SEQ ID NO: 578015 - DNA, 13 bp, D. melanogaster
agccagcacacac

SEQ ID NO: 578016 - DNA, 13 bp, D. melanogaster
agccagcagccaa

SEQ ID NO: 578017 - DNA, 14 bp, D. melanogaster
agccagcagccagc

SEQ ID NO: 578018 - DNA, 13 bp, D. melanogaster
agccagccaaatg

SEQ ID NO: 578019 - DNA, 14 bp, D. melanogaster
agccagccaaccag

SEQ ID NO: 578020 - DNA, 13 bp, D. melanogaster
agccagccaagca

SEQ ID NO: 578021 - DNA, 13 bp, D. melanogaster
agccagccacaaa

SEQ ID NO: 578022 - DNA, 14 bp, D. melanogaster
agccagccacatgc

SEQ ID NO: 578023 - DNA, 13 bp, D. melanogaster
agccagccaccca

SEQ ID NO: 578024 - DNA, 13 bp, D. melanogaster
agccagccagaaa

SEQ ID NO: 578025 - DNA, 13 bp, D. melanogaster
agccagccagcaa

SEQ ID NO: 578026 - DNA, 13 bp, D. melanogaster
agccagccagcag

SEQ ID NO: 578027 - DNA, 13 bp, D. melanogaster
agccagccagcca

SEQ ID NO: 578028 - DNA, 13 bp, D. melanogaster
agccagccagccg

SEQ ID NO: 578029 - DNA, 13 bp, D. melanogaster
agccagccagctg

SEQ ID NO: 578030 - DNA, 14 bp, D. melanogaster
agccagccagtcag

SEQ ID NO: 578031 - DNA, 13 bp, D. melanogaster
agccagccgaaaa

SEQ ID NO: 578032 - DNA, 13 bp, D. melanogaster
agccagcgaaatg

SEQ ID NO: 578033 - DNA, 13 bp, D. melanogaster
agccagcgaacaa

SEQ ID NO: 578034 - DNA, 13 bp, D. melanogaster
agccagcggaaaa

SEQ ID NO: 578035 - DNA, 13 bp, D. melanogaster
agccagctagcca

SEQ ID NO: 578036 - DNA, 13 bp, D. melanogaster
agccaggaaaaga

SEQ ID NO: 578037 - DNA, 14 bp, D. melanogaster
agccaggaaaagat

SEQ ID NO: 578038 - DNA, 13 bp, D. melanogaster
agccaggagaatt

SEQ ID NO: 578039 - DNA, 13 bp, D. melanogaster
agccaggagcagg

SEQ ID NO: 578040 - DNA, 13 bp, D. melanogaster
agccaggagccag

SEQ ID NO: 578041 - DNA, 13 bp, D. melanogaster
agccaggcaaaaa

SEQ ID NO: 578042 - DNA, 13 bp, D. melanogaster
agccaggcagcca

SEQ ID NO: 578043 - DNA, 13 bp, D. melanogaster
agccaggccaaaa

SEQ ID NO: 578044 - DNA, 13 bp, D. melanogaster
agccaggccaagt

SEQ ID NO: 578045 - DNA, 13 bp, D. melanogaster
agccaggccaggc

SEQ ID NO: 578046 - DNA, 13 bp, D. melanogaster
agccaggcccaaa

SEQ ID NO: 578047 - DNA, 13 bp, D. melanogaster
agccaggcgattt

SEQ ID NO: 578048 - DNA, 13 bp, D. melanogaster
agccaggggaaaa

SEQ ID NO: 578049 - DNA, 13 bp, D. melanogaster
agccagtacacac

SEQ ID NO: 578050 - DNA, 13 bp, D. melanogaster
agccagtagccag

SEQ ID NO: 578051 - DNA, 13 bp, D. melanogaster
agccagtggaaaa

SEQ ID NO: 578052 - DNA, 13 bp, D. melanogaster
agccagtggaggt

SEQ ID NO: 578053 - DNA, 13 bp, D. melanogaster
agccagttggcca

SEQ ID NO: 578054 - DNA, 13 bp, D. melanogaster
agccataaaaaca

SEQ ID NO: 578055 - DNA, 13 bp, D. melanogaster
agccataaaaact

SEQ ID NO: 578056 - DNA, 13 bp, D. melanogaster
agccataaaaagt

SEQ ID NO: 578057 - DNA, 13 bp, D. melanogaster
agccataaaatcg

SEQ ID NO: 578058 - DNA, 13 bp, D. melanogaster
agccataaacttt

SEQ ID NO: 578059 - DNA, 13 bp, D. melanogaster
agccataaattaa

SEQ ID NO: 578060 - DNA, 13 bp, D. melanogaster
agccataaattgt

SEQ ID NO: 578061 - DNA, 13 bp, D. melanogaster
agccatacacaaa

SEQ ID NO: 578062 - DNA, 13 bp, D. melanogaster
agccatagtttca

SEQ ID NO: 578063 - DNA, 13 bp, D. melanogaster
agccatatagcca

SEQ ID NO: 578064 - DNA, 14 bp, D. melanogaster
agccatatagccat

SEQ ID NO: 578065 - DNA, 13 bp, D. melanogaster
agccatatctgca

SEQ ID NO: 578066 - DNA, 13 bp, D. melanogaster
agccatcatcata

SEQ ID NO: 578067 - DNA, 14 bp, D. melanogaster
agccatcatcatat

SEQ ID NO: 578068 - DNA, 13 bp, D. melanogaster
agccatcatcatc

SEQ ID NO: 578069 - DNA, 14 bp, D. melanogaster
agccatccagccag

SEQ ID NO: 578070 - DNA, 13 bp, D. melanogaster
agccatcccatcc

SEQ ID NO: 578071 - DNA, 13 bp, D. melanogaster
agccatcgaaagg

SEQ ID NO: 578072 - DNA, 13 bp, D. melanogaster
agccatctctctc

SEQ ID NO: 578073 - DNA, 13 bp, D. melanogaster
agccatgaaatat

SEQ ID NO: 578074 - DNA, 13 bp, D. melanogaster
agccatggcaaca

SEQ ID NO: 578075 - DNA, 13 bp, D. melanogaster
agccattaaagtt

SEQ ID NO: 578076 - DNA, 13 bp, D. melanogaster
agccattaatagt

SEQ ID NO: 578077 - DNA, 13 bp, D. melanogaster
agccattgaaatg

SEQ ID NO: 578078 - DNA, 13 bp, D. melanogaster
agccattggcatt

SEQ ID NO: 578079 - DNA, 13 bp, D. melanogaster
agccattggctgt

SEQ ID NO: 578080 - DNA, 13 bp, D. melanogaster
agccatttaattt

SEQ ID NO: 578081 - DNA, 14 bp, D. melanogaster
agccatttatttcg

SEQ ID NO: 578082 - DNA, 13 bp, D. melanogaster
agccatttcaaat

SEQ ID NO: 578083 - DNA, 13 bp, D. melanogaster
agccatttgcaaa

SEQ ID NO: 578084 - DNA, 13 bp, D. melanogaster
agccatttgcaat

SEQ ID NO: 578085 - DNA, 13 bp, D. melanogaster
agccatttgtttt

SEQ ID NO: 578086 - DNA, 13 bp, D. melanogaster
agccattttcctt

SEQ ID NO: 578087 - DNA, 13 bp, D. melanogaster
agcccaaaactca

SEQ ID NO: 578088 - DNA, 13 bp, D. melanogaster
agcccaaatccaa

SEQ ID NO: 578089 - DNA, 13 bp, D. melanogaster
agcccaacaatca

SEQ ID NO: 578090 - DNA, 13 bp, D. melanogaster
agcccaagaaaat

SEQ ID NO: 578091 - DNA, 13 bp, D. melanogaster
agcccaagccaaa

SEQ ID NO: 578092 - DNA, 13 bp, D. melanogaster
agcccaagcccaa

SEQ ID NO: 578093 - DNA, 13 bp, D. melanogaster
agcccaatcagaa

SEQ ID NO: 578094 - DNA, 13 bp, D. melanogaster
agcccaatcccaa

SEQ ID NO: 578095 - DNA, 13 bp, D. melanogaster
agcccaatttccc

SEQ ID NO: 578096 - DNA, 13 bp, D. melanogaster
agcccacactttt

SEQ ID NO: 578097 - DNA, 13 bp, D. melanogaster
agcccacagtcaa

SEQ ID NO: 578098 - DNA, 13 bp, D. melanogaster
agcccagcaataa

SEQ ID NO: 578099 - DNA, 13 bp, D. melanogaster
agcccagccacgc

SEQ ID NO: 578100 - DNA, 13 bp, D. melanogaster
agcccagcccagc

SEQ ID NO: 578101 - DNA, 13 bp, D. melanogaster
agcccaggaaacc

SEQ ID NO: 578102 - DNA, 13 bp, D. melanogaster
agccccaaaaaag

SEQ ID NO: 578103 - DNA, 13 bp, D. melanogaster
agccccaaccact

SEQ ID NO: 578104 - DNA, 13 bp, D. melanogaster
agcccccgaaatt

SEQ ID NO: 578105 - DNA, 13 bp, D. melanogaster
agccccgcccact

SEQ ID NO: 578106 - DNA, 13 bp, D. melanogaster
agcccctgcaaat

SEQ ID NO: 578107 - DNA, 14 bp, D. melanogaster
agcccgcatagcca

SEQ ID NO: 578108 - DNA, 13 bp, D. melanogaster
agcccgccactcg

SEQ ID NO: 578109 - DNA, 13 bp, D. melanogaster
agcccgctcatta

SEQ ID NO: 578110 - DNA, 13 bp, D. melanogaster
agcccgctctgcc

SEQ ID NO: 578111 - DNA, 13 bp, D. melanogaster
agcccggctttct

SEQ ID NO: 578112 - DNA, 13 bp, D. melanogaster
agccctatcaatt

SEQ ID NO: 578113 - DNA, 13 bp, D. melanogaster
agccctcaaaaca

SEQ ID NO: 578114 - DNA, 13 bp, D. melanogaster
agccgaaaaatgt

SEQ ID NO: 578115 - DNA, 13 bp, D. melanogaster
agccgaaaaccaa

SEQ ID NO: 578116 - DNA, 13 bp, D. melanogaster
agccgaaaagcaa

SEQ ID NO: 578117 - DNA, 14 bp, D. melanogaster
agccgaaaatgcag

SEQ ID NO: 578118 - DNA, 13 bp, D. melanogaster
agccgaaaccgaa

SEQ ID NO: 578119 - DNA, 13 bp, D. melanogaster
agccgaaactaaa

SEQ ID NO: 578120 - DNA, 13 bp, D. melanogaster
agccgaaactttt

SEQ ID NO: 578121 - DNA, 13 bp, D. melanogaster
agccgaaagcaaa

SEQ ID NO: 578122 - DNA, 13 bp, D. melanogaster
agccgaaagccaa

SEQ ID NO: 578123 - DNA, 13 bp, D. melanogaster
agccgaaagcgaa

SEQ ID NO: 578124 - DNA, 13 bp, D. melanogaster
agccgaagacttg

SEQ ID NO: 578125 - DNA, 13 bp, D. melanogaster
agccgaagcaggc

SEQ ID NO: 578126 - DNA, 13 bp, D. melanogaster
agccgaagccgaa

SEQ ID NO: 578127 - DNA, 13 bp, D. melanogaster
agccgaagctgaa

SEQ ID NO: 578128 - DNA, 13 bp, D. melanogaster
agccgaaggaaaa

SEQ ID NO: 578129 - DNA, 13 bp, D. melanogaster
agccgacatccct

SEQ ID NO: 578130 - DNA, 13 bp, D. melanogaster
agccgagaacttg

SEQ ID NO: 578131 - DNA, 13 bp, D. melanogaster
agccgagacactg

SEQ ID NO: 578132 - DNA, 13 bp, D. melanogaster
agccgagcaaaca

SEQ ID NO: 578133 - DNA, 13 bp, D. melanogaster
agccgagccgagc

SEQ ID NO: 578134 - DNA, 13 bp, D. melanogaster
agccgagtttgag

SEQ ID NO: 578135 - DNA, 13 bp, D. melanogaster
agccgcaaaacaa

SEQ ID NO: 578136 - DNA, 13 bp, D. melanogaster
agccgcaaaagtg

SEQ ID NO: 578137 - DNA, 13 bp, D. melanogaster
agccgcaaacaaa

SEQ ID NO: 578138 - DNA, 13 bp, D. melanogaster
agccgcaaataaa

SEQ ID NO: 578139 - DNA, 14 bp, D. melanogaster
agccgcaacaacaa

SEQ ID NO: 578140 - DNA, 14 bp, D. melanogaster
agccgcaacagcaa

SEQ ID NO: 578141 - DNA, 13 bp, D. melanogaster
agccgcacaaaac

SEQ ID NO: 578142 - DNA, 13 bp, D. melanogaster
agccgcacacaca

SEQ ID NO: 578143 - DNA, 14 bp, D. melanogaster
agccgcacacacac

SEQ ID NO: 578144 - DNA, 13 bp, D. melanogaster
agccgcagacaaa

SEQ ID NO: 578145 - DNA, 13 bp, D. melanogaster
agccgcagataca

SEQ ID NO: 578146 - DNA, 13 bp, D. melanogaster
agccgcagcaaaa

SEQ ID NO: 578147 - DNA, 13 bp, D. melanogaster
agccgcagcaaca

SEQ ID NO: 578148 - DNA, 13 bp, D. melanogaster
agccgcagcagca

SEQ ID NO: 578149 - DNA, 14 bp, D. melanogaster
agccgcagcagcag

SEQ ID NO: 578150 - DNA, 13 bp, D. melanogaster
agccgcagtctac

SEQ ID NO: 578151 - DNA, 13 bp, D. melanogaster
agccgcatttaaa

SEQ ID NO: 578152 - DNA, 14 bp, D. melanogaster
agccgcccaaaact

SEQ ID NO: 578153 - DNA, 13 bp, D. melanogaster
agccgcctgtcca

SEQ ID NO: 578154 - DNA, 14 bp, D. melanogaster
agccgctattgcta

SEQ ID NO: 578155 - DNA, 13 bp, D. melanogaster
agccgcttctgcc

SEQ ID NO: 578156 - DNA, 13 bp, D. melanogaster
agccggaaaaatg

SEQ ID NO: 578157 - DNA, 13 bp, D. melanogaster
agccggaaaagcg

SEQ ID NO: 578158 - DNA, 13 bp, D. melanogaster
agccggctgcacc

SEQ ID NO: 578159 - DNA, 13 bp, D. melanogaster
agccggctttgac

SEQ ID NO: 578160 - DNA, 13 bp, D. melanogaster
agccgggggattt

SEQ ID NO: 578161 - DNA, 13 bp, D. melanogaster
agccggtgatgag

SEQ ID NO: 578162 - DNA, 13 bp, D. melanogaster
agccgttggagtc

SEQ ID NO: 578163 - DNA, 13 bp, D. melanogaster
agccgtttgatgg

SEQ ID NO: 578164 - DNA, 13 bp, D. melanogaster
agccgtttggatc

SEQ ID NO: 578165 - DNA, 13 bp, D. melanogaster
agccgttttattg

SEQ ID NO: 578166 - DNA, 13 bp, D. melanogaster
agcctaaaagtat

SEQ ID NO: 578167 - DNA, 13 bp, D. melanogaster
agcctaccaaaaa

SEQ ID NO: 578168 - DNA, 13 bp, D. melanogaster
agcctatatagat

SEQ ID NO: 578169 - DNA, 13 bp, D. melanogaster
agcctattcatat

SEQ ID NO: 578170 - DNA, 13 bp, D. melanogaster
agcctcaattgta

SEQ ID NO: 578171 - DNA, 13 bp, D. melanogaster
agcctcatttttg

SEQ ID NO: 578172 - DNA, 13 bp, D. melanogaster
agcctccgaaaat

SEQ ID NO: 578173 - DNA, 13 bp, D. melanogaster
agcctccgccaat

SEQ ID NO: 578174 - DNA, 13 bp, D. melanogaster
agcctcctccagt

SEQ ID NO: 578175 - DNA, 13 bp, D. melanogaster
agcctctgtgctt

SEQ ID NO: 578176 - DNA, 13 bp, D. melanogaster
agcctgaacaatt

SEQ ID NO: 578177 - DNA, 13 bp, D. melanogaster
agcctgagcagtg

SEQ ID NO: 578178 - DNA, 13 bp, D. melanogaster
agcctggagccac

SEQ ID NO: 578179 - DNA, 13 bp, D. melanogaster
agcctggatcctt

SEQ ID NO: 578180 - DNA, 13 bp, D. melanogaster
agcctggccagaa

SEQ ID NO: 578181 - DNA, 13 bp, D. melanogaster
agcctgtgtcaat

SEQ ID NO: 578182 - DNA, 13 bp, D. melanogaster
agcctgtgtgtgt

SEQ ID NO: 578183 - DNA, 13 bp, D. melanogaster
agccttggaactg

SEQ ID NO: 578184 - DNA, 13 bp, D. melanogaster
agccttggcaatg

SEQ ID NO: 578185 - DNA, 14 bp, D. melanogaster
agccttgttggcca

SEQ ID NO: 578186 - DNA, 13 bp, D. melanogaster
agccttttaacct

SEQ ID NO: 578187 - DNA, 13 bp, D. melanogaster
agcgaaaaaagtg

SEQ ID NO: 578188 - DNA, 14 bp, D. melanogaster
agcgaaaaacaagt

SEQ ID NO: 578189 - DNA, 13 bp, D. melanogaster
agcgaaaaatatt

SEQ ID NO: 578190 - DNA, 13 bp, D. melanogaster
agcgaaaaatgaa

SEQ ID NO: 578191 - DNA, 13 bp, D. melanogaster
agcgaaaagaaat

SEQ ID NO: 578192 - DNA, 13 bp, D. melanogaster
agcgaaaagcgaa

SEQ ID NO: 578193 - DNA, 13 bp, D. melanogaster
agcgaaaagtaaa

SEQ ID NO: 578194 - DNA, 13 bp, D. melanogaster
agcgaaaagtgaa

SEQ ID NO: 578195 - DNA, 13 bp, D. melanogaster
agcgaaaataaca

SEQ ID NO: 578196 - DNA, 13 bp, D. melanogaster
agcgaaaataata

SEQ ID NO: 578197 - DNA, 13 bp, D. melanogaster
agcgaaaatattt

SEQ ID NO: 578198 - DNA, 13 bp, D. melanogaster
agcgaaaatcaaa

SEQ ID NO: 578199 - DNA, 13 bp, D. melanogaster
agcgaaaatgaaa

SEQ ID NO: 578200 - DNA, 13 bp, D. melanogaster
agcgaaaattatt

SEQ ID NO: 578201 - DNA, 13 bp, D. melanogaster
agcgaaaattgca

SEQ ID NO: 578202 - DNA, 13 bp, D. melanogaster
agcgaaacaaatt

SEQ ID NO: 578203 - DNA, 13 bp, D. melanogaster
agcgaaacaattg

SEQ ID NO: 578204 - DNA, 13 bp, D. melanogaster
agcgaaaccgaaa

SEQ ID NO: 578205 - DNA, 13 bp, D. melanogaster
agcgaaacgaaat

SEQ ID NO: 578206 - DNA, 13 bp, D. melanogaster
agcgaaacggaaa

SEQ ID NO: 578207 - DNA, 13 bp, D. melanogaster
agcgaaactttgt

SEQ ID NO: 578208 - DNA, 13 bp, D. melanogaster
agcgaaagaaatt

SEQ ID NO: 578209 - DNA, 14 bp, D. melanogaster
agcgaaagagacag

SEQ ID NO: 578210 - DNA, 13 bp, D. melanogaster
agcgaaagagatg

SEQ ID NO: 578211 - DNA, 13 bp, D. melanogaster
agcgaaagataaa

SEQ ID NO: 578212 - DNA, 13 bp, D. melanogaster
agcgaaagcaaca

SEQ ID NO: 578213 - DNA, 13 bp, D. melanogaster
agcgaaagcgaaa

SEQ ID NO: 578214 - DNA, 13 bp, D. melanogaster
agcgaaagtgttg

SEQ ID NO: 578215 - DNA, 13 bp, D. melanogaster
agcgaaagtttgt

SEQ ID NO: 578216 - DNA, 13 bp, D. melanogaster
agcgaaataaatg

SEQ ID NO: 578217 - DNA, 13 bp, D. melanogaster
agcgaaataataa

SEQ ID NO: 578218 - DNA, 13 bp, D. melanogaster
agcgaaatcaaaa

SEQ ID NO: 578219 - DNA, 14 bp, D. melanogaster
agcgaaatgaaatt

SEQ ID NO: 578220 - DNA, 13 bp, D. melanogaster
agcgaaatgaatt

SEQ ID NO: 578221 - DNA, 13 bp, D. melanogaster
agcgaaatgcaaa

SEQ ID NO: 578222 - DNA, 13 bp, D. melanogaster
agcgaaatgcatt

SEQ ID NO: 578223 - DNA, 13 bp, D. melanogaster
agcgaaatgccat

SEQ ID NO: 578224 - DNA, 14 bp, D. melanogaster
agcgaaatgccata

SEQ ID NO: 578225 - DNA, 13 bp, D. melanogaster
agcgaaattcaat

SEQ ID NO: 578226 - DNA, 13 bp, D. melanogaster
agcgaaccaacag

SEQ ID NO: 578227 - DNA, 13 bp, D. melanogaster
agcgaactctcaa

SEQ ID NO: 578228 - DNA, 13 bp, D. melanogaster
agcgaactgcaga

SEQ ID NO: 578229 - DNA, 13 bp, D. melanogaster
agcgaactgggca

SEQ ID NO: 578230 - DNA, 13 bp, D. melanogaster
agcgaagagcgct

SEQ ID NO: 578231 - DNA, 13 bp, D. melanogaster
agcgaagaggctg

SEQ ID NO: 578232 - DNA, 14 bp, D. melanogaster
agcgaagaggctgt

SEQ ID NO: 578233 - DNA, 13 bp, D. melanogaster
agcgaagcctttg

SEQ ID NO: 578234 - DNA, 14 bp, D. melanogaster
agcgaagcctttgc

SEQ ID NO: 578235 - DNA, 13 bp, D. melanogaster
agcgaagcgaact

SEQ ID NO: 578236 - DNA, 13 bp, D. melanogaster
agcgaaggaagtg

SEQ ID NO: 578237 - DNA, 13 bp, D. melanogaster
agcgaataaaaat

SEQ ID NO: 578238 - DNA, 13 bp, D. melanogaster
agcgaataaataa

SEQ ID NO: 578239 - DNA, 13 bp, D. melanogaster
agcgaataaatta

SEQ ID NO: 578240 - DNA, 13 bp, D. melanogaster
agcgaataccaat

SEQ ID NO: 578241 - DNA, 13 bp, D. melanogaster
agcgaatatatat

SEQ ID NO: 578242 - DNA, 13 bp, D. melanogaster
agcgaatgataat

SEQ ID NO: 578243 - DNA, 13 bp, D. melanogaster
agcgaatggaatg

SEQ ID NO: 578244 - DNA, 13 bp, D. melanogaster
agcgaatttaaat

SEQ ID NO: 578245 - DNA, 13 bp, D. melanogaster
agcgaatttagaa

SEQ ID NO: 578246 - DNA, 13 bp, D. melanogaster
agcgaatttgtct

SEQ ID NO: 578247 - DNA, 13 bp, D. melanogaster
agcgacaacaact

SEQ ID NO: 578248 - DNA, 13 bp, D. melanogaster
agcgacaacgaca

SEQ ID NO: 578249 - DNA, 13 bp, D. melanogaster
agcgacaatgtga

SEQ ID NO: 578250 - DNA, 13 bp, D. melanogaster
agcgacagagaca

SEQ ID NO: 578251 - DNA, 13 bp, D. melanogaster
agcgacagagaga

SEQ ID NO: 578252 - DNA, 13 bp, D. melanogaster
agcgacagcaaca

SEQ ID NO: 578253 - DNA, 13 bp, D. melanogaster
agcgacagcgaca

SEQ ID NO: 578254 - DNA, 13 bp, D. melanogaster
agcgacagtttgt

SEQ ID NO: 578255 - DNA, 14 bp, D. melanogaster
agcgacgccggcag

SEQ ID NO: 578256 - DNA, 13 bp, D. melanogaster
agcgacggcttcg

SEQ ID NO: 578257 - DNA, 13 bp, D. melanogaster
agcgactcatcat

SEQ ID NO: 578258 - DNA, 13 bp, D. melanogaster
agcgactgactgc

SEQ ID NO: 578259 - DNA, 14 bp, D. melanogaster
agcgactgactgcc

SEQ ID NO: 578260 - DNA, 13 bp, D. melanogaster
agcgactgcgact

SEQ ID NO: 578261 - DNA, 13 bp, D. melanogaster
agcgagaaaaact

SEQ ID NO: 578262 - DNA, 13 bp, D. melanogaster
agcgagaaataaa

SEQ ID NO: 578263 - DNA, 13 bp, D. melanogaster
agcgagacagaga

SEQ ID NO: 578264 - DNA, 14 bp, D. melanogaster
agcgagagagcgaa

SEQ ID NO: 578265 - DNA, 13 bp, D. melanogaster
agcgagagagcgg

SEQ ID NO: 578266 - DNA, 13 bp, D. melanogaster
agcgagagagtga

SEQ ID NO: 578267 - DNA, 13 bp, D. melanogaster
agcgagagcgaaa

SEQ ID NO: 578268 - DNA, 13 bp, D. melanogaster
agcgagatggcga

SEQ ID NO: 578269 - DNA, 13 bp, D. melanogaster
agcgagcgaaaga

SEQ ID NO: 578270 - DNA, 13 bp, D. melanogaster
agcgagcgagatg

SEQ ID NO: 578271 - DNA, 13 bp, D. melanogaster
agcgagcgagcga

SEQ ID NO: 578272 - DNA, 14 bp, D. melanogaster
agcgagcgagcgag

SEQ ID NO: 578273 - DNA, 16 bp, D. melanogaster
agcgagcggaaagaga

SEQ ID NO: 578274 - DNA, 13 bp, D. melanogaster
agcgaggacgaaa

SEQ ID NO: 578275 - DNA, 13 bp, D. melanogaster
agcgagggaaaac

SEQ ID NO: 578276 - DNA, 13 bp, D. melanogaster
agcgagtccctca

SEQ ID NO: 578277 - DNA, 13 bp, D. melanogaster
agcgagtgaaaag

SEQ ID NO: 578278 - DNA, 13 bp, D. melanogaster
agcgagtgaaaga

SEQ ID NO: 578279 - DNA, 13 bp, D. melanogaster
agcgagtgagagg

SEQ ID NO: 578280 - DNA, 13 bp, D. melanogaster
agcgagtttatca

SEQ ID NO: 578281 - DNA, 13 bp, D. melanogaster
agcgataagcgca

SEQ ID NO: 578282 - DNA, 13 bp, D. melanogaster
agcgatagagaca

SEQ ID NO: 578283 - DNA, 13 bp, D. melanogaster
agcgatatcgaat

SEQ ID NO: 578284 - DNA, 13 bp, D. melanogaster
agcgatatttttg

SEQ ID NO: 578285 - DNA, 13 bp, D. melanogaster
agcgattgttatt

SEQ ID NO: 578286 - DNA, 13 bp, D. melanogaster
agcgcaaatataa

SEQ ID NO: 578287 - DNA, 13 bp, D. melanogaster
agcgcaaatgaaa

SEQ ID NO: 578288 - DNA, 13 bp, D. melanogaster
agcgcaaattgaa

SEQ ID NO: 578289 - DNA, 13 bp, D. melanogaster
agcgcaacaacaa

SEQ ID NO: 578290 - DNA, 14 bp, D. melanogaster
agcgcaagtttgtt

SEQ ID NO: 578291 - DNA, 13 bp, D. melanogaster
agcgcaattaaaa

SEQ ID NO: 578292 - DNA, 13 bp, D. melanogaster
agcgcacaaaagt

SEQ ID NO: 578293 - DNA, 13 bp, D. melanogaster
agcgcacaaattg

SEQ ID NO: 578294 - DNA, 13 bp, D. melanogaster
agcgcagagagag

SEQ ID NO: 578295 - DNA, 13 bp, D. melanogaster
agcgcagcaaaaa

SEQ ID NO: 578296 - DNA, 13 bp, D. melanogaster
agcgcagcagcag

SEQ ID NO: 578297 - DNA, 13 bp, D. melanogaster
agcgcagccgttc

SEQ ID NO: 578298 - DNA, 13 bp, D. melanogaster
agcgcagtgcatc

SEQ ID NO: 578299 - DNA, 13 bp, D. melanogaster
agcgcataaaaaa

SEQ ID NO: 578300 - DNA, 13 bp, D. melanogaster
agcgcatttaatt

SEQ ID NO: 578301 - DNA, 13 bp, D. melanogaster
agcgcattttttt

SEQ ID NO: 578302 - DNA, 13 bp, D. melanogaster
agcgccaaagcca

SEQ ID NO: 578303 - DNA, 13 bp, D. melanogaster
agcgccaagctca

SEQ ID NO: 578304 - DNA, 13 bp, D. melanogaster
agcgccacagaaa

SEQ ID NO: 578305 - DNA, 13 bp, D. melanogaster
agcgccactccgc

SEQ ID NO: 578306 - DNA, 13 bp, D. melanogaster
agcgccagttgcg

SEQ ID NO: 578307 - DNA, 13 bp, D. melanogaster
agcgcccagagtg

SEQ ID NO: 578308 - DNA, 13 bp, D. melanogaster
agcgcccccgtct

SEQ ID NO: 578309 - DNA, 13 bp, D. melanogaster
agcgccgaaaaaa

SEQ ID NO: 578310 - DNA, 13 bp, D. melanogaster
agcgccgatttgt

SEQ ID NO: 578311 - DNA, 13 bp, D. melanogaster
agcgccgcgtctt

SEQ ID NO: 578312 - DNA, 13 bp, D. melanogaster
agcgcgccaaaaa

SEQ ID NO: 578313 - DNA, 13 bp, D. melanogaster
agcgcgctcctgc

SEQ ID NO: 578314 - DNA, 13 bp, D. melanogaster
agcgcggttttat

SEQ ID NO: 578315 - DNA, 13 bp, D. melanogaster
agcgctatatgtt

SEQ ID NO: 578316 - DNA, 13 bp, D. melanogaster
agcgctcttcgct

SEQ ID NO: 578317 - DNA, 14 bp, D. melanogaster
agcgctgcggcaga

SEQ ID NO: 578318 - DNA, 13 bp, D. melanogaster
agcgctgctgctg

SEQ ID NO: 578319 - DNA, 14 bp, D. melanogaster
agcgctggccagcc

SEQ ID NO: 578320 - DNA, 13 bp, D. melanogaster
agcggaaaaataa

SEQ ID NO: 578321 - DNA, 13 bp, D. melanogaster
agcggaaaagcag

SEQ ID NO: 578322 - DNA, 13 bp, D. melanogaster
agcggaaaagcgg

SEQ ID NO: 578323 - DNA, 14 bp, D. melanogaster
agcggaaaagcggg

SEQ ID NO: 578324 - DNA, 13 bp, D. melanogaster
agcggaaaagtgg

SEQ ID NO: 578325 - DNA, 13 bp, D. melanogaster
agcggaaaagttt

SEQ ID NO: 578326 - DNA, 13 bp, D. melanogaster
agcggaaaatctg

SEQ ID NO: 578327 - DNA, 13 bp, D. melanogaster
agcggaaaatgcg

SEQ ID NO: 578328 - DNA, 13 bp, D. melanogaster
agcggaaaatggg

SEQ ID NO: 578329 - DNA, 13 bp, D. melanogaster
agcggaaaatgtg

SEQ ID NO: 578330 - DNA, 13 bp, D. melanogaster
agcggaaacagtt

SEQ ID NO: 578331 - DNA, 13 bp, D. melanogaster
agcggaaaccgca

SEQ ID NO: 578332 - DNA, 13 bp, D. melanogaster
agcggaaacggaa

SEQ ID NO: 578333 - DNA, 14 bp, D. melanogaster
agcggaaacggaaa

SEQ ID NO: 578334 - DNA, 14 bp, D. melanogaster
agcggaaacggaag

SEQ ID NO: 578335 - DNA, 14 bp, D. melanogaster
agcggaaagagagc

SEQ ID NO: 578336 - DNA, 13 bp, D. melanogaster
agcggaaatggaa

SEQ ID NO: 578337 - DNA, 13 bp, D. melanogaster
agcggaaatggca

SEQ ID NO: 578338 - DNA, 13 bp, D. melanogaster
agcggaaattgtt

SEQ ID NO: 578339 - DNA, 13 bp, D. melanogaster
agcggaaccggaa

SEQ ID NO: 578340 - DNA, 13 bp, D. melanogaster
agcggaagcggaa

SEQ ID NO: 578341 - DNA, 13 bp, D. melanogaster
agcggaagtgcag

SEQ ID NO: 578342 - DNA, 13 bp, D. melanogaster
agcggagaaccag

SEQ ID NO: 578343 - DNA, 13 bp, D. melanogaster
agcggagactatg

SEQ ID NO: 578344 - DNA, 13 bp, D. melanogaster
agcggagcagagc

SEQ ID NO: 578345 - DNA, 13 bp, D. melanogaster
agcggagcggcgt

SEQ ID NO: 578346 - DNA, 13 bp, D. melanogaster
agcggaggacagt

SEQ ID NO: 578347 - DNA, 13 bp, D. melanogaster
agcggaggagcag

SEQ ID NO: 578348 - DNA, 13 bp, D. melanogaster
agcggagtggagt

SEQ ID NO: 578349 - DNA, 13 bp, D. melanogaster
agcggatagaaaa

SEQ ID NO: 578350 - DNA, 13 bp, D. melanogaster
agcggatcccaaa

SEQ ID NO: 578351 - DNA, 13 bp, D. melanogaster
agcggatggcagc

SEQ ID NO: 578352 - DNA, 13 bp, D. melanogaster
agcggattgtcca

SEQ ID NO: 578353 - DNA, 13 bp, D. melanogaster
agcggcaaaaaag

SEQ ID NO: 578354 - DNA, 13 bp, D. melanogaster
agcggcaaaagtt

SEQ ID NO: 578355 - DNA, 13 bp, D. melanogaster
agcggcaaacaaa

SEQ ID NO: 578356 - DNA, 13 bp, D. melanogaster
agcggcaaagttt

SEQ ID NO: 578357 - DNA, 13 bp, D. melanogaster
agcggcaaatgtg

SEQ ID NO: 578358 - DNA, 13 bp, D. melanogaster
agcggcaacaaaa

SEQ ID NO: 578359 - DNA, 14 bp, D. melanogaster
agcggcaacaaaaa

SEQ ID NO: 578360 - DNA, 13 bp, D. melanogaster
agcggcaacaaag

SEQ ID NO: 578361 - DNA, 14 bp, D. melanogaster
agcggcaacaacaa

SEQ ID NO: 578362 - DNA, 13 bp, D. melanogaster
agcggcaacaacg

SEQ ID NO: 578363 - DNA, 14 bp, D. melanogaster
agcggcaacttgaa

SEQ ID NO: 578364 - DNA, 15 bp, D. melanogaster
agcggcagaagagca

SEQ ID NO: 578365 - DNA, 13 bp, D. melanogaster
agcggcagacaaa

SEQ ID NO: 578366 - DNA, 13 bp, D. melanogaster
agcggcagcaaca

SEQ ID NO: 578367 - DNA, 14 bp, D. melanogaster
agcggcagcaacat

SEQ ID NO: 578368 - DNA, 14 bp, D. melanogaster
agcggcagcagcaa

SEQ ID NO: 578369 - DNA, 15 bp, D. melanogaster
agcggcagcagcaac

SEQ ID NO: 578370 - DNA, 13 bp, D. melanogaster
agcggcagcagct

SEQ ID NO: 578371 - DNA, 13 bp, D. melanogaster
agcggcagcgaaa

SEQ ID NO: 578372 - DNA, 13 bp, D. melanogaster
agcggcagcgacg

SEQ ID NO: 578373 - DNA, 13 bp, D. melanogaster
agcggcattaaaa

SEQ ID NO: 578374 - DNA, 13 bp, D. melanogaster
agcggccagcgtg

SEQ ID NO: 578375 - DNA, 13 bp, D. melanogaster
agcggcgaactgc

SEQ ID NO: 578376 - DNA, 14 bp, D. melanogaster
agcggcggcaacaa

SEQ ID NO: 578377 - DNA, 13 bp, D. melanogaster
agcggcggcggca

SEQ ID NO: 578378 - DNA, 13 bp, D. melanogaster
agcggcgggaaaa

SEQ ID NO: 578379 - DNA, 13 bp, D. melanogaster
agcggctggtatt

SEQ ID NO: 578380 - DNA, 13 bp, D. melanogaster
agcgggaaaaaca

SEQ ID NO: 578381 - DNA, 13 bp, D. melanogaster
agcgggaaaagca

SEQ ID NO: 578382 - DNA, 14 bp, D. melanogaster
agcgggaaaagcgg

SEQ ID NO: 578383 - DNA, 13 bp, D. melanogaster
agcgggaaaatcg

SEQ ID NO: 578384 - DNA, 13 bp, D. melanogaster
agcgggaaaattg

SEQ ID NO: 578385 - DNA, 13 bp, D. melanogaster
agcgggaaagcgg

SEQ ID NO: 578386 - DNA, 13 bp, D. melanogaster
agcgggaaatggg

SEQ ID NO: 578387 - DNA, 13 bp, D. melanogaster
agcgggcaaaaag

SEQ ID NO: 578388 - DNA, 13 bp, D. melanogaster
agcgggcaaacaa

SEQ ID NO: 578389 - DNA, 13 bp, D. melanogaster
agcgggccaaaag

SEQ ID NO: 578390 - DNA, 13 bp, D. melanogaster
agcgggccataaa

SEQ ID NO: 578391 - DNA, 13 bp, D. melanogaster
agcgggcggaaaa

SEQ ID NO: 578392 - DNA, 13 bp, D. melanogaster
agcggggaaaagc

SEQ ID NO: 578393 - DNA, 13 bp, D. melanogaster
agcggggaaaatt

SEQ ID NO: 578394 - DNA, 13 bp, D. melanogaster
agcgggtaattgc

SEQ ID NO: 578395 - DNA, 13 bp, D. melanogaster
agcgggtggaaaa

SEQ ID NO: 578396 - DNA, 13 bp, D. melanogaster
agcggtatctacc

SEQ ID NO: 578397 - DNA, 13 bp, D. melanogaster
agcggtcgaaaaa

SEQ ID NO: 578398 - DNA, 13 bp, D. melanogaster
agcggttccgtta

SEQ ID NO: 578399 - DNA, 13 bp, D. melanogaster
agcgtaaacaaaa

SEQ ID NO: 578400 - DNA, 14 bp, D. melanogaster
agcgtaaattgtaa

SEQ ID NO: 578401 - DNA, 13 bp, D. melanogaster
agcgtaattaaaa

SEQ ID NO: 578402 - DNA, 13 bp, D. melanogaster
agcgtatgcaaat

SEQ ID NO: 578403 - DNA, 14 bp, D. melanogaster
agcgtctccaagag

SEQ ID NO: 578404 - DNA, 13 bp, D. melanogaster
agcgtgtgtgtgc

SEQ ID NO: 578405 - DNA, 13 bp, D. melanogaster
agcgtgttaaacc

SEQ ID NO: 578406 - DNA, 14 bp, D. melanogaster
agcgtgttggtgca

SEQ ID NO: 578407 - DNA, 13 bp, D. melanogaster
agcgttaaataaa

SEQ ID NO: 578408 - DNA, 13 bp, D. melanogaster
agcgttgccagat

SEQ ID NO: 578409 - DNA, 13 bp, D. melanogaster
agcgttggacgac

SEQ ID NO: 578410 - DNA, 13 bp, D. melanogaster
agcgttgttttgt

SEQ ID NO: 578411 - DNA, 13 bp, D. melanogaster
agcgtttccgacc

SEQ ID NO: 578412 - DNA, 13 bp, D. melanogaster
agcgttttaattt

SEQ ID NO: 578413 - DNA, 13 bp, D. melanogaster
agcgttttatttt

SEQ ID NO: 578414 - DNA, 13 bp, D. melanogaster
agcgttttgcata

SEQ ID NO: 578415 - DNA, 13 bp, D. melanogaster
agcgtttttaatt

SEQ ID NO: 578416 - DNA, 13 bp, D. melanogaster
agctaaaaagctg

SEQ ID NO: 578417 - DNA, 14 bp, D. melanogaster
agctaaaaataaag

SEQ ID NO: 578418 - DNA, 13 bp, D. melanogaster
agctaaaaatagt

SEQ ID NO: 578419 - DNA, 14 bp, D. melanogaster
agctaaaaatatgt

SEQ ID NO: 578420 - DNA, 13 bp, D. melanogaster
agctaaaaattaa

SEQ ID NO: 578421 - DNA, 13 bp, D. melanogaster
agctaaaaatttt

SEQ ID NO: 578422 - DNA, 13 bp, D. melanogaster
agctaaaacaaat

SEQ ID NO: 578423 - DNA, 13 bp, D. melanogaster
agctaaaacaatt

SEQ ID NO: 578424 - DNA, 13 bp, D. melanogaster
agctaaaaccaag

SEQ ID NO: 578425 - DNA, 13 bp, D. melanogaster
agctaaaagcaaa

SEQ ID NO: 578426 - DNA, 13 bp, D. melanogaster
agctaaaagttta

SEQ ID NO: 578427 - DNA, 13 bp, D. melanogaster
agctaaaataatt

SEQ ID NO: 578428 - DNA, 13 bp, D. melanogaster
agctaaaattaaa

SEQ ID NO: 578429 - DNA, 13 bp, D. melanogaster
agctaaaattaat

SEQ ID NO: 578430 - DNA, 13 bp, D. melanogaster
agctaaaattatt

SEQ ID NO: 578431 - DNA, 13 bp, D. melanogaster
agctaaacaaaac

SEQ ID NO: 578432 - DNA, 14 bp, D. melanogaster
agctaaacaggaaa

SEQ ID NO: 578433 - DNA, 14 bp, D. melanogaster
agctaaactggaga

SEQ ID NO: 578434 - DNA, 13 bp, D. melanogaster
agctaaagcaaaa

SEQ ID NO: 578435 - DNA, 13 bp, D. melanogaster
agctaaagccaaa

SEQ ID NO: 578436 - DNA, 13 bp, D. melanogaster
agctaaaggaaac

SEQ ID NO: 578437 - DNA, 13 bp, D. melanogaster
agctaaataaata

SEQ ID NO: 578438 - DNA, 13 bp, D. melanogaster
agctaaatattat

SEQ ID NO: 578439 - DNA, 13 bp, D. melanogaster
agctaaatatttt

SEQ ID NO: 578440 - DNA, 13 bp, D. melanogaster
agctaaatgaatt

SEQ ID NO: 578441 - DNA, 13 bp, D. melanogaster
agctaaattataa

SEQ ID NO: 578442 - DNA, 13 bp, D. melanogaster
agctaaattgttt

SEQ ID NO: 578443 - DNA, 13 bp, D. melanogaster
agctaaatttata

SEQ ID NO: 578444 - DNA, 13 bp, D. melanogaster
agctaaatttttt

SEQ ID NO: 578445 - DNA, 13 bp, D. melanogaster
agctaaccaaaaa

SEQ ID NO: 578446 - DNA, 13 bp, D. melanogaster
agctaactttgat

SEQ ID NO: 578447 - DNA, 13 bp, D. melanogaster
agctaagcaaaaa

SEQ ID NO: 578448 - DNA, 13 bp, D. melanogaster
agctaagcaaata

SEQ ID NO: 578449 - DNA, 13 bp, D. melanogaster
agctaagcgaatt

SEQ ID NO: 578450 - DNA, 14 bp, D. melanogaster
agctaataaattaa

SEQ ID NO: 578451 - DNA, 13 bp, D. melanogaster
agctaatcaaaaa

SEQ ID NO: 578452 - DNA, 13 bp, D. melanogaster
agctaatcaaatt

SEQ ID NO: 578453 - DNA, 13 bp, D. melanogaster
agctaatgctata

SEQ ID NO: 578454 - DNA, 13 bp, D. melanogaster
agctaatggctaa

SEQ ID NO: 578455 - DNA, 13 bp, D. melanogaster
agctaattaagtt

SEQ ID NO: 578456 - DNA, 13 bp, D. melanogaster
agctaattaccag

SEQ ID NO: 578457 - DNA, 13 bp, D. melanogaster
agctaattagttt

SEQ ID NO: 578458 - DNA, 13 bp, D. melanogaster
agctaattcgagc

SEQ ID NO: 578459 - DNA, 13 bp, D. melanogaster
agctaattgaaaa

SEQ ID NO: 578460 - DNA, 13 bp, D. melanogaster
agctaattgaatt

SEQ ID NO: 578461 - DNA, 13 bp, D. melanogaster
agctaattgcatt

SEQ ID NO: 578462 - DNA, 13 bp, D. melanogaster
agctacaaaaata

SEQ ID NO: 578463 - DNA, 13 bp, D. melanogaster
agctacaaatttt

SEQ ID NO: 578464 - DNA, 13 bp, D. melanogaster
agctacaagttga

SEQ ID NO: 578465 - DNA, 13 bp, D. melanogaster
agctacactcatt

SEQ ID NO: 578466 - DNA, 14 bp, D. melanogaster
agctacagatacag

SEQ ID NO: 578467 - DNA, 13 bp, D. melanogaster
agctacagcaaca

SEQ ID NO: 578468 - DNA, 13 bp, D. melanogaster
agctacagcacag

SEQ ID NO: 578469 - DNA, 13 bp, D. melanogaster
agctacagctaca

SEQ ID NO: 578470 - DNA, 14 bp, D. melanogaster
agctacagctacag

SEQ ID NO: 578471 - DNA, 14 bp, D. melanogaster
agctacaggagcaa

SEQ ID NO: 578472 - DNA, 13 bp, D. melanogaster
agctacatacata

SEQ ID NO: 578473 - DNA, 13 bp, D. melanogaster
agctacatatgta

SEQ ID NO: 578474 - DNA, 14 bp, D. melanogaster
agctacatgcagag

SEQ ID NO: 578475 - DNA, 13 bp, D. melanogaster
agctaccaaaaaa

SEQ ID NO: 578476 - DNA, 13 bp, D. melanogaster
agctaccagtggc

SEQ ID NO: 578477 - DNA, 14 bp, D. melanogaster
agctaccagtggca

SEQ ID NO: 578478 - DNA, 13 bp, D. melanogaster
agctaccgccctc

SEQ ID NO: 578479 - DNA, 13 bp, D. melanogaster
agctacgacagca

SEQ ID NO: 578480 - DNA, 13 bp, D. melanogaster
agctagaaagttg

SEQ ID NO: 578481 - DNA, 13 bp, D. melanogaster
agctagataaaag

SEQ ID NO: 578482 - DNA, 13 bp, D. melanogaster
agctagatgcgaa

SEQ ID NO: 578483 - DNA, 13 bp, D. melanogaster
agctagcaaaaaa

SEQ ID NO: 578484 - DNA, 13 bp, D. melanogaster
agctagcaacagt

SEQ ID NO: 578485 - DNA, 13 bp, D. melanogaster
agctagccagcca

SEQ ID NO: 578486 - DNA, 14 bp, D. melanogaster
agctagccagccag

SEQ ID NO: 578487 - DNA, 13 bp, D. melanogaster
agctagcgaagcc

SEQ ID NO: 578488 - DNA, 13 bp, D. melanogaster
agctagctcaagt

SEQ ID NO: 578489 - DNA, 13 bp, D. melanogaster
agctagctggctg

SEQ ID NO: 578490 - DNA, 13 bp, D. melanogaster
agctagtggaaat

SEQ ID NO: 578491 - DNA, 14 bp, D. melanogaster
agctagtggaaatg

SEQ ID NO: 578492 - DNA, 13 bp, D. melanogaster
agctagtggaagt

SEQ ID NO: 578493 - DNA, 13 bp, D. melanogaster
agctataaaaaac

SEQ ID NO: 578494 - DNA, 13 bp, D. melanogaster
agctataaaaatg

SEQ ID NO: 578495 - DNA, 13 bp, D. melanogaster
agctataaaagct

SEQ ID NO: 578496 - DNA, 13 bp, D. melanogaster
agctataaaattg

SEQ ID NO: 578497 - DNA, 14 bp, D. melanogaster
agctataaaattgt

SEQ ID NO: 578498 - DNA, 13 bp, D. melanogaster
agctataaccaca

SEQ ID NO: 578499 - DNA, 13 bp, D. melanogaster
agctatagctata

SEQ ID NO: 578500 - DNA, 14 bp, D. melanogaster
agctatagctatag

SEQ ID NO: 578501 - DNA, 13 bp, D. melanogaster
agctatagcttct

SEQ ID NO: 578502 - DNA, 13 bp, D. melanogaster
agctatatatgta

SEQ ID NO: 578503 - DNA, 14 bp, D. melanogaster
agctatatttaaat

SEQ ID NO: 578504 - DNA, 13 bp, D. melanogaster
agctatcgcttgt

SEQ ID NO: 578505 - DNA, 13 bp, D. melanogaster
agctatctttccc

SEQ ID NO: 578506 - DNA, 13 bp, D. melanogaster
agctatgatgcaa

SEQ ID NO: 578507 - DNA, 13 bp, D. melanogaster
agctatgattttg

SEQ ID NO: 578508 - DNA, 14 bp, D. melanogaster
agctatgattttga

SEQ ID NO: 578509 - DNA, 13 bp, D. melanogaster
agctatggaaaac

SEQ ID NO: 578510 - DNA, 13 bp, D. melanogaster
agctatggcttca

SEQ ID NO: 578511 - DNA, 13 bp, D. melanogaster
agctatgtacata

SEQ ID NO: 578512 - DNA, 14 bp, D. melanogaster
agctatgtacatat

SEQ ID NO: 578513 - DNA, 13 bp, D. melanogaster
agctattaaatat

SEQ ID NO: 578514 - DNA, 13 bp, D. melanogaster
agctattatatta

SEQ ID NO: 578515 - DNA, 13 bp, D. melanogaster
agctattgttttt

SEQ ID NO: 578516 - DNA, 13 bp, D. melanogaster
agctatttatata

SEQ ID NO: 578517 - DNA, 13 bp, D. melanogaster
agctattttatat

SEQ ID NO: 578518 - DNA, 14 bp, D. melanogaster
agctattttatatt

SEQ ID NO: 578519 - DNA, 13 bp, D. melanogaster
agctattttatta

SEQ ID NO: 578520 - DNA, 13 bp, D. melanogaster
agctatttttgat

SEQ ID NO: 578521 - DNA, 13 bp, D. melanogaster
agctcaaaaacta

SEQ ID NO: 578522 - DNA, 13 bp, D. melanogaster
agctcaaaacttt

SEQ ID NO: 578523 - DNA, 13 bp, D. melanogaster
agctcaaagaagc

SEQ ID NO: 578524 - DNA, 13 bp, D. melanogaster
agctcaaagccct

SEQ ID NO: 578525 - DNA, 13 bp, D. melanogaster
agctcaaatcaaa

SEQ ID NO: 578526 - DNA, 14 bp, D. melanogaster
agctcaacatttat

SEQ ID NO: 578527 - DNA, 13 bp, D. melanogaster
agctcaacgagat

SEQ ID NO: 578528 - DNA, 13 bp, D. melanogaster
agctcaacgaggt

SEQ ID NO: 578529 - DNA, 13 bp, D. melanogaster
agctcaagctcaa

SEQ ID NO: 578530 - DNA, 13 bp, D. melanogaster
agctcaagttctc

SEQ ID NO: 578531 - DNA, 13 bp, D. melanogaster
agctcaagtttgt

SEQ ID NO: 578532 - DNA, 13 bp, D. melanogaster
agctcaatatgtg

SEQ ID NO: 578533 - DNA, 13 bp, D. melanogaster
agctcaattccta

SEQ ID NO: 578534 - DNA, 13 bp, D. melanogaster
agctcacagaaac

SEQ ID NO: 578535 - DNA, 13 bp, D. melanogaster
agctcaccttcag

SEQ ID NO: 578536 - DNA, 13 bp, D. melanogaster
agctcacgcagca

SEQ ID NO: 578537 - DNA, 13 bp, D. melanogaster
agctcagatcagg

SEQ ID NO: 578538 - DNA, 13 bp, D. melanogaster
agctcagccaagg

SEQ ID NO: 578539 - DNA, 14 bp, D. melanogaster
agctcagccctcaa

SEQ ID NO: 578540 - DNA, 13 bp, D. melanogaster
agctcagctcagc

SEQ ID NO: 578541 - DNA, 13 bp, D. melanogaster
agctcatgaaaaa

SEQ ID NO: 578542 - DNA, 13 bp, D. melanogaster
agctcatggaggc

SEQ ID NO: 578543 - DNA, 13 bp, D. melanogaster
agctcattaaata

SEQ ID NO: 578544 - DNA, 13 bp, D. melanogaster
agctccaccacat

SEQ ID NO: 578545 - DNA, 13 bp, D. melanogaster
agctccagaacat

SEQ ID NO: 578546 - DNA, 14 bp, D. melanogaster
agctccagctccac

SEQ ID NO: 578547 - DNA, 14 bp, D. melanogaster
agctccagctccat

SEQ ID NO: 578548 - DNA, 13 bp, D. melanogaster
agctccatctcca

SEQ ID NO: 578549 - DNA, 13 bp, D. melanogaster
agctcccagctcc

SEQ ID NO: 578550 - DNA, 14 bp, D. melanogaster
agctcccagctccc

SEQ ID NO: 578551 - DNA, 13 bp, D. melanogaster
agctcccagcttc

SEQ ID NO: 578552 - DNA, 13 bp, D. melanogaster
agctcccctgatg

SEQ ID NO: 578553 - DNA, 13 bp, D. melanogaster
agctcctacaaaa

SEQ ID NO: 578554 - DNA, 13 bp, D. melanogaster
agctcctccagct

SEQ ID NO: 578555 - DNA, 13 bp, D. melanogaster
agctcctgcagca

SEQ ID NO: 578556 - DNA, 13 bp, D. melanogaster
agctccttggcca

SEQ ID NO: 578557 - DNA, 13 bp, D. melanogaster
agctcgaaaacaa

SEQ ID NO: 578558 - DNA, 13 bp, D. melanogaster
agctcgaaccatg

SEQ ID NO: 578559 - DNA, 13 bp, D. melanogaster
agctcgagaaaac

SEQ ID NO: 578560 - DNA, 14 bp, D. melanogaster
agctcggagccata

SEQ ID NO: 578561 - DNA, 14 bp, D. melanogaster
agctcggagtacct

SEQ ID NO: 578562 - DNA, 13 bp, D. melanogaster
agctcggtgctct

SEQ ID NO: 578563 - DNA, 13 bp, D. melanogaster
agctctaaaaata

SEQ ID NO: 578564 - DNA, 14 bp, D. melanogaster
agctctagaattaa

SEQ ID NO: 578565 - DNA, 13 bp, D. melanogaster
agctctccttcct

SEQ ID NO: 578566 - DNA, 13 bp, D. melanogaster
agctctcgccaaa

SEQ ID NO: 578567 - DNA, 13 bp, D. melanogaster
agctctttaatgc

SEQ ID NO: 578568 - DNA, 13 bp, D. melanogaster
agctctttgatgg

SEQ ID NO: 578569 - DNA, 13 bp, D. melanogaster
agctctttgtaga

SEQ ID NO: 578570 - DNA, 13 bp, D. melanogaster
agctcttttctac

SEQ ID NO: 578571 - DNA, 13 bp, D. melanogaster
agctgaaaaaata

SEQ ID NO: 578572 - DNA, 13 bp, D. melanogaster
agctgaaaaatga

SEQ ID NO: 578573 - DNA, 13 bp, D. melanogaster
agctgaaaaatgt

SEQ ID NO: 578574 - DNA, 13 bp, D. melanogaster
agctgaaaacaaa

SEQ ID NO: 578575 - DNA, 13 bp, D. melanogaster
agctgaaaactga

SEQ ID NO: 578576 - DNA, 14 bp, D. melanogaster
agctgaaaactgaa

SEQ ID NO: 578577 - DNA, 13 bp, D. melanogaster
agctgaaaacttt

SEQ ID NO: 578578 - DNA, 13 bp, D. melanogaster
agctgaaaagctg

SEQ ID NO: 578579 - DNA, 13 bp, D. melanogaster
agctgaaaagtat

SEQ ID NO: 578580 - DNA, 13 bp, D. melanogaster
agctgaaaagttt

SEQ ID NO: 578581 - DNA, 13 bp, D. melanogaster
agctgaaaataat

SEQ ID NO: 578582 - DNA, 13 bp, D. melanogaster
agctgaaaatata

SEQ ID NO: 578583 - DNA, 14 bp, D. melanogaster
agctgaaaatgaaa

SEQ ID NO: 578584 - DNA, 13 bp, D. melanogaster
agctgaaaatgtt

SEQ ID NO: 578585 - DNA, 13 bp, D. melanogaster
agctgaaaattat

SEQ ID NO: 578586 - DNA, 13 bp, D. melanogaster
agctgaaacattt

SEQ ID NO: 578587 - DNA, 13 bp, D. melanogaster
agctgaaactaaa

SEQ ID NO: 578588 - DNA, 13 bp, D. melanogaster
agctgaaagcaaa

SEQ ID NO: 578589 - DNA, 13 bp, D. melanogaster
agctgaaagccaa

SEQ ID NO: 578590 - DNA, 13 bp, D. melanogaster
agctgaaaggaaa

SEQ ID NO: 578591 - DNA, 13 bp, D. melanogaster
agctgaaataaaa

SEQ ID NO: 578592 - DNA, 13 bp, D. melanogaster
agctgaaatgaaa

SEQ ID NO: 578593 - DNA, 13 bp, D. melanogaster
agctgaaatttat

SEQ ID NO: 578594 - DNA, 13 bp, D. melanogaster
agctgaacaaaca

SEQ ID NO: 578595 - DNA, 13 bp, D. melanogaster
agctgaacaaggc

SEQ ID NO: 578596 - DNA, 13 bp, D. melanogaster
agctgaactgaac

SEQ ID NO: 578597 - DNA, 13 bp, D. melanogaster
agctgaagaaaaa

SEQ ID NO: 578598 - DNA, 13 bp, D. melanogaster
agctgaagcaccg

SEQ ID NO: 578599 - DNA, 13 bp, D. melanogaster
agctgaagctaaa

SEQ ID NO: 578600 - DNA, 14 bp, D. melanogaster
agctgaagctaaag

SEQ ID NO: 578601 - DNA, 13 bp, D. melanogaster
agctgaagctgaa

SEQ ID NO: 578602 - DNA, 13 bp, D. melanogaster
agctgaagctgga

SEQ ID NO: 578603 - DNA, 14 bp, D. melanogaster
agctgaagctggag

SEQ ID NO: 578604 - DNA, 14 bp, D. melanogaster
agctgaatactcta

SEQ ID NO: 578605 - DNA, 13 bp, D. melanogaster
agctgaatattaa

SEQ ID NO: 578606 - DNA, 13 bp, D. melanogaster
agctgaatctgaa

SEQ ID NO: 578607 - DNA, 13 bp, D. melanogaster
agctgaatgcaaa

SEQ ID NO: 578608 - DNA, 13 bp, D. melanogaster
agctgaatttatt

SEQ ID NO: 578609 - DNA, 13 bp, D. melanogaster
agctgacaaacaa

SEQ ID NO: 578610 - DNA, 13 bp, D. melanogaster
agctgacaacttt

SEQ ID NO: 578611 - DNA, 13 bp, D. melanogaster
agctgacacggca

SEQ ID NO: 578612 - DNA, 13 bp, D. melanogaster
agctgaccaaaca

SEQ ID NO: 578613 - DNA, 13 bp, D. melanogaster
agctgaccaccca

SEQ ID NO: 578614 - DNA, 13 bp, D. melanogaster
agctgagaaaaaa

SEQ ID NO: 578615 - DNA, 14 bp, D. melanogaster
agctgagaaaaaaa

SEQ ID NO: 578616 - DNA, 13 bp, D. melanogaster
agctgagcaaaca

SEQ ID NO: 578617 - DNA, 13 bp, D. melanogaster
agctgagcaaata

SEQ ID NO: 578618 - DNA, 15 bp, D. melanogaster
agctgagcagcctca

SEQ ID NO: 578619 - DNA, 13 bp, D. melanogaster
agctgaggcggaa

SEQ ID NO: 578620 - DNA, 13 bp, D. melanogaster
agctgataaaaaa

SEQ ID NO: 578621 - DNA, 13 bp, D. melanogaster
agctgatagccgt

SEQ ID NO: 578622 - DNA, 13 bp, D. melanogaster
agctgatatggtt

SEQ ID NO: 578623 - DNA, 13 bp, D. melanogaster
agctgatccttgg

SEQ ID NO: 578624 - DNA, 13 bp, D. melanogaster
agctgatgggcct

SEQ ID NO: 578625 - DNA, 13 bp, D. melanogaster
agctgatttggcc

SEQ ID NO: 578626 - DNA, 14 bp, D. melanogaster
agctgcaaaaaaaa

SEQ ID NO: 578627 - DNA, 13 bp, D. melanogaster
agctgcaaaaaac

SEQ ID NO: 578628 - DNA, 14 bp, D. melanogaster
agctgcaaaaaaca

SEQ ID NO: 578629 - DNA, 13 bp, D. melanogaster
agctgcaaaaatt

SEQ ID NO: 578630 - DNA, 13 bp, D. melanogaster
agctgcaaaagtt

SEQ ID NO: 578631 - DNA, 13 bp, D. melanogaster
agctgcaaaatgc

SEQ ID NO: 578632 - DNA, 13 bp, D. melanogaster
agctgcaaaattt

SEQ ID NO: 578633 - DNA, 13 bp, D. melanogaster
agctgcaaacaaa

SEQ ID NO: 578634 - DNA, 13 bp, D. melanogaster
agctgcaaagaaa

SEQ ID NO: 578635 - DNA, 13 bp, D. melanogaster
agctgcaaataaa

SEQ ID NO: 578636 - DNA, 13 bp, D. melanogaster
agctgcaaatgaa

SEQ ID NO: 578637 - DNA, 13 bp, D. melanogaster
agctgcaaattgc

SEQ ID NO: 578638 - DNA, 13 bp, D. melanogaster
agctgcaacaaat

SEQ ID NO: 578639 - DNA, 14 bp, D. melanogaster
agctgcaacaacaa

SEQ ID NO: 578640 - DNA, 13 bp, D. melanogaster
agctgcaacaact

SEQ ID NO: 578641 - DNA, 14 bp, D. melanogaster
agctgcaacaactt

SEQ ID NO: 578642 - DNA, 13 bp, D. melanogaster
agctgcaacatca

SEQ ID NO: 578643 - DNA, 14 bp, D. melanogaster
agctgcaactgcaa

SEQ ID NO: 578644 - DNA, 13 bp, D. melanogaster
agctgcaagaaaa

SEQ ID NO: 578645 - DNA, 13 bp, D. melanogaster
agctgcaagctgc

SEQ ID NO: 578646 - DNA, 14 bp, D. melanogaster
agctgcaagctgca

SEQ ID NO: 578647 - DNA, 13 bp, D. melanogaster
agctgcaagtgga

SEQ ID NO: 578648 - DNA, 13 bp, D. melanogaster
agctgcaagtttt

SEQ ID NO: 578649 - DNA, 13 bp, D. melanogaster
agctgcaataaaa

SEQ ID NO: 578650 - DNA, 13 bp, D. melanogaster
agctgcaatcgaa

SEQ ID NO: 578651 - DNA, 13 bp, D. melanogaster
agctgcaattgaa

SEQ ID NO: 578652 - DNA, 13 bp, D. melanogaster
agctgcaattttt

SEQ ID NO: 578653 - DNA, 13 bp, D. melanogaster
agctgcacaaaaa

SEQ ID NO: 578654 - DNA, 13 bp, D. melanogaster
agctgcacaaaac

SEQ ID NO: 578655 - DNA, 13 bp, D. melanogaster
agctgcacaaatt

SEQ ID NO: 578656 - DNA, 13 bp, D. melanogaster
agctgcacacaaa

SEQ ID NO: 578657 - DNA, 13 bp, D. melanogaster
agctgcacacaca

SEQ ID NO: 578658 - DNA, 13 bp, D. melanogaster
agctgcacgtgtg

SEQ ID NO: 578659 - DNA, 13 bp, D. melanogaster
agctgcactggga

SEQ ID NO: 578660 - DNA, 13 bp, D. melanogaster
agctgcacttttc

SEQ ID NO: 578661 - DNA, 13 bp, D. melanogaster
agctgcagacaaa

SEQ ID NO: 578662 - DNA, 13 bp, D. melanogaster
agctgcagataca

SEQ ID NO: 578663 - DNA, 14 bp, D. melanogaster
agctgcagatgcag

SEQ ID NO: 578664 - DNA, 13 bp, D. melanogaster
agctgcagcaaaa

SEQ ID NO: 578665 - DNA, 13 bp, D. melanogaster
agctgcagcagca

SEQ ID NO: 578666 - DNA, 14 bp, D. melanogaster
agctgcagcagcag

SEQ ID NO: 578667 - DNA, 13 bp, D. melanogaster
agctgcagcagcg

SEQ ID NO: 578668 - DNA, 13 bp, D. melanogaster
agctgcagcagct

SEQ ID NO: 578669 - DNA, 14 bp, D. melanogaster
agctgcagcagctg

SEQ ID NO: 578670 - DNA, 13 bp, D. melanogaster
agctgcagccaaa

SEQ ID NO: 578671 - DNA, 13 bp, D. melanogaster
agctgcagctcca

SEQ ID NO: 578672 - DNA, 14 bp, D. melanogaster
agctgcagctgcaa

SEQ ID NO: 578673 - DNA, 13 bp, D. melanogaster
agctgcagctgcc

SEQ ID NO: 578674 - DNA, 13 bp, D. melanogaster
agctgcagctgcg

SEQ ID NO: 578675 - DNA, 13 bp, D. melanogaster
agctgcagttcct

SEQ ID NO: 578676 - DNA, 13 bp, D. melanogaster
agctgcagttgaa

SEQ ID NO: 578677 - DNA, 13 bp, D. melanogaster
agctgcagtttgg

SEQ ID NO: 578678 - DNA, 13 bp, D. melanogaster
agctgcataaaaa

SEQ ID NO: 578679 - DNA, 13 bp, D. melanogaster
agctgcatagcca

SEQ ID NO: 578680 - DNA, 13 bp, D. melanogaster
agctgcatcggca

SEQ ID NO: 578681 - DNA, 13 bp, D. melanogaster
agctgcatgtgtg

SEQ ID NO: 578682 - DNA, 13 bp, D. melanogaster
agctgcattccca

SEQ ID NO: 578683 - DNA, 13 bp, D. melanogaster
agctgcattgttt

SEQ ID NO: 578684 - DNA, 13 bp, D. melanogaster
agctgcattttca

SEQ ID NO: 578685 - DNA, 13 bp, D. melanogaster
agctgcattttta

SEQ ID NO: 578686 - DNA, 13 bp, D. melanogaster
agctgccaaaaag

SEQ ID NO: 578687 - DNA, 13 bp, D. melanogaster
agctgccaaaatg

SEQ ID NO: 578688 - DNA, 13 bp, D. melanogaster
agctgccaactgc

SEQ ID NO: 578689 - DNA, 13 bp, D. melanogaster
agctgccaatttg

SEQ ID NO: 578690 - DNA, 13 bp, D. melanogaster
agctgccacaaaa

SEQ ID NO: 578691 - DNA, 13 bp, D. melanogaster
agctgccacacac

SEQ ID NO: 578692 - DNA, 14 bp, D. melanogaster
agctgccacacacc

SEQ ID NO: 578693 - DNA, 13 bp, D. melanogaster
agctgccagacct

SEQ ID NO: 578694 - DNA, 13 bp, D. melanogaster
agctgccccaaaa

SEQ ID NO: 578695 - DNA, 13 bp, D. melanogaster
agctgccgctgct

SEQ ID NO: 578696 - DNA, 13 bp, D. melanogaster
agctgcctgaaaa

SEQ ID NO: 578697 - DNA, 14 bp, D. melanogaster
agctgcctgaaaat

SEQ ID NO: 578698 - DNA, 13 bp, D. melanogaster
agctgcctggcaa

SEQ ID NO: 578699 - DNA, 13 bp, D. melanogaster
agctgcgagctgc

SEQ ID NO: 578700 - DNA, 13 bp, D. melanogaster
agctgcgccatct

SEQ ID NO: 578701 - DNA, 13 bp, D. melanogaster
agctgcgctgcaa

SEQ ID NO: 578702 - DNA, 13 bp, D. melanogaster
agctgcgctgccg

SEQ ID NO: 578703 - DNA, 14 bp, D. melanogaster
agctgctcaaaaag

SEQ ID NO: 578704 - DNA, 13 bp, D. melanogaster
agctgctcaaaac

SEQ ID NO: 578705 - DNA, 13 bp, D. melanogaster
agctgctccagct

SEQ ID NO: 578706 - DNA, 13 bp, D. melanogaster
agctgctcctcct

SEQ ID NO: 578707 - DNA, 13 bp, D. melanogaster
agctgctcctgct

SEQ ID NO: 578708 - DNA, 13 bp, D. melanogaster
agctgctctctct

SEQ ID NO: 578709 - DNA, 13 bp, D. melanogaster
agctgctgaaaaa

SEQ ID NO: 578710 - DNA, 13 bp, D. melanogaster
agctgctgatgat

SEQ ID NO: 578711 - DNA, 13 bp, D. melanogaster
agctgctgcaatt

SEQ ID NO: 578712 - DNA, 13 bp, D. melanogaster
agctgctgcagct

SEQ ID NO: 578713 - DNA, 14 bp, D. melanogaster
agctgctgcagctg

SEQ ID NO: 578714 - DNA, 13 bp, D. melanogaster
agctgctgcagta

SEQ ID NO: 578715 - DNA, 13 bp, D. melanogaster
agctgctgctgct

SEQ ID NO: 578716 - DNA, 14 bp, D. melanogaster
agctgctgctgctg

SEQ ID NO: 578717 - DNA, 13 bp, D. melanogaster
agctgctggaaaa

SEQ ID NO: 578718 - DNA, 13 bp, D. melanogaster
agctgctggcaaa

SEQ ID NO: 578719 - DNA, 13 bp, D. melanogaster
agctgctggcatt

SEQ ID NO: 578720 - DNA, 13 bp, D. melanogaster
agctgctggctgt

SEQ ID NO: 578721 - DNA, 13 bp, D. melanogaster
agctgcttaaaaa

SEQ ID NO: 578722 - DNA, 13 bp, D. melanogaster
agctgctttaatt

SEQ ID NO: 578723 - DNA, 13 bp, D. melanogaster
agctgctttgcat

SEQ ID NO: 578724 - DNA, 14 bp, D. melanogaster
agctggaaaaaaaa

SEQ ID NO: 578725 - DNA, 13 bp, D. melanogaster
agctggaaaaact

SEQ ID NO: 578726 - DNA, 14 bp, D. melanogaster
agctggaaaaactg

SEQ ID NO: 578727 - DNA, 13 bp, D. melanogaster
agctggaaaaagt

SEQ ID NO: 578728 - DNA, 13 bp, D. melanogaster
agctggaaaactg

SEQ ID NO: 578729 - DNA, 14 bp, D. melanogaster
agctggaaaagcgg

SEQ ID NO: 578730 - DNA, 13 bp, D. melanogaster
agctggaaaagct

SEQ ID NO: 578731 - DNA, 13 bp, D. melanogaster
agctggaaaagtg

SEQ ID NO: 578732 - DNA, 13 bp, D. melanogaster
agctggaaaagtt

SEQ ID NO: 578733 - DNA, 13 bp, D. melanogaster
agctggaaaatat

SEQ ID NO: 578734 - DNA, 13 bp, D. melanogaster
agctggaaaatgg

SEQ ID NO: 578735 - DNA, 13 bp, D. melanogaster
agctggaaaatgt

SEQ ID NO: 578736 - DNA, 13 bp, D. melanogaster
agctggaaaattt

SEQ ID NO: 578737 - DNA, 13 bp, D. melanogaster
agctggaaatgca

SEQ ID NO: 578738 - DNA, 13 bp, D. melanogaster
agctggaactgga

SEQ ID NO: 578739 - DNA, 13 bp, D. melanogaster
agctggaagctgg

SEQ ID NO: 578740 - DNA, 13 bp, D. melanogaster
agctggagagctg

SEQ ID NO: 578741 - DNA, 14 bp, D. melanogaster
agctggagagggac

SEQ ID NO: 578742 - DNA, 14 bp, D. melanogaster
agctggagatggag

SEQ ID NO: 578743 - DNA, 13 bp, D. melanogaster
agctggagcagca

SEQ ID NO: 578744 - DNA, 14 bp, D. melanogaster
agctggagcagcag

SEQ ID NO: 578745 - DNA, 13 bp, D. melanogaster
agctggagctgaa

SEQ ID NO: 578746 - DNA, 14 bp, D. melanogaster
agctggagctgaag

SEQ ID NO: 578747 - DNA, 14 bp, D. melanogaster
agctggagctggaa

SEQ ID NO: 578748 - DNA, 13 bp, D. melanogaster
agctggaggaaaa

SEQ ID NO: 578749 - DNA, 13 bp, D. melanogaster
agctggagtgccg

SEQ ID NO: 578750 - DNA, 13 bp, D. melanogaster
agctggagtttgt

SEQ ID NO: 578751 - DNA, 13 bp, D. melanogaster
agctggatctcca

SEQ ID NO: 578752 - DNA, 14 bp, D. melanogaster
agctggatctccag

SEQ ID NO: 578753 - DNA, 13 bp, D. melanogaster
agctggatgacaa

SEQ ID NO: 578754 - DNA, 13 bp, D. melanogaster
agctggatgatca

SEQ ID NO: 578755 - DNA, 13 bp, D. melanogaster
agctggcaaaaaa

SEQ ID NO: 578756 - DNA, 13 bp, D. melanogaster
agctggcaaaaat

SEQ ID NO: 578757 - DNA, 13 bp, D. melanogaster
agctggcaaaatt

SEQ ID NO: 578758 - DNA, 13 bp, D. melanogaster
agctggcaaagtt

SEQ ID NO: 578759 - DNA, 13 bp, D. melanogaster
agctggcaaatat

SEQ ID NO: 578760 - DNA, 13 bp, D. melanogaster
agctggcacagcg

SEQ ID NO: 578761 - DNA, 13 bp, D. melanogaster
agctggcagctgg

SEQ ID NO: 578762 - DNA, 13 bp, D. melanogaster
agctggcataaaa

SEQ ID NO: 578763 - DNA, 14 bp, D. melanogaster
agctggccaaaaag

SEQ ID NO: 578764 - DNA, 13 bp, D. melanogaster
agctggccaaaag

SEQ ID NO: 578765 - DNA, 13 bp, D. melanogaster
agctggccaaaca

SEQ ID NO: 578766 - DNA, 13 bp, D. melanogaster
agctggccaacaa

SEQ ID NO: 578767 - DNA, 13 bp, D. melanogaster
agctggccaacag

SEQ ID NO: 578768 - DNA, 13 bp, D. melanogaster
agctggccaagaa

SEQ ID NO: 578769 - DNA, 13 bp, D. melanogaster
agctggccaagat

SEQ ID NO: 578770 - DNA, 13 bp, D. melanogaster
agctggccaattt

SEQ ID NO: 578771 - DNA, 13 bp, D. melanogaster
agctggcccaaaa

SEQ ID NO: 578772 - DNA, 13 bp, D. melanogaster
agctggcctttct

SEQ ID NO: 578773 - DNA, 13 bp, D. melanogaster
agctggcgaaatg

SEQ ID NO: 578774 - DNA, 13 bp, D. melanogaster
agctggcggggat

SEQ ID NO: 578775 - DNA, 13 bp, D. melanogaster
agctggctgaaat

SEQ ID NO: 578776 - DNA, 13 bp, D. melanogaster
agctggctggaaa

SEQ ID NO: 578777 - DNA, 13 bp, D. melanogaster
agctgggaaaaat

SEQ ID NO: 578778 - DNA, 13 bp, D. melanogaster
agctgggaaaact

SEQ ID NO: 578779 - DNA, 13 bp, D. melanogaster
agctgggaaactg

SEQ ID NO: 578780 - DNA, 13 bp, D. melanogaster
agctgggaactgg

SEQ ID NO: 578781 - DNA, 13 bp, D. melanogaster
agctgggaatgcc

SEQ ID NO: 578782 - DNA, 13 bp, D. melanogaster
agctgggagctgg

SEQ ID NO: 578783 - DNA, 13 bp, D. melanogaster
agctgggcaaaaa

SEQ ID NO: 578784 - DNA, 13 bp, D. melanogaster
agctggtcatggg

SEQ ID NO: 578785 - DNA, 14 bp, D. melanogaster
agctggtgaaaaca

SEQ ID NO: 578786 - DNA, 13 bp, D. melanogaster
agctggtgagctg

SEQ ID NO: 578787 - DNA, 13 bp, D. melanogaster
agctggtggatgt

SEQ ID NO: 578788 - DNA, 13 bp, D. melanogaster
agctggtgtactt

SEQ ID NO: 578789 - DNA, 13 bp, D. melanogaster
agctgtaaaatat

SEQ ID NO: 578790 - DNA, 13 bp, D. melanogaster
agctgtaacaatc

SEQ ID NO: 578791 - DNA, 13 bp, D. melanogaster
agctgtaattcga

SEQ ID NO: 578792 - DNA, 13 bp, D. melanogaster
agctgtagctgta

SEQ ID NO: 578793 - DNA, 14 bp, D. melanogaster
agctgtagctgtag

SEQ ID NO: 578794 - DNA, 13 bp, D. melanogaster
agctgtataataa

SEQ ID NO: 578795 - DNA, 13 bp, D. melanogaster
agctgtcttaaca

SEQ ID NO: 578796 - DNA, 13 bp, D. melanogaster
agctgtgcaaata

SEQ ID NO: 578797 - DNA, 13 bp, D. melanogaster
agctgtggagctg

SEQ ID NO: 578798 - DNA, 13 bp, D. melanogaster
agctgtggatata

SEQ ID NO: 578799 - DNA, 13 bp, D. melanogaster
agctgtgggaaaa

SEQ ID NO: 578800 - DNA, 13 bp, D. melanogaster
agctgtgtataaa

SEQ ID NO: 578801 - DNA, 13 bp, D. melanogaster
agctgtgtgagtg

SEQ ID NO: 578802 - DNA, 13 bp, D. melanogaster
agctgtgtgcagc

SEQ ID NO: 578803 - DNA, 13 bp, D. melanogaster
agctgtgtgtttt

SEQ ID NO: 578804 - DNA, 13 bp, D. melanogaster
agctgtgttgttt

SEQ ID NO: 578805 - DNA, 13 bp, D. melanogaster
agctgttaaaaat

SEQ ID NO: 578806 - DNA, 13 bp, D. melanogaster
agctgttaaattt

SEQ ID NO: 578807 - DNA, 13 bp, D. melanogaster
agctgttaattaa

SEQ ID NO: 578808 - DNA, 13 bp, D. melanogaster
agctgttataaaa

SEQ ID NO: 578809 - DNA, 13 bp, D. melanogaster
agctgttggaaaa

SEQ ID NO: 578810 - DNA, 14 bp, D. melanogaster
agctgttgttgttt

SEQ ID NO: 578811 - DNA, 13 bp, D. melanogaster
agctgtttaaatt

SEQ ID NO: 578812 - DNA, 13 bp, D. melanogaster
agctgtttgaaaa

SEQ ID NO: 578813 - DNA, 13 bp, D. melanogaster
agctgtttgcagc

SEQ ID NO: 578814 - DNA, 13 bp, D. melanogaster
agctgtttgtgtt

SEQ ID NO: 578815 - DNA, 13 bp, D. melanogaster
agctgtttttatt

SEQ ID NO: 578816 - DNA, 13 bp, D. melanogaster
agctgttttttgt

SEQ ID NO: 578817 - DNA, 13 bp, D. melanogaster
agcttaaaaaaga

SEQ ID NO: 578818 - DNA, 13 bp, D. melanogaster
agcttaaaaaata

SEQ ID NO: 578819 - DNA, 13 bp, D. melanogaster
agcttaaaaacaa

SEQ ID NO: 578820 - DNA, 13 bp, D. melanogaster
agcttaaaaactt

SEQ ID NO: 578821 - DNA, 13 bp, D. melanogaster
agcttaaaatatt

SEQ ID NO: 578822 - DNA, 13 bp, D. melanogaster
agcttaaaattat

SEQ ID NO: 578823 - DNA, 13 bp, D. melanogaster
agcttaaacttaa

SEQ ID NO: 578824 - DNA, 13 bp, D. melanogaster
agcttaaagaaat

SEQ ID NO: 578825 - DNA, 13 bp, D. melanogaster
agcttaaagacat

SEQ ID NO: 578826 - DNA, 13 bp, D. melanogaster
agcttaaagcaaa

SEQ ID NO: 578827 - DNA, 13 bp, D. melanogaster
agcttaaagcata

SEQ ID NO: 578828 - DNA, 13 bp, D. melanogaster
agcttaaagtttt

SEQ ID NO: 578829 - DNA, 13 bp, D. melanogaster
agcttaaatcaaa

SEQ ID NO: 578830 - DNA, 13 bp, D. melanogaster
agcttaaattaat

SEQ ID NO: 578831 - DNA, 13 bp, D. melanogaster
agcttaaattatt

SEQ ID NO: 578832 - DNA, 13 bp, D. melanogaster
agcttaacacatt

SEQ ID NO: 578833 - DNA, 13 bp, D. melanogaster
agcttaacatttt

SEQ ID NO: 578834 - DNA, 13 bp, D. melanogaster
agcttaacttctt

SEQ ID NO: 578835 - DNA, 13 bp, D. melanogaster
agcttaactttta

SEQ ID NO: 578836 - DNA, 13 bp, D. melanogaster
agcttaagaaata

SEQ ID NO: 578837 - DNA, 13 bp, D. melanogaster
agcttaagcacgc

SEQ ID NO: 578838 - DNA, 13 bp, D. melanogaster
agcttaagcttaa

SEQ ID NO: 578839 - DNA, 14 bp, D. melanogaster
agcttaagcttaag

SEQ ID NO: 578840 - DNA, 13 bp, D. melanogaster
agcttaataaaaa

SEQ ID NO: 578841 - DNA, 13 bp, D. melanogaster
agcttaattcaat

SEQ ID NO: 578842 - DNA, 13 bp, D. melanogaster
agcttaatttgtt

SEQ ID NO: 578843 - DNA, 13 bp, D. melanogaster
agcttaattttat

SEQ ID NO: 578844 - DNA, 13 bp, D. melanogaster
agcttacaaaaat

SEQ ID NO: 578845 - DNA, 13 bp, D. melanogaster
agcttagcttagc

SEQ ID NO: 578846 - DNA, 14 bp, D. melanogaster
agcttagttttcaa

SEQ ID NO: 578847 - DNA, 13 bp, D. melanogaster
agcttatgcaaat

SEQ ID NO: 578848 - DNA, 13 bp, D. melanogaster
agcttatgggtct

SEQ ID NO: 578849 - DNA, 13 bp, D. melanogaster
agcttattaaaaa

SEQ ID NO: 578850 - DNA, 13 bp, D. melanogaster
agcttattgattt

SEQ ID NO: 578851 - DNA, 13 bp, D. melanogaster
agcttattgtttt

SEQ ID NO: 578852 - DNA, 13 bp, D. melanogaster
agcttatttactt

SEQ ID NO: 578853 - DNA, 13 bp, D. melanogaster
agcttattttata

SEQ ID NO: 578854 - DNA, 13 bp, D. melanogaster
agcttcaataaac

SEQ ID NO: 578855 - DNA, 14 bp, D. melanogaster
agcttcaataaacg

SEQ ID NO: 578856 - DNA, 13 bp, D. melanogaster
agcttcactcttg

SEQ ID NO: 578857 - DNA, 13 bp, D. melanogaster
agcttcagattca

SEQ ID NO: 578858 - DNA, 13 bp, D. melanogaster
agcttcagctcca

SEQ ID NO: 578859 - DNA, 13 bp, D. melanogaster
agcttcagctttt

SEQ ID NO: 578860 - DNA, 14 bp, D. melanogaster
agcttcagttgatg

SEQ ID NO: 578861 - DNA, 13 bp, D. melanogaster
agcttcatcatca

SEQ ID NO: 578862 - DNA, 13 bp, D. melanogaster
agcttccagagca

SEQ ID NO: 578863 - DNA, 13 bp, D. melanogaster
agcttcccaaata

SEQ ID NO: 578864 - DNA, 13 bp, D. melanogaster
agcttcctgcaga

SEQ ID NO: 578865 - DNA, 13 bp, D. melanogaster
agcttcgatgcca

SEQ ID NO: 578866 - DNA, 13 bp, D. melanogaster
agcttcgcattga

SEQ ID NO: 578867 - DNA, 13 bp, D. melanogaster
agcttcgtctgcg

SEQ ID NO: 578868 - DNA, 13 bp, D. melanogaster
agcttctgttttt

SEQ ID NO: 578869 - DNA, 13 bp, D. melanogaster
agcttctttttct

SEQ ID NO: 578870 - DNA, 13 bp, D. melanogaster
agcttgaaaaaat

SEQ ID NO: 578871 - DNA, 14 bp, D. melanogaster
agcttgaaaaggac

SEQ ID NO: 578872 - DNA, 13 bp, D. melanogaster
agcttgaaatcca

SEQ ID NO: 578873 - DNA, 14 bp, D. melanogaster
agcttgattatttt

SEQ ID NO: 578874 - DNA, 13 bp, D. melanogaster
agcttggaaatcg

SEQ ID NO: 578875 - DNA, 13 bp, D. melanogaster
agcttgtaaacaa

SEQ ID NO: 578876 - DNA, 13 bp, D. melanogaster
agcttgtttttgt

SEQ ID NO: 578877 - DNA, 13 bp, D. melanogaster
agctttaaaaaaa

SEQ ID NO: 578878 - DNA, 13 bp, D. melanogaster
agctttaaaaact

SEQ ID NO: 578879 - DNA, 13 bp, D. melanogaster
agctttaaaattg

SEQ ID NO: 578880 - DNA, 13 bp, D. melanogaster
agctttaaacaaa

SEQ ID NO: 578881 - DNA, 13 bp, D. melanogaster
agctttaaattga

SEQ ID NO: 578882 - DNA, 13 bp, D. melanogaster
agctttaaccaaa

SEQ ID NO: 578883 - DNA, 13 bp, D. melanogaster
agctttaatagtt

SEQ ID NO: 578884 - DNA, 13 bp, D. melanogaster
agctttaattgca

SEQ ID NO: 578885 - DNA, 13 bp, D. melanogaster
agctttaatttaa

SEQ ID NO: 578886 - DNA, 13 bp, D. melanogaster
agctttagctttg

SEQ ID NO: 578887 - DNA, 13 bp, D. melanogaster
agctttattttta

SEQ ID NO: 578888 - DNA, 13 bp, D. melanogaster
agctttcaaggca

SEQ ID NO: 578889 - DNA, 13 bp, D. melanogaster
agctttcagcttt

SEQ ID NO: 578890 - DNA, 13 bp, D. melanogaster
agctttcggaaag

SEQ ID NO: 578891 - DNA, 13 bp, D. melanogaster
agctttgaaataa

SEQ ID NO: 578892 - DNA, 14 bp, D. melanogaster
agctttgaactcca

SEQ ID NO: 578893 - DNA, 14 bp, D. melanogaster
agctttgaagagca

SEQ ID NO: 578894 - DNA, 13 bp, D. melanogaster
agctttgaatttt

SEQ ID NO: 578895 - DNA, 13 bp, D. melanogaster
agctttgatatta

SEQ ID NO: 578896 - DNA, 13 bp, D. melanogaster
agctttgatttgc

SEQ ID NO: 578897 - DNA, 13 bp, D. melanogaster
agctttgggcttt

SEQ ID NO: 578898 - DNA, 13 bp, D. melanogaster
agctttgtaaaaa

SEQ ID NO: 578899 - DNA, 14 bp, D. melanogaster
agctttgtaaatga

SEQ ID NO: 578900 - DNA, 13 bp, D. melanogaster
agctttgtttttg

SEQ ID NO: 578901 - DNA, 13 bp, D. melanogaster
agcttttaaaata

SEQ ID NO: 578902 - DNA, 13 bp, D. melanogaster
agcttttaaaatt

SEQ ID NO: 578903 - DNA, 14 bp, D. melanogaster
agcttttaaaattt

SEQ ID NO: 578904 - DNA, 13 bp, D. melanogaster
agcttttaaataa

SEQ ID NO: 578905 - DNA, 13 bp, D. melanogaster
agcttttaataaa

SEQ ID NO: 578906 - DNA, 13 bp, D. melanogaster
agcttttacgaaa

SEQ ID NO: 578907 - DNA, 13 bp, D. melanogaster
agcttttatagtt

SEQ ID NO: 578908 - DNA, 13 bp, D. melanogaster
agcttttatctag

SEQ ID NO: 578909 - DNA, 13 bp, D. melanogaster
agcttttattgtt

SEQ ID NO: 578910 - DNA, 14 bp, D. melanogaster
agcttttattttta

SEQ ID NO: 578911 - DNA, 13 bp, D. melanogaster
agcttttcaaatt

SEQ ID NO: 578912 - DNA, 13 bp, D. melanogaster
agcttttcacttt

SEQ ID NO: 578913 - DNA, 14 bp, D. melanogaster
agcttttccagctt

SEQ ID NO: 578914 - DNA, 13 bp, D. melanogaster
agcttttccattt

SEQ ID NO: 578915 - DNA, 13 bp, D. melanogaster
agcttttccgacc

SEQ ID NO: 578916 - DNA, 13 bp, D. melanogaster
agcttttgataaa

SEQ ID NO: 578917 - DNA, 13 bp, D. melanogaster
agcttttgatctg

SEQ ID NO: 578918 - DNA, 13 bp, D. melanogaster
agcttttgcaaat

SEQ ID NO: 578919 - DNA, 14 bp, D. melanogaster
agcttttgcttttg

SEQ ID NO: 578920 - DNA, 13 bp, D. melanogaster
agcttttgtttta

SEQ ID NO: 578921 - DNA, 13 bp, D. melanogaster
agcttttgttttg

SEQ ID NO: 578922 - DNA, 13 bp, D. melanogaster
agctttttaaata

SEQ ID NO: 578923 - DNA, 13 bp, D. melanogaster
agctttttaaatt

SEQ ID NO: 578924 - DNA, 14 bp, D. melanogaster
agctttttaaattt

SEQ ID NO: 578925 - DNA, 13 bp, D. melanogaster
agctttttattat

SEQ ID NO: 578926 - DNA, 13 bp, D. melanogaster
agctttttcaaat

SEQ ID NO: 578927 - DNA, 13 bp, D. melanogaster
agctttttgggaa

SEQ ID NO: 578928 - DNA, 13 bp, D. melanogaster
agcttttttcgac

SEQ ID NO: 578929 - DNA, 14 bp, D. melanogaster
aggaaaaaatattg

SEQ ID NO: 578930 - DNA, 13 bp, D. melanogaster
aggaaaaacaatt

SEQ ID NO: 578931 - DNA, 13 bp, D. melanogaster
aggaaaaacttca

SEQ ID NO: 578932 - DNA, 14 bp, D. melanogaster
aggaaaaacttcac

SEQ ID NO: 578933 - DNA, 13 bp, D. melanogaster
aggaaaaagtgtt

SEQ ID NO: 578934 - DNA, 13 bp, D. melanogaster
aggaaaaatacca

SEQ ID NO: 578935 - DNA, 13 bp, D. melanogaster
aggaaaaatccaa

SEQ ID NO: 578936 - DNA, 13 bp, D. melanogaster
aggaaaaattttc

SEQ ID NO: 578937 - DNA, 13 bp, D. melanogaster
aggaaaacaaatt

SEQ ID NO: 578938 - DNA, 13 bp, D. melanogaster
aggaaaacacgtg

SEQ ID NO: 578939 - DNA, 13 bp, D. melanogaster
aggaaaacagctt

SEQ ID NO: 578940 - DNA, 13 bp, D. melanogaster
aggaaaacatttt

SEQ ID NO: 578941 - DNA, 13 bp, D. melanogaster
aggaaaaccaaat

SEQ ID NO: 578942 - DNA, 13 bp, D. melanogaster
aggaaaaccaatt

SEQ ID NO: 578943 - DNA, 13 bp, D. melanogaster
aggaaaacctttt

SEQ ID NO: 578944 - DNA, 13 bp, D. melanogaster
aggaaaacgattt

SEQ ID NO: 578945 - DNA, 13 bp, D. melanogaster
aggaaaacggtca

SEQ ID NO: 578946 - DNA, 13 bp, D. melanogaster
aggaaaagcgtga

SEQ ID NO: 578947 - DNA, 13 bp, D. melanogaster
aggaaaagctgaa

SEQ ID NO: 578948 - DNA, 13 bp, D. melanogaster
aggaaaagcttca

SEQ ID NO: 578949 - DNA, 13 bp, D. melanogaster
aggaaaataattt

SEQ ID NO: 578950 - DNA, 13 bp, D. melanogaster
aggaaaatatatt

SEQ ID NO: 578951 - DNA, 13 bp, D. melanogaster
aggaaaatcaaat

SEQ ID NO: 578952 - DNA, 13 bp, D. melanogaster
aggaaaatcaata

SEQ ID NO: 578953 - DNA, 14 bp, D. melanogaster
aggaaaatcaataa

SEQ ID NO: 578954 - DNA, 13 bp, D. melanogaster
aggaaaatccatt

SEQ ID NO: 578955 - DNA, 13 bp, D. melanogaster
aggaaaatgccaa

SEQ ID NO: 578956 - DNA, 13 bp, D. melanogaster
aggaaaatggcaa

SEQ ID NO: 578957 - DNA, 13 bp, D. melanogaster
aggaaaatggcag

SEQ ID NO: 578958 - DNA, 13 bp, D. melanogaster
aggaaaatgtatt

SEQ ID NO: 578959 - DNA, 13 bp, D. melanogaster
aggaaaatgtttt

SEQ ID NO: 578960 - DNA, 14 bp, D. melanogaster
aggaaacaaaatga

SEQ ID NO: 578961 - DNA, 13 bp, D. melanogaster
aggaaacaaatat

SEQ ID NO: 578962 - DNA, 13 bp, D. melanogaster
aggaaacatttta

SEQ ID NO: 578963 - DNA, 13 bp, D. melanogaster
aggaaaccttctt

SEQ ID NO: 578964 - DNA, 13 bp, D. melanogaster
aggaaacggaaac

SEQ ID NO: 578965 - DNA, 13 bp, D. melanogaster
aggaaacggaaat

SEQ ID NO: 578966 - DNA, 13 bp, D. melanogaster
aggaaacggaagt

SEQ ID NO: 578967 - DNA, 13 bp, D. melanogaster
aggaaacttttaa

SEQ ID NO: 578968 - DNA, 14 bp, D. melanogaster
aggaaacttttaag

SEQ ID NO: 578969 - DNA, 13 bp, D. melanogaster
aggaaacttttcc

SEQ ID NO: 578970 - DNA, 13 bp, D. melanogaster
aggaaagggtatt

SEQ ID NO: 578971 - DNA, 13 bp, D. melanogaster
aggaaataaagtt

SEQ ID NO: 578972 - DNA, 13 bp, D. melanogaster
aggaaataatttc

SEQ ID NO: 578973 - DNA, 14 bp, D. melanogaster
aggaaataatttca

SEQ ID NO: 578974 - DNA, 13 bp, D. melanogaster
aggaaatacatac

SEQ ID NO: 578975 - DNA, 13 bp, D. melanogaster
aggaaatatgaat

SEQ ID NO: 578976 - DNA, 13 bp, D. melanogaster
aggaaatcatcat

SEQ ID NO: 578977 - DNA, 13 bp, D. melanogaster
aggaaatccattt

SEQ ID NO: 578978 - DNA, 13 bp, D. melanogaster
aggaaatcgattg

SEQ ID NO: 578979 - DNA, 13 bp, D. melanogaster
aggaaatgaaatt

SEQ ID NO: 578980 - DNA, 13 bp, D. melanogaster
aggaaatgcaaaa

SEQ ID NO: 578981 - DNA, 13 bp, D. melanogaster
aggaaatgccaaa

SEQ ID NO: 578982 - DNA, 13 bp, D. melanogaster
aggaaatgcgaaa

SEQ ID NO: 578983 - DNA, 13 bp, D. melanogaster
aggaaatgctgaa

SEQ ID NO: 578984 - DNA, 13 bp, D. melanogaster
aggaaatgctgct

SEQ ID NO: 578985 - DNA, 14 bp, D. melanogaster
aggaaatgctggcc

SEQ ID NO: 578986 - DNA, 13 bp, D. melanogaster
aggaaatgctttt

SEQ ID NO: 578987 - DNA, 13 bp, D. melanogaster
aggaaatggattt

SEQ ID NO: 578988 - DNA, 14 bp, D. melanogaster
aggaaatggatttc

SEQ ID NO: 578989 - DNA, 13 bp, D. melanogaster
aggaaatgtgcaa

SEQ ID NO: 578990 - DNA, 13 bp, D. melanogaster
aggaaatgttttt

SEQ ID NO: 578991 - DNA, 13 bp, D. melanogaster
aggaaattaagct

SEQ ID NO: 578992 - DNA, 13 bp, D. melanogaster
aggaaattatttt

SEQ ID NO: 578993 - DNA, 13 bp, D. melanogaster
aggaaattcaatt

SEQ ID NO: 578994 - DNA, 13 bp, D. melanogaster
aggaaattgccaa

SEQ ID NO: 578995 - DNA, 14 bp, D. melanogaster
aggaaattggcaaa

SEQ ID NO: 578996 - DNA, 13 bp, D. melanogaster
aggaaatttatat

SEQ ID NO: 578997 - DNA, 13 bp, D. melanogaster
aggaaatttatga

SEQ ID NO: 578998 - DNA, 13 bp, D. melanogaster
aggaacataaaca

SEQ ID NO: 578999 - DNA, 13 bp, D. melanogaster
aggaactattaaa

SEQ ID NO: 579000 - DNA, 13 bp, D. melanogaster
aggaactccagct

SEQ ID NO: 579001 - DNA, 13 bp, D. melanogaster
aggaactgcagct

SEQ ID NO: 579002 - DNA, 14 bp, D. melanogaster
aggaactgcagctg

SEQ ID NO: 579003 - DNA, 13 bp, D. melanogaster
aggaactgttttc

SEQ ID NO: 579004 - DNA, 13 bp, D. melanogaster
aggaagaagcagc

SEQ ID NO: 579005 - DNA, 14 bp, D. melanogaster
aggaagaccggcag

SEQ ID NO: 579006 - DNA, 13 bp, D. melanogaster
aggaagatggtcc

SEQ ID NO: 579007 - DNA, 13 bp, D. melanogaster
aggaagattttca

SEQ ID NO: 579008 - DNA, 13 bp, D. melanogaster
aggaagcagcagc

SEQ ID NO: 579009 - DNA, 13 bp, D. melanogaster
aggaagcgttttc

SEQ ID NO: 579010 - DNA, 14 bp, D. melanogaster
aggaagcgttttcg

SEQ ID NO: 579011 - DNA, 13 bp, D. melanogaster
aggaagctaggaa

SEQ ID NO: 579012 - DNA, 13 bp, D. melanogaster
aggaagctgctgg

SEQ ID NO: 579013 - DNA, 13 bp, D. melanogaster
aggaagctttcaa

SEQ ID NO: 579014 - DNA, 13 bp, D. melanogaster
aggaagtacaata

SEQ ID NO: 579015 - DNA, 13 bp, D. melanogaster
aggaagtcaaatt

SEQ ID NO: 579016 - DNA, 13 bp, D. melanogaster
aggaagtggaagt

SEQ ID NO: 579017 - DNA, 13 bp, D. melanogaster
aggaataggaata

SEQ ID NO: 579018 - DNA, 13 bp, D. melanogaster
aggaatataattt

SEQ ID NO: 579019 - DNA, 13 bp, D. melanogaster
aggaatatatgta

SEQ ID NO: 579020 - DNA, 13 bp, D. melanogaster
aggaatcaaagaa

SEQ ID NO: 579021 - DNA, 13 bp, D. melanogaster
aggaatccacatt

SEQ ID NO: 579022 - DNA, 13 bp, D. melanogaster
aggaatgatttct

SEQ ID NO: 579023 - DNA, 13 bp, D. melanogaster
aggaatgcccaag

SEQ ID NO: 579024 - DNA, 13 bp, D. melanogaster
aggaatgggaatg

SEQ ID NO: 579025 - DNA, 14 bp, D. melanogaster
aggaatgggaatgg

SEQ ID NO: 579026 - DNA, 13 bp, D. melanogaster
aggaatgtttatg

SEQ ID NO: 579027 - DNA, 13 bp, D. melanogaster
aggaattaaagca

SEQ ID NO: 579028 - DNA, 13 bp, D. melanogaster
aggaattatattt

SEQ ID NO: 579029 - DNA, 14 bp, D. melanogaster
aggaattattttaa

SEQ ID NO: 579030 - DNA, 13 bp, D. melanogaster
aggaattcgcatt

SEQ ID NO: 579031 - DNA, 13 bp, D. melanogaster
aggaattgagcta

SEQ ID NO: 579032 - DNA, 13 bp, D. melanogaster
aggaatttaatta

SEQ ID NO: 579033 - DNA, 13 bp, D. melanogaster
aggaatttatata

SEQ ID NO: 579034 - DNA, 13 bp, D. melanogaster
aggaatttcaatt

SEQ ID NO: 579035 - DNA, 13 bp, D. melanogaster
aggaatttccttt

SEQ ID NO: 579036 - DNA, 13 bp, D. melanogaster
aggaatttgatga

SEQ ID NO: 579037 - DNA, 13 bp, D. melanogaster
aggaattttaaat

SEQ ID NO: 579038 - DNA, 13 bp, D. melanogaster
aggaattttgccg

SEQ ID NO: 579039 - DNA, 13 bp, D. melanogaster
aggaatttttata

SEQ ID NO: 579040 - DNA, 13 bp, D. melanogaster
aggacaaaggaca

SEQ ID NO: 579041 - DNA, 13 bp, D. melanogaster
aggacaaaggacc

SEQ ID NO: 579042 - DNA, 13 bp, D. melanogaster
aggacaacaagga

SEQ ID NO: 579043 - DNA, 14 bp, D. melanogaster
aggacaacaaggac

SEQ ID NO: 579044 - DNA, 13 bp, D. melanogaster
aggacaaccgggc

SEQ ID NO: 579045 - DNA, 13 bp, D. melanogaster
aggacaatagcaa

SEQ ID NO: 579046 - DNA, 13 bp, D. melanogaster
aggacacacaaac

SEQ ID NO: 579047 - DNA, 13 bp, D. melanogaster
aggacacaggaca

SEQ ID NO: 579048 - DNA, 14 bp, D. melanogaster
aggacacaggacac

SEQ ID NO: 579049 - DNA, 13 bp, D. melanogaster
aggacacaggacg

SEQ ID NO: 579050 - DNA, 13 bp, D. melanogaster
aggacacgcacac

SEQ ID NO: 579051 - DNA, 13 bp, D. melanogaster
aggacactatcga

SEQ ID NO: 579052 - DNA, 13 bp, D. melanogaster
aggacagccccga

SEQ ID NO: 579053 - DNA, 13 bp, D. melanogaster
aggacaggacagg

SEQ ID NO: 579054 - DNA, 13 bp, D. melanogaster
aggacatcaaggg

SEQ ID NO: 579055 - DNA, 13 bp, D. melanogaster
aggacatcctacc

SEQ ID NO: 579056 - DNA, 13 bp, D. melanogaster
aggacatgcagga

SEQ ID NO: 579057 - DNA, 13 bp, D. melanogaster
aggacattcaaaa

SEQ ID NO: 579058 - DNA, 13 bp, D. melanogaster
aggaccaaaagga

SEQ ID NO: 579059 - DNA, 14 bp, D. melanogaster
aggaccaaaaggac

SEQ ID NO: 579060 - DNA, 13 bp, D. melanogaster
aggaccaaaggac

SEQ ID NO: 579061 - DNA, 13 bp, D. melanogaster
aggaccaacaaga

SEQ ID NO: 579062 - DNA, 13 bp, D. melanogaster
aggaccaggacca

SEQ ID NO: 579063 - DNA, 13 bp, D. melanogaster
aggaccgattgct

SEQ ID NO: 579064 - DNA, 13 bp, D. melanogaster
aggacctcatgtt

SEQ ID NO: 579065 - DNA, 13 bp, D. melanogaster
aggacctcgtcct

SEQ ID NO: 579066 - DNA, 14 bp, D. melanogaster
aggacgaaaaggac

SEQ ID NO: 579067 - DNA, 13 bp, D. melanogaster
aggacgaacagga

SEQ ID NO: 579068 - DNA, 14 bp, D. melanogaster
aggacgaaggacac

SEQ ID NO: 579069 - DNA, 13 bp, D. melanogaster
aggacgaaggacg

SEQ ID NO: 579070 - DNA, 14 bp, D. melanogaster
aggacgaaggacga

SEQ ID NO: 579071 - DNA, 14 bp, D. melanogaster
aggacgaaggacgc

SEQ ID NO: 579072 - DNA, 13 bp, D. melanogaster
aggacgacaagga

SEQ ID NO: 579073 - DNA, 14 bp, D. melanogaster
aggacgacaatttc

SEQ ID NO: 579074 - DNA, 13 bp, D. melanogaster
aggacgacaggac

SEQ ID NO: 579075 - DNA, 14 bp, D. melanogaster
aggacgacaggacg

SEQ ID NO: 579076 - DNA, 13 bp, D. melanogaster
aggacgacgatca

SEQ ID NO: 579077 - DNA, 13 bp, D. melanogaster
aggacgacgatga

SEQ ID NO: 579078 - DNA, 13 bp, D. melanogaster
aggacgagaacga

SEQ ID NO: 579079 - DNA, 13 bp, D. melanogaster
aggacgaggacga

SEQ ID NO: 579080 - DNA, 14 bp, D. melanogaster
aggacgaggacgag

SEQ ID NO: 579081 - DNA, 14 bp, D. melanogaster
aggacgaggatgag

SEQ ID NO: 579082 - DNA, 13 bp, D. melanogaster
aggacgaggtcct

SEQ ID NO: 579083 - DNA, 13 bp, D. melanogaster
aggacgataagtc

SEQ ID NO: 579084 - DNA, 13 bp, D. melanogaster
aggactcgcagga

SEQ ID NO: 579085 - DNA, 13 bp, D. melanogaster
aggactctgaggg

SEQ ID NO: 579086 - DNA, 13 bp, D. melanogaster
aggacttctttgg

SEQ ID NO: 579087 - DNA, 13 bp, D. melanogaster
aggactttgcata

SEQ ID NO: 579088 - DNA, 13 bp, D. melanogaster
aggagaaaatgtt

SEQ ID NO: 579089 - DNA, 13 bp, D. melanogaster
aggagaaccctca

SEQ ID NO: 579090 - DNA, 13 bp, D. melanogaster
aggagaagagttt

SEQ ID NO: 579091 - DNA, 13 bp, D. melanogaster
aggagaagccaga

SEQ ID NO: 579092 - DNA, 13 bp, D. melanogaster
aggagaagcctca

SEQ ID NO: 579093 - DNA, 13 bp, D. melanogaster
aggagaagtacgc

SEQ ID NO: 579094 - DNA, 13 bp, D. melanogaster
aggagaatcagaa

SEQ ID NO: 579095 - DNA, 15 bp, D. melanogaster
aggagagtaaatata

SEQ ID NO: 579096 - DNA, 13 bp, D. melanogaster
aggagataaagta

SEQ ID NO: 579097 - DNA, 13 bp, D. melanogaster
aggagataaagtt

SEQ ID NO: 579098 - DNA, 13 bp, D. melanogaster
aggagatgttgag

SEQ ID NO: 579099 - DNA, 13 bp, D. melanogaster
aggagattcacta

SEQ ID NO: 579100 - DNA, 14 bp, D. melanogaster
aggagcaaaggagc

SEQ ID NO: 579101 - DNA, 13 bp, D. melanogaster
aggagcaaatgtc

SEQ ID NO: 579102 - DNA, 13 bp, D. melanogaster
aggagcaacaaca

SEQ ID NO: 579103 - DNA, 14 bp, D. melanogaster
aggagcaacaacaa

SEQ ID NO: 579104 - DNA, 13 bp, D. melanogaster
aggagcaacatca

SEQ ID NO: 579105 - DNA, 14 bp, D. melanogaster
aggagcagaagcag

SEQ ID NO: 579106 - DNA, 14 bp, D. melanogaster
aggagcagcaacaa

SEQ ID NO: 579107 - DNA, 14 bp, D. melanogaster
aggagcagcagcaa

SEQ ID NO: 579108 - DNA, 14 bp, D. melanogaster
aggagcagcagcag

SEQ ID NO: 579109 - DNA, 13 bp, D. melanogaster
aggagcagcagcc

SEQ ID NO: 579110 - DNA, 13 bp, D. melanogaster
aggagcagcagga

SEQ ID NO: 579111 - DNA, 14 bp, D. melanogaster
aggagcagcaggag

SEQ ID NO: 579112 - DNA, 13 bp, D. melanogaster
aggagcagcggaa

SEQ ID NO: 579113 - DNA, 13 bp, D. melanogaster
aggagcagcggca

SEQ ID NO: 579114 - DNA, 13 bp, D. melanogaster
aggagcagctgga

SEQ ID NO: 579115 - DNA, 13 bp, D. melanogaster
aggagcaggaaca

SEQ ID NO: 579116 - DNA, 13 bp, D. melanogaster
aggagcaggacaa

SEQ ID NO: 579117 - DNA, 13 bp, D. melanogaster
aggagcaggacca

SEQ ID NO: 579118 - DNA, 13 bp, D. melanogaster
aggagcaggagca

SEQ ID NO: 579119 - DNA, 14 bp, D. melanogaster
aggagcaggagcag

SEQ ID NO: 579120 - DNA, 13 bp, D. melanogaster
aggagcaggagct

SEQ ID NO: 579121 - DNA, 13 bp, D. melanogaster
aggagcaggaggc

SEQ ID NO: 579122 - DNA, 13 bp, D. melanogaster
aggagcagggtgt

SEQ ID NO: 579123 - DNA, 14 bp, D. melanogaster
aggagcagggtgtt

SEQ ID NO: 579124 - DNA, 13 bp, D. melanogaster
aggagcagtagca

SEQ ID NO: 579125 - DNA, 13 bp, D. melanogaster
aggagcattccat

SEQ ID NO: 579126 - DNA, 13 bp, D. melanogaster
aggagccaaagga

SEQ ID NO: 579127 - DNA, 13 bp, D. melanogaster
aggagccacaaaa

SEQ ID NO: 579128 - DNA, 13 bp, D. melanogaster
aggagccaggagc

SEQ ID NO: 579129 - DNA, 13 bp, D. melanogaster
aggagccgcagca

SEQ ID NO: 579130 - DNA, 13 bp, D. melanogaster
aggagcgcgctct

SEQ ID NO: 579131 - DNA, 13 bp, D. melanogaster
aggagcggcagga

SEQ ID NO: 579132 - DNA, 13 bp, D. melanogaster
aggagcgttgcgt

SEQ ID NO: 579133 - DNA, 13 bp, D. melanogaster
aggagctgaagga

SEQ ID NO: 579134 - DNA, 13 bp, D. melanogaster
aggagctgaatat

SEQ ID NO: 579135 - DNA, 13 bp, D. melanogaster
aggagctgcaacc

SEQ ID NO: 579136 - DNA, 14 bp, D. melanogaster
aggagctgcaacca

SEQ ID NO: 579137 - DNA, 14 bp, D. melanogaster
aggagctgcaagaa

SEQ ID NO: 579138 - DNA, 13 bp, D. melanogaster
aggagctgcagga

SEQ ID NO: 579139 - DNA, 13 bp, D. melanogaster
aggagctggaaaa

SEQ ID NO: 579140 - DNA, 13 bp, D. melanogaster
aggagctggagca

SEQ ID NO: 579141 - DNA, 14 bp, D. melanogaster
aggagctggagcag

SEQ ID NO: 579142 - DNA, 13 bp, D. melanogaster
aggagctggagct

SEQ ID NO: 579143 - DNA, 14 bp, D. melanogaster
aggagctggagctg

SEQ ID NO: 579144 - DNA, 13 bp, D. melanogaster
aggagctggccaa

SEQ ID NO: 579145 - DNA, 13 bp, D. melanogaster
aggaggaaacttt

SEQ ID NO: 579146 - DNA, 13 bp, D. melanogaster
aggaggaagattt

SEQ ID NO: 579147 - DNA, 13 bp, D. melanogaster
aggaggagagcac

SEQ ID NO: 579148 - DNA, 13 bp, D. melanogaster
aggaggagccccc

SEQ ID NO: 579149 - DNA, 13 bp, D. melanogaster
aggaggagctgga

SEQ ID NO: 579150 - DNA, 13 bp, D. melanogaster
aggaggaggagtt

SEQ ID NO: 579151 - DNA, 14 bp, D. melanogaster
aggaggatatagac

SEQ ID NO: 579152 - DNA, 13 bp, D. melanogaster
aggaggccattca

SEQ ID NO: 579153 - DNA, 13 bp, D. melanogaster
aggaggcgtggca

SEQ ID NO: 579154 - DNA, 13 bp, D. melanogaster
aggaggtcaaaaa

SEQ ID NO: 579155 - DNA, 13 bp, D. melanogaster
aggagtacaccta

SEQ ID NO: 579156 - DNA, 13 bp, D. melanogaster
aggagtacgattt

SEQ ID NO: 579157 - DNA, 14 bp, D. melanogaster
aggagtacgatttc

SEQ ID NO: 579158 - DNA, 13 bp, D. melanogaster
aggagtataaaat

SEQ ID NO: 579159 - DNA, 13 bp, D. melanogaster
aggagttaccacc

SEQ ID NO: 579160 - DNA, 13 bp, D. melanogaster
aggagttttaagc

SEQ ID NO: 579161 - DNA, 13 bp, D. melanogaster
aggatacaggata

SEQ ID NO: 579162 - DNA, 13 bp, D. melanogaster
aggatacgttgct

SEQ ID NO: 579163 - DNA, 14 bp, D. melanogaster
aggatatacatata

SEQ ID NO: 579164 - DNA, 13 bp, D. melanogaster
aggatatatacat

SEQ ID NO: 579165 - DNA, 13 bp, D. melanogaster
aggatatatatat

SEQ ID NO: 579166 - DNA, 14 bp, D. melanogaster
aggatatatatata

SEQ ID NO: 579167 - DNA, 13 bp, D. melanogaster
aggatatatgtat

SEQ ID NO: 579168 - DNA, 13 bp, D. melanogaster
aggatatcgaaag

SEQ ID NO: 579169 - DNA, 13 bp, D. melanogaster
aggatatttcaat

SEQ ID NO: 579170 - DNA, 13 bp, D. melanogaster
aggatcaacaatt

SEQ ID NO: 579171 - DNA, 13 bp, D. melanogaster
aggatcaataacc

SEQ ID NO: 579172 - DNA, 14 bp, D. melanogaster
aggatcatcaaatt

SEQ ID NO: 579173 - DNA, 13 bp, D. melanogaster
aggatctgcagga

SEQ ID NO: 579174 - DNA, 13 bp, D. melanogaster
aggatgaagcgga

SEQ ID NO: 579175 - DNA, 13 bp, D. melanogaster
aggatgacaattc

SEQ ID NO: 579176 - DNA, 13 bp, D. melanogaster
aggatgacgatga

SEQ ID NO: 579177 - DNA, 13 bp, D. melanogaster
aggatgacttggc

SEQ ID NO: 579178 - DNA, 13 bp, D. melanogaster
aggatgaggatgg

SEQ ID NO: 579179 - DNA, 13 bp, D. melanogaster
aggatgatatgga

SEQ ID NO: 579180 - DNA, 13 bp, D. melanogaster
aggatgcaaaagg

SEQ ID NO: 579181 - DNA, 13 bp, D. melanogaster
aggatgcaggaca

SEQ ID NO: 579182 - DNA, 13 bp, D. melanogaster
aggatgcaggacg

SEQ ID NO: 579183 - DNA, 14 bp, D. melanogaster
aggatgccaggatg

SEQ ID NO: 579184 - DNA, 13 bp, D. melanogaster
aggatgccgtgct

SEQ ID NO: 579185 - DNA, 13 bp, D. melanogaster
aggatgcggatgc

SEQ ID NO: 579186 - DNA, 13 bp, D. melanogaster
aggatggacctgc

SEQ ID NO: 579187 - DNA, 13 bp, D. melanogaster
aggatggactgag

SEQ ID NO: 579188 - DNA, 13 bp, D. melanogaster
aggatggatggat

SEQ ID NO: 579189 - DNA, 13 bp, D. melanogaster
aggatggcaggat

SEQ ID NO: 579190 - DNA, 13 bp, D. melanogaster
aggatgggcaaac

SEQ ID NO: 579191 - DNA, 13 bp, D. melanogaster
aggatgtcacctt

SEQ ID NO: 579192 - DNA, 14 bp, D. melanogaster
aggatgtttacaag

SEQ ID NO: 579193 - DNA, 13 bp, D. melanogaster
aggattcactcaa

SEQ ID NO: 579194 - DNA, 13 bp, D. melanogaster
aggattcaggatt

SEQ ID NO: 579195 - DNA, 13 bp, D. melanogaster
aggattgggtcgt

SEQ ID NO: 579196 - DNA, 13 bp, D. melanogaster
aggatttaggaaa

SEQ ID NO: 579197 - DNA, 14 bp, D. melanogaster
aggatttatcaaaa

SEQ ID NO: 579198 - DNA, 13 bp, D. melanogaster
aggattttaaata

SEQ ID NO: 579199 - DNA, 13 bp, D. melanogaster
aggattttcggtc

SEQ ID NO: 579200 - DNA, 13 bp, D. melanogaster
aggattttctgaa

SEQ ID NO: 579201 - DNA, 13 bp, D. melanogaster
aggattttctttt

SEQ ID NO: 579202 - DNA, 13 bp, D. melanogaster
aggcaaaaagcag

SEQ ID NO: 579203 - DNA, 13 bp, D. melanogaster
aggcaaaagcaat

SEQ ID NO: 579204 - DNA, 13 bp, D. melanogaster
aggcaaaagccga

SEQ ID NO: 579205 - DNA, 13 bp, D. melanogaster
aggcaaaaggcaa

SEQ ID NO: 579206 - DNA, 13 bp, D. melanogaster
aggcaaaagtgca

SEQ ID NO: 579207 - DNA, 13 bp, D. melanogaster
aggcaaacaaatc

SEQ ID NO: 579208 - DNA, 13 bp, D. melanogaster
aggcaaacaataa

SEQ ID NO: 579209 - DNA, 14 bp, D. melanogaster
aggcaaacaataaa

SEQ ID NO: 579210 - DNA, 14 bp, D. melanogaster
aggcaaacagaaat

SEQ ID NO: 579211 - DNA, 13 bp, D. melanogaster
aggcaaacataaa

SEQ ID NO: 579212 - DNA, 13 bp, D. melanogaster
aggcaaacatcaa

SEQ ID NO: 579213 - DNA, 13 bp, D. melanogaster
aggcaaacatttt

SEQ ID NO: 579214 - DNA, 13 bp, D. melanogaster
aggcaaacgaaag

SEQ ID NO: 579215 - DNA, 14 bp, D. melanogaster
aggcaaacgtaaaa

SEQ ID NO: 579216 - DNA, 14 bp, D. melanogaster
aggcaaagcagaga

SEQ ID NO: 579217 - DNA, 13 bp, D. melanogaster
aggcaaaggcaaa

SEQ ID NO: 579218 - DNA, 13 bp, D. melanogaster
aggcaaaggcgaa

SEQ ID NO: 579219 - DNA, 13 bp, D. melanogaster
aggcaaaggcttg

SEQ ID NO: 579220 - DNA, 14 bp, D. melanogaster
aggcaaaggcttgg

SEQ ID NO: 579221 - DNA, 13 bp, D. melanogaster
aggcaaatagtga

SEQ ID NO: 579222 - DNA, 13 bp, D. melanogaster
aggcaaatattat

SEQ ID NO: 579223 - DNA, 14 bp, D. melanogaster
aggcaaatcaaatt

SEQ ID NO: 579224 - DNA, 14 bp, D. melanogaster
aggcaaatcccatt

SEQ ID NO: 579225 - DNA, 14 bp, D. melanogaster
aggcaaatctgttg

SEQ ID NO: 579226 - DNA, 13 bp, D. melanogaster
aggcaaatgcaat

SEQ ID NO: 579227 - DNA, 13 bp, D. melanogaster
aggcaaatggcaa

SEQ ID NO: 579228 - DNA, 13 bp, D. melanogaster
aggcaaatgggaa

SEQ ID NO: 579229 - DNA, 13 bp, D. melanogaster
aggcaaattgaat

SEQ ID NO: 579230 - DNA, 13 bp, D. melanogaster
aggcaacaaaatg

SEQ ID NO: 579231 - DNA, 13 bp, D. melanogaster
aggcaacaacaac

SEQ ID NO: 579232 - DNA, 13 bp, D. melanogaster
aggcaacaatgta

SEQ ID NO: 579233 - DNA, 14 bp, D. melanogaster
aggcaacagcaaca

SEQ ID NO: 579234 - DNA, 13 bp, D. melanogaster
aggcaaccgcaaa

SEQ ID NO: 579235 - DNA, 13 bp, D. melanogaster
aggcaacgaactc

SEQ ID NO: 579236 - DNA, 13 bp, D. melanogaster
aggcaacgaactt

SEQ ID NO: 579237 - DNA, 13 bp, D. melanogaster
aggcaacgataaa

SEQ ID NO: 579238 - DNA, 13 bp, D. melanogaster
aggcaacggcaac

SEQ ID NO: 579239 - DNA, 13 bp, D. melanogaster
aggcaacggccag

SEQ ID NO: 579240 - DNA, 13 bp, D. melanogaster
aggcaactgcaat

SEQ ID NO: 579241 - DNA, 13 bp, D. melanogaster
aggcaaggcaagg

SEQ ID NO: 579242 - DNA, 13 bp, D. melanogaster
aggcaataaataa

SEQ ID NO: 579243 - DNA, 13 bp, D. melanogaster
aggcaataagtaa

SEQ ID NO: 579244 - DNA, 13 bp, D. melanogaster
aggcaatattttt

SEQ ID NO: 579245 - DNA, 13 bp, D. melanogaster
aggcaatctaaat

SEQ ID NO: 579246 - DNA, 13 bp, D. melanogaster
aggcaatggcaaa

SEQ ID NO: 579247 - DNA, 13 bp, D. melanogaster
aggcaatggcaat

SEQ ID NO: 579248 - DNA, 13 bp, D. melanogaster
aggcaattgaaac

SEQ ID NO: 579249 - DNA, 13 bp, D. melanogaster
aggcaattgaaat

SEQ ID NO: 579250 - DNA, 13 bp, D. melanogaster
aggcaattgaatt

SEQ ID NO: 579251 - DNA, 13 bp, D. melanogaster
aggcacaaaaaat

SEQ ID NO: 579252 - DNA, 13 bp, D. melanogaster
aggcacaacctcc

SEQ ID NO: 579253 - DNA, 14 bp, D. melanogaster
aggcacacacacac

SEQ ID NO: 579254 - DNA, 13 bp, D. melanogaster
aggcacacacata

SEQ ID NO: 579255 - DNA, 13 bp, D. melanogaster
aggcacacagaca

SEQ ID NO: 579256 - DNA, 13 bp, D. melanogaster
aggcacatacata

SEQ ID NO: 579257 - DNA, 13 bp, D. melanogaster
aggcacccattga

SEQ ID NO: 579258 - DNA, 14 bp, D. melanogaster
aggcacgcacacac

SEQ ID NO: 579259 - DNA, 13 bp, D. melanogaster
aggcactaaagaa

SEQ ID NO: 579260 - DNA, 13 bp, D. melanogaster
aggcactgaaaaa

SEQ ID NO: 579261 - DNA, 14 bp, D. melanogaster
aggcactgagaaaa

SEQ ID NO: 579262 - DNA, 13 bp, D. melanogaster
aggcactgagaga

SEQ ID NO: 579263 - DNA, 13 bp, D. melanogaster
aggcactggaata

SEQ ID NO: 579264 - DNA, 13 bp, D. melanogaster
aggcacttgaaaa

SEQ ID NO: 579265 - DNA, 13 bp, D. melanogaster
aggcactttctga

SEQ ID NO: 579266 - DNA, 13 bp, D. melanogaster
aggcacttttgtt

SEQ ID NO: 579267 - DNA, 13 bp, D. melanogaster
aggcagaaaaagt

SEQ ID NO: 579268 - DNA, 14 bp, D. melanogaster
aggcagaagaaagc

SEQ ID NO: 579269 - DNA, 13 bp, D. melanogaster
aggcagacagaca

SEQ ID NO: 579270 - DNA, 13 bp, D. melanogaster
aggcagacagaga

SEQ ID NO: 579271 - DNA, 13 bp, D. melanogaster
aggcagagaaaat

SEQ ID NO: 579272 - DNA, 13 bp, D. melanogaster
aggcagagcgggc

SEQ ID NO: 579273 - DNA, 14 bp, D. melanogaster
aggcagagcgggct

SEQ ID NO: 579274 - DNA, 13 bp, D. melanogaster
aggcagatgtgaa

SEQ ID NO: 579275 - DNA, 13 bp, D. melanogaster
aggcagcaaaaac

SEQ ID NO: 579276 - DNA, 13 bp, D. melanogaster
aggcagcaacaaa

SEQ ID NO: 579277 - DNA, 14 bp, D. melanogaster
aggcagcaacaaaa

SEQ ID NO: 579278 - DNA, 13 bp, D. melanogaster
aggcagcaacaat

SEQ ID NO: 579279 - DNA, 14 bp, D. melanogaster
aggcagcagcaaca

SEQ ID NO: 579280 - DNA, 13 bp, D. melanogaster
aggcagcagcagc

SEQ ID NO: 579281 - DNA, 15 bp, D. melanogaster
aggcagcagcagcaa

SEQ ID NO: 579282 - DNA, 14 bp, D. melanogaster
aggcagcaggcagc

SEQ ID NO: 579283 - DNA, 13 bp, D. melanogaster
aggcagcagtgga

SEQ ID NO: 579284 - DNA, 13 bp, D. melanogaster
aggcagccaaatt

SEQ ID NO: 579285 - DNA, 13 bp, D. melanogaster
aggcagccaagtg

SEQ ID NO: 579286 - DNA, 13 bp, D. melanogaster
aggcagccacaaa

SEQ ID NO: 579287 - DNA, 13 bp, D. melanogaster
aggcagccagcca

SEQ ID NO: 579288 - DNA, 13 bp, D. melanogaster
aggcagccataaa

SEQ ID NO: 579289 - DNA, 13 bp, D. melanogaster
aggcagccgaaaa

SEQ ID NO: 579290 - DNA, 14 bp, D. melanogaster
aggcagccgaaaaa

SEQ ID NO: 579291 - DNA, 13 bp, D. melanogaster
aggcagcgaaaaa

SEQ ID NO: 579292 - DNA, 13 bp, D. melanogaster
aggcagcgaactt

SEQ ID NO: 579293 - DNA, 13 bp, D. melanogaster
aggcagcgacgcc

SEQ ID NO: 579294 - DNA, 13 bp, D. melanogaster
aggcagcggcagc

SEQ ID NO: 579295 - DNA, 13 bp, D. melanogaster
aggcagctcctgc

SEQ ID NO: 579296 - DNA, 13 bp, D. melanogaster
aggcagcttgcgg

SEQ ID NO: 579297 - DNA, 13 bp, D. melanogaster
aggcaggagaaat

SEQ ID NO: 579298 - DNA, 13 bp, D. melanogaster
aggcaggcaaaca

SEQ ID NO: 579299 - DNA, 13 bp, D. melanogaster
aggcaggcagaca

SEQ ID NO: 579300 - DNA, 13 bp, D. melanogaster
aggcaggcagcaa

SEQ ID NO: 579301 - DNA, 13 bp, D. melanogaster
aggcaggcagcca

SEQ ID NO: 579302 - DNA, 14 bp, D. melanogaster
aggcaggcaggcag

SEQ ID NO: 579303 - DNA, 13 bp, D. melanogaster
aggcagtcagcca

SEQ ID NO: 579304 - DNA, 13 bp, D. melanogaster
aggcagtcagtca

SEQ ID NO: 579305 - DNA, 13 bp, D. melanogaster
aggcagtcattat

SEQ ID NO: 579306 - DNA, 13 bp, D. melanogaster
aggcagtggaaaa

SEQ ID NO: 579307 - DNA, 13 bp, D. melanogaster
aggcatatacata

SEQ ID NO: 579308 - DNA, 13 bp, D. melanogaster
aggcatgcaaatg

SEQ ID NO: 579309 - DNA, 13 bp, D. melanogaster
aggcattaaagtc

SEQ ID NO: 579310 - DNA, 13 bp, D. melanogaster
aggcattacaaaa

SEQ ID NO: 579311 - DNA, 13 bp, D. melanogaster
aggcattcgaaaa

SEQ ID NO: 579312 - DNA, 14 bp, D. melanogaster
aggcattgtgcaaa

SEQ ID NO: 579313 - DNA, 13 bp, D. melanogaster
aggcatttaatta

SEQ ID NO: 579314 - DNA, 13 bp, D. melanogaster
aggcatttgcatt

SEQ ID NO: 579315 - DNA, 13 bp, D. melanogaster
aggcatttgtaca

SEQ ID NO: 579316 - DNA, 13 bp, D. melanogaster
aggcattttatta

SEQ ID NO: 579317 - DNA, 14 bp, D. melanogaster
aggcattttattaa

SEQ ID NO: 579318 - DNA, 13 bp, D. melanogaster
aggcattttggtg

SEQ ID NO: 579319 - DNA, 13 bp, D. melanogaster
aggcatttttcga

SEQ ID NO: 579320 - DNA, 13 bp, D. melanogaster
aggccaaaaagca

SEQ ID NO: 579321 - DNA, 13 bp, D. melanogaster
aggccaaaaccaa

SEQ ID NO: 579322 - DNA, 13 bp, D. melanogaster
aggccaaaagcaa

SEQ ID NO: 579323 - DNA, 13 bp, D. melanogaster
aggccaaaaggaa

SEQ ID NO: 579324 - DNA, 13 bp, D. melanogaster
aggccaaaggcaa

SEQ ID NO: 579325 - DNA, 13 bp, D. melanogaster
aggccaaagttct

SEQ ID NO: 579326 - DNA, 13 bp, D. melanogaster
aggccaaatccca

SEQ ID NO: 579327 - DNA, 13 bp, D. melanogaster
aggccaaatgccc

SEQ ID NO: 579328 - DNA, 13 bp, D. melanogaster
aggccaacagaaa

SEQ ID NO: 579329 - DNA, 13 bp, D. melanogaster
aggccacactggt

SEQ ID NO: 579330 - DNA, 13 bp, D. melanogaster
aggccacatctat

SEQ ID NO: 579331 - DNA, 13 bp, D. melanogaster
aggccaccgaatg

SEQ ID NO: 579332 - DNA, 13 bp, D. melanogaster
aggccacgcccac

SEQ ID NO: 579333 - DNA, 13 bp, D. melanogaster
aggccactatcat

SEQ ID NO: 579334 - DNA, 13 bp, D. melanogaster
aggccagaaacca

SEQ ID NO: 579335 - DNA, 13 bp, D. melanogaster
aggccagctcctt

SEQ ID NO: 579336 - DNA, 13 bp, D. melanogaster
aggccaggccaag

SEQ ID NO: 579337 - DNA, 13 bp, D. melanogaster
aggccaggccaga

SEQ ID NO: 579338 - DNA, 14 bp, D. melanogaster
aggccaggttaaaa

SEQ ID NO: 579339 - DNA, 13 bp, D. melanogaster
aggccagtgcaga

SEQ ID NO: 579340 - DNA, 13 bp, D. melanogaster
aggccataaaaca

SEQ ID NO: 579341 - DNA, 13 bp, D. melanogaster
aggccattcagga

SEQ ID NO: 579342 - DNA, 14 bp, D. melanogaster
aggccatttacttt

SEQ ID NO: 579343 - DNA, 13 bp, D. melanogaster
aggcccattgaaa

SEQ ID NO: 579344 - DNA, 13 bp, D. melanogaster
aggccgagcaaaa

SEQ ID NO: 579345 - DNA, 13 bp, D. melanogaster
aggccgtggccaa

SEQ ID NO: 579346 - DNA, 14 bp, D. melanogaster
aggcctaagtaaat

SEQ ID NO: 579347 - DNA, 13 bp, D. melanogaster
aggcctacgtaaa

SEQ ID NO: 579348 - DNA, 13 bp, D. melanogaster
aggcctcgggtgg

SEQ ID NO: 579349 - DNA, 13 bp, D. melanogaster
aggcctttgaata

SEQ ID NO: 579350 - DNA, 14 bp, D. melanogaster
aggcctttgaatat

SEQ ID NO: 579351 - DNA, 13 bp, D. melanogaster
aggcgaaaacttt

SEQ ID NO: 579352 - DNA, 13 bp, D. melanogaster
aggcgaaataaaa

SEQ ID NO: 579353 - DNA, 13 bp, D. melanogaster
aggcgaacagaaa

SEQ ID NO: 579354 - DNA, 13 bp, D. melanogaster
aggcgaacagccg

SEQ ID NO: 579355 - DNA, 13 bp, D. melanogaster
aggcgaacaggaa

SEQ ID NO: 579356 - DNA, 13 bp, D. melanogaster
aggcgaaggcaaa

SEQ ID NO: 579357 - DNA, 13 bp, D. melanogaster
aggcgaataaaaa

SEQ ID NO: 579358 - DNA, 13 bp, D. melanogaster
aggcgaatcgcct

SEQ ID NO: 579359 - DNA, 13 bp, D. melanogaster
aggcgactacaac

SEQ ID NO: 579360 - DNA, 14 bp, D. melanogaster
aggcgatggcgatg

SEQ ID NO: 579361 - DNA, 13 bp, D. melanogaster
aggcgcagaaata

SEQ ID NO: 579362 - DNA, 13 bp, D. melanogaster
aggcgcagcagca

SEQ ID NO: 579363 - DNA, 13 bp, D. melanogaster
aggcgctaaagga

SEQ ID NO: 579364 - DNA, 13 bp, D. melanogaster
aggcgctcagcaa

SEQ ID NO: 579365 - DNA, 14 bp, D. melanogaster
aggcgctggaaaat

SEQ ID NO: 579366 - DNA, 13 bp, D. melanogaster
aggcggaaaagcg

SEQ ID NO: 579367 - DNA, 13 bp, D. melanogaster
aggcggaggagtt

SEQ ID NO: 579368 - DNA, 15 bp, D. melanogaster
aggcggaggagttac

SEQ ID NO: 579369 - DNA, 13 bp, D. melanogaster
aggcggcgaaaag

SEQ ID NO: 579370 - DNA, 13 bp, D. melanogaster
aggcggcggcagc

SEQ ID NO: 579371 - DNA, 13 bp, D. melanogaster
aggcgtaaaacta

SEQ ID NO: 579372 - DNA, 13 bp, D. melanogaster
aggcgtacaaaaa

SEQ ID NO: 579373 - DNA, 13 bp, D. melanogaster
aggcgtatacgta

SEQ ID NO: 579374 - DNA, 13 bp, D. melanogaster
aggctaaaacgaa

SEQ ID NO: 579375 - DNA, 14 bp, D. melanogaster
aggctaaacaattt

SEQ ID NO: 579376 - DNA, 13 bp, D. melanogaster
aggctaagctaaa

SEQ ID NO: 579377 - DNA, 13 bp, D. melanogaster
aggctatggacgt

SEQ ID NO: 579378 - DNA, 13 bp, D. melanogaster
aggctcgagagat

SEQ ID NO: 579379 - DNA, 13 bp, D. melanogaster
aggctctctcgaa

SEQ ID NO: 579380 - DNA, 13 bp, D. melanogaster
aggctgagcggag

SEQ ID NO: 579381 - DNA, 13 bp, D. melanogaster
aggctgctccttc

SEQ ID NO: 579382 - DNA, 13 bp, D. melanogaster
aggctggagtccc

SEQ ID NO: 579383 - DNA, 13 bp, D. melanogaster
aggctggcaaaaa

SEQ ID NO: 579384 - DNA, 13 bp, D. melanogaster
aggctggcaaggc

SEQ ID NO: 579385 - DNA, 14 bp, D. melanogaster
aggcttaccaatgc

SEQ ID NO: 579386 - DNA, 13 bp, D. melanogaster
aggcttataatgc

SEQ ID NO: 579387 - DNA, 14 bp, D. melanogaster
aggcttataatgcc

SEQ ID NO: 579388 - DNA, 13 bp, D. melanogaster
aggcttatgccca

SEQ ID NO: 579389 - DNA, 13 bp, D. melanogaster
aggcttcactgta

SEQ ID NO: 579390 - DNA, 13 bp, D. melanogaster
aggctttggcgat

SEQ ID NO: 579391 - DNA, 13 bp, D. melanogaster
aggcttttcggat

SEQ ID NO: 579392 - DNA, 13 bp, D. melanogaster
agggaaaaaagtt

SEQ ID NO: 579393 - DNA, 13 bp, D. melanogaster
agggaaaactctg

SEQ ID NO: 579394 - DNA, 13 bp, D. melanogaster
agggaaaactgca

SEQ ID NO: 579395 - DNA, 13 bp, D. melanogaster
agggaaaataaca

SEQ ID NO: 579396 - DNA, 13 bp, D. melanogaster
agggaaaatcaaa

SEQ ID NO: 579397 - DNA, 13 bp, D. melanogaster
agggaaaatcggg

SEQ ID NO: 579398 - DNA, 13 bp, D. melanogaster
agggaaagttttc

SEQ ID NO: 579399 - DNA, 13 bp, D. melanogaster
agggaaataaatt

SEQ ID NO: 579400 - DNA, 13 bp, D. melanogaster
agggaaatgaaat

SEQ ID NO: 579401 - DNA, 13 bp, D. melanogaster
agggaaatgcaaa

SEQ ID NO: 579402 - DNA, 14 bp, D. melanogaster
agggaaatggaaat

SEQ ID NO: 579403 - DNA, 13 bp, D. melanogaster
agggaaattcaaa

SEQ ID NO: 579404 - DNA, 13 bp, D. melanogaster
agggaaatttaat

SEQ ID NO: 579405 - DNA, 13 bp, D. melanogaster
agggaagccatta

SEQ ID NO: 579406 - DNA, 13 bp, D. melanogaster
agggaatatatat

SEQ ID NO: 579407 - DNA, 13 bp, D. melanogaster
agggaatatgtgc

SEQ ID NO: 579408 - DNA, 13 bp, D. melanogaster
agggaattgaaga

SEQ ID NO: 579409 - DNA, 13 bp, D. melanogaster
agggacccaatgg

SEQ ID NO: 579410 - DNA, 13 bp, D. melanogaster
agggagaaatatg

SEQ ID NO: 579411 - DNA, 13 bp, D. melanogaster
agggagtgggaat

SEQ ID NO: 579412 - DNA, 13 bp, D. melanogaster
agggatacagcta

SEQ ID NO: 579413 - DNA, 13 bp, D. melanogaster
agggatgggcatg

SEQ ID NO: 579414 - DNA, 13 bp, D. melanogaster
agggcaaaaataa

SEQ ID NO: 579415 - DNA, 13 bp, D. melanogaster
agggcaaaagttt

SEQ ID NO: 579416 - DNA, 13 bp, D. melanogaster
agggcaacaacaa

SEQ ID NO: 579417 - DNA, 14 bp, D. melanogaster
agggcaaggacaat

SEQ ID NO: 579418 - DNA, 13 bp, D. melanogaster
agggcaataaaaa

SEQ ID NO: 579419 - DNA, 13 bp, D. melanogaster
agggcaataactt

SEQ ID NO: 579420 - DNA, 13 bp, D. melanogaster
agggcaattgtct

SEQ ID NO: 579421 - DNA, 14 bp, D. melanogaster
agggcacaaaacaa

SEQ ID NO: 579422 - DNA, 13 bp, D. melanogaster
agggcagcaaaaa

SEQ ID NO: 579423 - DNA, 13 bp, D. melanogaster
agggcagcttttg

SEQ ID NO: 579424 - DNA, 14 bp, D. melanogaster
agggcagcttttgt

SEQ ID NO: 579425 - DNA, 13 bp, D. melanogaster
agggcataaatca

SEQ ID NO: 579426 - DNA, 13 bp, D. melanogaster
agggcattaaaaa

SEQ ID NO: 579427 - DNA, 13 bp, D. melanogaster
agggcattattta

SEQ ID NO: 579428 - DNA, 13 bp, D. melanogaster
agggcattgaagc

SEQ ID NO: 579429 - DNA, 13 bp, D. melanogaster
agggccaaaacag

SEQ ID NO: 579430 - DNA, 13 bp, D. melanogaster
agggccagatcga

SEQ ID NO: 579431 - DNA, 13 bp, D. melanogaster
agggccagcaaag

SEQ ID NO: 579432 - DNA, 14 bp, D. melanogaster
agggcgatagcggt

SEQ ID NO: 579433 - DNA, 13 bp, D. melanogaster
agggcgctagcga

SEQ ID NO: 579434 - DNA, 13 bp, D. melanogaster
agggcgtggcagt

SEQ ID NO: 579435 - DNA, 13 bp, D. melanogaster
agggcgtggtcgc

SEQ ID NO: 579436 - DNA, 13 bp, D. melanogaster
agggctgttttga

SEQ ID NO: 579437 - DNA, 13 bp, D. melanogaster
aggggaaaacgct

SEQ ID NO: 579438 - DNA, 13 bp, D. melanogaster
aggggacaataag

SEQ ID NO: 579439 - DNA, 13 bp, D. melanogaster
aggggcaacaaca

SEQ ID NO: 579440 - DNA, 14 bp, D. melanogaster
aggggcaacaacaa

SEQ ID NO: 579441 - DNA, 13 bp, D. melanogaster
aggggcacacaga

SEQ ID NO: 579442 - DNA, 13 bp, D. melanogaster
aggggcggtgaag

SEQ ID NO: 579443 - DNA, 13 bp, D. melanogaster
aggggcgtggcag

SEQ ID NO: 579444 - DNA, 13 bp, D. melanogaster
aggggcgtggtcg

SEQ ID NO: 579445 - DNA, 13 bp, D. melanogaster
agggggagtggca

SEQ ID NO: 579446 - DNA, 13 bp, D. melanogaster
agggggcgtggca

SEQ ID NO: 579447 - DNA, 14 bp, D. melanogaster
agggggcgtggcag

SEQ ID NO: 579448 - DNA, 14 bp, D. melanogaster
agggggcgtggccc

SEQ ID NO: 579449 - DNA, 14 bp, D. melanogaster
agggggcgtggccg

SEQ ID NO: 579450 - DNA, 14 bp, D. melanogaster
agggggcgtggcgc

SEQ ID NO: 579451 - DNA, 14 bp, D. melanogaster
agggggcgtggctg

SEQ ID NO: 579452 - DNA, 13 bp, D. melanogaster
agggggcgtggtc

SEQ ID NO: 579453 - DNA, 13 bp, D. melanogaster
agggtataaaaat

SEQ ID NO: 579454 - DNA, 13 bp, D. melanogaster
agggtatctgata

SEQ ID NO: 579455 - DNA, 14 bp, D. melanogaster
agggtatgctagat

SEQ ID NO: 579456 - DNA, 13 bp, D. melanogaster
agggtcaaaaccg

SEQ ID NO: 579457 - DNA, 13 bp, D. melanogaster
agggtcatcattc

SEQ ID NO: 579458 - DNA, 13 bp, D. melanogaster
agggtctgtctgt

SEQ ID NO: 579459 - DNA, 13 bp, D. melanogaster
agggtgatccaga

SEQ ID NO: 579460 - DNA, 14 bp, D. melanogaster
agggtgtcaaaaaa

SEQ ID NO: 579461 - DNA, 13 bp, D. melanogaster
agggtgttgtatt

SEQ ID NO: 579462 - DNA, 13 bp, D. melanogaster
agggttgccaggt

SEQ ID NO: 579463 - DNA, 13 bp, D. melanogaster
agggtttcaaaaa

SEQ ID NO: 579464 - DNA, 13 bp, D. melanogaster
agggttttctact

SEQ ID NO: 579465 - DNA, 13 bp, D. melanogaster
aggtaaacaaaca

SEQ ID NO: 579466 - DNA, 13 bp, D. melanogaster
aggtaaacaattt

SEQ ID NO: 579467 - DNA, 14 bp, D. melanogaster
aggtaaacccaaat

SEQ ID NO: 579468 - DNA, 13 bp, D. melanogaster
aggtaaagctcga

SEQ ID NO: 579469 - DNA, 13 bp, D. melanogaster
aggtaaatggaaa

SEQ ID NO: 579470 - DNA, 14 bp, D. melanogaster
aggtaaggtaaggt

SEQ ID NO: 579471 - DNA, 13 bp, D. melanogaster
aggtaatgattaa

SEQ ID NO: 579472 - DNA, 13 bp, D. melanogaster
aggtaatgcgcta

SEQ ID NO: 579473 - DNA, 13 bp, D. melanogaster
aggtacaaaataa

SEQ ID NO: 579474 - DNA, 13 bp, D. melanogaster
aggtacaagtgcg

SEQ ID NO: 579475 - DNA, 13 bp, D. melanogaster
aggtacaataact

SEQ ID NO: 579476 - DNA, 13 bp, D. melanogaster
aggtacagataca

SEQ ID NO: 579477 - DNA, 13 bp, D. melanogaster
aggtacatatata

SEQ ID NO: 579478 - DNA, 13 bp, D. melanogaster
aggtacatatatg

SEQ ID NO: 579479 - DNA, 13 bp, D. melanogaster
aggtactcttcaa

SEQ ID NO: 579480 - DNA, 13 bp, D. melanogaster
aggtagatagata

SEQ ID NO: 579481 - DNA, 13 bp, D. melanogaster
aggtatatatata

SEQ ID NO: 579482 - DNA, 13 bp, D. melanogaster
aggtatattttta

SEQ ID NO: 579483 - DNA, 13 bp, D. melanogaster
aggtattatattt

SEQ ID NO: 579484 - DNA, 13 bp, D. melanogaster
aggtatttagtca

SEQ ID NO: 579485 - DNA, 13 bp, D. melanogaster
aggtatttgggaa

SEQ ID NO: 579486 - DNA, 13 bp, D. melanogaster
aggtcaagccttg

SEQ ID NO: 579487 - DNA, 13 bp, D. melanogaster
aggtcatattcaa

SEQ ID NO: 579488 - DNA, 13 bp, D. melanogaster
aggtcatccatat

SEQ ID NO: 579489 - DNA, 13 bp, D. melanogaster
aggtcctttcgcc

SEQ ID NO: 579490 - DNA, 13 bp, D. melanogaster
aggtcgagacatg

SEQ ID NO: 579491 - DNA, 13 bp, D. melanogaster
aggtcgagctaaa

SEQ ID NO: 579492 - DNA, 13 bp, D. melanogaster
aggtctggcagct

SEQ ID NO: 579493 - DNA, 13 bp, D. melanogaster
aggtcttcgcctg

SEQ ID NO: 579494 - DNA, 13 bp, D. melanogaster
aggtcttggcgca

SEQ ID NO: 579495 - DNA, 13 bp, D. melanogaster
aggtgaaagtaat

SEQ ID NO: 579496 - DNA, 13 bp, D. melanogaster
aggtgaagggcat

SEQ ID NO: 579497 - DNA, 14 bp, D. melanogaster
aggtgaatcgtatt

SEQ ID NO: 579498 - DNA, 13 bp, D. melanogaster
aggtgaatggcag

SEQ ID NO: 579499 - DNA, 13 bp, D. melanogaster
aggtgatcatctc

SEQ ID NO: 579500 - DNA, 13 bp, D. melanogaster
aggtgcagatatc

SEQ ID NO: 579501 - DNA, 13 bp, D. melanogaster
aggtgcccaaatt

SEQ ID NO: 579502 - DNA, 13 bp, D. melanogaster
aggtggaaaagcc

SEQ ID NO: 579503 - DNA, 14 bp, D. melanogaster
aggtggaaaagcca

SEQ ID NO: 579504 - DNA, 13 bp, D. melanogaster
aggtggaaaataa

SEQ ID NO: 579505 - DNA, 13 bp, D. melanogaster
aggtggaaaatgc

SEQ ID NO: 579506 - DNA, 13 bp, D. melanogaster
aggtggagctgga

SEQ ID NO: 579507 - DNA, 13 bp, D. melanogaster
aggtggaggttac

SEQ ID NO: 579508 - DNA, 13 bp, D. melanogaster
aggtggcaaaaag

SEQ ID NO: 579509 - DNA, 13 bp, D. melanogaster
aggtggcaatcga

SEQ ID NO: 579510 - DNA, 13 bp, D. melanogaster
aggtggcattttt

SEQ ID NO: 579511 - DNA, 13 bp, D. melanogaster
aggtggcgccacc

SEQ ID NO: 579512 - DNA, 13 bp, D. melanogaster
aggtggctgctcc

SEQ ID NO: 579513 - DNA, 13 bp, D. melanogaster
aggtggctgggcc

SEQ ID NO: 579514 - DNA, 14 bp, D. melanogaster
aggtgggcaatcga

SEQ ID NO: 579515 - DNA, 13 bp, D. melanogaster
aggtggtaaccaa

SEQ ID NO: 579516 - DNA, 13 bp, D. melanogaster
aggtggtcttcca

SEQ ID NO: 579517 - DNA, 13 bp, D. melanogaster
aggtggttaatga

SEQ ID NO: 579518 - DNA, 13 bp, D. melanogaster
aggtgtaaaattt

SEQ ID NO: 579519 - DNA, 13 bp, D. melanogaster
aggtgtcattcgg

SEQ ID NO: 579520 - DNA, 13 bp, D. melanogaster
aggtgtgaagaag

SEQ ID NO: 579521 - DNA, 13 bp, D. melanogaster
aggtgtggccatt

SEQ ID NO: 579522 - DNA, 13 bp, D. melanogaster
aggtgtgtgcgtg

SEQ ID NO: 579523 - DNA, 14 bp, D. melanogaster
aggtgtgtgcgtgt

SEQ ID NO: 579524 - DNA, 13 bp, D. melanogaster
aggtgttccccaa

SEQ ID NO: 579525 - DNA, 13 bp, D. melanogaster
aggtgttgaaaat

SEQ ID NO: 579526 - DNA, 14 bp, D. melanogaster
aggttatatttcct

SEQ ID NO: 579527 - DNA, 14 bp, D. melanogaster
aggttcaggttcag

SEQ ID NO: 579528 - DNA, 13 bp, D. melanogaster
aggttctcaagca

SEQ ID NO: 579529 - DNA, 13 bp, D. melanogaster
aggttcttctaca

SEQ ID NO: 579530 - DNA, 13 bp, D. melanogaster
aggttgagaaaat

SEQ ID NO: 579531 - DNA, 13 bp, D. melanogaster
aggttgagattca

SEQ ID NO: 579532 - DNA, 13 bp, D. melanogaster
aggttgagggttc

SEQ ID NO: 579533 - DNA, 13 bp, D. melanogaster
aggttgtctacaa

SEQ ID NO: 579534 - DNA, 13 bp, D. melanogaster
aggttgtgtactt

SEQ ID NO: 579535 - DNA, 14 bp, D. melanogaster
aggtttgagtgtgg

SEQ ID NO: 579536 - DNA, 13 bp, D. melanogaster
aggtttggtttta

SEQ ID NO: 579537 - DNA, 13 bp, D. melanogaster
aggttttaagacg

SEQ ID NO: 579538 - DNA, 13 bp, D. melanogaster
aggttttcatcaa

SEQ ID NO: 579539 - DNA, 13 bp, D. melanogaster
aggttttcatttt

SEQ ID NO: 579540 - DNA, 13 bp, D. melanogaster
aggttttgtaaag

SEQ ID NO: 579541 - DNA, 13 bp, D. melanogaster
aggtttttaaaaa

SEQ ID NO: 579542 - DNA, 13 bp, D. melanogaster
aggtttttaaaat

SEQ ID NO: 579543 - DNA, 13 bp, D. melanogaster
aggtttttaagtt

SEQ ID NO: 579544 - DNA, 14 bp, D. melanogaster
aggtttttaagttt

SEQ ID NO: 579545 - DNA, 13 bp, D. melanogaster
agtaaaaaccaga

SEQ ID NO: 579546 - DNA, 13 bp, D. melanogaster
agtaaaaacttaa

SEQ ID NO: 579547 - DNA, 13 bp, D. melanogaster
agtaaaaactttt

SEQ ID NO: 579548 - DNA, 14 bp, D. melanogaster
agtaaaaatatgtt

SEQ ID NO: 579549 - DNA, 13 bp, D. melanogaster
agtaaaaattgta

SEQ ID NO: 579550 - DNA, 13 bp, D. melanogaster
agtaaaaccaaca

SEQ ID NO: 579551 - DNA, 13 bp, D. melanogaster
agtaaaaccattt

SEQ ID NO: 579552 - DNA, 13 bp, D. melanogaster
agtaaaactgaaa

SEQ ID NO: 579553 - DNA, 13 bp, D. melanogaster
agtaaaactttat

SEQ ID NO: 579554 - DNA, 13 bp, D. melanogaster
agtaaaagcgaaa

SEQ ID NO: 579555 - DNA, 13 bp, D. melanogaster
agtaaaagtaaac

SEQ ID NO: 579556 - DNA, 13 bp, D. melanogaster
agtaaaagtgttt

SEQ ID NO: 579557 - DNA, 13 bp, D. melanogaster
agtaaaatatgtt

SEQ ID NO: 579558 - DNA, 14 bp, D. melanogaster
agtaaaatattgta

SEQ ID NO: 579559 - DNA, 13 bp, D. melanogaster
agtaaaatcaaat

SEQ ID NO: 579560 - DNA, 13 bp, D. melanogaster
agtaaaatgttta

SEQ ID NO: 579561 - DNA, 13 bp, D. melanogaster
agtaaaatgtttt

SEQ ID NO: 579562 - DNA, 13 bp, D. melanogaster
agtaaaattacat

SEQ ID NO: 579563 - DNA, 13 bp, D. melanogaster
agtaaaattgttg

SEQ ID NO: 579564 - DNA, 13 bp, D. melanogaster
agtaaacaaaagc

SEQ ID NO: 579565 - DNA, 13 bp, D. melanogaster
agtaaacaaaatc

SEQ ID NO: 579566 - DNA, 13 bp, D. melanogaster
agtaaacaaatga

SEQ ID NO: 579567 - DNA, 13 bp, D. melanogaster
agtaaacaaattc

SEQ ID NO: 579568 - DNA, 13 bp, D. melanogaster
agtaaacaagcat

SEQ ID NO: 579569 - DNA, 13 bp, D. melanogaster
agtaaacaattaa

SEQ ID NO: 579570 - DNA, 13 bp, D. melanogaster
agtaaacaatttt

SEQ ID NO: 579571 - DNA, 13 bp, D. melanogaster
agtaaacattttt

SEQ ID NO: 579572 - DNA, 13 bp, D. melanogaster
agtaaactatttt

SEQ ID NO: 579573 - DNA, 13 bp, D. melanogaster
agtaaaggatttt

SEQ ID NO: 579574 - DNA, 14 bp, D. melanogaster
agtaaagtaaagta

SEQ ID NO: 579575 - DNA, 13 bp, D. melanogaster
agtaaagtcatac

SEQ ID NO: 579576 - DNA, 13 bp, D. melanogaster
agtaaataaacat

SEQ ID NO: 579577 - DNA, 13 bp, D. melanogaster
agtaaataaattc

SEQ ID NO: 579578 - DNA, 13 bp, D. melanogaster
agtaaataacatt

SEQ ID NO: 579579 - DNA, 13 bp, D. melanogaster
agtaaatagcaaa

SEQ ID NO: 579580 - DNA, 13 bp, D. melanogaster
agtaaatatcttt

SEQ ID NO: 579581 - DNA, 13 bp, D. melanogaster
agtaaatcatttt

SEQ ID NO: 579582 - DNA, 13 bp, D. melanogaster
agtaaatgagtaa

SEQ ID NO: 579583 - DNA, 13 bp, D. melanogaster
agtaaatgcattt

SEQ ID NO: 579584 - DNA, 13 bp, D. melanogaster
agtaaatgttaaa

SEQ ID NO: 579585 - DNA, 13 bp, D. melanogaster
agtaaattcaatt

SEQ ID NO: 579586 - DNA, 14 bp, D. melanogaster
agtaaattcaattt

SEQ ID NO: 579587 - DNA, 13 bp, D. melanogaster
agtaaatttgaaa

SEQ ID NO: 579588 - DNA, 14 bp, D. melanogaster
agtaacaacaacaa

SEQ ID NO: 579589 - DNA, 13 bp, D. melanogaster
agtaacaacaatg

SEQ ID NO: 579590 - DNA, 13 bp, D. melanogaster
agtaacagcaaca

SEQ ID NO: 579591 - DNA, 13 bp, D. melanogaster
agtaacagtaaca

SEQ ID NO: 579592 - DNA, 13 bp, D. melanogaster
agtaaccagtaac

SEQ ID NO: 579593 - DNA, 14 bp, D. melanogaster
agtaacgggtataa

SEQ ID NO: 579594 - DNA, 13 bp, D. melanogaster
agtaactaactaa

SEQ ID NO: 579595 - DNA, 13 bp, D. melanogaster
agtaactataaaa

SEQ ID NO: 579596 - DNA, 13 bp, D. melanogaster
agtaactattcca

SEQ ID NO: 579597 - DNA, 13 bp, D. melanogaster
agtaactggaata

SEQ ID NO: 579598 - DNA, 13 bp, D. melanogaster
agtaactttgaat

SEQ ID NO: 579599 - DNA, 13 bp, D. melanogaster
agtaacttttaga

SEQ ID NO: 579600 - DNA, 13 bp, D. melanogaster
agtaagagctgct

SEQ ID NO: 579601 - DNA, 13 bp, D. melanogaster
agtaagcaaataa

SEQ ID NO: 579602 - DNA, 13 bp, D. melanogaster
agtaaggatcatc

SEQ ID NO: 579603 - DNA, 13 bp, D. melanogaster
agtaagttattta

SEQ ID NO: 579604 - DNA, 13 bp, D. melanogaster
agtaataacaaca

SEQ ID NO: 579605 - DNA, 13 bp, D. melanogaster
agtaataattcaa

SEQ ID NO: 579606 - DNA, 13 bp, D. melanogaster
agtaatacgatct

SEQ ID NO: 579607 - DNA, 13 bp, D. melanogaster
agtaatagtaata

SEQ ID NO: 579608 - DNA, 13 bp, D. melanogaster
agtaatagtagta

SEQ ID NO: 579609 - DNA, 13 bp, D. melanogaster
agtaatatatcaa

SEQ ID NO: 579610 - DNA, 13 bp, D. melanogaster
agtaatcaaaata

SEQ ID NO: 579611 - DNA, 13 bp, D. melanogaster
agtaatcaaaatt

SEQ ID NO: 579612 - DNA, 13 bp, D. melanogaster
agtaatcaaattt

SEQ ID NO: 579613 - DNA, 13 bp, D. melanogaster
agtaatgaaaatg

SEQ ID NO: 579614 - DNA, 13 bp, D. melanogaster
agtaatgagcaga

SEQ ID NO: 579615 - DNA, 13 bp, D. melanogaster
agtaattatgcat

SEQ ID NO: 579616 - DNA, 14 bp, D. melanogaster
agtaattattgaat

SEQ ID NO: 579617 - DNA, 13 bp, D. melanogaster
agtaattccagga

SEQ ID NO: 579618 - DNA, 14 bp, D. melanogaster
agtaattgattata

SEQ ID NO: 579619 - DNA, 13 bp, D. melanogaster
agtaattgcaatt

SEQ ID NO: 579620 - DNA, 13 bp, D. melanogaster
agtaattgcatcg

SEQ ID NO: 579621 - DNA, 13 bp, D. melanogaster
agtaattgttatt

SEQ ID NO: 579622 - DNA, 13 bp, D. melanogaster
agtacaaaacagt

SEQ ID NO: 579623 - DNA, 13 bp, D. melanogaster
agtacaaaatatg

SEQ ID NO: 579624 - DNA, 13 bp, D. melanogaster
agtacaaatacaa

SEQ ID NO: 579625 - DNA, 13 bp, D. melanogaster
agtacaaatgcac

SEQ ID NO: 579626 - DNA, 13 bp, D. melanogaster
agtacaaattaaa

SEQ ID NO: 579627 - DNA, 13 bp, D. melanogaster
agtacaaattgtt

SEQ ID NO: 579628 - DNA, 13 bp, D. melanogaster
agtacaaatttaa

SEQ ID NO: 579629 - DNA, 14 bp, D. melanogaster
agtacaacaaaatt

SEQ ID NO: 579630 - DNA, 14 bp, D. melanogaster
agtacaacaacaac

SEQ ID NO: 579631 - DNA, 13 bp, D. melanogaster
agtacaagtacaa

SEQ ID NO: 579632 - DNA, 13 bp, D. melanogaster
agtacacaaaata

SEQ ID NO: 579633 - DNA, 13 bp, D. melanogaster
agtacactggaaa

SEQ ID NO: 579634 - DNA, 13 bp, D. melanogaster
agtacagaaataa

SEQ ID NO: 579635 - DNA, 13 bp, D. melanogaster
agtacagaaatga

SEQ ID NO: 579636 - DNA, 13 bp, D. melanogaster
agtacaggaaatg

SEQ ID NO: 579637 - DNA, 13 bp, D. melanogaster
agtacagtgttac

SEQ ID NO: 579638 - DNA, 13 bp, D. melanogaster
agtacatacattt

SEQ ID NO: 579639 - DNA, 13 bp, D. melanogaster
agtacatagaggc

SEQ ID NO: 579640 - DNA, 13 bp, D. melanogaster
agtacatatacat

SEQ ID NO: 579641 - DNA, 13 bp, D. melanogaster
agtacatcacttt

SEQ ID NO: 579642 - DNA, 14 bp, D. melanogaster
agtacatcctccag

SEQ ID NO: 579643 - DNA, 13 bp, D. melanogaster
agtacattgaatt

SEQ ID NO: 579644 - DNA, 13 bp, D. melanogaster
agtacattgcaga

SEQ ID NO: 579645 - DNA, 13 bp, D. melanogaster
agtacattttaaa

SEQ ID NO: 579646 - DNA, 13 bp, D. melanogaster
agtaccagtacca

SEQ ID NO: 579647 - DNA, 13 bp, D. melanogaster
agtacccaaaaag

SEQ ID NO: 579648 - DNA, 13 bp, D. melanogaster
agtaccgctccac

SEQ ID NO: 579649 - DNA, 13 bp, D. melanogaster
agtaccgtttatt

SEQ ID NO: 579650 - DNA, 13 bp, D. melanogaster
agtacctcaaatt

SEQ ID NO: 579651 - DNA, 13 bp, D. melanogaster
agtacgagtattt

SEQ ID NO: 579652 - DNA, 13 bp, D. melanogaster
agtacgatttcga

SEQ ID NO: 579653 - DNA, 13 bp, D. melanogaster
agtactactacta

SEQ ID NO: 579654 - DNA, 13 bp, D. melanogaster
agtactataaata

SEQ ID NO: 579655 - DNA, 13 bp, D. melanogaster
agtactcacaatc

SEQ ID NO: 579656 - DNA, 13 bp, D. melanogaster
agtacttcttgga

SEQ ID NO: 579657 - DNA, 13 bp, D. melanogaster
agtactttaaaat

SEQ ID NO: 579658 - DNA, 13 bp, D. melanogaster
agtagaaaaccaa

SEQ ID NO: 579659 - DNA, 13 bp, D. melanogaster
agtagaaaatatt

SEQ ID NO: 579660 - DNA, 13 bp, D. melanogaster
agtagacaaaaat

SEQ ID NO: 579661 - DNA, 13 bp, D. melanogaster
agtagagcaggca

SEQ ID NO: 579662 - DNA, 14 bp, D. melanogaster
agtagcaaaaataa

SEQ ID NO: 579663 - DNA, 14 bp, D. melanogaster
agtagcaacaacaa

SEQ ID NO: 579664 - DNA, 13 bp, D. melanogaster
agtagcaagtagc

SEQ ID NO: 579665 - DNA, 13 bp, D. melanogaster
agtagcagtagca

SEQ ID NO: 579666 - DNA, 13 bp, D. melanogaster
agtagcagttgca

SEQ ID NO: 579667 - DNA, 13 bp, D. melanogaster
agtagcgcaaata

SEQ ID NO: 579668 - DNA, 14 bp, D. melanogaster
agtaggaaaacaaa

SEQ ID NO: 579669 - DNA, 13 bp, D. melanogaster
agtaggcaaccag

SEQ ID NO: 579670 - DNA, 13 bp, D. melanogaster
agtaggcaacgat

SEQ ID NO: 579671 - DNA, 13 bp, D. melanogaster
agtaggcgtggca

SEQ ID NO: 579672 - DNA, 13 bp, D. melanogaster
agtagggaaagtg

SEQ ID NO: 579673 - DNA, 13 bp, D. melanogaster
agtagtagtagta

SEQ ID NO: 579674 - DNA, 14 bp, D. melanogaster
agtagtagtagtaa

SEQ ID NO: 579675 - DNA, 14 bp, D. melanogaster
agtagtagtagtag

SEQ ID NO: 579676 - DNA, 13 bp, D. melanogaster
agtagtagtagtt

SEQ ID NO: 579677 - DNA, 13 bp, D. melanogaster
agtagtagtatag

SEQ ID NO: 579678 - DNA, 13 bp, D. melanogaster
agtagtccagatt

SEQ ID NO: 579679 - DNA, 13 bp, D. melanogaster
agtagttgtagtt

SEQ ID NO: 579680 - DNA, 13 bp, D. melanogaster
agtagtttttgtc

SEQ ID NO: 579681 - DNA, 14 bp, D. melanogaster
agtataaaaacaat

SEQ ID NO: 579682 - DNA, 13 bp, D. melanogaster
agtataaacaaat

SEQ ID NO: 579683 - DNA, 13 bp, D. melanogaster
agtataaagacaa

SEQ ID NO: 579684 - DNA, 13 bp, D. melanogaster
agtataaagtcaa

SEQ ID NO: 579685 - DNA, 14 bp, D. melanogaster
agtataaatctgaa

SEQ ID NO: 579686 - DNA, 13 bp, D. melanogaster
agtataaatgttt

SEQ ID NO: 579687 - DNA, 13 bp, D. melanogaster
agtataagaccac

SEQ ID NO: 579688 - DNA, 13 bp, D. melanogaster
agtataaggacac

SEQ ID NO: 579689 - DNA, 13 bp, D. melanogaster
agtatacaaattt

SEQ ID NO: 579690 - DNA, 13 bp, D. melanogaster
agtatacatatac

SEQ ID NO: 579691 - DNA, 13 bp, D. melanogaster
agtatacccaaaa

SEQ ID NO: 579692 - DNA, 13 bp, D. melanogaster
agtatacgccatg

SEQ ID NO: 579693 - DNA, 13 bp, D. melanogaster
agtatatacaata

SEQ ID NO: 579694 - DNA, 14 bp, D. melanogaster
agtatatacaattt

SEQ ID NO: 579695 - DNA, 13 bp, D. melanogaster
agtatatacatat

SEQ ID NO: 579696 - DNA, 14 bp, D. melanogaster
agtatatacatata

SEQ ID NO: 579697 - DNA, 13 bp, D. melanogaster
agtatatatatgt

SEQ ID NO: 579698 - DNA, 13 bp, D. melanogaster
agtatatatattc

SEQ ID NO: 579699 - DNA, 13 bp, D. melanogaster
agtatatatgtaa

SEQ ID NO: 579700 - DNA, 14 bp, D. melanogaster
agtatatatgtaca

SEQ ID NO: 579701 - DNA, 14 bp, D. melanogaster
agtatatatgtata

SEQ ID NO: 579702 - DNA, 13 bp, D. melanogaster
agtatatattgta

SEQ ID NO: 579703 - DNA, 13 bp, D. melanogaster
agtatatgtacat

SEQ ID NO: 579704 - DNA, 13 bp, D. melanogaster
agtatatgtatat

SEQ ID NO: 579705 - DNA, 13 bp, D. melanogaster
agtatattatgta

SEQ ID NO: 579706 - DNA, 13 bp, D. melanogaster
agtatattgattt

SEQ ID NO: 579707 - DNA, 13 bp, D. melanogaster
agtatcagtatca

SEQ ID NO: 579708 - DNA, 13 bp, D. melanogaster
agtatccaagtat

SEQ ID NO: 579709 - DNA, 13 bp, D. melanogaster
agtatccagtatc

SEQ ID NO: 579710 - DNA, 14 bp, D. melanogaster
agtatcctggctgc

SEQ ID NO: 579711 - DNA, 14 bp, D. melanogaster
agtatcctggtata

SEQ ID NO: 579712 - DNA, 13 bp, D. melanogaster
agtatcctgtagt

SEQ ID NO: 579713 - DNA, 13 bp, D. melanogaster
agtatctaaaggg

SEQ ID NO: 579714 - DNA, 14 bp, D. melanogaster
agtatctagtatct

SEQ ID NO: 579715 - DNA, 13 bp, D. melanogaster
agtatctgaaaga

SEQ ID NO: 579716 - DNA, 13 bp, D. melanogaster
agtatctgatagt

SEQ ID NO: 579717 - DNA, 13 bp, D. melanogaster
agtatctgcgcat

SEQ ID NO: 579718 - DNA, 13 bp, D. melanogaster
agtatctgctaaa

SEQ ID NO: 579719 - DNA, 13 bp, D. melanogaster
agtatctggcaga

SEQ ID NO: 579720 - DNA, 14 bp, D. melanogaster
agtatctgtgtgag

SEQ ID NO: 579721 - DNA, 13 bp, D. melanogaster
agtatctttaaaa

SEQ ID NO: 579722 - DNA, 13 bp, D. melanogaster
agtatgcaaataa

SEQ ID NO: 579723 - DNA, 13 bp, D. melanogaster
agtatgcaacaca

SEQ ID NO: 579724 - DNA, 13 bp, D. melanogaster
agtatgcagtcaa

SEQ ID NO: 579725 - DNA, 14 bp, D. melanogaster
agtatgcagttaca

SEQ ID NO: 579726 - DNA, 13 bp, D. melanogaster
agtatgccaaaaa

SEQ ID NO: 579727 - DNA, 13 bp, D. melanogaster
agtatgcgtgtgt

SEQ ID NO: 579728 - DNA, 13 bp, D. melanogaster
agtatgtaaatat

SEQ ID NO: 579729 - DNA, 13 bp, D. melanogaster
agtatgtaacagt

SEQ ID NO: 579730 - DNA, 13 bp, D. melanogaster
agtatgtatgtat

SEQ ID NO: 579731 - DNA, 13 bp, D. melanogaster
agtatgtgtgtgt

SEQ ID NO: 579732 - DNA, 13 bp, D. melanogaster
agtatgttccatt

SEQ ID NO: 579733 - DNA, 14 bp, D. melanogaster
agtatgttccattg

SEQ ID NO: 579734 - DNA, 13 bp, D. melanogaster
agtatgttcccca

SEQ ID NO: 579735 - DNA, 13 bp, D. melanogaster
agtattaaacaaa

SEQ ID NO: 579736 - DNA, 13 bp, D. melanogaster
agtattaaagtat

SEQ ID NO: 579737 - DNA, 14 bp, D. melanogaster
agtattaagaaacg

SEQ ID NO: 579738 - DNA, 13 bp, D. melanogaster
agtattaagtata

SEQ ID NO: 579739 - DNA, 13 bp, D. melanogaster
agtattcagtatt

SEQ ID NO: 579740 - DNA, 13 bp, D. melanogaster
agtattcagtttt

SEQ ID NO: 579741 - DNA, 13 bp, D. melanogaster
agtattgagtatt

SEQ ID NO: 579742 - DNA, 13 bp, D. melanogaster
agtattgattttc

SEQ ID NO: 579743 - DNA, 13 bp, D. melanogaster
agtattgctttta

SEQ ID NO: 579744 - DNA, 13 bp, D. melanogaster
agtattgtaaatt

SEQ ID NO: 579745 - DNA, 13 bp, D. melanogaster
agtattgtgatgg

SEQ ID NO: 579746 - DNA, 13 bp, D. melanogaster
agtatttaaaaag

SEQ ID NO: 579747 - DNA, 13 bp, D. melanogaster
agtatttaaagta

SEQ ID NO: 579748 - DNA, 13 bp, D. melanogaster
agtatttaacaaa

SEQ ID NO: 579749 - DNA, 13 bp, D. melanogaster
agtatttaagaaa

SEQ ID NO: 579750 - DNA, 13 bp, D. melanogaster
agtatttaagttt

SEQ ID NO: 579751 - DNA, 13 bp, D. melanogaster
agtatttattttc

SEQ ID NO: 579752 - DNA, 13 bp, D. melanogaster
agtatttcaaata

SEQ ID NO: 579753 - DNA, 13 bp, D. melanogaster
agtatttgaaaaa

SEQ ID NO: 579754 - DNA, 13 bp, D. melanogaster
agtatttgagcaa

SEQ ID NO: 579755 - DNA, 13 bp, D. melanogaster
agtatttgcatat

SEQ ID NO: 579756 - DNA, 14 bp, D. melanogaster
agtatttgtatttg

SEQ ID NO: 579757 - DNA, 13 bp, D. melanogaster
agtatttgtttga

SEQ ID NO: 579758 - DNA, 13 bp, D. melanogaster
agtattttagtat

SEQ ID NO: 579759 - DNA, 13 bp, D. melanogaster
agtattttattgc

SEQ ID NO: 579760 - DNA, 13 bp, D. melanogaster
agtattttcctct

SEQ ID NO: 579761 - DNA, 13 bp, D. melanogaster
agtattttgaatt

SEQ ID NO: 579762 - DNA, 13 bp, D. melanogaster
agtattttgacct

SEQ ID NO: 579763 - DNA, 13 bp, D. melanogaster
agtattttgatta

SEQ ID NO: 579764 - DNA, 14 bp, D. melanogaster
agtattttgcatga

SEQ ID NO: 579765 - DNA, 14 bp, D. melanogaster
agtattttgcattt

SEQ ID NO: 579766 - DNA, 13 bp, D. melanogaster
agtatttttacat

SEQ ID NO: 579767 - DNA, 13 bp, D. melanogaster
agtatttttcatt

SEQ ID NO: 579768 - DNA, 13 bp, D. melanogaster
agtatttttgaaa

SEQ ID NO: 579769 - DNA, 14 bp, D. melanogaster
agtatttttggaaa

SEQ ID NO: 579770 - DNA, 13 bp, D. melanogaster
agtattttttcat

SEQ ID NO: 579771 - DNA, 13 bp, D. melanogaster
agtcaaaaatgaa

SEQ ID NO: 579772 - DNA, 13 bp, D. melanogaster
agtcaaaacaaat

SEQ ID NO: 579773 - DNA, 13 bp, D. melanogaster
agtcaaaacaaga

SEQ ID NO: 579774 - DNA, 13 bp, D. melanogaster
agtcaaaagaaga

SEQ ID NO: 579775 - DNA, 13 bp, D. melanogaster
agtcaaaagtcaa

SEQ ID NO: 579776 - DNA, 13 bp, D. melanogaster
agtcaaaataaat

SEQ ID NO: 579777 - DNA, 13 bp, D. melanogaster
agtcaaaatttaa

SEQ ID NO: 579778 - DNA, 13 bp, D. melanogaster
agtcaaacataaa

SEQ ID NO: 579779 - DNA, 13 bp, D. melanogaster
agtcaaagtgaaa

SEQ ID NO: 579780 - DNA, 13 bp, D. melanogaster
agtcaaataaaca

SEQ ID NO: 579781 - DNA, 14 bp, D. melanogaster
agtcaaataaataa

SEQ ID NO: 579782 - DNA, 13 bp, D. melanogaster
agtcaaatattat

SEQ ID NO: 579783 - DNA, 13 bp, D. melanogaster
agtcaaatgattt

SEQ ID NO: 579784 - DNA, 13 bp, D. melanogaster
agtcaaattaaaa

SEQ ID NO: 579785 - DNA, 13 bp, D. melanogaster
agtcaaattgaat

SEQ ID NO: 579786 - DNA, 13 bp, D. melanogaster
agtcaaatttaat

SEQ ID NO: 579787 - DNA, 13 bp, D. melanogaster
agtcaaatttttg

SEQ ID NO: 579788 - DNA, 14 bp, D. melanogaster
agtcaaatttttga

SEQ ID NO: 579789 - DNA, 13 bp, D. melanogaster
agtcaacaaagcg

SEQ ID NO: 579790 - DNA, 13 bp, D. melanogaster
agtcaacaacaaa

SEQ ID NO: 579791 - DNA, 13 bp, D. melanogaster
agtcaaccgcatt

SEQ ID NO: 579792 - DNA, 13 bp, D. melanogaster
agtcaacggaaac

SEQ ID NO: 579793 - DNA, 13 bp, D. melanogaster
agtcaagaattct

SEQ ID NO: 579794 - DNA, 14 bp, D. melanogaster
agtcaagtcaagtc

SEQ ID NO: 579795 - DNA, 13 bp, D. melanogaster
agtcaagtggaaa

SEQ ID NO: 579796 - DNA, 13 bp, D. melanogaster
agtcaagtggaag

SEQ ID NO: 579797 - DNA, 13 bp, D. melanogaster
agtcaagttatga

SEQ ID NO: 579798 - DNA, 14 bp, D. melanogaster
agtcaagttatgat

SEQ ID NO: 579799 - DNA, 13 bp, D. melanogaster
agtcaataattgt

SEQ ID NO: 579800 - DNA, 13 bp, D. melanogaster
agtcaatcaatca

SEQ ID NO: 579801 - DNA, 13 bp, D. melanogaster
agtcaatgaaata

SEQ ID NO: 579802 - DNA, 13 bp, D. melanogaster
agtcaattaaaat

SEQ ID NO: 579803 - DNA, 13 bp, D. melanogaster
agtcaattgaaaa

SEQ ID NO: 579804 - DNA, 13 bp, D. melanogaster
agtcaatttaaaa

SEQ ID NO: 579805 - DNA, 13 bp, D. melanogaster
agtcacagaactt

SEQ ID NO: 579806 - DNA, 13 bp, D. melanogaster
agtcacagtcaca

SEQ ID NO: 579807 - DNA, 14 bp, D. melanogaster
agtcacagtcacag

SEQ ID NO: 579808 - DNA, 14 bp, D. melanogaster
agtcacagtcgcag

SEQ ID NO: 579809 - DNA, 13 bp, D. melanogaster
agtcacataaatt

SEQ ID NO: 579810 - DNA, 13 bp, D. melanogaster
agtcacatttttg

SEQ ID NO: 579811 - DNA, 13 bp, D. melanogaster
agtcaccttaata

SEQ ID NO: 579812 - DNA, 14 bp, D. melanogaster
agtcacttattttt

SEQ ID NO: 579813 - DNA, 13 bp, D. melanogaster
agtcagagagcca

SEQ ID NO: 579814 - DNA, 13 bp, D. melanogaster
agtcagagtatgt

SEQ ID NO: 579815 - DNA, 13 bp, D. melanogaster
agtcagagtcaga

SEQ ID NO: 579816 - DNA, 13 bp, D. melanogaster
agtcagcaaaaaa

SEQ ID NO: 579817 - DNA, 13 bp, D. melanogaster
agtcagcattaaa

SEQ ID NO: 579818 - DNA, 13 bp, D. melanogaster
agtcagccaaaaa

SEQ ID NO: 579819 - DNA, 13 bp, D. melanogaster
agtcagccagcca

SEQ ID NO: 579820 - DNA, 13 bp, D. melanogaster
agtcagccagtca

SEQ ID NO: 579821 - DNA, 13 bp, D. melanogaster
agtcagccattca

SEQ ID NO: 579822 - DNA, 13 bp, D. melanogaster
agtcagtcacttg

SEQ ID NO: 579823 - DNA, 13 bp, D. melanogaster
agtcagtcagcca

SEQ ID NO: 579824 - DNA, 14 bp, D. melanogaster
agtcagtcagccag

SEQ ID NO: 579825 - DNA, 13 bp, D. melanogaster
agtcagtcagtca

SEQ ID NO: 579826 - DNA, 13 bp, D. melanogaster
agtcagtcagtcg

SEQ ID NO: 579827 - DNA, 13 bp, D. melanogaster
agtcagtcagtga

SEQ ID NO: 579828 - DNA, 13 bp, D. melanogaster
agtcagtcagttg

SEQ ID NO: 579829 - DNA, 13 bp, D. melanogaster
agtcagtcggtca

SEQ ID NO: 579830 - DNA, 13 bp, D. melanogaster
agtcagttagtca

SEQ ID NO: 579831 - DNA, 14 bp, D. melanogaster
agtcagttagtcag

SEQ ID NO: 579832 - DNA, 13 bp, D. melanogaster
agtcagttggtca

SEQ ID NO: 579833 - DNA, 14 bp, D. melanogaster
agtcagttttcgat

SEQ ID NO: 579834 - DNA, 13 bp, D. melanogaster
agtcatatttaaa

SEQ ID NO: 579835 - DNA, 13 bp, D. melanogaster
agtcatatttttc

SEQ ID NO: 579836 - DNA, 13 bp, D. melanogaster
agtcatcatcatc

SEQ ID NO: 579837 - DNA, 13 bp, D. melanogaster
agtcatccagtca

SEQ ID NO: 579838 - DNA, 13 bp, D. melanogaster
agtcatccatgtt

SEQ ID NO: 579839 - DNA, 13 bp, D. melanogaster
agtcatcctaaac

SEQ ID NO: 579840 - DNA, 13 bp, D. melanogaster
agtcatcgaagga

SEQ ID NO: 579841 - DNA, 13 bp, D. melanogaster
agtcattaaaagt

SEQ ID NO: 579842 - DNA, 13 bp, D. melanogaster
agtcatttgactt

SEQ ID NO: 579843 - DNA, 13 bp, D. melanogaster
agtcatttgcatg

SEQ ID NO: 579844 - DNA, 13 bp, D. melanogaster
agtccaaaggcaa

SEQ ID NO: 579845 - DNA, 14 bp, D. melanogaster
agtccaaaggcaac

SEQ ID NO: 579846 - DNA, 13 bp, D. melanogaster
agtccaactcaca

SEQ ID NO: 579847 - DNA, 13 bp, D. melanogaster
agtccaagcattt

SEQ ID NO: 579848 - DNA, 15 bp, D. melanogaster
agtccaagcatttgt

SEQ ID NO: 579849 - DNA, 14 bp, D. melanogaster
agtccaagtccaag

SEQ ID NO: 579850 - DNA, 13 bp, D. melanogaster
agtccaagtcgaa

SEQ ID NO: 579851 - DNA, 13 bp, D. melanogaster
agtccaagtctgg

SEQ ID NO: 579852 - DNA, 13 bp, D. melanogaster
agtccacagtttt

SEQ ID NO: 579853 - DNA, 13 bp, D. melanogaster
agtccataaaaat

SEQ ID NO: 579854 - DNA, 13 bp, D. melanogaster
agtccatcaaaga

SEQ ID NO: 579855 - DNA, 13 bp, D. melanogaster
agtccgcagtccg

SEQ ID NO: 579856 - DNA, 13 bp, D. melanogaster
agtccgtagtccg

SEQ ID NO: 579857 - DNA, 14 bp, D. melanogaster
agtccgtatgtgtt

SEQ ID NO: 579858 - DNA, 13 bp, D. melanogaster
agtcctatcttcc

SEQ ID NO: 579859 - DNA, 13 bp, D. melanogaster
agtcctgccagtc

SEQ ID NO: 579860 - DNA, 13 bp, D. melanogaster
agtcctgcccccc

SEQ ID NO: 579861 - DNA, 13 bp, D. melanogaster
agtcctggagtcc

SEQ ID NO: 579862 - DNA, 13 bp, D. melanogaster
agtcctggccaaa

SEQ ID NO: 579863 - DNA, 13 bp, D. melanogaster
agtccttcgtcct

SEQ ID NO: 579864 - DNA, 13 bp, D. melanogaster
agtcgaaaagaaa

SEQ ID NO: 579865 - DNA, 13 bp, D. melanogaster
agtcgaaagtcaa

SEQ ID NO: 579866 - DNA, 13 bp, D. melanogaster
agtcgaaattaaa

SEQ ID NO: 579867 - DNA, 13 bp, D. melanogaster
agtcgaactggcc

SEQ ID NO: 579868 - DNA, 13 bp, D. melanogaster
agtcgaagagaaa

SEQ ID NO: 579869 - DNA, 13 bp, D. melanogaster
agtcgaagtcgaa

SEQ ID NO: 579870 - DNA, 13 bp, D. melanogaster
agtcgaagttgaa

SEQ ID NO: 579871 - DNA, 13 bp, D. melanogaster
agtcgaatcgaat

SEQ ID NO: 579872 - DNA, 13 bp, D. melanogaster
agtcgaattgatt

SEQ ID NO: 579873 - DNA, 13 bp, D. melanogaster
agtcgaggaaatc

SEQ ID NO: 579874 - DNA, 13 bp, D. melanogaster
agtcgaggaactc

SEQ ID NO: 579875 - DNA, 13 bp, D. melanogaster
agtcgagtcgagt

SEQ ID NO: 579876 - DNA, 13 bp, D. melanogaster
agtcgagttcctc

SEQ ID NO: 579877 - DNA, 13 bp, D. melanogaster
agtcgagttgagt

SEQ ID NO: 579878 - DNA, 13 bp, D. melanogaster
agtcgagtttccc

SEQ ID NO: 579879 - DNA, 14 bp, D. melanogaster
agtcgatctagcca

SEQ ID NO: 579880 - DNA, 13 bp, D. melanogaster
agtcgatctgacc

SEQ ID NO: 579881 - DNA, 13 bp, D. melanogaster
agtcgatctggcc

SEQ ID NO: 579882 - DNA, 13 bp, D. melanogaster
agtcgattatcgc

SEQ ID NO: 579883 - DNA, 13 bp, D. melanogaster
agtcgatttggcc

SEQ ID NO: 579884 - DNA, 14 bp, D. melanogaster
agtcgattttggaa

SEQ ID NO: 579885 - DNA, 13 bp, D. melanogaster
agtcgcaaaaaaa

SEQ ID NO: 579886 - DNA, 13 bp, D. melanogaster
agtcgcactgcaa

SEQ ID NO: 579887 - DNA, 13 bp, D. melanogaster
agtcgcagccgtt

SEQ ID NO: 579888 - DNA, 13 bp, D. melanogaster
agtcgcagtattt

SEQ ID NO: 579889 - DNA, 13 bp, D. melanogaster
agtcgcagtcgct

SEQ ID NO: 579890 - DNA, 13 bp, D. melanogaster
agtcgcctgctga

SEQ ID NO: 579891 - DNA, 15 bp, D. melanogaster
agtcgcctgctgcaa

SEQ ID NO: 579892 - DNA, 13 bp, D. melanogaster
agtcgcgatcccc

SEQ ID NO: 579893 - DNA, 13 bp, D. melanogaster
agtcgcggataaa

SEQ ID NO: 579894 - DNA, 13 bp, D. melanogaster
agtcgctgttgaa

SEQ ID NO: 579895 - DNA, 13 bp, D. melanogaster
agtcggaaaagtc

SEQ ID NO: 579896 - DNA, 13 bp, D. melanogaster
agtcggaaacgct

SEQ ID NO: 579897 - DNA, 14 bp, D. melanogaster
agtcggaaacgctt

SEQ ID NO: 579898 - DNA, 13 bp, D. melanogaster
agtcggagtcgga

SEQ ID NO: 579899 - DNA, 14 bp, D. melanogaster
agtcggagtcggag

SEQ ID NO: 579900 - DNA, 13 bp, D. melanogaster
agtcggcaacaga

SEQ ID NO: 579901 - DNA, 13 bp, D. melanogaster
agtcggcgaaatt

SEQ ID NO: 579902 - DNA, 13 bp, D. melanogaster
agtcgggaaactc

SEQ ID NO: 579903 - DNA, 13 bp, D. melanogaster
agtcgggccaaaa

SEQ ID NO: 579904 - DNA, 13 bp, D. melanogaster
agtcggggaagtc

SEQ ID NO: 579905 - DNA, 13 bp, D. melanogaster
agtcgtcgtcgtc

SEQ ID NO: 579906 - DNA, 14 bp, D. melanogaster
agtcgtcgtcgtcg

SEQ ID NO: 579907 - DNA, 13 bp, D. melanogaster
agtcgttcaaggt

SEQ ID NO: 579908 - DNA, 14 bp, D. melanogaster
agtcgttgaaccat

SEQ ID NO: 579909 - DNA, 13 bp, D. melanogaster
agtctaagaactt

SEQ ID NO: 579910 - DNA, 13 bp, D. melanogaster
agtctactgccca

SEQ ID NO: 579911 - DNA, 13 bp, D. melanogaster
agtctactggaat

SEQ ID NO: 579912 - DNA, 14 bp, D. melanogaster
agtctactggaata

SEQ ID NO: 579913 - DNA, 14 bp, D. melanogaster
agtctagatctaga

SEQ ID NO: 579914 - DNA, 13 bp, D. melanogaster
agtctatacggtg

SEQ ID NO: 579915 - DNA, 13 bp, D. melanogaster
agtctatttggta

SEQ ID NO: 579916 - DNA, 13 bp, D. melanogaster
agtctccagatag

SEQ ID NO: 579917 - DNA, 13 bp, D. melanogaster
agtctctctctct

SEQ ID NO: 579918 - DNA, 13 bp, D. melanogaster
agtctgaaatctg

SEQ ID NO: 579919 - DNA, 13 bp, D. melanogaster
agtctgcttttgg

SEQ ID NO: 579920 - DNA, 14 bp, D. melanogaster
agtctggaaagctg

SEQ ID NO: 579921 - DNA, 13 bp, D. melanogaster
agtctggacttta

SEQ ID NO: 579922 - DNA, 14 bp, D. melanogaster
agtctggagttcaa

SEQ ID NO: 579923 - DNA, 13 bp, D. melanogaster
agtctggccaaga

SEQ ID NO: 579924 - DNA, 13 bp, D. melanogaster
agtcttaagctga

SEQ ID NO: 579925 - DNA, 13 bp, D. melanogaster
agtcttaatgttt

SEQ ID NO: 579926 - DNA, 14 bp, D. melanogaster
agtcttcagtcttc

SEQ ID NO: 579927 - DNA, 13 bp, D. melanogaster
agtcttccaaaaa

SEQ ID NO: 579928 - DNA, 13 bp, D. melanogaster
agtctttaggttt

SEQ ID NO: 579929 - DNA, 13 bp, D. melanogaster
agtctttcgcaaa

SEQ ID NO: 579930 - DNA, 13 bp, D. melanogaster
agtctttcgtttc

SEQ ID NO: 579931 - DNA, 13 bp, D. melanogaster
agtctttgttatt

SEQ ID NO: 579932 - DNA, 13 bp, D. melanogaster
agtcttttgttcg

SEQ ID NO: 579933 - DNA, 13 bp, D. melanogaster
agtcttttgtttc

SEQ ID NO: 579934 - DNA, 13 bp, D. melanogaster
agtgaaaaataca

SEQ ID NO: 579935 - DNA, 13 bp, D. melanogaster
agtgaaaaatcaa

SEQ ID NO: 579936 - DNA, 13 bp, D. melanogaster
agtgaaaaatgga

SEQ ID NO: 579937 - DNA, 14 bp, D. melanogaster
agtgaaaaatggac

SEQ ID NO: 579938 - DNA, 13 bp, D. melanogaster
agtgaaaaatgtg

SEQ ID NO: 579939 - DNA, 13 bp, D. melanogaster
agtgaaaaattcg

SEQ ID NO: 579940 - DNA, 13 bp, D. melanogaster
agtgaaaacaaat

SEQ ID NO: 579941 - DNA, 13 bp, D. melanogaster
agtgaaaacaatt

SEQ ID NO: 579942 - DNA, 14 bp, D. melanogaster
agtgaaaacatcca

SEQ ID NO: 579943 - DNA, 13 bp, D. melanogaster
agtgaaaagtgtt

SEQ ID NO: 579944 - DNA, 13 bp, D. melanogaster
agtgaaaagttaa

SEQ ID NO: 579945 - DNA, 13 bp, D. melanogaster
agtgaaaagtttt

SEQ ID NO: 579946 - DNA, 14 bp, D. melanogaster
agtgaaaatctgtt

SEQ ID NO: 579947 - DNA, 13 bp, D. melanogaster
agtgaaaatgcat

SEQ ID NO: 579948 - DNA, 13 bp, D. melanogaster
agtgaaaatgtgt

SEQ ID NO: 579949 - DNA, 13 bp, D. melanogaster
agtgaaaatgttt

SEQ ID NO: 579950 - DNA, 13 bp, D. melanogaster
agtgaaaattgca

SEQ ID NO: 579951 - DNA, 14 bp, D. melanogaster
agtgaaaattttca

SEQ ID NO: 579952 - DNA, 13 bp, D. melanogaster
agtgaaacagtta

SEQ ID NO: 579953 - DNA, 13 bp, D. melanogaster
agtgaaacatttg

SEQ ID NO: 579954 - DNA, 13 bp, D. melanogaster
agtgaaacccaaa

SEQ ID NO: 579955 - DNA, 13 bp, D. melanogaster
agtgaaagagacg

SEQ ID NO: 579956 - DNA, 13 bp, D. melanogaster
agtgaaagcattt

SEQ ID NO: 579957 - DNA, 13 bp, D. melanogaster
agtgaaaggcaag

SEQ ID NO: 579958 - DNA, 13 bp, D. melanogaster
agtgaaaggtaaa

SEQ ID NO: 579959 - DNA, 13 bp, D. melanogaster
agtgaaagtattt

SEQ ID NO: 579960 - DNA, 13 bp, D. melanogaster
agtgaaagtgaaa

SEQ ID NO: 579961 - DNA, 13 bp, D. melanogaster
agtgaaataaatg

SEQ ID NO: 579962 - DNA, 13 bp, D. melanogaster
agtgaaataattt

SEQ ID NO: 579963 - DNA, 13 bp, D. melanogaster
agtgaaatatatt

SEQ ID NO: 579964 - DNA, 13 bp, D. melanogaster
agtgaaatattat

SEQ ID NO: 579965 - DNA, 13 bp, D. melanogaster
agtgaaatgtaaa

SEQ ID NO: 579966 - DNA, 13 bp, D. melanogaster
agtgaaatgtgaa

SEQ ID NO: 579967 - DNA, 13 bp, D. melanogaster
agtgaaatgttgt

SEQ ID NO: 579968 - DNA, 13 bp, D. melanogaster
agtgaaattgaat

SEQ ID NO: 579969 - DNA, 13 bp, D. melanogaster
agtgaacggaagt

SEQ ID NO: 579970 - DNA, 13 bp, D. melanogaster
agtgaacgtgaac

SEQ ID NO: 579971 - DNA, 15 bp, D. melanogaster
agtgaactaagtgaa

SEQ ID NO: 579972 - DNA, 14 bp, D. melanogaster
agtgaagaatttaa

SEQ ID NO: 579973 - DNA, 13 bp, D. melanogaster
agtgaagctcatt

SEQ ID NO: 579974 - DNA, 13 bp, D. melanogaster
agtgaaggaaaat

SEQ ID NO: 579975 - DNA, 13 bp, D. melanogaster
agtgaagtgaaaa

SEQ ID NO: 579976 - DNA, 13 bp, D. melanogaster
agtgaagtgaaga

SEQ ID NO: 579977 - DNA, 13 bp, D. melanogaster
agtgaagtgaagt

SEQ ID NO: 579978 - DNA, 14 bp, D. melanogaster
agtgaagtgaagtg

SEQ ID NO: 579979 - DNA, 14 bp, D. melanogaster
agtgaagtggagtg

SEQ ID NO: 579980 - DNA, 13 bp, D. melanogaster
agtgaataacaaa

SEQ ID NO: 579981 - DNA, 13 bp, D. melanogaster
agtgaatagtgaa

SEQ ID NO: 579982 - DNA, 13 bp, D. melanogaster
agtgaatataaat

SEQ ID NO: 579983 - DNA, 13 bp, D. melanogaster
agtgaatctactt

SEQ ID NO: 579984 - DNA, 14 bp, D. melanogaster
agtgaatctacttg

SEQ ID NO: 579985 - DNA, 13 bp, D. melanogaster
agtgaatggaaat

SEQ ID NO: 579986 - DNA, 13 bp, D. melanogaster
agtgaattccttt

SEQ ID NO: 579987 - DNA, 13 bp, D. melanogaster
agtgaattgaaaa

SEQ ID NO: 579988 - DNA, 13 bp, D. melanogaster
agtgaattgaatt

SEQ ID NO: 579989 - DNA, 13 bp, D. melanogaster
agtgaatttaatt

SEQ ID NO: 579990 - DNA, 13 bp, D. melanogaster
agtgaattttaaa

SEQ ID NO: 579991 - DNA, 13 bp, D. melanogaster
agtgaattttaat

SEQ ID NO: 579992 - DNA, 13 bp, D. melanogaster
agtgacaaattcg

SEQ ID NO: 579993 - DNA, 13 bp, D. melanogaster
agtgacaacaaca

SEQ ID NO: 579994 - DNA, 13 bp, D. melanogaster
agtgacaattgtg

SEQ ID NO: 579995 - DNA, 13 bp, D. melanogaster
agtgacattgcaa

SEQ ID NO: 579996 - DNA, 13 bp, D. melanogaster
agtgaccaccatg

SEQ ID NO: 579997 - DNA, 13 bp, D. melanogaster
agtgaccattaaa

SEQ ID NO: 579998 - DNA, 13 bp, D. melanogaster
agtgacctcactg

SEQ ID NO: 579999 - DNA, 14 bp, D. melanogaster
agtgacgatgacat

SEQ ID NO: 580000 - DNA, 14 bp, D. melanogaster
agtgactaaaaata

SEQ ID NO: 580001 - DNA, 13 bp, D. melanogaster
agtgactgactga

SEQ ID NO: 580002 - DNA, 13 bp, D. melanogaster
agtgacttttgtt

SEQ ID NO: 580003 - DNA, 14 bp, D. melanogaster
agtgacttttgttt

SEQ ID NO: 580004 - DNA, 14 bp, D. melanogaster
agtgagaaaaacac

SEQ ID NO: 580005 - DNA, 14 bp, D. melanogaster
agtgagagcgagag

SEQ ID NO: 580006 - DNA, 13 bp, D. melanogaster
agtgagcgagtga

SEQ ID NO: 580007 - DNA, 13 bp, D. melanogaster
agtgagcgtgata

SEQ ID NO: 580008 - DNA, 13 bp, D. melanogaster
agtgagtaagtga

SEQ ID NO: 580009 - DNA, 13 bp, D. melanogaster
agtgagtgaatga

SEQ ID NO: 580010 - DNA, 14 bp, D. melanogaster
agtgagtgagagag

SEQ ID NO: 580011 - DNA, 13 bp, D. melanogaster
agtgagtgagcga

SEQ ID NO: 580012 - DNA, 13 bp, D. melanogaster
agtgagtggagtg

SEQ ID NO: 580013 - DNA, 13 bp, D. melanogaster
agtgagtgtgtgt

SEQ ID NO: 580014 - DNA, 14 bp, D. melanogaster
agtgagtgtgtgtg

SEQ ID NO: 580015 - DNA, 13 bp, D. melanogaster
agtgagtttgctt

SEQ ID NO: 580016 - DNA, 13 bp, D. melanogaster
agtgagttttctc

SEQ ID NO: 580017 - DNA, 13 bp, D. melanogaster
agtgataacattt

SEQ ID NO: 580018 - DNA, 13 bp, D. melanogaster
agtgatatttaat

SEQ ID NO: 580019 - DNA, 13 bp, D. melanogaster
agtgatcttttga

SEQ ID NO: 580020 - DNA, 13 bp, D. melanogaster
agtgatgaagaaa

SEQ ID NO: 580021 - DNA, 13 bp, D. melanogaster
agtgatgaagatg

SEQ ID NO: 580022 - DNA, 13 bp, D. melanogaster
agtgatgaaggca

SEQ ID NO: 580023 - DNA, 13 bp, D. melanogaster
agtgatggacaac

SEQ ID NO: 580024 - DNA, 13 bp, D. melanogaster
agtgatgttcaaa

SEQ ID NO: 580025 - DNA, 13 bp, D. melanogaster
agtgattctttat

SEQ ID NO: 580026 - DNA, 13 bp, D. melanogaster
agtgattgggaca

SEQ ID NO: 580027 - DNA, 13 bp, D. melanogaster
agtgatttaaaaa

SEQ ID NO: 580028 - DNA, 13 bp, D. melanogaster
agtgatttaaatt

SEQ ID NO: 580029 - DNA, 13 bp, D. melanogaster
agtgatttaattt

SEQ ID NO: 580030 - DNA, 13 bp, D. melanogaster
agtgatttgcata

SEQ ID NO: 580031 - DNA, 13 bp, D. melanogaster
agtgattttcaat

SEQ ID NO: 580032 - DNA, 13 bp, D. melanogaster
agtgcaaaaagca

SEQ ID NO: 580033 - DNA, 13 bp, D. melanogaster
agtgcaaaaagtg

SEQ ID NO: 580034 - DNA, 13 bp, D. melanogaster
agtgcaaaacaaa

SEQ ID NO: 580035 - DNA, 13 bp, D. melanogaster
agtgcaaaacaat

SEQ ID NO: 580036 - DNA, 13 bp, D. melanogaster
agtgcaaaaccaa

SEQ ID NO: 580037 - DNA, 13 bp, D. melanogaster
agtgcaaaagaaa

SEQ ID NO: 580038 - DNA, 14 bp, D. melanogaster
agtgcaaaagattg

SEQ ID NO: 580039 - DNA, 13 bp, D. melanogaster
agtgcaaaagtgc

SEQ ID NO: 580040 - DNA, 14 bp, D. melanogaster
agtgcaaaagtgcc

SEQ ID NO: 580041 - DNA, 13 bp, D. melanogaster
agtgcaaaataat

SEQ ID NO: 580042 - DNA, 13 bp, D. melanogaster
agtgcaaaatcaa

SEQ ID NO: 580043 - DNA, 13 bp, D. melanogaster
agtgcaaaatgaa

SEQ ID NO: 580044 - DNA, 13 bp, D. melanogaster
agtgcaaaatttt

SEQ ID NO: 580045 - DNA, 13 bp, D. melanogaster
agtgcaaagtaaa

SEQ ID NO: 580046 - DNA, 13 bp, D. melanogaster
agtgcaaagtgca

SEQ ID NO: 580047 - DNA, 13 bp, D. melanogaster
agtgcaaataaat

SEQ ID NO: 580048 - DNA, 13 bp, D. melanogaster
agtgcaaataata

SEQ ID NO: 580049 - DNA, 13 bp, D. melanogaster
agtgcaaatattg

SEQ ID NO: 580050 - DNA, 13 bp, D. melanogaster
agtgcaaatattt

SEQ ID NO: 580051 - DNA, 14 bp, D. melanogaster
agtgcaaatattta

SEQ ID NO: 580052 - DNA, 13 bp, D. melanogaster
agtgcaaatcaaa

SEQ ID NO: 580053 - DNA, 13 bp, D. melanogaster
agtgcaaattgaa

SEQ ID NO: 580054 - DNA, 13 bp, D. melanogaster
agtgcaaatttgt

SEQ ID NO: 580055 - DNA, 13 bp, D. melanogaster
agtgcaacacttg

SEQ ID NO: 580056 - DNA, 13 bp, D. melanogaster
agtgcaacatttc

SEQ ID NO: 580057 - DNA, 14 bp, D. melanogaster
agtgcaactgcaac

SEQ ID NO: 580058 - DNA, 13 bp, D. melanogaster
agtgcaagaaaat

SEQ ID NO: 580059 - DNA, 13 bp, D. melanogaster
agtgcaagcgaga

SEQ ID NO: 580060 - DNA, 13 bp, D. melanogaster
agtgcaagtgcag

SEQ ID NO: 580061 - DNA, 13 bp, D. melanogaster
agtgcaagtggaa

SEQ ID NO: 580062 - DNA, 13 bp, D. melanogaster
agtgcaataaata

SEQ ID NO: 580063 - DNA, 13 bp, D. melanogaster
agtgcaataatta

SEQ ID NO: 580064 - DNA, 13 bp, D. melanogaster
agtgcaatcaaat

SEQ ID NO: 580065 - DNA, 13 bp, D. melanogaster
agtgcaatgaaaa

SEQ ID NO: 580066 - DNA, 13 bp, D. melanogaster
agtgcaatgaaat

SEQ ID NO: 580067 - DNA, 13 bp, D. melanogaster
agtgcaatttaat

SEQ ID NO: 580068 - DNA, 13 bp, D. melanogaster
agtgcaatttata

SEQ ID NO: 580069 - DNA, 13 bp, D. melanogaster
agtgcaatttgaa

SEQ ID NO: 580070 - DNA, 13 bp, D. melanogaster
agtgcaatttgca

SEQ ID NO: 580071 - DNA, 13 bp, D. melanogaster
agtgcaatttgtt

SEQ ID NO: 580072 - DNA, 13 bp, D. melanogaster
agtgcaattttct

SEQ ID NO: 580073 - DNA, 13 bp, D. melanogaster
agtgcaattttta

SEQ ID NO: 580074 - DNA, 13 bp, D. melanogaster
agtgcacaaagaa

SEQ ID NO: 580075 - DNA, 13 bp, D. melanogaster
agtgcacaataaa

SEQ ID NO: 580076 - DNA, 13 bp, D. melanogaster
agtgcacaatttt

SEQ ID NO: 580077 - DNA, 13 bp, D. melanogaster
agtgcacacaaaa

SEQ ID NO: 580078 - DNA, 14 bp, D. melanogaster
agtgcacacaaaat

SEQ ID NO: 580079 - DNA, 13 bp, D. melanogaster
agtgcacagaaag

SEQ ID NO: 580080 - DNA, 13 bp, D. melanogaster
agtgcacataaaa

SEQ ID NO: 580081 - DNA, 13 bp, D. melanogaster
agtgcaccgaaaa

SEQ ID NO: 580082 - DNA, 13 bp, D. melanogaster
agtgcacctgcaa

SEQ ID NO: 580083 - DNA, 13 bp, D. melanogaster
agtgcactcaaaa

SEQ ID NO: 580084 - DNA, 13 bp, D. melanogaster
agtgcactcagaa

SEQ ID NO: 580085 - DNA, 13 bp, D. melanogaster
agtgcactgaaag

SEQ ID NO: 580086 - DNA, 14 bp, D. melanogaster
agtgcactgagaga

SEQ ID NO: 580087 - DNA, 13 bp, D. melanogaster
agtgcactgcgag

SEQ ID NO: 580088 - DNA, 13 bp, D. melanogaster
agtgcacttgaaa

SEQ ID NO: 580089 - DNA, 13 bp, D. melanogaster
agtgcacttgcga

SEQ ID NO: 580090 - DNA, 13 bp, D. melanogaster
agtgcacttttca

SEQ ID NO: 580091 - DNA, 13 bp, D. melanogaster
agtgcacttttta

SEQ ID NO: 580092 - DNA, 13 bp, D. melanogaster
agtgcagagtgca

SEQ ID NO: 580093 - DNA, 13 bp, D. melanogaster
agtgcagcaaatt

SEQ ID NO: 580094 - DNA, 13 bp, D. melanogaster
agtgcagcaacaa

SEQ ID NO: 580095 - DNA, 13 bp, D. melanogaster
agtgcagcagcag

SEQ ID NO: 580096 - DNA, 14 bp, D. melanogaster
agtgcagcagcagc

SEQ ID NO: 580097 - DNA, 13 bp, D. melanogaster
agtgcagcagtac

SEQ ID NO: 580098 - DNA, 13 bp, D. melanogaster
agtgcagcgaaaa

SEQ ID NO: 580099 - DNA, 13 bp, D. melanogaster
agtgcagcttgca

SEQ ID NO: 580100 - DNA, 13 bp, D. melanogaster
agtgcagtgcact

SEQ ID NO: 580101 - DNA, 14 bp, D. melanogaster
agtgcagtgcagtg

SEQ ID NO: 580102 - DNA, 13 bp, D. melanogaster
agtgcagtggaaa

SEQ ID NO: 580103 - DNA, 13 bp, D. melanogaster
agtgcagtttgca

SEQ ID NO: 580104 - DNA, 13 bp, D. melanogaster
agtgcagttttta

SEQ ID NO: 580105 - DNA, 13 bp, D. melanogaster
agtgcatacatat

SEQ ID NO: 580106 - DNA, 13 bp, D. melanogaster
agtgcatcgaggg

SEQ ID NO: 580107 - DNA, 13 bp, D. melanogaster
agtgcattcaaat

SEQ ID NO: 580108 - DNA, 13 bp, D. melanogaster
agtgcattgccca

SEQ ID NO: 580109 - DNA, 13 bp, D. melanogaster
agtgcatttaaaa

SEQ ID NO: 580110 - DNA, 13 bp, D. melanogaster
agtgcattttaaa

SEQ ID NO: 580111 - DNA, 13 bp, D. melanogaster
agtgcattttcca

SEQ ID NO: 580112 - DNA, 13 bp, D. melanogaster
agtgcattttgtg

SEQ ID NO: 580113 - DNA, 14 bp, D. melanogaster
agtgcatttttttt

SEQ ID NO: 580114 - DNA, 13 bp, D. melanogaster
agtgccaaaagtt

SEQ ID NO: 580115 - DNA, 13 bp, D. melanogaster
agtgccaaaccaa

SEQ ID NO: 580116 - DNA, 13 bp, D. melanogaster
agtgccaaagtgc

SEQ ID NO: 580117 - DNA, 13 bp, D. melanogaster
agtgccaacacaa

SEQ ID NO: 580118 - DNA, 13 bp, D. melanogaster
agtgccaactgtg

SEQ ID NO: 580119 - DNA, 13 bp, D. melanogaster
agtgccaagtgcc

SEQ ID NO: 580120 - DNA, 13 bp, D. melanogaster
agtgccaattaaa

SEQ ID NO: 580121 - DNA, 13 bp, D. melanogaster
agtgccacataca

SEQ ID NO: 580122 - DNA, 13 bp, D. melanogaster
agtgccacatgaa

SEQ ID NO: 580123 - DNA, 13 bp, D. melanogaster
agtgccacccact

SEQ ID NO: 580124 - DNA, 14 bp, D. melanogaster
agtgccacgcccac

SEQ ID NO: 580125 - DNA, 15 bp, D. melanogaster
agtgccacgcccaca

SEQ ID NO: 580126 - DNA, 13 bp, D. melanogaster
agtgccacgcccc

SEQ ID NO: 580127 - DNA, 14 bp, D. melanogaster
agtgccacgcccct

SEQ ID NO: 580128 - DNA, 13 bp, D. melanogaster
agtgccagtgcca

SEQ ID NO: 580129 - DNA, 13 bp, D. melanogaster
agtgccagtggca

SEQ ID NO: 580130 - DNA, 13 bp, D. melanogaster
agtgccataaaaa

SEQ ID NO: 580131 - DNA, 13 bp, D. melanogaster
agtgcccaaaatg

SEQ ID NO: 580132 - DNA, 14 bp, D. melanogaster
agtgcccaaaatgc

SEQ ID NO: 580133 - DNA, 13 bp, D. melanogaster
agtgccgagaacc

SEQ ID NO: 580134 - DNA, 13 bp, D. melanogaster
agtgccgcaaggc

SEQ ID NO: 580135 - DNA, 13 bp, D. melanogaster
agtgccgcctcgg

SEQ ID NO: 580136 - DNA, 13 bp, D. melanogaster
agtgcctaaatta

SEQ ID NO: 580137 - DNA, 13 bp, D. melanogaster
agtgcctgaaaac

SEQ ID NO: 580138 - DNA, 13 bp, D. melanogaster
agtgccttcataa

SEQ ID NO: 580139 - DNA, 13 bp, D. melanogaster
agtgcctttaatt

SEQ ID NO: 580140 - DNA, 13 bp, D. melanogaster
agtgcgaaaggga

SEQ ID NO: 580141 - DNA, 13 bp, D. melanogaster
agtgcgaacgaga

SEQ ID NO: 580142 - DNA, 14 bp, D. melanogaster
agtgcgacccctaa

SEQ ID NO: 580143 - DNA, 15 bp, D. melanogaster
agtgcgagcgagagg

SEQ ID NO: 580144 - DNA, 13 bp, D. melanogaster
agtgcgagtgagt

SEQ ID NO: 580145 - DNA, 14 bp, D. melanogaster
agtgcgagtgcgag

SEQ ID NO: 580146 - DNA, 14 bp, D. melanogaster
agtgcgagtgtgag

SEQ ID NO: 580147 - DNA, 13 bp, D. melanogaster
agtgcggaaaatg

SEQ ID NO: 580148 - DNA, 13 bp, D. melanogaster
agtgcggcaaaaa

SEQ ID NO: 580149 - DNA, 13 bp, D. melanogaster
agtgcgggaaaat

SEQ ID NO: 580150 - DNA, 13 bp, D. melanogaster
agtgcgtatacgc

SEQ ID NO: 580151 - DNA, 14 bp, D. melanogaster
agtgcgtatgcgta

SEQ ID NO: 580152 - DNA, 13 bp, D. melanogaster
agtgcgtgagtgt

SEQ ID NO: 580153 - DNA, 14 bp, D. melanogaster
agtgcgtgtgtgtg

SEQ ID NO: 580154 - DNA, 13 bp, D. melanogaster
agtgcgtttcgca

SEQ ID NO: 580155 - DNA, 13 bp, D. melanogaster
agtgcgtttgtgt

SEQ ID NO: 580156 - DNA, 14 bp, D. melanogaster
agtgcgtttgtgtg

SEQ ID NO: 580157 - DNA, 13 bp, D. melanogaster
agtgctaaaaaaa

SEQ ID NO: 580158 - DNA, 13 bp, D. melanogaster
agtgctaataaat

SEQ ID NO: 580159 - DNA, 13 bp, D. melanogaster
agtgctaggcgtt

SEQ ID NO: 580160 - DNA, 13 bp, D. melanogaster
agtgctataaaaa

SEQ ID NO: 580161 - DNA, 14 bp, D. melanogaster
agtgctatcgaaaa

SEQ ID NO: 580162 - DNA, 13 bp, D. melanogaster
agtgctatttaaa

SEQ ID NO: 580163 - DNA, 13 bp, D. melanogaster
agtgctatttttg

SEQ ID NO: 580164 - DNA, 14 bp, D. melanogaster
agtgctcaaatttt

SEQ ID NO: 580165 - DNA, 13 bp, D. melanogaster
agtgctcactgta

SEQ ID NO: 580166 - DNA, 14 bp, D. melanogaster
agtgctccagccac

SEQ ID NO: 580167 - DNA, 16 bp, D. melanogaster
agtgctccagccaccg

SEQ ID NO: 580168 - DNA, 13 bp, D. melanogaster
agtgctgcagttg

SEQ ID NO: 580169 - DNA, 13 bp, D. melanogaster
agtgctgccaaaa

SEQ ID NO: 580170 - DNA, 13 bp, D. melanogaster
agtgctgctaaaa

SEQ ID NO: 580171 - DNA, 13 bp, D. melanogaster
agtgctggccaaa

SEQ ID NO: 580172 - DNA, 13 bp, D. melanogaster
agtgctgggcaaa

SEQ ID NO: 580173 - DNA, 13 bp, D. melanogaster
agtgctggtggga

SEQ ID NO: 580174 - DNA, 13 bp, D. melanogaster
agtgctgtattta

SEQ ID NO: 580175 - DNA, 13 bp, D. melanogaster
agtgcttaaattt

SEQ ID NO: 580176 - DNA, 13 bp, D. melanogaster
agtgcttaattaa

SEQ ID NO: 580177 - DNA, 13 bp, D. melanogaster
agtgcttggtgaa

SEQ ID NO: 580178 - DNA, 13 bp, D. melanogaster
agtgctttaaaat

SEQ ID NO: 580179 - DNA, 13 bp, D. melanogaster
agtgctttatttt

SEQ ID NO: 580180 - DNA, 13 bp, D. melanogaster
agtgctttcaatt

SEQ ID NO: 580181 - DNA, 13 bp, D. melanogaster
agtgctttcgctg

SEQ ID NO: 580182 - DNA, 13 bp, D. melanogaster
agtggaaaaaagt

SEQ ID NO: 580183 - DNA, 13 bp, D. melanogaster
agtggaaaaaatg

SEQ ID NO: 580184 - DNA, 13 bp, D. melanogaster
agtggaaaaactg

SEQ ID NO: 580185 - DNA, 13 bp, D. melanogaster
agtggaaaaagtg

SEQ ID NO: 580186 - DNA, 13 bp, D. melanogaster
agtggaaaacaat

SEQ ID NO: 580187 - DNA, 13 bp, D. melanogaster
agtggaaaactca

SEQ ID NO: 580188 - DNA, 13 bp, D. melanogaster
agtggaaaagcgg

SEQ ID NO: 580189 - DNA, 14 bp, D. melanogaster
agtggaaaagtgaa

SEQ ID NO: 580190 - DNA, 13 bp, D. melanogaster
agtggaaaagtgg

SEQ ID NO: 580191 - DNA, 14 bp, D. melanogaster
agtggaaaataagt

SEQ ID NO: 580192 - DNA, 14 bp, D. melanogaster
agtggaaaatattt

SEQ ID NO: 580193 - DNA, 13 bp, D. melanogaster
agtggaaaatcga

SEQ ID NO: 580194 - DNA, 13 bp, D. melanogaster
agtggaaaatgag

SEQ ID NO: 580195 - DNA, 13 bp, D. melanogaster
agtggaaaatgga

SEQ ID NO: 580196 - DNA, 13 bp, D. melanogaster
agtggaaaatgta

SEQ ID NO: 580197 - DNA, 13 bp, D. melanogaster
agtggaaaatgtg

SEQ ID NO: 580198 - DNA, 14 bp, D. melanogaster
agtggaaaattgaa

SEQ ID NO: 580199 - DNA, 13 bp, D. melanogaster
agtggaaaattgc

SEQ ID NO: 580200 - DNA, 13 bp, D. melanogaster
agtggaaaccgca

SEQ ID NO: 580201 - DNA, 13 bp, D. melanogaster
agtggaaacgaaa

SEQ ID NO: 580202 - DNA, 13 bp, D. melanogaster
agtggaaagcgaa

SEQ ID NO: 580203 - DNA, 13 bp, D. melanogaster
agtggaaataaat

SEQ ID NO: 580204 - DNA, 13 bp, D. melanogaster
agtggaaatgaaa

SEQ ID NO: 580205 - DNA, 13 bp, D. melanogaster
agtggaaatgcaa

SEQ ID NO: 580206 - DNA, 14 bp, D. melanogaster
agtggaaatgcaaa

SEQ ID NO: 580207 - DNA, 13 bp, D. melanogaster
agtggaaatgcca

SEQ ID NO: 580208 - DNA, 13 bp, D. melanogaster
agtggaaatggga

SEQ ID NO: 580209 - DNA, 13 bp, D. melanogaster
agtggaaattaat

SEQ ID NO: 580210 - DNA, 13 bp, D. melanogaster
agtggaaattgaa

SEQ ID NO: 580211 - DNA, 13 bp, D. melanogaster
agtggaaattgtt

SEQ ID NO: 580212 - DNA, 13 bp, D. melanogaster
agtggaaatttgt

SEQ ID NO: 580213 - DNA, 13 bp, D. melanogaster
agtggaacaaaaa

SEQ ID NO: 580214 - DNA, 13 bp, D. melanogaster
agtggaagtgaaa

SEQ ID NO: 580215 - DNA, 14 bp, D. melanogaster
agtggaagtgaaat

SEQ ID NO: 580216 - DNA, 13 bp, D. melanogaster
agtggaagtgcga

SEQ ID NO: 580217 - DNA, 14 bp, D. melanogaster
agtggaagtggaaa

SEQ ID NO: 580218 - DNA, 13 bp, D. melanogaster
agtggaagtggca

SEQ ID NO: 580219 - DNA, 14 bp, D. melanogaster
agtggaagtggcag

SEQ ID NO: 580220 - DNA, 13 bp, D. melanogaster
agtggaatggaaa

SEQ ID NO: 580221 - DNA, 14 bp, D. melanogaster
agtggaatggaatg

SEQ ID NO: 580222 - DNA, 13 bp, D. melanogaster
agtggaattttaa

SEQ ID NO: 580223 - DNA, 13 bp, D. melanogaster
agtggaatttttt

SEQ ID NO: 580224 - DNA, 13 bp, D. melanogaster
agtggacagatga

SEQ ID NO: 580225 - DNA, 13 bp, D. melanogaster
agtggaccaattg

SEQ ID NO: 580226 - DNA, 14 bp, D. melanogaster
agtggacgtggcaa

SEQ ID NO: 580227 - DNA, 14 bp, D. melanogaster
agtggagagcgagc

SEQ ID NO: 580228 - DNA, 13 bp, D. melanogaster
agtggagcagaaa

SEQ ID NO: 580229 - DNA, 13 bp, D. melanogaster
agtggaggttcct

SEQ ID NO: 580230 - DNA, 13 bp, D. melanogaster
agtggagtatctt

SEQ ID NO: 580231 - DNA, 13 bp, D. melanogaster
agtggagtcgagt

SEQ ID NO: 580232 - DNA, 13 bp, D. melanogaster
agtggagtgccga

SEQ ID NO: 580233 - DNA, 13 bp, D. melanogaster
agtggagtggaag

SEQ ID NO: 580234 - DNA, 14 bp, D. melanogaster
agtggagtggaatg

SEQ ID NO: 580235 - DNA, 13 bp, D. melanogaster
agtggagtggaga

SEQ ID NO: 580236 - DNA, 13 bp, D. melanogaster
agtggagtggagt

SEQ ID NO: 580237 - DNA, 14 bp, D. melanogaster
agtggagtggagtg

SEQ ID NO: 580238 - DNA, 13 bp, D. melanogaster
agtggataggaaa

SEQ ID NO: 580239 - DNA, 13 bp, D. melanogaster
agtggatcactca

SEQ ID NO: 580240 - DNA, 13 bp, D. melanogaster
agtggattctaac

SEQ ID NO: 580241 - DNA, 13 bp, D. melanogaster
agtggattgcgca

SEQ ID NO: 580242 - DNA, 14 bp, D. melanogaster
agtggcaaaaacaa

SEQ ID NO: 580243 - DNA, 13 bp, D. melanogaster
agtggcaaaaatt

SEQ ID NO: 580244 - DNA, 13 bp, D. melanogaster
agtggcaaaatag

SEQ ID NO: 580245 - DNA, 13 bp, D. melanogaster
agtggcaaacaaa

SEQ ID NO: 580246 - DNA, 13 bp, D. melanogaster
agtggcaaacttt

SEQ ID NO: 580247 - DNA, 13 bp, D. melanogaster
agtggcaaagtgg

SEQ ID NO: 580248 - DNA, 13 bp, D. melanogaster
agtggcaagtgca

SEQ ID NO: 580249 - DNA, 13 bp, D. melanogaster
agtggcaatggca

SEQ ID NO: 580250 - DNA, 14 bp, D. melanogaster
agtggcacaataaa

SEQ ID NO: 580251 - DNA, 13 bp, D. melanogaster
agtggcacacaca

SEQ ID NO: 580252 - DNA, 13 bp, D. melanogaster
agtggcactggca

SEQ ID NO: 580253 - DNA, 13 bp, D. melanogaster
agtggcagcagca

SEQ ID NO: 580254 - DNA, 13 bp, D. melanogaster
agtggcagccaaa

SEQ ID NO: 580255 - DNA, 13 bp, D. melanogaster
agtggcagccact

SEQ ID NO: 580256 - DNA, 13 bp, D. melanogaster
agtggcagccagg

SEQ ID NO: 580257 - DNA, 13 bp, D. melanogaster
agtggcaggaaaa

SEQ ID NO: 580258 - DNA, 13 bp, D. melanogaster
agtggcagggaaa

SEQ ID NO: 580259 - DNA, 13 bp, D. melanogaster
agtggcagtggaa

SEQ ID NO: 580260 - DNA, 14 bp, D. melanogaster
agtggcagtggcag

SEQ ID NO: 580261 - DNA, 13 bp, D. melanogaster
agtggcattggca

SEQ ID NO: 580262 - DNA, 13 bp, D. melanogaster
agtggcatttaat

SEQ ID NO: 580263 - DNA, 13 bp, D. melanogaster
agtggccaaaagg

SEQ ID NO: 580264 - DNA, 13 bp, D. melanogaster
agtggccaaaatg

SEQ ID NO: 580265 - DNA, 13 bp, D. melanogaster
agtggccaagcaa

SEQ ID NO: 580266 - DNA, 13 bp, D. melanogaster
agtggccaagtgg

SEQ ID NO: 580267 - DNA, 13 bp, D. melanogaster
agtggccagcaaa

SEQ ID NO: 580268 - DNA, 13 bp, D. melanogaster
agtggccataaaa

SEQ ID NO: 580269 - DNA, 13 bp, D. melanogaster
agtggcccaaaag

SEQ ID NO: 580270 - DNA, 13 bp, D. melanogaster
agtggcgagtcga

SEQ ID NO: 580271 - DNA, 13 bp, D. melanogaster
agtggcgagtggc

SEQ ID NO: 580272 - DNA, 13 bp, D. melanogaster
agtggctaaagta

SEQ ID NO: 580273 - DNA, 13 bp, D. melanogaster
agtggctatgata

SEQ ID NO: 580274 - DNA, 13 bp, D. melanogaster
agtggctcagtgg

SEQ ID NO: 580275 - DNA, 13 bp, D. melanogaster
agtggctctcaaa

SEQ ID NO: 580276 - DNA, 14 bp, D. melanogaster
agtggctctcaaag

SEQ ID NO: 580277 - DNA, 13 bp, D. melanogaster
agtggctgagatc

SEQ ID NO: 580278 - DNA, 13 bp, D. melanogaster
agtggctgccaca

SEQ ID NO: 580279 - DNA, 13 bp, D. melanogaster
agtggctgcccca

SEQ ID NO: 580280 - DNA, 13 bp, D. melanogaster
agtggctgcggaa

SEQ ID NO: 580281 - DNA, 13 bp, D. melanogaster
agtggctgctgtt

SEQ ID NO: 580282 - DNA, 13 bp, D. melanogaster
agtggctggcaaa

SEQ ID NO: 580283 - DNA, 13 bp, D. melanogaster
agtggctggctgg

SEQ ID NO: 580284 - DNA, 13 bp, D. melanogaster
agtggctgtcaaa

SEQ ID NO: 580285 - DNA, 13 bp, D. melanogaster
agtggcttcataa

SEQ ID NO: 580286 - DNA, 13 bp, D. melanogaster
agtggcttgttcg

SEQ ID NO: 580287 - DNA, 13 bp, D. melanogaster
agtgggaaaaatg

SEQ ID NO: 580288 - DNA, 13 bp, D. melanogaster
agtgggaaaatgt

SEQ ID NO: 580289 - DNA, 13 bp, D. melanogaster
agtgggaaaatta

SEQ ID NO: 580290 - DNA, 13 bp, D. melanogaster
agtgggaatggga

SEQ ID NO: 580291 - DNA, 13 bp, D. melanogaster
agtgggagtgcga

SEQ ID NO: 580292 - DNA, 13 bp, D. melanogaster
agtgggagtggaa

SEQ ID NO: 580293 - DNA, 13 bp, D. melanogaster
agtgggagtggca

SEQ ID NO: 580294 - DNA, 14 bp, D. melanogaster
agtgggagtggcaa

SEQ ID NO: 580295 - DNA, 14 bp, D. melanogaster
agtgggagtggcag

SEQ ID NO: 580296 - DNA, 13 bp, D. melanogaster
agtgggcaaaaag

SEQ ID NO: 580297 - DNA, 13 bp, D. melanogaster
agtgggcaagtgg

SEQ ID NO: 580298 - DNA, 13 bp, D. melanogaster
agtgggcagtggg

SEQ ID NO: 580299 - DNA, 13 bp, D. melanogaster
agtgggccaaatg

SEQ ID NO: 580300 - DNA, 13 bp, D. melanogaster
agtgggccacaaa

SEQ ID NO: 580301 - DNA, 13 bp, D. melanogaster
agtgggcgaaaaa

SEQ ID NO: 580302 - DNA, 13 bp, D. melanogaster
agtgggcggaaag

SEQ ID NO: 580303 - DNA, 13 bp, D. melanogaster
agtgggcggaatg

SEQ ID NO: 580304 - DNA, 13 bp, D. melanogaster
agtgggcggggca

SEQ ID NO: 580305 - DNA, 13 bp, D. melanogaster
agtgggcggttgg

SEQ ID NO: 580306 - DNA, 13 bp, D. melanogaster
agtgggcgtggaa

SEQ ID NO: 580307 - DNA, 13 bp, D. melanogaster
agtgggcgtggca

SEQ ID NO: 580308 - DNA, 14 bp, D. melanogaster
agtgggcgtggcat

SEQ ID NO: 580309 - DNA, 13 bp, D. melanogaster
agtgggcgtggcc

SEQ ID NO: 580310 - DNA, 14 bp, D. melanogaster
agtgggcgtggcca

SEQ ID NO: 580311 - DNA, 14 bp, D. melanogaster
agtgggcgtggccg

SEQ ID NO: 580312 - DNA, 13 bp, D. melanogaster
agtgggcgtggcg

SEQ ID NO: 580313 - DNA, 13 bp, D. melanogaster
agtgggcgtgggt

SEQ ID NO: 580314 - DNA, 13 bp, D. melanogaster
agtgggcgtggtc

SEQ ID NO: 580315 - DNA, 13 bp, D. melanogaster
agtgggcgtggtg

SEQ ID NO: 580316 - DNA, 13 bp, D. melanogaster
agtgggcgtggtt

SEQ ID NO: 580317 - DNA, 13 bp, D. melanogaster
agtggggaaaatg

SEQ ID NO: 580318 - DNA, 13 bp, D. melanogaster
agtggggactcca

SEQ ID NO: 580319 - DNA, 13 bp, D. melanogaster
agtggggagagat

SEQ ID NO: 580320 - DNA, 13 bp, D. melanogaster
agtgggggaaaat

SEQ ID NO: 580321 - DNA, 13 bp, D. melanogaster
agtggggtcagtt

SEQ ID NO: 580322 - DNA, 13 bp, D. melanogaster
agtgggtaaaaaa

SEQ ID NO: 580323 - DNA, 13 bp, D. melanogaster
agtgggtcaaaaa

SEQ ID NO: 580324 - DNA, 13 bp, D. melanogaster
agtgggtggaatg

SEQ ID NO: 580325 - DNA, 13 bp, D. melanogaster
agtgggtggcaaa

SEQ ID NO: 580326 - DNA, 13 bp, D. melanogaster
agtgggtggcaat

SEQ ID NO: 580327 - DNA, 13 bp, D. melanogaster
agtgggtggcagg

SEQ ID NO: 580328 - DNA, 13 bp, D. melanogaster
agtgggtggcatt

SEQ ID NO: 580329 - DNA, 13 bp, D. melanogaster
agtgggtggctgg

SEQ ID NO: 580330 - DNA, 14 bp, D. melanogaster
agtgggtggctggg

SEQ ID NO: 580331 - DNA, 13 bp, D. melanogaster
agtgggtggcttt

SEQ ID NO: 580332 - DNA, 13 bp, D. melanogaster
agtgggtgggaaa

SEQ ID NO: 580333 - DNA, 13 bp, D. melanogaster
agtgggtgggctt

SEQ ID NO: 580334 - DNA, 13 bp, D. melanogaster
agtgggtggtgca

SEQ ID NO: 580335 - DNA, 13 bp, D. melanogaster
agtgggtgtggca

SEQ ID NO: 580336 - DNA, 14 bp, D. melanogaster
agtgggtgtggcaa

SEQ ID NO: 580337 - DNA, 13 bp, D. melanogaster
agtgggttgatcg

SEQ ID NO: 580338 - DNA, 13 bp, D. melanogaster
agtggtagtggta

SEQ ID NO: 580339 - DNA, 14 bp, D. melanogaster
agtggtagtggtag

SEQ ID NO: 580340 - DNA, 13 bp, D. melanogaster
agtggtcaaagta

SEQ ID NO: 580341 - DNA, 13 bp, D. melanogaster
agtggtctagctc

SEQ ID NO: 580342 - DNA, 13 bp, D. melanogaster
agtggtctggagg

SEQ ID NO: 580343 - DNA, 13 bp, D. melanogaster
agtggtcttttaa

SEQ ID NO: 580344 - DNA, 13 bp, D. melanogaster
agtggtgcggtgg

SEQ ID NO: 580345 - DNA, 13 bp, D. melanogaster
agtggtggaaaat

SEQ ID NO: 580346 - DNA, 13 bp, D. melanogaster
agtggtggcaacg

SEQ ID NO: 580347 - DNA, 13 bp, D. melanogaster
agtggttcggtgg

SEQ ID NO: 580348 - DNA, 13 bp, D. melanogaster
agtggttggggct

SEQ ID NO: 580349 - DNA, 13 bp, D. melanogaster
agtggtttctttg

SEQ ID NO: 580350 - DNA, 13 bp, D. melanogaster
agtgtaaacattt

SEQ ID NO: 580351 - DNA, 13 bp, D. melanogaster
agtgtaaataatt

SEQ ID NO: 580352 - DNA, 13 bp, D. melanogaster
agtgtaaatatat

SEQ ID NO: 580353 - DNA, 13 bp, D. melanogaster
agtgtaatagata

SEQ ID NO: 580354 - DNA, 13 bp, D. melanogaster
agtgtaatattgt

SEQ ID NO: 580355 - DNA, 13 bp, D. melanogaster
agtgtacatatgt

SEQ ID NO: 580356 - DNA, 13 bp, D. melanogaster
agtgtacattcca

SEQ ID NO: 580357 - DNA, 13 bp, D. melanogaster
agtgtaccaatta

SEQ ID NO: 580358 - DNA, 13 bp, D. melanogaster
agtgtataaataa

SEQ ID NO: 580359 - DNA, 13 bp, D. melanogaster
agtgtataaatat

SEQ ID NO: 580360 - DNA, 13 bp, D. melanogaster
agtgtataattta

SEQ ID NO: 580361 - DNA, 14 bp, D. melanogaster
agtgtatatatata

SEQ ID NO: 580362 - DNA, 14 bp, D. melanogaster
agtgtatatatgat

SEQ ID NO: 580363 - DNA, 14 bp, D. melanogaster
agtgtatctgtatc

SEQ ID NO: 580364 - DNA, 14 bp, D. melanogaster
agtgtatctgtgtg

SEQ ID NO: 580365 - DNA, 13 bp, D. melanogaster
agtgtatgagtgt

SEQ ID NO: 580366 - DNA, 13 bp, D. melanogaster
agtgtatggaaaa

SEQ ID NO: 580367 - DNA, 13 bp, D. melanogaster
agtgtatgtattt

SEQ ID NO: 580368 - DNA, 13 bp, D. melanogaster
agtgtatgtgtat

SEQ ID NO: 580369 - DNA, 13 bp, D. melanogaster
agtgtatgtgtgc

SEQ ID NO: 580370 - DNA, 13 bp, D. melanogaster
agtgtatgtgtgt

SEQ ID NO: 580371 - DNA, 14 bp, D. melanogaster
agtgtatgtgtgtg

SEQ ID NO: 580372 - DNA, 13 bp, D. melanogaster
agtgtattaattt

SEQ ID NO: 580373 - DNA, 13 bp, D. melanogaster
agtgtattcaaat

SEQ ID NO: 580374 - DNA, 14 bp, D. melanogaster
agtgtattcatttg

SEQ ID NO: 580375 - DNA, 13 bp, D. melanogaster
agtgtatttgtgt

SEQ ID NO: 580376 - DNA, 13 bp, D. melanogaster
agtgtcaattgtc

SEQ ID NO: 580377 - DNA, 13 bp, D. melanogaster
agtgtcaatttga

SEQ ID NO: 580378 - DNA, 13 bp, D. melanogaster
agtgtcagaaaat

SEQ ID NO: 580379 - DNA, 14 bp, D. melanogaster
agtgtccagtgtcc

SEQ ID NO: 580380 - DNA, 13 bp, D. melanogaster
agtgtcgaacgga

SEQ ID NO: 580381 - DNA, 13 bp, D. melanogaster
agtgtctgaactt

SEQ ID NO: 580382 - DNA, 13 bp, D. melanogaster
agtgtctggttgt

SEQ ID NO: 580383 - DNA, 13 bp, D. melanogaster
agtgtctggtttt

SEQ ID NO: 580384 - DNA, 13 bp, D. melanogaster
agtgtcttgtaat

SEQ ID NO: 580385 - DNA, 13 bp, D. melanogaster
agtgtctttgatt

SEQ ID NO: 580386 - DNA, 13 bp, D. melanogaster
agtgtgaaaatgc

SEQ ID NO: 580387 - DNA, 13 bp, D. melanogaster
agtgtgaaatatt

SEQ ID NO: 580388 - DNA, 13 bp, D. melanogaster
agtgtgaatgcaa

SEQ ID NO: 580389 - DNA, 13 bp, D. melanogaster
agtgtgaatgcga

SEQ ID NO: 580390 - DNA, 14 bp, D. melanogaster
agtgtgaatgcgaa

SEQ ID NO: 580391 - DNA, 13 bp, D. melanogaster
agtgtgagtgcga

SEQ ID NO: 580392 - DNA, 14 bp, D. melanogaster
agtgtgagtgcgag

SEQ ID NO: 580393 - DNA, 14 bp, D. melanogaster
agtgtgagtgtgtg

SEQ ID NO: 580394 - DNA, 13 bp, D. melanogaster
agtgtgcagtgtg

SEQ ID NO: 580395 - DNA, 14 bp, D. melanogaster
agtgtgcatgtgtg

SEQ ID NO: 580396 - DNA, 13 bp, D. melanogaster
agtgtgccagtgt

SEQ ID NO: 580397 - DNA, 13 bp, D. melanogaster
agtgtgcgtgtgc

SEQ ID NO: 580398 - DNA, 13 bp, D. melanogaster
agtgtgcgtgttg

SEQ ID NO: 580399 - DNA, 14 bp, D. melanogaster
agtgtgcgtgttgt

SEQ ID NO: 580400 - DNA, 13 bp, D. melanogaster
agtgtgcgttttg

SEQ ID NO: 580401 - DNA, 13 bp, D. melanogaster
agtgtggaaaagc

SEQ ID NO: 580402 - DNA, 13 bp, D. melanogaster
agtgtggcaacaa

SEQ ID NO: 580403 - DNA, 13 bp, D. melanogaster
agtgtggcaagtg

SEQ ID NO: 580404 - DNA, 13 bp, D. melanogaster
agtgtgggaaatg

SEQ ID NO: 580405 - DNA, 14 bp, D. melanogaster
agtgtgggaaatgg

SEQ ID NO: 580406 - DNA, 13 bp, D. melanogaster
agtgtgggcgtga

SEQ ID NO: 580407 - DNA, 14 bp, D. melanogaster
agtgtgggcgtggc

SEQ ID NO: 580408 - DNA, 13 bp, D. melanogaster
agtgtgtaaacag

SEQ ID NO: 580409 - DNA, 13 bp, D. melanogaster
agtgtgtatgtgt

SEQ ID NO: 580410 - DNA, 14 bp, D. melanogaster
agtgtgtatgtgtg

SEQ ID NO: 580411 - DNA, 13 bp, D. melanogaster
agtgtgtctgtgt

SEQ ID NO: 580412 - DNA, 14 bp, D. melanogaster
agtgtgtgagtgtg

SEQ ID NO: 580413 - DNA, 13 bp, D. melanogaster
agtgtgtgcatgt

SEQ ID NO: 580414 - DNA, 13 bp, D. melanogaster
agtgtgtgcgtgt

SEQ ID NO: 580415 - DNA, 14 bp, D. melanogaster
agtgtgtgcgtgtg

SEQ ID NO: 580416 - DNA, 13 bp, D. melanogaster
agtgtgtgggtga

SEQ ID NO: 580417 - DNA, 13 bp, D. melanogaster
agtgtgtgtatgt

SEQ ID NO: 580418 - DNA, 14 bp, D. melanogaster
agtgtgtgtatgtg

SEQ ID NO: 580419 - DNA, 13 bp, D. melanogaster
agtgtgtgtgaga

SEQ ID NO: 580420 - DNA, 13 bp, D. melanogaster
agtgtgtgtgcaa

SEQ ID NO: 580421 - DNA, 13 bp, D. melanogaster
agtgtgtgtgcac

SEQ ID NO: 580422 - DNA, 13 bp, D. melanogaster
agtgtgtgtgcca

SEQ ID NO: 580423 - DNA, 14 bp, D. melanogaster
agtgtgtgtgcgtt

SEQ ID NO: 580424 - DNA, 14 bp, D. melanogaster
agtgtgtgtgtctg

SEQ ID NO: 580425 - DNA, 13 bp, D. melanogaster
agtgtgtgtgtga

SEQ ID NO: 580426 - DNA, 14 bp, D. melanogaster
agtgtgtgtgtgag

SEQ ID NO: 580427 - DNA, 14 bp, D. melanogaster
agtgtgtgtgtgcc

SEQ ID NO: 580428 - DNA, 13 bp, D. melanogaster
agtgtgttagtgt

SEQ ID NO: 580429 - DNA, 13 bp, D. melanogaster
agtgtgttcaatt

SEQ ID NO: 580430 - DNA, 13 bp, D. melanogaster
agtgttacagtta

SEQ ID NO: 580431 - DNA, 13 bp, D. melanogaster
agtgttcaaatct

SEQ ID NO: 580432 - DNA, 13 bp, D. melanogaster
agtgttcctgaaa

SEQ ID NO: 580433 - DNA, 13 bp, D. melanogaster
agtgttgaaaatt

SEQ ID NO: 580434 - DNA, 13 bp, D. melanogaster
agtgttgaatgta

SEQ ID NO: 580435 - DNA, 13 bp, D. melanogaster
agtgttgcaaaac

SEQ ID NO: 580436 - DNA, 13 bp, D. melanogaster
agtgttgccaact

SEQ ID NO: 580437 - DNA, 13 bp, D. melanogaster
agtgttgctgttg

SEQ ID NO: 580438 - DNA, 13 bp, D. melanogaster
agtgttgtcatcc

SEQ ID NO: 580439 - DNA, 13 bp, D. melanogaster
agtgttgtttaac

SEQ ID NO: 580440 - DNA, 13 bp, D. melanogaster
agtgtttaaaaaa

SEQ ID NO: 580441 - DNA, 13 bp, D. melanogaster
agtgtttatgtaa

SEQ ID NO: 580442 - DNA, 13 bp, D. melanogaster
agtgtttcaaaaa

SEQ ID NO: 580443 - DNA, 13 bp, D. melanogaster
agtgtttgattta

SEQ ID NO: 580444 - DNA, 14 bp, D. melanogaster
agtgtttgcaataa

SEQ ID NO: 580445 - DNA, 13 bp, D. melanogaster
agtgtttgccaaa

SEQ ID NO: 580446 - DNA, 13 bp, D. melanogaster
agtgtttggtgga

SEQ ID NO: 580447 - DNA, 13 bp, D. melanogaster
agtgtttgttaag

SEQ ID NO: 580448 - DNA, 13 bp, D. melanogaster
agtgttttaaata

SEQ ID NO: 580449 - DNA, 13 bp, D. melanogaster
agtgttttaattg

SEQ ID NO: 580450 - DNA, 13 bp, D. melanogaster
agtgttttcaaaa

SEQ ID NO: 580451 - DNA, 14 bp, D. melanogaster
agtgttttctaccg

SEQ ID NO: 580452 - DNA, 13 bp, D. melanogaster
agtgttttggcca

SEQ ID NO: 580453 - DNA, 13 bp, D. melanogaster
agtgttttttaaa

SEQ ID NO: 580454 - DNA, 13 bp, D. melanogaster
agttaaaaacatt

SEQ ID NO: 580455 - DNA, 13 bp, D. melanogaster
agttaaaaaggct

SEQ ID NO: 580456 - DNA, 13 bp, D. melanogaster
agttaaaaattca

SEQ ID NO: 580457 - DNA, 13 bp, D. melanogaster
agttaaaactaaa

SEQ ID NO: 580458 - DNA, 13 bp, D. melanogaster
agttaaaagcaaa

SEQ ID NO: 580459 - DNA, 13 bp, D. melanogaster
agttaaaagttaa

SEQ ID NO: 580460 - DNA, 13 bp, D. melanogaster
agttaaacaaaag

SEQ ID NO: 580461 - DNA, 13 bp, D. melanogaster
agttaaacttgaa

SEQ ID NO: 580462 - DNA, 13 bp, D. melanogaster
agttaaagccaaa

SEQ ID NO: 580463 - DNA, 13 bp, D. melanogaster
agttaaagttaaa

SEQ ID NO: 580464 - DNA, 14 bp, D. melanogaster
agttaaagttaaag

SEQ ID NO: 580465 - DNA, 13 bp, D. melanogaster
agttaaagttaag

SEQ ID NO: 580466 - DNA, 13 bp, D. melanogaster
agttaaagttgaa

SEQ ID NO: 580467 - DNA, 13 bp, D. melanogaster
agttaaataagtt

SEQ ID NO: 580468 - DNA, 13 bp, D. melanogaster
agttaaatatgaa

SEQ ID NO: 580469 - DNA, 13 bp, D. melanogaster
agttaaatatttc

SEQ ID NO: 580470 - DNA, 13 bp, D. melanogaster
agttaaatgctca

SEQ ID NO: 580471 - DNA, 13 bp, D. melanogaster
agttaaatggcaa

SEQ ID NO: 580472 - DNA, 13 bp, D. melanogaster
agttaaatgtaaa

SEQ ID NO: 580473 - DNA, 13 bp, D. melanogaster
agttaaatgttta

SEQ ID NO: 580474 - DNA, 13 bp, D. melanogaster
agttaaattcaat

SEQ ID NO: 580475 - DNA, 13 bp, D. melanogaster
agttaaatttaag

SEQ ID NO: 580476 - DNA, 13 bp, D. melanogaster
agttaaatttcaa

SEQ ID NO: 580477 - DNA, 13 bp, D. melanogaster
agttaactaaaac

SEQ ID NO: 580478 - DNA, 13 bp, D. melanogaster
agttaactaagtt

SEQ ID NO: 580479 - DNA, 13 bp, D. melanogaster
agttaactatttt

SEQ ID NO: 580480 - DNA, 13 bp, D. melanogaster
agttaagcaaaca

SEQ ID NO: 580481 - DNA, 13 bp, D. melanogaster
agttaagcttaaa

SEQ ID NO: 580482 - DNA, 13 bp, D. melanogaster
agttaagtccgtg

SEQ ID NO: 580483 - DNA, 13 bp, D. melanogaster
agttaagttagtt

SEQ ID NO: 580484 - DNA, 13 bp, D. melanogaster
agttaagtttgtt

SEQ ID NO: 580485 - DNA, 13 bp, D. melanogaster
agttaataaaaca

SEQ ID NO: 580486 - DNA, 13 bp, D. melanogaster
agttaatacattt

SEQ ID NO: 580487 - DNA, 13 bp, D. melanogaster
agttaatagttaa

SEQ ID NO: 580488 - DNA, 13 bp, D. melanogaster
agttaatatctaa

SEQ ID NO: 580489 - DNA, 13 bp, D. melanogaster
agttaatattttc

SEQ ID NO: 580490 - DNA, 13 bp, D. melanogaster
agttaatgaaata

SEQ ID NO: 580491 - DNA, 13 bp, D. melanogaster
agttaattaaagt

SEQ ID NO: 580492 - DNA, 13 bp, D. melanogaster
agttaattagttt

SEQ ID NO: 580493 - DNA, 13 bp, D. melanogaster
agttaattatttg

SEQ ID NO: 580494 - DNA, 13 bp, D. melanogaster
agttaattgtatt

SEQ ID NO: 580495 - DNA, 13 bp, D. melanogaster
agttaatttaagt

SEQ ID NO: 580496 - DNA, 13 bp, D. melanogaster
agttaatttactt

SEQ ID NO: 580497 - DNA, 13 bp, D. melanogaster
agttaatttagaa

SEQ ID NO: 580498 - DNA, 13 bp, D. melanogaster
agttaatttattg

SEQ ID NO: 580499 - DNA, 13 bp, D. melanogaster
agttacaactaaa

SEQ ID NO: 580500 - DNA, 14 bp, D. melanogaster
agttacacaataat

SEQ ID NO: 580501 - DNA, 14 bp, D. melanogaster
agttacagttacag

SEQ ID NO: 580502 - DNA, 13 bp, D. melanogaster
agttacatatata

SEQ ID NO: 580503 - DNA, 13 bp, D. melanogaster
agttacattattt

SEQ ID NO: 580504 - DNA, 14 bp, D. melanogaster
agttacccatgaat

SEQ ID NO: 580505 - DNA, 13 bp, D. melanogaster
agttacccttttt

SEQ ID NO: 580506 - DNA, 13 bp, D. melanogaster
agttactaatgaa

SEQ ID NO: 580507 - DNA, 13 bp, D. melanogaster
agttactcagcta

SEQ ID NO: 580508 - DNA, 13 bp, D. melanogaster
agttacttaaaaa

SEQ ID NO: 580509 - DNA, 13 bp, D. melanogaster
agttagaaacaaa

SEQ ID NO: 580510 - DNA, 13 bp, D. melanogaster
agttagataaaag

SEQ ID NO: 580511 - DNA, 13 bp, D. melanogaster
agttagcagttag

SEQ ID NO: 580512 - DNA, 13 bp, D. melanogaster
agttagccaagtt

SEQ ID NO: 580513 - DNA, 13 bp, D. melanogaster
agttagtaatttt

SEQ ID NO: 580514 - DNA, 13 bp, D. melanogaster
agttagtcagtta

SEQ ID NO: 580515 - DNA, 14 bp, D. melanogaster
agttagtcagttag

SEQ ID NO: 580516 - DNA, 13 bp, D. melanogaster
agttagttttaaa

SEQ ID NO: 580517 - DNA, 13 bp, D. melanogaster
agttataaaaact

SEQ ID NO: 580518 - DNA, 13 bp, D. melanogaster
agttataaacaaa

SEQ ID NO: 580519 - DNA, 13 bp, D. melanogaster
agttataagcttt

SEQ ID NO: 580520 - DNA, 13 bp, D. melanogaster
agttataatgaaa

SEQ ID NO: 580521 - DNA, 13 bp, D. melanogaster
agttatacaaaat

SEQ ID NO: 580522 - DNA, 13 bp, D. melanogaster
agttatagccaaa

SEQ ID NO: 580523 - DNA, 13 bp, D. melanogaster
agttatagttata

SEQ ID NO: 580524 - DNA, 13 bp, D. melanogaster
agttatatatatg

SEQ ID NO: 580525 - DNA, 13 bp, D. melanogaster
agttatatgtaca

SEQ ID NO: 580526 - DNA, 14 bp, D. melanogaster
agttatattcaaat

SEQ ID NO: 580527 - DNA, 14 bp, D. melanogaster
agttatcatattta

SEQ ID NO: 580528 - DNA, 13 bp, D. melanogaster
agttatcgatttg

SEQ ID NO: 580529 - DNA, 13 bp, D. melanogaster
agttatctgctgt

SEQ ID NO: 580530 - DNA, 13 bp, D. melanogaster
agttatgatgaaa

SEQ ID NO: 580531 - DNA, 13 bp, D. melanogaster
agttatgcaaatt

SEQ ID NO: 580532 - DNA, 13 bp, D. melanogaster
agttatggaaaat

SEQ ID NO: 580533 - DNA, 13 bp, D. melanogaster
agttatggagaaa

SEQ ID NO: 580534 - DNA, 13 bp, D. melanogaster
agttatggcaaaa

SEQ ID NO: 580535 - DNA, 13 bp, D. melanogaster
agttatggccaaa

SEQ ID NO: 580536 - DNA, 13 bp, D. melanogaster
agttatgtattta

SEQ ID NO: 580537 - DNA, 13 bp, D. melanogaster
agttattaacaaa

SEQ ID NO: 580538 - DNA, 14 bp, D. melanogaster
agttattaagttat

SEQ ID NO: 580539 - DNA, 13 bp, D. melanogaster
agttattacattt

SEQ ID NO: 580540 - DNA, 14 bp, D. melanogaster
agttattacatttt

SEQ ID NO: 580541 - DNA, 13 bp, D. melanogaster
agttattagttat

SEQ ID NO: 580542 - DNA, 13 bp, D. melanogaster
agttattcaaaaa

SEQ ID NO: 580543 - DNA, 13 bp, D. melanogaster
agttattccattt

SEQ ID NO: 580544 - DNA, 13 bp, D. melanogaster
agttattgaaaat

SEQ ID NO: 580545 - DNA, 14 bp, D. melanogaster
agttattgccctgc

SEQ ID NO: 580546 - DNA, 13 bp, D. melanogaster
agttattgtacct

SEQ ID NO: 580547 - DNA, 13 bp, D. melanogaster
agttatttacaaa

SEQ ID NO: 580548 - DNA, 13 bp, D. melanogaster
agttatttcaact

SEQ ID NO: 580549 - DNA, 13 bp, D. melanogaster
agttatttgcaaa

SEQ ID NO: 580550 - DNA, 13 bp, D. melanogaster
agttatttgtatg

SEQ ID NO: 580551 - DNA, 13 bp, D. melanogaster
agttattttcagt

SEQ ID NO: 580552 - DNA, 13 bp, D. melanogaster
agttatttttgct

SEQ ID NO: 580553 - DNA, 13 bp, D. melanogaster
agttcaaaatcaa

SEQ ID NO: 580554 - DNA, 13 bp, D. melanogaster
agttcaaactgca

SEQ ID NO: 580555 - DNA, 13 bp, D. melanogaster
agttcaaagaccc

SEQ ID NO: 580556 - DNA, 14 bp, D. melanogaster
agttcaaagacccc

SEQ ID NO: 580557 - DNA, 13 bp, D. melanogaster
agttcaaagtttt

SEQ ID NO: 580558 - DNA, 13 bp, D. melanogaster
agttcaaatgcga

SEQ ID NO: 580559 - DNA, 13 bp, D. melanogaster
agttcaacaattt

SEQ ID NO: 580560 - DNA, 13 bp, D. melanogaster
agttcaacatttt

SEQ ID NO: 580561 - DNA, 13 bp, D. melanogaster
agttcaagttcaa

SEQ ID NO: 580562 - DNA, 13 bp, D. melanogaster
agttcaagttgaa

SEQ ID NO: 580563 - DNA, 13 bp, D. melanogaster
agttcaataaact

SEQ ID NO: 580564 - DNA, 13 bp, D. melanogaster
agttcaatcgatt

SEQ ID NO: 580565 - DNA, 14 bp, D. melanogaster
agttcaatcgattt

SEQ ID NO: 580566 - DNA, 13 bp, D. melanogaster
agttcaatgaaat

SEQ ID NO: 580567 - DNA, 13 bp, D. melanogaster
agttcaatgagca

SEQ ID NO: 580568 - DNA, 13 bp, D. melanogaster
agttcaatggaaa

SEQ ID NO: 580569 - DNA, 13 bp, D. melanogaster
agttcaatgtgaa

SEQ ID NO: 580570 - DNA, 13 bp, D. melanogaster
agttcaattgaaa

SEQ ID NO: 580571 - DNA, 13 bp, D. melanogaster
agttcaattgaat

SEQ ID NO: 580572 - DNA, 13 bp, D. melanogaster
agttcaatttatt

SEQ ID NO: 580573 - DNA, 13 bp, D. melanogaster
agttcacaaatat

SEQ ID NO: 580574 - DNA, 13 bp, D. melanogaster
agttcacacacac

SEQ ID NO: 580575 - DNA, 13 bp, D. melanogaster
agttcacatggtc

SEQ ID NO: 580576 - DNA, 13 bp, D. melanogaster
agttcagaataat

SEQ ID NO: 580577 - DNA, 13 bp, D. melanogaster
agttcagaattat

SEQ ID NO: 580578 - DNA, 13 bp, D. melanogaster
agttcagcagaga

SEQ ID NO: 580579 - DNA, 13 bp, D. melanogaster
agttcaggcaaat

SEQ ID NO: 580580 - DNA, 13 bp, D. melanogaster
agttcagttcaat

SEQ ID NO: 580581 - DNA, 13 bp, D. melanogaster
agttcagttcagt

SEQ ID NO: 580582 - DNA, 14 bp, D. melanogaster
agttcagttcagtt

SEQ ID NO: 580583 - DNA, 13 bp, D. melanogaster
agttcagttcatt

SEQ ID NO: 580584 - DNA, 13 bp, D. melanogaster
agttcagttcggt

SEQ ID NO: 580585 - DNA, 13 bp, D. melanogaster
agttcagttctgt

SEQ ID NO: 580586 - DNA, 13 bp, D. melanogaster
agttcagtttagt

SEQ ID NO: 580587 - DNA, 13 bp, D. melanogaster
agttcataaagat

SEQ ID NO: 580588 - DNA, 13 bp, D. melanogaster
agttcataattta

SEQ ID NO: 580589 - DNA, 13 bp, D. melanogaster
agttcatctggac

SEQ ID NO: 580590 - DNA, 13 bp, D. melanogaster
agttcatgaatat

SEQ ID NO: 580591 - DNA, 13 bp, D. melanogaster
agttcattaaaaa

SEQ ID NO: 580592 - DNA, 13 bp, D. melanogaster
agttcattaatat

SEQ ID NO: 580593 - DNA, 13 bp, D. melanogaster
agttcattagaat

SEQ ID NO: 580594 - DNA, 13 bp, D. melanogaster
agttcattattaa

SEQ ID NO: 580595 - DNA, 13 bp, D. melanogaster
agttcattcagat

SEQ ID NO: 580596 - DNA, 13 bp, D. melanogaster
agttcattgaaat

SEQ ID NO: 580597 - DNA, 13 bp, D. melanogaster
agttcatttaaaa

SEQ ID NO: 580598 - DNA, 13 bp, D. melanogaster
agttcatttaatt

SEQ ID NO: 580599 - DNA, 13 bp, D. melanogaster
agttcattttcat

SEQ ID NO: 580600 - DNA, 13 bp, D. melanogaster
agttcatttttat

SEQ ID NO: 580601 - DNA, 13 bp, D. melanogaster
agttccaaaatac

SEQ ID NO: 580602 - DNA, 13 bp, D. melanogaster
agttccacttcca

SEQ ID NO: 580603 - DNA, 13 bp, D. melanogaster
agttccagtttgc

SEQ ID NO: 580604 - DNA, 14 bp, D. melanogaster
agttccagtttgca

SEQ ID NO: 580605 - DNA, 13 bp, D. melanogaster
agttccattacca

SEQ ID NO: 580606 - DNA, 13 bp, D. melanogaster
agttccgataact

SEQ ID NO: 580607 - DNA, 13 bp, D. melanogaster
agttccgataagg

SEQ ID NO: 580608 - DNA, 13 bp, D. melanogaster
agttccgcagcca

SEQ ID NO: 580609 - DNA, 13 bp, D. melanogaster
agttccgtgattg

SEQ ID NO: 580610 - DNA, 13 bp, D. melanogaster
agttcctcgacta

SEQ ID NO: 580611 - DNA, 13 bp, D. melanogaster
agttcctgagatc

SEQ ID NO: 580612 - DNA, 13 bp, D. melanogaster
agttccttacctt

SEQ ID NO: 580613 - DNA, 14 bp, D. melanogaster
agttcctttcgatg

SEQ ID NO: 580614 - DNA, 14 bp, D. melanogaster
agttcgagttcgag

SEQ ID NO: 580615 - DNA, 13 bp, D. melanogaster
agttcgattggga

SEQ ID NO: 580616 - DNA, 13 bp, D. melanogaster
agttcgatttgat

SEQ ID NO: 580617 - DNA, 13 bp, D. melanogaster
agttcgctaattt

SEQ ID NO: 580618 - DNA, 13 bp, D. melanogaster
agttcgcttcgct

SEQ ID NO: 580619 - DNA, 14 bp, D. melanogaster
agttcggttcggtt

SEQ ID NO: 580620 - DNA, 13 bp, D. melanogaster
agttcggtttggt

SEQ ID NO: 580621 - DNA, 13 bp, D. melanogaster
agttcgtcaaaaa

SEQ ID NO: 580622 - DNA, 13 bp, D. melanogaster
agttcgttgccta

SEQ ID NO: 580623 - DNA, 13 bp, D. melanogaster
agttcgtttacaa

SEQ ID NO: 580624 - DNA, 13 bp, D. melanogaster
agttcgttttgtt

SEQ ID NO: 580625 - DNA, 13 bp, D. melanogaster
agttctatatata

SEQ ID NO: 580626 - DNA, 13 bp, D. melanogaster
agttctatatatt

SEQ ID NO: 580627 - DNA, 13 bp, D. melanogaster
agttctcacggaa

SEQ ID NO: 580628 - DNA, 13 bp, D. melanogaster
agttctcagcagc

SEQ ID NO: 580629 - DNA, 13 bp, D. melanogaster
agttctcagttca

SEQ ID NO: 580630 - DNA, 13 bp, D. melanogaster
agttctgaaaaaa

SEQ ID NO: 580631 - DNA, 13 bp, D. melanogaster
agttctgaatgac

SEQ ID NO: 580632 - DNA, 13 bp, D. melanogaster
agttctggccaaa

SEQ ID NO: 580633 - DNA, 13 bp, D. melanogaster
agttcttaaaaaa

SEQ ID NO: 580634 - DNA, 13 bp, D. melanogaster
agttcttaatata

SEQ ID NO: 580635 - DNA, 13 bp, D. melanogaster
agttcttatacaa

SEQ ID NO: 580636 - DNA, 13 bp, D. melanogaster
agttcttcatgta

SEQ ID NO: 580637 - DNA, 13 bp, D. melanogaster
agttcttccaaag

SEQ ID NO: 580638 - DNA, 13 bp, D. melanogaster
agttcttcttcaa

SEQ ID NO: 580639 - DNA, 13 bp, D. melanogaster
agttctttaaatt

SEQ ID NO: 580640 - DNA, 13 bp, D. melanogaster
agttctttattaa

SEQ ID NO: 580641 - DNA, 13 bp, D. melanogaster
agttctttattac

SEQ ID NO: 580642 - DNA, 13 bp, D. melanogaster
agttctttgaact

SEQ ID NO: 580643 - DNA, 13 bp, D. melanogaster
agttctttgtgca

SEQ ID NO: 580644 - DNA, 13 bp, D. melanogaster
agttctttttcaa

SEQ ID NO: 580645 - DNA, 13 bp, D. melanogaster
agttgaaaaacaa

SEQ ID NO: 580646 - DNA, 13 bp, D. melanogaster
agttgaaaactaa

SEQ ID NO: 580647 - DNA, 13 bp, D. melanogaster
agttgaaaagtta

SEQ ID NO: 580648 - DNA, 13 bp, D. melanogaster
agttgaaaagttg

SEQ ID NO: 580649 - DNA, 13 bp, D. melanogaster
agttgaaaatata

SEQ ID NO: 580650 - DNA, 13 bp, D. melanogaster
agttgaaaatgtt

SEQ ID NO: 580651 - DNA, 13 bp, D. melanogaster
agttgaaaattaa

SEQ ID NO: 580652 - DNA, 13 bp, D. melanogaster
agttgaaacaaat

SEQ ID NO: 580653 - DNA, 13 bp, D. melanogaster
agttgaaacaatt

SEQ ID NO: 580654 - DNA, 14 bp, D. melanogaster
agttgaaacagttg

SEQ ID NO: 580655 - DNA, 13 bp, D. melanogaster
agttgaaactgga

SEQ ID NO: 580656 - DNA, 13 bp, D. melanogaster
agttgaaacttaa

SEQ ID NO: 580657 - DNA, 13 bp, D. melanogaster
agttgaaactttt

SEQ ID NO: 580658 - DNA, 13 bp, D. melanogaster
agttgaaagttga

SEQ ID NO: 580659 - DNA, 13 bp, D. melanogaster
agttgaaatattt

SEQ ID NO: 580660 - DNA, 13 bp, D. melanogaster
agttgaaattgat

SEQ ID NO: 580661 - DNA, 13 bp, D. melanogaster
agttgaaatttgt

SEQ ID NO: 580662 - DNA, 13 bp, D. melanogaster
agttgaacaaact

SEQ ID NO: 580663 - DNA, 13 bp, D. melanogaster
agttgaagctgaa

SEQ ID NO: 580664 - DNA, 14 bp, D. melanogaster
agttgaaggcagcc

SEQ ID NO: 580665 - DNA, 13 bp, D. melanogaster
agttgaaggtgag

SEQ ID NO: 580666 - DNA, 13 bp, D. melanogaster
agttgaagttgaa

SEQ ID NO: 580667 - DNA, 14 bp, D. melanogaster
agttgaagttgaag

SEQ ID NO: 580668 - DNA, 13 bp, D. melanogaster
agttgaataaatt

SEQ ID NO: 580669 - DNA, 13 bp, D. melanogaster
agttgaatatgtt

SEQ ID NO: 580670 - DNA, 13 bp, D. melanogaster
agttgaattaaat

SEQ ID NO: 580671 - DNA, 13 bp, D. melanogaster
agttgaatttatt

SEQ ID NO: 580672 - DNA, 13 bp, D. melanogaster
agttgaatttttg

SEQ ID NO: 580673 - DNA, 13 bp, D. melanogaster
agttgacaatgaa

SEQ ID NO: 580674 - DNA, 13 bp, D. melanogaster
agttgacaatttt

SEQ ID NO: 580675 - DNA, 13 bp, D. melanogaster
agttgacacacct

SEQ ID NO: 580676 - DNA, 13 bp, D. melanogaster
agttgacatttct

SEQ ID NO: 580677 - DNA, 13 bp, D. melanogaster
agttgacatttgg

SEQ ID NO: 580678 - DNA, 13 bp, D. melanogaster
agttgacattttt

SEQ ID NO: 580679 - DNA, 13 bp, D. melanogaster
agttgaccataaa

SEQ ID NO: 580680 - DNA, 13 bp, D. melanogaster
agttgactaagga

SEQ ID NO: 580681 - DNA, 13 bp, D. melanogaster
agttgagaagaaa

SEQ ID NO: 580682 - DNA, 15 bp, D. melanogaster
agttgagaagaaagt

SEQ ID NO: 580683 - DNA, 13 bp, D. melanogaster
agttgagattaaa

SEQ ID NO: 580684 - DNA, 13 bp, D. melanogaster
agttgagattaag

SEQ ID NO: 580685 - DNA, 14 bp, D. melanogaster
agttgagttcagtt

SEQ ID NO: 580686 - DNA, 13 bp, D. melanogaster
agttgagttgaat

SEQ ID NO: 580687 - DNA, 13 bp, D. melanogaster
agttgagttgagt

SEQ ID NO: 580688 - DNA, 14 bp, D. melanogaster
agttgagttgagtt

SEQ ID NO: 580689 - DNA, 13 bp, D. melanogaster
agttgataaacaa

SEQ ID NO: 580690 - DNA, 13 bp, D. melanogaster
agttgatatattt

SEQ ID NO: 580691 - DNA, 13 bp, D. melanogaster
agttgatcgctgt

SEQ ID NO: 580692 - DNA, 13 bp, D. melanogaster
agttgattaaaaa

SEQ ID NO: 580693 - DNA, 14 bp, D. melanogaster
agttgattaaaaat

SEQ ID NO: 580694 - DNA, 13 bp, D. melanogaster
agttgattaaatt

SEQ ID NO: 580695 - DNA, 13 bp, D. melanogaster
agttgattttata

SEQ ID NO: 580696 - DNA, 13 bp, D. melanogaster
agttgcaaaaaaa

SEQ ID NO: 580697 - DNA, 14 bp, D. melanogaster
agttgcaaaaaaaa

SEQ ID NO: 580698 - DNA, 15 bp, D. melanogaster
agttgcaaaataaat

SEQ ID NO: 580699 - DNA, 13 bp, D. melanogaster
agttgcaaataat

SEQ ID NO: 580700 - DNA, 13 bp, D. melanogaster
agttgcaacaaaa

SEQ ID NO: 580701 - DNA, 13 bp, D. melanogaster
agttgcaactttt

SEQ ID NO: 580702 - DNA, 13 bp, D. melanogaster
agttgcaagttgc

SEQ ID NO: 580703 - DNA, 14 bp, D. melanogaster
agttgcaagttgct

SEQ ID NO: 580704 - DNA, 13 bp, D. melanogaster
agttgcaataaaa

SEQ ID NO: 580705 - DNA, 13 bp, D. melanogaster
agttgcaattaaa

SEQ ID NO: 580706 - DNA, 13 bp, D. melanogaster
agttgcaattgct

SEQ ID NO: 580707 - DNA, 13 bp, D. melanogaster
agttgcaatttta

SEQ ID NO: 580708 - DNA, 13 bp, D. melanogaster
agttgcacttgca

SEQ ID NO: 580709 - DNA, 13 bp, D. melanogaster
agttgcagaatga

SEQ ID NO: 580710 - DNA, 14 bp, D. melanogaster
agttgcagaatgaa

SEQ ID NO: 580711 - DNA, 13 bp, D. melanogaster
agttgcagatgca

SEQ ID NO: 580712 - DNA, 13 bp, D. melanogaster
agttgcagcaaca

SEQ ID NO: 580713 - DNA, 14 bp, D. melanogaster
agttgcagcagcaa

SEQ ID NO: 580714 - DNA, 13 bp, D. melanogaster
agttgcagctgca

SEQ ID NO: 580715 - DNA, 13 bp, D. melanogaster
agttgcagctgcc

SEQ ID NO: 580716 - DNA, 13 bp, D. melanogaster
agttgcaggttgc

SEQ ID NO: 580717 - DNA, 13 bp, D. melanogaster
agttgcagtggca

SEQ ID NO: 580718 - DNA, 14 bp, D. melanogaster
agttgcagttgcaa

SEQ ID NO: 580719 - DNA, 14 bp, D. melanogaster
agttgcagttgcac

SEQ ID NO: 580720 - DNA, 14 bp, D. melanogaster
agttgcagttgcat

SEQ ID NO: 580721 - DNA, 13 bp, D. melanogaster
agttgcagttgcc

SEQ ID NO: 580722 - DNA, 13 bp, D. melanogaster
agttgcagttgga

SEQ ID NO: 580723 - DNA, 13 bp, D. melanogaster
agttgcataaaat

SEQ ID NO: 580724 - DNA, 13 bp, D. melanogaster
agttgcataaata

SEQ ID NO: 580725 - DNA, 13 bp, D. melanogaster
agttgcatgaccc

SEQ ID NO: 580726 - DNA, 13 bp, D. melanogaster
agttgcattgata

SEQ ID NO: 580727 - DNA, 13 bp, D. melanogaster
agttgcattgttt

SEQ ID NO: 580728 - DNA, 13 bp, D. melanogaster
agttgcatttaat

SEQ ID NO: 580729 - DNA, 13 bp, D. melanogaster
agttgccaaaaat

SEQ ID NO: 580730 - DNA, 13 bp, D. melanogaster
agttgccaaacaa

SEQ ID NO: 580731 - DNA, 13 bp, D. melanogaster
agttgccaacttt

SEQ ID NO: 580732 - DNA, 13 bp, D. melanogaster
agttgccaataaa

SEQ ID NO: 580733 - DNA, 14 bp, D. melanogaster
agttgccagttgca

SEQ ID NO: 580734 - DNA, 13 bp, D. melanogaster
agttgccatttct

SEQ ID NO: 580735 - DNA, 13 bp, D. melanogaster
agttgcccaccat

SEQ ID NO: 580736 - DNA, 14 bp, D. melanogaster
agttgcccaccata

SEQ ID NO: 580737 - DNA, 13 bp, D. melanogaster
agttgcccagttg

SEQ ID NO: 580738 - DNA, 13 bp, D. melanogaster
agttgccccaaaa

SEQ ID NO: 580739 - DNA, 13 bp, D. melanogaster
agttgccgatgca

SEQ ID NO: 580740 - DNA, 13 bp, D. melanogaster
agttgcctttgtt

SEQ ID NO: 580741 - DNA, 13 bp, D. melanogaster
agttgcgaaaaaa

SEQ ID NO: 580742 - DNA, 13 bp, D. melanogaster
agttgcgacgcca

SEQ ID NO: 580743 - DNA, 13 bp, D. melanogaster
agttgcgagttgc

SEQ ID NO: 580744 - DNA, 13 bp, D. melanogaster
agttgctagttgc

SEQ ID NO: 580745 - DNA, 14 bp, D. melanogaster
agttgctcagcgcc

SEQ ID NO: 580746 - DNA, 13 bp, D. melanogaster
agttgctcgattt

SEQ ID NO: 580747 - DNA, 14 bp, D. melanogaster
agttgctcgatttg

SEQ ID NO: 580748 - DNA, 13 bp, D. melanogaster
agttgctgataag

SEQ ID NO: 580749 - DNA, 13 bp, D. melanogaster
agttgctgcagct

SEQ ID NO: 580750 - DNA, 13 bp, D. melanogaster
agttgctgctgct

SEQ ID NO: 580751 - DNA, 13 bp, D. melanogaster
agttgctgctggc

SEQ ID NO: 580752 - DNA, 13 bp, D. melanogaster
agttgctgctggt

SEQ ID NO: 580753 - DNA, 13 bp, D. melanogaster
agttgctgttgtt

SEQ ID NO: 580754 - DNA, 14 bp, D. melanogaster
agttgctgttgttg

SEQ ID NO: 580755 - DNA, 13 bp, D. melanogaster
agttgcttaaatt

SEQ ID NO: 580756 - DNA, 13 bp, D. melanogaster
agttggaaaaaca

SEQ ID NO: 580757 - DNA, 14 bp, D. melanogaster
agttggaaaaatca

SEQ ID NO: 580758 - DNA, 13 bp, D. melanogaster
agttggaaaaatt

SEQ ID NO: 580759 - DNA, 13 bp, D. melanogaster
agttggaaaagtt

SEQ ID NO: 580760 - DNA, 13 bp, D. melanogaster
agttggaaaatgt

SEQ ID NO: 580761 - DNA, 13 bp, D. melanogaster
agttggaaaattt

SEQ ID NO: 580762 - DNA, 13 bp, D. melanogaster
agttggaaatata

SEQ ID NO: 580763 - DNA, 13 bp, D. melanogaster
agttggaaatgga

SEQ ID NO: 580764 - DNA, 13 bp, D. melanogaster
agttggaaattaa

SEQ ID NO: 580765 - DNA, 13 bp, D. melanogaster
agttggaaattct

SEQ ID NO: 580766 - DNA, 13 bp, D. melanogaster
agttggaattttt

SEQ ID NO: 580767 - DNA, 13 bp, D. melanogaster
agttggactcaaa

SEQ ID NO: 580768 - DNA, 13 bp, D. melanogaster
agttggactttaa

SEQ ID NO: 580769 - DNA, 14 bp, D. melanogaster
agttggactttaaa

SEQ ID NO: 580770 - DNA, 13 bp, D. melanogaster
agttggagacgaa

SEQ ID NO: 580771 - DNA, 14 bp, D. melanogaster
agttggagatggag

SEQ ID NO: 580772 - DNA, 13 bp, D. melanogaster
agttggagctgca

SEQ ID NO: 580773 - DNA, 14 bp, D. melanogaster
agttggagctggag

SEQ ID NO: 580774 - DNA, 13 bp, D. melanogaster
agttggagctggg

SEQ ID NO: 580775 - DNA, 13 bp, D. melanogaster
agttggaggaaga

SEQ ID NO: 580776 - DNA, 13 bp, D. melanogaster
agttggagtcgga

SEQ ID NO: 580777 - DNA, 13 bp, D. melanogaster
agttggagttgga

SEQ ID NO: 580778 - DNA, 13 bp, D. melanogaster
agttggattatca

SEQ ID NO: 580779 - DNA, 13 bp, D. melanogaster
agttggattcaac

SEQ ID NO: 580780 - DNA, 13 bp, D. melanogaster
agttggcaacact

SEQ ID NO: 580781 - DNA, 13 bp, D. melanogaster
agttggcaacttt

SEQ ID NO: 580782 - DNA, 13 bp, D. melanogaster
agttggcaataat

SEQ ID NO: 580783 - DNA, 13 bp, D. melanogaster
agttggcagatct

SEQ ID NO: 580784 - DNA, 13 bp, D. melanogaster
agttggcagcaca

SEQ ID NO: 580785 - DNA, 13 bp, D. melanogaster
agttggcagttgg

SEQ ID NO: 580786 - DNA, 13 bp, D. melanogaster
agttggccaaaaa

SEQ ID NO: 580787 - DNA, 14 bp, D. melanogaster
agttggccaaaaaa

SEQ ID NO: 580788 - DNA, 14 bp, D. melanogaster
agttggccaaaaag

SEQ ID NO: 580789 - DNA, 13 bp, D. melanogaster
agttggccaaaac

SEQ ID NO: 580790 - DNA, 14 bp, D. melanogaster
agttggccaaaagt

SEQ ID NO: 580791 - DNA, 13 bp, D. melanogaster
agttggccaaact

SEQ ID NO: 580792 - DNA, 14 bp, D. melanogaster
agttggccaacaaa

SEQ ID NO: 580793 - DNA, 13 bp, D. melanogaster
agttggccaacag

SEQ ID NO: 580794 - DNA, 14 bp, D. melanogaster
agttggccaacttt

SEQ ID NO: 580795 - DNA, 13 bp, D. melanogaster
agttggccaagaa

SEQ ID NO: 580796 - DNA, 13 bp, D. melanogaster
agttggccaagtt

SEQ ID NO: 580797 - DNA, 14 bp, D. melanogaster
agttggccaagttg

SEQ ID NO: 580798 - DNA, 13 bp, D. melanogaster
agttggccaattt

SEQ ID NO: 580799 - DNA, 13 bp, D. melanogaster
agttggccacttt

SEQ ID NO: 580800 - DNA, 13 bp, D. melanogaster
agttggccagaag

SEQ ID NO: 580801 - DNA, 13 bp, D. melanogaster
agttggccaggaa

SEQ ID NO: 580802 - DNA, 13 bp, D. melanogaster
agttggccagttg

SEQ ID NO: 580803 - DNA, 13 bp, D. melanogaster
agttggccatttg

SEQ ID NO: 580804 - DNA, 13 bp, D. melanogaster
agttggcccaaaa

SEQ ID NO: 580805 - DNA, 13 bp, D. melanogaster
agttggcccaaac

SEQ ID NO: 580806 - DNA, 13 bp, D. melanogaster
agttggcccaaag

SEQ ID NO: 580807 - DNA, 13 bp, D. melanogaster
agttggcccaagg

SEQ ID NO: 580808 - DNA, 13 bp, D. melanogaster
agttggcctggcc

SEQ ID NO: 580809 - DNA, 13 bp, D. melanogaster
agttggcgaaaaa

SEQ ID NO: 580810 - DNA, 13 bp, D. melanogaster
agttggcggaaaa

SEQ ID NO: 580811 - DNA, 13 bp, D. melanogaster
agttggctttttt

SEQ ID NO: 580812 - DNA, 13 bp, D. melanogaster
agttgggaaaatc

SEQ ID NO: 580813 - DNA, 13 bp, D. melanogaster
agttgggaaaatg

SEQ ID NO: 580814 - DNA, 13 bp, D. melanogaster
agttgggagttgg

SEQ ID NO: 580815 - DNA, 13 bp, D. melanogaster
agttgggcaaaca

SEQ ID NO: 580816 - DNA, 13 bp, D. melanogaster
agttgggccaaaa

SEQ ID NO: 580817 - DNA, 13 bp, D. melanogaster
agttggggaaaaa

SEQ ID NO: 580818 - DNA, 13 bp, D. melanogaster
agttggtaaacaa

SEQ ID NO: 580819 - DNA, 13 bp, D. melanogaster
agttggtcaagtg

SEQ ID NO: 580820 - DNA, 14 bp, D. melanogaster
agttggtcaggagg

SEQ ID NO: 580821 - DNA, 13 bp, D. melanogaster
agttggtcatttt

SEQ ID NO: 580822 - DNA, 13 bp, D. melanogaster
agttggtggccat

SEQ ID NO: 580823 - DNA, 14 bp, D. melanogaster
agttggtggccatt

SEQ ID NO: 580824 - DNA, 13 bp, D. melanogaster
agttggttgttta

SEQ ID NO: 580825 - DNA, 13 bp, D. melanogaster
agttgtaaaaata

SEQ ID NO: 580826 - DNA, 13 bp, D. melanogaster
agttgtaaatatt

SEQ ID NO: 580827 - DNA, 14 bp, D. melanogaster
agttgtaacttcgc

SEQ ID NO: 580828 - DNA, 13 bp, D. melanogaster
agttgtaataaaa

SEQ ID NO: 580829 - DNA, 13 bp, D. melanogaster
agttgtagcagaa

SEQ ID NO: 580830 - DNA, 13 bp, D. melanogaster
agttgtagtagta

SEQ ID NO: 580831 - DNA, 13 bp, D. melanogaster
agttgtagttgta

SEQ ID NO: 580832 - DNA, 14 bp, D. melanogaster
agttgtagttgttg

SEQ ID NO: 580833 - DNA, 13 bp, D. melanogaster
agttgtataaata

SEQ ID NO: 580834 - DNA, 13 bp, D. melanogaster
agttgtccatcac

SEQ ID NO: 580835 - DNA, 13 bp, D. melanogaster
agttgtccgaaga

SEQ ID NO: 580836 - DNA, 13 bp, D. melanogaster
agttgtgcaaaca

SEQ ID NO: 580837 - DNA, 13 bp, D. melanogaster
agttgtgcaaata

SEQ ID NO: 580838 - DNA, 13 bp, D. melanogaster
agttgtggcaaaa

SEQ ID NO: 580839 - DNA, 13 bp, D. melanogaster
agttgtggtattc

SEQ ID NO: 580840 - DNA, 13 bp, D. melanogaster
agttgttaaagtt

SEQ ID NO: 580841 - DNA, 13 bp, D. melanogaster
agttgttaataaa

SEQ ID NO: 580842 - DNA, 13 bp, D. melanogaster
agttgttgaaatt

SEQ ID NO: 580843 - DNA, 13 bp, D. melanogaster
agttgttgcacat

SEQ ID NO: 580844 - DNA, 13 bp, D. melanogaster
agttgttgctgct

SEQ ID NO: 580845 - DNA, 14 bp, D. melanogaster
agttgttgctgctg

SEQ ID NO: 580846 - DNA, 14 bp, D. melanogaster
agttgttgctgttg

SEQ ID NO: 580847 - DNA, 13 bp, D. melanogaster
agttgttggagtt

SEQ ID NO: 580848 - DNA, 13 bp, D. melanogaster
agttgttgttctt

SEQ ID NO: 580849 - DNA, 13 bp, D. melanogaster
agttgttgttgct

SEQ ID NO: 580850 - DNA, 15 bp, D. melanogaster
agttgtttagaagac

SEQ ID NO: 580851 - DNA, 13 bp, D. melanogaster
agttgtttgccat

SEQ ID NO: 580852 - DNA, 13 bp, D. melanogaster
agttgtttgcgtg

SEQ ID NO: 580853 - DNA, 14 bp, D. melanogaster
agttgtttggcaaa

SEQ ID NO: 580854 - DNA, 13 bp, D. melanogaster
agtttaaaaaaca

SEQ ID NO: 580855 - DNA, 13 bp, D. melanogaster
agtttaaaaacaa

SEQ ID NO: 580856 - DNA, 13 bp, D. melanogaster
agtttaaaaagtt

SEQ ID NO: 580857 - DNA, 13 bp, D. melanogaster
agtttaaaaatct

SEQ ID NO: 580858 - DNA, 13 bp, D. melanogaster
agtttaaaacaaa

SEQ ID NO: 580859 - DNA, 13 bp, D. melanogaster
agtttaaacaaaa

SEQ ID NO: 580860 - DNA, 13 bp, D. melanogaster
agtttaaagcaaa

SEQ ID NO: 580861 - DNA, 13 bp, D. melanogaster
agtttaaagctta

SEQ ID NO: 580862 - DNA, 13 bp, D. melanogaster
agtttaaagtaaa

SEQ ID NO: 580863 - DNA, 13 bp, D. melanogaster
agtttaaagtatt

SEQ ID NO: 580864 - DNA, 13 bp, D. melanogaster
agtttaaagttgt

SEQ ID NO: 580865 - DNA, 13 bp, D. melanogaster
agtttaaatgttt

SEQ ID NO: 580866 - DNA, 13 bp, D. melanogaster
agtttaaattgaa

SEQ ID NO: 580867 - DNA, 14 bp, D. melanogaster
agtttaaattgaat

SEQ ID NO: 580868 - DNA, 13 bp, D. melanogaster
agtttaaattgtt

SEQ ID NO: 580869 - DNA, 13 bp, D. melanogaster
agtttaactttaa

SEQ ID NO: 580870 - DNA, 14 bp, D. melanogaster
agtttaactttttg

SEQ ID NO: 580871 - DNA, 13 bp, D. melanogaster
agtttaagaaaat

SEQ ID NO: 580872 - DNA, 13 bp, D. melanogaster
agtttaagaaatt

SEQ ID NO: 580873 - DNA, 13 bp, D. melanogaster
agtttaatcaaat

SEQ ID NO: 580874 - DNA, 13 bp, D. melanogaster
agtttaatgaaat

SEQ ID NO: 580875 - DNA, 13 bp, D. melanogaster
agtttaatgttaa

SEQ ID NO: 580876 - DNA, 13 bp, D. melanogaster
agtttaattagtt

SEQ ID NO: 580877 - DNA, 13 bp, D. melanogaster
agtttaattccca

SEQ ID NO: 580878 - DNA, 13 bp, D. melanogaster
agtttaattggaa

SEQ ID NO: 580879 - DNA, 14 bp, D. melanogaster
agtttacaaaacta

SEQ ID NO: 580880 - DNA, 13 bp, D. melanogaster
agtttacaaatta

SEQ ID NO: 580881 - DNA, 13 bp, D. melanogaster
agtttacacactt

SEQ ID NO: 580882 - DNA, 13 bp, D. melanogaster
agtttacataaga

SEQ ID NO: 580883 - DNA, 16 bp, D. melanogaster
agtttacctagctgcc

SEQ ID NO: 580884 - DNA, 13 bp, D. melanogaster
agtttacttatta

SEQ ID NO: 580885 - DNA, 13 bp, D. melanogaster
agtttagctttaa

SEQ ID NO: 580886 - DNA, 13 bp, D. melanogaster
agtttagttaatt

SEQ ID NO: 580887 - DNA, 14 bp, D. melanogaster
agtttagttaatta

SEQ ID NO: 580888 - DNA, 13 bp, D. melanogaster
agtttagttcagt

SEQ ID NO: 580889 - DNA, 14 bp, D. melanogaster
agtttagttcagtt

SEQ ID NO: 580890 - DNA, 14 bp, D. melanogaster
agtttagtttagtt

SEQ ID NO: 580891 - DNA, 13 bp, D. melanogaster
agtttagttttaa

SEQ ID NO: 580892 - DNA, 14 bp, D. melanogaster
agtttataaacaaa

SEQ ID NO: 580893 - DNA, 14 bp, D. melanogaster
agtttataccgcat

SEQ ID NO: 580894 - DNA, 13 bp, D. melanogaster
agtttatagttta

SEQ ID NO: 580895 - DNA, 13 bp, D. melanogaster
agtttatatacat

SEQ ID NO: 580896 - DNA, 14 bp, D. melanogaster
agtttatcaaggtt

SEQ ID NO: 580897 - DNA, 13 bp, D. melanogaster
agtttatgaaata

SEQ ID NO: 580898 - DNA, 14 bp, D. melanogaster
agtttatgacccgt

SEQ ID NO: 580899 - DNA, 13 bp, D. melanogaster
agtttattgctgg

SEQ ID NO: 580900 - DNA, 13 bp, D. melanogaster
agtttattggcaa

SEQ ID NO: 580901 - DNA, 13 bp, D. melanogaster
agtttatttcaaa

SEQ ID NO: 580902 - DNA, 13 bp, D. melanogaster
agtttatttcatt

SEQ ID NO: 580903 - DNA, 14 bp, D. melanogaster
agtttatttcattt

SEQ ID NO: 580904 - DNA, 13 bp, D. melanogaster
agtttattttgaa

SEQ ID NO: 580905 - DNA, 13 bp, D. melanogaster
agtttcaaaatat

SEQ ID NO: 580906 - DNA, 13 bp, D. melanogaster
agtttcaaattat

SEQ ID NO: 580907 - DNA, 13 bp, D. melanogaster
agtttcaaattta

SEQ ID NO: 580908 - DNA, 13 bp, D. melanogaster
agtttcaagtgct

SEQ ID NO: 580909 - DNA, 13 bp, D. melanogaster
agtttcaagtgtt

SEQ ID NO: 580910 - DNA, 13 bp, D. melanogaster
agtttcaagttca

SEQ ID NO: 580911 - DNA, 13 bp, D. melanogaster
agtttcaattaaa

SEQ ID NO: 580912 - DNA, 13 bp, D. melanogaster
agtttcaattaag

SEQ ID NO: 580913 - DNA, 13 bp, D. melanogaster
agtttcaattgaa

SEQ ID NO: 580914 - DNA, 13 bp, D. melanogaster
agtttcaatttta

SEQ ID NO: 580915 - DNA, 13 bp, D. melanogaster
agtttcacaatgc

SEQ ID NO: 580916 - DNA, 14 bp, D. melanogaster
agtttcacgacttt

SEQ ID NO: 580917 - DNA, 13 bp, D. melanogaster
agtttcagattca

SEQ ID NO: 580918 - DNA, 13 bp, D. melanogaster
agtttcagcagat

SEQ ID NO: 580919 - DNA, 13 bp, D. melanogaster
agtttcagcggat

SEQ ID NO: 580920 - DNA, 13 bp, D. melanogaster
agtttcagcttca

SEQ ID NO: 580921 - DNA, 14 bp, D. melanogaster
agtttcagcttcag

SEQ ID NO: 580922 - DNA, 13 bp, D. melanogaster
agtttcagttcag

SEQ ID NO: 580923 - DNA, 13 bp, D. melanogaster
agtttcagttcca

SEQ ID NO: 580924 - DNA, 13 bp, D. melanogaster
agtttcagttgca

SEQ ID NO: 580925 - DNA, 13 bp, D. melanogaster
agtttcagtttcg

SEQ ID NO: 580926 - DNA, 14 bp, D. melanogaster
agtttcagtttcgg

SEQ ID NO: 580927 - DNA, 13 bp, D. melanogaster
agtttcagtttct

SEQ ID NO: 580928 - DNA, 14 bp, D. melanogaster
agtttcagttttag

SEQ ID NO: 580929 - DNA, 13 bp, D. melanogaster
agtttcagttttc

SEQ ID NO: 580930 - DNA, 13 bp, D. melanogaster
agtttcagttttt

SEQ ID NO: 580931 - DNA, 13 bp, D. melanogaster
agtttcattaaat

SEQ ID NO: 580932 - DNA, 13 bp, D. melanogaster
agtttcatttaaa

SEQ ID NO: 580933 - DNA, 13 bp, D. melanogaster
agtttcatttatt

SEQ ID NO: 580934 - DNA, 13 bp, D. melanogaster
agtttcatttgaa

SEQ ID NO: 580935 - DNA, 13 bp, D. melanogaster
agtttcattttat

SEQ ID NO: 580936 - DNA, 13 bp, D. melanogaster
agtttccactttt

SEQ ID NO: 580937 - DNA, 13 bp, D. melanogaster
agtttccagtttg

SEQ ID NO: 580938 - DNA, 13 bp, D. melanogaster
agtttccatttcc

SEQ ID NO: 580939 - DNA, 13 bp, D. melanogaster
agtttcccatttc

SEQ ID NO: 580940 - DNA, 13 bp, D. melanogaster
agtttcccatttt

SEQ ID NO: 580941 - DNA, 13 bp, D. melanogaster
agtttcccgacta

SEQ ID NO: 580942 - DNA, 14 bp, D. melanogaster
agtttcctggccgg

SEQ ID NO: 580943 - DNA, 13 bp, D. melanogaster
agtttcgaaaata

SEQ ID NO: 580944 - DNA, 14 bp, D. melanogaster
agtttcgaaaatat

SEQ ID NO: 580945 - DNA, 13 bp, D. melanogaster
agtttcgattaga

SEQ ID NO: 580946 - DNA, 13 bp, D. melanogaster
agtttcgcatttt

SEQ ID NO: 580947 - DNA, 13 bp, D. melanogaster
agtttcggtttcg

SEQ ID NO: 580948 - DNA, 13 bp, D. melanogaster
agtttcggttttt

SEQ ID NO: 580949 - DNA, 13 bp, D. melanogaster
agtttcgttttgg

SEQ ID NO: 580950 - DNA, 14 bp, D. melanogaster
agtttctattagat

SEQ ID NO: 580951 - DNA, 13 bp, D. melanogaster
agtttctcaaatt

SEQ ID NO: 580952 - DNA, 14 bp, D. melanogaster
agtttctcgactat

SEQ ID NO: 580953 - DNA, 13 bp, D. melanogaster
agtttctcgcaaa

SEQ ID NO: 580954 - DNA, 13 bp, D. melanogaster
agtttctgaattt

SEQ ID NO: 580955 - DNA, 13 bp, D. melanogaster
agtttctgccgaa

SEQ ID NO: 580956 - DNA, 13 bp, D. melanogaster
agtttcttaaatt

SEQ ID NO: 580957 - DNA, 13 bp, D. melanogaster
agtttcttataaa

SEQ ID NO: 580958 - DNA, 13 bp, D. melanogaster
agtttcttattaa

SEQ ID NO: 580959 - DNA, 13 bp, D. melanogaster
agtttcttctatt

SEQ ID NO: 580960 - DNA, 14 bp, D. melanogaster
agtttcttctattt

SEQ ID NO: 580961 - DNA, 13 bp, D. melanogaster
agtttcttgacaa

SEQ ID NO: 580962 - DNA, 13 bp, D. melanogaster
agtttcttgacag

SEQ ID NO: 580963 - DNA, 13 bp, D. melanogaster
agtttctttaaat

SEQ ID NO: 580964 - DNA, 13 bp, D. melanogaster
agtttgaaaattt

SEQ ID NO: 580965 - DNA, 13 bp, D. melanogaster
agtttgaaattga

SEQ ID NO: 580966 - DNA, 13 bp, D. melanogaster
agtttgaagtttt

SEQ ID NO: 580967 - DNA, 14 bp, D. melanogaster
agtttgaataatat

SEQ ID NO: 580968 - DNA, 13 bp, D. melanogaster
agtttgaatttga

SEQ ID NO: 580969 - DNA, 13 bp, D. melanogaster
agtttgacagcca

SEQ ID NO: 580970 - DNA, 13 bp, D. melanogaster
agtttgagctacg

SEQ ID NO: 580971 - DNA, 13 bp, D. melanogaster
agtttgagtttca

SEQ ID NO: 580972 - DNA, 13 bp, D. melanogaster
agtttgagtttga

SEQ ID NO: 580973 - DNA, 13 bp, D. melanogaster
agtttgagtttgt

SEQ ID NO: 580974 - DNA, 13 bp, D. melanogaster
agtttgatgataa

SEQ ID NO: 580975 - DNA, 14 bp, D. melanogaster
agtttgatgataaa

SEQ ID NO: 580976 - DNA, 14 bp, D. melanogaster
agtttgattaaaaa

SEQ ID NO: 580977 - DNA, 13 bp, D. melanogaster
agtttgatttaaa

SEQ ID NO: 580978 - DNA, 13 bp, D. melanogaster
agtttgattttga

SEQ ID NO: 580979 - DNA, 13 bp, D. melanogaster
agtttgcaacact

SEQ ID NO: 580980 - DNA, 13 bp, D. melanogaster
agtttgcagttcg

SEQ ID NO: 580981 - DNA, 13 bp, D. melanogaster
agtttgcagttgg

SEQ ID NO: 580982 - DNA, 13 bp, D. melanogaster
agtttgcagtttg

SEQ ID NO: 580983 - DNA, 13 bp, D. melanogaster
agtttgcatttga

SEQ ID NO: 580984 - DNA, 13 bp, D. melanogaster
agtttgcattttg

SEQ ID NO: 580985 - DNA, 13 bp, D. melanogaster
agtttgccaaaaa

SEQ ID NO: 580986 - DNA, 13 bp, D. melanogaster
agtttgccaagaa

SEQ ID NO: 580987 - DNA, 13 bp, D. melanogaster
agtttgcggcaat

SEQ ID NO: 580988 - DNA, 13 bp, D. melanogaster
agtttgcggtagt

SEQ ID NO: 580989 - DNA, 13 bp, D. melanogaster
agtttgctacctt

SEQ ID NO: 580990 - DNA, 13 bp, D. melanogaster
agtttgctgtgtg

SEQ ID NO: 580991 - DNA, 13 bp, D. melanogaster
agtttgcttgaag

SEQ ID NO: 580992 - DNA, 13 bp, D. melanogaster
agtttggaaaaaa

SEQ ID NO: 580993 - DNA, 13 bp, D. melanogaster
agtttggagtttg

SEQ ID NO: 580994 - DNA, 13 bp, D. melanogaster
agtttggcaaaaa

SEQ ID NO: 580995 - DNA, 13 bp, D. melanogaster
agtttggcaaata

SEQ ID NO: 580996 - DNA, 13 bp, D. melanogaster
agtttggccaaaa

SEQ ID NO: 580997 - DNA, 13 bp, D. melanogaster
agtttggccaaca

SEQ ID NO: 580998 - DNA, 13 bp, D. melanogaster
agtttggccaact

SEQ ID NO: 580999 - DNA, 13 bp, D. melanogaster
agtttggctataa

SEQ ID NO: 581000 - DNA, 13 bp, D. melanogaster
agtttggctttcg

SEQ ID NO: 581001 - DNA, 13 bp, D. melanogaster
agtttggggcatt

SEQ ID NO: 581002 - DNA, 13 bp, D. melanogaster
agtttggttttgc

SEQ ID NO: 581003 - DNA, 13 bp, D. melanogaster
agtttgtaaaaat

SEQ ID NO: 581004 - DNA, 13 bp, D. melanogaster
agtttgtaaaatt

SEQ ID NO: 581005 - DNA, 13 bp, D. melanogaster
agtttgtaaatat

SEQ ID NO: 581006 - DNA, 13 bp, D. melanogaster
agtttgtaaattg

SEQ ID NO: 581007 - DNA, 13 bp, D. melanogaster
agtttgtaattaa

SEQ ID NO: 581008 - DNA, 13 bp, D. melanogaster
agtttgtagtttg

SEQ ID NO: 581009 - DNA, 13 bp, D. melanogaster
agtttgtcagttt

SEQ ID NO: 581010 - DNA, 13 bp, D. melanogaster
agtttgtgacttt

SEQ ID NO: 581011 - DNA, 14 bp, D. melanogaster
agtttgtgtttaaa

SEQ ID NO: 581012 - DNA, 13 bp, D. melanogaster
agtttgttcaact

SEQ ID NO: 581013 - DNA, 13 bp, D. melanogaster
agtttgttgaact

SEQ ID NO: 581014 - DNA, 14 bp, D. melanogaster
agtttgttgaccca

SEQ ID NO: 581015 - DNA, 14 bp, D. melanogaster
agtttgttgcctaa

SEQ ID NO: 581016 - DNA, 13 bp, D. melanogaster
agtttgttgctta

SEQ ID NO: 581017 - DNA, 13 bp, D. melanogaster
agtttgtttcaga

SEQ ID NO: 581018 - DNA, 14 bp, D. melanogaster
agttttaaaaccaa

SEQ ID NO: 581019 - DNA, 13 bp, D. melanogaster
agttttaaaactt

SEQ ID NO: 581020 - DNA, 14 bp, D. melanogaster
agttttaaaattca

SEQ ID NO: 581021 - DNA, 13 bp, D. melanogaster
agttttaaatcaa

SEQ ID NO: 581022 - DNA, 13 bp, D. melanogaster
agttttaaatgta

SEQ ID NO: 581023 - DNA, 13 bp, D. melanogaster
agttttaaattgc

SEQ ID NO: 581024 - DNA, 13 bp, D. melanogaster
agttttaaattgt

SEQ ID NO: 581025 - DNA, 13 bp, D. melanogaster
agttttaacatca

SEQ ID NO: 581026 - DNA, 13 bp, D. melanogaster
agttttaacattt

SEQ ID NO: 581027 - DNA, 13 bp, D. melanogaster
agttttaagcatt

SEQ ID NO: 581028 - DNA, 14 bp, D. melanogaster
agttttaagcattg

SEQ ID NO: 581029 - DNA, 13 bp, D. melanogaster
agttttaagccaa

SEQ ID NO: 581030 - DNA, 13 bp, D. melanogaster
agttttaaggcca

SEQ ID NO: 581031 - DNA, 13 bp, D. melanogaster
agttttaataact

SEQ ID NO: 581032 - DNA, 13 bp, D. melanogaster
agttttaatacta

SEQ ID NO: 581033 - DNA, 13 bp, D. melanogaster
agttttaatcaaa

SEQ ID NO: 581034 - DNA, 13 bp, D. melanogaster
agttttaatcaat

SEQ ID NO: 581035 - DNA, 13 bp, D. melanogaster
agttttaatgaaa

SEQ ID NO: 581036 - DNA, 13 bp, D. melanogaster
agttttaatttca

SEQ ID NO: 581037 - DNA, 13 bp, D. melanogaster
agttttaatttct

SEQ ID NO: 581038 - DNA, 13 bp, D. melanogaster
agttttacacaag

SEQ ID NO: 581039 - DNA, 13 bp, D. melanogaster
agttttacatata

SEQ ID NO: 581040 - DNA, 13 bp, D. melanogaster
agttttaccttat

SEQ ID NO: 581041 - DNA, 13 bp, D. melanogaster
agttttagtttaa

SEQ ID NO: 581042 - DNA, 13 bp, D. melanogaster
agttttagtttca

SEQ ID NO: 581043 - DNA, 13 bp, D. melanogaster
agttttatataca

SEQ ID NO: 581044 - DNA, 13 bp, D. melanogaster
agttttatctgca

SEQ ID NO: 581045 - DNA, 13 bp, D. melanogaster
agttttatgaatg

SEQ ID NO: 581046 - DNA, 13 bp, D. melanogaster
agttttatgactt

SEQ ID NO: 581047 - DNA, 13 bp, D. melanogaster
agttttatgcaat

SEQ ID NO: 581048 - DNA, 13 bp, D. melanogaster
agttttattaaag

SEQ ID NO: 581049 - DNA, 13 bp, D. melanogaster
agttttattcaat

SEQ ID NO: 581050 - DNA, 13 bp, D. melanogaster
agttttatttgca

SEQ ID NO: 581051 - DNA, 13 bp, D. melanogaster
agttttattttca

SEQ ID NO: 581052 - DNA, 13 bp, D. melanogaster
agttttcaaaata

SEQ ID NO: 581053 - DNA, 13 bp, D. melanogaster
agttttcaaagaa

SEQ ID NO: 581054 - DNA, 13 bp, D. melanogaster
agttttcaaatgt

SEQ ID NO: 581055 - DNA, 13 bp, D. melanogaster
agttttcaaatta

SEQ ID NO: 581056 - DNA, 13 bp, D. melanogaster
agttttcaacgaa

SEQ ID NO: 581057 - DNA, 13 bp, D. melanogaster
agttttcaagttt

SEQ ID NO: 581058 - DNA, 13 bp, D. melanogaster
agttttcaatata

SEQ ID NO: 581059 - DNA, 13 bp, D. melanogaster
agttttcaatgaa

SEQ ID NO: 581060 - DNA, 13 bp, D. melanogaster
agttttcaattta

SEQ ID NO: 581061 - DNA, 13 bp, D. melanogaster
agttttcaatttt

SEQ ID NO: 581062 - DNA, 13 bp, D. melanogaster
agttttcacccag

SEQ ID NO: 581063 - DNA, 13 bp, D. melanogaster
agttttcactttc

SEQ ID NO: 581064 - DNA, 13 bp, D. melanogaster
agttttcactttt

SEQ ID NO: 581065 - DNA, 13 bp, D. melanogaster
agttttcagcttg

SEQ ID NO: 581066 - DNA, 13 bp, D. melanogaster
agttttcagttcg

SEQ ID NO: 581067 - DNA, 14 bp, D. melanogaster
agttttcagttttc

SEQ ID NO: 581068 - DNA, 13 bp, D. melanogaster
agttttcatataa

SEQ ID NO: 581069 - DNA, 13 bp, D. melanogaster
agttttcattgcc

SEQ ID NO: 581070 - DNA, 13 bp, D. melanogaster
agttttcattgtt

SEQ ID NO: 581071 - DNA, 13 bp, D. melanogaster
agttttcatttca

SEQ ID NO: 581072 - DNA, 13 bp, D. melanogaster
agttttccaaaca

SEQ ID NO: 581073 - DNA, 13 bp, D. melanogaster
agttttccaactt

SEQ ID NO: 581074 - DNA, 13 bp, D. melanogaster
agttttccaccaa

SEQ ID NO: 581075 - DNA, 13 bp, D. melanogaster
agttttccacttt

SEQ ID NO: 581076 - DNA, 13 bp, D. melanogaster
agttttccagcag

SEQ ID NO: 581077 - DNA, 13 bp, D. melanogaster
agttttccagctg

SEQ ID NO: 581078 - DNA, 13 bp, D. melanogaster
agttttccatttc

SEQ ID NO: 581079 - DNA, 13 bp, D. melanogaster
agttttccatttt

SEQ ID NO: 581080 - DNA, 13 bp, D. melanogaster
agttttcccaaaa

SEQ ID NO: 581081 - DNA, 13 bp, D. melanogaster
agttttcccaacc

SEQ ID NO: 581082 - DNA, 13 bp, D. melanogaster
agttttccccatt

SEQ ID NO: 581083 - DNA, 13 bp, D. melanogaster
agttttcccccaa

SEQ ID NO: 581084 - DNA, 13 bp, D. melanogaster
agttttccctttc

SEQ ID NO: 581085 - DNA, 13 bp, D. melanogaster
agttttccgacgt

SEQ ID NO: 581086 - DNA, 14 bp, D. melanogaster
agttttccgctttt

SEQ ID NO: 581087 - DNA, 13 bp, D. melanogaster
agttttcctccgt

SEQ ID NO: 581088 - DNA, 14 bp, D. melanogaster
agttttcctgaaac

SEQ ID NO: 581089 - DNA, 13 bp, D. melanogaster
agttttcctgttt

SEQ ID NO: 581090 - DNA, 13 bp, D. melanogaster
agttttccttaaa

SEQ ID NO: 581091 - DNA, 13 bp, D. melanogaster
agttttcctttgc

SEQ ID NO: 581092 - DNA, 13 bp, D. melanogaster
agttttccttttg

SEQ ID NO: 581093 - DNA, 13 bp, D. melanogaster
agttttcgatcgt

SEQ ID NO: 581094 - DNA, 13 bp, D. melanogaster
agttttcggtaga

SEQ ID NO: 581095 - DNA, 14 bp, D. melanogaster
agttttcgtcgttt

SEQ ID NO: 581096 - DNA, 13 bp, D. melanogaster
agttttcgtttcg

SEQ ID NO: 581097 - DNA, 14 bp, D. melanogaster
agttttcgttttgt

SEQ ID NO: 581098 - DNA, 13 bp, D. melanogaster
agttttctaaagt

SEQ ID NO: 581099 - DNA, 13 bp, D. melanogaster
agttttctagttt

SEQ ID NO: 581100 - DNA, 13 bp, D. melanogaster
agttttctcaggc

SEQ ID NO: 581101 - DNA, 13 bp, D. melanogaster
agttttctgattt

SEQ ID NO: 581102 - DNA, 14 bp, D. melanogaster
agttttcttgattt

SEQ ID NO: 581103 - DNA, 13 bp, D. melanogaster
agttttcttttaa

SEQ ID NO: 581104 - DNA, 13 bp, D. melanogaster
agttttgaaaact

SEQ ID NO: 581105 - DNA, 13 bp, D. melanogaster
agttttgaaaatg

SEQ ID NO: 581106 - DNA, 13 bp, D. melanogaster
agttttgaatatt

SEQ ID NO: 581107 - DNA, 13 bp, D. melanogaster
agttttgaatttg

SEQ ID NO: 581108 - DNA, 13 bp, D. melanogaster
agttttgacattt

SEQ ID NO: 581109 - DNA, 13 bp, D. melanogaster
agttttgagttta

SEQ ID NO: 581110 - DNA, 13 bp, D. melanogaster
agttttgatttaa

SEQ ID NO: 581111 - DNA, 13 bp, D. melanogaster
agttttgcaattt

SEQ ID NO: 581112 - DNA, 13 bp, D. melanogaster
agttttgcagttt

SEQ ID NO: 581113 - DNA, 13 bp, D. melanogaster
agttttgcatgca

SEQ ID NO: 581114 - DNA, 13 bp, D. melanogaster
agttttgcattca

SEQ ID NO: 581115 - DNA, 13 bp, D. melanogaster
agttttgcatttt

SEQ ID NO: 581116 - DNA, 13 bp, D. melanogaster
agttttgccaaaa

SEQ ID NO: 581117 - DNA, 13 bp, D. melanogaster
agttttgcgaaaa

SEQ ID NO: 581118 - DNA, 13 bp, D. melanogaster
agttttgcttaaa

SEQ ID NO: 581119 - DNA, 13 bp, D. melanogaster
agttttggccaaa

SEQ ID NO: 581120 - DNA, 14 bp, D. melanogaster
agttttggccaatt

SEQ ID NO: 581121 - DNA, 13 bp, D. melanogaster
agttttgggccaa

SEQ ID NO: 581122 - DNA, 13 bp, D. melanogaster
agttttgggcggc

SEQ ID NO: 581123 - DNA, 13 bp, D. melanogaster
agttttgggcggt

SEQ ID NO: 581124 - DNA, 14 bp, D. melanogaster
agttttgggcggtt

SEQ ID NO: 581125 - DNA, 13 bp, D. melanogaster
agttttggtttcg

SEQ ID NO: 581126 - DNA, 13 bp, D. melanogaster
agttttgtaaatt

SEQ ID NO: 581127 - DNA, 13 bp, D. melanogaster
agttttgtgaaaa

SEQ ID NO: 581128 - DNA, 14 bp, D. melanogaster
agttttgttaattg

SEQ ID NO: 581129 - DNA, 13 bp, D. melanogaster
agttttgtttgct

SEQ ID NO: 581130 - DNA, 13 bp, D. melanogaster
agtttttaaaaag

SEQ ID NO: 581131 - DNA, 13 bp, D. melanogaster
agtttttaaaact

SEQ ID NO: 581132 - DNA, 13 bp, D. melanogaster
agtttttaaaagt

SEQ ID NO: 581133 - DNA, 13 bp, D. melanogaster
agtttttaaaatc

SEQ ID NO: 581134 - DNA, 13 bp, D. melanogaster
agtttttaaactt

SEQ ID NO: 581135 - DNA, 13 bp, D. melanogaster
agtttttaacaaa

SEQ ID NO: 581136 - DNA, 13 bp, D. melanogaster
agtttttaacaat

SEQ ID NO: 581137 - DNA, 13 bp, D. melanogaster
agtttttaagtaa

SEQ ID NO: 581138 - DNA, 13 bp, D. melanogaster
agtttttaagtta

SEQ ID NO: 581139 - DNA, 13 bp, D. melanogaster
agtttttaataac

SEQ ID NO: 581140 - DNA, 13 bp, D. melanogaster
agtttttaatgga

SEQ ID NO: 581141 - DNA, 13 bp, D. melanogaster
agtttttaattac

SEQ ID NO: 581142 - DNA, 13 bp, D. melanogaster
agtttttaattgc

SEQ ID NO: 581143 - DNA, 13 bp, D. melanogaster
agtttttacattt

SEQ ID NO: 581144 - DNA, 13 bp, D. melanogaster
agtttttagtttc

SEQ ID NO: 581145 - DNA, 13 bp, D. melanogaster
agtttttatctac

SEQ ID NO: 581146 - DNA, 14 bp, D. melanogaster
agtttttatctact

SEQ ID NO: 581147 - DNA, 13 bp, D. melanogaster
agtttttcaaatt

SEQ ID NO: 581148 - DNA, 13 bp, D. melanogaster
agtttttcaagca

SEQ ID NO: 581149 - DNA, 13 bp, D. melanogaster
agtttttcaataa

SEQ ID NO: 581150 - DNA, 13 bp, D. melanogaster
agtttttcaatta

SEQ ID NO: 581151 - DNA, 14 bp, D. melanogaster
agtttttcaattaa

SEQ ID NO: 581152 - DNA, 13 bp, D. melanogaster
agtttttcacttt

SEQ ID NO: 581153 - DNA, 13 bp, D. melanogaster
agtttttcagttt

SEQ ID NO: 581154 - DNA, 14 bp, D. melanogaster
agtttttcagtttt

SEQ ID NO: 581155 - DNA, 13 bp, D. melanogaster
agtttttcatgtg

SEQ ID NO: 581156 - DNA, 14 bp, D. melanogaster
agtttttcatgtga

SEQ ID NO: 581157 - DNA, 13 bp, D. melanogaster
agtttttcatgtt

SEQ ID NO: 581158 - DNA, 13 bp, D. melanogaster
agtttttcatttc

SEQ ID NO: 581159 - DNA, 14 bp, D. melanogaster
agtttttcatttgc

SEQ ID NO: 581160 - DNA, 13 bp, D. melanogaster
agtttttccaaaa

SEQ ID NO: 581161 - DNA, 13 bp, D. melanogaster
agtttttccaact

SEQ ID NO: 581162 - DNA, 13 bp, D. melanogaster
agtttttccagca

SEQ ID NO: 581163 - DNA, 13 bp, D. melanogaster
agtttttccagct

SEQ ID NO: 581164 - DNA, 13 bp, D. melanogaster
agtttttcccaaa

SEQ ID NO: 581165 - DNA, 13 bp, D. melanogaster
agtttttcccaac

SEQ ID NO: 581166 - DNA, 13 bp, D. melanogaster
agtttttcctgcc

SEQ ID NO: 581167 - DNA, 13 bp, D. melanogaster
agtttttcgaaaa

SEQ ID NO: 581168 - DNA, 13 bp, D. melanogaster
agtttttcgattt

SEQ ID NO: 581169 - DNA, 13 bp, D. melanogaster
agtttttcgcatt

SEQ ID NO: 581170 - DNA, 13 bp, D. melanogaster
agtttttctggct

SEQ ID NO: 581171 - DNA, 13 bp, D. melanogaster
agtttttcttcat

SEQ ID NO: 581172 - DNA, 13 bp, D. melanogaster
agtttttgaaaaa

SEQ ID NO: 581173 - DNA, 13 bp, D. melanogaster
agtttttgaaaat

SEQ ID NO: 581174 - DNA, 13 bp, D. melanogaster
agtttttgaataa

SEQ ID NO: 581175 - DNA, 14 bp, D. melanogaster
agtttttgaataaa

SEQ ID NO: 581176 - DNA, 13 bp, D. melanogaster
agtttttgaatat

SEQ ID NO: 581177 - DNA, 13 bp, D. melanogaster
agtttttgaccaa

SEQ ID NO: 581178 - DNA, 14 bp, D. melanogaster
agtttttgaccaag

SEQ ID NO: 581179 - DNA, 13 bp, D. melanogaster
agtttttgagctt

SEQ ID NO: 581180 - DNA, 13 bp, D. melanogaster
agtttttgatata

SEQ ID NO: 581181 - DNA, 14 bp, D. melanogaster
agtttttgatatag

SEQ ID NO: 581182 - DNA, 13 bp, D. melanogaster
agtttttgatgct

SEQ ID NO: 581183 - DNA, 13 bp, D. melanogaster
agtttttgattaa

SEQ ID NO: 581184 - DNA, 13 bp, D. melanogaster
agtttttgcaaat

SEQ ID NO: 581185 - DNA, 13 bp, D. melanogaster
agtttttgccaat

SEQ ID NO: 581186 - DNA, 13 bp, D. melanogaster
agtttttgctgaa

SEQ ID NO: 581187 - DNA, 14 bp, D. melanogaster
agtttttgctgaag

SEQ ID NO: 581188 - DNA, 13 bp, D. melanogaster
agtttttgctgcc

SEQ ID NO: 581189 - DNA, 13 bp, D. melanogaster
agtttttggcaaa

SEQ ID NO: 581190 - DNA, 14 bp, D. melanogaster
agtttttggcaaaa

SEQ ID NO: 581191 - DNA, 14 bp, D. melanogaster
agtttttggccaaa

SEQ ID NO: 581192 - DNA, 14 bp, D. melanogaster
agtttttggccaac

SEQ ID NO: 581193 - DNA, 13 bp, D. melanogaster
agtttttggccca

SEQ ID NO: 581194 - DNA, 13 bp, D. melanogaster
agtttttggctaa

SEQ ID NO: 581195 - DNA, 13 bp, D. melanogaster
agtttttggcttt

SEQ ID NO: 581196 - DNA, 13 bp, D. melanogaster
agtttttgggggc

SEQ ID NO: 581197 - DNA, 13 bp, D. melanogaster
agtttttgggttc

SEQ ID NO: 581198 - DNA, 13 bp, D. melanogaster
agtttttgtggcc

SEQ ID NO: 581199 - DNA, 13 bp, D. melanogaster
agtttttgtggct

SEQ ID NO: 581200 - DNA, 13 bp, D. melanogaster
agttttttaagaa

SEQ ID NO: 581201 - DNA, 13 bp, D. melanogaster
agttttttattca

SEQ ID NO: 581202 - DNA, 13 bp, D. melanogaster
agttttttgaaaa

SEQ ID NO: 581203 - DNA, 13 bp, D. melanogaster
agttttttgacaa

SEQ ID NO: 581204 - DNA, 13 bp, D. melanogaster
agttttttgccca

SEQ ID NO: 581205 - DNA, 13 bp, D. melanogaster
agttttttgtagc

SEQ ID NO: 581206 - DNA, 13 bp, D. melanogaster
agttttttgttca

SEQ ID NO: 581207 - DNA, 13 bp, D. melanogaster
ataaaaaaagctt

SEQ ID NO: 581208 - DNA, 13 bp, D. melanogaster
ataaaaaaagtgc

SEQ ID NO: 581209 - DNA, 14 bp, D. melanogaster
ataaaaaacaagcg

SEQ ID NO: 581210 - DNA, 13 bp, D. melanogaster
ataaaaaactgat

SEQ ID NO: 581211 - DNA, 13 bp, D. melanogaster
ataaaaaagcgat

SEQ ID NO: 581212 - DNA, 14 bp, D. melanogaster
ataaaaaagtgcaa

SEQ ID NO: 581213 - DNA, 13 bp, D. melanogaster
ataaaaaagtttc

SEQ ID NO: 581214 - DNA, 13 bp, D. melanogaster
ataaaaaatcgta

SEQ ID NO: 581215 - DNA, 14 bp, D. melanogaster
ataaaaaatgcatt

SEQ ID NO: 581216 - DNA, 13 bp, D. melanogaster
ataaaaaattgcc

SEQ ID NO: 581217 - DNA, 13 bp, D. melanogaster
ataaaaacaatgt

SEQ ID NO: 581218 - DNA, 13 bp, D. melanogaster
ataaaaaccagtt

SEQ ID NO: 581219 - DNA, 13 bp, D. melanogaster
ataaaaaccattt

SEQ ID NO: 581220 - DNA, 13 bp, D. melanogaster
ataaaaacgaatg

SEQ ID NO: 581221 - DNA, 13 bp, D. melanogaster
ataaaaacgatga

SEQ ID NO: 581222 - DNA, 13 bp, D. melanogaster
ataaaaacgattt

SEQ ID NO: 581223 - DNA, 13 bp, D. melanogaster
ataaaaacgtatt

SEQ ID NO: 581224 - DNA, 14 bp, D. melanogaster
ataaaaacgtattt

SEQ ID NO: 581225 - DNA, 13 bp, D. melanogaster
ataaaaacgtcaa

SEQ ID NO: 581226 - DNA, 13 bp, D. melanogaster
ataaaaacgtctt

SEQ ID NO: 581227 - DNA, 13 bp, D. melanogaster
ataaaaacgttta

SEQ ID NO: 581228 - DNA, 13 bp, D. melanogaster
ataaaaacgtttt

SEQ ID NO: 581229 - DNA, 13 bp, D. melanogaster
ataaaaactcttt

SEQ ID NO: 581230 - DNA, 13 bp, D. melanogaster
ataaaaacttttg

SEQ ID NO: 581231 - DNA, 13 bp, D. melanogaster
ataaaaagagtgg

SEQ ID NO: 581232 - DNA, 13 bp, D. melanogaster
ataaaaagatttc

SEQ ID NO: 581233 - DNA, 13 bp, D. melanogaster
ataaaaagcaact

SEQ ID NO: 581234 - DNA, 13 bp, D. melanogaster
ataaaaagcaatg

SEQ ID NO: 581235 - DNA, 13 bp, D. melanogaster
ataaaaagcaatt

SEQ ID NO: 581236 - DNA, 13 bp, D. melanogaster
ataaaaagcagca

SEQ ID NO: 581237 - DNA, 13 bp, D. melanogaster
ataaaaagcatat

SEQ ID NO: 581238 - DNA, 13 bp, D. melanogaster
ataaaaagccatt

SEQ ID NO: 581239 - DNA, 13 bp, D. melanogaster
ataaaaagcgaat

SEQ ID NO: 581240 - DNA, 13 bp, D. melanogaster
ataaaaagcgatt

SEQ ID NO: 581241 - DNA, 13 bp, D. melanogaster
ataaaaagctttt

SEQ ID NO: 581242 - DNA, 13 bp, D. melanogaster
ataaaaaggacat

SEQ ID NO: 581243 - DNA, 13 bp, D. melanogaster
ataaaaaggattt

SEQ ID NO: 581244 - DNA, 13 bp, D. melanogaster
ataaaaagtaatc

SEQ ID NO: 581245 - DNA, 13 bp, D. melanogaster
ataaaaagtcaca

SEQ ID NO: 581246 - DNA, 13 bp, D. melanogaster
ataaaaagtgttt

SEQ ID NO: 581247 - DNA, 13 bp, D. melanogaster
ataaaaagttaca

SEQ ID NO: 581248 - DNA, 13 bp, D. melanogaster
ataaaaagttttc

SEQ ID NO: 581249 - DNA, 13 bp, D. melanogaster
ataaaaatatgct

SEQ ID NO: 581250 - DNA, 13 bp, D. melanogaster
ataaaaatccagc

SEQ ID NO: 581251 - DNA, 13 bp, D. melanogaster
ataaaaatccatt

SEQ ID NO: 581252 - DNA, 14 bp, D. melanogaster
ataaaaatccattt

SEQ ID NO: 581253 - DNA, 13 bp, D. melanogaster
ataaaaatcccat

SEQ ID NO: 581254 - DNA, 14 bp, D. melanogaster
ataaaaatgcaaat

SEQ ID NO: 581255 - DNA, 13 bp, D. melanogaster
ataaaaatgcaat

SEQ ID NO: 581256 - DNA, 13 bp, D. melanogaster
ataaaaatgcagc

SEQ ID NO: 581257 - DNA, 13 bp, D. melanogaster
ataaaaatgcagt

SEQ ID NO: 581258 - DNA, 14 bp, D. melanogaster
ataaaaatgcattt

SEQ ID NO: 581259 - DNA, 13 bp, D. melanogaster
ataaaaatgccaa

SEQ ID NO: 581260 - DNA, 13 bp, D. melanogaster
ataaaaatgcgtg

SEQ ID NO: 581261 - DNA, 14 bp, D. melanogaster
ataaaaatggaatc

SEQ ID NO: 581262 - DNA, 13 bp, D. melanogaster
ataaaaatgtaca

SEQ ID NO: 581263 - DNA, 14 bp, D. melanogaster
ataaaaatgtacaa

SEQ ID NO: 581264 - DNA, 13 bp, D. melanogaster
ataaaaatgtcaa

SEQ ID NO: 581265 - DNA, 13 bp, D. melanogaster
ataaaaatgtcat

SEQ ID NO: 581266 - DNA, 13 bp, D. melanogaster
ataaaaatgtgca

SEQ ID NO: 581267 - DNA, 13 bp, D. melanogaster
ataaaaatgtgtt

SEQ ID NO: 581268 - DNA, 13 bp, D. melanogaster
ataaaaatgttag

SEQ ID NO: 581269 - DNA, 13 bp, D. melanogaster
ataaaaatgttgc

SEQ ID NO: 581270 - DNA, 13 bp, D. melanogaster
ataaaaattgcat

SEQ ID NO: 581271 - DNA, 13 bp, D. melanogaster
ataaaaattggca

SEQ ID NO: 581272 - DNA, 14 bp, D. melanogaster
ataaaaattggcaa

SEQ ID NO: 581273 - DNA, 13 bp, D. melanogaster
ataaaaatttcca

SEQ ID NO: 581274 - DNA, 14 bp, D. melanogaster
ataaaacaaaagtt

SEQ ID NO: 581275 - DNA, 13 bp, D. melanogaster
ataaaacaaagtt

SEQ ID NO: 581276 - DNA, 13 bp, D. melanogaster
ataaaacaacttt

SEQ ID NO: 581277 - DNA, 13 bp, D. melanogaster
ataaaacaatgca

SEQ ID NO: 581278 - DNA, 13 bp, D. melanogaster
ataaaacaatttg

SEQ ID NO: 581279 - DNA, 13 bp, D. melanogaster
ataaaacacttta

SEQ ID NO: 581280 - DNA, 13 bp, D. melanogaster
ataaaacactttt

SEQ ID NO: 581281 - DNA, 13 bp, D. melanogaster
ataaaacagattt

SEQ ID NO: 581282 - DNA, 13 bp, D. melanogaster
ataaaacagcagc

SEQ ID NO: 581283 - DNA, 13 bp, D. melanogaster
ataaaacagtagt

SEQ ID NO: 581284 - DNA, 13 bp, D. melanogaster
ataaaacatgttt

SEQ ID NO: 581285 - DNA, 13 bp, D. melanogaster
ataaaacattttg

SEQ ID NO: 581286 - DNA, 13 bp, D. melanogaster
ataaaaccaagca

SEQ ID NO: 581287 - DNA, 13 bp, D. melanogaster
ataaaaccaattt

SEQ ID NO: 581288 - DNA, 13 bp, D. melanogaster
ataaaaccattta

SEQ ID NO: 581289 - DNA, 13 bp, D. melanogaster
ataaaacccaatt

SEQ ID NO: 581290 - DNA, 13 bp, D. melanogaster
ataaaacccattt

SEQ ID NO: 581291 - DNA, 13 bp, D. melanogaster
ataaaaccgaaac

SEQ ID NO: 581292 - DNA, 13 bp, D. melanogaster
ataaaacgaaacc

SEQ ID NO: 581293 - DNA, 13 bp, D. melanogaster
ataaaacgaaatt

SEQ ID NO: 581294 - DNA, 13 bp, D. melanogaster
ataaaacgatttc

SEQ ID NO: 581295 - DNA, 13 bp, D. melanogaster
ataaaacgcattt

SEQ ID NO: 581296 - DNA, 13 bp, D. melanogaster
ataaaacgtattt

SEQ ID NO: 581297 - DNA, 13 bp, D. melanogaster
ataaaacgtgcca

SEQ ID NO: 581298 - DNA, 13 bp, D. melanogaster
ataaaactaaatg

SEQ ID NO: 581299 - DNA, 13 bp, D. melanogaster
ataaaactacaga

SEQ ID NO: 581300 - DNA, 14 bp, D. melanogaster
ataaaactatgagt

SEQ ID NO: 581301 - DNA, 13 bp, D. melanogaster
ataaaactcaatg

SEQ ID NO: 581302 - DNA, 13 bp, D. melanogaster
ataaaactctgta

SEQ ID NO: 581303 - DNA, 13 bp, D. melanogaster
ataaaactgaaag

SEQ ID NO: 581304 - DNA, 13 bp, D. melanogaster
ataaaactgattg

SEQ ID NO: 581305 - DNA, 13 bp, D. melanogaster
ataaaactgcaaa

SEQ ID NO: 581306 - DNA, 13 bp, D. melanogaster
ataaaactgcaat

SEQ ID NO: 581307 - DNA, 13 bp, D. melanogaster
ataaaactggcaa

SEQ ID NO: 581308 - DNA, 13 bp, D. melanogaster
ataaaactgtcat

SEQ ID NO: 581309 - DNA, 13 bp, D. melanogaster
ataaaacttgtta

SEQ ID NO: 581310 - DNA, 14 bp, D. melanogaster
ataaaagaaaattc

SEQ ID NO: 581311 - DNA, 13 bp, D. melanogaster
ataaaagagacac

SEQ ID NO: 581312 - DNA, 13 bp, D. melanogaster
ataaaagagttag

SEQ ID NO: 581313 - DNA, 13 bp, D. melanogaster
ataaaagagtttt

SEQ ID NO: 581314 - DNA, 13 bp, D. melanogaster
ataaaagatgagg

SEQ ID NO: 581315 - DNA, 13 bp, D. melanogaster
ataaaagcaaagt

SEQ ID NO: 581316 - DNA, 14 bp, D. melanogaster
ataaaagcaacaac

SEQ ID NO: 581317 - DNA, 13 bp, D. melanogaster
ataaaagcaatgc

SEQ ID NO: 581318 - DNA, 13 bp, D. melanogaster
ataaaagcaatta

SEQ ID NO: 581319 - DNA, 13 bp, D. melanogaster
ataaaagcagcaa

SEQ ID NO: 581320 - DNA, 13 bp, D. melanogaster
ataaaagcatttt

SEQ ID NO: 581321 - DNA, 13 bp, D. melanogaster
ataaaagccaaac

SEQ ID NO: 581322 - DNA, 13 bp, D. melanogaster
ataaaagcgaaac

SEQ ID NO: 581323 - DNA, 14 bp, D. melanogaster
ataaaagctaaaag

SEQ ID NO: 581324 - DNA, 13 bp, D. melanogaster
ataaaagctataa

SEQ ID NO: 581325 - DNA, 13 bp, D. melanogaster
ataaaagctgaaa

SEQ ID NO: 581326 - DNA, 13 bp, D. melanogaster
ataaaagctttaa

SEQ ID NO: 581327 - DNA, 13 bp, D. melanogaster
ataaaaggatatt

SEQ ID NO: 581328 - DNA, 13 bp, D. melanogaster
ataaaaggccaaa

SEQ ID NO: 581329 - DNA, 14 bp, D. melanogaster
ataaaagtaaacga

SEQ ID NO: 581330 - DNA, 13 bp, D. melanogaster
ataaaagtaacat

SEQ ID NO: 581331 - DNA, 13 bp, D. melanogaster
ataaaagtaattg

SEQ ID NO: 581332 - DNA, 13 bp, D. melanogaster
ataaaagtacgtt

SEQ ID NO: 581333 - DNA, 13 bp, D. melanogaster
ataaaagtatttc

SEQ ID NO: 581334 - DNA, 13 bp, D. melanogaster
ataaaagtatttg

SEQ ID NO: 581335 - DNA, 13 bp, D. melanogaster
ataaaagtcaaag

SEQ ID NO: 581336 - DNA, 13 bp, D. melanogaster
ataaaagtgaaac

SEQ ID NO: 581337 - DNA, 13 bp, D. melanogaster
ataaaagtgcaaa

SEQ ID NO: 581338 - DNA, 13 bp, D. melanogaster
ataaaagtgcaca

SEQ ID NO: 581339 - DNA, 13 bp, D. melanogaster
ataaaagtgcgtt

SEQ ID NO: 581340 - DNA, 14 bp, D. melanogaster
ataaaagtgctaaa

SEQ ID NO: 581341 - DNA, 13 bp, D. melanogaster
ataaaagtggcaa

SEQ ID NO: 581342 - DNA, 13 bp, D. melanogaster
ataaaagtgtttt

SEQ ID NO: 581343 - DNA, 14 bp, D. melanogaster
ataaaagtgttttt

SEQ ID NO: 581344 - DNA, 13 bp, D. melanogaster
ataaaagttcaaa

SEQ ID NO: 581345 - DNA, 13 bp, D. melanogaster
ataaaagtttgct

SEQ ID NO: 581346 - DNA, 13 bp, D. melanogaster
ataaaagtttttc

SEQ ID NO: 581347 - DNA, 14 bp, D. melanogaster
ataaaataaaatgc

SEQ ID NO: 581348 - DNA, 14 bp, D. melanogaster
ataaaataagaatc

SEQ ID NO: 581349 - DNA, 14 bp, D. melanogaster
ataaaatacataga

SEQ ID NO: 581350 - DNA, 13 bp, D. melanogaster
ataaaatacgttt

SEQ ID NO: 581351 - DNA, 13 bp, D. melanogaster
ataaaatactctt

SEQ ID NO: 581352 - DNA, 13 bp, D. melanogaster
ataaaatagtcaa

SEQ ID NO: 581353 - DNA, 13 bp, D. melanogaster
ataaaatatcgaa

SEQ ID NO: 581354 - DNA, 14 bp, D. melanogaster
ataaaatatgtaca

SEQ ID NO: 581355 - DNA, 13 bp, D. melanogaster
ataaaatatgttg

SEQ ID NO: 581356 - DNA, 14 bp, D. melanogaster
ataaaatattgcat

SEQ ID NO: 581357 - DNA, 13 bp, D. melanogaster
ataaaatcaaagc

SEQ ID NO: 581358 - DNA, 13 bp, D. melanogaster
ataaaatcaaatg

SEQ ID NO: 581359 - DNA, 13 bp, D. melanogaster
ataaaatcaagat

SEQ ID NO: 581360 - DNA, 13 bp, D. melanogaster
ataaaatcaagca

SEQ ID NO: 581361 - DNA, 13 bp, D. melanogaster
ataaaatcaatga

SEQ ID NO: 581362 - DNA, 13 bp, D. melanogaster
ataaaatcagttt

SEQ ID NO: 581363 - DNA, 14 bp, D. melanogaster
ataaaatcagtttc

SEQ ID NO: 581364 - DNA, 14 bp, D. melanogaster
ataaaatcatgtat

SEQ ID NO: 581365 - DNA, 13 bp, D. melanogaster
ataaaatcattgt

SEQ ID NO: 581366 - DNA, 13 bp, D. melanogaster
ataaaatcatttg

SEQ ID NO: 581367 - DNA, 13 bp, D. melanogaster
ataaaatccaatt

SEQ ID NO: 581368 - DNA, 13 bp, D. melanogaster
ataaaatcgaaat

SEQ ID NO: 581369 - DNA, 13 bp, D. melanogaster
ataaaatcgaata

SEQ ID NO: 581370 - DNA, 13 bp, D. melanogaster
ataaaatcgattt

SEQ ID NO: 581371 - DNA, 13 bp, D. melanogaster
ataaaatcgcata

SEQ ID NO: 581372 - DNA, 13 bp, D. melanogaster
ataaaatcgtcaa

SEQ ID NO: 581373 - DNA, 13 bp, D. melanogaster
ataaaatcgttaa

SEQ ID NO: 581374 - DNA, 13 bp, D. melanogaster
ataaaatctttca

SEQ ID NO: 581375 - DNA, 14 bp, D. melanogaster
ataaaatctttcaa

SEQ ID NO: 581376 - DNA, 13 bp, D. melanogaster
ataaaatgaaatc

SEQ ID NO: 581377 - DNA, 13 bp, D. melanogaster
ataaaatgaatgt

SEQ ID NO: 581378 - DNA, 13 bp, D. melanogaster
ataaaatgagaac

SEQ ID NO: 581379 - DNA, 13 bp, D. melanogaster
ataaaatgataca

SEQ ID NO: 581380 - DNA, 14 bp, D. melanogaster
ataaaatgcaaata

SEQ ID NO: 581381 - DNA, 13 bp, D. melanogaster
ataaaatgcaact

SEQ ID NO: 581382 - DNA, 13 bp, D. melanogaster
ataaaatgcaata

SEQ ID NO: 581383 - DNA, 13 bp, D. melanogaster
ataaaatgcacat

SEQ ID NO: 581384 - DNA, 13 bp, D. melanogaster
ataaaatgcatgt

SEQ ID NO: 581385 - DNA, 13 bp, D. melanogaster
ataaaatgcatta

SEQ ID NO: 581386 - DNA, 13 bp, D. melanogaster
ataaaatgccagc

SEQ ID NO: 581387 - DNA, 13 bp, D. melanogaster
ataaaatgcgaaa

SEQ ID NO: 581388 - DNA, 14 bp, D. melanogaster
ataaaatgcgaaaa

SEQ ID NO: 581389 - DNA, 14 bp, D. melanogaster
ataaaatgctccaa

SEQ ID NO: 581390 - DNA, 13 bp, D. melanogaster
ataaaatgcttga

SEQ ID NO: 581391 - DNA, 13 bp, D. melanogaster
ataaaatggaaac

SEQ ID NO: 581392 - DNA, 13 bp, D. melanogaster
ataaaatggagca

SEQ ID NO: 581393 - DNA, 14 bp, D. melanogaster
ataaaatggatcca

SEQ ID NO: 581394 - DNA, 13 bp, D. melanogaster
ataaaatggattt

SEQ ID NO: 581395 - DNA, 13 bp, D. melanogaster
ataaaatggcaaa

SEQ ID NO: 581396 - DNA, 14 bp, D. melanogaster
ataaaatggcaaaa

SEQ ID NO: 581397 - DNA, 13 bp, D. melanogaster
ataaaatggcaat

SEQ ID NO: 581398 - DNA, 14 bp, D. melanogaster
ataaaatggtaatt

SEQ ID NO: 581399 - DNA, 13 bp, D. melanogaster
ataaaatgtaact

SEQ ID NO: 581400 - DNA, 13 bp, D. melanogaster
ataaaatgtacaa

SEQ ID NO: 581401 - DNA, 13 bp, D. melanogaster
ataaaatgtagat

SEQ ID NO: 581402 - DNA, 13 bp, D. melanogaster
ataaaatgtatca

SEQ ID NO: 581403 - DNA, 13 bp, D. melanogaster
ataaaatgtatgt

SEQ ID NO: 581404 - DNA, 13 bp, D. melanogaster
ataaaatgtattc

SEQ ID NO: 581405 - DNA, 13 bp, D. melanogaster
ataaaatgtcatt

SEQ ID NO: 581406 - DNA, 14 bp, D. melanogaster
ataaaatgttaatc

SEQ ID NO: 581407 - DNA, 13 bp, D. melanogaster
ataaaatgttatg

SEQ ID NO: 581408 - DNA, 13 bp, D. melanogaster
ataaaatgttggc

SEQ ID NO: 581409 - DNA, 13 bp, D. melanogaster
ataaaatgttgtt

SEQ ID NO: 581410 - DNA, 13 bp, D. melanogaster
ataaaatgtttac

SEQ ID NO: 581411 - DNA, 13 bp, D. melanogaster
ataaaatgtttca

SEQ ID NO: 581412 - DNA, 13 bp, D. melanogaster
ataaaattatgca

SEQ ID NO: 581413 - DNA, 14 bp, D. melanogaster
ataaaattatttgc

SEQ ID NO: 581414 - DNA, 13 bp, D. melanogaster
ataaaattcccaa

SEQ ID NO: 581415 - DNA, 13 bp, D. melanogaster
ataaaattgcaat

SEQ ID NO: 581416 - DNA, 13 bp, D. melanogaster
ataaaattgtatg

SEQ ID NO: 581417 - DNA, 13 bp, D. melanogaster
ataaaattgtgat

SEQ ID NO: 581418 - DNA, 13 bp, D. melanogaster
ataaaattgttga

SEQ ID NO: 581419 - DNA, 13 bp, D. melanogaster
ataaaattgtttg

SEQ ID NO: 581420 - DNA, 13 bp, D. melanogaster
ataaaatttatgg

SEQ ID NO: 581421 - DNA, 13 bp, D. melanogaster
ataaaatttgcat

SEQ ID NO: 581422 - DNA, 13 bp, D. melanogaster
ataaaatttgtag

SEQ ID NO: 581423 - DNA, 13 bp, D. melanogaster
ataaacaaaagcg

SEQ ID NO: 581424 - DNA, 13 bp, D. melanogaster
ataaacaaaagct

SEQ ID NO: 581425 - DNA, 13 bp, D. melanogaster
ataaacaaaatgc

SEQ ID NO: 581426 - DNA, 13 bp, D. melanogaster
ataaacaaaatgg

SEQ ID NO: 581427 - DNA, 14 bp, D. melanogaster
ataaacaaaatgtt

SEQ ID NO: 581428 - DNA, 13 bp, D. melanogaster
ataaacaaaattg

SEQ ID NO: 581429 - DNA, 13 bp, D. melanogaster
ataaacaaacagc

SEQ ID NO: 581430 - DNA, 13 bp, D. melanogaster
ataaacaaatagc

SEQ ID NO: 581431 - DNA, 13 bp, D. melanogaster
ataaacaaatcga

SEQ ID NO: 581432 - DNA, 13 bp, D. melanogaster
ataaacaaatgcg

SEQ ID NO: 581433 - DNA, 14 bp, D. melanogaster
ataaacaaatgtat

SEQ ID NO: 581434 - DNA, 13 bp, D. melanogaster
ataaacaaattgc

SEQ ID NO: 581435 - DNA, 14 bp, D. melanogaster
ataaacaaattgca

SEQ ID NO: 581436 - DNA, 13 bp, D. melanogaster
ataaacaacaatg

SEQ ID NO: 581437 - DNA, 13 bp, D. melanogaster
ataaacaacattt

SEQ ID NO: 581438 - DNA, 14 bp, D. melanogaster
ataaacaacatttt

SEQ ID NO: 581439 - DNA, 13 bp, D. melanogaster
ataaacaactttt

SEQ ID NO: 581440 - DNA, 14 bp, D. melanogaster
ataaacaagaaact

SEQ ID NO: 581441 - DNA, 13 bp, D. melanogaster
ataaacaagaatt

SEQ ID NO: 581442 - DNA, 13 bp, D. melanogaster
ataaacaagatat

SEQ ID NO: 581443 - DNA, 13 bp, D. melanogaster
ataaacaaggcaa

SEQ ID NO: 581444 - DNA, 13 bp, D. melanogaster
ataaacaagtgca

SEQ ID NO: 581445 - DNA, 13 bp, D. melanogaster
ataaacaagttgc

SEQ ID NO: 581446 - DNA, 13 bp, D. melanogaster
ataaacaatcgaa

SEQ ID NO: 581447 - DNA, 13 bp, D. melanogaster
ataaacaatggaa

SEQ ID NO: 581448 - DNA, 13 bp, D. melanogaster
ataaacaattgaa

SEQ ID NO: 581449 - DNA, 13 bp, D. melanogaster
ataaacaattgta

SEQ ID NO: 581450 - DNA, 13 bp, D. melanogaster
ataaacaatttca

SEQ ID NO: 581451 - DNA, 13 bp, D. melanogaster
ataaacaatttgt

SEQ ID NO: 581452 - DNA, 14 bp, D. melanogaster
ataaacaatttgta

SEQ ID NO: 581453 - DNA, 13 bp, D. melanogaster
ataaacacacact

SEQ ID NO: 581454 - DNA, 13 bp, D. melanogaster
ataaacacacaga

SEQ ID NO: 581455 - DNA, 13 bp, D. melanogaster
ataaacacgcaca

SEQ ID NO: 581456 - DNA, 14 bp, D. melanogaster
ataaacagaaaatt

SEQ ID NO: 581457 - DNA, 13 bp, D. melanogaster
ataaacagaattt

SEQ ID NO: 581458 - DNA, 13 bp, D. melanogaster
ataaacagatttt

SEQ ID NO: 581459 - DNA, 13 bp, D. melanogaster
ataaacagcaaca

SEQ ID NO: 581460 - DNA, 13 bp, D. melanogaster
ataaacagcagca

SEQ ID NO: 581461 - DNA, 14 bp, D. melanogaster
ataaacagttttca

SEQ ID NO: 581462 - DNA, 13 bp, D. melanogaster
ataaacataattc

SEQ ID NO: 581463 - DNA, 13 bp, D. melanogaster
ataaacatacatt

SEQ ID NO: 581464 - DNA, 13 bp, D. melanogaster
ataaacatagcaa

SEQ ID NO: 581465 - DNA, 13 bp, D. melanogaster
ataaacatatcga

SEQ ID NO: 581466 - DNA, 13 bp, D. melanogaster
ataaacatattca

SEQ ID NO: 581467 - DNA, 13 bp, D. melanogaster
ataaacatatttg

SEQ ID NO: 581468 - DNA, 14 bp, D. melanogaster
ataaacatatttgt

SEQ ID NO: 581469 - DNA, 13 bp, D. melanogaster
ataaacatcaatt

SEQ ID NO: 581470 - DNA, 13 bp, D. melanogaster
ataaacatgtaaa

SEQ ID NO: 581471 - DNA, 13 bp, D. melanogaster
ataaacattaaag

SEQ ID NO: 581472 - DNA, 13 bp, D. melanogaster
ataaacattacga

SEQ ID NO: 581473 - DNA, 13 bp, D. melanogaster
ataaacattgaaa

SEQ ID NO: 581474 - DNA, 13 bp, D. melanogaster
ataaacatttgca

SEQ ID NO: 581475 - DNA, 13 bp, D. melanogaster
ataaacattttcg

SEQ ID NO: 581476 - DNA, 13 bp, D. melanogaster
ataaacattttgg

SEQ ID NO: 581477 - DNA, 14 bp, D. melanogaster
ataaacatttttgt

SEQ ID NO: 581478 - DNA, 13 bp, D. melanogaster
ataaaccaaattt

SEQ ID NO: 581479 - DNA, 13 bp, D. melanogaster
ataaaccataatt

SEQ ID NO: 581480 - DNA, 14 bp, D. melanogaster
ataaaccataattg

SEQ ID NO: 581481 - DNA, 13 bp, D. melanogaster
ataaaccatttta

SEQ ID NO: 581482 - DNA, 13 bp, D. melanogaster
ataaaccgaaaat

SEQ ID NO: 581483 - DNA, 13 bp, D. melanogaster
ataaaccgcaaaa

SEQ ID NO: 581484 - DNA, 13 bp, D. melanogaster
ataaacctaatgc

SEQ ID NO: 581485 - DNA, 13 bp, D. melanogaster
ataaacctatata

SEQ ID NO: 581486 - DNA, 14 bp, D. melanogaster
ataaacgaaacgaa

SEQ ID NO: 581487 - DNA, 13 bp, D. melanogaster
ataaacgaaagct

SEQ ID NO: 581488 - DNA, 13 bp, D. melanogaster
ataaacgaaatca

SEQ ID NO: 581489 - DNA, 13 bp, D. melanogaster
ataaacgaaattt

SEQ ID NO: 581490 - DNA, 13 bp, D. melanogaster
ataaacgagctaa

SEQ ID NO: 581491 - DNA, 13 bp, D. melanogaster
ataaacgatataa

SEQ ID NO: 581492 - DNA, 14 bp, D. melanogaster
ataaacgatttcat

SEQ ID NO: 581493 - DNA, 13 bp, D. melanogaster
ataaacgcaatgc

SEQ ID NO: 581494 - DNA, 13 bp, D. melanogaster
ataaacgcataaa

SEQ ID NO: 581495 - DNA, 13 bp, D. melanogaster
ataaacggaattt

SEQ ID NO: 581496 - DNA, 13 bp, D. melanogaster
ataaacgtacata

SEQ ID NO: 581497 - DNA, 13 bp, D. melanogaster
ataaacgtatagc

SEQ ID NO: 581498 - DNA, 13 bp, D. melanogaster
ataaacgtatata

SEQ ID NO: 581499 - DNA, 13 bp, D. melanogaster
ataaacgtttatt

SEQ ID NO: 581500 - DNA, 13 bp, D. melanogaster
ataaactacatag

SEQ ID NO: 581501 - DNA, 13 bp, D. melanogaster
ataaactactttt

SEQ ID NO: 581502 - DNA, 13 bp, D. melanogaster
ataaactagtttt

SEQ ID NO: 581503 - DNA, 13 bp, D. melanogaster
ataaactatatag

SEQ ID NO: 581504 - DNA, 13 bp, D. melanogaster
ataaactcaatta

SEQ ID NO: 581505 - DNA, 13 bp, D. melanogaster
ataaactcatttg

SEQ ID NO: 581506 - DNA, 13 bp, D. melanogaster
ataaactctttta

SEQ ID NO: 581507 - DNA, 13 bp, D. melanogaster
ataaactgaaaat

SEQ ID NO: 581508 - DNA, 13 bp, D. melanogaster
ataaactgaaatt

SEQ ID NO: 581509 - DNA, 13 bp, D. melanogaster
ataaactgaataa

SEQ ID NO: 581510 - DNA, 13 bp, D. melanogaster
ataaactgagcga

SEQ ID NO: 581511 - DNA, 13 bp, D. melanogaster
ataaactgattta

SEQ ID NO: 581512 - DNA, 13 bp, D. melanogaster
ataaactgcactt

SEQ ID NO: 581513 - DNA, 13 bp, D. melanogaster
ataaactgcagtc

SEQ ID NO: 581514 - DNA, 13 bp, D. melanogaster
ataaactgttttt

SEQ ID NO: 581515 - DNA, 13 bp, D. melanogaster
ataaacttaaact

SEQ ID NO: 581516 - DNA, 13 bp, D. melanogaster
ataaacttaaatc

SEQ ID NO: 581517 - DNA, 13 bp, D. melanogaster
ataaacttacata

SEQ ID NO: 581518 - DNA, 13 bp, D. melanogaster
ataaacttatcta

SEQ ID NO: 581519 - DNA, 13 bp, D. melanogaster
ataaacttcaatt

SEQ ID NO: 581520 - DNA, 13 bp, D. melanogaster
ataaacttgaact

SEQ ID NO: 581521 - DNA, 13 bp, D. melanogaster
ataaactttaaac

SEQ ID NO: 581522 - DNA, 13 bp, D. melanogaster
ataaacttttctt

SEQ ID NO: 581523 - DNA, 14 bp, D. melanogaster
ataaagaaaaattc

SEQ ID NO: 581524 - DNA, 13 bp, D. melanogaster
ataaagaaagtgc

SEQ ID NO: 581525 - DNA, 14 bp, D. melanogaster
ataaagaaatacat

SEQ ID NO: 581526 - DNA, 14 bp, D. melanogaster
ataaagaaattcaa

SEQ ID NO: 581527 - DNA, 13 bp, D. melanogaster
ataaagaaatttc

SEQ ID NO: 581528 - DNA, 13 bp, D. melanogaster
ataaagaacttta

SEQ ID NO: 581529 - DNA, 13 bp, D. melanogaster
ataaagaatacga

SEQ ID NO: 581530 - DNA, 13 bp, D. melanogaster
ataaagagagtgc

SEQ ID NO: 581531 - DNA, 13 bp, D. melanogaster
ataaagataaagc

SEQ ID NO: 581532 - DNA, 13 bp, D. melanogaster
ataaagatatcaa

SEQ ID NO: 581533 - DNA, 13 bp, D. melanogaster
ataaagatgtttt

SEQ ID NO: 581534 - DNA, 13 bp, D. melanogaster
ataaagcaaacag

SEQ ID NO: 581535 - DNA, 13 bp, D. melanogaster
ataaagcaaagca

SEQ ID NO: 581536 - DNA, 13 bp, D. melanogaster
ataaagcaaatgc

SEQ ID NO: 581537 - DNA, 13 bp, D. melanogaster
ataaagcaaattg

SEQ ID NO: 581538 - DNA, 13 bp, D. melanogaster
ataaagcaattaa

SEQ ID NO: 581539 - DNA, 13 bp, D. melanogaster
ataaagcacacaa

SEQ ID NO: 581540 - DNA, 13 bp, D. melanogaster
ataaagcaggaaa

SEQ ID NO: 581541 - DNA, 13 bp, D. melanogaster
ataaagccaaaat

SEQ ID NO: 581542 - DNA, 13 bp, D. melanogaster
ataaagccaacaa

SEQ ID NO: 581543 - DNA, 13 bp, D. melanogaster
ataaagccataaa

SEQ ID NO: 581544 - DNA, 13 bp, D. melanogaster
ataaagctatata

SEQ ID NO: 581545 - DNA, 13 bp, D. melanogaster
ataaagctgtttt

SEQ ID NO: 581546 - DNA, 13 bp, D. melanogaster
ataaagcttattt

SEQ ID NO: 581547 - DNA, 13 bp, D. melanogaster
ataaagcttttat

SEQ ID NO: 581548 - DNA, 13 bp, D. melanogaster
ataaaggattcca

SEQ ID NO: 581549 - DNA, 13 bp, D. melanogaster
ataaaggcataaa

SEQ ID NO: 581550 - DNA, 13 bp, D. melanogaster
ataaagtaaatgt

SEQ ID NO: 581551 - DNA, 13 bp, D. melanogaster
ataaagtaatttc

SEQ ID NO: 581552 - DNA, 13 bp, D. melanogaster
ataaagtacaaat

SEQ ID NO: 581553 - DNA, 13 bp, D. melanogaster
ataaagtagagca

SEQ ID NO: 581554 - DNA, 14 bp, D. melanogaster
ataaagtatataca

SEQ ID NO: 581555 - DNA, 13 bp, D. melanogaster
ataaagtatttca

SEQ ID NO: 581556 - DNA, 13 bp, D. melanogaster
ataaagtcaaata

SEQ ID NO: 581557 - DNA, 13 bp, D. melanogaster
ataaagtcaaatt

SEQ ID NO: 581558 - DNA, 13 bp, D. melanogaster
ataaagtcgaaaa

SEQ ID NO: 581559 - DNA, 14 bp, D. melanogaster
ataaagtctattat

SEQ ID NO: 581560 - DNA, 13 bp, D. melanogaster
ataaagtgaaagt

SEQ ID NO: 581561 - DNA, 13 bp, D. melanogaster
ataaagtgatcga

SEQ ID NO: 581562 - DNA, 13 bp, D. melanogaster
ataaagtgtatat

SEQ ID NO: 581563 - DNA, 13 bp, D. melanogaster
ataaagttaaagt

SEQ ID NO: 581564 - DNA, 13 bp, D. melanogaster
ataaagttaattg

SEQ ID NO: 581565 - DNA, 13 bp, D. melanogaster
ataaagttatcaa

SEQ ID NO: 581566 - DNA, 14 bp, D. melanogaster
ataaagttgaaatt

SEQ ID NO: 581567 - DNA, 13 bp, D. melanogaster
ataaagttgaatt

SEQ ID NO: 581568 - DNA, 13 bp, D. melanogaster
ataaagttgttaa

SEQ ID NO: 581569 - DNA, 13 bp, D. melanogaster
ataaagttgtttt

SEQ ID NO: 581570 - DNA, 14 bp, D. melanogaster
ataaagtttagttt

SEQ ID NO: 581571 - DNA, 13 bp, D. melanogaster
ataaagtttgttt

SEQ ID NO: 581572 - DNA, 13 bp, D. melanogaster
ataaagttttgat

SEQ ID NO: 581573 - DNA, 14 bp, D. melanogaster
ataaagttttgata

SEQ ID NO: 581574 - DNA, 13 bp, D. melanogaster
ataaataaaatcg

SEQ ID NO: 581575 - DNA, 13 bp, D. melanogaster
ataaataaacagc

SEQ ID NO: 581576 - DNA, 16 bp, D. melanogaster
ataaataaagctgaaa

SEQ ID NO: 581577 - DNA, 13 bp, D. melanogaster
ataaataaagtgc

SEQ ID NO: 581578 - DNA, 13 bp, D. melanogaster
ataaataaagtgt

SEQ ID NO: 581579 - DNA, 13 bp, D. melanogaster
ataaataaagttg

SEQ ID NO: 581580 - DNA, 13 bp, D. melanogaster
ataaataaatacg

SEQ ID NO: 581581 - DNA, 14 bp, D. melanogaster
ataaataaatacgt

SEQ ID NO: 581582 - DNA, 13 bp, D. melanogaster
ataaataaatagc

SEQ ID NO: 581583 - DNA, 14 bp, D. melanogaster
ataaataaatagca

SEQ ID NO: 581584 - DNA, 13 bp, D. melanogaster
ataaataaatcag

SEQ ID NO: 581585 - DNA, 13 bp, D. melanogaster
ataaataaatgca

SEQ ID NO: 581586 - DNA, 14 bp, D. melanogaster
ataaataaatgctt

SEQ ID NO: 581587 - DNA, 14 bp, D. melanogaster
ataaataaattgca

SEQ ID NO: 581588 - DNA, 13 bp, D. melanogaster
ataaataacattg

SEQ ID NO: 581589 - DNA, 14 bp, D. melanogaster
ataaataagcaatt

SEQ ID NO: 581590 - DNA, 13 bp, D. melanogaster
ataaataagcgca

SEQ ID NO: 581591 - DNA, 14 bp, D. melanogaster
ataaataagtaaac

SEQ ID NO: 581592 - DNA, 13 bp, D. melanogaster
ataaataagtgat

SEQ ID NO: 581593 - DNA, 13 bp, D. melanogaster
ataaataagtgca

SEQ ID NO: 581594 - DNA, 13 bp, D. melanogaster
ataaataagtgtg

SEQ ID NO: 581595 - DNA, 13 bp, D. melanogaster
ataaataagttca

SEQ ID NO: 581596 - DNA, 13 bp, D. melanogaster
ataaataagtttg

SEQ ID NO: 581597 - DNA, 13 bp, D. melanogaster
ataaataataagc

SEQ ID NO: 581598 - DNA, 13 bp, D. melanogaster
ataaataatacga

SEQ ID NO: 581599 - DNA, 13 bp, D. melanogaster
ataaataatactg

SEQ ID NO: 581600 - DNA, 13 bp, D. melanogaster
ataaataatatcc

SEQ ID NO: 581601 - DNA, 13 bp, D. melanogaster
ataaataatgcaa

SEQ ID NO: 581602 - DNA, 14 bp, D. melanogaster
ataaataatgcaaa

SEQ ID NO: 581603 - DNA, 13 bp, D. melanogaster
ataaataattgct

SEQ ID NO: 581604 - DNA, 13 bp, D. melanogaster
ataaatacaagca

SEQ ID NO: 581605 - DNA, 13 bp, D. melanogaster
ataaatacagtaa

SEQ ID NO: 581606 - DNA, 13 bp, D. melanogaster
ataaatacagtcc

SEQ ID NO: 581607 - DNA, 13 bp, D. melanogaster
ataaatacattga

SEQ ID NO: 581608 - DNA, 13 bp, D. melanogaster
ataaatacatttg

SEQ ID NO: 581609 - DNA, 14 bp, D. melanogaster
ataaatacattttc

SEQ ID NO: 581610 - DNA, 13 bp, D. melanogaster
ataaataccaatt

SEQ ID NO: 581611 - DNA, 13 bp, D. melanogaster
ataaatacgcaaa

SEQ ID NO: 581612 - DNA, 13 bp, D. melanogaster
ataaatacgcaat

SEQ ID NO: 581613 - DNA, 13 bp, D. melanogaster
ataaatagataca

SEQ ID NO: 581614 - DNA, 13 bp, D. melanogaster
ataaatagcagca

SEQ ID NO: 581615 - DNA, 13 bp, D. melanogaster
ataaatagccaaa

SEQ ID NO: 581616 - DNA, 13 bp, D. melanogaster
ataaatagtttgg

SEQ ID NO: 581617 - DNA, 13 bp, D. melanogaster
ataaatatacaga

SEQ ID NO: 581618 - DNA, 13 bp, D. melanogaster
ataaatatagcaa

SEQ ID NO: 581619 - DNA, 13 bp, D. melanogaster
ataaatatatagc

SEQ ID NO: 581620 - DNA, 13 bp, D. melanogaster
ataaatatatctg

SEQ ID NO: 581621 - DNA, 13 bp, D. melanogaster
ataaatatatgct

SEQ ID NO: 581622 - DNA, 13 bp, D. melanogaster
ataaatatccata

SEQ ID NO: 581623 - DNA, 13 bp, D. melanogaster
ataaatatccatt

SEQ ID NO: 581624 - DNA, 13 bp, D. melanogaster
ataaatatcgaaa

SEQ ID NO: 581625 - DNA, 13 bp, D. melanogaster
ataaatatcttgt

SEQ ID NO: 581626 - DNA, 13 bp, D. melanogaster
ataaatatgaatg

SEQ ID NO: 581627 - DNA, 13 bp, D. melanogaster
ataaatatgattg

SEQ ID NO: 581628 - DNA, 13 bp, D. melanogaster
ataaatatgcaaa

SEQ ID NO: 581629 - DNA, 14 bp, D. melanogaster
ataaatatgcataa

SEQ ID NO: 581630 - DNA, 13 bp, D. melanogaster
ataaatatgcatg

SEQ ID NO: 581631 - DNA, 13 bp, D. melanogaster
ataaatatgcatt

SEQ ID NO: 581632 - DNA, 14 bp, D. melanogaster
ataaatatgcattt

SEQ ID NO: 581633 - DNA, 13 bp, D. melanogaster
ataaatatgcttt

SEQ ID NO: 581634 - DNA, 13 bp, D. melanogaster
ataaatatggcca

SEQ ID NO: 581635 - DNA, 13 bp, D. melanogaster
ataaatatggttt

SEQ ID NO: 581636 - DNA, 13 bp, D. melanogaster
ataaatatgtaag

SEQ ID NO: 581637 - DNA, 13 bp, D. melanogaster
ataaatatgtaca

SEQ ID NO: 581638 - DNA, 13 bp, D. melanogaster
ataaatatgtacg

SEQ ID NO: 581639 - DNA, 13 bp, D. melanogaster
ataaatatgtaga

SEQ ID NO: 581640 - DNA, 13 bp, D. melanogaster
ataaatatgtatg

SEQ ID NO: 581641 - DNA, 13 bp, D. melanogaster
ataaatatgtcaa

SEQ ID NO: 581642 - DNA, 13 bp, D. melanogaster
ataaatatgtgcc

SEQ ID NO: 581643 - DNA, 13 bp, D. melanogaster
ataaatatgttga

SEQ ID NO: 581644 - DNA, 13 bp, D. melanogaster
ataaatatgtttg

SEQ ID NO: 581645 - DNA, 13 bp, D. melanogaster
ataaatattatgc

SEQ ID NO: 581646 - DNA, 13 bp, D. melanogaster
ataaatattcaga

SEQ ID NO: 581647 - DNA, 14 bp, D. melanogaster
ataaatattcttga

SEQ ID NO: 581648 - DNA, 13 bp, D. melanogaster
ataaatattgaca

SEQ ID NO: 581649 - DNA, 13 bp, D. melanogaster
ataaatattgcag

SEQ ID NO: 581650 - DNA, 13 bp, D. melanogaster
ataaatatttcga

SEQ ID NO: 581651 - DNA, 14 bp, D. melanogaster
ataaatatttgcca

SEQ ID NO: 581652 - DNA, 13 bp, D. melanogaster
ataaatatttgtg

SEQ ID NO: 581653 - DNA, 14 bp, D. melanogaster
ataaatattttcca

SEQ ID NO: 581654 - DNA, 13 bp, D. melanogaster
ataaatcaaaagc

SEQ ID NO: 581655 - DNA, 13 bp, D. melanogaster
ataaatcaaaatg

SEQ ID NO: 581656 - DNA, 13 bp, D. melanogaster
ataaatcaaaggc

SEQ ID NO: 581657 - DNA, 13 bp, D. melanogaster
ataaatcaaatga

SEQ ID NO: 581658 - DNA, 13 bp, D. melanogaster
ataaatcaagttt

SEQ ID NO: 581659 - DNA, 13 bp, D. melanogaster
ataaatcaatcag

SEQ ID NO: 581660 - DNA, 13 bp, D. melanogaster
ataaatcaatggc

SEQ ID NO: 581661 - DNA, 14 bp, D. melanogaster
ataaatcaatttgt

SEQ ID NO: 581662 - DNA, 13 bp, D. melanogaster
ataaatcacaaag

SEQ ID NO: 581663 - DNA, 13 bp, D. melanogaster
ataaatcactttg

SEQ ID NO: 581664 - DNA, 13 bp, D. melanogaster
ataaatcagccaa

SEQ ID NO: 581665 - DNA, 13 bp, D. melanogaster
ataaatcagttta

SEQ ID NO: 581666 - DNA, 13 bp, D. melanogaster
ataaatcagtttt

SEQ ID NO: 581667 - DNA, 13 bp, D. melanogaster
ataaatcatatgt

SEQ ID NO: 581668 - DNA, 13 bp, D. melanogaster
ataaatcatttga

SEQ ID NO: 581669 - DNA, 13 bp, D. melanogaster
ataaatccaattt

SEQ ID NO: 581670 - DNA, 13 bp, D. melanogaster
ataaatccatatt

SEQ ID NO: 581671 - DNA, 13 bp, D. melanogaster
ataaatcccattg

SEQ ID NO: 581672 - DNA, 13 bp, D. melanogaster
ataaatcctataa

SEQ ID NO: 581673 - DNA, 13 bp, D. melanogaster
ataaatcctttaa

SEQ ID NO: 581674 - DNA, 13 bp, D. melanogaster
ataaatcgaaaca

SEQ ID NO: 581675 - DNA, 13 bp, D. melanogaster
ataaatcgaaata

SEQ ID NO: 581676 - DNA, 13 bp, D. melanogaster
ataaatcgaaatt

SEQ ID NO: 581677 - DNA, 13 bp, D. melanogaster
ataaatcgattaa

SEQ ID NO: 581678 - DNA, 13 bp, D. melanogaster
ataaatcgcatta

SEQ ID NO: 581679 - DNA, 13 bp, D. melanogaster
ataaatcgtttaa

SEQ ID NO: 581680 - DNA, 13 bp, D. melanogaster
ataaatctaaatg

SEQ ID NO: 581681 - DNA, 13 bp, D. melanogaster
ataaatctatatg

SEQ ID NO: 581682 - DNA, 13 bp, D. melanogaster
ataaatctcattt

SEQ ID NO: 581683 - DNA, 13 bp, D. melanogaster
ataaatctgtaat

SEQ ID NO: 581684 - DNA, 13 bp, D. melanogaster
ataaatctgtgca

SEQ ID NO: 581685 - DNA, 13 bp, D. melanogaster
ataaatcttctga

SEQ ID NO: 581686 - DNA, 13 bp, D. melanogaster
ataaatctttcaa

SEQ ID NO: 581687 - DNA, 13 bp, D. melanogaster
ataaatgaaaacc

SEQ ID NO: 581688 - DNA, 13 bp, D. melanogaster
ataaatgaaaacg

SEQ ID NO: 581689 - DNA, 13 bp, D. melanogaster
ataaatgaaatct

SEQ ID NO: 581690 - DNA, 13 bp, D. melanogaster
ataaatgaaattg

SEQ ID NO: 581691 - DNA, 13 bp, D. melanogaster
ataaatgacaata

SEQ ID NO: 581692 - DNA, 13 bp, D. melanogaster
ataaatgatgagt

SEQ ID NO: 581693 - DNA, 13 bp, D. melanogaster
ataaatgattcaa

SEQ ID NO: 581694 - DNA, 13 bp, D. melanogaster
ataaatgcaaaac

SEQ ID NO: 581695 - DNA, 14 bp, D. melanogaster
ataaatgcaaacaa

SEQ ID NO: 581696 - DNA, 13 bp, D. melanogaster
ataaatgcaaagc

SEQ ID NO: 581697 - DNA, 13 bp, D. melanogaster
ataaatgcaaatg

SEQ ID NO: 581698 - DNA, 14 bp, D. melanogaster
ataaatgcaactaa

SEQ ID NO: 581699 - DNA, 13 bp, D. melanogaster
ataaatgcaatta

SEQ ID NO: 581700 - DNA, 13 bp, D. melanogaster
ataaatgcacttg

SEQ ID NO: 581701 - DNA, 13 bp, D. melanogaster
ataaatgcagcaa

SEQ ID NO: 581702 - DNA, 14 bp, D. melanogaster
ataaatgcatatat

SEQ ID NO: 581703 - DNA, 14 bp, D. melanogaster
ataaatgcattaaa

SEQ ID NO: 581704 - DNA, 13 bp, D. melanogaster
ataaatgccaaaa

SEQ ID NO: 581705 - DNA, 13 bp, D. melanogaster
ataaatgccaaag

SEQ ID NO: 581706 - DNA, 13 bp, D. melanogaster
ataaatgccaact

SEQ ID NO: 581707 - DNA, 13 bp, D. melanogaster
ataaatgcgaaat

SEQ ID NO: 581708 - DNA, 13 bp, D. melanogaster
ataaatgcgaatg

SEQ ID NO: 581709 - DNA, 13 bp, D. melanogaster
ataaatgcgattt

SEQ ID NO: 581710 - DNA, 13 bp, D. melanogaster
ataaatgctaata

SEQ ID NO: 581711 - DNA, 13 bp, D. melanogaster
ataaatgctgaaa

SEQ ID NO: 581712 - DNA, 13 bp, D. melanogaster
ataaatgcttttg

SEQ ID NO: 581713 - DNA, 13 bp, D. melanogaster
ataaatggaattt

SEQ ID NO: 581714 - DNA, 13 bp, D. melanogaster
ataaatggcaaac

SEQ ID NO: 581715 - DNA, 13 bp, D. melanogaster
ataaatggcaaca

SEQ ID NO: 581716 - DNA, 13 bp, D. melanogaster
ataaatggcaact

SEQ ID NO: 581717 - DNA, 14 bp, D. melanogaster
ataaatggctaaaa

SEQ ID NO: 581718 - DNA, 14 bp, D. melanogaster
ataaatgggattat

SEQ ID NO: 581719 - DNA, 13 bp, D. melanogaster
ataaatgggttca

SEQ ID NO: 581720 - DNA, 14 bp, D. melanogaster
ataaatgtaaaaac

SEQ ID NO: 581721 - DNA, 13 bp, D. melanogaster
ataaatgtaaagt

SEQ ID NO: 581722 - DNA, 13 bp, D. melanogaster
ataaatgtaatac

SEQ ID NO: 581723 - DNA, 13 bp, D. melanogaster
ataaatgtatctg

SEQ ID NO: 581724 - DNA, 13 bp, D. melanogaster
ataaatgtcaaaa

SEQ ID NO: 581725 - DNA, 13 bp, D. melanogaster
ataaatgtcaaat

SEQ ID NO: 581726 - DNA, 13 bp, D. melanogaster
ataaatgtcaatt

SEQ ID NO: 581727 - DNA, 13 bp, D. melanogaster
ataaatgtcagaa

SEQ ID NO: 581728 - DNA, 14 bp, D. melanogaster
ataaatgtcataaa

SEQ ID NO: 581729 - DNA, 13 bp, D. melanogaster
ataaatgtctcaa

SEQ ID NO: 581730 - DNA, 13 bp, D. melanogaster
ataaatgtctgtc

SEQ ID NO: 581731 - DNA, 14 bp, D. melanogaster
ataaatgtctgtcg

SEQ ID NO: 581732 - DNA, 13 bp, D. melanogaster
ataaatgtgaaat

SEQ ID NO: 581733 - DNA, 13 bp, D. melanogaster
ataaatgtgatat

SEQ ID NO: 581734 - DNA, 13 bp, D. melanogaster
ataaatgtgcaaa

SEQ ID NO: 581735 - DNA, 13 bp, D. melanogaster
ataaatgtgcata

SEQ ID NO: 581736 - DNA, 13 bp, D. melanogaster
ataaatgtgcttt

SEQ ID NO: 581737 - DNA, 13 bp, D. melanogaster
ataaatgtggaaa

SEQ ID NO: 581738 - DNA, 13 bp, D. melanogaster
ataaatgtgtgta

SEQ ID NO: 581739 - DNA, 13 bp, D. melanogaster
ataaatgtgttaa

SEQ ID NO: 581740 - DNA, 13 bp, D. melanogaster
ataaatgtgttgg

SEQ ID NO: 581741 - DNA, 13 bp, D. melanogaster
ataaatgtgtttt

SEQ ID NO: 581742 - DNA, 13 bp, D. melanogaster
ataaatgttcaaa

SEQ ID NO: 581743 - DNA, 13 bp, D. melanogaster
ataaatgttgaaa

SEQ ID NO: 581744 - DNA, 13 bp, D. melanogaster
ataaatgttgagc

SEQ ID NO: 581745 - DNA, 14 bp, D. melanogaster
ataaatgttgagct

SEQ ID NO: 581746 - DNA, 13 bp, D. melanogaster
ataaatgttgata

SEQ ID NO: 581747 - DNA, 14 bp, D. melanogaster
ataaatgttgtcta

SEQ ID NO: 581748 - DNA, 13 bp, D. melanogaster
ataaatgtttatg

SEQ ID NO: 581749 - DNA, 13 bp, D. melanogaster
ataaatgtttgta

SEQ ID NO: 581750 - DNA, 13 bp, D. melanogaster
ataaatgtttgtg

SEQ ID NO: 581751 - DNA, 13 bp, D. melanogaster
ataaatgttttga

SEQ ID NO: 581752 - DNA, 13 bp, D. melanogaster
ataaatgtttttc

SEQ ID NO: 581753 - DNA, 13 bp, D. melanogaster
ataaattaaaacg

SEQ ID NO: 581754 - DNA, 13 bp, D. melanogaster
ataaattaaactg

SEQ ID NO: 581755 - DNA, 13 bp, D. melanogaster
ataaattaaatgc

SEQ ID NO: 581756 - DNA, 14 bp, D. melanogaster
ataaattaaatgca

SEQ ID NO: 581757 - DNA, 14 bp, D. melanogaster
ataaattaaatgtc

SEQ ID NO: 581758 - DNA, 13 bp, D. melanogaster
ataaattaagcaa

SEQ ID NO: 581759 - DNA, 13 bp, D. melanogaster
ataaattaatcag

SEQ ID NO: 581760 - DNA, 13 bp, D. melanogaster
ataaattaattgg

SEQ ID NO: 581761 - DNA, 13 bp, D. melanogaster
ataaattacaaag

SEQ ID NO: 581762 - DNA, 13 bp, D. melanogaster
ataaattacaact

SEQ ID NO: 581763 - DNA, 13 bp, D. melanogaster
ataaattacagca

SEQ ID NO: 581764 - DNA, 13 bp, D. melanogaster
ataaattacgttt

SEQ ID NO: 581765 - DNA, 13 bp, D. melanogaster
ataaattacttac

SEQ ID NO: 581766 - DNA, 13 bp, D. melanogaster
ataaattagccag

SEQ ID NO: 581767 - DNA, 13 bp, D. melanogaster
ataaattagccat

SEQ ID NO: 581768 - DNA, 13 bp, D. melanogaster
ataaattagctaa

SEQ ID NO: 581769 - DNA, 13 bp, D. melanogaster
ataaattagtcaa

SEQ ID NO: 581770 - DNA, 13 bp, D. melanogaster
ataaattatgcaa

SEQ ID NO: 581771 - DNA, 14 bp, D. melanogaster
ataaattatgcaat

SEQ ID NO: 581772 - DNA, 13 bp, D. melanogaster
ataaattatgcca

SEQ ID NO: 581773 - DNA, 13 bp, D. melanogaster
ataaattatttcg

SEQ ID NO: 581774 - DNA, 13 bp, D. melanogaster
ataaattcaaatc

SEQ ID NO: 581775 - DNA, 14 bp, D. melanogaster
ataaattcaaatga

SEQ ID NO: 581776 - DNA, 13 bp, D. melanogaster
ataaattcaactt

SEQ ID NO: 581777 - DNA, 13 bp, D. melanogaster
ataaattcaagta

SEQ ID NO: 581778 - DNA, 13 bp, D. melanogaster
ataaattcaattg

SEQ ID NO: 581779 - DNA, 14 bp, D. melanogaster
ataaattcaatttg

SEQ ID NO: 581780 - DNA, 13 bp, D. melanogaster
ataaattcagttt

SEQ ID NO: 581781 - DNA, 13 bp, D. melanogaster
ataaattcatttc

SEQ ID NO: 581782 - DNA, 13 bp, D. melanogaster
ataaattccattt

SEQ ID NO: 581783 - DNA, 13 bp, D. melanogaster
ataaattccgaaa

SEQ ID NO: 581784 - DNA, 13 bp, D. melanogaster
ataaattccttaa

SEQ ID NO: 581785 - DNA, 13 bp, D. melanogaster
ataaattgaaact

SEQ ID NO: 581786 - DNA, 13 bp, D. melanogaster
ataaattgaacaa

SEQ ID NO: 581787 - DNA, 13 bp, D. melanogaster
ataaattgaagtt

SEQ ID NO: 581788 - DNA, 13 bp, D. melanogaster
ataaattgacaaa

SEQ ID NO: 581789 - DNA, 13 bp, D. melanogaster
ataaattgagtga

SEQ ID NO: 581790 - DNA, 13 bp, D. melanogaster
ataaattgcaaat

SEQ ID NO: 581791 - DNA, 13 bp, D. melanogaster
ataaattgcaagt

SEQ ID NO: 581792 - DNA, 13 bp, D. melanogaster
ataaattgcacaa

SEQ ID NO: 581793 - DNA, 13 bp, D. melanogaster
ataaattgcactt

SEQ ID NO: 581794 - DNA, 13 bp, D. melanogaster
ataaattgcatgt

SEQ ID NO: 581795 - DNA, 13 bp, D. melanogaster
ataaattgcattc

SEQ ID NO: 581796 - DNA, 14 bp, D. melanogaster
ataaattgcatttt

SEQ ID NO: 581797 - DNA, 13 bp, D. melanogaster
ataaattgccaaa

SEQ ID NO: 581798 - DNA, 13 bp, D. melanogaster
ataaattgccatc

SEQ ID NO: 581799 - DNA, 13 bp, D. melanogaster
ataaattgcgcat

SEQ ID NO: 581800 - DNA, 13 bp, D. melanogaster
ataaattgctggc

SEQ ID NO: 581801 - DNA, 13 bp, D. melanogaster
ataaattgcttaa

SEQ ID NO: 581802 - DNA, 13 bp, D. melanogaster
ataaattggcaat

SEQ ID NO: 581803 - DNA, 13 bp, D. melanogaster
ataaattggcata

SEQ ID NO: 581804 - DNA, 13 bp, D. melanogaster
ataaattggctaa

SEQ ID NO: 581805 - DNA, 13 bp, D. melanogaster
ataaattggtcca

SEQ ID NO: 581806 - DNA, 13 bp, D. melanogaster
ataaattgtaagc

SEQ ID NO: 581807 - DNA, 13 bp, D. melanogaster
ataaattgtactt

SEQ ID NO: 581808 - DNA, 13 bp, D. melanogaster
ataaattgtatac

SEQ ID NO: 581809 - DNA, 13 bp, D. melanogaster
ataaattgtgttt

SEQ ID NO: 581810 - DNA, 13 bp, D. melanogaster
ataaattgttcaa

SEQ ID NO: 581811 - DNA, 13 bp, D. melanogaster
ataaattgttgat

SEQ ID NO: 581812 - DNA, 14 bp, D. melanogaster
ataaattgtttatg

SEQ ID NO: 581813 - DNA, 13 bp, D. melanogaster
ataaatttaaagc

SEQ ID NO: 581814 - DNA, 13 bp, D. melanogaster
ataaatttaagca

SEQ ID NO: 581815 - DNA, 14 bp, D. melanogaster
ataaatttaagcaa

SEQ ID NO: 581816 - DNA, 13 bp, D. melanogaster
ataaatttacaca

SEQ ID NO: 581817 - DNA, 13 bp, D. melanogaster
ataaatttatggt

SEQ ID NO: 581818 - DNA, 14 bp, D. melanogaster
ataaatttcaaatg

SEQ ID NO: 581819 - DNA, 13 bp, D. melanogaster
ataaatttcaact

SEQ ID NO: 581820 - DNA, 13 bp, D. melanogaster
ataaatttcaagt

SEQ ID NO: 581821 - DNA, 13 bp, D. melanogaster
ataaatttcacat

SEQ ID NO: 581822 - DNA, 14 bp, D. melanogaster
ataaatttcacatt

SEQ ID NO: 581823 - DNA, 13 bp, D. melanogaster
ataaatttcagcc

SEQ ID NO: 581824 - DNA, 14 bp, D. melanogaster
ataaatttccattt

SEQ ID NO: 581825 - DNA, 13 bp, D. melanogaster
ataaatttcctca

SEQ ID NO: 581826 - DNA, 13 bp, D. melanogaster
ataaatttcctct

SEQ ID NO: 581827 - DNA, 13 bp, D. melanogaster
ataaatttcgaaa

SEQ ID NO: 581828 - DNA, 13 bp, D. melanogaster
ataaatttcgaac

SEQ ID NO: 581829 - DNA, 13 bp, D. melanogaster
ataaatttcgatt

SEQ ID NO: 581830 - DNA, 14 bp, D. melanogaster
ataaatttcgattt

SEQ ID NO: 581831 - DNA, 13 bp, D. melanogaster
ataaatttctcat

SEQ ID NO: 581832 - DNA, 13 bp, D. melanogaster
ataaatttctgtt

SEQ ID NO: 581833 - DNA, 13 bp, D. melanogaster
ataaatttgaaag

SEQ ID NO: 581834 - DNA, 13 bp, D. melanogaster
ataaatttgaatg

SEQ ID NO: 581835 - DNA, 13 bp, D. melanogaster
ataaatttgagca

SEQ ID NO: 581836 - DNA, 14 bp, D. melanogaster
ataaatttgcaatt

SEQ ID NO: 581837 - DNA, 13 bp, D. melanogaster
ataaatttgcagc

SEQ ID NO: 581838 - DNA, 13 bp, D. melanogaster
ataaatttgcata

SEQ ID NO: 581839 - DNA, 13 bp, D. melanogaster
ataaatttgcatg

SEQ ID NO: 581840 - DNA, 13 bp, D. melanogaster
ataaatttgccag

SEQ ID NO: 581841 - DNA, 13 bp, D. melanogaster
ataaatttgcgat

SEQ ID NO: 581842 - DNA, 13 bp, D. melanogaster
ataaatttgctaa

SEQ ID NO: 581843 - DNA, 13 bp, D. melanogaster
ataaatttgctta

SEQ ID NO: 581844 - DNA, 13 bp, D. melanogaster
ataaatttggcaa

SEQ ID NO: 581845 - DNA, 13 bp, D. melanogaster
ataaatttggcat

SEQ ID NO: 581846 - DNA, 13 bp, D. melanogaster
ataaatttgtaac

SEQ ID NO: 581847 - DNA, 13 bp, D. melanogaster
ataaatttgtgtt

SEQ ID NO: 581848 - DNA, 13 bp, D. melanogaster
ataaatttgttgc

SEQ ID NO: 581849 - DNA, 13 bp, D. melanogaster
ataaattttccaa

SEQ ID NO: 581850 - DNA, 14 bp, D. melanogaster
ataaattttccaaa

SEQ ID NO: 581851 - DNA, 13 bp, D. melanogaster
ataacaaaaatgc

SEQ ID NO: 581852 - DNA, 13 bp, D. melanogaster
ataacaaaaatgg

SEQ ID NO: 581853 - DNA, 13 bp, D. melanogaster
ataacaaaaggca

SEQ ID NO: 581854 - DNA, 14 bp, D. melanogaster
ataacaaaagtgcc

SEQ ID NO: 581855 - DNA, 13 bp, D. melanogaster
ataacaaaagttt

SEQ ID NO: 581856 - DNA, 13 bp, D. melanogaster
ataacaaaattgt

SEQ ID NO: 581857 - DNA, 13 bp, D. melanogaster
ataacaaacagca

SEQ ID NO: 581858 - DNA, 13 bp, D. melanogaster
ataacaaatgcat

SEQ ID NO: 581859 - DNA, 13 bp, D. melanogaster
ataacaaattgtt

SEQ ID NO: 581860 - DNA, 13 bp, D. melanogaster
ataacaacaaatg

SEQ ID NO: 581861 - DNA, 13 bp, D. melanogaster
ataacaacagcaa

SEQ ID NO: 581862 - DNA, 13 bp, D. melanogaster
ataacaagattat

SEQ ID NO: 581863 - DNA, 14 bp, D. melanogaster
ataacaagcaaaca

SEQ ID NO: 581864 - DNA, 13 bp, D. melanogaster
ataacaagtattt

SEQ ID NO: 581865 - DNA, 13 bp, D. melanogaster
ataacaagtgtct

SEQ ID NO: 581866 - DNA, 13 bp, D. melanogaster
ataacaataaatg

SEQ ID NO: 581867 - DNA, 13 bp, D. melanogaster
ataacaataacga

SEQ ID NO: 581868 - DNA, 13 bp, D. melanogaster
ataacaataactt

SEQ ID NO: 581869 - DNA, 13 bp, D. melanogaster
ataacaataatga

SEQ ID NO: 581870 - DNA, 13 bp, D. melanogaster
ataacaatagcaa

SEQ ID NO: 581871 - DNA, 13 bp, D. melanogaster
ataacaatgataa

SEQ ID NO: 581872 - DNA, 13 bp, D. melanogaster
ataacaatgccag

SEQ ID NO: 581873 - DNA, 13 bp, D. melanogaster
ataacaattacca

SEQ ID NO: 581874 - DNA, 13 bp, D. melanogaster
ataacacatattt

SEQ ID NO: 581875 - DNA, 13 bp, D. melanogaster
ataacacatttgt

SEQ ID NO: 581876 - DNA, 13 bp, D. melanogaster
ataacaccggaaa

SEQ ID NO: 581877 - DNA, 13 bp, D. melanogaster
ataacagaaagta

SEQ ID NO: 581878 - DNA, 13 bp, D. melanogaster
ataacatagatga

SEQ ID NO: 581879 - DNA, 13 bp, D. melanogaster
ataacatagtaat

SEQ ID NO: 581880 - DNA, 13 bp, D. melanogaster
ataacatcaacag

SEQ ID NO: 581881 - DNA, 13 bp, D. melanogaster
ataacatcatcat

SEQ ID NO: 581882 - DNA, 13 bp, D. melanogaster
ataacatccaagg

SEQ ID NO: 581883 - DNA, 14 bp, D. melanogaster
ataacatgaagtta

SEQ ID NO: 581884 - DNA, 13 bp, D. melanogaster
ataacattacatt

SEQ ID NO: 581885 - DNA, 13 bp, D. melanogaster
ataacattgaaaa

SEQ ID NO: 581886 - DNA, 13 bp, D. melanogaster
ataacattgaatc

SEQ ID NO: 581887 - DNA, 13 bp, D. melanogaster
ataacatttaatg

SEQ ID NO: 581888 - DNA, 13 bp, D. melanogaster
ataacatttacat

SEQ ID NO: 581889 - DNA, 13 bp, D. melanogaster
ataacatttgatt

SEQ ID NO: 581890 - DNA, 13 bp, D. melanogaster
ataacatttgcat

SEQ ID NO: 581891 - DNA, 13 bp, D. melanogaster
ataacattttatg

SEQ ID NO: 581892 - DNA, 13 bp, D. melanogaster
ataacattttcaa

SEQ ID NO: 581893 - DNA, 14 bp, D. melanogaster
ataacattttcaaa

SEQ ID NO: 581894 - DNA, 13 bp, D. melanogaster
ataacattttgaa

SEQ ID NO: 581895 - DNA, 13 bp, D. melanogaster
ataaccacaacat

SEQ ID NO: 581896 - DNA, 13 bp, D. melanogaster
ataaccacagatg

SEQ ID NO: 581897 - DNA, 13 bp, D. melanogaster
ataaccacatcat

SEQ ID NO: 581898 - DNA, 13 bp, D. melanogaster
ataaccaccagtt

SEQ ID NO: 581899 - DNA, 13 bp, D. melanogaster
ataaccagacaaa

SEQ ID NO: 581900 - DNA, 13 bp, D. melanogaster
ataaccataacca

SEQ ID NO: 581901 - DNA, 14 bp, D. melanogaster
ataaccataaccat

SEQ ID NO: 581902 - DNA, 13 bp, D. melanogaster
ataaccatattgc

SEQ ID NO: 581903 - DNA, 13 bp, D. melanogaster
ataaccatcaaag

SEQ ID NO: 581904 - DNA, 13 bp, D. melanogaster
ataaccatttaat

SEQ ID NO: 581905 - DNA, 15 bp, D. melanogaster
ataaccgaattggaa

SEQ ID NO: 581906 - DNA, 13 bp, D. melanogaster
ataaccgccgagc

SEQ ID NO: 581907 - DNA, 13 bp, D. melanogaster
ataacctggccaa

SEQ ID NO: 581908 - DNA, 13 bp, D. melanogaster
ataacctgttgta

SEQ ID NO: 581909 - DNA, 14 bp, D. melanogaster
ataacctttgctag

SEQ ID NO: 581910 - DNA, 13 bp, D. melanogaster
ataacgaaatcaa

SEQ ID NO: 581911 - DNA, 13 bp, D. melanogaster
ataacgaaattaa

SEQ ID NO: 581912 - DNA, 13 bp, D. melanogaster
ataacgaagaaag

SEQ ID NO: 581913 - DNA, 13 bp, D. melanogaster
ataacgaatttat

SEQ ID NO: 581914 - DNA, 13 bp, D. melanogaster
ataacgataacga

SEQ ID NO: 581915 - DNA, 14 bp, D. melanogaster
ataacgataacgat

SEQ ID NO: 581916 - DNA, 14 bp, D. melanogaster
ataacgccaagcac

SEQ ID NO: 581917 - DNA, 13 bp, D. melanogaster
ataacggccagca

SEQ ID NO: 581918 - DNA, 13 bp, D. melanogaster
ataacggttatta

SEQ ID NO: 581919 - DNA, 13 bp, D. melanogaster
ataacgtaaaaat

SEQ ID NO: 581920 - DNA, 13 bp, D. melanogaster
ataacgtaaagaa

SEQ ID NO: 581921 - DNA, 14 bp, D. melanogaster
ataacgtaaagaaa

SEQ ID NO: 581922 - DNA, 13 bp, D. melanogaster
ataacgtaataac

SEQ ID NO: 581923 - DNA, 13 bp, D. melanogaster
ataacgtatacgc

SEQ ID NO: 581924 - DNA, 13 bp, D. melanogaster
ataacgtatccca

SEQ ID NO: 581925 - DNA, 13 bp, D. melanogaster
ataacgttaaaca

SEQ ID NO: 581926 - DNA, 13 bp, D. melanogaster
ataactaaacttt

SEQ ID NO: 581927 - DNA, 13 bp, D. melanogaster
ataactacaatat

SEQ ID NO: 581928 - DNA, 13 bp, D. melanogaster
ataactataacta

SEQ ID NO: 581929 - DNA, 14 bp, D. melanogaster
ataactataactat

SEQ ID NO: 581930 - DNA, 13 bp, D. melanogaster
ataactatgcacc

SEQ ID NO: 581931 - DNA, 13 bp, D. melanogaster
ataactccaagaa

SEQ ID NO: 581932 - DNA, 13 bp, D. melanogaster
ataactccatttt

SEQ ID NO: 581933 - DNA, 13 bp, D. melanogaster
ataactcctacaa

SEQ ID NO: 581934 - DNA, 13 bp, D. melanogaster
ataactctaagtt

SEQ ID NO: 581935 - DNA, 13 bp, D. melanogaster
ataactgaaaatg

SEQ ID NO: 581936 - DNA, 13 bp, D. melanogaster
ataactgaaaatt

SEQ ID NO: 581937 - DNA, 13 bp, D. melanogaster
ataactggaaata

SEQ ID NO: 581938 - DNA, 13 bp, D. melanogaster
ataacttaaccat

SEQ ID NO: 581939 - DNA, 13 bp, D. melanogaster
ataacttaactta

SEQ ID NO: 581940 - DNA, 14 bp, D. melanogaster
ataacttaataact

SEQ ID NO: 581941 - DNA, 13 bp, D. melanogaster
ataacttacttaa

SEQ ID NO: 581942 - DNA, 14 bp, D. melanogaster
ataacttagttagt

SEQ ID NO: 581943 - DNA, 14 bp, D. melanogaster
ataacttcaaaatt

SEQ ID NO: 581944 - DNA, 13 bp, D. melanogaster
ataacttcataaa

SEQ ID NO: 581945 - DNA, 14 bp, D. melanogaster
ataacttcatattt

SEQ ID NO: 581946 - DNA, 13 bp, D. melanogaster
ataacttcatgtt

SEQ ID NO: 581947 - DNA, 13 bp, D. melanogaster
ataacttcatttc

SEQ ID NO: 581948 - DNA, 14 bp, D. melanogaster
ataacttcgatttc

SEQ ID NO: 581949 - DNA, 13 bp, D. melanogaster
ataacttgaaagt

SEQ ID NO: 581950 - DNA, 13 bp, D. melanogaster
ataacttgaaggc

SEQ ID NO: 581951 - DNA, 13 bp, D. melanogaster
ataacttgaataa

SEQ ID NO: 581952 - DNA, 13 bp, D. melanogaster
ataacttggtcaa

SEQ ID NO: 581953 - DNA, 14 bp, D. melanogaster
ataactttacaact

SEQ ID NO: 581954 - DNA, 13 bp, D. melanogaster
ataactttacact

SEQ ID NO: 581955 - DNA, 13 bp, D. melanogaster
ataactttgaatt

SEQ ID NO: 581956 - DNA, 13 bp, D. melanogaster
ataactttgattt

SEQ ID NO: 581957 - DNA, 13 bp, D. melanogaster
ataactttggcaa

SEQ ID NO: 581958 - DNA, 13 bp, D. melanogaster
ataacttttcaaa

SEQ ID NO: 581959 - DNA, 13 bp, D. melanogaster
ataacttttgcaa

SEQ ID NO: 581960 - DNA, 14 bp, D. melanogaster
ataacttttgcaaa

SEQ ID NO: 581961 - DNA, 13 bp, D. melanogaster
ataagaaaacatt

SEQ ID NO: 581962 - DNA, 13 bp, D. melanogaster
ataagaaaatgtt

SEQ ID NO: 581963 - DNA, 13 bp, D. melanogaster
ataagaaactgta

SEQ ID NO: 581964 - DNA, 13 bp, D. melanogaster
ataagaaatacat

SEQ ID NO: 581965 - DNA, 13 bp, D. melanogaster
ataagaaatctaa

SEQ ID NO: 581966 - DNA, 13 bp, D. melanogaster
ataagaaattctc

SEQ ID NO: 581967 - DNA, 14 bp, D. melanogaster
ataagaacaatata

SEQ ID NO: 581968 - DNA, 13 bp, D. melanogaster
ataagaaggattt

SEQ ID NO: 581969 - DNA, 13 bp, D. melanogaster
ataagaatatttg

SEQ ID NO: 581970 - DNA, 13 bp, D. melanogaster
ataagacggagga

SEQ ID NO: 581971 - DNA, 14 bp, D. melanogaster
ataagactgtattt

SEQ ID NO: 581972 - DNA, 13 bp, D. melanogaster
ataagatatacat

SEQ ID NO: 581973 - DNA, 13 bp, D. melanogaster
ataagatattact

SEQ ID NO: 581974 - DNA, 14 bp, D. melanogaster
ataagattggaccc

SEQ ID NO: 581975 - DNA, 13 bp, D. melanogaster
ataagcaaaacat

SEQ ID NO: 581976 - DNA, 13 bp, D. melanogaster
ataagcaaaattt

SEQ ID NO: 581977 - DNA, 13 bp, D. melanogaster
ataagcaaacagc

SEQ ID NO: 581978 - DNA, 13 bp, D. melanogaster
ataagcaaacgaa

SEQ ID NO: 581979 - DNA, 13 bp, D. melanogaster
ataagcaaactaa

SEQ ID NO: 581980 - DNA, 14 bp, D. melanogaster
ataagcaaataaat

SEQ ID NO: 581981 - DNA, 13 bp, D. melanogaster
ataagcaaataag

SEQ ID NO: 581982 - DNA, 13 bp, D. melanogaster
ataagcaaatatt

SEQ ID NO: 581983 - DNA, 13 bp, D. melanogaster
ataagcaactggg

SEQ ID NO: 581984 - DNA, 13 bp, D. melanogaster
ataagcaattaaa

SEQ ID NO: 581985 - DNA, 13 bp, D. melanogaster
ataagcacaaatc

SEQ ID NO: 581986 - DNA, 13 bp, D. melanogaster
ataagcagaaaat

SEQ ID NO: 581987 - DNA, 13 bp, D. melanogaster
ataagcataagca

SEQ ID NO: 581988 - DNA, 13 bp, D. melanogaster
ataagcataataa

SEQ ID NO: 581989 - DNA, 13 bp, D. melanogaster
ataagcataattt

SEQ ID NO: 581990 - DNA, 13 bp, D. melanogaster
ataagcatattta

SEQ ID NO: 581991 - DNA, 13 bp, D. melanogaster
ataagcatttatt

SEQ ID NO: 581992 - DNA, 13 bp, D. melanogaster
ataagccaaaata

SEQ ID NO: 581993 - DNA, 13 bp, D. melanogaster
ataagccacaaaa

SEQ ID NO: 581994 - DNA, 13 bp, D. melanogaster
ataagcccaaaat

SEQ ID NO: 581995 - DNA, 13 bp, D. melanogaster
ataagcgaataaa

SEQ ID NO: 581996 - DNA, 13 bp, D. melanogaster
ataagcgagcagc

SEQ ID NO: 581997 - DNA, 13 bp, D. melanogaster
ataagcgtcagct

SEQ ID NO: 581998 - DNA, 13 bp, D. melanogaster
ataagctaaataa

SEQ ID NO: 581999 - DNA, 13 bp, D. melanogaster
ataagctactgaa

SEQ ID NO: 582000 - DNA, 13 bp, D. melanogaster
ataagctcgaaaa

SEQ ID NO: 582001 - DNA, 13 bp, D. melanogaster
ataagctgcaaaa

SEQ ID NO: 582002 - DNA, 14 bp, D. melanogaster
ataagctgcaacaa

SEQ ID NO: 582003 - DNA, 13 bp, D. melanogaster
ataagctggccaa

SEQ ID NO: 582004 - DNA, 13 bp, D. melanogaster
ataagcttaaata

SEQ ID NO: 582005 - DNA, 13 bp, D. melanogaster
ataagcttaataa

SEQ ID NO: 582006 - DNA, 13 bp, D. melanogaster
ataagcttatata

SEQ ID NO: 582007 - DNA, 13 bp, D. melanogaster
ataagctttaaaa

SEQ ID NO: 582008 - DNA, 13 bp, D. melanogaster
ataagctttaatt

SEQ ID NO: 582009 - DNA, 13 bp, D. melanogaster
ataaggaaacatt

SEQ ID NO: 582010 - DNA, 13 bp, D. melanogaster
ataaggaagaagt

SEQ ID NO: 582011 - DNA, 13 bp, D. melanogaster
ataaggaatcaat

SEQ ID NO: 582012 - DNA, 13 bp, D. melanogaster
ataaggcaaatat

SEQ ID NO: 582013 - DNA, 15 bp, D. melanogaster
ataaggcaatgattg

SEQ ID NO: 582014 - DNA, 13 bp, D. melanogaster
ataaggcactgtt

SEQ ID NO: 582015 - DNA, 13 bp, D. melanogaster
ataagggaaaatt

SEQ ID NO: 582016 - DNA, 13 bp, D. melanogaster
ataaggtccgagt

SEQ ID NO: 582017 - DNA, 13 bp, D. melanogaster
ataaggttctcaa

SEQ ID NO: 582018 - DNA, 13 bp, D. melanogaster
ataagtaaaactg

SEQ ID NO: 582019 - DNA, 14 bp, D. melanogaster
ataagtaaatatgt

SEQ ID NO: 582020 - DNA, 13 bp, D. melanogaster
ataagtaaatcat

SEQ ID NO: 582021 - DNA, 13 bp, D. melanogaster
ataagtaacgtga

SEQ ID NO: 582022 - DNA, 13 bp, D. melanogaster
ataagtaagtaag

SEQ ID NO: 582023 - DNA, 13 bp, D. melanogaster
ataagtaataagt

SEQ ID NO: 582024 - DNA, 13 bp, D. melanogaster
ataagtacacaac

SEQ ID NO: 582025 - DNA, 13 bp, D. melanogaster
ataagtacatatt

SEQ ID NO: 582026 - DNA, 13 bp, D. melanogaster
ataagtataagta

SEQ ID NO: 582027 - DNA, 13 bp, D. melanogaster
ataagtataatga

SEQ ID NO: 582028 - DNA, 13 bp, D. melanogaster
ataagtatacata

SEQ ID NO: 582029 - DNA, 13 bp, D. melanogaster
ataagtatatatg

SEQ ID NO: 582030 - DNA, 13 bp, D. melanogaster
ataagtatatgta

SEQ ID NO: 582031 - DNA, 13 bp, D. melanogaster
ataagtatttcat

SEQ ID NO: 582032 - DNA, 13 bp, D. melanogaster
ataagtatttgga

SEQ ID NO: 582033 - DNA, 13 bp, D. melanogaster
ataagtcattaaa

SEQ ID NO: 582034 - DNA, 13 bp, D. melanogaster
ataagtctgtgaa

SEQ ID NO: 582035 - DNA, 13 bp, D. melanogaster
ataagtgaaaatt

SEQ ID NO: 582036 - DNA, 13 bp, D. melanogaster
ataagtgaaatat

SEQ ID NO: 582037 - DNA, 13 bp, D. melanogaster
ataagtgaattgt

SEQ ID NO: 582038 - DNA, 13 bp, D. melanogaster
ataagtgcattgc

SEQ ID NO: 582039 - DNA, 13 bp, D. melanogaster
ataagtggaaaat

SEQ ID NO: 582040 - DNA, 13 bp, D. melanogaster
ataagtggcaaaa

SEQ ID NO: 582041 - DNA, 13 bp, D. melanogaster
ataagtggcagtg

SEQ ID NO: 582042 - DNA, 14 bp, D. melanogaster
ataagtgtgtgtgt

SEQ ID NO: 582043 - DNA, 13 bp, D. melanogaster
ataagttaatatg

SEQ ID NO: 582044 - DNA, 13 bp, D. melanogaster
ataagttataagt

SEQ ID NO: 582045 - DNA, 13 bp, D. melanogaster
ataagttcataaa

SEQ ID NO: 582046 - DNA, 13 bp, D. melanogaster
ataagttcgtcaa

SEQ ID NO: 582047 - DNA, 13 bp, D. melanogaster
ataagttgtagca

SEQ ID NO: 582048 - DNA, 13 bp, D. melanogaster
ataagtttatgtt

SEQ ID NO: 582049 - DNA, 13 bp, D. melanogaster
ataagtttgaaaa

SEQ ID NO: 582050 - DNA, 13 bp, D. melanogaster
ataagttttgtaa

SEQ ID NO: 582051 - DNA, 13 bp, D. melanogaster
ataagtttttcaa

SEQ ID NO: 582052 - DNA, 13 bp, D. melanogaster
ataataaaaacgc

SEQ ID NO: 582053 - DNA, 13 bp, D. melanogaster
ataataaaaatgc

SEQ ID NO: 582054 - DNA, 13 bp, D. melanogaster
ataataaaagcca

SEQ ID NO: 582055 - DNA, 13 bp, D. melanogaster
ataataaaatgct

SEQ ID NO: 582056 - DNA, 14 bp, D. melanogaster
ataataaacaaatg

SEQ ID NO: 582057 - DNA, 13 bp, D. melanogaster
ataataaacgaat

SEQ ID NO: 582058 - DNA, 13 bp, D. melanogaster
ataataaactgaa

SEQ ID NO: 582059 - DNA, 13 bp, D. melanogaster
ataataaagcaat

SEQ ID NO: 582060 - DNA, 13 bp, D. melanogaster
ataataaagtgta

SEQ ID NO: 582061 - DNA, 13 bp, D. melanogaster
ataataaatgcat

SEQ ID NO: 582062 - DNA, 13 bp, D. melanogaster
ataataaatgttc

SEQ ID NO: 582063 - DNA, 13 bp, D. melanogaster
ataataaattcca

SEQ ID NO: 582064 - DNA, 13 bp, D. melanogaster
ataataaatttgc

SEQ ID NO: 582065 - DNA, 14 bp, D. melanogaster
ataataaatttgcc

SEQ ID NO: 582066 - DNA, 13 bp, D. melanogaster
ataataacaaagt

SEQ ID NO: 582067 - DNA, 13 bp, D. melanogaster
ataataacaaatg

SEQ ID NO: 582068 - DNA, 13 bp, D. melanogaster
ataataacaacag

SEQ ID NO: 582069 - DNA, 13 bp, D. melanogaster
ataataacattga

SEQ ID NO: 582070 - DNA, 13 bp, D. melanogaster
ataataacctgtt

SEQ ID NO: 582071 - DNA, 13 bp, D. melanogaster
ataataagcataa

SEQ ID NO: 582072 - DNA, 13 bp, D. melanogaster
ataataataaacg

SEQ ID NO: 582073 - DNA, 16 bp, D. melanogaster
ataataataacgttaa

SEQ ID NO: 582074 - DNA, 14 bp, D. melanogaster
ataataataagcaa

SEQ ID NO: 582075 - DNA, 13 bp, D. melanogaster
ataataataatcg

SEQ ID NO: 582076 - DNA, 14 bp, D. melanogaster
ataataataatgac

SEQ ID NO: 582077 - DNA, 14 bp, D. melanogaster
ataataataatgct

SEQ ID NO: 582078 - DNA, 14 bp, D. melanogaster
ataataataattcg

SEQ ID NO: 582079 - DNA, 13 bp, D. melanogaster
ataataatacaag

SEQ ID NO: 582080 - DNA, 13 bp, D. melanogaster
ataataataccat

SEQ ID NO: 582081 - DNA, 13 bp, D. melanogaster
ataataatacgaa

SEQ ID NO: 582082 - DNA, 13 bp, D. melanogaster
ataataatactac

SEQ ID NO: 582083 - DNA, 13 bp, D. melanogaster
ataataatagaac

SEQ ID NO: 582084 - DNA, 13 bp, D. melanogaster
ataataatcgcaa

SEQ ID NO: 582085 - DNA, 13 bp, D. melanogaster
ataataatgaaac

SEQ ID NO: 582086 - DNA, 13 bp, D. melanogaster
ataataatgacac

SEQ ID NO: 582087 - DNA, 13 bp, D. melanogaster
ataataatgagca

SEQ ID NO: 582088 - DNA, 13 bp, D. melanogaster
ataataatgatca

SEQ ID NO: 582089 - DNA, 13 bp, D. melanogaster
ataataatgatga

SEQ ID NO: 582090 - DNA, 14 bp, D. melanogaster
ataataatgatgat

SEQ ID NO: 582091 - DNA, 13 bp, D. melanogaster
ataataatgcaaa

SEQ ID NO: 582092 - DNA, 14 bp, D. melanogaster
ataataatgcaaaa

SEQ ID NO: 582093 - DNA, 13 bp, D. melanogaster
ataataatgcaat

SEQ ID NO: 582094 - DNA, 13 bp, D. melanogaster
ataataatgttga

SEQ ID NO: 582095 - DNA, 13 bp, D. melanogaster
ataataatgttgt

SEQ ID NO: 582096 - DNA, 13 bp, D. melanogaster
ataataatgtttg

SEQ ID NO: 582097 - DNA, 13 bp, D. melanogaster
ataataattatgg

SEQ ID NO: 582098 - DNA, 13 bp, D. melanogaster
ataataattccat

SEQ ID NO: 582099 - DNA, 13 bp, D. melanogaster
ataataatttcct

SEQ ID NO: 582100 - DNA, 14 bp, D. melanogaster
ataataatttcctt

SEQ ID NO: 582101 - DNA, 13 bp, D. melanogaster
ataatacaaaatg

SEQ ID NO: 582102 - DNA, 13 bp, D. melanogaster
ataatacaaatgt

SEQ ID NO: 582103 - DNA, 13 bp, D. melanogaster
ataatacaaattg

SEQ ID NO: 582104 - DNA, 13 bp, D. melanogaster
ataatacagaaat

SEQ ID NO: 582105 - DNA, 13 bp, D. melanogaster
ataatacagtttt

SEQ ID NO: 582106 - DNA, 13 bp, D. melanogaster
ataatacatatgt

SEQ ID NO: 582107 - DNA, 13 bp, D. melanogaster
ataatacattttc

SEQ ID NO: 582108 - DNA, 13 bp, D. melanogaster
ataataccgaaaa

SEQ ID NO: 582109 - DNA, 14 bp, D. melanogaster
ataataccgaaaat

SEQ ID NO: 582110 - DNA, 13 bp, D. melanogaster
ataatacgaaaat

SEQ ID NO: 582111 - DNA, 13 bp, D. melanogaster
ataatacgaataa

SEQ ID NO: 582112 - DNA, 13 bp, D. melanogaster
ataatactaattg

SEQ ID NO: 582113 - DNA, 13 bp, D. melanogaster
ataatacttcagt

SEQ ID NO: 582114 - DNA, 13 bp, D. melanogaster
ataatagaagtta

SEQ ID NO: 582115 - DNA, 13 bp, D. melanogaster
ataatagcaacaa

SEQ ID NO: 582116 - DNA, 13 bp, D. melanogaster
ataatagcaacat

SEQ ID NO: 582117 - DNA, 13 bp, D. melanogaster
ataataggaatgt

SEQ ID NO: 582118 - DNA, 13 bp, D. melanogaster
ataatagtataga

SEQ ID NO: 582119 - DNA, 13 bp, D. melanogaster
ataatagtttctt

SEQ ID NO: 582120 - DNA, 14 bp, D. melanogaster
ataatagtttctta

SEQ ID NO: 582121 - DNA, 13 bp, D. melanogaster
ataatataatgca

SEQ ID NO: 582122 - DNA, 13 bp, D. melanogaster
ataatatataagc

SEQ ID NO: 582123 - DNA, 13 bp, D. melanogaster
ataatatatacac

SEQ ID NO: 582124 - DNA, 13 bp, D. melanogaster
ataatatatgtgt

SEQ ID NO: 582125 - DNA, 13 bp, D. melanogaster
ataatatcatcaa

SEQ ID NO: 582126 - DNA, 13 bp, D. melanogaster
ataatatcgaaat

SEQ ID NO: 582127 - DNA, 13 bp, D. melanogaster
ataatatcgatat

SEQ ID NO: 582128 - DNA, 13 bp, D. melanogaster
ataatatgaatca

SEQ ID NO: 582129 - DNA, 13 bp, D. melanogaster
ataatatgtacat

SEQ ID NO: 582130 - DNA, 14 bp, D. melanogaster
ataatatgtacata

SEQ ID NO: 582131 - DNA, 14 bp, D. melanogaster
ataatatgtatgta

SEQ ID NO: 582132 - DNA, 13 bp, D. melanogaster
ataatattccatt

SEQ ID NO: 582133 - DNA, 13 bp, D. melanogaster
ataatattgtaca

SEQ ID NO: 582134 - DNA, 13 bp, D. melanogaster
ataatatttctgt

SEQ ID NO: 582135 - DNA, 13 bp, D. melanogaster
ataatatttggaa

SEQ ID NO: 582136 - DNA, 13 bp, D. melanogaster
ataatatttggtt

SEQ ID NO: 582137 - DNA, 13 bp, D. melanogaster
ataatatttgtac

SEQ ID NO: 582138 - DNA, 13 bp, D. melanogaster
ataatattttcag

SEQ ID NO: 582139 - DNA, 13 bp, D. melanogaster
ataatcaaaaagt

SEQ ID NO: 582140 - DNA, 13 bp, D. melanogaster
ataatcaaaaatg

SEQ ID NO: 582141 - DNA, 13 bp, D. melanogaster
ataatcaaaagca

SEQ ID NO: 582142 - DNA, 13 bp, D. melanogaster
ataatcaaaagta

SEQ ID NO: 582143 - DNA, 13 bp, D. melanogaster
ataatcaaacatt

SEQ ID NO: 582144 - DNA, 13 bp, D. melanogaster
ataatcaaattgt

SEQ ID NO: 582145 - DNA, 13 bp, D. melanogaster
ataatcaagtcgt

SEQ ID NO: 582146 - DNA, 13 bp, D. melanogaster
ataatcaatcata

SEQ ID NO: 582147 - DNA, 13 bp, D. melanogaster
ataatcaattcat

SEQ ID NO: 582148 - DNA, 13 bp, D. melanogaster
ataatcacattaa

SEQ ID NO: 582149 - DNA, 13 bp, D. melanogaster
ataatcagttttt

SEQ ID NO: 582150 - DNA, 13 bp, D. melanogaster
ataatcataatca

SEQ ID NO: 582151 - DNA, 14 bp, D. melanogaster
ataatcataatcat

SEQ ID NO: 582152 - DNA, 13 bp, D. melanogaster
ataatcataatga

SEQ ID NO: 582153 - DNA, 13 bp, D. melanogaster
ataatcatcataa

SEQ ID NO: 582154 - DNA, 14 bp, D. melanogaster
ataatcatcataat

SEQ ID NO: 582155 - DNA, 13 bp, D. melanogaster
ataatcatccaat

SEQ ID NO: 582156 - DNA, 13 bp, D. melanogaster
ataatccaaaacg

SEQ ID NO: 582157 - DNA, 13 bp, D. melanogaster
ataatccaaaatg

SEQ ID NO: 582158 - DNA, 13 bp, D. melanogaster
ataatccaactaa

SEQ ID NO: 582159 - DNA, 13 bp, D. melanogaster
ataatccaagttg

SEQ ID NO: 582160 - DNA, 13 bp, D. melanogaster
ataatccaattaa

SEQ ID NO: 582161 - DNA, 13 bp, D. melanogaster
ataatccagcaga

SEQ ID NO: 582162 - DNA, 13 bp, D. melanogaster
ataatccatttaa

SEQ ID NO: 582163 - DNA, 13 bp, D. melanogaster
ataatcccattta

SEQ ID NO: 582164 - DNA, 13 bp, D. melanogaster
ataatccgttttt

SEQ ID NO: 582165 - DNA, 13 bp, D. melanogaster
ataatcgaaacaa

SEQ ID NO: 582166 - DNA, 13 bp, D. melanogaster
ataatcgaataat

SEQ ID NO: 582167 - DNA, 13 bp, D. melanogaster
ataatcgattttt

SEQ ID NO: 582168 - DNA, 13 bp, D. melanogaster
ataatcgcaagtg

SEQ ID NO: 582169 - DNA, 13 bp, D. melanogaster
ataatctagttat

SEQ ID NO: 582170 - DNA, 14 bp, D. melanogaster
ataatctagttatg

SEQ ID NO: 582171 - DNA, 13 bp, D. melanogaster
ataatctattgaa

SEQ ID NO: 582172 - DNA, 13 bp, D. melanogaster
ataatctcaacat

SEQ ID NO: 582173 - DNA, 13 bp, D. melanogaster
ataatcttttgtt

SEQ ID NO: 582174 - DNA, 13 bp, D. melanogaster
ataatgaaaaatc

SEQ ID NO: 582175 - DNA, 13 bp, D. melanogaster
ataatgaaaacca

SEQ ID NO: 582176 - DNA, 13 bp, D. melanogaster
ataatgaaaactt

SEQ ID NO: 582177 - DNA, 13 bp, D. melanogaster
ataatgaaaagca

SEQ ID NO: 582178 - DNA, 13 bp, D. melanogaster
ataatgaaacaat

SEQ ID NO: 582179 - DNA, 13 bp, D. melanogaster
ataatgaaagcaa

SEQ ID NO: 582180 - DNA, 13 bp, D. melanogaster
ataatgaaatcag

SEQ ID NO: 582181 - DNA, 13 bp, D. melanogaster
ataatgaaattga

SEQ ID NO: 582182 - DNA, 13 bp, D. melanogaster
ataatgaaattgt

SEQ ID NO: 582183 - DNA, 13 bp, D. melanogaster
ataatgaaatttc

SEQ ID NO: 582184 - DNA, 13 bp, D. melanogaster
ataatgaacaaat

SEQ ID NO: 582185 - DNA, 13 bp, D. melanogaster
ataatgaacatgc

SEQ ID NO: 582186 - DNA, 13 bp, D. melanogaster
ataatgaagagga

SEQ ID NO: 582187 - DNA, 13 bp, D. melanogaster
ataatgaagctac

SEQ ID NO: 582188 - DNA, 13 bp, D. melanogaster
ataatgaataatg

SEQ ID NO: 582189 - DNA, 13 bp, D. melanogaster
ataatgaatccag

SEQ ID NO: 582190 - DNA, 13 bp, D. melanogaster
ataatgaatggca

SEQ ID NO: 582191 - DNA, 13 bp, D. melanogaster
ataatgaattcat

SEQ ID NO: 582192 - DNA, 13 bp, D. melanogaster
ataatgacaatga

SEQ ID NO: 582193 - DNA, 13 bp, D. melanogaster
ataatgacgatga

SEQ ID NO: 582194 - DNA, 13 bp, D. melanogaster
ataatgagtgaaa

SEQ ID NO: 582195 - DNA, 13 bp, D. melanogaster
ataatgataatga

SEQ ID NO: 582196 - DNA, 14 bp, D. melanogaster
ataatgataatgat

SEQ ID NO: 582197 - DNA, 13 bp, D. melanogaster
ataatgataatgc

SEQ ID NO: 582198 - DNA, 13 bp, D. melanogaster
ataatgataatgg

SEQ ID NO: 582199 - DNA, 14 bp, D. melanogaster
ataatgatcaaaaa

SEQ ID NO: 582200 - DNA, 13 bp, D. melanogaster
ataatgatgaaat

SEQ ID NO: 582201 - DNA, 13 bp, D. melanogaster
ataatgatgataa

SEQ ID NO: 582202 - DNA, 13 bp, D. melanogaster
ataatgatgatga

SEQ ID NO: 582203 - DNA, 13 bp, D. melanogaster
ataatgatgatgt

SEQ ID NO: 582204 - DNA, 13 bp, D. melanogaster
ataatgatgccgc

SEQ ID NO: 582205 - DNA, 13 bp, D. melanogaster
ataatgattatga

SEQ ID NO: 582206 - DNA, 13 bp, D. melanogaster
ataatgcaaaaca

SEQ ID NO: 582207 - DNA, 13 bp, D. melanogaster
ataatgcaaatgg

SEQ ID NO: 582208 - DNA, 13 bp, D. melanogaster
ataatgcaataat

SEQ ID NO: 582209 - DNA, 13 bp, D. melanogaster
ataatgcaattaa

SEQ ID NO: 582210 - DNA, 13 bp, D. melanogaster
ataatgcagatat

SEQ ID NO: 582211 - DNA, 14 bp, D. melanogaster
ataatgcagatatc

SEQ ID NO: 582212 - DNA, 13 bp, D. melanogaster
ataatgcataaat

SEQ ID NO: 582213 - DNA, 13 bp, D. melanogaster
ataatgcatataa

SEQ ID NO: 582214 - DNA, 13 bp, D. melanogaster
ataatgccaaaaa

SEQ ID NO: 582215 - DNA, 13 bp, D. melanogaster
ataatgccaaaag

SEQ ID NO: 582216 - DNA, 13 bp, D. melanogaster
ataatgccaataa

SEQ ID NO: 582217 - DNA, 13 bp, D. melanogaster
ataatgcccaaag

SEQ ID NO: 582218 - DNA, 13 bp, D. melanogaster
ataatgctaaaaa

SEQ ID NO: 582219 - DNA, 13 bp, D. melanogaster
ataatgctaaaat

SEQ ID NO: 582220 - DNA, 14 bp, D. melanogaster
ataatgctaaaata

SEQ ID NO: 582221 - DNA, 13 bp, D. melanogaster
ataatgctaatta

SEQ ID NO: 582222 - DNA, 13 bp, D. melanogaster
ataatgctgacat

SEQ ID NO: 582223 - DNA, 13 bp, D. melanogaster
ataatgctttaaa

SEQ ID NO: 582224 - DNA, 13 bp, D. melanogaster
ataatggaaacaa

SEQ ID NO: 582225 - DNA, 14 bp, D. melanogaster
ataatggaaacaat

SEQ ID NO: 582226 - DNA, 13 bp, D. melanogaster
ataatggacatgg

SEQ ID NO: 582227 - DNA, 14 bp, D. melanogaster
ataatggacatgga

SEQ ID NO: 582228 - DNA, 13 bp, D. melanogaster
ataatggaggagg

SEQ ID NO: 582229 - DNA, 13 bp, D. melanogaster
ataatggcataaa

SEQ ID NO: 582230 - DNA, 13 bp, D. melanogaster
ataatggccaaaa

SEQ ID NO: 582231 - DNA, 13 bp, D. melanogaster
ataatggctacct

SEQ ID NO: 582232 - DNA, 13 bp, D. melanogaster
ataatggtacaca

SEQ ID NO: 582233 - DNA, 13 bp, D. melanogaster
ataatggtacttg

SEQ ID NO: 582234 - DNA, 13 bp, D. melanogaster
ataatggtccaaa

SEQ ID NO: 582235 - DNA, 14 bp, D. melanogaster
ataatggtgcatac

SEQ ID NO: 582236 - DNA, 13 bp, D. melanogaster
ataatgtacatat

SEQ ID NO: 582237 - DNA, 13 bp, D. melanogaster
ataatgtctttaa

SEQ ID NO: 582238 - DNA, 13 bp, D. melanogaster
ataatgtgaaaat

SEQ ID NO: 582239 - DNA, 13 bp, D. melanogaster
ataatgtgtatat

SEQ ID NO: 582240 - DNA, 13 bp, D. melanogaster
ataatgttaaatg

SEQ ID NO: 582241 - DNA, 13 bp, D. melanogaster
ataatgttgaaat

SEQ ID NO: 582242 - DNA, 14 bp, D. melanogaster
ataatgttggccaa

SEQ ID NO: 582243 - DNA, 13 bp, D. melanogaster
ataatgtttcaat

SEQ ID NO: 582244 - DNA, 13 bp, D. melanogaster
ataattaaagtga

SEQ ID NO: 582245 - DNA, 13 bp, D. melanogaster
ataattaaatgtc

SEQ ID NO: 582246 - DNA, 13 bp, D. melanogaster
ataattaaccatt

SEQ ID NO: 582247 - DNA, 13 bp, D. melanogaster
ataattaagcaaa

SEQ ID NO: 582248 - DNA, 13 bp, D. melanogaster
ataattaatgagc

SEQ ID NO: 582249 - DNA, 13 bp, D. melanogaster
ataattaatgcaa

SEQ ID NO: 582250 - DNA, 13 bp, D. melanogaster
ataattaatggca

SEQ ID NO: 582251 - DNA, 13 bp, D. melanogaster
ataattacaaaag

SEQ ID NO: 582252 - DNA, 13 bp, D. melanogaster
ataattacaatgc

SEQ ID NO: 582253 - DNA, 13 bp, D. melanogaster
ataattacagttt

SEQ ID NO: 582254 - DNA, 13 bp, D. melanogaster
ataattaccgaaa

SEQ ID NO: 582255 - DNA, 14 bp, D. melanogaster
ataattacctacct

SEQ ID NO: 582256 - DNA, 13 bp, D. melanogaster
ataattacgatat

SEQ ID NO: 582257 - DNA, 14 bp, D. melanogaster
ataattactatagt

SEQ ID NO: 582258 - DNA, 14 bp, D. melanogaster
ataattactgacct

SEQ ID NO: 582259 - DNA, 13 bp, D. melanogaster
ataattagaccaa

SEQ ID NO: 582260 - DNA, 13 bp, D. melanogaster
ataattatagaca

SEQ ID NO: 582261 - DNA, 13 bp, D. melanogaster
ataattatgaact

SEQ ID NO: 582262 - DNA, 13 bp, D. melanogaster
ataattatgcaaa

SEQ ID NO: 582263 - DNA, 13 bp, D. melanogaster
ataattattgcaa

SEQ ID NO: 582264 - DNA, 13 bp, D. melanogaster
ataattatttcga

SEQ ID NO: 582265 - DNA, 14 bp, D. melanogaster
ataattcaaaccga

SEQ ID NO: 582266 - DNA, 13 bp, D. melanogaster
ataattcaagaaa

SEQ ID NO: 582267 - DNA, 13 bp, D. melanogaster
ataattcaatcaa

SEQ ID NO: 582268 - DNA, 13 bp, D. melanogaster
ataattcacaaat

SEQ ID NO: 582269 - DNA, 13 bp, D. melanogaster
ataattcagaaaa

SEQ ID NO: 582270 - DNA, 13 bp, D. melanogaster
ataattcagcaaa

SEQ ID NO: 582271 - DNA, 13 bp, D. melanogaster
ataattcattttc

SEQ ID NO: 582272 - DNA, 13 bp, D. melanogaster
ataattccaattt

SEQ ID NO: 582273 - DNA, 14 bp, D. melanogaster
ataattcgaatcaa

SEQ ID NO: 582274 - DNA, 13 bp, D. melanogaster
ataattctgttaa

SEQ ID NO: 582275 - DNA, 13 bp, D. melanogaster
ataattgaaaaac

SEQ ID NO: 582276 - DNA, 13 bp, D. melanogaster
ataattgaaagta

SEQ ID NO: 582277 - DNA, 13 bp, D. melanogaster
ataattgaatgca

SEQ ID NO: 582278 - DNA, 14 bp, D. melanogaster
ataattgaggctct

SEQ ID NO: 582279 - DNA, 14 bp, D. melanogaster
ataattgataattg

SEQ ID NO: 582280 - DNA, 13 bp, D. melanogaster
ataattgcagttt

SEQ ID NO: 582281 - DNA, 14 bp, D. melanogaster
ataattgcataatt

SEQ ID NO: 582282 - DNA, 13 bp, D. melanogaster
ataattgcatata

SEQ ID NO: 582283 - DNA, 13 bp, D. melanogaster
ataattgcattaa

SEQ ID NO: 582284 - DNA, 13 bp, D. melanogaster
ataattgccaaaa

SEQ ID NO: 582285 - DNA, 13 bp, D. melanogaster
ataattgcgaaaa

SEQ ID NO: 582286 - DNA, 13 bp, D. melanogaster
ataattgcttaat

SEQ ID NO: 582287 - DNA, 13 bp, D. melanogaster
ataattggaattt

SEQ ID NO: 582288 - DNA, 13 bp, D. melanogaster
ataattggattaa

SEQ ID NO: 582289 - DNA, 13 bp, D. melanogaster
ataattggcaatt

SEQ ID NO: 582290 - DNA, 13 bp, D. melanogaster
ataattgtaatgt

SEQ ID NO: 582291 - DNA, 13 bp, D. melanogaster
ataattgtacaac

SEQ ID NO: 582292 - DNA, 13 bp, D. melanogaster
ataattgtacata

SEQ ID NO: 582293 - DNA, 13 bp, D. melanogaster
ataattgtattgg

SEQ ID NO: 582294 - DNA, 13 bp, D. melanogaster
ataattgtgaaaa

SEQ ID NO: 582295 - DNA, 13 bp, D. melanogaster
ataattgtgcttt

SEQ ID NO: 582296 - DNA, 13 bp, D. melanogaster
ataattgtttctt

SEQ ID NO: 582297 - DNA, 13 bp, D. melanogaster
ataattgttttac

SEQ ID NO: 582298 - DNA, 13 bp, D. melanogaster
ataatttaacatc

SEQ ID NO: 582299 - DNA, 13 bp, D. melanogaster
ataatttaagttg

SEQ ID NO: 582300 - DNA, 13 bp, D. melanogaster
ataatttacaatg

SEQ ID NO: 582301 - DNA, 13 bp, D. melanogaster
ataatttacacaa

SEQ ID NO: 582302 - DNA, 13 bp, D. melanogaster
ataatttagccaa

SEQ ID NO: 582303 - DNA, 13 bp, D. melanogaster
ataatttagtttg

SEQ ID NO: 582304 - DNA, 13 bp, D. melanogaster
ataatttatatgg

SEQ ID NO: 582305 - DNA, 13 bp, D. melanogaster
ataatttatgact

SEQ ID NO: 582306 - DNA, 13 bp, D. melanogaster
ataatttatgcaa

SEQ ID NO: 582307 - DNA, 14 bp, D. melanogaster
ataatttatgcaat

SEQ ID NO: 582308 - DNA, 13 bp, D. melanogaster
ataatttatgcca

SEQ ID NO: 582309 - DNA, 13 bp, D. melanogaster
ataatttatgcgc

SEQ ID NO: 582310 - DNA, 13 bp, D. melanogaster
ataatttattagc

SEQ ID NO: 582311 - DNA, 13 bp, D. melanogaster
ataatttattcgc

SEQ ID NO: 582312 - DNA, 13 bp, D. melanogaster
ataatttattgca

SEQ ID NO: 582313 - DNA, 13 bp, D. melanogaster
ataatttattgcc

SEQ ID NO: 582314 - DNA, 13 bp, D. melanogaster
ataatttattgtc

SEQ ID NO: 582315 - DNA, 13 bp, D. melanogaster
ataatttatttcc

SEQ ID NO: 582316 - DNA, 14 bp, D. melanogaster
ataatttcaaaatc

SEQ ID NO: 582317 - DNA, 13 bp, D. melanogaster
ataatttcaaagt

SEQ ID NO: 582318 - DNA, 14 bp, D. melanogaster
ataatttcaattga

SEQ ID NO: 582319 - DNA, 13 bp, D. melanogaster
ataatttcacaaa

SEQ ID NO: 582320 - DNA, 13 bp, D. melanogaster
ataatttcacaat

SEQ ID NO: 582321 - DNA, 13 bp, D. melanogaster
ataatttcacttt

SEQ ID NO: 582322 - DNA, 13 bp, D. melanogaster
ataatttcagcat

SEQ ID NO: 582323 - DNA, 13 bp, D. melanogaster
ataatttcatcaa

SEQ ID NO: 582324 - DNA, 13 bp, D. melanogaster
ataatttcatttg

SEQ ID NO: 582325 - DNA, 13 bp, D. melanogaster
ataatttccaaat

SEQ ID NO: 582326 - DNA, 13 bp, D. melanogaster
ataatttccataa

SEQ ID NO: 582327 - DNA, 13 bp, D. melanogaster
ataatttccattt

SEQ ID NO: 582328 - DNA, 14 bp, D. melanogaster
ataatttccatttc

SEQ ID NO: 582329 - DNA, 13 bp, D. melanogaster
ataatttcccaaa

SEQ ID NO: 582330 - DNA, 13 bp, D. melanogaster
ataatttcctttg

SEQ ID NO: 582331 - DNA, 13 bp, D. melanogaster
ataatttcgaatt

SEQ ID NO: 582332 - DNA, 13 bp, D. melanogaster
ataatttcggact

SEQ ID NO: 582333 - DNA, 13 bp, D. melanogaster
ataatttctgttt

SEQ ID NO: 582334 - DNA, 13 bp, D. melanogaster
ataatttgaaaac

SEQ ID NO: 582335 - DNA, 13 bp, D. melanogaster
ataatttgagaaa

SEQ ID NO: 582336 - DNA, 13 bp, D. melanogaster
ataatttgatatg

SEQ ID NO: 582337 - DNA, 13 bp, D. melanogaster
ataatttgatgta

SEQ ID NO: 582338 - DNA, 13 bp, D. melanogaster
ataatttgatttc

SEQ ID NO: 582339 - DNA, 13 bp, D. melanogaster
ataatttgcaatt

SEQ ID NO: 582340 - DNA, 14 bp, D. melanogaster
ataatttgcataat

SEQ ID NO: 582341 - DNA, 13 bp, D. melanogaster
ataatttgcatac

SEQ ID NO: 582342 - DNA, 14 bp, D. melanogaster
ataatttgcatatt

SEQ ID NO: 582343 - DNA, 13 bp, D. melanogaster
ataatttgccaaa

SEQ ID NO: 582344 - DNA, 13 bp, D. melanogaster
ataatttgcttat

SEQ ID NO: 582345 - DNA, 13 bp, D. melanogaster
ataatttggaaat

SEQ ID NO: 582346 - DNA, 13 bp, D. melanogaster
ataatttggcaat

SEQ ID NO: 582347 - DNA, 13 bp, D. melanogaster
ataatttggctta

SEQ ID NO: 582348 - DNA, 13 bp, D. melanogaster
ataatttggtaaa

SEQ ID NO: 582349 - DNA, 13 bp, D. melanogaster
ataatttggtatt

SEQ ID NO: 582350 - DNA, 13 bp, D. melanogaster
ataatttgtattc

SEQ ID NO: 582351 - DNA, 13 bp, D. melanogaster
ataatttgtcaaa

SEQ ID NO: 582352 - DNA, 13 bp, D. melanogaster
ataatttgtgcaa

SEQ ID NO: 582353 - DNA, 13 bp, D. melanogaster
ataatttgttctg

SEQ ID NO: 582354 - DNA, 13 bp, D. melanogaster
ataatttgtttgg

SEQ ID NO: 582355 - DNA, 13 bp, D. melanogaster
ataatttgttttc

SEQ ID NO: 582356 - DNA, 13 bp, D. melanogaster
ataattttaagtg

SEQ ID NO: 582357 - DNA, 13 bp, D. melanogaster
ataattttcaact

SEQ ID NO: 582358 - DNA, 13 bp, D. melanogaster
ataattttcacaa

SEQ ID NO: 582359 - DNA, 13 bp, D. melanogaster
ataattttcagtt

SEQ ID NO: 582360 - DNA, 13 bp, D. melanogaster
ataattttctcaa

SEQ ID NO: 582361 - DNA, 14 bp, D. melanogaster
ataattttctcaac

SEQ ID NO: 582362 - DNA, 13 bp, D. melanogaster
ataattttctcca

SEQ ID NO: 582363 - DNA, 13 bp, D. melanogaster
ataattttctgct

SEQ ID NO: 582364 - DNA, 13 bp, D. melanogaster
ataattttctgta

SEQ ID NO: 582365 - DNA, 13 bp, D. melanogaster
ataattttgagat

SEQ ID NO: 582366 - DNA, 13 bp, D. melanogaster
ataattttgagtt

SEQ ID NO: 582367 - DNA, 14 bp, D. melanogaster
ataattttgcattt

SEQ ID NO: 582368 - DNA, 13 bp, D. melanogaster
ataattttgccag

SEQ ID NO: 582369 - DNA, 13 bp, D. melanogaster
ataattttggtta

SEQ ID NO: 582370 - DNA, 13 bp, D. melanogaster
ataattttgtatg

SEQ ID NO: 582371 - DNA, 13 bp, D. melanogaster
ataatttttctgg

SEQ ID NO: 582372 - DNA, 13 bp, D. melanogaster
ataatttttgcaa

SEQ ID NO: 582373 - DNA, 13 bp, D. melanogaster
ataatttttgctt

SEQ ID NO: 582374 - DNA, 14 bp, D. melanogaster
ataatttttggcca

SEQ ID NO: 582375 - DNA, 14 bp, D. melanogaster
ataattttttcgat

SEQ ID NO: 582376 - DNA, 13 bp, D. melanogaster
ataattttttgac

SEQ ID NO: 582377 - DNA, 13 bp, D. melanogaster
ataattttttgcc

SEQ ID NO: 582378 - DNA, 13 bp, D. melanogaster
atacaaaaaatgt

SEQ ID NO: 582379 - DNA, 13 bp, D. melanogaster
atacaaaaacttt

SEQ ID NO: 582380 - DNA, 14 bp, D. melanogaster
atacaaaaatgctt

SEQ ID NO: 582381 - DNA, 13 bp, D. melanogaster
atacaaaaatggg

SEQ ID NO: 582382 - DNA, 13 bp, D. melanogaster
atacaaaaatgtt

SEQ ID NO: 582383 - DNA, 13 bp, D. melanogaster
atacaaaaattgt

SEQ ID NO: 582384 - DNA, 14 bp, D. melanogaster
atacaaaaattgtt

SEQ ID NO: 582385 - DNA, 13 bp, D. melanogaster
atacaaaacgagc

SEQ ID NO: 582386 - DNA, 13 bp, D. melanogaster
atacaaaactgaa

SEQ ID NO: 582387 - DNA, 13 bp, D. melanogaster
atacaaaactttt

SEQ ID NO: 582388 - DNA, 13 bp, D. melanogaster
atacaaaagtatc

SEQ ID NO: 582389 - DNA, 14 bp, D. melanogaster
atacaaaagtatct

SEQ ID NO: 582390 - DNA, 13 bp, D. melanogaster
atacaaaatacga

SEQ ID NO: 582391 - DNA, 13 bp, D. melanogaster
atacaaaatagtt

SEQ ID NO: 582392 - DNA, 13 bp, D. melanogaster
atacaaaatcatt

SEQ ID NO: 582393 - DNA, 13 bp, D. melanogaster
atacaaaatggca

SEQ ID NO: 582394 - DNA, 13 bp, D. melanogaster
atacaaaatgtta

SEQ ID NO: 582395 - DNA, 14 bp, D. melanogaster
atacaaaatgttta

SEQ ID NO: 582396 - DNA, 13 bp, D. melanogaster
atacaaaattcgg

SEQ ID NO: 582397 - DNA, 13 bp, D. melanogaster
atacaaaattgta

SEQ ID NO: 582398 - DNA, 13 bp, D. melanogaster
atacaaaatttca

SEQ ID NO: 582399 - DNA, 13 bp, D. melanogaster
atacaaaatttgt

SEQ ID NO: 582400 - DNA, 14 bp, D. melanogaster
atacaaaatttgta

SEQ ID NO: 582401 - DNA, 13 bp, D. melanogaster
atacaaacagaat

SEQ ID NO: 582402 - DNA, 14 bp, D. melanogaster
atacaaacatatgt

SEQ ID NO: 582403 - DNA, 13 bp, D. melanogaster
atacaaacgcaca

SEQ ID NO: 582404 - DNA, 13 bp, D. melanogaster
atacaaagtatat

SEQ ID NO: 582405 - DNA, 14 bp, D. melanogaster
atacaaagtatata

SEQ ID NO: 582406 - DNA, 13 bp, D. melanogaster
atacaaataaatg

SEQ ID NO: 582407 - DNA, 13 bp, D. melanogaster
atacaaataatag

SEQ ID NO: 582408 - DNA, 13 bp, D. melanogaster
atacaaatacaga

SEQ ID NO: 582409 - DNA, 14 bp, D. melanogaster
atacaaatacattt

SEQ ID NO: 582410 - DNA, 13 bp, D. melanogaster
atacaaatacgaa

SEQ ID NO: 582411 - DNA, 14 bp, D. melanogaster
atacaaatacgaat

SEQ ID NO: 582412 - DNA, 13 bp, D. melanogaster
atacaaatactta

SEQ ID NO: 582413 - DNA, 13 bp, D. melanogaster
atacaaatagttt

SEQ ID NO: 582414 - DNA, 13 bp, D. melanogaster
atacaaatatatg

SEQ ID NO: 582415 - DNA, 13 bp, D. melanogaster
atacaaatatcac

SEQ ID NO: 582416 - DNA, 13 bp, D. melanogaster
atacaaatatgaa

SEQ ID NO: 582417 - DNA, 13 bp, D. melanogaster
atacaaatatgtg

SEQ ID NO: 582418 - DNA, 13 bp, D. melanogaster
atacaaatatgtt

SEQ ID NO: 582419 - DNA, 14 bp, D. melanogaster
atacaaatattatc

SEQ ID NO: 582420 - DNA, 13 bp, D. melanogaster
atacaaatattgt

SEQ ID NO: 582421 - DNA, 13 bp, D. melanogaster
atacaaatatttg

SEQ ID NO: 582422 - DNA, 14 bp, D. melanogaster
atacaaatattttg

SEQ ID NO: 582423 - DNA, 13 bp, D. melanogaster
atacaaatgaatg

SEQ ID NO: 582424 - DNA, 13 bp, D. melanogaster
atacaaatgattt

SEQ ID NO: 582425 - DNA, 13 bp, D. melanogaster
atacaaatgcatt

SEQ ID NO: 582426 - DNA, 13 bp, D. melanogaster
atacaaatgcctt

SEQ ID NO: 582427 - DNA, 13 bp, D. melanogaster
atacaaatggtat

SEQ ID NO: 582428 - DNA, 13 bp, D. melanogaster
atacaaatgtata

SEQ ID NO: 582429 - DNA, 13 bp, D. melanogaster
atacaaatgtatc

SEQ ID NO: 582430 - DNA, 14 bp, D. melanogaster
atacaaatgtatct

SEQ ID NO: 582431 - DNA, 13 bp, D. melanogaster
atacaaatgttat

SEQ ID NO: 582432 - DNA, 13 bp, D. melanogaster
atacaaattcata

SEQ ID NO: 582433 - DNA, 13 bp, D. melanogaster
atacaaattcatt

SEQ ID NO: 582434 - DNA, 13 bp, D. melanogaster
atacaaattcgaa

SEQ ID NO: 582435 - DNA, 13 bp, D. melanogaster
atacaaattgaaa

SEQ ID NO: 582436 - DNA, 13 bp, D. melanogaster
atacaaattgcaa

SEQ ID NO: 582437 - DNA, 13 bp, D. melanogaster
atacaaattgctt

SEQ ID NO: 582438 - DNA, 13 bp, D. melanogaster
atacaaattggaa

SEQ ID NO: 582439 - DNA, 13 bp, D. melanogaster
atacaaattgtaa

SEQ ID NO: 582440 - DNA, 14 bp, D. melanogaster
atacaaattgtaac

SEQ ID NO: 582441 - DNA, 13 bp, D. melanogaster
atacaaattgtgt

SEQ ID NO: 582442 - DNA, 13 bp, D. melanogaster
atacaaatttaca

SEQ ID NO: 582443 - DNA, 13 bp, D. melanogaster
atacaaatttcaa

SEQ ID NO: 582444 - DNA, 13 bp, D. melanogaster
atacaaatttgaa

SEQ ID NO: 582445 - DNA, 13 bp, D. melanogaster
atacaaatttgta

SEQ ID NO: 582446 - DNA, 13 bp, D. melanogaster
atacaaatttgtt

SEQ ID NO: 582447 - DNA, 13 bp, D. melanogaster
atacaaattttgc

SEQ ID NO: 582448 - DNA, 13 bp, D. melanogaster
atacaacaatttg

SEQ ID NO: 582449 - DNA, 13 bp, D. melanogaster
atacaacattttt

SEQ ID NO: 582450 - DNA, 13 bp, D. melanogaster
atacaacctaaag

SEQ ID NO: 582451 - DNA, 13 bp, D. melanogaster
atacaactaattt

SEQ ID NO: 582452 - DNA, 13 bp, D. melanogaster
atacaactttttt

SEQ ID NO: 582453 - DNA, 14 bp, D. melanogaster
atacaagaaaatat

SEQ ID NO: 582454 - DNA, 13 bp, D. melanogaster
atacaagaaacat

SEQ ID NO: 582455 - DNA, 13 bp, D. melanogaster
atacaagaaatat

SEQ ID NO: 582456 - DNA, 13 bp, D. melanogaster
atacaagaggaaa

SEQ ID NO: 582457 - DNA, 13 bp, D. melanogaster
atacaagcaagaa

SEQ ID NO: 582458 - DNA, 13 bp, D. melanogaster
atacaagtacaca

SEQ ID NO: 582459 - DNA, 13 bp, D. melanogaster
atacaagtttatt

SEQ ID NO: 582460 - DNA, 13 bp, D. melanogaster
atacaataacatt

SEQ ID NO: 582461 - DNA, 13 bp, D. melanogaster
atacaatacaatg

SEQ ID NO: 582462 - DNA, 13 bp, D. melanogaster
atacaatacaatt

SEQ ID NO: 582463 - DNA, 14 bp, D. melanogaster
atacaatacaattt

SEQ ID NO: 582464 - DNA, 14 bp, D. melanogaster
atacaatacatttt

SEQ ID NO: 582465 - DNA, 13 bp, D. melanogaster
atacaatagtcct

SEQ ID NO: 582466 - DNA, 13 bp, D. melanogaster
atacaatagtttt

SEQ ID NO: 582467 - DNA, 14 bp, D. melanogaster
atacaatatatatc

SEQ ID NO: 582468 - DNA, 13 bp, D. melanogaster
atacaatatatgt

SEQ ID NO: 582469 - DNA, 13 bp, D. melanogaster
atacaatatcaac

SEQ ID NO: 582470 - DNA, 13 bp, D. melanogaster
atacaatatgtac

SEQ ID NO: 582471 - DNA, 13 bp, D. melanogaster
atacaatatgtat

SEQ ID NO: 582472 - DNA, 14 bp, D. melanogaster
atacaatatgtata

SEQ ID NO: 582473 - DNA, 13 bp, D. melanogaster
atacaatcaattt

SEQ ID NO: 582474 - DNA, 14 bp, D. melanogaster
atacaatcgcaaca

SEQ ID NO: 582475 - DNA, 13 bp, D. melanogaster
atacaatcggaaa

SEQ ID NO: 582476 - DNA, 14 bp, D. melanogaster
atacaattaattca

SEQ ID NO: 582477 - DNA, 13 bp, D. melanogaster
atacaattacttt

SEQ ID NO: 582478 - DNA, 13 bp, D. melanogaster
atacaattccatt

SEQ ID NO: 582479 - DNA, 13 bp, D. melanogaster
atacaatttaagt

SEQ ID NO: 582480 - DNA, 13 bp, D. melanogaster
atacaatttacat

SEQ ID NO: 582481 - DNA, 13 bp, D. melanogaster
atacaatttattg

SEQ ID NO: 582482 - DNA, 14 bp, D. melanogaster
atacaatttatttg

SEQ ID NO: 582483 - DNA, 13 bp, D. melanogaster
atacaatttcttt

SEQ ID NO: 582484 - DNA, 13 bp, D. melanogaster
atacaatttgaaa

SEQ ID NO: 582485 - DNA, 13 bp, D. melanogaster
atacaatttgcaa

SEQ ID NO: 582486 - DNA, 13 bp, D. melanogaster
atacaatttggtt

SEQ ID NO: 582487 - DNA, 14 bp, D. melanogaster
atacaattttcaaa

SEQ ID NO: 582488 - DNA, 13 bp, D. melanogaster
atacaattttgta

SEQ ID NO: 582489 - DNA, 13 bp, D. melanogaster
atacacaaacatg

SEQ ID NO: 582490 - DNA, 13 bp, D. melanogaster
atacacaaatatg

SEQ ID NO: 582491 - DNA, 13 bp, D. melanogaster
atacacaaatgca

SEQ ID NO: 582492 - DNA, 13 bp, D. melanogaster
atacacaatatac

SEQ ID NO: 582493 - DNA, 13 bp, D. melanogaster
atacacaatattt

SEQ ID NO: 582494 - DNA, 13 bp, D. melanogaster
atacacaatttta

SEQ ID NO: 582495 - DNA, 13 bp, D. melanogaster
atacacacaagca

SEQ ID NO: 582496 - DNA, 13 bp, D. melanogaster
atacacacaattt

SEQ ID NO: 582497 - DNA, 14 bp, D. melanogaster
atacacacacacat

SEQ ID NO: 582498 - DNA, 13 bp, D. melanogaster
atacacacacacg

SEQ ID NO: 582499 - DNA, 14 bp, D. melanogaster
atacacacacacgc

SEQ ID NO: 582500 - DNA, 13 bp, D. melanogaster
atacacacacatc

SEQ ID NO: 582501 - DNA, 14 bp, D. melanogaster
atacacacacatgc

SEQ ID NO: 582502 - DNA, 13 bp, D. melanogaster
atacacacacgcc

SEQ ID NO: 582503 - DNA, 13 bp, D. melanogaster
atacacacactta

SEQ ID NO: 582504 - DNA, 13 bp, D. melanogaster
atacacacagaca

SEQ ID NO: 582505 - DNA, 13 bp, D. melanogaster
atacacacagcca

SEQ ID NO: 582506 - DNA, 13 bp, D. melanogaster
atacacacataca

SEQ ID NO: 582507 - DNA, 14 bp, D. melanogaster
atacacacatacac

SEQ ID NO: 582508 - DNA, 13 bp, D. melanogaster
atacacacataga

SEQ ID NO: 582509 - DNA, 13 bp, D. melanogaster
atacacacatatc

SEQ ID NO: 582510 - DNA, 13 bp, D. melanogaster
atacacacattta

SEQ ID NO: 582511 - DNA, 14 bp, D. melanogaster
atacacaccactta

SEQ ID NO: 582512 - DNA, 13 bp, D. melanogaster
atacacacgcaca

SEQ ID NO: 582513 - DNA, 14 bp, D. melanogaster
atacacacgcacac

SEQ ID NO: 582514 - DNA, 14 bp, D. melanogaster
atacacactcacac

SEQ ID NO: 582515 - DNA, 13 bp, D. melanogaster
atacacagaaaca

SEQ ID NO: 582516 - DNA, 13 bp, D. melanogaster
atacacagaaata

SEQ ID NO: 582517 - DNA, 13 bp, D. melanogaster
atacacagacata

SEQ ID NO: 582518 - DNA, 14 bp, D. melanogaster
atacacagacatac

SEQ ID NO: 582519 - DNA, 13 bp, D. melanogaster
atacacagataca

SEQ ID NO: 582520 - DNA, 13 bp, D. melanogaster
atacacagatata

SEQ ID NO: 582521 - DNA, 13 bp, D. melanogaster
atacacagcagat

SEQ ID NO: 582522 - DNA, 13 bp, D. melanogaster
atacacagctcac

SEQ ID NO: 582523 - DNA, 13 bp, D. melanogaster
atacacagttttt

SEQ ID NO: 582524 - DNA, 13 bp, D. melanogaster
atacacatacacg

SEQ ID NO: 582525 - DNA, 13 bp, D. melanogaster
atacacatacata

SEQ ID NO: 582526 - DNA, 14 bp, D. melanogaster
atacacatacatat

SEQ ID NO: 582527 - DNA, 13 bp, D. melanogaster
atacacatacgta

SEQ ID NO: 582528 - DNA, 14 bp, D. melanogaster
atacacatatacat

SEQ ID NO: 582529 - DNA, 13 bp, D. melanogaster
atacacatataga

SEQ ID NO: 582530 - DNA, 13 bp, D. melanogaster
atacacatatatg

SEQ ID NO: 582531 - DNA, 13 bp, D. melanogaster
atacacatatgta

SEQ ID NO: 582532 - DNA, 14 bp, D. melanogaster
atacacatatgtac

SEQ ID NO: 582533 - DNA, 13 bp, D. melanogaster
atacacatccaca

SEQ ID NO: 582534 - DNA, 13 bp, D. melanogaster
atacacatgcaca

SEQ ID NO: 582535 - DNA, 14 bp, D. melanogaster
atacacatgcatat

SEQ ID NO: 582536 - DNA, 13 bp, D. melanogaster
atacacatgtaca

SEQ ID NO: 582537 - DNA, 13 bp, D. melanogaster
atacacattaaag

SEQ ID NO: 582538 - DNA, 13 bp, D. melanogaster
atacacatttttt

SEQ ID NO: 582539 - DNA, 13 bp, D. melanogaster
atacaccaatact

SEQ ID NO: 582540 - DNA, 13 bp, D. melanogaster
atacacgcacaca

SEQ ID NO: 582541 - DNA, 13 bp, D. melanogaster
atacactatatac

SEQ ID NO: 582542 - DNA, 14 bp, D. melanogaster
atacactcacacac

SEQ ID NO: 582543 - DNA, 14 bp, D. melanogaster
atacactcatacac

SEQ ID NO: 582544 - DNA, 13 bp, D. melanogaster
atacactcgcaca

SEQ ID NO: 582545 - DNA, 13 bp, D. melanogaster
atacactgaaaaa

SEQ ID NO: 582546 - DNA, 13 bp, D. melanogaster
atacactgagaaa

SEQ ID NO: 582547 - DNA, 14 bp, D. melanogaster
atacactgagaaaa

SEQ ID NO: 582548 - DNA, 14 bp, D. melanogaster
atacactgagcgaa

SEQ ID NO: 582549 - DNA, 13 bp, D. melanogaster
atacactgcaaaa

SEQ ID NO: 582550 - DNA, 14 bp, D. melanogaster
atacactgcgagaa

SEQ ID NO: 582551 - DNA, 13 bp, D. melanogaster
atacactgggaaa

SEQ ID NO: 582552 - DNA, 14 bp, D. melanogaster
atacactgggaaaa

SEQ ID NO: 582553 - DNA, 13 bp, D. melanogaster
atacacttatata

SEQ ID NO: 582554 - DNA, 13 bp, D. melanogaster
atacactttaatt

SEQ ID NO: 582555 - DNA, 13 bp, D. melanogaster
atacactttactt

SEQ ID NO: 582556 - DNA, 13 bp, D. melanogaster
atacactttttaa

SEQ ID NO: 582557 - DNA, 13 bp, D. melanogaster
atacactttttat

SEQ ID NO: 582558 - DNA, 13 bp, D. melanogaster
atacactttttgt

SEQ ID NO: 582559 - DNA, 13 bp, D. melanogaster
atacagaaaaatg

SEQ ID NO: 582560 - DNA, 13 bp, D. melanogaster
atacagaaacaga

SEQ ID NO: 582561 - DNA, 13 bp, D. melanogaster
atacagaatacag

SEQ ID NO: 582562 - DNA, 13 bp, D. melanogaster
atacagaatataa

SEQ ID NO: 582563 - DNA, 13 bp, D. melanogaster
atacagacacaga

SEQ ID NO: 582564 - DNA, 13 bp, D. melanogaster
atacagacagaca

SEQ ID NO: 582565 - DNA, 13 bp, D. melanogaster
atacagataaaga

SEQ ID NO: 582566 - DNA, 13 bp, D. melanogaster
atacagatacaca

SEQ ID NO: 582567 - DNA, 14 bp, D. melanogaster
atacagatacacac

SEQ ID NO: 582568 - DNA, 13 bp, D. melanogaster
atacagatacagg

SEQ ID NO: 582569 - DNA, 13 bp, D. melanogaster
atacagatacatc

SEQ ID NO: 582570 - DNA, 13 bp, D. melanogaster
atacagatacatt

SEQ ID NO: 582571 - DNA, 14 bp, D. melanogaster
atacagatacgaat

SEQ ID NO: 582572 - DNA, 13 bp, D. melanogaster
atacagatactga

SEQ ID NO: 582573 - DNA, 14 bp, D. melanogaster
atacagatactttt

SEQ ID NO: 582574 - DNA, 13 bp, D. melanogaster
atacagatatatt

SEQ ID NO: 582575 - DNA, 13 bp, D. melanogaster
atacagatgcaaa

SEQ ID NO: 582576 - DNA, 13 bp, D. melanogaster
atacagatgcaga

SEQ ID NO: 582577 - DNA, 13 bp, D. melanogaster
atacagattataa

SEQ ID NO: 582578 - DNA, 13 bp, D. melanogaster
atacagattctag

SEQ ID NO: 582579 - DNA, 13 bp, D. melanogaster
atacagcagcaat

SEQ ID NO: 582580 - DNA, 14 bp, D. melanogaster
atacagtttgtcaa

SEQ ID NO: 582581 - DNA, 13 bp, D. melanogaster
atacagttttatt

SEQ ID NO: 582582 - DNA, 13 bp, D. melanogaster
atacataaaagag

SEQ ID NO: 582583 - DNA, 13 bp, D. melanogaster
atacataaaccca

SEQ ID NO: 582584 - DNA, 13 bp, D. melanogaster
atacataaataag

SEQ ID NO: 582585 - DNA, 13 bp, D. melanogaster
atacataaatcat

SEQ ID NO: 582586 - DNA, 13 bp, D. melanogaster
atacataacatac

SEQ ID NO: 582587 - DNA, 13 bp, D. melanogaster
atacataacatat

SEQ ID NO: 582588 - DNA, 13 bp, D. melanogaster
atacataatacat

SEQ ID NO: 582589 - DNA, 14 bp, D. melanogaster
atacataatatact

SEQ ID NO: 582590 - DNA, 13 bp, D. melanogaster
atacatacaatat

SEQ ID NO: 582591 - DNA, 13 bp, D. melanogaster
atacatacaatgt

SEQ ID NO: 582592 - DNA, 13 bp, D. melanogaster
atacatacaatta

SEQ ID NO: 582593 - DNA, 13 bp, D. melanogaster
atacatacaattt

SEQ ID NO: 582594 - DNA, 13 bp, D. melanogaster
atacatacacaca

SEQ ID NO: 582595 - DNA, 14 bp, D. melanogaster
atacatacacacat

SEQ ID NO: 582596 - DNA, 13 bp, D. melanogaster
atacatacacacg

SEQ ID NO: 582597 - DNA, 13 bp, D. melanogaster
atacatacacata

SEQ ID NO: 582598 - DNA, 13 bp, D. melanogaster
atacatacacatt

SEQ ID NO: 582599 - DNA, 13 bp, D. melanogaster
atacatacagaca

SEQ ID NO: 582600 - DNA, 14 bp, D. melanogaster
atacatacataaca

SEQ ID NO: 582601 - DNA, 14 bp, D. melanogaster
atacatacataagt

SEQ ID NO: 582602 - DNA, 14 bp, D. melanogaster
atacatacatacaa

SEQ ID NO: 582603 - DNA, 17 bp, D. melanogaster
atacatacatacataaa

SEQ ID NO: 582604 - DNA, 14 bp, D. melanogaster
atacatacatactt

SEQ ID NO: 582605 - DNA, 13 bp, D. melanogaster
atacatacataga

SEQ ID NO: 582606 - DNA, 13 bp, D. melanogaster
atacatacatagc

SEQ ID NO: 582607 - DNA, 13 bp, D. melanogaster
atacatacatagg

SEQ ID NO: 582608 - DNA, 14 bp, D. melanogaster
atacatacataggt

SEQ ID NO: 582609 - DNA, 13 bp, D. melanogaster
atacatacatagt

SEQ ID NO: 582610 - DNA, 14 bp, D. melanogaster
atacatacatatat

SEQ ID NO: 582611 - DNA, 16 bp, D. melanogaster
atacatacatatatag

SEQ ID NO: 582612 - DNA, 16 bp, D. melanogaster
atacatacatatatgg

SEQ ID NO: 582613 - DNA, 15 bp, D. melanogaster
atacatacatatatt

SEQ ID NO: 582614 - DNA, 13 bp, D. melanogaster
atacatacatatc

SEQ ID NO: 582615 - DNA, 14 bp, D. melanogaster
atacatacatatgc

SEQ ID NO: 582616 - DNA, 14 bp, D. melanogaster
atacatacatattc

SEQ ID NO: 582617 - DNA, 13 bp, D. melanogaster
atacatacatcat

SEQ ID NO: 582618 - DNA, 13 bp, D. melanogaster
atacatacatctg

SEQ ID NO: 582619 - DNA, 13 bp, D. melanogaster
atacatacatgca

SEQ ID NO: 582620 - DNA, 13 bp, D. melanogaster
atacatacatgcc

SEQ ID NO: 582621 - DNA, 13 bp, D. melanogaster
atacatacatgta

SEQ ID NO: 582622 - DNA, 14 bp, D. melanogaster
atacatacatgtgt

SEQ ID NO: 582623 - DNA, 13 bp, D. melanogaster
atacatacattgc

SEQ ID NO: 582624 - DNA, 14 bp, D. melanogaster
atacatacatttat

SEQ ID NO: 582625 - DNA, 13 bp, D. melanogaster
atacatacatttc

SEQ ID NO: 582626 - DNA, 13 bp, D. melanogaster
atacatacatttt

SEQ ID NO: 582627 - DNA, 14 bp, D. melanogaster
atacatacattttt

SEQ ID NO: 582628 - DNA, 13 bp, D. melanogaster
atacataccatat

SEQ ID NO: 582629 - DNA, 13 bp, D. melanogaster
atacatacctata

SEQ ID NO: 582630 - DNA, 14 bp, D. melanogaster
atacatacctatat

SEQ ID NO: 582631 - DNA, 13 bp, D. melanogaster
atacatacgagta

SEQ ID NO: 582632 - DNA, 13 bp, D. melanogaster
atacatacgcata

SEQ ID NO: 582633 - DNA, 13 bp, D. melanogaster
atacatacgtaca

SEQ ID NO: 582634 - DNA, 14 bp, D. melanogaster
atacatacgtacat

SEQ ID NO: 582635 - DNA, 15 bp, D. melanogaster
atacatacgtatata

SEQ ID NO: 582636 - DNA, 13 bp, D. melanogaster
atacatactacat

SEQ ID NO: 582637 - DNA, 13 bp, D. melanogaster
atacatactcgta

SEQ ID NO: 582638 - DNA, 14 bp, D. melanogaster
atacatacttacat

SEQ ID NO: 582639 - DNA, 14 bp, D. melanogaster
atacatacttatat

SEQ ID NO: 582640 - DNA, 13 bp, D. melanogaster
atacatacttatt

SEQ ID NO: 582641 - DNA, 13 bp, D. melanogaster
atacatagagcaa

SEQ ID NO: 582642 - DNA, 13 bp, D. melanogaster
atacatagataca

SEQ ID NO: 582643 - DNA, 13 bp, D. melanogaster
atacatagatata

SEQ ID NO: 582644 - DNA, 13 bp, D. melanogaster
atacatagttatt

SEQ ID NO: 582645 - DNA, 13 bp, D. melanogaster
atacatataaaag

SEQ ID NO: 582646 - DNA, 13 bp, D. melanogaster
atacatataaatg

SEQ ID NO: 582647 - DNA, 13 bp, D. melanogaster
atacatataatgt

SEQ ID NO: 582648 - DNA, 13 bp, D. melanogaster
atacatataattg

SEQ ID NO: 582649 - DNA, 13 bp, D. melanogaster
atacatatacaag

SEQ ID NO: 582650 - DNA, 14 bp, D. melanogaster
atacatatacacac

SEQ ID NO: 582651 - DNA, 15 bp, D. melanogaster
atacatatacacgta

SEQ ID NO: 582652 - DNA, 13 bp, D. melanogaster
atacatatacact

SEQ ID NO: 582653 - DNA, 13 bp, D. melanogaster
atacatatacata

SEQ ID NO: 582654 - DNA, 14 bp, D. melanogaster
atacatatacatag

SEQ ID NO: 582655 - DNA, 14 bp, D. melanogaster
atacatatacatgt

SEQ ID NO: 582656 - DNA, 13 bp, D. melanogaster
atacatataccca

SEQ ID NO: 582657 - DNA, 13 bp, D. melanogaster
atacatataccta

SEQ ID NO: 582658 - DNA, 13 bp, D. melanogaster
atacatatacgca

SEQ ID NO: 582659 - DNA, 13 bp, D. melanogaster
atacatatagaaa

SEQ ID NO: 582660 - DNA, 13 bp, D. melanogaster
atacatatagcca

SEQ ID NO: 582661 - DNA, 13 bp, D. melanogaster
atacatatataag

SEQ ID NO: 582662 - DNA, 14 bp, D. melanogaster
atacatatataaga

SEQ ID NO: 582663 - DNA, 14 bp, D. melanogaster
atacatatatacgt

SEQ ID NO: 582664 - DNA, 14 bp, D. melanogaster
atacatatatactt

SEQ ID NO: 582665 - DNA, 13 bp, D. melanogaster
atacatatatagg

SEQ ID NO: 582666 - DNA, 13 bp, D. melanogaster
atacatatatagt

SEQ ID NO: 582667 - DNA, 14 bp, D. melanogaster
atacatatatagtt

SEQ ID NO: 582668 - DNA, 14 bp, D. melanogaster
atacatatatatac

SEQ ID NO: 582669 - DNA, 14 bp, D. melanogaster
atacatatatatag

SEQ ID NO: 582670 - DNA, 13 bp, D. melanogaster
atacatatatatc

SEQ ID NO: 582671 - DNA, 14 bp, D. melanogaster
atacatatatatga

SEQ ID NO: 582672 - DNA, 14 bp, D. melanogaster
atacatatatatgc

SEQ ID NO: 582673 - DNA, 14 bp, D. melanogaster
atacatatatcaat

SEQ ID NO: 582674 - DNA, 13 bp, D. melanogaster
atacatatatccc

SEQ ID NO: 582675 - DNA, 13 bp, D. melanogaster
atacatatatccg

SEQ ID NO: 582676 - DNA, 13 bp, D. melanogaster
atacatatatctc

SEQ ID NO: 582677 - DNA, 14 bp, D. melanogaster
atacatatatctct

SEQ ID NO: 582678 - DNA, 14 bp, D. melanogaster
atacatatatctgt

SEQ ID NO: 582679 - DNA, 13 bp, D. melanogaster
atacatatatgag

SEQ ID NO: 582680 - DNA, 14 bp, D. melanogaster
atacatatatgagt

SEQ ID NO: 582681 - DNA, 13 bp, D. melanogaster
atacatatatgca

SEQ ID NO: 582682 - DNA, 13 bp, D. melanogaster
atacatatatgcc

SEQ ID NO: 582683 - DNA, 13 bp, D. melanogaster
atacatatatggt

SEQ ID NO: 582684 - DNA, 14 bp, D. melanogaster
atacatatatgtac

SEQ ID NO: 582685 - DNA, 15 bp, D. melanogaster
atacatatatgtacg

SEQ ID NO: 582686 - DNA, 14 bp, D. melanogaster
atacatatatgtat

SEQ ID NO: 582687 - DNA, 14 bp, D. melanogaster
atacatatatgtgt

SEQ ID NO: 582688 - DNA, 14 bp, D. melanogaster
atacatatatgttc

SEQ ID NO: 582689 - DNA, 14 bp, D. melanogaster
atacatatatgttt

SEQ ID NO: 582690 - DNA, 14 bp, D. melanogaster
atacatatattaac

SEQ ID NO: 582691 - DNA, 13 bp, D. melanogaster
atacatatattac

SEQ ID NO: 582692 - DNA, 13 bp, D. melanogaster
atacatatattcc

SEQ ID NO: 582693 - DNA, 13 bp, D. melanogaster
atacatatattcg

SEQ ID NO: 582694 - DNA, 13 bp, D. melanogaster
atacatatattct

SEQ ID NO: 582695 - DNA, 14 bp, D. melanogaster
atacatatattgtt

SEQ ID NO: 582696 - DNA, 13 bp, D. melanogaster
atacatatatttc

SEQ ID NO: 582697 - DNA, 14 bp, D. melanogaster
atacatatatttca

SEQ ID NO: 582698 - DNA, 14 bp, D. melanogaster
atacatatctcgct

SEQ ID NO: 582699 - DNA, 13 bp, D. melanogaster
atacatatgaata

SEQ ID NO: 582700 - DNA, 14 bp, D. melanogaster
atacatatgaatat

SEQ ID NO: 582701 - DNA, 13 bp, D. melanogaster
atacatatgcaaa

SEQ ID NO: 582702 - DNA, 13 bp, D. melanogaster
atacatatgcaca

SEQ ID NO: 582703 - DNA, 14 bp, D. melanogaster
atacatatgcacat

SEQ ID NO: 582704 - DNA, 13 bp, D. melanogaster
atacatatgcact

SEQ ID NO: 582705 - DNA, 13 bp, D. melanogaster
atacatatgcata

SEQ ID NO: 582706 - DNA, 14 bp, D. melanogaster
atacatatgcatat

SEQ ID NO: 582707 - DNA, 13 bp, D. melanogaster
atacatatgctta

SEQ ID NO: 582708 - DNA, 14 bp, D. melanogaster
atacatatgtaaaa

SEQ ID NO: 582709 - DNA, 13 bp, D. melanogaster
atacatatgtaat

SEQ ID NO: 582710 - DNA, 14 bp, D. melanogaster
atacatatgtacaa

SEQ ID NO: 582711 - DNA, 13 bp, D. melanogaster
atacatatgtacc

SEQ ID NO: 582712 - DNA, 13 bp, D. melanogaster
atacatatgtacg

SEQ ID NO: 582713 - DNA, 14 bp, D. melanogaster
atacatatgtacgt

SEQ ID NO: 582714 - DNA, 14 bp, D. melanogaster
atacatatgtagat

SEQ ID NO: 582715 - DNA, 13 bp, D. melanogaster
atacatatgtagt

SEQ ID NO: 582716 - DNA, 14 bp, D. melanogaster
atacatatgtagtt

SEQ ID NO: 582717 - DNA, 14 bp, D. melanogaster
atacatatgtatgc

SEQ ID NO: 582718 - DNA, 14 bp, D. melanogaster
atacatatgtatgg

SEQ ID NO: 582719 - DNA, 17 bp, D. melanogaster
atacatatgtatgtaca

SEQ ID NO: 582720 - DNA, 13 bp, D. melanogaster
atacatatgtgat

SEQ ID NO: 582721 - DNA, 13 bp, D. melanogaster
atacatatgtgca

SEQ ID NO: 582722 - DNA, 14 bp, D. melanogaster
atacatatgtgcat

SEQ ID NO: 582723 - DNA, 13 bp, D. melanogaster
atacatatgtgcc

SEQ ID NO: 582724 - DNA, 13 bp, D. melanogaster
atacatatgtgct

SEQ ID NO: 582725 - DNA, 13 bp, D. melanogaster
atacatatgtgta

SEQ ID NO: 582726 - DNA, 14 bp, D. melanogaster
atacatatgtgtat

SEQ ID NO: 582727 - DNA, 14 bp, D. melanogaster
atacatatgtgtgc

SEQ ID NO: 582728 - DNA, 13 bp, D. melanogaster
atacatatgtttg

SEQ ID NO: 582729 - DNA, 13 bp, D. melanogaster
atacatattatac

SEQ ID NO: 582730 - DNA, 13 bp, D. melanogaster
atacatattcaaa

SEQ ID NO: 582731 - DNA, 13 bp, D. melanogaster
atacatattgttt

SEQ ID NO: 582732 - DNA, 13 bp, D. melanogaster
atacatatttaca

SEQ ID NO: 582733 - DNA, 13 bp, D. melanogaster
atacatatttacc

SEQ ID NO: 582734 - DNA, 13 bp, D. melanogaster
atacatatttcca

SEQ ID NO: 582735 - DNA, 13 bp, D. melanogaster
atacatatttgca

SEQ ID NO: 582736 - DNA, 14 bp, D. melanogaster
atacatatttgcat

SEQ ID NO: 582737 - DNA, 14 bp, D. melanogaster
atacatatttgtgt

SEQ ID NO: 582738 - DNA, 14 bp, D. melanogaster
atacatattttcaa

SEQ ID NO: 582739 - DNA, 13 bp, D. melanogaster
atacatattttcc

SEQ ID NO: 582740 - DNA, 13 bp, D. melanogaster
atacatatttttc

SEQ ID NO: 582741 - DNA, 13 bp, D. melanogaster
atacatgatatat

SEQ ID NO: 582742 - DNA, 13 bp, D. melanogaster
atacatgcataca

SEQ ID NO: 582743 - DNA, 14 bp, D. melanogaster
atacatgcatatat

SEQ ID NO: 582744 - DNA, 13 bp, D. melanogaster
atacatgcccatc

SEQ ID NO: 582745 - DNA, 13 bp, D. melanogaster
atacatggcgtat

SEQ ID NO: 582746 - DNA, 13 bp, D. melanogaster
atacatgtacata

SEQ ID NO: 582747 - DNA, 13 bp, D. melanogaster
atacatgtataca

SEQ ID NO: 582748 - DNA, 13 bp, D. melanogaster
atacatgtatata

SEQ ID NO: 582749 - DNA, 14 bp, D. melanogaster
atacatgtatatat

SEQ ID NO: 582750 - DNA, 13 bp, D. melanogaster
atacatgtatatt

SEQ ID NO: 582751 - DNA, 13 bp, D. melanogaster
atacatgtatgtg

SEQ ID NO: 582752 - DNA, 13 bp, D. melanogaster
atacatgtgtaca

SEQ ID NO: 582753 - DNA, 13 bp, D. melanogaster
atacatgtgtatg

SEQ ID NO: 582754 - DNA, 14 bp, D. melanogaster
atacatgtgtatgc

SEQ ID NO: 582755 - DNA, 13 bp, D. melanogaster
atacattacatat

SEQ ID NO: 582756 - DNA, 13 bp, D. melanogaster
atacattatatag

SEQ ID NO: 582757 - DNA, 13 bp, D. melanogaster
atacattcaatat

SEQ ID NO: 582758 - DNA, 14 bp, D. melanogaster
atacattcatatat

SEQ ID NO: 582759 - DNA, 13 bp, D. melanogaster
atacattgtacac

SEQ ID NO: 582760 - DNA, 14 bp, D. melanogaster
atacattgtacact

SEQ ID NO: 582761 - DNA, 13 bp, D. melanogaster
atacattgtatat

SEQ ID NO: 582762 - DNA, 19 bp, D. melanogaster
atacattgtgacactttgt

SEQ ID NO: 582763 - DNA, 13 bp, D. melanogaster
atacatttaacaa

SEQ ID NO: 582764 - DNA, 13 bp, D. melanogaster
atacatttaatac

SEQ ID NO: 582765 - DNA, 13 bp, D. melanogaster
atacatttaatga

SEQ ID NO: 582766 - DNA, 13 bp, D. melanogaster
atacatttacaca

SEQ ID NO: 582767 - DNA, 14 bp, D. melanogaster
atacatttacacat

SEQ ID NO: 582768 - DNA, 13 bp, D. melanogaster
atacatttacata

SEQ ID NO: 582769 - DNA, 13 bp, D. melanogaster
atacatttatact

SEQ ID NO: 582770 - DNA, 13 bp, D. melanogaster
atacatttatgta

SEQ ID NO: 582771 - DNA, 13 bp, D. melanogaster
atacatttattag

SEQ ID NO: 582772 - DNA, 13 bp, D. melanogaster
atacatttatttc

SEQ ID NO: 582773 - DNA, 13 bp, D. melanogaster
atacatttatttg

SEQ ID NO: 582774 - DNA, 13 bp, D. melanogaster
atacatttcacat

SEQ ID NO: 582775 - DNA, 13 bp, D. melanogaster
atacatttcgatt

SEQ ID NO: 582776 - DNA, 13 bp, D. melanogaster
atacatttgatat

SEQ ID NO: 582777 - DNA, 14 bp, D. melanogaster
atacatttgtatct

SEQ ID NO: 582778 - DNA, 13 bp, D. melanogaster
atacatttgtatt

SEQ ID NO: 582779 - DNA, 13 bp, D. melanogaster
atacatttgttaa

SEQ ID NO: 582780 - DNA, 13 bp, D. melanogaster
atacattttaaac

SEQ ID NO: 582781 - DNA, 14 bp, D. melanogaster
atacattttaaaga

SEQ ID NO: 582782 - DNA, 13 bp, D. melanogaster
atacattttaagc

SEQ ID NO: 582783 - DNA, 13 bp, D. melanogaster
atacattttaagt

SEQ ID NO: 582784 - DNA, 13 bp, D. melanogaster
atacattttacat

SEQ ID NO: 582785 - DNA, 13 bp, D. melanogaster
atacattttagtt

SEQ ID NO: 582786 - DNA, 13 bp, D. melanogaster
atacattttatac

SEQ ID NO: 582787 - DNA, 13 bp, D. melanogaster
atacattttcaat

SEQ ID NO: 582788 - DNA, 14 bp, D. melanogaster
atacattttcaata

SEQ ID NO: 582789 - DNA, 13 bp, D. melanogaster
atacattttcaga

SEQ ID NO: 582790 - DNA, 13 bp, D. melanogaster
atacattttcata

SEQ ID NO: 582791 - DNA, 13 bp, D. melanogaster
atacattttccaa

SEQ ID NO: 582792 - DNA, 13 bp, D. melanogaster
atacattttccat

SEQ ID NO: 582793 - DNA, 13 bp, D. melanogaster
atacattttctta

SEQ ID NO: 582794 - DNA, 14 bp, D. melanogaster
atacattttgaaat

SEQ ID NO: 582795 - DNA, 13 bp, D. melanogaster
atacattttgata

SEQ ID NO: 582796 - DNA, 13 bp, D. melanogaster
atacattttggat

SEQ ID NO: 582797 - DNA, 13 bp, D. melanogaster
atacattttgtgt

SEQ ID NO: 582798 - DNA, 14 bp, D. melanogaster
atacatttttaaag

SEQ ID NO: 582799 - DNA, 14 bp, D. melanogaster
atacatttttaatg

SEQ ID NO: 582800 - DNA, 13 bp, D. melanogaster
atacatttttagt

SEQ ID NO: 582801 - DNA, 13 bp, D. melanogaster
atacatttttatc

SEQ ID NO: 582802 - DNA, 14 bp, D. melanogaster
atacatttttcaaa

SEQ ID NO: 582803 - DNA, 13 bp, D. melanogaster
atacatttttcat

SEQ ID NO: 582804 - DNA, 13 bp, D. melanogaster
atacatttttgat

SEQ ID NO: 582805 - DNA, 13 bp, D. melanogaster
atacatttttgtc

SEQ ID NO: 582806 - DNA, 13 bp, D. melanogaster
atacattttttac

SEQ ID NO: 582807 - DNA, 13 bp, D. melanogaster
atacatttttttg

SEQ ID NO: 582808 - DNA, 14 bp, D. melanogaster
ataccaaaactttt

SEQ ID NO: 582809 - DNA, 13 bp, D. melanogaster
ataccaaaatatt

SEQ ID NO: 582810 - DNA, 13 bp, D. melanogaster
ataccaaagaaat

SEQ ID NO: 582811 - DNA, 13 bp, D. melanogaster
ataccaaagaaca

SEQ ID NO: 582812 - DNA, 13 bp, D. melanogaster
ataccaaagacac

SEQ ID NO: 582813 - DNA, 13 bp, D. melanogaster
ataccaaatacca

SEQ ID NO: 582814 - DNA, 13 bp, D. melanogaster
ataccaaatttta

SEQ ID NO: 582815 - DNA, 13 bp, D. melanogaster
ataccaacagatt

SEQ ID NO: 582816 - DNA, 13 bp, D. melanogaster
ataccaagaaaat

SEQ ID NO: 582817 - DNA, 13 bp, D. melanogaster
ataccaaggagcc

SEQ ID NO: 582818 - DNA, 13 bp, D. melanogaster
ataccaataccaa

SEQ ID NO: 582819 - DNA, 14 bp, D. melanogaster
ataccaataccaat

SEQ ID NO: 582820 - DNA, 13 bp, D. melanogaster
ataccaatagcaa

SEQ ID NO: 582821 - DNA, 13 bp, D. melanogaster
ataccaatttaaa

SEQ ID NO: 582822 - DNA, 13 bp, D. melanogaster
ataccaatttgta

SEQ ID NO: 582823 - DNA, 13 bp, D. melanogaster
ataccactattac

SEQ ID NO: 582824 - DNA, 13 bp, D. melanogaster
ataccagatacca

SEQ ID NO: 582825 - DNA, 13 bp, D. melanogaster
ataccagctgagg

SEQ ID NO: 582826 - DNA, 13 bp, D. melanogaster
ataccaggatact

SEQ ID NO: 582827 - DNA, 13 bp, D. melanogaster
ataccataccata

SEQ ID NO: 582828 - DNA, 14 bp, D. melanogaster
ataccataccatac

SEQ ID NO: 582829 - DNA, 13 bp, D. melanogaster
ataccataccatg

SEQ ID NO: 582830 - DNA, 13 bp, D. melanogaster
ataccatactata

SEQ ID NO: 582831 - DNA, 13 bp, D. melanogaster
ataccatatacca

SEQ ID NO: 582832 - DNA, 13 bp, D. melanogaster
ataccatatatgt

SEQ ID NO: 582833 - DNA, 13 bp, D. melanogaster
ataccatcagggg

SEQ ID NO: 582834 - DNA, 13 bp, D. melanogaster
ataccatgcgatg

SEQ ID NO: 582835 - DNA, 13 bp, D. melanogaster
ataccattaaata

SEQ ID NO: 582836 - DNA, 13 bp, D. melanogaster
ataccatttccat

SEQ ID NO: 582837 - DNA, 13 bp, D. melanogaster
ataccattttact

SEQ ID NO: 582838 - DNA, 13 bp, D. melanogaster
atacccaaaatgg

SEQ ID NO: 582839 - DNA, 13 bp, D. melanogaster
atacccacaagtg

SEQ ID NO: 582840 - DNA, 13 bp, D. melanogaster
atacccacatata

SEQ ID NO: 582841 - DNA, 13 bp, D. melanogaster
atacccataccca

SEQ ID NO: 582842 - DNA, 14 bp, D. melanogaster
atacccatacccat

SEQ ID NO: 582843 - DNA, 13 bp, D. melanogaster
atacccatatacc

SEQ ID NO: 582844 - DNA, 13 bp, D. melanogaster
atacccatatcca

SEQ ID NO: 582845 - DNA, 13 bp, D. melanogaster
atacccatgccca

SEQ ID NO: 582846 - DNA, 14 bp, D. melanogaster
atacccattactca

SEQ ID NO: 582847 - DNA, 14 bp, D. melanogaster
atacccattactcg

SEQ ID NO: 582848 - DNA, 13 bp, D. melanogaster
atacccattccca

SEQ ID NO: 582849 - DNA, 13 bp, D. melanogaster
atacccatttcca

SEQ ID NO: 582850 - DNA, 13 bp, D. melanogaster
atacccgttactc

SEQ ID NO: 582851 - DNA, 13 bp, D. melanogaster
atacccgttactt

SEQ ID NO: 582852 - DNA, 13 bp, D. melanogaster
atacccgttattc

SEQ ID NO: 582853 - DNA, 13 bp, D. melanogaster
atacccgttgctc

SEQ ID NO: 582854 - DNA, 13 bp, D. melanogaster
ataccctatataa

SEQ ID NO: 582855 - DNA, 13 bp, D. melanogaster
ataccctgcatta

SEQ ID NO: 582856 - DNA, 13 bp, D. melanogaster
ataccctggaaaa

SEQ ID NO: 582857 - DNA, 13 bp, D. melanogaster
ataccctttaaat

SEQ ID NO: 582858 - DNA, 13 bp, D. melanogaster
ataccctttactc

SEQ ID NO: 582859 - DNA, 13 bp, D. melanogaster
atacccttttaat

SEQ ID NO: 582860 - DNA, 13 bp, D. melanogaster
ataccgaaaaata

SEQ ID NO: 582861 - DNA, 14 bp, D. melanogaster
ataccgaaaataaa

SEQ ID NO: 582862 - DNA, 13 bp, D. melanogaster
ataccgataccga

SEQ ID NO: 582863 - DNA, 13 bp, D. melanogaster
ataccgattattt

SEQ ID NO: 582864 - DNA, 13 bp, D. melanogaster
ataccgcaattaa

SEQ ID NO: 582865 - DNA, 13 bp, D. melanogaster
ataccgcatatag

SEQ ID NO: 582866 - DNA, 13 bp, D. melanogaster
atacctatatata

SEQ ID NO: 582867 - DNA, 13 bp, D. melanogaster
atacctatatatt

SEQ ID NO: 582868 - DNA, 14 bp, D. melanogaster
atacctatatattt

SEQ ID NO: 582869 - DNA, 13 bp, D. melanogaster
atacctatgtata

SEQ ID NO: 582870 - DNA, 14 bp, D. melanogaster
atacctatgtatat

SEQ ID NO: 582871 - DNA, 13 bp, D. melanogaster
atacctatgtatg

SEQ ID NO: 582872 - DNA, 14 bp, D. melanogaster
atacctatgtatgt

SEQ ID NO: 582873 - DNA, 13 bp, D. melanogaster
atacctattaact

SEQ ID NO: 582874 - DNA, 13 bp, D. melanogaster
atacctatttgga

SEQ ID NO: 582875 - DNA, 13 bp, D. melanogaster
atacctcgctgaa

SEQ ID NO: 582876 - DNA, 13 bp, D. melanogaster
atacctgttactc

SEQ ID NO: 582877 - DNA, 13 bp, D. melanogaster
ataccttcgaatg

SEQ ID NO: 582878 - DNA, 13 bp, D. melanogaster
atacctttaaaaa

SEQ ID NO: 582879 - DNA, 13 bp, D. melanogaster
atacctttaaaat

SEQ ID NO: 582880 - DNA, 13 bp, D. melanogaster
atacctttctatt

SEQ ID NO: 582881 - DNA, 13 bp, D. melanogaster
atacgaaaaaatt

SEQ ID NO: 582882 - DNA, 13 bp, D. melanogaster
atacgaaaaatat

SEQ ID NO: 582883 - DNA, 13 bp, D. melanogaster
atacgaaaatgaa

SEQ ID NO: 582884 - DNA, 13 bp, D. melanogaster
atacgaaaatgtt

SEQ ID NO: 582885 - DNA, 13 bp, D. melanogaster
atacgaaatatgt

SEQ ID NO: 582886 - DNA, 13 bp, D. melanogaster
atacgaaatattt

SEQ ID NO: 582887 - DNA, 13 bp, D. melanogaster
atacgaacatata

SEQ ID NO: 582888 - DNA, 13 bp, D. melanogaster
atacgaactaaaa

SEQ ID NO: 582889 - DNA, 13 bp, D. melanogaster
atacgaatacaaa

SEQ ID NO: 582890 - DNA, 14 bp, D. melanogaster
atacgaatacgaat

SEQ ID NO: 582891 - DNA, 13 bp, D. melanogaster
atacgaatatttt

SEQ ID NO: 582892 - DNA, 13 bp, D. melanogaster
atacgaatgcgaa

SEQ ID NO: 582893 - DNA, 14 bp, D. melanogaster
atacgaatgcgaat

SEQ ID NO: 582894 - DNA, 13 bp, D. melanogaster
atacgaatttatt

SEQ ID NO: 582895 - DNA, 13 bp, D. melanogaster
atacgacagacaa

SEQ ID NO: 582896 - DNA, 13 bp, D. melanogaster
atacgacgcgttg

SEQ ID NO: 582897 - DNA, 13 bp, D. melanogaster
atacgagaacaaa

SEQ ID NO: 582898 - DNA, 13 bp, D. melanogaster
atacgagtatatg

SEQ ID NO: 582899 - DNA, 14 bp, D. melanogaster
atacgagtatatgt

SEQ ID NO: 582900 - DNA, 13 bp, D. melanogaster
atacgatatacga

SEQ ID NO: 582901 - DNA, 13 bp, D. melanogaster
atacgatatatat

SEQ ID NO: 582902 - DNA, 13 bp, D. melanogaster
atacgatatttta

SEQ ID NO: 582903 - DNA, 13 bp, D. melanogaster
atacgatccgatc

SEQ ID NO: 582904 - DNA, 13 bp, D. melanogaster
atacgattcgatt

SEQ ID NO: 582905 - DNA, 13 bp, D. melanogaster
atacgattgataa

SEQ ID NO: 582906 - DNA, 13 bp, D. melanogaster
atacgattttaat

SEQ ID NO: 582907 - DNA, 13 bp, D. melanogaster
atacgattttttg

SEQ ID NO: 582908 - DNA, 13 bp, D. melanogaster
atacgcaaataaa

SEQ ID NO: 582909 - DNA, 13 bp, D. melanogaster
atacgcaacgttg

SEQ ID NO: 582910 - DNA, 13 bp, D. melanogaster
atacgcaatgtgc

SEQ ID NO: 582911 - DNA, 13 bp, D. melanogaster
atacgcaattgta

SEQ ID NO: 582912 - DNA, 13 bp, D. melanogaster
atacgcaccgttg

SEQ ID NO: 582913 - DNA, 14 bp, D. melanogaster
atacgcaccgttgc

SEQ ID NO: 582914 - DNA, 13 bp, D. melanogaster
atacgcacgcaca

SEQ ID NO: 582915 - DNA, 14 bp, D. melanogaster
atacgcacgcacac

SEQ ID NO: 582916 - DNA, 13 bp, D. melanogaster
atacgcactgttg

SEQ ID NO: 582917 - DNA, 14 bp, D. melanogaster
atacgcactgttgc

SEQ ID NO: 582918 - DNA, 13 bp, D. melanogaster
atacgcagaaaac

SEQ ID NO: 582919 - DNA, 14 bp, D. melanogaster
atacgcagcgttgt

SEQ ID NO: 582920 - DNA, 13 bp, D. melanogaster
atacgcagtggtg

SEQ ID NO: 582921 - DNA, 13 bp, D. melanogaster
atacgcatacgca

SEQ ID NO: 582922 - DNA, 13 bp, D. melanogaster
atacgccacgttg

SEQ ID NO: 582923 - DNA, 13 bp, D. melanogaster
atacgccatgtgg

SEQ ID NO: 582924 - DNA, 14 bp, D. melanogaster
atacgccatgtggc

SEQ ID NO: 582925 - DNA, 13 bp, D. melanogaster
atacgccatgttg

SEQ ID NO: 582926 - DNA, 13 bp, D. melanogaster
atacgccctgtgt

SEQ ID NO: 582927 - DNA, 13 bp, D. melanogaster
atacgccctgttg

SEQ ID NO: 582928 - DNA, 14 bp, D. melanogaster
atacgccgcgttgt

SEQ ID NO: 582929 - DNA, 13 bp, D. melanogaster
atacgccgtgttg

SEQ ID NO: 582930 - DNA, 13 bp, D. melanogaster
atacgcggcgtat

SEQ ID NO: 582931 - DNA, 13 bp, D. melanogaster
atacggaaatgtg

SEQ ID NO: 582932 - DNA, 13 bp, D. melanogaster
atacggacatacg

SEQ ID NO: 582933 - DNA, 13 bp, D. melanogaster
atacggacggaca

SEQ ID NO: 582934 - DNA, 15 bp, D. melanogaster
atacggatacggata

SEQ ID NO: 582935 - DNA, 14 bp, D. melanogaster
atacggatgcggat

SEQ ID NO: 582936 - DNA, 13 bp, D. melanogaster
atacggattgtat

SEQ ID NO: 582937 - DNA, 13 bp, D. melanogaster
atacggccaatgt

SEQ ID NO: 582938 - DNA, 13 bp, D. melanogaster
atacggggaaaac

SEQ ID NO: 582939 - DNA, 14 bp, D. melanogaster
atacggggaaaacc

SEQ ID NO: 582940 - DNA, 13 bp, D. melanogaster
atacggtcagcaa

SEQ ID NO: 582941 - DNA, 13 bp, D. melanogaster
atacgtaatgtga

SEQ ID NO: 582942 - DNA, 13 bp, D. melanogaster
atacgtacatacg

SEQ ID NO: 582943 - DNA, 13 bp, D. melanogaster
atacgtacatata

SEQ ID NO: 582944 - DNA, 14 bp, D. melanogaster
atacgtacatatat

SEQ ID NO: 582945 - DNA, 13 bp, D. melanogaster
atacgtatacgta

SEQ ID NO: 582946 - DNA, 14 bp, D. melanogaster
atacgtatacgtat

SEQ ID NO: 582947 - DNA, 13 bp, D. melanogaster
atacgtatacgtt

SEQ ID NO: 582948 - DNA, 13 bp, D. melanogaster
atacgtatataaa

SEQ ID NO: 582949 - DNA, 13 bp, D. melanogaster
atacgtatataca

SEQ ID NO: 582950 - DNA, 14 bp, D. melanogaster
atacgtatatatgt

SEQ ID NO: 582951 - DNA, 13 bp, D. melanogaster
atacgtatatatt

SEQ ID NO: 582952 - DNA, 14 bp, D. melanogaster
atacgtatatattt

SEQ ID NO: 582953 - DNA, 13 bp, D. melanogaster
atacgtatatgta

SEQ ID NO: 582954 - DNA, 14 bp, D. melanogaster
atacgtatatgtat

SEQ ID NO: 582955 - DNA, 14 bp, D. melanogaster
atacgtatgtatat

SEQ ID NO: 582956 - DNA, 13 bp, D. melanogaster
atacgtatgtgta

SEQ ID NO: 582957 - DNA, 13 bp, D. melanogaster
atacgtatttatt

SEQ ID NO: 582958 - DNA, 13 bp, D. melanogaster
atacgtgtaatta

SEQ ID NO: 582959 - DNA, 14 bp, D. melanogaster
atacgtgtgcacac

SEQ ID NO: 582960 - DNA, 14 bp, D. melanogaster
atacgtgtgtgtgt

SEQ ID NO: 582961 - DNA, 13 bp, D. melanogaster
atacgtttttaaa

SEQ ID NO: 582962 - DNA, 13 bp, D. melanogaster
atacgttttttaa

SEQ ID NO: 582963 - DNA, 13 bp, D. melanogaster
atactaaacattt

SEQ ID NO: 582964 - DNA, 13 bp, D. melanogaster
atactaaagtttt

SEQ ID NO: 582965 - DNA, 13 bp, D. melanogaster
atactaaatgttt

SEQ ID NO: 582966 - DNA, 13 bp, D. melanogaster
atactaataccaa

SEQ ID NO: 582967 - DNA, 14 bp, D. melanogaster
atactaatgtacat

SEQ ID NO: 582968 - DNA, 13 bp, D. melanogaster
atactacatttta

SEQ ID NO: 582969 - DNA, 14 bp, D. melanogaster
atactactactact

SEQ ID NO: 582970 - DNA, 13 bp, D. melanogaster
atactactacttt

SEQ ID NO: 582971 - DNA, 13 bp, D. melanogaster
atactactatata

SEQ ID NO: 582972 - DNA, 13 bp, D. melanogaster
atactagattcgt

SEQ ID NO: 582973 - DNA, 13 bp, D. melanogaster
atactataccata

SEQ ID NO: 582974 - DNA, 14 bp, D. melanogaster
atactatatactat

SEQ ID NO: 582975 - DNA, 13 bp, D. melanogaster
atactatatactt

SEQ ID NO: 582976 - DNA, 13 bp, D. melanogaster
atactatatagta

SEQ ID NO: 582977 - DNA, 14 bp, D. melanogaster
atactatatagtat

SEQ ID NO: 582978 - DNA, 13 bp, D. melanogaster
atactatatatac

SEQ ID NO: 582979 - DNA, 14 bp, D. melanogaster
atactatatataca

SEQ ID NO: 582980 - DNA, 13 bp, D. melanogaster
atactatatatag

SEQ ID NO: 582981 - DNA, 13 bp, D. melanogaster
atactatatatct

SEQ ID NO: 582982 - DNA, 13 bp, D. melanogaster
atactatatatgt

SEQ ID NO: 582983 - DNA, 13 bp, D. melanogaster
atactatatgtac

SEQ ID NO: 582984 - DNA, 13 bp, D. melanogaster
atactattaacaa

SEQ ID NO: 582985 - DNA, 13 bp, D. melanogaster
atactattgttat

SEQ ID NO: 582986 - DNA, 15 bp, D. melanogaster
atactatttctgggt

SEQ ID NO: 582987 - DNA, 13 bp, D. melanogaster
atactattttttg

SEQ ID NO: 582988 - DNA, 13 bp, D. melanogaster
atactcaatattt

SEQ ID NO: 582989 - DNA, 14 bp, D. melanogaster
atactcataaggaa

SEQ ID NO: 582990 - DNA, 14 bp, D. melanogaster
atactcatactcat

SEQ ID NO: 582991 - DNA, 13 bp, D. melanogaster
atactcgcacaca

SEQ ID NO: 582992 - DNA, 13 bp, D. melanogaster
atactcgtaaata

SEQ ID NO: 582993 - DNA, 13 bp, D. melanogaster
atactcgtacata

SEQ ID NO: 582994 - DNA, 14 bp, D. melanogaster
atactcgtacatat

SEQ ID NO: 582995 - DNA, 14 bp, D. melanogaster
atactcgtatatat

SEQ ID NO: 582996 - DNA, 13 bp, D. melanogaster
atactcgtatatt

SEQ ID NO: 582997 - DNA, 13 bp, D. melanogaster
atactctgatatt

SEQ ID NO: 582998 - DNA, 13 bp, D. melanogaster
atactctgccgaa

SEQ ID NO: 582999 - DNA, 13 bp, D. melanogaster
atactgaatggaa

SEQ ID NO: 583000 - DNA, 14 bp, D. melanogaster
atactgatactgat

SEQ ID NO: 583001 - DNA, 14 bp, D. melanogaster
atactgcacttttt

SEQ ID NO: 583002 - DNA, 13 bp, D. melanogaster
atactgcttcaac

SEQ ID NO: 583003 - DNA, 14 bp, D. melanogaster
atactggaaaaaca

SEQ ID NO: 583004 - DNA, 14 bp, D. melanogaster
atactggccagcag

SEQ ID NO: 583005 - DNA, 13 bp, D. melanogaster
atactggccatca

SEQ ID NO: 583006 - DNA, 13 bp, D. melanogaster
atacttaatactt

SEQ ID NO: 583007 - DNA, 13 bp, D. melanogaster
atacttacaatat

SEQ ID NO: 583008 - DNA, 13 bp, D. melanogaster
atacttacaattt

SEQ ID NO: 583009 - DNA, 14 bp, D. melanogaster
atacttacacacac

SEQ ID NO: 583010 - DNA, 13 bp, D. melanogaster
atacttacactta

SEQ ID NO: 583011 - DNA, 13 bp, D. melanogaster
atacttacatatt

SEQ ID NO: 583012 - DNA, 13 bp, D. melanogaster
atacttacttata

SEQ ID NO: 583013 - DNA, 13 bp, D. melanogaster
atacttatactta

SEQ ID NO: 583014 - DNA, 13 bp, D. melanogaster
atacttatatgta

SEQ ID NO: 583015 - DNA, 13 bp, D. melanogaster
atacttatgcata

SEQ ID NO: 583016 - DNA, 13 bp, D. melanogaster
atacttatgccca

SEQ ID NO: 583017 - DNA, 13 bp, D. melanogaster
atacttattcaaa

SEQ ID NO: 583018 - DNA, 15 bp, D. melanogaster
atacttccctcaaaa

SEQ ID NO: 583019 - DNA, 13 bp, D. melanogaster
atacttgaaaata

SEQ ID NO: 583020 - DNA, 13 bp, D. melanogaster
atacttgataaaa

SEQ ID NO: 583021 - DNA, 13 bp, D. melanogaster
atacttgattttt

SEQ ID NO: 583022 - DNA, 14 bp, D. melanogaster
atacttgggctggg

SEQ ID NO: 583023 - DNA, 13 bp, D. melanogaster
atacttgtattta

SEQ ID NO: 583024 - DNA, 13 bp, D. melanogaster
atactttaatttc

SEQ ID NO: 583025 - DNA, 13 bp, D. melanogaster
atactttaccacc

SEQ ID NO: 583026 - DNA, 13 bp, D. melanogaster
atactttagaaaa

SEQ ID NO: 583027 - DNA, 13 bp, D. melanogaster
atactttcaatat

SEQ ID NO: 583028 - DNA, 13 bp, D. melanogaster
atactttcgggcg

SEQ ID NO: 583029 - DNA, 13 bp, D. melanogaster
atactttctttaa

SEQ ID NO: 583030 - DNA, 13 bp, D. melanogaster
atactttgagatt

SEQ ID NO: 583031 - DNA, 13 bp, D. melanogaster
atactttgttcat

SEQ ID NO: 583032 - DNA, 13 bp, D. melanogaster
atacttttagaca

SEQ ID NO: 583033 - DNA, 13 bp, D. melanogaster
atacttttcaaat

SEQ ID NO: 583034 - DNA, 13 bp, D. melanogaster
atacttttcatat

SEQ ID NO: 583035 - DNA, 14 bp, D. melanogaster
atacttttccgttt

SEQ ID NO: 583036 - DNA, 13 bp, D. melanogaster
atacttttcggct

SEQ ID NO: 583037 - DNA, 13 bp, D. melanogaster
atacttttgaaaa

SEQ ID NO: 583038 - DNA, 13 bp, D. melanogaster
atacttttgcaat

SEQ ID NO: 583039 - DNA, 13 bp, D. melanogaster
atacttttgcttt

SEQ ID NO: 583040 - DNA, 13 bp, D. melanogaster
atacttttggaca

SEQ ID NO: 583041 - DNA, 13 bp, D. melanogaster
atacttttggcaa

SEQ ID NO: 583042 - DNA, 13 bp, D. melanogaster
atacttttgggca

SEQ ID NO: 583043 - DNA, 13 bp, D. melanogaster
atacttttgggcg

SEQ ID NO: 583044 - DNA, 13 bp, D. melanogaster
atactttttaagc

SEQ ID NO: 583045 - DNA, 13 bp, D. melanogaster
atactttttcaac

SEQ ID NO: 583046 - DNA, 13 bp, D. melanogaster
atacttttttgat

SEQ ID NO: 583047 - DNA, 13 bp, D. melanogaster
atagaaaaacttt

SEQ ID NO: 583048 - DNA, 13 bp, D. melanogaster
atagaaaaagtac

SEQ ID NO: 583049 - DNA, 13 bp, D. melanogaster
atagaaaaatatc

SEQ ID NO: 583050 - DNA, 13 bp, D. melanogaster
atagaaaacaatt

SEQ ID NO: 583051 - DNA, 13 bp, D. melanogaster
atagaaaagcaat

SEQ ID NO: 583052 - DNA, 13 bp, D. melanogaster
atagaaaagtcat

SEQ ID NO: 583053 - DNA, 13 bp, D. melanogaster
atagaaaagtttc

SEQ ID NO: 583054 - DNA, 13 bp, D. melanogaster
atagaaaatttcc

SEQ ID NO: 583055 - DNA, 14 bp, D. melanogaster
atagaaacaaacgg

SEQ ID NO: 583056 - DNA, 13 bp, D. melanogaster
atagaaactaatt

SEQ ID NO: 583057 - DNA, 13 bp, D. melanogaster
atagaaagcatag

SEQ ID NO: 583058 - DNA, 13 bp, D. melanogaster
atagaaagctaaa

SEQ ID NO: 583059 - DNA, 13 bp, D. melanogaster
atagaaaggtatt

SEQ ID NO: 583060 - DNA, 13 bp, D. melanogaster
atagaaataatca

SEQ ID NO: 583061 - DNA, 13 bp, D. melanogaster
atagaaataattg

SEQ ID NO: 583062 - DNA, 13 bp, D. melanogaster
atagaaatacata

SEQ ID NO: 583063 - DNA, 13 bp, D. melanogaster
atagaaatatatg

SEQ ID NO: 583064 - DNA, 13 bp, D. melanogaster
atagaaatcaatt

SEQ ID NO: 583065 - DNA, 13 bp, D. melanogaster
atagaaatcgaaa

SEQ ID NO: 583066 - DNA, 13 bp, D. melanogaster
atagaaatcgata

SEQ ID NO: 583067 - DNA, 13 bp, D. melanogaster
atagaaatgaatc

SEQ ID NO: 583068 - DNA, 13 bp, D. melanogaster
atagaaatgcatt

SEQ ID NO: 583069 - DNA, 13 bp, D. melanogaster
atagaaatgccaa

SEQ ID NO: 583070 - DNA, 13 bp, D. melanogaster
atagaaatggaag

SEQ ID NO: 583071 - DNA, 13 bp, D. melanogaster
atagaaatgttat

SEQ ID NO: 583072 - DNA, 13 bp, D. melanogaster
atagaaattacaa

SEQ ID NO: 583073 - DNA, 13 bp, D. melanogaster
atagaaattcaat

SEQ ID NO: 583074 - DNA, 13 bp, D. melanogaster
atagaaattccaa

SEQ ID NO: 583075 - DNA, 13 bp, D. melanogaster
atagaaattgtca

SEQ ID NO: 583076 - DNA, 14 bp, D. melanogaster
atagaaattgttaa

SEQ ID NO: 583077 - DNA, 13 bp, D. melanogaster
atagaaatttaca

SEQ ID NO: 583078 - DNA, 14 bp, D. melanogaster
atagaaatttacaa

SEQ ID NO: 583079 - DNA, 15 bp, D. melanogaster
atagaacaagcattt

SEQ ID NO: 583080 - DNA, 13 bp, D. melanogaster
atagaaccattag

SEQ ID NO: 583081 - DNA, 13 bp, D. melanogaster
atagaagatatat

SEQ ID NO: 583082 - DNA, 13 bp, D. melanogaster
atagaagccaaat

SEQ ID NO: 583083 - DNA, 13 bp, D. melanogaster
atagaaggaaaca

SEQ ID NO: 583084 - DNA, 13 bp, D. melanogaster
atagaatagaatt

SEQ ID NO: 583085 - DNA, 13 bp, D. melanogaster
atagaatgcagaa

SEQ ID NO: 583086 - DNA, 14 bp, D. melanogaster
atagaatgcagaaa

SEQ ID NO: 583087 - DNA, 14 bp, D. melanogaster
atagaattagacga

SEQ ID NO: 583088 - DNA, 13 bp, D. melanogaster
atagaattattca

SEQ ID NO: 583089 - DNA, 13 bp, D. melanogaster
atagaatttcatt

SEQ ID NO: 583090 - DNA, 13 bp, D. melanogaster
atagacagataga

SEQ ID NO: 583091 - DNA, 14 bp, D. melanogaster
atagacagcagcga

SEQ ID NO: 583092 - DNA, 13 bp, D. melanogaster
atagacatagaca

SEQ ID NO: 583093 - DNA, 13 bp, D. melanogaster
atagacatatata

SEQ ID NO: 583094 - DNA, 13 bp, D. melanogaster
atagaccatttaa

SEQ ID NO: 583095 - DNA, 13 bp, D. melanogaster
atagacccaatat

SEQ ID NO: 583096 - DNA, 13 bp, D. melanogaster
atagacgaggtgt

SEQ ID NO: 583097 - DNA, 13 bp, D. melanogaster
atagagaaattat

SEQ ID NO: 583098 - DNA, 13 bp, D. melanogaster
atagagaagtgca

SEQ ID NO: 583099 - DNA, 13 bp, D. melanogaster
atagagatagaga

SEQ ID NO: 583100 - DNA, 14 bp, D. melanogaster
atagagatagagat

SEQ ID NO: 583101 - DNA, 13 bp, D. melanogaster
atagaggagaacc

SEQ ID NO: 583102 - DNA, 13 bp, D. melanogaster
atagaggtaagac

SEQ ID NO: 583103 - DNA, 13 bp, D. melanogaster
atagaggtggagg

SEQ ID NO: 583104 - DNA, 13 bp, D. melanogaster
atagataaacaca

SEQ ID NO: 583105 - DNA, 14 bp, D. melanogaster
atagataaacacaa

SEQ ID NO: 583106 - DNA, 13 bp, D. melanogaster
atagataaataca

SEQ ID NO: 583107 - DNA, 14 bp, D. melanogaster
atagataataatga

SEQ ID NO: 583108 - DNA, 13 bp, D. melanogaster
atagataatagat

SEQ ID NO: 583109 - DNA, 13 bp, D. melanogaster
atagatacaaata

SEQ ID NO: 583110 - DNA, 13 bp, D. melanogaster
atagatacaattt

SEQ ID NO: 583111 - DNA, 13 bp, D. melanogaster
atagatacagata

SEQ ID NO: 583112 - DNA, 13 bp, D. melanogaster
atagatagagata

SEQ ID NO: 583113 - DNA, 13 bp, D. melanogaster
atagatagataga

SEQ ID NO: 583114 - DNA, 14 bp, D. melanogaster
atagatagatagat

SEQ ID NO: 583115 - DNA, 13 bp, D. melanogaster
atagatagattga

SEQ ID NO: 583116 - DNA, 13 bp, D. melanogaster
atagatataagca

SEQ ID NO: 583117 - DNA, 14 bp, D. melanogaster
atagatataatcga

SEQ ID NO: 583118 - DNA, 13 bp, D. melanogaster
atagatatacaaa

SEQ ID NO: 583119 - DNA, 13 bp, D. melanogaster
atagatatagata

SEQ ID NO: 583120 - DNA, 14 bp, D. melanogaster
atagatatagatat

SEQ ID NO: 583121 - DNA, 13 bp, D. melanogaster
atagatatatacg

SEQ ID NO: 583122 - DNA, 14 bp, D. melanogaster
atagatatatagat

SEQ ID NO: 583123 - DNA, 14 bp, D. melanogaster
atagatatatatgt

SEQ ID NO: 583124 - DNA, 14 bp, D. melanogaster
atagatatatgtat

SEQ ID NO: 583125 - DNA, 13 bp, D. melanogaster
atagatatgcata

SEQ ID NO: 583126 - DNA, 13 bp, D. melanogaster
atagatatgtata

SEQ ID NO: 583127 - DNA, 14 bp, D. melanogaster
atagatatgtatat

SEQ ID NO: 583128 - DNA, 13 bp, D. melanogaster
atagatattaagg

SEQ ID NO: 583129 - DNA, 13 bp, D. melanogaster
atagatcctattt

SEQ ID NO: 583130 - DNA, 13 bp, D. melanogaster
atagatcgagctt

SEQ ID NO: 583131 - DNA, 13 bp, D. melanogaster
atagatctgaaat

SEQ ID NO: 583132 - DNA, 14 bp, D. melanogaster
atagatctgaaatt

SEQ ID NO: 583133 - DNA, 13 bp, D. melanogaster
atagatctgacaa

SEQ ID NO: 583134 - DNA, 13 bp, D. melanogaster
atagatgatattt

SEQ ID NO: 583135 - DNA, 14 bp, D. melanogaster
atagatgatatttt

SEQ ID NO: 583136 - DNA, 13 bp, D. melanogaster
atagatgatgaat

SEQ ID NO: 583137 - DNA, 13 bp, D. melanogaster
atagatgggaaaa

SEQ ID NO: 583138 - DNA, 13 bp, D. melanogaster
atagatgtatgta

SEQ ID NO: 583139 - DNA, 13 bp, D. melanogaster
atagatgtggcct

SEQ ID NO: 583140 - DNA, 13 bp, D. melanogaster
atagattctggat

SEQ ID NO: 583141 - DNA, 13 bp, D. melanogaster
atagatttaaagc

SEQ ID NO: 583142 - DNA, 13 bp, D. melanogaster
atagatttatatg

SEQ ID NO: 583143 - DNA, 13 bp, D. melanogaster
atagatttcataa

SEQ ID NO: 583144 - DNA, 14 bp, D. melanogaster
atagatttcataaa

SEQ ID NO: 583145 - DNA, 13 bp, D. melanogaster
atagatttccatt

SEQ ID NO: 583146 - DNA, 13 bp, D. melanogaster
atagatttgccaa

SEQ ID NO: 583147 - DNA, 13 bp, D. melanogaster
atagattttaaca

SEQ ID NO: 583148 - DNA, 14 bp, D. melanogaster
atagattttatcaa

SEQ ID NO: 583149 - DNA, 14 bp, D. melanogaster
atagcaaaaataat

SEQ ID NO: 583150 - DNA, 13 bp, D. melanogaster
atagcaaaagcaa

SEQ ID NO: 583151 - DNA, 13 bp, D. melanogaster
atagcaaacaaat

SEQ ID NO: 583152 - DNA, 14 bp, D. melanogaster
atagcaaacatttt

SEQ ID NO: 583153 - DNA, 13 bp, D. melanogaster
atagcaaatattt

SEQ ID NO: 583154 - DNA, 13 bp, D. melanogaster
atagcaaattaaa

SEQ ID NO: 583155 - DNA, 15 bp, D. melanogaster
atagcaacagcaaca

SEQ ID NO: 583156 - DNA, 13 bp, D. melanogaster
atagcaacatttt

SEQ ID NO: 583157 - DNA, 14 bp, D. melanogaster
atagcaataataat

SEQ ID NO: 583158 - DNA, 13 bp, D. melanogaster
atagcaatagcaa

SEQ ID NO: 583159 - DNA, 13 bp, D. melanogaster
atagcaatatata

SEQ ID NO: 583160 - DNA, 13 bp, D. melanogaster
atagcaatttgtt

SEQ ID NO: 583161 - DNA, 13 bp, D. melanogaster
atagcaatttttt

SEQ ID NO: 583162 - DNA, 13 bp, D. melanogaster
atagcacaaaaca

SEQ ID NO: 583163 - DNA, 13 bp, D. melanogaster
atagcacacacac

SEQ ID NO: 583164 - DNA, 13 bp, D. melanogaster
atagcactgtaat

SEQ ID NO: 583165 - DNA, 13 bp, D. melanogaster
atagcacttaaaa

SEQ ID NO: 583166 - DNA, 13 bp, D. melanogaster
atagcagcaacaa

SEQ ID NO: 583167 - DNA, 13 bp, D. melanogaster
atagcatactttt

SEQ ID NO: 583168 - DNA, 14 bp, D. melanogaster
atagcatacttttg

SEQ ID NO: 583169 - DNA, 13 bp, D. melanogaster
atagcatagaacc

SEQ ID NO: 583170 - DNA, 13 bp, D. melanogaster
atagcatcattca

SEQ ID NO: 583171 - DNA, 13 bp, D. melanogaster
atagcattctccg

SEQ ID NO: 583172 - DNA, 13 bp, D. melanogaster
atagcattttaat

SEQ ID NO: 583173 - DNA, 13 bp, D. melanogaster
atagccaaaaaag

SEQ ID NO: 583174 - DNA, 13 bp, D. melanogaster
atagccaaaaacc

SEQ ID NO: 583175 - DNA, 13 bp, D. melanogaster
atagccaaactat

SEQ ID NO: 583176 - DNA, 13 bp, D. melanogaster
atagccaaatcga

SEQ ID NO: 583177 - DNA, 13 bp, D. melanogaster
atagccaacaaca

SEQ ID NO: 583178 - DNA, 13 bp, D. melanogaster
atagccacaactt

SEQ ID NO: 583179 - DNA, 13 bp, D. melanogaster
atagccacttaat

SEQ ID NO: 583180 - DNA, 13 bp, D. melanogaster
atagccatagcca

SEQ ID NO: 583181 - DNA, 13 bp, D. melanogaster
atagccgagtcaa

SEQ ID NO: 583182 - DNA, 13 bp, D. melanogaster
atagccgagtcga

SEQ ID NO: 583183 - DNA, 13 bp, D. melanogaster
atagccttacaac

SEQ ID NO: 583184 - DNA, 13 bp, D. melanogaster
atagccttagcaa

SEQ ID NO: 583185 - DNA, 13 bp, D. melanogaster
atagcgaatatat

SEQ ID NO: 583186 - DNA, 13 bp, D. melanogaster
atagcgacaattt

SEQ ID NO: 583187 - DNA, 13 bp, D. melanogaster
atagcgctggcaa

SEQ ID NO: 583188 - DNA, 13 bp, D. melanogaster
atagctactttct

SEQ ID NO: 583189 - DNA, 13 bp, D. melanogaster
atagctagcaaaa

SEQ ID NO: 583190 - DNA, 13 bp, D. melanogaster
atagctagtttta

SEQ ID NO: 583191 - DNA, 13 bp, D. melanogaster
atagctatagcta

SEQ ID NO: 583192 - DNA, 14 bp, D. melanogaster
atagctatagctat

SEQ ID NO: 583193 - DNA, 13 bp, D. melanogaster
atagctcgaaatt

SEQ ID NO: 583194 - DNA, 13 bp, D. melanogaster
atagcttcagagc

SEQ ID NO: 583195 - DNA, 13 bp, D. melanogaster
atagcttcagttt

SEQ ID NO: 583196 - DNA, 14 bp, D. melanogaster
atagcttcgatctt

SEQ ID NO: 583197 - DNA, 13 bp, D. melanogaster
atagcttcgatgc

SEQ ID NO: 583198 - DNA, 13 bp, D. melanogaster
atagcttctttaa

SEQ ID NO: 583199 - DNA, 14 bp, D. melanogaster
atagcttctttaat

SEQ ID NO: 583200 - DNA, 13 bp, D. melanogaster
atagctttaaaaa

SEQ ID NO: 583201 - DNA, 13 bp, D. melanogaster
atagctttaaata

SEQ ID NO: 583202 - DNA, 13 bp, D. melanogaster
atagctttaatta

SEQ ID NO: 583203 - DNA, 13 bp, D. melanogaster
atagctttaattt

SEQ ID NO: 583204 - DNA, 13 bp, D. melanogaster
ataggaaaagact

SEQ ID NO: 583205 - DNA, 13 bp, D. melanogaster
ataggaaaagcaa

SEQ ID NO: 583206 - DNA, 13 bp, D. melanogaster
ataggaaaatatt

SEQ ID NO: 583207 - DNA, 13 bp, D. melanogaster
ataggaaatatat

SEQ ID NO: 583208 - DNA, 13 bp, D. melanogaster
ataggaaatattt

SEQ ID NO: 583209 - DNA, 13 bp, D. melanogaster
ataggaataggaa

SEQ ID NO: 583210 - DNA, 13 bp, D. melanogaster
ataggatattttt

SEQ ID NO: 583211 - DNA, 13 bp, D. melanogaster
ataggcaaacaaa

SEQ ID NO: 583212 - DNA, 13 bp, D. melanogaster
atagggataggga

SEQ ID NO: 583213 - DNA, 14 bp, D. melanogaster
atagggatagggat

SEQ ID NO: 583214 - DNA, 13 bp, D. melanogaster
atagggcacaaaa

SEQ ID NO: 583215 - DNA, 13 bp, D. melanogaster
ataggtatgacaa

SEQ ID NO: 583216 - DNA, 13 bp, D. melanogaster
ataggtattaaaa

SEQ ID NO: 583217 - DNA, 13 bp, D. melanogaster
ataggtatttaaa

SEQ ID NO: 583218 - DNA, 13 bp, D. melanogaster
ataggtttttatg

SEQ ID NO: 583219 - DNA, 13 bp, D. melanogaster
atagtaaaattgt

SEQ ID NO: 583220 - DNA, 15 bp, D. melanogaster
atagtaaaattgttg

SEQ ID NO: 583221 - DNA, 13 bp, D. melanogaster
atagtaaatgact

SEQ ID NO: 583222 - DNA, 13 bp, D. melanogaster
atagtaaggttat

SEQ ID NO: 583223 - DNA, 14 bp, D. melanogaster
atagtaatagtaat

SEQ ID NO: 583224 - DNA, 13 bp, D. melanogaster
atagtaatgattc

SEQ ID NO: 583225 - DNA, 13 bp, D. melanogaster
atagtagaaaacc

SEQ ID NO: 583226 - DNA, 13 bp, D. melanogaster
atagtatactata

SEQ ID NO: 583227 - DNA, 13 bp, D. melanogaster
atagtatagtaaa

SEQ ID NO: 583228 - DNA, 13 bp, D. melanogaster
atagtatagtatt

SEQ ID NO: 583229 - DNA, 13 bp, D. melanogaster
atagtatagtgta

SEQ ID NO: 583230 - DNA, 13 bp, D. melanogaster
atagtatagttta

SEQ ID NO: 583231 - DNA, 14 bp, D. melanogaster
atagtatatagtat

SEQ ID NO: 583232 - DNA, 13 bp, D. melanogaster
atagtatgtacat

SEQ ID NO: 583233 - DNA, 13 bp, D. melanogaster
atagtattcttta

SEQ ID NO: 583234 - DNA, 14 bp, D. melanogaster
atagtattctttaa

SEQ ID NO: 583235 - DNA, 14 bp, D. melanogaster
atagtattttcaaa

SEQ ID NO: 583236 - DNA, 13 bp, D. melanogaster
atagtattttgta

SEQ ID NO: 583237 - DNA, 14 bp, D. melanogaster
atagtcaaaataca

SEQ ID NO: 583238 - DNA, 13 bp, D. melanogaster
atagtcaaatcta

SEQ ID NO: 583239 - DNA, 13 bp, D. melanogaster
atagtcatagtca

SEQ ID NO: 583240 - DNA, 13 bp, D. melanogaster
atagtcatcattc

SEQ ID NO: 583241 - DNA, 13 bp, D. melanogaster
atagtccagtgct

SEQ ID NO: 583242 - DNA, 13 bp, D. melanogaster
atagtcgaaatat

SEQ ID NO: 583243 - DNA, 13 bp, D. melanogaster
atagtcgaggaac

SEQ ID NO: 583244 - DNA, 14 bp, D. melanogaster
atagtcgaggaact

SEQ ID NO: 583245 - DNA, 13 bp, D. melanogaster
atagtcttaatat

SEQ ID NO: 583246 - DNA, 13 bp, D. melanogaster
atagtgaaagttt

SEQ ID NO: 583247 - DNA, 13 bp, D. melanogaster
atagtgaataatt

SEQ ID NO: 583248 - DNA, 13 bp, D. melanogaster
atagtgacaatgt

SEQ ID NO: 583249 - DNA, 13 bp, D. melanogaster
atagtgcccttca

SEQ ID NO: 583250 - DNA, 13 bp, D. melanogaster
atagtggatagtg

SEQ ID NO: 583251 - DNA, 13 bp, D. melanogaster
atagtgtatatat

SEQ ID NO: 583252 - DNA, 13 bp, D. melanogaster
atagttaaagttt

SEQ ID NO: 583253 - DNA, 13 bp, D. melanogaster
atagttaatagtt

SEQ ID NO: 583254 - DNA, 13 bp, D. melanogaster
atagttacacaaa

SEQ ID NO: 583255 - DNA, 13 bp, D. melanogaster
atagttactaaaa

SEQ ID NO: 583256 - DNA, 14 bp, D. melanogaster
atagttagttagtt

SEQ ID NO: 583257 - DNA, 13 bp, D. melanogaster
atagttatatagt

SEQ ID NO: 583258 - DNA, 13 bp, D. melanogaster
atagttattttac

SEQ ID NO: 583259 - DNA, 13 bp, D. melanogaster
atagttgatagaa

SEQ ID NO: 583260 - DNA, 14 bp, D. melanogaster
atagttgatagaaa

SEQ ID NO: 583261 - DNA, 13 bp, D. melanogaster
atagttgttattg

SEQ ID NO: 583262 - DNA, 13 bp, D. melanogaster
atagtttaatggg

SEQ ID NO: 583263 - DNA, 13 bp, D. melanogaster
atagtttacaaaa

SEQ ID NO: 583264 - DNA, 14 bp, D. melanogaster
atagtttacaaaac

SEQ ID NO: 583265 - DNA, 13 bp, D. melanogaster
atagtttagttta

SEQ ID NO: 583266 - DNA, 13 bp, D. melanogaster
atagtttccagat

SEQ ID NO: 583267 - DNA, 13 bp, D. melanogaster
atagtttgaataa

SEQ ID NO: 583268 - DNA, 13 bp, D. melanogaster
atagtttggaaaa

SEQ ID NO: 583269 - DNA, 13 bp, D. melanogaster
atagtttgtatta

SEQ ID NO: 583270 - DNA, 13 bp, D. melanogaster
atagtttgtgact

SEQ ID NO: 583271 - DNA, 13 bp, D. melanogaster
atagttttagaaa

SEQ ID NO: 583272 - DNA, 13 bp, D. melanogaster
atagttttcaaaa

SEQ ID NO: 583273 - DNA, 13 bp, D. melanogaster
atagttttcaaat

SEQ ID NO: 583274 - DNA, 13 bp, D. melanogaster
atagttttgtata

SEQ ID NO: 583275 - DNA, 13 bp, D. melanogaster
atagtttttagga

SEQ ID NO: 583276 - DNA, 13 bp, D. melanogaster
atagtttttcatt

SEQ ID NO: 583277 - DNA, 13 bp, D. melanogaster
atagtttttgata

SEQ ID NO: 583278 - DNA, 13 bp, D. melanogaster
atataaaaagcat

SEQ ID NO: 583279 - DNA, 13 bp, D. melanogaster
atataaaaatgcc

SEQ ID NO: 583280 - DNA, 13 bp, D. melanogaster
atataaaaatggt

SEQ ID NO: 583281 - DNA, 13 bp, D. melanogaster
atataaaaccgaa

SEQ ID NO: 583282 - DNA, 13 bp, D. melanogaster
atataaaacggaa

SEQ ID NO: 583283 - DNA, 13 bp, D. melanogaster
atataaaacgtat

SEQ ID NO: 583284 - DNA, 13 bp, D. melanogaster
atataaaactgaa

SEQ ID NO: 583285 - DNA, 13 bp, D. melanogaster
atataaaagcagg

SEQ ID NO: 583286 - DNA, 13 bp, D. melanogaster
atataaaagttgt

SEQ ID NO: 583287 - DNA, 14 bp, D. melanogaster
atataaaatatgca

SEQ ID NO: 583288 - DNA, 13 bp, D. melanogaster
atataaaatcgaa

SEQ ID NO: 583289 - DNA, 13 bp, D. melanogaster
atataaaatcgca

SEQ ID NO: 583290 - DNA, 13 bp, D. melanogaster
atataaaatgcat

SEQ ID NO: 583291 - DNA, 13 bp, D. melanogaster
atataaacaaagc

SEQ ID NO: 583292 - DNA, 13 bp, D. melanogaster
atataaacaagca

SEQ ID NO: 583293 - DNA, 13 bp, D. melanogaster
atataaacagcaa

SEQ ID NO: 583294 - DNA, 13 bp, D. melanogaster
atataaacatgtt

SEQ ID NO: 583295 - DNA, 14 bp, D. melanogaster
atataaacattaag

SEQ ID NO: 583296 - DNA, 13 bp, D. melanogaster
atataaaccaatt

SEQ ID NO: 583297 - DNA, 13 bp, D. melanogaster
atataaaccatat

SEQ ID NO: 583298 - DNA, 13 bp, D. melanogaster
atataaacgtata

SEQ ID NO: 583299 - DNA, 13 bp, D. melanogaster
atataaactactt

SEQ ID NO: 583300 - DNA, 13 bp, D. melanogaster
atataaactgaaa

SEQ ID NO: 583301 - DNA, 13 bp, D. melanogaster
atataaacttcaa

SEQ ID NO: 583302 - DNA, 13 bp, D. melanogaster
atataaagcaatt

SEQ ID NO: 583303 - DNA, 13 bp, D. melanogaster
atataaataagca

SEQ ID NO: 583304 - DNA, 13 bp, D. melanogaster
atataaataagcg

SEQ ID NO: 583305 - DNA, 14 bp, D. melanogaster
atataaataagcgc

SEQ ID NO: 583306 - DNA, 13 bp, D. melanogaster
atataaatacgta

SEQ ID NO: 583307 - DNA, 13 bp, D. melanogaster
atataaatacttc

SEQ ID NO: 583308 - DNA, 13 bp, D. melanogaster
atataaatagctt

SEQ ID NO: 583309 - DNA, 13 bp, D. melanogaster
atataaatatagc

SEQ ID NO: 583310 - DNA, 13 bp, D. melanogaster
atataaatatgct

SEQ ID NO: 583311 - DNA, 13 bp, D. melanogaster
atataaatcagtt

SEQ ID NO: 583312 - DNA, 13 bp, D. melanogaster
atataaatcatac

SEQ ID NO: 583313 - DNA, 13 bp, D. melanogaster
atataaatcgaat

SEQ ID NO: 583314 - DNA, 13 bp, D. melanogaster
atataaatcggaa

SEQ ID NO: 583315 - DNA, 14 bp, D. melanogaster
atataaatgcaaat

SEQ ID NO: 583316 - DNA, 13 bp, D. melanogaster
atataaatggcat

SEQ ID NO: 583317 - DNA, 13 bp, D. melanogaster
atataaatggtaa

SEQ ID NO: 583318 - DNA, 13 bp, D. melanogaster
atataaatggttt

SEQ ID NO: 583319 - DNA, 14 bp, D. melanogaster
atataaatgtacat

SEQ ID NO: 583320 - DNA, 14 bp, D. melanogaster
atataaatgtatgt

SEQ ID NO: 583321 - DNA, 13 bp, D. melanogaster
atataaatgtgaa

SEQ ID NO: 583322 - DNA, 14 bp, D. melanogaster
atataaatgtgtaa

SEQ ID NO: 583323 - DNA, 14 bp, D. melanogaster
atataaatgtgtgt

SEQ ID NO: 583324 - DNA, 13 bp, D. melanogaster
atataaatgttgt

SEQ ID NO: 583325 - DNA, 13 bp, D. melanogaster
atataaatgtttc

SEQ ID NO: 583326 - DNA, 14 bp, D. melanogaster
atataaattgactc

SEQ ID NO: 583327 - DNA, 14 bp, D. melanogaster
atataaatttcagt

SEQ ID NO: 583328 - DNA, 13 bp, D. melanogaster
atataaatttcga

SEQ ID NO: 583329 - DNA, 13 bp, D. melanogaster
atataacaaatag

SEQ ID NO: 583330 - DNA, 13 bp, D. melanogaster
atataacacattt

SEQ ID NO: 583331 - DNA, 13 bp, D. melanogaster
atataacatatgt

SEQ ID NO: 583332 - DNA, 13 bp, D. melanogaster
atataacatcttt

SEQ ID NO: 583333 - DNA, 13 bp, D. melanogaster
atataaccgattt

SEQ ID NO: 583334 - DNA, 13 bp, D. melanogaster
atataacgcatac

SEQ ID NO: 583335 - DNA, 13 bp, D. melanogaster
atataacgtatac

SEQ ID NO: 583336 - DNA, 14 bp, D. melanogaster
atataacgtatacg

SEQ ID NO: 583337 - DNA, 13 bp, D. melanogaster
atataactaacta

SEQ ID NO: 583338 - DNA, 13 bp, D. melanogaster
atataactgaatg

SEQ ID NO: 583339 - DNA, 13 bp, D. melanogaster
atataactggaaa

SEQ ID NO: 583340 - DNA, 13 bp, D. melanogaster
atataagatatac

SEQ ID NO: 583341 - DNA, 13 bp, D. melanogaster
atataagcaaaat

SEQ ID NO: 583342 - DNA, 13 bp, D. melanogaster
atataagctataa

SEQ ID NO: 583343 - DNA, 13 bp, D. melanogaster
atataaggatata

SEQ ID NO: 583344 - DNA, 14 bp, D. melanogaster
atataagtacatat

SEQ ID NO: 583345 - DNA, 14 bp, D. melanogaster
atataataatagtg

SEQ ID NO: 583346 - DNA, 13 bp, D. melanogaster
atataatatacac

SEQ ID NO: 583347 - DNA, 13 bp, D. melanogaster
atataatcgaaaa

SEQ ID NO: 583348 - DNA, 13 bp, D. melanogaster
atataatctattg

SEQ ID NO: 583349 - DNA, 13 bp, D. melanogaster
atataatgcattt

SEQ ID NO: 583350 - DNA, 13 bp, D. melanogaster
atataatggagaa

SEQ ID NO: 583351 - DNA, 13 bp, D. melanogaster
atataatgtacat

SEQ ID NO: 583352 - DNA, 13 bp, D. melanogaster
atataattcccaa

SEQ ID NO: 583353 - DNA, 13 bp, D. melanogaster
atataattgtttg

SEQ ID NO: 583354 - DNA, 13 bp, D. melanogaster
atataatttcgaa

SEQ ID NO: 583355 - DNA, 14 bp, D. melanogaster
atataattttatgc

SEQ ID NO: 583356 - DNA, 13 bp, D. melanogaster
atatacaaaagca

SEQ ID NO: 583357 - DNA, 13 bp, D. melanogaster
atatacaaactgc

SEQ ID NO: 583358 - DNA, 14 bp, D. melanogaster
atatacaaactgca

SEQ ID NO: 583359 - DNA, 13 bp, D. melanogaster
atatacaaagata

SEQ ID NO: 583360 - DNA, 14 bp, D. melanogaster
atatacaaaggaaa

SEQ ID NO: 583361 - DNA, 13 bp, D. melanogaster
atatacaaatacc

SEQ ID NO: 583362 - DNA, 13 bp, D. melanogaster
atatacaaatatc

SEQ ID NO: 583363 - DNA, 13 bp, D. melanogaster
atatacaaatgaa

SEQ ID NO: 583364 - DNA, 13 bp, D. melanogaster
atatacaaattga

SEQ ID NO: 583365 - DNA, 14 bp, D. melanogaster
atatacaaattttg

SEQ ID NO: 583366 - DNA, 14 bp, D. melanogaster
atatacaacatata

SEQ ID NO: 583367 - DNA, 14 bp, D. melanogaster
atatacaacatttt

SEQ ID NO: 583368 - DNA, 13 bp, D. melanogaster
atatacaagaaat

SEQ ID NO: 583369 - DNA, 13 bp, D. melanogaster
atatacaatacat

SEQ ID NO: 583370 - DNA, 13 bp, D. melanogaster
atatacaatagaa

SEQ ID NO: 583371 - DNA, 13 bp, D. melanogaster
atatacaatagtt

SEQ ID NO: 583372 - DNA, 13 bp, D. melanogaster
atatacaatatgt

SEQ ID NO: 583373 - DNA, 13 bp, D. melanogaster
atatacaatcata

SEQ ID NO: 583374 - DNA, 13 bp, D. melanogaster
atatacaatgatt

SEQ ID NO: 583375 - DNA, 13 bp, D. melanogaster
atatacaatgtaa

SEQ ID NO: 583376 - DNA, 14 bp, D. melanogaster
atatacaattatgt

SEQ ID NO: 583377 - DNA, 14 bp, D. melanogaster
atatacaatttaca

SEQ ID NO: 583378 - DNA, 13 bp, D. melanogaster
atatacacaaatt

SEQ ID NO: 583379 - DNA, 13 bp, D. melanogaster
atatacacaatat

SEQ ID NO: 583380 - DNA, 13 bp, D. melanogaster
atatacacacact

SEQ ID NO: 583381 - DNA, 14 bp, D. melanogaster
atatacacacatac

SEQ ID NO: 583382 - DNA, 13 bp, D. melanogaster
atatacacacatg

SEQ ID NO: 583383 - DNA, 13 bp, D. melanogaster
atatacacacgca

SEQ ID NO: 583384 - DNA, 13 bp, D. melanogaster
atatacacacttt

SEQ ID NO: 583385 - DNA, 13 bp, D. melanogaster
atatacacagaaa

SEQ ID NO: 583386 - DNA, 14 bp, D. melanogaster
atatacacagatat

SEQ ID NO: 583387 - DNA, 13 bp, D. melanogaster
atatacacatata

SEQ ID NO: 583388 - DNA, 14 bp, D. melanogaster
atatacacatatac

SEQ ID NO: 583389 - DNA, 13 bp, D. melanogaster
atatacacatatc

SEQ ID NO: 583390 - DNA, 13 bp, D. melanogaster
atatacacgtata

SEQ ID NO: 583391 - DNA, 14 bp, D. melanogaster
atatacacgtatat

SEQ ID NO: 583392 - DNA, 13 bp, D. melanogaster
atatacactatat

SEQ ID NO: 583393 - DNA, 13 bp, D. melanogaster
atatacacttaaa

SEQ ID NO: 583394 - DNA, 13 bp, D. melanogaster
atatacacttttt

SEQ ID NO: 583395 - DNA, 13 bp, D. melanogaster
atatacagaaatg

SEQ ID NO: 583396 - DNA, 13 bp, D. melanogaster
atatacagacata

SEQ ID NO: 583397 - DNA, 13 bp, D. melanogaster
atatacagcatat

SEQ ID NO: 583398 - DNA, 13 bp, D. melanogaster
atatacagctgtg

SEQ ID NO: 583399 - DNA, 13 bp, D. melanogaster
atatacataaatg

SEQ ID NO: 583400 - DNA, 13 bp, D. melanogaster
atatacataagtg

SEQ ID NO: 583401 - DNA, 13 bp, D. melanogaster
atatacataagtt

SEQ ID NO: 583402 - DNA, 13 bp, D. melanogaster
atatacatacaat

SEQ ID NO: 583403 - DNA, 14 bp, D. melanogaster
atatacatacatag

SEQ ID NO: 583404 - DNA, 16 bp, D. melanogaster
atatacatacatatac

SEQ ID NO: 583405 - DNA, 19 bp, D. melanogaster
atatacatacatatatatg

SEQ ID NO: 583406 - DNA, 13 bp, D. melanogaster
atatacatacatg

SEQ ID NO: 583407 - DNA, 14 bp, D. melanogaster
atatacatacatgc

SEQ ID NO: 583408 - DNA, 14 bp, D. melanogaster
atatacatacatta

SEQ ID NO: 583409 - DNA, 13 bp, D. melanogaster
atatacatacgta

SEQ ID NO: 583410 - DNA, 14 bp, D. melanogaster
atatacatacgtat

SEQ ID NO: 583411 - DNA, 13 bp, D. melanogaster
atatacatacttt

SEQ ID NO: 583412 - DNA, 13 bp, D. melanogaster
atatacatagaga

SEQ ID NO: 583413 - DNA, 13 bp, D. melanogaster
atatacatagata

SEQ ID NO: 583414 - DNA, 14 bp, D. melanogaster
atatacatagatac

SEQ ID NO: 583415 - DNA, 13 bp, D. melanogaster
atatacatagatg

SEQ ID NO: 583416 - DNA, 13 bp, D. melanogaster
atatacataggta

SEQ ID NO: 583417 - DNA, 14 bp, D. melanogaster
atatacatataaag

SEQ ID NO: 583418 - DNA, 13 bp, D. melanogaster
atatacatataac

SEQ ID NO: 583419 - DNA, 13 bp, D. melanogaster
atatacatataag

SEQ ID NO: 583420 - DNA, 14 bp, D. melanogaster
atatacatataatg

SEQ ID NO: 583421 - DNA, 17 bp, D. melanogaster
atatacatatacataca

SEQ ID NO: 583422 - DNA, 13 bp, D. melanogaster
atatacatatacc

SEQ ID NO: 583423 - DNA, 13 bp, D. melanogaster
atatacatatagg

SEQ ID NO: 583424 - DNA, 14 bp, D. melanogaster
atatacatatagta

SEQ ID NO: 583425 - DNA, 14 bp, D. melanogaster
atatacatatatcc

SEQ ID NO: 583426 - DNA, 14 bp, D. melanogaster
atatacatatatcg

SEQ ID NO: 583427 - DNA, 14 bp, D. melanogaster
atatacatatatgg

SEQ ID NO: 583428 - DNA, 14 bp, D. melanogaster
atatacatatattg

SEQ ID NO: 583429 - DNA, 13 bp, D. melanogaster
atatacatatgag

SEQ ID NO: 583430 - DNA, 13 bp, D. melanogaster
atatacatatgat

SEQ ID NO: 583431 - DNA, 14 bp, D. melanogaster
atatacatatgtac

SEQ ID NO: 583432 - DNA, 14 bp, D. melanogaster
atatacatatgtat

SEQ ID NO: 583433 - DNA, 13 bp, D. melanogaster
atatacatatgtg

SEQ ID NO: 583434 - DNA, 14 bp, D. melanogaster
atatacatatgtgt

SEQ ID NO: 583435 - DNA, 13 bp, D. melanogaster
atatacatatgtt

SEQ ID NO: 583436 - DNA, 14 bp, D. melanogaster
atatacatatgttt

SEQ ID NO: 583437 - DNA, 13 bp, D. melanogaster
atatacatattac

SEQ ID NO: 583438 - DNA, 13 bp, D. melanogaster
atatacatatttc

SEQ ID NO: 583439 - DNA, 14 bp, D. melanogaster
atatacatatttct

SEQ ID NO: 583440 - DNA, 13 bp, D. melanogaster
atatacatatttg

SEQ ID NO: 583441 - DNA, 14 bp, D. melanogaster
atatacatatttgc

SEQ ID NO: 583442 - DNA, 13 bp, D. melanogaster
atatacatctttt

SEQ ID NO: 583443 - DNA, 13 bp, D. melanogaster
atatacatgcaca

SEQ ID NO: 583444 - DNA, 14 bp, D. melanogaster
atatacatgcatac

SEQ ID NO: 583445 - DNA, 14 bp, D. melanogaster
atatacatgtatat

SEQ ID NO: 583446 - DNA, 13 bp, D. melanogaster
atatacatgtatg

SEQ ID NO: 583447 - DNA, 14 bp, D. melanogaster
atatacatgtatgt

SEQ ID NO: 583448 - DNA, 13 bp, D. melanogaster
atatacatgtgta

SEQ ID NO: 583449 - DNA, 13 bp, D. melanogaster
atatacatgtgtg

SEQ ID NO: 583450 - DNA, 13 bp, D. melanogaster
atatacattacat

SEQ ID NO: 583451 - DNA, 13 bp, D. melanogaster
atatacatttatg

SEQ ID NO: 583452 - DNA, 13 bp, D. melanogaster
atatacattttca

SEQ ID NO: 583453 - DNA, 13 bp, D. melanogaster
atatacattttga

SEQ ID NO: 583454 - DNA, 13 bp, D. melanogaster
atataccaaatat

SEQ ID NO: 583455 - DNA, 13 bp, D. melanogaster
atataccaaattt

SEQ ID NO: 583456 - DNA, 13 bp, D. melanogaster
atataccacaata

SEQ ID NO: 583457 - DNA, 13 bp, D. melanogaster
atataccacatat

SEQ ID NO: 583458 - DNA, 13 bp, D. melanogaster
atataccaggata

SEQ ID NO: 583459 - DNA, 13 bp, D. melanogaster
atataccatataa

SEQ ID NO: 583460 - DNA, 13 bp, D. melanogaster
atataccatttca

SEQ ID NO: 583461 - DNA, 13 bp, D. melanogaster
atatacccatata

SEQ ID NO: 583462 - DNA, 14 bp, D. melanogaster
atatacccatatat

SEQ ID NO: 583463 - DNA, 13 bp, D. melanogaster
atataccctatat

SEQ ID NO: 583464 - DNA, 14 bp, D. melanogaster
atatacccttgcag

SEQ ID NO: 583465 - DNA, 13 bp, D. melanogaster
atatacgaaaata

SEQ ID NO: 583466 - DNA, 13 bp, D. melanogaster
atatacgaacata

SEQ ID NO: 583467 - DNA, 13 bp, D. melanogaster
atatacgaatata

SEQ ID NO: 583468 - DNA, 13 bp, D. melanogaster
atatacgagtata

SEQ ID NO: 583469 - DNA, 14 bp, D. melanogaster
atatacgagtatat

SEQ ID NO: 583470 - DNA, 13 bp, D. melanogaster
atatacgatatac

SEQ ID NO: 583471 - DNA, 13 bp, D. melanogaster
atatacgatccta

SEQ ID NO: 583472 - DNA, 13 bp, D. melanogaster
atatacgattata

SEQ ID NO: 583473 - DNA, 13 bp, D. melanogaster
atatacgatttta

SEQ ID NO: 583474 - DNA, 14 bp, D. melanogaster
atatacgcatatat

SEQ ID NO: 583475 - DNA, 13 bp, D. melanogaster
atatacggatata

SEQ ID NO: 583476 - DNA, 14 bp, D. melanogaster
atatacgtacatac

SEQ ID NO: 583477 - DNA, 14 bp, D. melanogaster
atatacgtacatat

SEQ ID NO: 583478 - DNA, 13 bp, D. melanogaster
atatacgtatggt

SEQ ID NO: 583479 - DNA, 15 bp, D. melanogaster
atatacgtatgtata

SEQ ID NO: 583480 - DNA, 13 bp, D. melanogaster
atatacgtttata

SEQ ID NO: 583481 - DNA, 13 bp, D. melanogaster
atatacgtttttt

SEQ ID NO: 583482 - DNA, 13 bp, D. melanogaster
atatactaatgta

SEQ ID NO: 583483 - DNA, 13 bp, D. melanogaster
atatactacaata

SEQ ID NO: 583484 - DNA, 13 bp, D. melanogaster
atatactacatat

SEQ ID NO: 583485 - DNA, 13 bp, D. melanogaster
atatactactact

SEQ ID NO: 583486 - DNA, 13 bp, D. melanogaster
atatactatacac

SEQ ID NO: 583487 - DNA, 14 bp, D. melanogaster
atatactatacata

SEQ ID NO: 583488 - DNA, 13 bp, D. melanogaster
atatactatatac

SEQ ID NO: 583489 - DNA, 14 bp, D. melanogaster
atatactatatatg

SEQ ID NO: 583490 - DNA, 13 bp, D. melanogaster
atatactatatgt

SEQ ID NO: 583491 - DNA, 13 bp, D. melanogaster
atatactcaaaat

SEQ ID NO: 583492 - DNA, 13 bp, D. melanogaster
atatactcacatt

SEQ ID NO: 583493 - DNA, 13 bp, D. melanogaster
atatactcatata

SEQ ID NO: 583494 - DNA, 14 bp, D. melanogaster
atatactcatatat

SEQ ID NO: 583495 - DNA, 13 bp, D. melanogaster
atatactcgtata

SEQ ID NO: 583496 - DNA, 14 bp, D. melanogaster
atatactcgtatat

SEQ ID NO: 583497 - DNA, 14 bp, D. melanogaster
atatactcgtatgt

SEQ ID NO: 583498 - DNA, 13 bp, D. melanogaster
atatactcgttta

SEQ ID NO: 583499 - DNA, 13 bp, D. melanogaster
atatacttacaca

SEQ ID NO: 583500 - DNA, 14 bp, D. melanogaster
atatacttacatat

SEQ ID NO: 583501 - DNA, 15 bp, D. melanogaster
atatacttgaaaata

SEQ ID NO: 583502 - DNA, 13 bp, D. melanogaster
atatactttaaag

SEQ ID NO: 583503 - DNA, 13 bp, D. melanogaster
atatactttatgt

SEQ ID NO: 583504 - DNA, 13 bp, D. melanogaster
atatactttcaaa

SEQ ID NO: 583505 - DNA, 13 bp, D. melanogaster
atatacttttcaa

SEQ ID NO: 583506 - DNA, 13 bp, D. melanogaster
atatagaaaacat

SEQ ID NO: 583507 - DNA, 13 bp, D. melanogaster
atatagaaaactt

SEQ ID NO: 583508 - DNA, 13 bp, D. melanogaster
atatagaaaagtt

SEQ ID NO: 583509 - DNA, 13 bp, D. melanogaster
atatagaactata

SEQ ID NO: 583510 - DNA, 13 bp, D. melanogaster
atatagaagagct

SEQ ID NO: 583511 - DNA, 13 bp, D. melanogaster
atatagaatatag

SEQ ID NO: 583512 - DNA, 13 bp, D. melanogaster
atatagacatata

SEQ ID NO: 583513 - DNA, 13 bp, D. melanogaster
atatagagataga

SEQ ID NO: 583514 - DNA, 13 bp, D. melanogaster
atatagagatata

SEQ ID NO: 583515 - DNA, 13 bp, D. melanogaster
atatagatacaaa

SEQ ID NO: 583516 - DNA, 13 bp, D. melanogaster
atatagatacaat

SEQ ID NO: 583517 - DNA, 13 bp, D. melanogaster
atatagatacaga

SEQ ID NO: 583518 - DNA, 14 bp, D. melanogaster
atatagatacatat

SEQ ID NO: 583519 - DNA, 13 bp, D. melanogaster
atatagatagaga

SEQ ID NO: 583520 - DNA, 13 bp, D. melanogaster
atatagatagata

SEQ ID NO: 583521 - DNA, 14 bp, D. melanogaster
atatagatagatag

SEQ ID NO: 583522 - DNA, 13 bp, D. melanogaster
atatagatatatc

SEQ ID NO: 583523 - DNA, 13 bp, D. melanogaster
atatagatatgaa

SEQ ID NO: 583524 - DNA, 13 bp, D. melanogaster
atatagatatgta

SEQ ID NO: 583525 - DNA, 14 bp, D. melanogaster
atatagatatgtat

SEQ ID NO: 583526 - DNA, 13 bp, D. melanogaster
atatagatgtaca

SEQ ID NO: 583527 - DNA, 13 bp, D. melanogaster
atatagcaataaa

SEQ ID NO: 583528 - DNA, 13 bp, D. melanogaster
atatagcaatata

SEQ ID NO: 583529 - DNA, 13 bp, D. melanogaster
atatagcaccaag

SEQ ID NO: 583530 - DNA, 13 bp, D. melanogaster
atatagcatacat

SEQ ID NO: 583531 - DNA, 13 bp, D. melanogaster
atatagcatatag

SEQ ID NO: 583532 - DNA, 14 bp, D. melanogaster
atatagcatatagc

SEQ ID NO: 583533 - DNA, 13 bp, D. melanogaster
atatagccatata

SEQ ID NO: 583534 - DNA, 13 bp, D. melanogaster
atatagccttagc

SEQ ID NO: 583535 - DNA, 13 bp, D. melanogaster
atatagcgatatt

SEQ ID NO: 583536 - DNA, 13 bp, D. melanogaster
atatagctatata

SEQ ID NO: 583537 - DNA, 13 bp, D. melanogaster
atatagctttaaa

SEQ ID NO: 583538 - DNA, 13 bp, D. melanogaster
atatagcttttgc

SEQ ID NO: 583539 - DNA, 13 bp, D. melanogaster
atataggatatat

SEQ ID NO: 583540 - DNA, 13 bp, D. melanogaster
atataggtacata

SEQ ID NO: 583541 - DNA, 13 bp, D. melanogaster
atataggtatata

SEQ ID NO: 583542 - DNA, 13 bp, D. melanogaster
atatagtacatac

SEQ ID NO: 583543 - DNA, 13 bp, D. melanogaster
atatagtacatat

SEQ ID NO: 583544 - DNA, 13 bp, D. melanogaster
atatagtacgtgt

SEQ ID NO: 583545 - DNA, 13 bp, D. melanogaster
atatagtactata

SEQ ID NO: 583546 - DNA, 14 bp, D. melanogaster
atatagtagcaaaa

SEQ ID NO: 583547 - DNA, 13 bp, D. melanogaster
atatagtatagta

SEQ ID NO: 583548 - DNA, 14 bp, D. melanogaster
atatagtatatatg

SEQ ID NO: 583549 - DNA, 13 bp, D. melanogaster
atatagtcggaaa

SEQ ID NO: 583550 - DNA, 13 bp, D. melanogaster
atatagtcgtaag

SEQ ID NO: 583551 - DNA, 13 bp, D. melanogaster
atatagttatagt

SEQ ID NO: 583552 - DNA, 13 bp, D. melanogaster
atatagttgatag

SEQ ID NO: 583553 - DNA, 13 bp, D. melanogaster
atatagttttcaa

SEQ ID NO: 583554 - DNA, 13 bp, D. melanogaster
atatataaaacag

SEQ ID NO: 583555 - DNA, 13 bp, D. melanogaster
atatataaaactg

SEQ ID NO: 583556 - DNA, 13 bp, D. melanogaster
atatataaaggta

SEQ ID NO: 583557 - DNA, 13 bp, D. melanogaster
atatataaatagc

SEQ ID NO: 583558 - DNA, 13 bp, D. melanogaster
atatataaattcc

SEQ ID NO: 583559 - DNA, 13 bp, D. melanogaster
atatataaggtat

SEQ ID NO: 583560 - DNA, 15 bp, D. melanogaster
atatataagttcaca

SEQ ID NO: 583561 - DNA, 13 bp, D. melanogaster
atatataatgcaa

SEQ ID NO: 583562 - DNA, 13 bp, D. melanogaster
atatataattgca

SEQ ID NO: 583563 - DNA, 13 bp, D. melanogaster
atatatacaatgt

SEQ ID NO: 583564 - DNA, 14 bp, D. melanogaster
atatatacacaaac

SEQ ID NO: 583565 - DNA, 13 bp, D. melanogaster
atatatacacaca

SEQ ID NO: 583566 - DNA, 14 bp, D. melanogaster
atatatacacacac

SEQ ID NO: 583567 - DNA, 16 bp, D. melanogaster
atatatacacacatat

SEQ ID NO: 583568 - DNA, 13 bp, D. melanogaster
atatatacacact

SEQ ID NO: 583569 - DNA, 13 bp, D. melanogaster
atatatacacaga

SEQ ID NO: 583570 - DNA, 15 bp, D. melanogaster
atatatacacatata

SEQ ID NO: 583571 - DNA, 13 bp, D. melanogaster
atatatacactat

SEQ ID NO: 583572 - DNA, 14 bp, D. melanogaster
atatatacactata

SEQ ID NO: 583573 - DNA, 14 bp, D. melanogaster
atatatacactatt

SEQ ID NO: 583574 - DNA, 13 bp, D. melanogaster
atatatacagata

SEQ ID NO: 583575 - DNA, 14 bp, D. melanogaster
atatatacagatat

SEQ ID NO: 583576 - DNA, 13 bp, D. melanogaster
atatatacagtat

SEQ ID NO: 583577 - DNA, 13 bp, D. melanogaster
atatatacataag

SEQ ID NO: 583578 - DNA, 14 bp, D. melanogaster
atatatacataagt

SEQ ID NO: 583579 - DNA, 14 bp, D. melanogaster
atatatacatacac

SEQ ID NO: 583580 - DNA, 18 bp, D. melanogaster
atatatacatacatatgt

SEQ ID NO: 583581 - DNA, 14 bp, D. melanogaster
atatatacatacgt

SEQ ID NO: 583582 - DNA, 13 bp, D. melanogaster
atatatacatatc

SEQ ID NO: 583583 - DNA, 14 bp, D. melanogaster
atatatacatatct

SEQ ID NO: 583584 - DNA, 13 bp, D. melanogaster
atatatacatcta

SEQ ID NO: 583585 - DNA, 14 bp, D. melanogaster
atatatacatctat

SEQ ID NO: 583586 - DNA, 13 bp, D. melanogaster
atatataccattt

SEQ ID NO: 583587 - DNA, 14 bp, D. melanogaster
atatataccttata

SEQ ID NO: 583588 - DNA, 13 bp, D. melanogaster
atatatacgaata

SEQ ID NO: 583589 - DNA, 13 bp, D. melanogaster
atatatacgatat

SEQ ID NO: 583590 - DNA, 14 bp, D. melanogaster
atatatacgatata

SEQ ID NO: 583591 - DNA, 13 bp, D. melanogaster
atatatacgcaaa

SEQ ID NO: 583592 - DNA, 14 bp, D. melanogaster
atatatacgcatat

SEQ ID NO: 583593 - DNA, 13 bp, D. melanogaster
atatatacgtaca

SEQ ID NO: 583594 - DNA, 13 bp, D. melanogaster
atatatacgtata

SEQ ID NO: 583595 - DNA, 13 bp, D. melanogaster
atatatacgtatt

SEQ ID NO: 583596 - DNA, 13 bp, D. melanogaster
atatatacgtgtg

SEQ ID NO: 583597 - DNA, 13 bp, D. melanogaster
atatatacgttca

SEQ ID NO: 583598 - DNA, 13 bp, D. melanogaster
atatatacgttta

SEQ ID NO: 583599 - DNA, 13 bp, D. melanogaster
atatatactatac

SEQ ID NO: 583600 - DNA, 14 bp, D. melanogaster
atatatactgtata

SEQ ID NO: 583601 - DNA, 13 bp, D. melanogaster
atatatacttgaa

SEQ ID NO: 583602 - DNA, 13 bp, D. melanogaster
atatatactttac

SEQ ID NO: 583603 - DNA, 14 bp, D. melanogaster
atatatactttaca

SEQ ID NO: 583604 - DNA, 13 bp, D. melanogaster
atatatactttgt

SEQ ID NO: 583605 - DNA, 14 bp, D. melanogaster
atatatactttgta

SEQ ID NO: 583606 - DNA, 13 bp, D. melanogaster
atatatagagaga

SEQ ID NO: 583607 - DNA, 14 bp, D. melanogaster
atatatagagtata

SEQ ID NO: 583608 - DNA, 14 bp, D. melanogaster
atatatagatacat

SEQ ID NO: 583609 - DNA, 13 bp, D. melanogaster
atatatagataga

SEQ ID NO: 583610 - DNA, 14 bp, D. melanogaster
atatatagatagat

SEQ ID NO: 583611 - DNA, 13 bp, D. melanogaster
atatatagatatc

SEQ ID NO: 583612 - DNA, 13 bp, D. melanogaster
atatatagatttc

SEQ ID NO: 583613 - DNA, 13 bp, D. melanogaster
atatatagcaaat

SEQ ID NO: 583614 - DNA, 13 bp, D. melanogaster
atatatagcataa

SEQ ID NO: 583615 - DNA, 14 bp, D. melanogaster
atatatagcatata

SEQ ID NO: 583616 - DNA, 13 bp, D. melanogaster
atatataggtatt

SEQ ID NO: 583617 - DNA, 13 bp, D. melanogaster
atatatagtgtgt

SEQ ID NO: 583618 - DNA, 13 bp, D. melanogaster
atatatagttttg

SEQ ID NO: 583619 - DNA, 14 bp, D. melanogaster
atatatataaaagc

SEQ ID NO: 583620 - DNA, 13 bp, D. melanogaster
atatatataaagg

SEQ ID NO: 583621 - DNA, 14 bp, D. melanogaster
atatatataaatcg

SEQ ID NO: 583622 - DNA, 13 bp, D. melanogaster
atatatataacac

SEQ ID NO: 583623 - DNA, 13 bp, D. melanogaster
atatatataagca

SEQ ID NO: 583624 - DNA, 13 bp, D. melanogaster
atatatataagct

SEQ ID NO: 583625 - DNA, 13 bp, D. melanogaster
atatatatacaag

SEQ ID NO: 583626 - DNA, 14 bp, D. melanogaster
atatatatacaagt

SEQ ID NO: 583627 - DNA, 13 bp, D. melanogaster
atatatatacaga

SEQ ID NO: 583628 - DNA, 14 bp, D. melanogaster
atatatatacagat

SEQ ID NO: 583629 - DNA, 13 bp, D. melanogaster
atatatatacagt

SEQ ID NO: 583630 - DNA, 13 bp, D. melanogaster
atatatatacatg

SEQ ID NO: 583631 - DNA, 14 bp, D. melanogaster
atatatatacatgg

SEQ ID NO: 583632 - DNA, 13 bp, D. melanogaster
atatatataccat

SEQ ID NO: 583633 - DNA, 13 bp, D. melanogaster
atatatataccca

SEQ ID NO: 583634 - DNA, 13 bp, D. melanogaster
atatatatacgaa

SEQ ID NO: 583635 - DNA, 14 bp, D. melanogaster
atatatatacgtat

SEQ ID NO: 583636 - DNA, 16 bp, D. melanogaster
atatatatacgtatat

SEQ ID NO: 583637 - DNA, 13 bp, D. melanogaster
atatatatactca

SEQ ID NO: 583638 - DNA, 14 bp, D. melanogaster
atatatatactttc

SEQ ID NO: 583639 - DNA, 13 bp, D. melanogaster
atatatatagagt

SEQ ID NO: 583640 - DNA, 14 bp, D. melanogaster
atatatatagagta

SEQ ID NO: 583641 - DNA, 13 bp, D. melanogaster
atatatatagatc

SEQ ID NO: 583642 - DNA, 13 bp, D. melanogaster
atatatatagatg

SEQ ID NO: 583643 - DNA, 13 bp, D. melanogaster
atatatatagccc

SEQ ID NO: 583644 - DNA, 13 bp, D. melanogaster
atatatatagttc

SEQ ID NO: 583645 - DNA, 14 bp, D. melanogaster
atatatatagtttg

SEQ ID NO: 583646 - DNA, 14 bp, D. melanogaster
atatatatatacgc

SEQ ID NO: 583647 - DNA, 14 bp, D. melanogaster
atatatatatagac

SEQ ID NO: 583648 - DNA, 14 bp, D. melanogaster
atatatatatagtg

SEQ ID NO: 583649 - DNA, 14 bp, D. melanogaster
atatatatatcgat

SEQ ID NO: 583650 - DNA, 13 bp, D. melanogaster
atatatatatcgc

SEQ ID NO: 583651 - DNA, 13 bp, D. melanogaster
atatatatatctc

SEQ ID NO: 583652 - DNA, 14 bp, D. melanogaster
atatatatatgcac

SEQ ID NO: 583653 - DNA, 13 bp, D. melanogaster
atatatatatggc

SEQ ID NO: 583654 - DNA, 14 bp, D. melanogaster
atatatatatgggg

SEQ ID NO: 583655 - DNA, 13 bp, D. melanogaster
atatatatatgtc

SEQ ID NO: 583656 - DNA, 13 bp, D. melanogaster
atatatatatgtg

SEQ ID NO: 583657 - DNA, 14 bp, D. melanogaster
atatatatatgtgc

SEQ ID NO: 583658 - DNA, 13 bp, D. melanogaster
atatatatattcg

SEQ ID NO: 583659 - DNA, 14 bp, D. melanogaster
atatatatattcga

SEQ ID NO: 583660 - DNA, 14 bp, D. melanogaster
atatatatattgca

SEQ ID NO: 583661 - DNA, 14 bp, D. melanogaster
atatatatatttgc

SEQ ID NO: 583662 - DNA, 14 bp, D. melanogaster
atatatatatttgg

SEQ ID NO: 583663 - DNA, 13 bp, D. melanogaster
atatatatcactt

SEQ ID NO: 583664 - DNA, 13 bp, D. melanogaster
atatatatcagtt

SEQ ID NO: 583665 - DNA, 13 bp, D. melanogaster
atatatatccaaa

SEQ ID NO: 583666 - DNA, 13 bp, D. melanogaster
atatatatctgcc

SEQ ID NO: 583667 - DNA, 13 bp, D. melanogaster
atatatatctgta

SEQ ID NO: 583668 - DNA, 13 bp, D. melanogaster
atatatatctgtt

SEQ ID NO: 583669 - DNA, 13 bp, D. melanogaster
atatatatcttga

SEQ ID NO: 583670 - DNA, 13 bp, D. melanogaster
atatatatctttc

SEQ ID NO: 583671 - DNA, 13 bp, D. melanogaster
atatatatctttg

SEQ ID NO: 583672 - DNA, 13 bp, D. melanogaster
atatatatgattg

SEQ ID NO: 583673 - DNA, 14 bp, D. melanogaster
atatatatgcaaaa

SEQ ID NO: 583674 - DNA, 13 bp, D. melanogaster
atatatatgcaac

SEQ ID NO: 583675 - DNA, 13 bp, D. melanogaster
atatatatgcacg

SEQ ID NO: 583676 - DNA, 13 bp, D. melanogaster
atatatatgcgca

SEQ ID NO: 583677 - DNA, 13 bp, D. melanogaster
atatatatgcgta

SEQ ID NO: 583678 - DNA, 14 bp, D. melanogaster
atatatatgcgtat

SEQ ID NO: 583679 - DNA, 13 bp, D. melanogaster
atatatatgctaa

SEQ ID NO: 583680 - DNA, 13 bp, D. melanogaster
atatatatgctat

SEQ ID NO: 583681 - DNA, 14 bp, D. melanogaster
atatatatgctata

SEQ ID NO: 583682 - DNA, 13 bp, D. melanogaster
atatatatgctta

SEQ ID NO: 583683 - DNA, 13 bp, D. melanogaster
atatatatgcttt

SEQ ID NO: 583684 - DNA, 14 bp, D. melanogaster
atatatatggatat

SEQ ID NO: 583685 - DNA, 14 bp, D. melanogaster
atatatatgtaagt

SEQ ID NO: 583686 - DNA, 13 bp, D. melanogaster
atatatatgtaca

SEQ ID NO: 583687 - DNA, 14 bp, D. melanogaster
atatatatgtacaa

SEQ ID NO: 583688 - DNA, 17 bp, D. melanogaster
atatatatgtacatatg

SEQ ID NO: 583689 - DNA, 13 bp, D. melanogaster
atatatatgtact

SEQ ID NO: 583690 - DNA, 13 bp, D. melanogaster
atatatatgtaga

SEQ ID NO: 583691 - DNA, 13 bp, D. melanogaster
atatatatgtatg

SEQ ID NO: 583692 - DNA, 14 bp, D. melanogaster
atatatatgtatgc

SEQ ID NO: 583693 - DNA, 15 bp, D. melanogaster
atatatatgtatgta

SEQ ID NO: 583694 - DNA, 16 bp, D. melanogaster
atatatatgtatgtac

SEQ ID NO: 583695 - DNA, 14 bp, D. melanogaster
atatatatgtattg

SEQ ID NO: 583696 - DNA, 13 bp, D. melanogaster
atatatatgtgtt

SEQ ID NO: 583697 - DNA, 13 bp, D. melanogaster
atatatattcaac

SEQ ID NO: 583698 - DNA, 13 bp, D. melanogaster
atatatattcaca

SEQ ID NO: 583699 - DNA, 13 bp, D. melanogaster
atatatattcagt

SEQ ID NO: 583700 - DNA, 13 bp, D. melanogaster
atatatattccac

SEQ ID NO: 583701 - DNA, 13 bp, D. melanogaster
atatatattccat

SEQ ID NO: 583702 - DNA, 13 bp, D. melanogaster
atatatattcctc

SEQ ID NO: 583703 - DNA, 13 bp, D. melanogaster
atatatattctgg

SEQ ID NO: 583704 - DNA, 13 bp, D. melanogaster
atatatattctgt

SEQ ID NO: 583705 - DNA, 13 bp, D. melanogaster
atatatattgcta

SEQ ID NO: 583706 - DNA, 13 bp, D. melanogaster
atatatattggaa

SEQ ID NO: 583707 - DNA, 13 bp, D. melanogaster
atatatattggct

SEQ ID NO: 583708 - DNA, 13 bp, D. melanogaster
atatatatttagc

SEQ ID NO: 583709 - DNA, 14 bp, D. melanogaster
atatatatttcgat

SEQ ID NO: 583710 - DNA, 13 bp, D. melanogaster
atatatatttgag

SEQ ID NO: 583711 - DNA, 14 bp, D. melanogaster
atatatatttgcaa

SEQ ID NO: 583712 - DNA, 14 bp, D. melanogaster
atatatatttgcat

SEQ ID NO: 583713 - DNA, 13 bp, D. melanogaster
atatatatttggt

SEQ ID NO: 583714 - DNA, 13 bp, D. melanogaster
atatatattttcc

SEQ ID NO: 583715 - DNA, 14 bp, D. melanogaster
atatatattttcca

SEQ ID NO: 583716 - DNA, 13 bp, D. melanogaster
atatatcaaaaag

SEQ ID NO: 583717 - DNA, 13 bp, D. melanogaster
atatatcacattt

SEQ ID NO: 583718 - DNA, 13 bp, D. melanogaster
atatatcagtttt

SEQ ID NO: 583719 - DNA, 13 bp, D. melanogaster
atatatcatttca

SEQ ID NO: 583720 - DNA, 13 bp, D. melanogaster
atatatccaaaat

SEQ ID NO: 583721 - DNA, 13 bp, D. melanogaster
atatatccaaata

SEQ ID NO: 583722 - DNA, 13 bp, D. melanogaster
atatatccatata

SEQ ID NO: 583723 - DNA, 14 bp, D. melanogaster
atatatccatatat

SEQ ID NO: 583724 - DNA, 13 bp, D. melanogaster
atatatcccatat

SEQ ID NO: 583725 - DNA, 14 bp, D. melanogaster
atatatcccatata

SEQ ID NO: 583726 - DNA, 13 bp, D. melanogaster
atatatcctatat

SEQ ID NO: 583727 - DNA, 14 bp, D. melanogaster
atatatcctatata

SEQ ID NO: 583728 - DNA, 13 bp, D. melanogaster
atatatccttgaa

SEQ ID NO: 583729 - DNA, 13 bp, D. melanogaster
atatatccttttg

SEQ ID NO: 583730 - DNA, 13 bp, D. melanogaster
atatatcgaaaat

SEQ ID NO: 583731 - DNA, 13 bp, D. melanogaster
atatatcgaaata

SEQ ID NO: 583732 - DNA, 13 bp, D. melanogaster
atatatcgatata

SEQ ID NO: 583733 - DNA, 14 bp, D. melanogaster
atatatcgatatat

SEQ ID NO: 583734 - DNA, 13 bp, D. melanogaster
atatatcgatatt

SEQ ID NO: 583735 - DNA, 13 bp, D. melanogaster
atatatcgcatat

SEQ ID NO: 583736 - DNA, 13 bp, D. melanogaster
atatatcgtatat

SEQ ID NO: 583737 - DNA, 13 bp, D. melanogaster
atatatctacaat

SEQ ID NO: 583738 - DNA, 13 bp, D. melanogaster
atatatctacata

SEQ ID NO: 583739 - DNA, 13 bp, D. melanogaster
atatatctactta

SEQ ID NO: 583740 - DNA, 13 bp, D. melanogaster
atatatctataca

SEQ ID NO: 583741 - DNA, 14 bp, D. melanogaster
atatatctatatgt

SEQ ID NO: 583742 - DNA, 13 bp, D. melanogaster
atatatctcatat

SEQ ID NO: 583743 - DNA, 13 bp, D. melanogaster
atatatctgatat

SEQ ID NO: 583744 - DNA, 13 bp, D. melanogaster
atatatctgtata

SEQ ID NO: 583745 - DNA, 14 bp, D. melanogaster
atatatctgtatat

SEQ ID NO: 583746 - DNA, 13 bp, D. melanogaster
atatatctgttga

SEQ ID NO: 583747 - DNA, 13 bp, D. melanogaster
atatatctttcaa

SEQ ID NO: 583748 - DNA, 13 bp, D. melanogaster
atatatcttttga

SEQ ID NO: 583749 - DNA, 13 bp, D. melanogaster
atatatgaaagta

SEQ ID NO: 583750 - DNA, 13 bp, D. melanogaster
atatatgaacaat

SEQ ID NO: 583751 - DNA, 13 bp, D. melanogaster
atatatgaacata

SEQ ID NO: 583752 - DNA, 13 bp, D. melanogaster
atatatgaatgta

SEQ ID NO: 583753 - DNA, 13 bp, D. melanogaster
atatatgagatat

SEQ ID NO: 583754 - DNA, 14 bp, D. melanogaster
atatatgagtatat

SEQ ID NO: 583755 - DNA, 13 bp, D. melanogaster
atatatgatatac

SEQ ID NO: 583756 - DNA, 13 bp, D. melanogaster
atatatgatatca

SEQ ID NO: 583757 - DNA, 13 bp, D. melanogaster
atatatgcaaaac

SEQ ID NO: 583758 - DNA, 14 bp, D. melanogaster
atatatgcaaatat

SEQ ID NO: 583759 - DNA, 14 bp, D. melanogaster
atatatgcaatata

SEQ ID NO: 583760 - DNA, 13 bp, D. melanogaster
atatatgcaatta

SEQ ID NO: 583761 - DNA, 13 bp, D. melanogaster
atatatgcaattt

SEQ ID NO: 583762 - DNA, 13 bp, D. melanogaster
atatatgcacaat

SEQ ID NO: 583763 - DNA, 13 bp, D. melanogaster
atatatgcacata

SEQ ID NO: 583764 - DNA, 13 bp, D. melanogaster
atatatgcagcga

SEQ ID NO: 583765 - DNA, 13 bp, D. melanogaster
atatatgcagctg

SEQ ID NO: 583766 - DNA, 13 bp, D. melanogaster
atatatgcataaa

SEQ ID NO: 583767 - DNA, 14 bp, D. melanogaster
atatatgcataaat

SEQ ID NO: 583768 - DNA, 16 bp, D. melanogaster
atatatgcatatatat

SEQ ID NO: 583769 - DNA, 13 bp, D. melanogaster
atatatgcatatg

SEQ ID NO: 583770 - DNA, 14 bp, D. melanogaster
atatatgcatatgt

SEQ ID NO: 583771 - DNA, 14 bp, D. melanogaster
atatatgcatgtat

SEQ ID NO: 583772 - DNA, 13 bp, D. melanogaster
atatatgcatgtt

SEQ ID NO: 583773 - DNA, 13 bp, D. melanogaster
atatatgcattaa

SEQ ID NO: 583774 - DNA, 13 bp, D. melanogaster
atatatgcattta

SEQ ID NO: 583775 - DNA, 14 bp, D. melanogaster
atatatgcatttat

SEQ ID NO: 583776 - DNA, 13 bp, D. melanogaster
atatatgcatttt

SEQ ID NO: 583777 - DNA, 14 bp, D. melanogaster
atatatgcattttt

SEQ ID NO: 583778 - DNA, 13 bp, D. melanogaster
atatatgccacca

SEQ ID NO: 583779 - DNA, 14 bp, D. melanogaster
atatatgccatata

SEQ ID NO: 583780 - DNA, 13 bp, D. melanogaster
atatatgcgcata

SEQ ID NO: 583781 - DNA, 14 bp, D. melanogaster
atatatgcgtatat

SEQ ID NO: 583782 - DNA, 13 bp, D. melanogaster
atatatgctaatt

SEQ ID NO: 583783 - DNA, 13 bp, D. melanogaster
atatatggaaaat

SEQ ID NO: 583784 - DNA, 13 bp, D. melanogaster
atatatggaaagg

SEQ ID NO: 583785 - DNA, 13 bp, D. melanogaster
atatatggataca

SEQ ID NO: 583786 - DNA, 13 bp, D. melanogaster
atatatggatata

SEQ ID NO: 583787 - DNA, 14 bp, D. melanogaster
atatatggatatat

SEQ ID NO: 583788 - DNA, 13 bp, D. melanogaster
atatatggatatg

SEQ ID NO: 583789 - DNA, 13 bp, D. melanogaster
atatatggatatt

SEQ ID NO: 583790 - DNA, 14 bp, D. melanogaster
atatatggatgact

SEQ ID NO: 583791 - DNA, 13 bp, D. melanogaster
atatatggatttt

SEQ ID NO: 583792 - DNA, 13 bp, D. melanogaster
atatatggcaaaa

SEQ ID NO: 583793 - DNA, 14 bp, D. melanogaster
atatatggccagcg

SEQ ID NO: 583794 - DNA, 13 bp, D. melanogaster
atatatgtaaatg

SEQ ID NO: 583795 - DNA, 13 bp, D. melanogaster
atatatgtaacaa

SEQ ID NO: 583796 - DNA, 13 bp, D. melanogaster
atatatgtaagtt

SEQ ID NO: 583797 - DNA, 13 bp, D. melanogaster
atatatgtacaaa

SEQ ID NO: 583798 - DNA, 13 bp, D. melanogaster
atatatgtacaag

SEQ ID NO: 583799 - DNA, 14 bp, D. melanogaster
atatatgtacaata

SEQ ID NO: 583800 - DNA, 13 bp, D. melanogaster
atatatgtacaca

SEQ ID NO: 583801 - DNA, 14 bp, D. melanogaster
atatatgtacacaa

SEQ ID NO: 583802 - DNA, 13 bp, D. melanogaster
atatatgtacata

SEQ ID NO: 583803 - DNA, 14 bp, D. melanogaster
atatatgtacataa

SEQ ID NO: 583804 - DNA, 14 bp, D. melanogaster
atatatgtacatac

SEQ ID NO: 583805 - DNA, 14 bp, D. melanogaster
atatatgtacatag

SEQ ID NO: 583806 - DNA, 13 bp, D. melanogaster
atatatgtacatg

SEQ ID NO: 583807 - DNA, 13 bp, D. melanogaster
atatatgtacatt

SEQ ID NO: 583808 - DNA, 13 bp, D. melanogaster
atatatgtacgtg

SEQ ID NO: 583809 - DNA, 14 bp, D. melanogaster
atatatgtactata

SEQ ID NO: 583810 - DNA, 14 bp, D. melanogaster
atatatgtacttta

SEQ ID NO: 583811 - DNA, 13 bp, D. melanogaster
atatatgtaggta

SEQ ID NO: 583812 - DNA, 14 bp, D. melanogaster
atatatgtaggtat

SEQ ID NO: 583813 - DNA, 13 bp, D. melanogaster
atatatgtagtta

SEQ ID NO: 583814 - DNA, 14 bp, D. melanogaster
atatatgtataaac

SEQ ID NO: 583815 - DNA, 14 bp, D. melanogaster
atatatgtataaag

SEQ ID NO: 583816 - DNA, 13 bp, D. melanogaster
atatatgtataag

SEQ ID NO: 583817 - DNA, 14 bp, D. melanogaster
atatatgtatacat

SEQ ID NO: 583818 - DNA, 13 bp, D. melanogaster
atatatgtatact

SEQ ID NO: 583819 - DNA, 14 bp, D. melanogaster
atatatgtatactc

SEQ ID NO: 583820 - DNA, 14 bp, D. melanogaster
atatatgtatatac

SEQ ID NO: 583821 - DNA, 14 bp, D. melanogaster
atatatgtatatag

SEQ ID NO: 583822 - DNA, 14 bp, D. melanogaster
atatatgtatatct

SEQ ID NO: 583823 - DNA, 14 bp, D. melanogaster
atatatgtatatgc

SEQ ID NO: 583824 - DNA, 14 bp, D. melanogaster
atatatgtatatgg

SEQ ID NO: 583825 - DNA, 14 bp, D. melanogaster
atatatgtatcttt

SEQ ID NO: 583826 - DNA, 13 bp, D. melanogaster
atatatgtatgcc

SEQ ID NO: 583827 - DNA, 13 bp, D. melanogaster
atatatgtatggt

SEQ ID NO: 583828 - DNA, 13 bp, D. melanogaster
atatatgtatgta

SEQ ID NO: 583829 - DNA, 14 bp, D. melanogaster
atatatgtatgtaa

SEQ ID NO: 583830 - DNA, 14 bp, D. melanogaster
atatatgtatgtat

SEQ ID NO: 583831 - DNA, 14 bp, D. melanogaster
atatatgtatgtgt

SEQ ID NO: 583832 - DNA, 13 bp, D. melanogaster
atatatgtatgtt

SEQ ID NO: 583833 - DNA, 14 bp, D. melanogaster
atatatgtatgttc

SEQ ID NO: 583834 - DNA, 13 bp, D. melanogaster
atatatgtattct

SEQ ID NO: 583835 - DNA, 13 bp, D. melanogaster
atatatgtatttc

SEQ ID NO: 583836 - DNA, 13 bp, D. melanogaster
atatatgtgaaat

SEQ ID NO: 583837 - DNA, 13 bp, D. melanogaster
atatatgtgaata

SEQ ID NO: 583838 - DNA, 13 bp, D. melanogaster
atatatgtgaatt

SEQ ID NO: 583839 - DNA, 13 bp, D. melanogaster
atatatgtgcata

SEQ ID NO: 583840 - DNA, 14 bp, D. melanogaster
atatatgtgcatat

SEQ ID NO: 583841 - DNA, 13 bp, D. melanogaster
atatatgtgcatt

SEQ ID NO: 583842 - DNA, 13 bp, D. melanogaster
atatatgtgcttt

SEQ ID NO: 583843 - DNA, 13 bp, D. melanogaster
atatatgtgtaat

SEQ ID NO: 583844 - DNA, 13 bp, D. melanogaster
atatatgtgtata

SEQ ID NO: 583845 - DNA, 14 bp, D. melanogaster
atatatgtgtatgt

SEQ ID NO: 583846 - DNA, 14 bp, D. melanogaster
atatatgtgtgtat

SEQ ID NO: 583847 - DNA, 13 bp, D. melanogaster
atatatgtgtgtg

SEQ ID NO: 583848 - DNA, 14 bp, D. melanogaster
atatatgtgtgtgt

SEQ ID NO: 583849 - DNA, 13 bp, D. melanogaster
atatatgtgtgtt

SEQ ID NO: 583850 - DNA, 14 bp, D. melanogaster
atatatgttatatg

SEQ ID NO: 583851 - DNA, 13 bp, D. melanogaster
atatatgtttatc

SEQ ID NO: 583852 - DNA, 13 bp, D. melanogaster
atatatgtttgta

SEQ ID NO: 583853 - DNA, 13 bp, D. melanogaster
atatatgtttgtg

SEQ ID NO: 583854 - DNA, 14 bp, D. melanogaster
atatattaaaagtc

SEQ ID NO: 583855 - DNA, 13 bp, D. melanogaster
atatattaaccat

SEQ ID NO: 583856 - DNA, 13 bp, D. melanogaster
atatattacacaa

SEQ ID NO: 583857 - DNA, 13 bp, D. melanogaster
atatattatatgg

SEQ ID NO: 583858 - DNA, 13 bp, D. melanogaster
atatattatgcaa

SEQ ID NO: 583859 - DNA, 13 bp, D. melanogaster
atatattatgtac

SEQ ID NO: 583860 - DNA, 14 bp, D. melanogaster
atatattatgtaca

SEQ ID NO: 583861 - DNA, 13 bp, D. melanogaster
atatattattcca

SEQ ID NO: 583862 - DNA, 13 bp, D. melanogaster
atatattcaaaag

SEQ ID NO: 583863 - DNA, 13 bp, D. melanogaster
atatattcaacca

SEQ ID NO: 583864 - DNA, 13 bp, D. melanogaster
atatattcaagtg

SEQ ID NO: 583865 - DNA, 13 bp, D. melanogaster
atatattcacata

SEQ ID NO: 583866 - DNA, 13 bp, D. melanogaster
atatattcacttt

SEQ ID NO: 583867 - DNA, 13 bp, D. melanogaster
atatattcataca

SEQ ID NO: 583868 - DNA, 13 bp, D. melanogaster
atatattcatgaa

SEQ ID NO: 583869 - DNA, 13 bp, D. melanogaster
atatattccaaat

SEQ ID NO: 583870 - DNA, 13 bp, D. melanogaster
atatattccattt

SEQ ID NO: 583871 - DNA, 13 bp, D. melanogaster
atatattcgaata

SEQ ID NO: 583872 - DNA, 13 bp, D. melanogaster
atatattcgattt

SEQ ID NO: 583873 - DNA, 13 bp, D. melanogaster
atatattcgctat

SEQ ID NO: 583874 - DNA, 14 bp, D. melanogaster
atatattcgctgca

SEQ ID NO: 583875 - DNA, 14 bp, D. melanogaster
atatattcgtatat

SEQ ID NO: 583876 - DNA, 13 bp, D. melanogaster
atatattcgtatt

SEQ ID NO: 583877 - DNA, 13 bp, D. melanogaster
atatattcgtgtt

SEQ ID NO: 583878 - DNA, 13 bp, D. melanogaster
atatattcttgat

SEQ ID NO: 583879 - DNA, 14 bp, D. melanogaster
atatattcttgatt

SEQ ID NO: 583880 - DNA, 14 bp, D. melanogaster
atatattgcatttt

SEQ ID NO: 583881 - DNA, 13 bp, D. melanogaster
atatattgctgag

SEQ ID NO: 583882 - DNA, 13 bp, D. melanogaster
atatattggaaaa

SEQ ID NO: 583883 - DNA, 13 bp, D. melanogaster
atatattgtacat

SEQ ID NO: 583884 - DNA, 14 bp, D. melanogaster
atatattgtacata

SEQ ID NO: 583885 - DNA, 13 bp, D. melanogaster
atatattgtagaa

SEQ ID NO: 583886 - DNA, 13 bp, D. melanogaster
atatattgtagat

SEQ ID NO: 583887 - DNA, 13 bp, D. melanogaster
atatattgtagta

SEQ ID NO: 583888 - DNA, 14 bp, D. melanogaster
atatattgtagtat

SEQ ID NO: 583889 - DNA, 13 bp, D. melanogaster
atatattgtagtt

SEQ ID NO: 583890 - DNA, 14 bp, D. melanogaster
atatattgtatgta

SEQ ID NO: 583891 - DNA, 13 bp, D. melanogaster
atatatttaacca

SEQ ID NO: 583892 - DNA, 13 bp, D. melanogaster
atatatttaagcc

SEQ ID NO: 583893 - DNA, 13 bp, D. melanogaster
atatatttaagtg

SEQ ID NO: 583894 - DNA, 13 bp, D. melanogaster
atatatttacaga

SEQ ID NO: 583895 - DNA, 13 bp, D. melanogaster
atatatttacgaa

SEQ ID NO: 583896 - DNA, 13 bp, D. melanogaster
atatatttacttc

SEQ ID NO: 583897 - DNA, 13 bp, D. melanogaster
atatatttagcaa

SEQ ID NO: 583898 - DNA, 14 bp, D. melanogaster
atatatttatacac

SEQ ID NO: 583899 - DNA, 13 bp, D. melanogaster
atatatttatgga

SEQ ID NO: 583900 - DNA, 14 bp, D. melanogaster
atatatttattagc

SEQ ID NO: 583901 - DNA, 13 bp, D. melanogaster
atatatttattcg

SEQ ID NO: 583902 - DNA, 13 bp, D. melanogaster
atatatttcaaag

SEQ ID NO: 583903 - DNA, 13 bp, D. melanogaster
atatatttcagct

SEQ ID NO: 583904 - DNA, 13 bp, D. melanogaster
atatatttccata

SEQ ID NO: 583905 - DNA, 13 bp, D. melanogaster
atatatttcgata

SEQ ID NO: 583906 - DNA, 13 bp, D. melanogaster
atatatttctgtt

SEQ ID NO: 583907 - DNA, 13 bp, D. melanogaster
atatatttgcaaa

SEQ ID NO: 583908 - DNA, 13 bp, D. melanogaster
atatatttgcaat

SEQ ID NO: 583909 - DNA, 13 bp, D. melanogaster
atatatttgcact

SEQ ID NO: 583910 - DNA, 13 bp, D. melanogaster
atatatttgcata

SEQ ID NO: 583911 - DNA, 13 bp, D. melanogaster
atatatttgcatt

SEQ ID NO: 583912 - DNA, 14 bp, D. melanogaster
atatatttgcattt

SEQ ID NO: 583913 - DNA, 13 bp, D. melanogaster
atatatttgccat

SEQ ID NO: 583914 - DNA, 13 bp, D. melanogaster
atatatttggaat

SEQ ID NO: 583915 - DNA, 13 bp, D. melanogaster
atatatttgtaag

SEQ ID NO: 583916 - DNA, 13 bp, D. melanogaster
atatatttgtatc

SEQ ID NO: 583917 - DNA, 13 bp, D. melanogaster
atatattttatgg

SEQ ID NO: 583918 - DNA, 14 bp, D. melanogaster
atatattttatgga

SEQ ID NO: 583919 - DNA, 13 bp, D. melanogaster
atatattttcaac

SEQ ID NO: 583920 - DNA, 14 bp, D. melanogaster
atatattttcattg

SEQ ID NO: 583921 - DNA, 13 bp, D. melanogaster
atatattttccaa

SEQ ID NO: 583922 - DNA, 13 bp, D. melanogaster
atatattttccat

SEQ ID NO: 583923 - DNA, 13 bp, D. melanogaster
atatattttcgaa

SEQ ID NO: 583924 - DNA, 13 bp, D. melanogaster
atatattttcgct

SEQ ID NO: 583925 - DNA, 14 bp, D. melanogaster
atatattttgcaat

SEQ ID NO: 583926 - DNA, 13 bp, D. melanogaster
atatattttgcag

SEQ ID NO: 583927 - DNA, 13 bp, D. melanogaster
atatattttgctt

SEQ ID NO: 583928 - DNA, 14 bp, D. melanogaster
atatattttggaaa

SEQ ID NO: 583929 - DNA, 13 bp, D. melanogaster
atatattttggca

SEQ ID NO: 583930 - DNA, 13 bp, D. melanogaster
atatatttttgac

SEQ ID NO: 583931 - DNA, 13 bp, D. melanogaster
atatatttttgca

SEQ ID NO: 583932 - DNA, 13 bp, D. melanogaster
atatcaaaagttt

SEQ ID NO: 583933 - DNA, 13 bp, D. melanogaster
atatcaaatacat

SEQ ID NO: 583934 - DNA, 13 bp, D. melanogaster
atatcaaatatct

SEQ ID NO: 583935 - DNA, 13 bp, D. melanogaster
atatcaaattgac

SEQ ID NO: 583936 - DNA, 13 bp, D. melanogaster
atatcaacaaatt

SEQ ID NO: 583937 - DNA, 13 bp, D. melanogaster
atatcaaccacaa

SEQ ID NO: 583938 - DNA, 13 bp, D. melanogaster
atatcaactaaat

SEQ ID NO: 583939 - DNA, 13 bp, D. melanogaster
atatcaactacaa

SEQ ID NO: 583940 - DNA, 14 bp, D. melanogaster
atatcaactattat

SEQ ID NO: 583941 - DNA, 13 bp, D. melanogaster
atatcaacttttt

SEQ ID NO: 583942 - DNA, 13 bp, D. melanogaster
atatcaaggtgag

SEQ ID NO: 583943 - DNA, 13 bp, D. melanogaster
atatcaatagata

SEQ ID NO: 583944 - DNA, 13 bp, D. melanogaster
atatcaatatgtt

SEQ ID NO: 583945 - DNA, 13 bp, D. melanogaster
atatcaatgcaac

SEQ ID NO: 583946 - DNA, 13 bp, D. melanogaster
atatcaattgaaa

SEQ ID NO: 583947 - DNA, 13 bp, D. melanogaster
atatcaattgcat

SEQ ID NO: 583948 - DNA, 14 bp, D. melanogaster
atatcaattgcatt

SEQ ID NO: 583949 - DNA, 13 bp, D. melanogaster
atatcaattgtct

SEQ ID NO: 583950 - DNA, 13 bp, D. melanogaster
atatcacatattt

SEQ ID NO: 583951 - DNA, 13 bp, D. melanogaster
atatcacatttat

SEQ ID NO: 583952 - DNA, 14 bp, D. melanogaster
atatcacgtatacg

SEQ ID NO: 583953 - DNA, 13 bp, D. melanogaster
atatcagcaatga

SEQ ID NO: 583954 - DNA, 13 bp, D. melanogaster
atatcagcataag

SEQ ID NO: 583955 - DNA, 14 bp, D. melanogaster
atatcagcataaga

SEQ ID NO: 583956 - DNA, 14 bp, D. melanogaster
atatcagctgtttt

SEQ ID NO: 583957 - DNA, 13 bp, D. melanogaster
atatcatacaaat

SEQ ID NO: 583958 - DNA, 13 bp, D. melanogaster
atatcatacatat

SEQ ID NO: 583959 - DNA, 13 bp, D. melanogaster
atatcatagccac

SEQ ID NO: 583960 - DNA, 13 bp, D. melanogaster
atatcatatatac

SEQ ID NO: 583961 - DNA, 14 bp, D. melanogaster
atatcatatatgta

SEQ ID NO: 583962 - DNA, 13 bp, D. melanogaster
atatcatatattc

SEQ ID NO: 583963 - DNA, 13 bp, D. melanogaster
atatcatatcata

SEQ ID NO: 583964 - DNA, 13 bp, D. melanogaster
atatcatatcatc

SEQ ID NO: 583965 - DNA, 13 bp, D. melanogaster
atatcatatcatt

SEQ ID NO: 583966 - DNA, 13 bp, D. melanogaster
atatcatcaaagt

SEQ ID NO: 583967 - DNA, 13 bp, D. melanogaster
atatcatcatcat

SEQ ID NO: 583968 - DNA, 13 bp, D. melanogaster
atatcatcgtctt

SEQ ID NO: 583969 - DNA, 14 bp, D. melanogaster
atatcatcgtcttc

SEQ ID NO: 583970 - DNA, 13 bp, D. melanogaster
atatcattcaaaa

SEQ ID NO: 583971 - DNA, 13 bp, D. melanogaster
atatcattgattt

SEQ ID NO: 583972 - DNA, 13 bp, D. melanogaster
atatcatttcaaa

SEQ ID NO: 583973 - DNA, 13 bp, D. melanogaster
atatccaaaaatt

SEQ ID NO: 583974 - DNA, 13 bp, D. melanogaster
atatccaaaatat

SEQ ID NO: 583975 - DNA, 13 bp, D. melanogaster
atatccaaaggac

SEQ ID NO: 583976 - DNA, 14 bp, D. melanogaster
atatccaaaggaca

SEQ ID NO: 583977 - DNA, 13 bp, D. melanogaster
atatccaagaaaa

SEQ ID NO: 583978 - DNA, 13 bp, D. melanogaster
atatccaattaaa

SEQ ID NO: 583979 - DNA, 13 bp, D. melanogaster
atatccacatcca

SEQ ID NO: 583980 - DNA, 13 bp, D. melanogaster
atatccataaaca

SEQ ID NO: 583981 - DNA, 13 bp, D. melanogaster
atatccataagcc

SEQ ID NO: 583982 - DNA, 13 bp, D. melanogaster
atatccataccca

SEQ ID NO: 583983 - DNA, 13 bp, D. melanogaster
atatccatataca

SEQ ID NO: 583984 - DNA, 13 bp, D. melanogaster
atatccatatatc

SEQ ID NO: 583985 - DNA, 13 bp, D. melanogaster
atatccatatcca

SEQ ID NO: 583986 - DNA, 13 bp, D. melanogaster
atatccatatgta

SEQ ID NO: 583987 - DNA, 13 bp, D. melanogaster
atatccatccata

SEQ ID NO: 583988 - DNA, 13 bp, D. melanogaster
atatccatgcgca

SEQ ID NO: 583989 - DNA, 13 bp, D. melanogaster
atatccatgttgt

SEQ ID NO: 583990 - DNA, 13 bp, D. melanogaster
atatccatttcaa

SEQ ID NO: 583991 - DNA, 13 bp, D. melanogaster
atatcccacatac

SEQ ID NO: 583992 - DNA, 13 bp, D. melanogaster
atatcccagaaaa

SEQ ID NO: 583993 - DNA, 13 bp, D. melanogaster
atatccgattttt

SEQ ID NO: 583994 - DNA, 13 bp, D. melanogaster
atatcctaaggca

SEQ ID NO: 583995 - DNA, 13 bp, D. melanogaster
atatccttacatt

SEQ ID NO: 583996 - DNA, 13 bp, D. melanogaster
atatccttcctgc

SEQ ID NO: 583997 - DNA, 14 bp, D. melanogaster
atatccttcctgca

SEQ ID NO: 583998 - DNA, 13 bp, D. melanogaster
atatccttcgacc

SEQ ID NO: 583999 - DNA, 13 bp, D. melanogaster
atatcctttaaaa

SEQ ID NO: 584000 - DNA, 13 bp, D. melanogaster
atatcctttcatt

SEQ ID NO: 584001 - DNA, 13 bp, D. melanogaster
atatcctttggac

SEQ ID NO: 584002 - DNA, 13 bp, D. melanogaster
atatcctttttgc

SEQ ID NO: 584003 - DNA, 13 bp, D. melanogaster
atatcgaaaaaat

SEQ ID NO: 584004 - DNA, 13 bp, D. melanogaster
atatcgaaaaatg

SEQ ID NO: 584005 - DNA, 13 bp, D. melanogaster
atatcgaaagcga

SEQ ID NO: 584006 - DNA, 13 bp, D. melanogaster
atatcgaaataaa

SEQ ID NO: 584007 - DNA, 13 bp, D. melanogaster
atatcgaacaaaa

SEQ ID NO: 584008 - DNA, 13 bp, D. melanogaster
atatcgaatatat

SEQ ID NO: 584009 - DNA, 13 bp, D. melanogaster
atatcgagcaact

SEQ ID NO: 584010 - DNA, 13 bp, D. melanogaster
atatcgataaaaa

SEQ ID NO: 584011 - DNA, 13 bp, D. melanogaster
atatcgataaata

SEQ ID NO: 584012 - DNA, 13 bp, D. melanogaster
atatcgatagaaa

SEQ ID NO: 584013 - DNA, 13 bp, D. melanogaster
atatcgatagata

SEQ ID NO: 584014 - DNA, 14 bp, D. melanogaster
atatcgatagatat

SEQ ID NO: 584015 - DNA, 13 bp, D. melanogaster
atatcgatatatt

SEQ ID NO: 584016 - DNA, 13 bp, D. melanogaster
atatcgatatcaa

SEQ ID NO: 584017 - DNA, 13 bp, D. melanogaster
atatcgatatcga

SEQ ID NO: 584018 - DNA, 13 bp, D. melanogaster
atatcgtatatat

SEQ ID NO: 584019 - DNA, 13 bp, D. melanogaster
atatctaaatctt

SEQ ID NO: 584020 - DNA, 14 bp, D. melanogaster
atatctaatatcta

SEQ ID NO: 584021 - DNA, 13 bp, D. melanogaster
atatctacataaa

SEQ ID NO: 584022 - DNA, 13 bp, D. melanogaster
atatctacataca

SEQ ID NO: 584023 - DNA, 13 bp, D. melanogaster
atatctacatatg

SEQ ID NO: 584024 - DNA, 13 bp, D. melanogaster
atatctactacgt

SEQ ID NO: 584025 - DNA, 13 bp, D. melanogaster
atatctactatat

SEQ ID NO: 584026 - DNA, 13 bp, D. melanogaster
atatctagatata

SEQ ID NO: 584027 - DNA, 14 bp, D. melanogaster
atatctatatatac

SEQ ID NO: 584028 - DNA, 14 bp, D. melanogaster
atatctatatatct

SEQ ID NO: 584029 - DNA, 14 bp, D. melanogaster
atatctatatattc

SEQ ID NO: 584030 - DNA, 14 bp, D. melanogaster
atatctatatgtat

SEQ ID NO: 584031 - DNA, 14 bp, D. melanogaster
atatctatcgatat

SEQ ID NO: 584032 - DNA, 13 bp, D. melanogaster
atatctatcgatt

SEQ ID NO: 584033 - DNA, 13 bp, D. melanogaster
atatctatctata

SEQ ID NO: 584034 - DNA, 14 bp, D. melanogaster
atatctatctatat

SEQ ID NO: 584035 - DNA, 13 bp, D. melanogaster
atatctatgaaat

SEQ ID NO: 584036 - DNA, 13 bp, D. melanogaster
atatctatgtatt

SEQ ID NO: 584037 - DNA, 13 bp, D. melanogaster
atatctattgata

SEQ ID NO: 584038 - DNA, 13 bp, D. melanogaster
atatctattgccc

SEQ ID NO: 584039 - DNA, 14 bp, D. melanogaster
atatctcaaaaact

SEQ ID NO: 584040 - DNA, 13 bp, D. melanogaster
atatctcaatttt

SEQ ID NO: 584041 - DNA, 13 bp, D. melanogaster
atatctcatattt

SEQ ID NO: 584042 - DNA, 14 bp, D. melanogaster
atatctcgctctcc

SEQ ID NO: 584043 - DNA, 13 bp, D. melanogaster
atatctcgttgag

SEQ ID NO: 584044 - DNA, 13 bp, D. melanogaster
atatctctctctc

SEQ ID NO: 584045 - DNA, 13 bp, D. melanogaster
atatctgaaatat

SEQ ID NO: 584046 - DNA, 13 bp, D. melanogaster
atatctgccattg

SEQ ID NO: 584047 - DNA, 13 bp, D. melanogaster
atatctgtatata

SEQ ID NO: 584048 - DNA, 14 bp, D. melanogaster
atatctgtatatat

SEQ ID NO: 584049 - DNA, 14 bp, D. melanogaster
atatctgtatatgt

SEQ ID NO: 584050 - DNA, 13 bp, D. melanogaster
atatctgtatcta

SEQ ID NO: 584051 - DNA, 13 bp, D. melanogaster
atatctgtatttt

SEQ ID NO: 584052 - DNA, 13 bp, D. melanogaster
atatctgtgtaaa

SEQ ID NO: 584053 - DNA, 14 bp, D. melanogaster
atatctgtgtatat

SEQ ID NO: 584054 - DNA, 14 bp, D. melanogaster
atatctgtgtgtgt

SEQ ID NO: 584055 - DNA, 13 bp, D. melanogaster
atatctgttctgc

SEQ ID NO: 584056 - DNA, 14 bp, D. melanogaster
atatctgttctgct

SEQ ID NO: 584057 - DNA, 14 bp, D. melanogaster
atatcttaaatatg

SEQ ID NO: 584058 - DNA, 13 bp, D. melanogaster
atatcttaaatga

SEQ ID NO: 584059 - DNA, 13 bp, D. melanogaster
atatcttagaaaa

SEQ ID NO: 584060 - DNA, 13 bp, D. melanogaster
atatcttatagtt

SEQ ID NO: 584061 - DNA, 15 bp, D. melanogaster
atatcttatgtaaat

SEQ ID NO: 584062 - DNA, 13 bp, D. melanogaster
atatcttcacaaa

SEQ ID NO: 584063 - DNA, 13 bp, D. melanogaster
atatcttcccaaa

SEQ ID NO: 584064 - DNA, 13 bp, D. melanogaster
atatcttctacaa

SEQ ID NO: 584065 - DNA, 13 bp, D. melanogaster
atatcttggccat

SEQ ID NO: 584066 - DNA, 13 bp, D. melanogaster
atatcttgtttat

SEQ ID NO: 584067 - DNA, 13 bp, D. melanogaster
atatctttaggct

SEQ ID NO: 584068 - DNA, 13 bp, D. melanogaster
atatcttttgtgt

SEQ ID NO: 584069 - DNA, 13 bp, D. melanogaster
atatctttttaag

SEQ ID NO: 584070 - DNA, 13 bp, D. melanogaster
atatctttttgaa

SEQ ID NO: 584071 - DNA, 13 bp, D. melanogaster
atatgaaaaacca

SEQ ID NO: 584072 - DNA, 13 bp, D. melanogaster
atatgaaaaagtt

SEQ ID NO: 584073 - DNA, 13 bp, D. melanogaster
atatgaaaacaat

SEQ ID NO: 584074 - DNA, 13 bp, D. melanogaster
atatgaaaacata

SEQ ID NO: 584075 - DNA, 13 bp, D. melanogaster
atatgaaaacatt

SEQ ID NO: 584076 - DNA, 13 bp, D. melanogaster
atatgaaaactat

SEQ ID NO: 584077 - DNA, 13 bp, D. melanogaster
atatgaaaactgt

SEQ ID NO: 584078 - DNA, 13 bp, D. melanogaster
atatgaaaatatg

SEQ ID NO: 584079 - DNA, 13 bp, D. melanogaster
atatgaaaatcca

SEQ ID NO: 584080 - DNA, 13 bp, D. melanogaster
atatgaaaatgga

SEQ ID NO: 584081 - DNA, 13 bp, D. melanogaster
atatgaaaatgtg

SEQ ID NO: 584082 - DNA, 13 bp, D. melanogaster
atatgaaaattgt

SEQ ID NO: 584083 - DNA, 14 bp, D. melanogaster
atatgaaaattgtt

SEQ ID NO: 584084 - DNA, 13 bp, D. melanogaster
atatgaaacaaat

SEQ ID NO: 584085 - DNA, 13 bp, D. melanogaster
atatgaaacatta

SEQ ID NO: 584086 - DNA, 13 bp, D. melanogaster
atatgaaactatt

SEQ ID NO: 584087 - DNA, 13 bp, D. melanogaster
atatgaaagcaaa

SEQ ID NO: 584088 - DNA, 13 bp, D. melanogaster
atatgaaagctat

SEQ ID NO: 584089 - DNA, 14 bp, D. melanogaster
atatgaaagctatc

SEQ ID NO: 584090 - DNA, 13 bp, D. melanogaster
atatgaaagtttt

SEQ ID NO: 584091 - DNA, 13 bp, D. melanogaster
atatgaaatacaa

SEQ ID NO: 584092 - DNA, 13 bp, D. melanogaster
atatgaaatggaa

SEQ ID NO: 584093 - DNA, 13 bp, D. melanogaster
atatgaaattaca

SEQ ID NO: 584094 - DNA, 13 bp, D. melanogaster
atatgaaatttct

SEQ ID NO: 584095 - DNA, 13 bp, D. melanogaster
atatgaacaaaat

SEQ ID NO: 584096 - DNA, 13 bp, D. melanogaster
atatgaacaaata

SEQ ID NO: 584097 - DNA, 13 bp, D. melanogaster
atatgaacaatat

SEQ ID NO: 584098 - DNA, 13 bp, D. melanogaster
atatgaacataaa

SEQ ID NO: 584099 - DNA, 13 bp, D. melanogaster
atatgaacatata

SEQ ID NO: 584100 - DNA, 14 bp, D. melanogaster
atatgaacatatat

SEQ ID NO: 584101 - DNA, 13 bp, D. melanogaster
atatgaagaagta

SEQ ID NO: 584102 - DNA, 13 bp, D. melanogaster
atatgaagtatat

SEQ ID NO: 584103 - DNA, 13 bp, D. melanogaster
atatgaataaact

SEQ ID NO: 584104 - DNA, 13 bp, D. melanogaster
atatgaataacaa

SEQ ID NO: 584105 - DNA, 13 bp, D. melanogaster
atatgaatataca

SEQ ID NO: 584106 - DNA, 13 bp, D. melanogaster
atatgaatatatg

SEQ ID NO: 584107 - DNA, 14 bp, D. melanogaster
atatgaatatatgt

SEQ ID NO: 584108 - DNA, 13 bp, D. melanogaster
atatgaatatcaa

SEQ ID NO: 584109 - DNA, 13 bp, D. melanogaster
atatgaatatgaa

SEQ ID NO: 584110 - DNA, 14 bp, D. melanogaster
atatgaatatgaat

SEQ ID NO: 584111 - DNA, 13 bp, D. melanogaster
atatgaatatgat

SEQ ID NO: 584112 - DNA, 13 bp, D. melanogaster
atatgaatatgta

SEQ ID NO: 584113 - DNA, 13 bp, D. melanogaster
atatgaatgcata

SEQ ID NO: 584114 - DNA, 13 bp, D. melanogaster
atatgaatggcca

SEQ ID NO: 584115 - DNA, 13 bp, D. melanogaster
atatgaatgtatt

SEQ ID NO: 584116 - DNA, 13 bp, D. melanogaster
atatgaattagtt

SEQ ID NO: 584117 - DNA, 13 bp, D. melanogaster
atatgaattcaaa

SEQ ID NO: 584118 - DNA, 13 bp, D. melanogaster
atatgactaattt

SEQ ID NO: 584119 - DNA, 13 bp, D. melanogaster
atatgactatttt

SEQ ID NO: 584120 - DNA, 13 bp, D. melanogaster
atatgacttttgc

SEQ ID NO: 584121 - DNA, 14 bp, D. melanogaster
atatgacttttgca

SEQ ID NO: 584122 - DNA, 13 bp, D. melanogaster
atatgagaaatat

SEQ ID NO: 584123 - DNA, 13 bp, D. melanogaster
atatgagcatttt

SEQ ID NO: 584124 - DNA, 13 bp, D. melanogaster
atatgagcgaaca

SEQ ID NO: 584125 - DNA, 13 bp, D. melanogaster
atatgagtacaac

SEQ ID NO: 584126 - DNA, 13 bp, D. melanogaster
atatgagtatata

SEQ ID NO: 584127 - DNA, 13 bp, D. melanogaster
atatgataactgt

SEQ ID NO: 584128 - DNA, 13 bp, D. melanogaster
atatgataatgat

SEQ ID NO: 584129 - DNA, 13 bp, D. melanogaster
atatgatatgaaa

SEQ ID NO: 584130 - DNA, 14 bp, D. melanogaster
atatgatatgataa

SEQ ID NO: 584131 - DNA, 14 bp, D. melanogaster
atatgatatgatat

SEQ ID NO: 584132 - DNA, 13 bp, D. melanogaster
atatgatatgatt

SEQ ID NO: 584133 - DNA, 13 bp, D. melanogaster
atatgatatgttt

SEQ ID NO: 584134 - DNA, 13 bp, D. melanogaster
atatgatattttg

SEQ ID NO: 584135 - DNA, 13 bp, D. melanogaster
atatgatcaaaaa

SEQ ID NO: 584136 - DNA, 13 bp, D. melanogaster
atatgatgaaata

SEQ ID NO: 584137 - DNA, 13 bp, D. melanogaster
atatgatgaaatt

SEQ ID NO: 584138 - DNA, 13 bp, D. melanogaster
atatgatgatatg

SEQ ID NO: 584139 - DNA, 13 bp, D. melanogaster
atatgatgcactt

SEQ ID NO: 584140 - DNA, 13 bp, D. melanogaster
atatgatgtatat

SEQ ID NO: 584141 - DNA, 13 bp, D. melanogaster
atatgatgtcatt

SEQ ID NO: 584142 - DNA, 13 bp, D. melanogaster
atatgattttgaa

SEQ ID NO: 584143 - DNA, 13 bp, D. melanogaster
atatgcaaaaaat

SEQ ID NO: 584144 - DNA, 13 bp, D. melanogaster
atatgcaaaaatg

SEQ ID NO: 584145 - DNA, 14 bp, D. melanogaster
atatgcaaaaatga

SEQ ID NO: 584146 - DNA, 13 bp, D. melanogaster
atatgcaaaaatt

SEQ ID NO: 584147 - DNA, 13 bp, D. melanogaster
atatgcaaaacac

SEQ ID NO: 584148 - DNA, 13 bp, D. melanogaster
atatgcaaaactg

SEQ ID NO: 584149 - DNA, 13 bp, D. melanogaster
atatgcaaaagtg

SEQ ID NO: 584150 - DNA, 13 bp, D. melanogaster
atatgcaaaatag

SEQ ID NO: 584151 - DNA, 13 bp, D. melanogaster
atatgcaaaatat

SEQ ID NO: 584152 - DNA, 13 bp, D. melanogaster
atatgcaaaattt

SEQ ID NO: 584153 - DNA, 13 bp, D. melanogaster
atatgcaaacaaa

SEQ ID NO: 584154 - DNA, 13 bp, D. melanogaster
atatgcaaagcat

SEQ ID NO: 584155 - DNA, 13 bp, D. melanogaster
atatgcaaagcca

SEQ ID NO: 584156 - DNA, 13 bp, D. melanogaster
atatgcaaaggaa

SEQ ID NO: 584157 - DNA, 14 bp, D. melanogaster
atatgcaaataaat

SEQ ID NO: 584158 - DNA, 13 bp, D. melanogaster
atatgcaaataca

SEQ ID NO: 584159 - DNA, 14 bp, D. melanogaster
atatgcaaatacat

SEQ ID NO: 584160 - DNA, 13 bp, D. melanogaster
atatgcaaatagt

SEQ ID NO: 584161 - DNA, 13 bp, D. melanogaster
atatgcaaatatt

SEQ ID NO: 584162 - DNA, 14 bp, D. melanogaster
atatgcaaatattg

SEQ ID NO: 584163 - DNA, 13 bp, D. melanogaster
atatgcaaatcga

SEQ ID NO: 584164 - DNA, 13 bp, D. melanogaster
atatgcaaatgaa

SEQ ID NO: 584165 - DNA, 13 bp, D. melanogaster
atatgcaaatgat

SEQ ID NO: 584166 - DNA, 13 bp, D. melanogaster
atatgcaaatgca

SEQ ID NO: 584167 - DNA, 14 bp, D. melanogaster
atatgcaaatgcca

SEQ ID NO: 584168 - DNA, 13 bp, D. melanogaster
atatgcaaatgct

SEQ ID NO: 584169 - DNA, 13 bp, D. melanogaster
atatgcaaatggc

SEQ ID NO: 584170 - DNA, 13 bp, D. melanogaster
atatgcaaatgtg

SEQ ID NO: 584171 - DNA, 13 bp, D. melanogaster
atatgcaaattcc

SEQ ID NO: 584172 - DNA, 14 bp, D. melanogaster
atatgcaaattctg

SEQ ID NO: 584173 - DNA, 14 bp, D. melanogaster
atatgcaaattgtt

SEQ ID NO: 584174 - DNA, 13 bp, D. melanogaster
atatgcaacaaaa

SEQ ID NO: 584175 - DNA, 13 bp, D. melanogaster
atatgcaacaatt

SEQ ID NO: 584176 - DNA, 13 bp, D. melanogaster
atatgcaataaaa

SEQ ID NO: 584177 - DNA, 13 bp, D. melanogaster
atatgcaatatgc

SEQ ID NO: 584178 - DNA, 13 bp, D. melanogaster
atatgcaatattt

SEQ ID NO: 584179 - DNA, 13 bp, D. melanogaster
atatgcaattaaa

SEQ ID NO: 584180 - DNA, 13 bp, D. melanogaster
atatgcaatttta

SEQ ID NO: 584181 - DNA, 13 bp, D. melanogaster
atatgcacaaaat

SEQ ID NO: 584182 - DNA, 13 bp, D. melanogaster
atatgcacaaaca

SEQ ID NO: 584183 - DNA, 13 bp, D. melanogaster
atatgcacaattg

SEQ ID NO: 584184 - DNA, 13 bp, D. melanogaster
atatgcacacaaa

SEQ ID NO: 584185 - DNA, 13 bp, D. melanogaster
atatgcacacata

SEQ ID NO: 584186 - DNA, 13 bp, D. melanogaster
atatgcacacatg

SEQ ID NO: 584187 - DNA, 13 bp, D. melanogaster
atatgcacagaaa

SEQ ID NO: 584188 - DNA, 13 bp, D. melanogaster
atatgcacataaa

SEQ ID NO: 584189 - DNA, 13 bp, D. melanogaster
atatgcacataca

SEQ ID NO: 584190 - DNA, 14 bp, D. melanogaster
atatgcacatatat

SEQ ID NO: 584191 - DNA, 13 bp, D. melanogaster
atatgcacatatt

SEQ ID NO: 584192 - DNA, 13 bp, D. melanogaster
atatgcactttat

SEQ ID NO: 584193 - DNA, 13 bp, D. melanogaster
atatgcagaaaac

SEQ ID NO: 584194 - DNA, 13 bp, D. melanogaster
atatgcagatata

SEQ ID NO: 584195 - DNA, 13 bp, D. melanogaster
atatgcagatgca

SEQ ID NO: 584196 - DNA, 13 bp, D. melanogaster
atatgcatacaaa

SEQ ID NO: 584197 - DNA, 14 bp, D. melanogaster
atatgcatacatat

SEQ ID NO: 584198 - DNA, 13 bp, D. melanogaster
atatgcatacatt

SEQ ID NO: 584199 - DNA, 13 bp, D. melanogaster
atatgcatataaa

SEQ ID NO: 584200 - DNA, 14 bp, D. melanogaster
atatgcatatacat

SEQ ID NO: 584201 - DNA, 13 bp, D. melanogaster
atatgcatatata

SEQ ID NO: 584202 - DNA, 13 bp, D. melanogaster
atatgcatatatc

SEQ ID NO: 584203 - DNA, 13 bp, D. melanogaster
atatgcatatcca

SEQ ID NO: 584204 - DNA, 13 bp, D. melanogaster
atatgcatatgaa

SEQ ID NO: 584205 - DNA, 14 bp, D. melanogaster
atatgcatatgaaa

SEQ ID NO: 584206 - DNA, 13 bp, D. melanogaster
atatgcatatgca

SEQ ID NO: 584207 - DNA, 14 bp, D. melanogaster
atatgcatatgcaa

SEQ ID NO: 584208 - DNA, 14 bp, D. melanogaster
atatgcatatgcat

SEQ ID NO: 584209 - DNA, 13 bp, D. melanogaster
atatgcatatgtg

SEQ ID NO: 584210 - DNA, 14 bp, D. melanogaster
atatgcatattaaa

SEQ ID NO: 584211 - DNA, 13 bp, D. melanogaster
atatgcatatttt

SEQ ID NO: 584212 - DNA, 13 bp, D. melanogaster
atatgcatgcatt

SEQ ID NO: 584213 - DNA, 13 bp, D. melanogaster
atatgcattatat

SEQ ID NO: 584214 - DNA, 13 bp, D. melanogaster
atatgcatttaaa

SEQ ID NO: 584215 - DNA, 13 bp, D. melanogaster
atatgcatttatt

SEQ ID NO: 584216 - DNA, 13 bp, D. melanogaster
atatgcatttcat

SEQ ID NO: 584217 - DNA, 13 bp, D. melanogaster
atatgcattttgc

SEQ ID NO: 584218 - DNA, 13 bp, D. melanogaster
atatgcatttttg

SEQ ID NO: 584219 - DNA, 13 bp, D. melanogaster
atatgccaaaaat

SEQ ID NO: 584220 - DNA, 13 bp, D. melanogaster
atatgccaaaaca

SEQ ID NO: 584221 - DNA, 13 bp, D. melanogaster
atatgccaaaaga

SEQ ID NO: 584222 - DNA, 13 bp, D. melanogaster
atatgccaaataa

SEQ ID NO: 584223 - DNA, 13 bp, D. melanogaster
atatgccaaatat

SEQ ID NO: 584224 - DNA, 13 bp, D. melanogaster
atatgccaaattt

SEQ ID NO: 584225 - DNA, 13 bp, D. melanogaster
atatgccaatttt

SEQ ID NO: 584226 - DNA, 13 bp, D. melanogaster
atatgccatttat

SEQ ID NO: 584227 - DNA, 13 bp, D. melanogaster
atatgcccttaaa

SEQ ID NO: 584228 - DNA, 13 bp, D. melanogaster
atatgccttaaaa

SEQ ID NO: 584229 - DNA, 13 bp, D. melanogaster
atatgcgaaatta

SEQ ID NO: 584230 - DNA, 13 bp, D. melanogaster
atatgcgcataaa

SEQ ID NO: 584231 - DNA, 13 bp, D. melanogaster
atatgcgtatata

SEQ ID NO: 584232 - DNA, 13 bp, D. melanogaster
atatgcgtatgta

SEQ ID NO: 584233 - DNA, 13 bp, D. melanogaster
atatgctatttta

SEQ ID NO: 584234 - DNA, 13 bp, D. melanogaster
atatgctcaaaaa

SEQ ID NO: 584235 - DNA, 14 bp, D. melanogaster
atatgctcaaaaat

SEQ ID NO: 584236 - DNA, 14 bp, D. melanogaster
atatgcttaaaaac

SEQ ID NO: 584237 - DNA, 13 bp, D. melanogaster
atatgcttaaata

SEQ ID NO: 584238 - DNA, 13 bp, D. melanogaster
atatgcttttaat

SEQ ID NO: 584239 - DNA, 13 bp, D. melanogaster
atatgcttttata

SEQ ID NO: 584240 - DNA, 13 bp, D. melanogaster
atatggaaaaact

SEQ ID NO: 584241 - DNA, 13 bp, D. melanogaster
atatggaaaatac

SEQ ID NO: 584242 - DNA, 13 bp, D. melanogaster
atatggaaaatct

SEQ ID NO: 584243 - DNA, 13 bp, D. melanogaster
atatggaaatatt

SEQ ID NO: 584244 - DNA, 13 bp, D. melanogaster
atatggaaattat

SEQ ID NO: 584245 - DNA, 13 bp, D. melanogaster
atatggaataaat

SEQ ID NO: 584246 - DNA, 13 bp, D. melanogaster
atatggaataatt

SEQ ID NO: 584247 - DNA, 14 bp, D. melanogaster
atatggaataatta

SEQ ID NO: 584248 - DNA, 13 bp, D. melanogaster
atatggaatatat

SEQ ID NO: 584249 - DNA, 13 bp, D. melanogaster
atatggaatgcca

SEQ ID NO: 584250 - DNA, 13 bp, D. melanogaster
atatggacaataa

SEQ ID NO: 584251 - DNA, 13 bp, D. melanogaster
atatggagcaaga

SEQ ID NO: 584252 - DNA, 13 bp, D. melanogaster
atatggatatata

SEQ ID NO: 584253 - DNA, 14 bp, D. melanogaster
atatggatatatat

SEQ ID NO: 584254 - DNA, 13 bp, D. melanogaster
atatggatatatg

SEQ ID NO: 584255 - DNA, 13 bp, D. melanogaster
atatggatatgga

SEQ ID NO: 584256 - DNA, 13 bp, D. melanogaster
atatggatatggc

SEQ ID NO: 584257 - DNA, 13 bp, D. melanogaster
atatggatatgta

SEQ ID NO: 584258 - DNA, 13 bp, D. melanogaster
atatggatcttca

SEQ ID NO: 584259 - DNA, 13 bp, D. melanogaster
atatggatgacat

SEQ ID NO: 584260 - DNA, 13 bp, D. melanogaster
atatggatgacct

SEQ ID NO: 584261 - DNA, 13 bp, D. melanogaster
atatggatgactt

SEQ ID NO: 584262 - DNA, 13 bp, D. melanogaster
atatggatgattt

SEQ ID NO: 584263 - DNA, 13 bp, D. melanogaster
atatggatgtgga

SEQ ID NO: 584264 - DNA, 13 bp, D. melanogaster
atatggattttat

SEQ ID NO: 584265 - DNA, 13 bp, D. melanogaster
atatggcaaaaat

SEQ ID NO: 584266 - DNA, 13 bp, D. melanogaster
atatggcaaaaca

SEQ ID NO: 584267 - DNA, 14 bp, D. melanogaster
atatggcaagcatt

SEQ ID NO: 584268 - DNA, 13 bp, D. melanogaster
atatggccaaaaa

SEQ ID NO: 584269 - DNA, 13 bp, D. melanogaster
atatggccaacaa

SEQ ID NO: 584270 - DNA, 13 bp, D. melanogaster
atatggccagcgg

SEQ ID NO: 584271 - DNA, 13 bp, D. melanogaster
atatggccataaa

SEQ ID NO: 584272 - DNA, 13 bp, D. melanogaster
atatggctatgcg

SEQ ID NO: 584273 - DNA, 13 bp, D. melanogaster
atatggcttaaaa

SEQ ID NO: 584274 - DNA, 13 bp, D. melanogaster
atatggcttaaat

SEQ ID NO: 584275 - DNA, 13 bp, D. melanogaster
atatgggatatat

SEQ ID NO: 584276 - DNA, 13 bp, D. melanogaster
atatgggcaatat

SEQ ID NO: 584277 - DNA, 13 bp, D. melanogaster
atatggggaaaat

SEQ ID NO: 584278 - DNA, 13 bp, D. melanogaster
atatggggtcttt

SEQ ID NO: 584279 - DNA, 14 bp, D. melanogaster
atatggtatatatg

SEQ ID NO: 584280 - DNA, 13 bp, D. melanogaster
atatggtcctgaa

SEQ ID NO: 584281 - DNA, 13 bp, D. melanogaster
atatggtgcagat

SEQ ID NO: 584282 - DNA, 13 bp, D. melanogaster
atatggttggaaa

SEQ ID NO: 584283 - DNA, 13 bp, D. melanogaster
atatgtaaaactt

SEQ ID NO: 584284 - DNA, 13 bp, D. melanogaster
atatgtaaaagtt

SEQ ID NO: 584285 - DNA, 13 bp, D. melanogaster
atatgtaaacaaa

SEQ ID NO: 584286 - DNA, 13 bp, D. melanogaster
atatgtaaacaca

SEQ ID NO: 584287 - DNA, 13 bp, D. melanogaster
atatgtaaataca

SEQ ID NO: 584288 - DNA, 13 bp, D. melanogaster
atatgtaaatatg

SEQ ID NO: 584289 - DNA, 14 bp, D. melanogaster
atatgtaaatatgt

SEQ ID NO: 584290 - DNA, 13 bp, D. melanogaster
atatgtaacaaat

SEQ ID NO: 584291 - DNA, 13 bp, D. melanogaster
atatgtaagaaca

SEQ ID NO: 584292 - DNA, 13 bp, D. melanogaster
atatgtaagtata

SEQ ID NO: 584293 - DNA, 13 bp, D. melanogaster
atatgtaagttaa

SEQ ID NO: 584294 - DNA, 13 bp, D. melanogaster
atatgtaataaag

SEQ ID NO: 584295 - DNA, 13 bp, D. melanogaster
atatgtaatgaaa

SEQ ID NO: 584296 - DNA, 13 bp, D. melanogaster
atatgtaatgtat

SEQ ID NO: 584297 - DNA, 13 bp, D. melanogaster
atatgtacaaata

SEQ ID NO: 584298 - DNA, 14 bp, D. melanogaster
atatgtacaaatat

SEQ ID NO: 584299 - DNA, 13 bp, D. melanogaster
atatgtacaaatt

SEQ ID NO: 584300 - DNA, 13 bp, D. melanogaster
atatgtacaacaa

SEQ ID NO: 584301 - DNA, 13 bp, D. melanogaster
atatgtacaatat

SEQ ID NO: 584302 - DNA, 13 bp, D. melanogaster
atatgtacaatgt

SEQ ID NO: 584303 - DNA, 13 bp, D. melanogaster
atatgtacacaaa

SEQ ID NO: 584304 - DNA, 13 bp, D. melanogaster
atatgtacacaca

SEQ ID NO: 584305 - DNA, 14 bp, D. melanogaster
atatgtacacacat

SEQ ID NO: 584306 - DNA, 13 bp, D. melanogaster
atatgtacacata

SEQ ID NO: 584307 - DNA, 14 bp, D. melanogaster
atatgtacacatat

SEQ ID NO: 584308 - DNA, 14 bp, D. melanogaster
atatgtacacatgt

SEQ ID NO: 584309 - DNA, 13 bp, D. melanogaster
atatgtacacttt

SEQ ID NO: 584310 - DNA, 13 bp, D. melanogaster
atatgtacataca

SEQ ID NO: 584311 - DNA, 14 bp, D. melanogaster
atatgtacatacat

SEQ ID NO: 584312 - DNA, 14 bp, D. melanogaster
atatgtacataggt

SEQ ID NO: 584313 - DNA, 14 bp, D. melanogaster
atatgtacatagtt

SEQ ID NO: 584314 - DNA, 14 bp, D. melanogaster
atatgtacatatac

SEQ ID NO: 584315 - DNA, 15 bp, D. melanogaster
atatgtacatatatg

SEQ ID NO: 584316 - DNA, 13 bp, D. melanogaster
atatgtacatatc

SEQ ID NO: 584317 - DNA, 14 bp, D. melanogaster
atatgtacatatct

SEQ ID NO: 584318 - DNA, 14 bp, D. melanogaster
atatgtacatatga

SEQ ID NO: 584319 - DNA, 17 bp, D. melanogaster
atatgtacatatgtata

SEQ ID NO: 584320 - DNA, 14 bp, D. melanogaster
atatgtacatattt

SEQ ID NO: 584321 - DNA, 13 bp, D. melanogaster
atatgtacatcaa

SEQ ID NO: 584322 - DNA, 13 bp, D. melanogaster
atatgtacatcta

SEQ ID NO: 584323 - DNA, 14 bp, D. melanogaster
atatgtacatgtat

SEQ ID NO: 584324 - DNA, 13 bp, D. melanogaster
atatgtacattta

SEQ ID NO: 584325 - DNA, 14 bp, D. melanogaster
atatgtacatttat

SEQ ID NO: 584326 - DNA, 13 bp, D. melanogaster
atatgtacatttc

SEQ ID NO: 584327 - DNA, 13 bp, D. melanogaster
atatgtacctaca

SEQ ID NO: 584328 - DNA, 13 bp, D. melanogaster
atatgtacgagta

SEQ ID NO: 584329 - DNA, 14 bp, D. melanogaster
atatgtacgagtat

SEQ ID NO: 584330 - DNA, 13 bp, D. melanogaster
atatgtacgtata

SEQ ID NO: 584331 - DNA, 14 bp, D. melanogaster
atatgtacgtatat

SEQ ID NO: 584332 - DNA, 13 bp, D. melanogaster
atatgtacgtttt

SEQ ID NO: 584333 - DNA, 13 bp, D. melanogaster
atatgtactacat

SEQ ID NO: 584334 - DNA, 14 bp, D. melanogaster
atatgtactacata

SEQ ID NO: 584335 - DNA, 14 bp, D. melanogaster
atatgtactatata

SEQ ID NO: 584336 - DNA, 14 bp, D. melanogaster
atatgtactatgta

SEQ ID NO: 584337 - DNA, 14 bp, D. melanogaster
atatgtacttatat

SEQ ID NO: 584338 - DNA, 13 bp, D. melanogaster
atatgtacttatt

SEQ ID NO: 584339 - DNA, 13 bp, D. melanogaster
atatgtactttaa

SEQ ID NO: 584340 - DNA, 13 bp, D. melanogaster
atatgtagataaa

SEQ ID NO: 584341 - DNA, 13 bp, D. melanogaster
atatgtagataca

SEQ ID NO: 584342 - DNA, 13 bp, D. melanogaster
atatgtataaaca

SEQ ID NO: 584343 - DNA, 13 bp, D. melanogaster
atatgtataaaga

SEQ ID NO: 584344 - DNA, 13 bp, D. melanogaster
atatgtataacat

SEQ ID NO: 584345 - DNA, 14 bp, D. melanogaster
atatgtatacaaat

SEQ ID NO: 584346 - DNA, 13 bp, D. melanogaster
atatgtatacaat

SEQ ID NO: 584347 - DNA, 13 bp, D. melanogaster
atatgtatacatg

SEQ ID NO: 584348 - DNA, 13 bp, D. melanogaster
atatgtataccca

SEQ ID NO: 584349 - DNA, 13 bp, D. melanogaster
atatgtatacgta

SEQ ID NO: 584350 - DNA, 13 bp, D. melanogaster
atatgtatacttt

SEQ ID NO: 584351 - DNA, 14 bp, D. melanogaster
atatgtatacttta

SEQ ID NO: 584352 - DNA, 13 bp, D. melanogaster
atatgtatagcat

SEQ ID NO: 584353 - DNA, 13 bp, D. melanogaster
atatgtatagtat

SEQ ID NO: 584354 - DNA, 14 bp, D. melanogaster
atatgtatataaca

SEQ ID NO: 584355 - DNA, 13 bp, D. melanogaster
atatgtatataca

SEQ ID NO: 584356 - DNA, 14 bp, D. melanogaster
atatgtatatactc

SEQ ID NO: 584357 - DNA, 14 bp, D. melanogaster
atatgtatatagaa

SEQ ID NO: 584358 - DNA, 14 bp, D. melanogaster
atatgtatatagat

SEQ ID NO: 584359 - DNA, 13 bp, D. melanogaster
atatgtatatagc

SEQ ID NO: 584360 - DNA, 13 bp, D. melanogaster
atatgtatatagt

SEQ ID NO: 584361 - DNA, 14 bp, D. melanogaster
atatgtatatatag

SEQ ID NO: 584362 - DNA, 13 bp, D. melanogaster
atatgtatatatc

SEQ ID NO: 584363 - DNA, 14 bp, D. melanogaster
atatgtatatattc

SEQ ID NO: 584364 - DNA, 13 bp, D. melanogaster
atatgtatatcag

SEQ ID NO: 584365 - DNA, 13 bp, D. melanogaster
atatgtatatctc

SEQ ID NO: 584366 - DNA, 14 bp, D. melanogaster
atatgtatatctgt

SEQ ID NO: 584367 - DNA, 14 bp, D. melanogaster
atatgtatatgatt

SEQ ID NO: 584368 - DNA, 14 bp, D. melanogaster
atatgtatatgcag

SEQ ID NO: 584369 - DNA, 13 bp, D. melanogaster
atatgtatatgct

SEQ ID NO: 584370 - DNA, 13 bp, D. melanogaster
atatgtatatggc

SEQ ID NO: 584371 - DNA, 13 bp, D. melanogaster
atatgtatatgta

SEQ ID NO: 584372 - DNA, 14 bp, D. melanogaster
atatgtatatgtaa

SEQ ID NO: 584373 - DNA, 14 bp, D. melanogaster
atatgtatatgtag

SEQ ID NO: 584374 - DNA, 14 bp, D. melanogaster
atatgtatatgtat

SEQ ID NO: 584375 - DNA, 13 bp, D. melanogaster
atatgtatatgtg

SEQ ID NO: 584376 - DNA, 13 bp, D. melanogaster
atatgtatattct

SEQ ID NO: 584377 - DNA, 14 bp, D. melanogaster
atatgtatatttac

SEQ ID NO: 584378 - DNA, 13 bp, D. melanogaster
atatgtatatttc

SEQ ID NO: 584379 - DNA, 13 bp, D. melanogaster
atatgtatatttg

SEQ ID NO: 584380 - DNA, 14 bp, D. melanogaster
atatgtatctatat

SEQ ID NO: 584381 - DNA, 13 bp, D. melanogaster
atatgtatctcta

SEQ ID NO: 584382 - DNA, 13 bp, D. melanogaster
atatgtatctgca

SEQ ID NO: 584383 - DNA, 13 bp, D. melanogaster
atatgtatctgta

SEQ ID NO: 584384 - DNA, 14 bp, D. melanogaster
atatgtatctgtat

SEQ ID NO: 584385 - DNA, 13 bp, D. melanogaster
atatgtatcttat

SEQ ID NO: 584386 - DNA, 13 bp, D. melanogaster
atatgtatcttca

SEQ ID NO: 584387 - DNA, 13 bp, D. melanogaster
atatgtatcttgt

SEQ ID NO: 584388 - DNA, 13 bp, D. melanogaster
atatgtatgaaca

SEQ ID NO: 584389 - DNA, 13 bp, D. melanogaster
atatgtatgaatg

SEQ ID NO: 584390 - DNA, 14 bp, D. melanogaster
atatgtatgaatgt

SEQ ID NO: 584391 - DNA, 13 bp, D. melanogaster
atatgtatgatgt

SEQ ID NO: 584392 - DNA, 13 bp, D. melanogaster
atatgtatgcaaa

SEQ ID NO: 584393 - DNA, 13 bp, D. melanogaster
atatgtatgcaca

SEQ ID NO: 584394 - DNA, 13 bp, D. melanogaster
atatgtatgcaga

SEQ ID NO: 584395 - DNA, 13 bp, D. melanogaster
atatgtatgtaaa

SEQ ID NO: 584396 - DNA, 14 bp, D. melanogaster
atatgtatgtaaat

SEQ ID NO: 584397 - DNA, 13 bp, D. melanogaster
atatgtatgtaac

SEQ ID NO: 584398 - DNA, 13 bp, D. melanogaster
atatgtatgtaat

SEQ ID NO: 584399 - DNA, 14 bp, D. melanogaster
atatgtatgtaata

SEQ ID NO: 584400 - DNA, 14 bp, D. melanogaster
atatgtatgtacaa

SEQ ID NO: 584401 - DNA, 14 bp, D. melanogaster
atatgtatgtacat

SEQ ID NO: 584402 - DNA, 16 bp, D. melanogaster
atatgtatgtacatat

SEQ ID NO: 584403 - DNA, 14 bp, D. melanogaster
atatgtatgtacgt

SEQ ID NO: 584404 - DNA, 13 bp, D. melanogaster
atatgtatgtaga

SEQ ID NO: 584405 - DNA, 13 bp, D. melanogaster
atatgtatgtata

SEQ ID NO: 584406 - DNA, 14 bp, D. melanogaster
atatgtatgtataa

SEQ ID NO: 584407 - DNA, 14 bp, D. melanogaster
atatgtatgtatat

SEQ ID NO: 584408 - DNA, 14 bp, D. melanogaster
atatgtatgtatgc

SEQ ID NO: 584409 - DNA, 14 bp, D. melanogaster
atatgtatgtatgg

SEQ ID NO: 584410 - DNA, 13 bp, D. melanogaster
atatgtatgtatt

SEQ ID NO: 584411 - DNA, 13 bp, D. melanogaster
atatgtatgtcca

SEQ ID NO: 584412 - DNA, 13 bp, D. melanogaster
atatgtatgtgat

SEQ ID NO: 584413 - DNA, 13 bp, D. melanogaster
atatgtatgtgca

SEQ ID NO: 584414 - DNA, 14 bp, D. melanogaster
atatgtatgtgcac

SEQ ID NO: 584415 - DNA, 13 bp, D. melanogaster
atatgtatgtgct

SEQ ID NO: 584416 - DNA, 14 bp, D. melanogaster
atatgtatgtgtgg

SEQ ID NO: 584417 - DNA, 14 bp, D. melanogaster
atatgtatgtgtgt

SEQ ID NO: 584418 - DNA, 13 bp, D. melanogaster
atatgtatgttta

SEQ ID NO: 584419 - DNA, 13 bp, D. melanogaster
atatgtattactt

SEQ ID NO: 584420 - DNA, 13 bp, D. melanogaster
atatgtattagtt

SEQ ID NO: 584421 - DNA, 13 bp, D. melanogaster
atatgtattcata

SEQ ID NO: 584422 - DNA, 13 bp, D. melanogaster
atatgtattgaaa

SEQ ID NO: 584423 - DNA, 13 bp, D. melanogaster
atatgtatttaca

SEQ ID NO: 584424 - DNA, 13 bp, D. melanogaster
atatgtatttatc

SEQ ID NO: 584425 - DNA, 13 bp, D. melanogaster
atatgtcataaaa

SEQ ID NO: 584426 - DNA, 13 bp, D. melanogaster
atatgtcgcagat

SEQ ID NO: 584427 - DNA, 13 bp, D. melanogaster
atatgtgaaaatg

SEQ ID NO: 584428 - DNA, 13 bp, D. melanogaster
atatgtgaaataa

SEQ ID NO: 584429 - DNA, 13 bp, D. melanogaster
atatgtgaaatat

SEQ ID NO: 584430 - DNA, 13 bp, D. melanogaster
atatgtgaataaa

SEQ ID NO: 584431 - DNA, 13 bp, D. melanogaster
atatgtgattagg

SEQ ID NO: 584432 - DNA, 13 bp, D. melanogaster
atatgtgatttaa

SEQ ID NO: 584433 - DNA, 13 bp, D. melanogaster
atatgtgcaaaaa

SEQ ID NO: 584434 - DNA, 13 bp, D. melanogaster
atatgtgcatata

SEQ ID NO: 584435 - DNA, 13 bp, D. melanogaster
atatgtgcatgtg

SEQ ID NO: 584436 - DNA, 13 bp, D. melanogaster
atatgtgctatat

SEQ ID NO: 584437 - DNA, 13 bp, D. melanogaster
atatgtgtaaata

SEQ ID NO: 584438 - DNA, 13 bp, D. melanogaster
atatgtgtaatat

SEQ ID NO: 584439 - DNA, 13 bp, D. melanogaster
atatgtgtacaaa

SEQ ID NO: 584440 - DNA, 13 bp, D. melanogaster
atatgtgtacatc

SEQ ID NO: 584441 - DNA, 14 bp, D. melanogaster
atatgtgtataaat

SEQ ID NO: 584442 - DNA, 13 bp, D. melanogaster
atatgtgtataca

SEQ ID NO: 584443 - DNA, 13 bp, D. melanogaster
atatgtgtatctg

SEQ ID NO: 584444 - DNA, 14 bp, D. melanogaster
atatgtgtatgtac

SEQ ID NO: 584445 - DNA, 14 bp, D. melanogaster
atatgtgtatgtat

SEQ ID NO: 584446 - DNA, 13 bp, D. melanogaster
atatgtgtgcaca

SEQ ID NO: 584447 - DNA, 13 bp, D. melanogaster
atatgtgtgcata

SEQ ID NO: 584448 - DNA, 14 bp, D. melanogaster
atatgtgtgcatat

SEQ ID NO: 584449 - DNA, 14 bp, D. melanogaster
atatgtgtgcgtgt

SEQ ID NO: 584450 - DNA, 13 bp, D. melanogaster
atatgtgtgggtg

SEQ ID NO: 584451 - DNA, 14 bp, D. melanogaster
atatgtgtgtatat

SEQ ID NO: 584452 - DNA, 14 bp, D. melanogaster
atatgtgtgtatgt

SEQ ID NO: 584453 - DNA, 13 bp, D. melanogaster
atatgtgtgtgcc

SEQ ID NO: 584454 - DNA, 14 bp, D. melanogaster
atatgtgtgtgtac

SEQ ID NO: 584455 - DNA, 13 bp, D. melanogaster
atatgtgtgtgtg

SEQ ID NO: 584456 - DNA, 14 bp, D. melanogaster
atatgtgtgtgtgt

SEQ ID NO: 584457 - DNA, 13 bp, D. melanogaster
atatgtgtgtgtt

SEQ ID NO: 584458 - DNA, 13 bp, D. melanogaster
atatgtgtttgtg

SEQ ID NO: 584459 - DNA, 13 bp, D. melanogaster
atatgttaatgtt

SEQ ID NO: 584460 - DNA, 14 bp, D. melanogaster
atatgttaattgcg

SEQ ID NO: 584461 - DNA, 13 bp, D. melanogaster
atatgttaatttc

SEQ ID NO: 584462 - DNA, 13 bp, D. melanogaster
atatgttcaaaat

SEQ ID NO: 584463 - DNA, 13 bp, D. melanogaster
atatgttcaaatt

SEQ ID NO: 584464 - DNA, 13 bp, D. melanogaster
atatgttcaataa

SEQ ID NO: 584465 - DNA, 13 bp, D. melanogaster
atatgttcaatat

SEQ ID NO: 584466 - DNA, 13 bp, D. melanogaster
atatgttcatatg

SEQ ID NO: 584467 - DNA, 13 bp, D. melanogaster
atatgttctattt

SEQ ID NO: 584468 - DNA, 13 bp, D. melanogaster
atatgttgaaaat

SEQ ID NO: 584469 - DNA, 13 bp, D. melanogaster
atatgttgaaata

SEQ ID NO: 584470 - DNA, 13 bp, D. melanogaster
atatgttgtatat

SEQ ID NO: 584471 - DNA, 13 bp, D. melanogaster
atatgtttaacaa

SEQ ID NO: 584472 - DNA, 13 bp, D. melanogaster
atatgtttaacta

SEQ ID NO: 584473 - DNA, 13 bp, D. melanogaster
atatgtttacttt

SEQ ID NO: 584474 - DNA, 14 bp, D. melanogaster
atatgtttagtgat

SEQ ID NO: 584475 - DNA, 13 bp, D. melanogaster
atatgtttatggc

SEQ ID NO: 584476 - DNA, 13 bp, D. melanogaster
atatgtttatgta

SEQ ID NO: 584477 - DNA, 13 bp, D. melanogaster
atatgtttcaaaa

SEQ ID NO: 584478 - DNA, 13 bp, D. melanogaster
atatgtttgctgt

SEQ ID NO: 584479 - DNA, 13 bp, D. melanogaster
atatgtttgtgtg

SEQ ID NO: 584480 - DNA, 13 bp, D. melanogaster
atatgttttatgg

SEQ ID NO: 584481 - DNA, 13 bp, D. melanogaster
atatgttttgaaa

SEQ ID NO: 584482 - DNA, 13 bp, D. melanogaster
atatgtttttctg

SEQ ID NO: 584483 - DNA, 13 bp, D. melanogaster
atattaaaaccat

SEQ ID NO: 584484 - DNA, 13 bp, D. melanogaster
atattaaaatacc

SEQ ID NO: 584485 - DNA, 13 bp, D. melanogaster
atattaaaattgc

SEQ ID NO: 584486 - DNA, 13 bp, D. melanogaster
atattaaacaagt

SEQ ID NO: 584487 - DNA, 13 bp, D. melanogaster
atattaaacgaaa

SEQ ID NO: 584488 - DNA, 13 bp, D. melanogaster
atattaaagcaaa

SEQ ID NO: 584489 - DNA, 13 bp, D. melanogaster
atattaaagccag

SEQ ID NO: 584490 - DNA, 13 bp, D. melanogaster
atattaacatgag

SEQ ID NO: 584491 - DNA, 13 bp, D. melanogaster
atattaaccatta

SEQ ID NO: 584492 - DNA, 13 bp, D. melanogaster
atattaacttgat

SEQ ID NO: 584493 - DNA, 13 bp, D. melanogaster
atattaagataca

SEQ ID NO: 584494 - DNA, 13 bp, D. melanogaster
atattaagcaaat

SEQ ID NO: 584495 - DNA, 13 bp, D. melanogaster
atattaagcaatt

SEQ ID NO: 584496 - DNA, 14 bp, D. melanogaster
atattaagcatacg

SEQ ID NO: 584497 - DNA, 13 bp, D. melanogaster
atattaaggcaag

SEQ ID NO: 584498 - DNA, 14 bp, D. melanogaster
atattaaggcaagg

SEQ ID NO: 584499 - DNA, 14 bp, D. melanogaster
atattaagtatacg

SEQ ID NO: 584500 - DNA, 13 bp, D. melanogaster
atattaagtcaaa

SEQ ID NO: 584501 - DNA, 13 bp, D. melanogaster
atattaagtgaaa

SEQ ID NO: 584502 - DNA, 13 bp, D. melanogaster
atattaagtggct

SEQ ID NO: 584503 - DNA, 13 bp, D. melanogaster
atattaatagctt

SEQ ID NO: 584504 - DNA, 13 bp, D. melanogaster
atattaatatgca

SEQ ID NO: 584505 - DNA, 13 bp, D. melanogaster
atattaatccaaa

SEQ ID NO: 584506 - DNA, 13 bp, D. melanogaster
atattaatgagca

SEQ ID NO: 584507 - DNA, 13 bp, D. melanogaster
atattaatgtaca

SEQ ID NO: 584508 - DNA, 13 bp, D. melanogaster
atattaatgttgt

SEQ ID NO: 584509 - DNA, 13 bp, D. melanogaster
atattaattgcat

SEQ ID NO: 584510 - DNA, 13 bp, D. melanogaster
atattaattggaa

SEQ ID NO: 584511 - DNA, 13 bp, D. melanogaster
atattacaaaatc

SEQ ID NO: 584512 - DNA, 13 bp, D. melanogaster
atattacaaaatg

SEQ ID NO: 584513 - DNA, 13 bp, D. melanogaster
atattacaatttc

SEQ ID NO: 584514 - DNA, 13 bp, D. melanogaster
atattacacatta

SEQ ID NO: 584515 - DNA, 13 bp, D. melanogaster
atattacagaaaa

SEQ ID NO: 584516 - DNA, 14 bp, D. melanogaster
atattacatacgta

SEQ ID NO: 584517 - DNA, 14 bp, D. melanogaster
atattacatattac

SEQ ID NO: 584518 - DNA, 13 bp, D. melanogaster
atattacatttga

SEQ ID NO: 584519 - DNA, 13 bp, D. melanogaster
atattaccaaaat

SEQ ID NO: 584520 - DNA, 13 bp, D. melanogaster
atattaccattat

SEQ ID NO: 584521 - DNA, 13 bp, D. melanogaster
atattactgaaat

SEQ ID NO: 584522 - DNA, 13 bp, D. melanogaster
atattactttcaa

SEQ ID NO: 584523 - DNA, 13 bp, D. melanogaster
atattatatatgc

SEQ ID NO: 584524 - DNA, 13 bp, D. melanogaster
atattatcgaaaa

SEQ ID NO: 584525 - DNA, 13 bp, D. melanogaster
atattatcgagaa

SEQ ID NO: 584526 - DNA, 14 bp, D. melanogaster
atattatcgagaaa

SEQ ID NO: 584527 - DNA, 13 bp, D. melanogaster
atattatctatac

SEQ ID NO: 584528 - DNA, 13 bp, D. melanogaster
atattatgtacat

SEQ ID NO: 584529 - DNA, 13 bp, D. melanogaster
atattatgtttca

SEQ ID NO: 584530 - DNA, 13 bp, D. melanogaster
atattattaccat

SEQ ID NO: 584531 - DNA, 13 bp, D. melanogaster
atattattcagtt

SEQ ID NO: 584532 - DNA, 14 bp, D. melanogaster
atattattcatgca

SEQ ID NO: 584533 - DNA, 13 bp, D. melanogaster
atattattgatca

SEQ ID NO: 584534 - DNA, 14 bp, D. melanogaster
atattattgatcag

SEQ ID NO: 584535 - DNA, 13 bp, D. melanogaster
atattattgccaa

SEQ ID NO: 584536 - DNA, 13 bp, D. melanogaster
atattatttacag

SEQ ID NO: 584537 - DNA, 13 bp, D. melanogaster
atattatttacca

SEQ ID NO: 584538 - DNA, 13 bp, D. melanogaster
atattatttatgc

SEQ ID NO: 584539 - DNA, 13 bp, D. melanogaster
atattatttatgg

SEQ ID NO: 584540 - DNA, 13 bp, D. melanogaster
atattatttcagt

SEQ ID NO: 584541 - DNA, 13 bp, D. melanogaster
atattatttccaa

SEQ ID NO: 584542 - DNA, 13 bp, D. melanogaster
atattatttgcaa

SEQ ID NO: 584543 - DNA, 13 bp, D. melanogaster
atattatttgctt

SEQ ID NO: 584544 - DNA, 13 bp, D. melanogaster
atattattttcag

SEQ ID NO: 584545 - DNA, 13 bp, D. melanogaster
atattattttcgc

SEQ ID NO: 584546 - DNA, 13 bp, D. melanogaster
atattcaaaacat

SEQ ID NO: 584547 - DNA, 14 bp, D. melanogaster
atattcaaaaccca

SEQ ID NO: 584548 - DNA, 13 bp, D. melanogaster
atattcaaaattc

SEQ ID NO: 584549 - DNA, 13 bp, D. melanogaster
atattcaaacaca

SEQ ID NO: 584550 - DNA, 13 bp, D. melanogaster
atattcaaacatt

SEQ ID NO: 584551 - DNA, 13 bp, D. melanogaster
atattcaaaccaa

SEQ ID NO: 584552 - DNA, 13 bp, D. melanogaster
atattcaaagtat

SEQ ID NO: 584553 - DNA, 13 bp, D. melanogaster
atattcaaataca

SEQ ID NO: 584554 - DNA, 13 bp, D. melanogaster
atattcaaatgag

SEQ ID NO: 584555 - DNA, 13 bp, D. melanogaster
atattcaaatgca

SEQ ID NO: 584556 - DNA, 13 bp, D. melanogaster
atattcaaatgta

SEQ ID NO: 584557 - DNA, 13 bp, D. melanogaster
atattcaaatgtg

SEQ ID NO: 584558 - DNA, 14 bp, D. melanogaster
atattcaaattcaa

SEQ ID NO: 584559 - DNA, 14 bp, D. melanogaster
atattcaaattgaa

SEQ ID NO: 584560 - DNA, 13 bp, D. melanogaster
atattcaaattgc

SEQ ID NO: 584561 - DNA, 13 bp, D. melanogaster
atattcaaatttg

SEQ ID NO: 584562 - DNA, 14 bp, D. melanogaster
atattcaacaattt

SEQ ID NO: 584563 - DNA, 14 bp, D. melanogaster
atattcaacaggca

SEQ ID NO: 584564 - DNA, 13 bp, D. melanogaster
atattcaacatat

SEQ ID NO: 584565 - DNA, 13 bp, D. melanogaster
atattcaagaaga

SEQ ID NO: 584566 - DNA, 13 bp, D. melanogaster
atattcaagattt

SEQ ID NO: 584567 - DNA, 13 bp, D. melanogaster
atattcaagggaa

SEQ ID NO: 584568 - DNA, 13 bp, D. melanogaster
atattcaattatg

SEQ ID NO: 584569 - DNA, 13 bp, D. melanogaster
atattcaatttgg

SEQ ID NO: 584570 - DNA, 13 bp, D. melanogaster
atattcaattttc

SEQ ID NO: 584571 - DNA, 13 bp, D. melanogaster
atattcaattttg

SEQ ID NO: 584572 - DNA, 13 bp, D. melanogaster
atattcacaatat

SEQ ID NO: 584573 - DNA, 13 bp, D. melanogaster
atattcacacaaa

SEQ ID NO: 584574 - DNA, 13 bp, D. melanogaster
atattcacacaca

SEQ ID NO: 584575 - DNA, 13 bp, D. melanogaster
atattcacatatt

SEQ ID NO: 584576 - DNA, 13 bp, D. melanogaster
atattcacatttt

SEQ ID NO: 584577 - DNA, 13 bp, D. melanogaster
atattcagaaatt

SEQ ID NO: 584578 - DNA, 13 bp, D. melanogaster
atattcagaatat

SEQ ID NO: 584579 - DNA, 14 bp, D. melanogaster
atattcagacaatt

SEQ ID NO: 584580 - DNA, 13 bp, D. melanogaster
atattcagataca

SEQ ID NO: 584581 - DNA, 13 bp, D. melanogaster
atattcagcaagc

SEQ ID NO: 584582 - DNA, 13 bp, D. melanogaster
atattcagcaatt

SEQ ID NO: 584583 - DNA, 13 bp, D. melanogaster
atattcataatca

SEQ ID NO: 584584 - DNA, 13 bp, D. melanogaster
atattcataatga

SEQ ID NO: 584585 - DNA, 13 bp, D. melanogaster
atattcatacata

SEQ ID NO: 584586 - DNA, 13 bp, D. melanogaster
atattcatagaaa

SEQ ID NO: 584587 - DNA, 13 bp, D. melanogaster
atattcatatgca

SEQ ID NO: 584588 - DNA, 13 bp, D. melanogaster
atattcatattca

SEQ ID NO: 584589 - DNA, 13 bp, D. melanogaster
atattcatatttc

SEQ ID NO: 584590 - DNA, 13 bp, D. melanogaster
atattcatggaaa

SEQ ID NO: 584591 - DNA, 13 bp, D. melanogaster
atattcattcaaa

SEQ ID NO: 584592 - DNA, 14 bp, D. melanogaster
atattcattcatat

SEQ ID NO: 584593 - DNA, 13 bp, D. melanogaster
atattcatttcaa

SEQ ID NO: 584594 - DNA, 13 bp, D. melanogaster
atattcatttgaa

SEQ ID NO: 584595 - DNA, 13 bp, D. melanogaster
atattcatttgca

SEQ ID NO: 584596 - DNA, 13 bp, D. melanogaster
atattcatttggc

SEQ ID NO: 584597 - DNA, 13 bp, D. melanogaster
atattcatttgta

SEQ ID NO: 584598 - DNA, 13 bp, D. melanogaster
atattcattttca

SEQ ID NO: 584599 - DNA, 13 bp, D. melanogaster
atattcattttgc

SEQ ID NO: 584600 - DNA, 13 bp, D. melanogaster
atattccaaatat

SEQ ID NO: 584601 - DNA, 13 bp, D. melanogaster
atattccaattaa

SEQ ID NO: 584602 - DNA, 13 bp, D. melanogaster
atattccaattta

SEQ ID NO: 584603 - DNA, 13 bp, D. melanogaster
atattccataaaa

SEQ ID NO: 584604 - DNA, 13 bp, D. melanogaster
atattccattcat

SEQ ID NO: 584605 - DNA, 13 bp, D. melanogaster
atattccgttttt

SEQ ID NO: 584606 - DNA, 13 bp, D. melanogaster
atattcctaaata

SEQ ID NO: 584607 - DNA, 13 bp, D. melanogaster
atattccttaaaa

SEQ ID NO: 584608 - DNA, 13 bp, D. melanogaster
atattcgaaaaaa

SEQ ID NO: 584609 - DNA, 13 bp, D. melanogaster
atattcgaaaatt

SEQ ID NO: 584610 - DNA, 14 bp, D. melanogaster
atattcgaaaattt

SEQ ID NO: 584611 - DNA, 13 bp, D. melanogaster
atattcgaaatta

SEQ ID NO: 584612 - DNA, 13 bp, D. melanogaster
atattcgaaattt

SEQ ID NO: 584613 - DNA, 13 bp, D. melanogaster
atattcgaattaa

SEQ ID NO: 584614 - DNA, 13 bp, D. melanogaster
atattcgatattc

SEQ ID NO: 584615 - DNA, 13 bp, D. melanogaster
atattcgatattt

SEQ ID NO: 584616 - DNA, 13 bp, D. melanogaster
atattcgatttaa

SEQ ID NO: 584617 - DNA, 13 bp, D. melanogaster
atattcgatttta

SEQ ID NO: 584618 - DNA, 13 bp, D. melanogaster
atattcgattttt

SEQ ID NO: 584619 - DNA, 14 bp, D. melanogaster
atattcgatttttt

SEQ ID NO: 584620 - DNA, 14 bp, D. melanogaster
atattcggtatttt

SEQ ID NO: 584621 - DNA, 13 bp, D. melanogaster
atattctacaata

SEQ ID NO: 584622 - DNA, 13 bp, D. melanogaster
atattctacatat

SEQ ID NO: 584623 - DNA, 14 bp, D. melanogaster
atattctcagatca

SEQ ID NO: 584624 - DNA, 13 bp, D. melanogaster
atattctgaaaaa

SEQ ID NO: 584625 - DNA, 13 bp, D. melanogaster
atattctgaaata

SEQ ID NO: 584626 - DNA, 13 bp, D. melanogaster
atattctgaataa

SEQ ID NO: 584627 - DNA, 13 bp, D. melanogaster
atattctgaatat

SEQ ID NO: 584628 - DNA, 13 bp, D. melanogaster
atattctgatttc

SEQ ID NO: 584629 - DNA, 14 bp, D. melanogaster
atattctgggaatt

SEQ ID NO: 584630 - DNA, 14 bp, D. melanogaster
atattctggttttt

SEQ ID NO: 584631 - DNA, 13 bp, D. melanogaster
atattcttaagaa

SEQ ID NO: 584632 - DNA, 13 bp, D. melanogaster
atattcttaatca

SEQ ID NO: 584633 - DNA, 13 bp, D. melanogaster
atattcttcaaat

SEQ ID NO: 584634 - DNA, 13 bp, D. melanogaster
atattcttgatca

SEQ ID NO: 584635 - DNA, 13 bp, D. melanogaster
atattctttatca

SEQ ID NO: 584636 - DNA, 14 bp, D. melanogaster
atattcttttcgaa

SEQ ID NO: 584637 - DNA, 13 bp, D. melanogaster
atattcttttgta

SEQ ID NO: 584638 - DNA, 13 bp, D. melanogaster
atattgaaaaaca

SEQ ID NO: 584639 - DNA, 13 bp, D. melanogaster
atattgaaaacat

SEQ ID NO: 584640 - DNA, 13 bp, D. melanogaster
atattgaaaacta

SEQ ID NO: 584641 - DNA, 13 bp, D. melanogaster
atattgaaaactt

SEQ ID NO: 584642 - DNA, 13 bp, D. melanogaster
atattgaaacaat

SEQ ID NO: 584643 - DNA, 13 bp, D. melanogaster
atattgaaagcaa

SEQ ID NO: 584644 - DNA, 13 bp, D. melanogaster
atattgaaagtat

SEQ ID NO: 584645 - DNA, 14 bp, D. melanogaster
atattgaaatcaat

SEQ ID NO: 584646 - DNA, 13 bp, D. melanogaster
atattgaaatcat

SEQ ID NO: 584647 - DNA, 13 bp, D. melanogaster
atattgaaattac

SEQ ID NO: 584648 - DNA, 13 bp, D. melanogaster
atattgaaattgt

SEQ ID NO: 584649 - DNA, 13 bp, D. melanogaster
atattgaaatttg

SEQ ID NO: 584650 - DNA, 13 bp, D. melanogaster
atattgaattgtg

SEQ ID NO: 584651 - DNA, 14 bp, D. melanogaster
atattgaattgtgg

SEQ ID NO: 584652 - DNA, 13 bp, D. melanogaster
atattgaattttg

SEQ ID NO: 584653 - DNA, 13 bp, D. melanogaster
atattgacaattt

SEQ ID NO: 584654 - DNA, 13 bp, D. melanogaster
atattgacatcat

SEQ ID NO: 584655 - DNA, 13 bp, D. melanogaster
atattgacatttt

SEQ ID NO: 584656 - DNA, 13 bp, D. melanogaster
atattgaccatta

SEQ ID NO: 584657 - DNA, 13 bp, D. melanogaster
atattgagaaaat

SEQ ID NO: 584658 - DNA, 13 bp, D. melanogaster
atattgagaacct

SEQ ID NO: 584659 - DNA, 13 bp, D. melanogaster
atattgagagcga

SEQ ID NO: 584660 - DNA, 13 bp, D. melanogaster
atattgagatatt

SEQ ID NO: 584661 - DNA, 13 bp, D. melanogaster
atattgaggaaat

SEQ ID NO: 584662 - DNA, 13 bp, D. melanogaster
atattgataagat

SEQ ID NO: 584663 - DNA, 13 bp, D. melanogaster
atattgatagttt

SEQ ID NO: 584664 - DNA, 14 bp, D. melanogaster
atattgatagtttc

SEQ ID NO: 584665 - DNA, 14 bp, D. melanogaster
atattgatattgat

SEQ ID NO: 584666 - DNA, 13 bp, D. melanogaster
atattgatattgc

SEQ ID NO: 584667 - DNA, 13 bp, D. melanogaster
atattgattgcat

SEQ ID NO: 584668 - DNA, 13 bp, D. melanogaster
atattgatttcga

SEQ ID NO: 584669 - DNA, 13 bp, D. melanogaster
atattgatttgca

SEQ ID NO: 584670 - DNA, 13 bp, D. melanogaster
atattgatttggg

SEQ ID NO: 584671 - DNA, 13 bp, D. melanogaster
atattgattttca

SEQ ID NO: 584672 - DNA, 13 bp, D. melanogaster
atattgcaaaata

SEQ ID NO: 584673 - DNA, 13 bp, D. melanogaster
atattgcaaaatg

SEQ ID NO: 584674 - DNA, 13 bp, D. melanogaster
atattgcaacaag

SEQ ID NO: 584675 - DNA, 13 bp, D. melanogaster
atattgcaacatt

SEQ ID NO: 584676 - DNA, 13 bp, D. melanogaster
atattgcaataaa

SEQ ID NO: 584677 - DNA, 13 bp, D. melanogaster
atattgcaatata

SEQ ID NO: 584678 - DNA, 13 bp, D. melanogaster
atattgcaatatt

SEQ ID NO: 584679 - DNA, 13 bp, D. melanogaster
atattgcaatttt

SEQ ID NO: 584680 - DNA, 13 bp, D. melanogaster
atattgcacaaat

SEQ ID NO: 584681 - DNA, 14 bp, D. melanogaster
atattgcagataaa

SEQ ID NO: 584682 - DNA, 13 bp, D. melanogaster
atattgcataatt

SEQ ID NO: 584683 - DNA, 13 bp, D. melanogaster
atattgcatatat

SEQ ID NO: 584684 - DNA, 13 bp, D. melanogaster
atattgcatatta

SEQ ID NO: 584685 - DNA, 13 bp, D. melanogaster
atattgccaaaaa

SEQ ID NO: 584686 - DNA, 14 bp, D. melanogaster
atattgcgcatacg

SEQ ID NO: 584687 - DNA, 14 bp, D. melanogaster
atattgcgtatacg

SEQ ID NO: 584688 - DNA, 13 bp, D. melanogaster
atattgctattaa

SEQ ID NO: 584689 - DNA, 13 bp, D. melanogaster
atattgctgctgc

SEQ ID NO: 584690 - DNA, 13 bp, D. melanogaster
atattggaaatat

SEQ ID NO: 584691 - DNA, 13 bp, D. melanogaster
atattggcaaata

SEQ ID NO: 584692 - DNA, 13 bp, D. melanogaster
atattggggaata

SEQ ID NO: 584693 - DNA, 14 bp, D. melanogaster
atattggggaataa

SEQ ID NO: 584694 - DNA, 13 bp, D. melanogaster
atattggtaataa

SEQ ID NO: 584695 - DNA, 13 bp, D. melanogaster
atattggtgaata

SEQ ID NO: 584696 - DNA, 14 bp, D. melanogaster
atattggtgaataa

SEQ ID NO: 584697 - DNA, 13 bp, D. melanogaster
atattggtttcat

SEQ ID NO: 584698 - DNA, 13 bp, D. melanogaster
atattgtaaaatg

SEQ ID NO: 584699 - DNA, 13 bp, D. melanogaster
atattgtaaacat

SEQ ID NO: 584700 - DNA, 14 bp, D. melanogaster
atattgtaagtata

SEQ ID NO: 584701 - DNA, 13 bp, D. melanogaster
atattgtacaatt

SEQ ID NO: 584702 - DNA, 14 bp, D. melanogaster
atattgtacatatg

SEQ ID NO: 584703 - DNA, 14 bp, D. melanogaster
atattgtatacata

SEQ ID NO: 584704 - DNA, 14 bp, D. melanogaster
atattgtatataca

SEQ ID NO: 584705 - DNA, 13 bp, D. melanogaster
atattgtatattc

SEQ ID NO: 584706 - DNA, 13 bp, D. melanogaster
atattgtatgtac

SEQ ID NO: 584707 - DNA, 13 bp, D. melanogaster
atattgtatttct

SEQ ID NO: 584708 - DNA, 13 bp, D. melanogaster
atattgtattttc

SEQ ID NO: 584709 - DNA, 13 bp, D. melanogaster
atattgtcaagtt

SEQ ID NO: 584710 - DNA, 13 bp, D. melanogaster
atattgtgaatat

SEQ ID NO: 584711 - DNA, 13 bp, D. melanogaster
atattgtgtatat

SEQ ID NO: 584712 - DNA, 13 bp, D. melanogaster
atattgtgtttag

SEQ ID NO: 584713 - DNA, 13 bp, D. melanogaster
atattgttaacaa

SEQ ID NO: 584714 - DNA, 14 bp, D. melanogaster
atattgttattatc

SEQ ID NO: 584715 - DNA, 13 bp, D. melanogaster
atattgttcaaat

SEQ ID NO: 584716 - DNA, 13 bp, D. melanogaster
atattgttgacaa

SEQ ID NO: 584717 - DNA, 13 bp, D. melanogaster
atattgttggaaa

SEQ ID NO: 584718 - DNA, 14 bp, D. melanogaster
atattgttggaaat

SEQ ID NO: 584719 - DNA, 13 bp, D. melanogaster
atattgtttgaaa

SEQ ID NO: 584720 - DNA, 13 bp, D. melanogaster
atattgtttgcaa

SEQ ID NO: 584721 - DNA, 13 bp, D. melanogaster
atattgtttgtaa

SEQ ID NO: 584722 - DNA, 14 bp, D. melanogaster
atattgttttggct

SEQ ID NO: 584723 - DNA, 13 bp, D. melanogaster
atatttaaaaacg

SEQ ID NO: 584724 - DNA, 13 bp, D. melanogaster
atatttaaaagcg

SEQ ID NO: 584725 - DNA, 13 bp, D. melanogaster
atatttaaaaggc

SEQ ID NO: 584726 - DNA, 13 bp, D. melanogaster
atatttaaacaag

SEQ ID NO: 584727 - DNA, 13 bp, D. melanogaster
atatttaaagcat

SEQ ID NO: 584728 - DNA, 13 bp, D. melanogaster
atatttaaaggaa

SEQ ID NO: 584729 - DNA, 13 bp, D. melanogaster
atatttaaatacg

SEQ ID NO: 584730 - DNA, 13 bp, D. melanogaster
atatttaaatctg

SEQ ID NO: 584731 - DNA, 13 bp, D. melanogaster
atatttaacaaca

SEQ ID NO: 584732 - DNA, 13 bp, D. melanogaster
atatttaacaagc

SEQ ID NO: 584733 - DNA, 13 bp, D. melanogaster
atatttaacacat

SEQ ID NO: 584734 - DNA, 13 bp, D. melanogaster
atatttaacagaa

SEQ ID NO: 584735 - DNA, 13 bp, D. melanogaster
atatttaaccata

SEQ ID NO: 584736 - DNA, 13 bp, D. melanogaster
atatttaactttg

SEQ ID NO: 584737 - DNA, 13 bp, D. melanogaster
atatttaagaaac

SEQ ID NO: 584738 - DNA, 13 bp, D. melanogaster
atatttaagcagc

SEQ ID NO: 584739 - DNA, 13 bp, D. melanogaster
atatttaagccaa

SEQ ID NO: 584740 - DNA, 14 bp, D. melanogaster
atatttaagtctct

SEQ ID NO: 584741 - DNA, 13 bp, D. melanogaster
atatttaagtgtt

SEQ ID NO: 584742 - DNA, 13 bp, D. melanogaster
atatttaatcgaa

SEQ ID NO: 584743 - DNA, 13 bp, D. melanogaster
atatttaatgaac

SEQ ID NO: 584744 - DNA, 13 bp, D. melanogaster
atatttaatgcat

SEQ ID NO: 584745 - DNA, 13 bp, D. melanogaster
atatttaatggca

SEQ ID NO: 584746 - DNA, 13 bp, D. melanogaster
atatttaatttgc

SEQ ID NO: 584747 - DNA, 13 bp, D. melanogaster
atatttacaaaac

SEQ ID NO: 584748 - DNA, 13 bp, D. melanogaster
atatttacaaacg

SEQ ID NO: 584749 - DNA, 14 bp, D. melanogaster
atatttacaaacgg

SEQ ID NO: 584750 - DNA, 13 bp, D. melanogaster
atatttacacaaa

SEQ ID NO: 584751 - DNA, 14 bp, D. melanogaster
atatttacacaatt

SEQ ID NO: 584752 - DNA, 13 bp, D. melanogaster
atatttacacaga

SEQ ID NO: 584753 - DNA, 14 bp, D. melanogaster
atatttacacattt

SEQ ID NO: 584754 - DNA, 13 bp, D. melanogaster
atatttacatact

SEQ ID NO: 584755 - DNA, 13 bp, D. melanogaster
atatttacattca

SEQ ID NO: 584756 - DNA, 13 bp, D. melanogaster
atatttacattga

SEQ ID NO: 584757 - DNA, 13 bp, D. melanogaster
atatttacatttg

SEQ ID NO: 584758 - DNA, 13 bp, D. melanogaster
atatttaccaaat

SEQ ID NO: 584759 - DNA, 13 bp, D. melanogaster
atatttaccataa

SEQ ID NO: 584760 - DNA, 14 bp, D. melanogaster
atatttaccataaa

SEQ ID NO: 584761 - DNA, 13 bp, D. melanogaster
atatttacgaaat

SEQ ID NO: 584762 - DNA, 13 bp, D. melanogaster
atatttacgattt

SEQ ID NO: 584763 - DNA, 13 bp, D. melanogaster
atatttacgtata

SEQ ID NO: 584764 - DNA, 13 bp, D. melanogaster
atatttactaaac

SEQ ID NO: 584765 - DNA, 13 bp, D. melanogaster
atatttactacaa

SEQ ID NO: 584766 - DNA, 14 bp, D. melanogaster
atatttactgtttt

SEQ ID NO: 584767 - DNA, 13 bp, D. melanogaster
atatttagaaaac

SEQ ID NO: 584768 - DNA, 13 bp, D. melanogaster
atatttagatatg

SEQ ID NO: 584769 - DNA, 13 bp, D. melanogaster
atatttagcaatt

SEQ ID NO: 584770 - DNA, 13 bp, D. melanogaster
atatttagccaaa

SEQ ID NO: 584771 - DNA, 13 bp, D. melanogaster
atatttagctttt

SEQ ID NO: 584772 - DNA, 13 bp, D. melanogaster
atatttagttagc

SEQ ID NO: 584773 - DNA, 13 bp, D. melanogaster
atatttagtttca

SEQ ID NO: 584774 - DNA, 13 bp, D. melanogaster
atatttataagcc

SEQ ID NO: 584775 - DNA, 13 bp, D. melanogaster
atatttataagct

SEQ ID NO: 584776 - DNA, 13 bp, D. melanogaster
atatttatacaac

SEQ ID NO: 584777 - DNA, 13 bp, D. melanogaster
atatttatacact

SEQ ID NO: 584778 - DNA, 13 bp, D. melanogaster
atatttataccca

SEQ ID NO: 584779 - DNA, 13 bp, D. melanogaster
atatttatacgtg

SEQ ID NO: 584780 - DNA, 13 bp, D. melanogaster
atatttatactct

SEQ ID NO: 584781 - DNA, 13 bp, D. melanogaster
atatttatagagt

SEQ ID NO: 584782 - DNA, 13 bp, D. melanogaster
atatttatagcca

SEQ ID NO: 584783 - DNA, 13 bp, D. melanogaster
atatttatagctt

SEQ ID NO: 584784 - DNA, 13 bp, D. melanogaster
atatttatagtac

SEQ ID NO: 584785 - DNA, 13 bp, D. melanogaster
atatttatatacc

SEQ ID NO: 584786 - DNA, 14 bp, D. melanogaster
atatttatatgcat

SEQ ID NO: 584787 - DNA, 13 bp, D. melanogaster
atatttatcagat

SEQ ID NO: 584788 - DNA, 13 bp, D. melanogaster
atatttatcgaaa

SEQ ID NO: 584789 - DNA, 13 bp, D. melanogaster
atatttatcgata

SEQ ID NO: 584790 - DNA, 13 bp, D. melanogaster
atatttatgaaac

SEQ ID NO: 584791 - DNA, 13 bp, D. melanogaster
atatttatgaaag

SEQ ID NO: 584792 - DNA, 13 bp, D. melanogaster
atatttatgacta

SEQ ID NO: 584793 - DNA, 13 bp, D. melanogaster
atatttatgcagc

SEQ ID NO: 584794 - DNA, 13 bp, D. melanogaster
atatttatgcagt

SEQ ID NO: 584795 - DNA, 14 bp, D. melanogaster
atatttatgcatat

SEQ ID NO: 584796 - DNA, 13 bp, D. melanogaster
atatttatgcctt

SEQ ID NO: 584797 - DNA, 13 bp, D. melanogaster
atatttatgcgca

SEQ ID NO: 584798 - DNA, 13 bp, D. melanogaster
atatttatgcgtt

SEQ ID NO: 584799 - DNA, 13 bp, D. melanogaster
atatttatgcttt

SEQ ID NO: 584800 - DNA, 13 bp, D. melanogaster
atatttatggaaa

SEQ ID NO: 584801 - DNA, 14 bp, D. melanogaster
atatttatggaaat

SEQ ID NO: 584802 - DNA, 13 bp, D. melanogaster
atatttatggata

SEQ ID NO: 584803 - DNA, 13 bp, D. melanogaster
atatttatggatt

SEQ ID NO: 584804 - DNA, 13 bp, D. melanogaster
atatttatggcta

SEQ ID NO: 584805 - DNA, 13 bp, D. melanogaster
atatttatggctt

SEQ ID NO: 584806 - DNA, 14 bp, D. melanogaster
atatttatgtacat

SEQ ID NO: 584807 - DNA, 13 bp, D. melanogaster
atatttatgtgat

SEQ ID NO: 584808 - DNA, 13 bp, D. melanogaster
atatttatgtgct

SEQ ID NO: 584809 - DNA, 13 bp, D. melanogaster
atatttattacca

SEQ ID NO: 584810 - DNA, 13 bp, D. melanogaster
atatttattagag

SEQ ID NO: 584811 - DNA, 13 bp, D. melanogaster
atatttattagca

SEQ ID NO: 584812 - DNA, 13 bp, D. melanogaster
atatttattgact

SEQ ID NO: 584813 - DNA, 13 bp, D. melanogaster
atatttattgagc

SEQ ID NO: 584814 - DNA, 13 bp, D. melanogaster
atatttattgagt

SEQ ID NO: 584815 - DNA, 13 bp, D. melanogaster
atatttattggct

SEQ ID NO: 584816 - DNA, 13 bp, D. melanogaster
atatttattgtac

SEQ ID NO: 584817 - DNA, 13 bp, D. melanogaster
atatttatttacc

SEQ ID NO: 584818 - DNA, 13 bp, D. melanogaster
atatttatttctg

SEQ ID NO: 584819 - DNA, 14 bp, D. melanogaster
atatttatttgctt

SEQ ID NO: 584820 - DNA, 13 bp, D. melanogaster
atatttatttggc

SEQ ID NO: 584821 - DNA, 13 bp, D. melanogaster
atatttattttcg

SEQ ID NO: 584822 - DNA, 13 bp, D. melanogaster
atatttcaaattc

SEQ ID NO: 584823 - DNA, 13 bp, D. melanogaster
atatttcaacaat

SEQ ID NO: 584824 - DNA, 13 bp, D. melanogaster
atatttcaatatc

SEQ ID NO: 584825 - DNA, 13 bp, D. melanogaster
atatttcaatttc

SEQ ID NO: 584826 - DNA, 14 bp, D. melanogaster
atatttcacaattt

SEQ ID NO: 584827 - DNA, 13 bp, D. melanogaster
atatttcacactt

SEQ ID NO: 584828 - DNA, 13 bp, D. melanogaster
atatttcacatat

SEQ ID NO: 584829 - DNA, 13 bp, D. melanogaster
atatttcacattt

SEQ ID NO: 584830 - DNA, 13 bp, D. melanogaster
atatttcacttat

SEQ ID NO: 584831 - DNA, 13 bp, D. melanogaster
atatttcagctat

SEQ ID NO: 584832 - DNA, 13 bp, D. melanogaster
atatttcagtttg

SEQ ID NO: 584833 - DNA, 13 bp, D. melanogaster
atatttcagtttt

SEQ ID NO: 584834 - DNA, 13 bp, D. melanogaster
atatttcataagc

SEQ ID NO: 584835 - DNA, 13 bp, D. melanogaster
atatttcatagtt

SEQ ID NO: 584836 - DNA, 13 bp, D. melanogaster
atatttcatatag

SEQ ID NO: 584837 - DNA, 13 bp, D. melanogaster
atatttcatatgt

SEQ ID NO: 584838 - DNA, 13 bp, D. melanogaster
atatttcatccat

SEQ ID NO: 584839 - DNA, 13 bp, D. melanogaster
atatttcatgaat

SEQ ID NO: 584840 - DNA, 13 bp, D. melanogaster
atatttcattcaa

SEQ ID NO: 584841 - DNA, 13 bp, D. melanogaster
atatttcattgaa

SEQ ID NO: 584842 - DNA, 13 bp, D. melanogaster
atatttcattgat

SEQ ID NO: 584843 - DNA, 13 bp, D. melanogaster
atatttcatttgc

SEQ ID NO: 584844 - DNA, 14 bp, D. melanogaster
atatttcatttgcc

SEQ ID NO: 584845 - DNA, 13 bp, D. melanogaster
atatttccaaata

SEQ ID NO: 584846 - DNA, 13 bp, D. melanogaster
atatttccaataa

SEQ ID NO: 584847 - DNA, 13 bp, D. melanogaster
atatttccaatat

SEQ ID NO: 584848 - DNA, 13 bp, D. melanogaster
atatttccaattc

SEQ ID NO: 584849 - DNA, 13 bp, D. melanogaster
atatttccagtta

SEQ ID NO: 584850 - DNA, 13 bp, D. melanogaster
atatttccataaa

SEQ ID NO: 584851 - DNA, 13 bp, D. melanogaster
atatttccatatt

SEQ ID NO: 584852 - DNA, 13 bp, D. melanogaster
atatttccattaa

SEQ ID NO: 584853 - DNA, 13 bp, D. melanogaster
atatttcccaact

SEQ ID NO: 584854 - DNA, 13 bp, D. melanogaster
atatttcccaatt

SEQ ID NO: 584855 - DNA, 13 bp, D. melanogaster
atatttcccattt

SEQ ID NO: 584856 - DNA, 14 bp, D. melanogaster
atatttcccgcagt

SEQ ID NO: 584857 - DNA, 13 bp, D. melanogaster
atatttccgattc

SEQ ID NO: 584858 - DNA, 13 bp, D. melanogaster
atatttccgcatt

SEQ ID NO: 584859 - DNA, 13 bp, D. melanogaster
atatttccgtttt

SEQ ID NO: 584860 - DNA, 13 bp, D. melanogaster
atatttcctatat

SEQ ID NO: 584861 - DNA, 13 bp, D. melanogaster
atatttcgaaaaa

SEQ ID NO: 584862 - DNA, 13 bp, D. melanogaster
atatttcgaaaat

SEQ ID NO: 584863 - DNA, 13 bp, D. melanogaster
atatttcgaaatt

SEQ ID NO: 584864 - DNA, 13 bp, D. melanogaster
atatttcgaattt

SEQ ID NO: 584865 - DNA, 14 bp, D. melanogaster
atatttcgactatt

SEQ ID NO: 584866 - DNA, 13 bp, D. melanogaster
atatttcgagggg

SEQ ID NO: 584867 - DNA, 13 bp, D. melanogaster
atatttcgattaa

SEQ ID NO: 584868 - DNA, 13 bp, D. melanogaster
atatttcgatttt

SEQ ID NO: 584869 - DNA, 13 bp, D. melanogaster
atatttcgcaaat

SEQ ID NO: 584870 - DNA, 13 bp, D. melanogaster
atatttcgcattt

SEQ ID NO: 584871 - DNA, 13 bp, D. melanogaster
atatttcgtattt

SEQ ID NO: 584872 - DNA, 13 bp, D. melanogaster
atatttcgttttg

SEQ ID NO: 584873 - DNA, 13 bp, D. melanogaster
atatttctactaa

SEQ ID NO: 584874 - DNA, 13 bp, D. melanogaster
atatttctcaaaa

SEQ ID NO: 584875 - DNA, 13 bp, D. melanogaster
atatttctcctgc

SEQ ID NO: 584876 - DNA, 13 bp, D. melanogaster
atatttctctacg

SEQ ID NO: 584877 - DNA, 13 bp, D. melanogaster
atatttctgaaat

SEQ ID NO: 584878 - DNA, 13 bp, D. melanogaster
atatttctgaata

SEQ ID NO: 584879 - DNA, 13 bp, D. melanogaster
atatttctgattt

SEQ ID NO: 584880 - DNA, 14 bp, D. melanogaster
atatttctgttatt

SEQ ID NO: 584881 - DNA, 13 bp, D. melanogaster
atatttctgttta

SEQ ID NO: 584882 - DNA, 13 bp, D. melanogaster
atatttcttacaa

SEQ ID NO: 584883 - DNA, 13 bp, D. melanogaster
atatttcttcaaa

SEQ ID NO: 584884 - DNA, 13 bp, D. melanogaster
atatttcttggaa

SEQ ID NO: 584885 - DNA, 13 bp, D. melanogaster
atatttgaaaaac

SEQ ID NO: 584886 - DNA, 13 bp, D. melanogaster
atatttgaaaatc

SEQ ID NO: 584887 - DNA, 13 bp, D. melanogaster
atatttgaaacaa

SEQ ID NO: 584888 - DNA, 13 bp, D. melanogaster
atatttgaaagtt

SEQ ID NO: 584889 - DNA, 13 bp, D. melanogaster
atatttgaacaat

SEQ ID NO: 584890 - DNA, 13 bp, D. melanogaster
atatttgaataca

SEQ ID NO: 584891 - DNA, 13 bp, D. melanogaster
atatttgaatatc

SEQ ID NO: 584892 - DNA, 13 bp, D. melanogaster
atatttgaatatg

SEQ ID NO: 584893 - DNA, 13 bp, D. melanogaster
atatttgaatcat

SEQ ID NO: 584894 - DNA, 14 bp, D. melanogaster
atatttgaatcttt

SEQ ID NO: 584895 - DNA, 13 bp, D. melanogaster
atatttgaatgca

SEQ ID NO: 584896 - DNA, 13 bp, D. melanogaster
atatttgaattca

SEQ ID NO: 584897 - DNA, 13 bp, D. melanogaster
atatttgacaata

SEQ ID NO: 584898 - DNA, 13 bp, D. melanogaster
atatttgactttt

SEQ ID NO: 584899 - DNA, 13 bp, D. melanogaster
atatttgagaaaa

SEQ ID NO: 584900 - DNA, 13 bp, D. melanogaster
atatttgagaaat

SEQ ID NO: 584901 - DNA, 13 bp, D. melanogaster
atatttgagcaaa

SEQ ID NO: 584902 - DNA, 13 bp, D. melanogaster
atatttgataagc

SEQ ID NO: 584903 - DNA, 13 bp, D. melanogaster
atatttgatatga

SEQ ID NO: 584904 - DNA, 13 bp, D. melanogaster
atatttgattaca

SEQ ID NO: 584905 - DNA, 13 bp, D. melanogaster
atatttgattatg

SEQ ID NO: 584906 - DNA, 13 bp, D. melanogaster
atatttgcaaatc

SEQ ID NO: 584907 - DNA, 13 bp, D. melanogaster
atatttgcaaatt

SEQ ID NO: 584908 - DNA, 13 bp, D. melanogaster
atatttgcaagta

SEQ ID NO: 584909 - DNA, 13 bp, D. melanogaster
atatttgcaatat

SEQ ID NO: 584910 - DNA, 13 bp, D. melanogaster
atatttgcaattg

SEQ ID NO: 584911 - DNA, 14 bp, D. melanogaster
atatttgcacaaat

SEQ ID NO: 584912 - DNA, 13 bp, D. melanogaster
atatttgcacaca

SEQ ID NO: 584913 - DNA, 13 bp, D. melanogaster
atatttgcacagc

SEQ ID NO: 584914 - DNA, 13 bp, D. melanogaster
atatttgcacagt

SEQ ID NO: 584915 - DNA, 13 bp, D. melanogaster
atatttgcagtgc

SEQ ID NO: 584916 - DNA, 13 bp, D. melanogaster
atatttgcataaa

SEQ ID NO: 584917 - DNA, 14 bp, D. melanogaster
atatttgcataaaa

SEQ ID NO: 584918 - DNA, 13 bp, D. melanogaster
atatttgcataat

SEQ ID NO: 584919 - DNA, 14 bp, D. melanogaster
atatttgcataatt

SEQ ID NO: 584920 - DNA, 14 bp, D. melanogaster
atatttgcatacat

SEQ ID NO: 584921 - DNA, 14 bp, D. melanogaster
atatttgcatatat

SEQ ID NO: 584922 - DNA, 14 bp, D. melanogaster
atatttgcatattt

SEQ ID NO: 584923 - DNA, 13 bp, D. melanogaster
atatttgcattag

SEQ ID NO: 584924 - DNA, 13 bp, D. melanogaster
atatttgcatttc

SEQ ID NO: 584925 - DNA, 13 bp, D. melanogaster
atatttgccaaaa

SEQ ID NO: 584926 - DNA, 14 bp, D. melanogaster
atatttgccaaaaa

SEQ ID NO: 584927 - DNA, 13 bp, D. melanogaster
atatttgccaaca

SEQ ID NO: 584928 - DNA, 13 bp, D. melanogaster
atatttgccaact

SEQ ID NO: 584929 - DNA, 13 bp, D. melanogaster
atatttgccaata

SEQ ID NO: 584930 - DNA, 13 bp, D. melanogaster
atatttgccagca

SEQ ID NO: 584931 - DNA, 13 bp, D. melanogaster
atatttgccagct

SEQ ID NO: 584932 - DNA, 13 bp, D. melanogaster
atatttgcccagc

SEQ ID NO: 584933 - DNA, 13 bp, D. melanogaster
atatttgccttat

SEQ ID NO: 584934 - DNA, 13 bp, D. melanogaster
atatttgccttca

SEQ ID NO: 584935 - DNA, 13 bp, D. melanogaster
atatttgcgctac

SEQ ID NO: 584936 - DNA, 13 bp, D. melanogaster
atatttgcgtttt

SEQ ID NO: 584937 - DNA, 13 bp, D. melanogaster
atatttgctcaaa

SEQ ID NO: 584938 - DNA, 13 bp, D. melanogaster
atatttgcttaaa

SEQ ID NO: 584939 - DNA, 14 bp, D. melanogaster
atatttgcttaaat

SEQ ID NO: 584940 - DNA, 13 bp, D. melanogaster
atatttgcttaag

SEQ ID NO: 584941 - DNA, 13 bp, D. melanogaster
atatttgctttaa

SEQ ID NO: 584942 - DNA, 13 bp, D. melanogaster
atatttgctttgt

SEQ ID NO: 584943 - DNA, 13 bp, D. melanogaster
atatttggaaaat

SEQ ID NO: 584944 - DNA, 13 bp, D. melanogaster
atatttggaatat

SEQ ID NO: 584945 - DNA, 14 bp, D. melanogaster
atatttggaattgg

SEQ ID NO: 584946 - DNA, 13 bp, D. melanogaster
atatttggatata

SEQ ID NO: 584947 - DNA, 13 bp, D. melanogaster
atatttggatatt

SEQ ID NO: 584948 - DNA, 13 bp, D. melanogaster
atatttggattat

SEQ ID NO: 584949 - DNA, 13 bp, D. melanogaster
atatttggcaaaa

SEQ ID NO: 584950 - DNA, 13 bp, D. melanogaster
atatttggcatat

SEQ ID NO: 584951 - DNA, 14 bp, D. melanogaster
atatttggctacca

SEQ ID NO: 584952 - DNA, 13 bp, D. melanogaster
atatttggctggc

SEQ ID NO: 584953 - DNA, 13 bp, D. melanogaster
atatttggtatat

SEQ ID NO: 584954 - DNA, 13 bp, D. melanogaster
atatttggtcaaa

SEQ ID NO: 584955 - DNA, 14 bp, D. melanogaster
atatttgtacatat

SEQ ID NO: 584956 - DNA, 13 bp, D. melanogaster
atatttgtacatt

SEQ ID NO: 584957 - DNA, 13 bp, D. melanogaster
atatttgtatgta

SEQ ID NO: 584958 - DNA, 13 bp, D. melanogaster
atatttgtcattt

SEQ ID NO: 584959 - DNA, 13 bp, D. melanogaster
atatttgtccaaa

SEQ ID NO: 584960 - DNA, 13 bp, D. melanogaster
atatttgtgaaat

SEQ ID NO: 584961 - DNA, 13 bp, D. melanogaster
atatttgtgaatt

SEQ ID NO: 584962 - DNA, 13 bp, D. melanogaster
atatttgtgatgt

SEQ ID NO: 584963 - DNA, 13 bp, D. melanogaster
atatttgtgctgc

SEQ ID NO: 584964 - DNA, 13 bp, D. melanogaster
atatttgtggcaa

SEQ ID NO: 584965 - DNA, 13 bp, D. melanogaster
atatttgtgtata

SEQ ID NO: 584966 - DNA, 13 bp, D. melanogaster
atatttgtgtgta

SEQ ID NO: 584967 - DNA, 14 bp, D. melanogaster
atatttgtgtgtat

SEQ ID NO: 584968 - DNA, 13 bp, D. melanogaster
atatttgtgtgtg

SEQ ID NO: 584969 - DNA, 13 bp, D. melanogaster
atatttgttcaaa

SEQ ID NO: 584970 - DNA, 13 bp, D. melanogaster
atatttgttgaaa

SEQ ID NO: 584971 - DNA, 13 bp, D. melanogaster
atatttgttgtac

SEQ ID NO: 584972 - DNA, 13 bp, D. melanogaster
atatttgttttcc

SEQ ID NO: 584973 - DNA, 13 bp, D. melanogaster
atatttgttttcg

SEQ ID NO: 584974 - DNA, 13 bp, D. melanogaster
atattttaaaagc

SEQ ID NO: 584975 - DNA, 13 bp, D. melanogaster
atattttaaacac

SEQ ID NO: 584976 - DNA, 13 bp, D. melanogaster
atattttaaatgc

SEQ ID NO: 584977 - DNA, 13 bp, D. melanogaster
atattttaaatgg

SEQ ID NO: 584978 - DNA, 13 bp, D. melanogaster
atattttaaggat

SEQ ID NO: 584979 - DNA, 13 bp, D. melanogaster
atattttaatgca

SEQ ID NO: 584980 - DNA, 13 bp, D. melanogaster
atattttaatgcc

SEQ ID NO: 584981 - DNA, 13 bp, D. melanogaster
atattttaatggc

SEQ ID NO: 584982 - DNA, 13 bp, D. melanogaster
atattttacaagt

SEQ ID NO: 584983 - DNA, 13 bp, D. melanogaster
atattttaccata

SEQ ID NO: 584984 - DNA, 13 bp, D. melanogaster
atattttactaca

SEQ ID NO: 584985 - DNA, 13 bp, D. melanogaster
atattttagaaga

SEQ ID NO: 584986 - DNA, 13 bp, D. melanogaster
atattttagacaa

SEQ ID NO: 584987 - DNA, 14 bp, D. melanogaster
atattttagacaaa

SEQ ID NO: 584988 - DNA, 13 bp, D. melanogaster
atattttagcatt

SEQ ID NO: 584989 - DNA, 13 bp, D. melanogaster
atattttagccaa

SEQ ID NO: 584990 - DNA, 13 bp, D. melanogaster
atattttagccat

SEQ ID NO: 584991 - DNA, 13 bp, D. melanogaster
atattttataagc

SEQ ID NO: 584992 - DNA, 13 bp, D. melanogaster
atattttatcaca

SEQ ID NO: 584993 - DNA, 13 bp, D. melanogaster
atattttatgagc

SEQ ID NO: 584994 - DNA, 14 bp, D. melanogaster
atattttatgcaaa

SEQ ID NO: 584995 - DNA, 13 bp, D. melanogaster
atattttatgcac

SEQ ID NO: 584996 - DNA, 13 bp, D. melanogaster
atattttatgcat

SEQ ID NO: 584997 - DNA, 13 bp, D. melanogaster
atattttatggaa

SEQ ID NO: 584998 - DNA, 13 bp, D. melanogaster
atattttatggag

SEQ ID NO: 584999 - DNA, 13 bp, D. melanogaster
atattttatgtga

SEQ ID NO: 585000 - DNA, 13 bp, D. melanogaster
atattttatgtgc

SEQ ID NO: 585001 - DNA, 13 bp, D. melanogaster
atattttattagc

SEQ ID NO: 585002 - DNA, 13 bp, D. melanogaster
atattttattcca

SEQ ID NO: 585003 - DNA, 14 bp, D. melanogaster
atattttattgcat

SEQ ID NO: 585004 - DNA, 13 bp, D. melanogaster
atattttattgct

SEQ ID NO: 585005 - DNA, 13 bp, D. melanogaster
atattttcaaacg

SEQ ID NO: 585006 - DNA, 13 bp, D. melanogaster
atattttcaacca

SEQ ID NO: 585007 - DNA, 13 bp, D. melanogaster
atattttcaactg

SEQ ID NO: 585008 - DNA, 13 bp, D. melanogaster
atattttcaagaa

SEQ ID NO: 585009 - DNA, 13 bp, D. melanogaster
atattttcaagat

SEQ ID NO: 585010 - DNA, 13 bp, D. melanogaster
atattttcaagtg

SEQ ID NO: 585011 - DNA, 13 bp, D. melanogaster
atattttcacatt

SEQ ID NO: 585012 - DNA, 13 bp, D. melanogaster
atattttcagaaa

SEQ ID NO: 585013 - DNA, 13 bp, D. melanogaster
atattttcatatc

SEQ ID NO: 585014 - DNA, 13 bp, D. melanogaster
atattttcatcat

SEQ ID NO: 585015 - DNA, 13 bp, D. melanogaster
atattttcatttg

SEQ ID NO: 585016 - DNA, 14 bp, D. melanogaster
atattttccaaaat

SEQ ID NO: 585017 - DNA, 13 bp, D. melanogaster
atattttccaact

SEQ ID NO: 585018 - DNA, 13 bp, D. melanogaster
atattttccacat

SEQ ID NO: 585019 - DNA, 13 bp, D. melanogaster
atattttccactc

SEQ ID NO: 585020 - DNA, 13 bp, D. melanogaster
atattttccagca

SEQ ID NO: 585021 - DNA, 13 bp, D. melanogaster
atattttccagct

SEQ ID NO: 585022 - DNA, 13 bp, D. melanogaster
atattttccatat

SEQ ID NO: 585023 - DNA, 13 bp, D. melanogaster
atattttccttgg

SEQ ID NO: 585024 - DNA, 13 bp, D. melanogaster
atattttcgaaaa

SEQ ID NO: 585025 - DNA, 14 bp, D. melanogaster
atattttcgaaatt

SEQ ID NO: 585026 - DNA, 13 bp, D. melanogaster
atattttcgagtt

SEQ ID NO: 585027 - DNA, 13 bp, D. melanogaster
atattttcgatgc

SEQ ID NO: 585028 - DNA, 13 bp, D. melanogaster
atattttcgattt

SEQ ID NO: 585029 - DNA, 13 bp, D. melanogaster
atattttcgcatt

SEQ ID NO: 585030 - DNA, 13 bp, D. melanogaster
atattttcgctga

SEQ ID NO: 585031 - DNA, 13 bp, D. melanogaster
atattttctaaag

SEQ ID NO: 585032 - DNA, 13 bp, D. melanogaster
atattttctcaat

SEQ ID NO: 585033 - DNA, 13 bp, D. melanogaster
atattttctctgt

SEQ ID NO: 585034 - DNA, 13 bp, D. melanogaster
atattttctgcaa

SEQ ID NO: 585035 - DNA, 13 bp, D. melanogaster
atattttcttaag

SEQ ID NO: 585036 - DNA, 13 bp, D. melanogaster
atattttcttgat

SEQ ID NO: 585037 - DNA, 13 bp, D. melanogaster
atattttcttgca

SEQ ID NO: 585038 - DNA, 14 bp, D. melanogaster
atattttgaaaaca

SEQ ID NO: 585039 - DNA, 13 bp, D. melanogaster
atattttgaatgc

SEQ ID NO: 585040 - DNA, 13 bp, D. melanogaster
atattttgagtaa

SEQ ID NO: 585041 - DNA, 13 bp, D. melanogaster
atattttgatgaa

SEQ ID NO: 585042 - DNA, 13 bp, D. melanogaster
atattttgatggc

SEQ ID NO: 585043 - DNA, 13 bp, D. melanogaster
atattttgattag

SEQ ID NO: 585044 - DNA, 13 bp, D. melanogaster
atattttgcaaaa

SEQ ID NO: 585045 - DNA, 13 bp, D. melanogaster
atattttgcaaac

SEQ ID NO: 585046 - DNA, 14 bp, D. melanogaster
atattttgcaaagt

SEQ ID NO: 585047 - DNA, 13 bp, D. melanogaster
atattttgcactt

SEQ ID NO: 585048 - DNA, 14 bp, D. melanogaster
atattttgcataaa

SEQ ID NO: 585049 - DNA, 14 bp, D. melanogaster
atattttgcatatt

SEQ ID NO: 585050 - DNA, 13 bp, D. melanogaster
atattttgccatt

SEQ ID NO: 585051 - DNA, 13 bp, D. melanogaster
atattttgcgcga

SEQ ID NO: 585052 - DNA, 13 bp, D. melanogaster
atattttgctaaa

SEQ ID NO: 585053 - DNA, 13 bp, D. melanogaster
atattttggaaat

SEQ ID NO: 585054 - DNA, 13 bp, D. melanogaster
atattttggaatt

SEQ ID NO: 585055 - DNA, 13 bp, D. melanogaster
atattttggacca

SEQ ID NO: 585056 - DNA, 14 bp, D. melanogaster
atattttggagaat

SEQ ID NO: 585057 - DNA, 13 bp, D. melanogaster
atattttggcaag

SEQ ID NO: 585058 - DNA, 13 bp, D. melanogaster
atattttgggtcg

SEQ ID NO: 585059 - DNA, 13 bp, D. melanogaster
atattttgtaaac

SEQ ID NO: 585060 - DNA, 13 bp, D. melanogaster
atattttgtaaga

SEQ ID NO: 585061 - DNA, 13 bp, D. melanogaster
atattttgtacat

SEQ ID NO: 585062 - DNA, 14 bp, D. melanogaster
atattttgtatctt

SEQ ID NO: 585063 - DNA, 13 bp, D. melanogaster
atattttgtatgc

SEQ ID NO: 585064 - DNA, 14 bp, D. melanogaster
atattttgtcaaat

SEQ ID NO: 585065 - DNA, 13 bp, D. melanogaster
atattttgtcaca

SEQ ID NO: 585066 - DNA, 13 bp, D. melanogaster
atattttgtgaaa

SEQ ID NO: 585067 - DNA, 14 bp, D. melanogaster
atattttgtgaaat

SEQ ID NO: 585068 - DNA, 13 bp, D. melanogaster
atattttgtgttc

SEQ ID NO: 585069 - DNA, 14 bp, D. melanogaster
atattttgttacaa

SEQ ID NO: 585070 - DNA, 13 bp, D. melanogaster
atattttgttggc

SEQ ID NO: 585071 - DNA, 14 bp, D. melanogaster
atattttgtttaca

SEQ ID NO: 585072 - DNA, 13 bp, D. melanogaster
atattttgtttcc

SEQ ID NO: 585073 - DNA, 14 bp, D. melanogaster
atattttgtttgtc

SEQ ID NO: 585074 - DNA, 13 bp, D. melanogaster
atatttttaagag

SEQ ID NO: 585075 - DNA, 13 bp, D. melanogaster
atatttttaaggt

SEQ ID NO: 585076 - DNA, 13 bp, D. melanogaster
atatttttaagtc

SEQ ID NO: 585077 - DNA, 13 bp, D. melanogaster
atatttttacttg

SEQ ID NO: 585078 - DNA, 13 bp, D. melanogaster
atatttttagaag

SEQ ID NO: 585079 - DNA, 13 bp, D. melanogaster
atatttttagatg

SEQ ID NO: 585080 - DNA, 13 bp, D. melanogaster
atatttttagcca

SEQ ID NO: 585081 - DNA, 13 bp, D. melanogaster
atatttttagcta

SEQ ID NO: 585082 - DNA, 13 bp, D. melanogaster
atatttttagtgg

SEQ ID NO: 585083 - DNA, 13 bp, D. melanogaster
atatttttatggc

SEQ ID NO: 585084 - DNA, 14 bp, D. melanogaster
atatttttatggca

SEQ ID NO: 585085 - DNA, 14 bp, D. melanogaster
atatttttcaaaac

SEQ ID NO: 585086 - DNA, 14 bp, D. melanogaster
atatttttcaaaag

SEQ ID NO: 585087 - DNA, 13 bp, D. melanogaster
atatttttcagtg

SEQ ID NO: 585088 - DNA, 13 bp, D. melanogaster
atatttttcgaat

SEQ ID NO: 585089 - DNA, 13 bp, D. melanogaster
atatttttcgagc

SEQ ID NO: 585090 - DNA, 13 bp, D. melanogaster
atatttttcgcaa

SEQ ID NO: 585091 - DNA, 13 bp, D. melanogaster
atatttttcgtat

SEQ ID NO: 585092 - DNA, 13 bp, D. melanogaster
atatttttctctg

SEQ ID NO: 585093 - DNA, 13 bp, D. melanogaster
atatttttctgag

SEQ ID NO: 585094 - DNA, 13 bp, D. melanogaster
atatttttctgtg

SEQ ID NO: 585095 - DNA, 13 bp, D. melanogaster
atatttttcttgc

SEQ ID NO: 585096 - DNA, 13 bp, D. melanogaster
atatttttgaaac

SEQ ID NO: 585097 - DNA, 13 bp, D. melanogaster
atatttttgaaag

SEQ ID NO: 585098 - DNA, 13 bp, D. melanogaster
atatttttgaagt

SEQ ID NO: 585099 - DNA, 14 bp, D. melanogaster
atatttttgacatt

SEQ ID NO: 585100 - DNA, 13 bp, D. melanogaster
atatttttgacga

SEQ ID NO: 585101 - DNA, 13 bp, D. melanogaster
atatttttgagca

SEQ ID NO: 585102 - DNA, 13 bp, D. melanogaster
atatttttgatca

SEQ ID NO: 585103 - DNA, 13 bp, D. melanogaster
atatttttgcata

SEQ ID NO: 585104 - DNA, 13 bp, D. melanogaster
atatttttgcatt

SEQ ID NO: 585105 - DNA, 13 bp, D. melanogaster
atatttttgggaa

SEQ ID NO: 585106 - DNA, 13 bp, D. melanogaster
atatttttgggca

SEQ ID NO: 585107 - DNA, 13 bp, D. melanogaster
atatttttggtca

SEQ ID NO: 585108 - DNA, 13 bp, D. melanogaster
atatttttgtctg

SEQ ID NO: 585109 - DNA, 13 bp, D. melanogaster
atatttttgttca

SEQ ID NO: 585110 - DNA, 13 bp, D. melanogaster
atattttttaacg

SEQ ID NO: 585111 - DNA, 13 bp, D. melanogaster
atattttttactg

SEQ ID NO: 585112 - DNA, 13 bp, D. melanogaster
atattttttagca

SEQ ID NO: 585113 - DNA, 14 bp, D. melanogaster
atattttttccatg

SEQ ID NO: 585114 - DNA, 13 bp, D. melanogaster
atattttttgcaa

SEQ ID NO: 585115 - DNA, 13 bp, D. melanogaster
atattttttggca

SEQ ID NO: 585116 - DNA, 13 bp, D. melanogaster
atattttttggcg

SEQ ID NO: 585117 - DNA, 13 bp, D. melanogaster
atattttttgtac

SEQ ID NO: 585118 - DNA, 14 bp, D. melanogaster
atattttttgtcat

SEQ ID NO: 585119 - DNA, 13 bp, D. melanogaster
atattttttgtgc

SEQ ID NO: 585120 - DNA, 13 bp, D. melanogaster
atcaaaaaacttt

SEQ ID NO: 585121 - DNA, 13 bp, D. melanogaster
atcaaaaaatgta

SEQ ID NO: 585122 - DNA, 13 bp, D. melanogaster
atcaaaaacttca

SEQ ID NO: 585123 - DNA, 13 bp, D. melanogaster
atcaaaaatactt

SEQ ID NO: 585124 - DNA, 13 bp, D. melanogaster
atcaaaaatatct

SEQ ID NO: 585125 - DNA, 13 bp, D. melanogaster
atcaaaaatatgt

SEQ ID NO: 585126 - DNA, 13 bp, D. melanogaster
atcaaaaatgcga

SEQ ID NO: 585127 - DNA, 13 bp, D. melanogaster
atcaaaaatggct

SEQ ID NO: 585128 - DNA, 15 bp, D. melanogaster
atcaaaaatgtagcc

SEQ ID NO: 585129 - DNA, 13 bp, D. melanogaster
atcaaaaattcga

SEQ ID NO: 585130 - DNA, 14 bp, D. melanogaster
atcaaaaattgaaa

SEQ ID NO: 585131 - DNA, 14 bp, D. melanogaster
atcaaaaatttcgc

SEQ ID NO: 585132 - DNA, 14 bp, D. melanogaster
atcaaaacaaaagc

SEQ ID NO: 585133 - DNA, 13 bp, D. melanogaster
atcaaaacaaagc

SEQ ID NO: 585134 - DNA, 13 bp, D. melanogaster
atcaaaacacagc

SEQ ID NO: 585135 - DNA, 14 bp, D. melanogaster
atcaaaacataagc

SEQ ID NO: 585136 - DNA, 13 bp, D. melanogaster
atcaaaacattga

SEQ ID NO: 585137 - DNA, 14 bp, D. melanogaster
atcaaaacattgaa

SEQ ID NO: 585138 - DNA, 13 bp, D. melanogaster
atcaaaaccattt

SEQ ID NO: 585139 - DNA, 13 bp, D. melanogaster
atcaaaacgaaag

SEQ ID NO: 585140 - DNA, 13 bp, D. melanogaster
atcaaaacgaaat

SEQ ID NO: 585141 - DNA, 13 bp, D. melanogaster
atcaaaacgacaa

SEQ ID NO: 585142 - DNA, 13 bp, D. melanogaster
atcaaaactaaag

SEQ ID NO: 585143 - DNA, 13 bp, D. melanogaster
atcaaaactaatc

SEQ ID NO: 585144 - DNA, 13 bp, D. melanogaster
atcaaaactcaga

SEQ ID NO: 585145 - DNA, 13 bp, D. melanogaster
atcaaaagatttt

SEQ ID NO: 585146 - DNA, 14 bp, D. melanogaster
atcaaaagatttta

SEQ ID NO: 585147 - DNA, 13 bp, D. melanogaster
atcaaaagcaaag

SEQ ID NO: 585148 - DNA, 13 bp, D. melanogaster
atcaaaagcaatt

SEQ ID NO: 585149 - DNA, 13 bp, D. melanogaster
atcaaaagcataa

SEQ ID NO: 585150 - DNA, 14 bp, D. melanogaster
atcaaaagcatctc

SEQ ID NO: 585151 - DNA, 13 bp, D. melanogaster
atcaaaagcattt

SEQ ID NO: 585152 - DNA, 13 bp, D. melanogaster
atcaaaagcgaaa

SEQ ID NO: 585153 - DNA, 13 bp, D. melanogaster
atcaaaagctaaa

SEQ ID NO: 585154 - DNA, 14 bp, D. melanogaster
atcaaaagctaaac

SEQ ID NO: 585155 - DNA, 13 bp, D. melanogaster
atcaaaagctaac

SEQ ID NO: 585156 - DNA, 13 bp, D. melanogaster
atcaaaagctttt

SEQ ID NO: 585157 - DNA, 13 bp, D. melanogaster
atcaaaaggagta

SEQ ID NO: 585158 - DNA, 13 bp, D. melanogaster
atcaaaaggtttt

SEQ ID NO: 585159 - DNA, 13 bp, D. melanogaster
atcaaaagtacaa

SEQ ID NO: 585160 - DNA, 14 bp, D. melanogaster
atcaaaagtacaaa

SEQ ID NO: 585161 - DNA, 13 bp, D. melanogaster
atcaaaagtcaaa

SEQ ID NO: 585162 - DNA, 13 bp, D. melanogaster
atcaaaagtgatc

SEQ ID NO: 585163 - DNA, 13 bp, D. melanogaster
atcaaaagttaat

SEQ ID NO: 585164 - DNA, 13 bp, D. melanogaster
atcaaaataccga

SEQ ID NO: 585165 - DNA, 14 bp, D. melanogaster
atcaaaataccgaa

SEQ ID NO: 585166 - DNA, 13 bp, D. melanogaster
atcaaaatatttg

SEQ ID NO: 585167 - DNA, 14 bp, D. melanogaster
atcaaaatcaaatg

SEQ ID NO: 585168 - DNA, 13 bp, D. melanogaster
atcaaaatcagaa

SEQ ID NO: 585169 - DNA, 13 bp, D. melanogaster
atcaaaatcattt

SEQ ID NO: 585170 - DNA, 13 bp, D. melanogaster
atcaaaatcgaaa

SEQ ID NO: 585171 - DNA, 14 bp, D. melanogaster
atcaaaatcgaatt

SEQ ID NO: 585172 - DNA, 14 bp, D. melanogaster
atcaaaatgaaaat

SEQ ID NO: 585173 - DNA, 13 bp, D. melanogaster
atcaaaatgaaat

SEQ ID NO: 585174 - DNA, 13 bp, D. melanogaster
atcaaaatgataa

SEQ ID NO: 585175 - DNA, 13 bp, D. melanogaster
atcaaaatgcttt

SEQ ID NO: 585176 - DNA, 13 bp, D. melanogaster
atcaaaatgtaaa

SEQ ID NO: 585177 - DNA, 13 bp, D. melanogaster
atcaaaatgtatt

SEQ ID NO: 585178 - DNA, 13 bp, D. melanogaster
atcaaaatgtcaa

SEQ ID NO: 585179 - DNA, 13 bp, D. melanogaster
atcaaaattagtt

SEQ ID NO: 585180 - DNA, 13 bp, D. melanogaster
atcaaaattatca

SEQ ID NO: 585181 - DNA, 13 bp, D. melanogaster
atcaaaattcaag

SEQ ID NO: 585182 - DNA, 13 bp, D. melanogaster
atcaaaattgcaa

SEQ ID NO: 585183 - DNA, 13 bp, D. melanogaster
atcaaaattgttt

SEQ ID NO: 585184 - DNA, 13 bp, D. melanogaster
atcaaaatttcaa

SEQ ID NO: 585185 - DNA, 14 bp, D. melanogaster
atcaaaatttcagt

SEQ ID NO: 585186 - DNA, 13 bp, D. melanogaster
atcaaaatttgtc

SEQ ID NO: 585187 - DNA, 13 bp, D. melanogaster
atcaaaatttgtt

SEQ ID NO: 585188 - DNA, 13 bp, D. melanogaster
atcaaacaaaatg

SEQ ID NO: 585189 - DNA, 13 bp, D. melanogaster
atcaaacaattca

SEQ ID NO: 585190 - DNA, 13 bp, D. melanogaster
atcaaacaatttt

SEQ ID NO: 585191 - DNA, 13 bp, D. melanogaster
atcaaacattcaa

SEQ ID NO: 585192 - DNA, 13 bp, D. melanogaster
atcaaacgaaaat

SEQ ID NO: 585193 - DNA, 13 bp, D. melanogaster
atcaaactgattt

SEQ ID NO: 585194 - DNA, 13 bp, D. melanogaster
atcaaactttagg

SEQ ID NO: 585195 - DNA, 13 bp, D. melanogaster
atcaaagaaatgt

SEQ ID NO: 585196 - DNA, 13 bp, D. melanogaster
atcaaagagcaaa

SEQ ID NO: 585197 - DNA, 14 bp, D. melanogaster
atcaaagagcaaag

SEQ ID NO: 585198 - DNA, 13 bp, D. melanogaster
atcaaagagcaac

SEQ ID NO: 585199 - DNA, 14 bp, D. melanogaster
atcaaagagcaact

SEQ ID NO: 585200 - DNA, 13 bp, D. melanogaster
atcaaagagctaa

SEQ ID NO: 585201 - DNA, 13 bp, D. melanogaster
atcaaagatattt

SEQ ID NO: 585202 - DNA, 13 bp, D. melanogaster
atcaaagcaaatc

SEQ ID NO: 585203 - DNA, 13 bp, D. melanogaster
atcaaagcaactg

SEQ ID NO: 585204 - DNA, 13 bp, D. melanogaster
atcaaagcatttt

SEQ ID NO: 585205 - DNA, 13 bp, D. melanogaster
atcaaagccttaa

SEQ ID NO: 585206 - DNA, 13 bp, D. melanogaster
atcaaaggcaatt

SEQ ID NO: 585207 - DNA, 13 bp, D. melanogaster
atcaaagtcccaa

SEQ ID NO: 585208 - DNA, 13 bp, D. melanogaster
atcaaagtgcaaa

SEQ ID NO: 585209 - DNA, 13 bp, D. melanogaster
atcaaagtgtttt

SEQ ID NO: 585210 - DNA, 13 bp, D. melanogaster
atcaaagttgaaa

SEQ ID NO: 585211 - DNA, 13 bp, D. melanogaster
atcaaataaatct

SEQ ID NO: 585212 - DNA, 13 bp, D. melanogaster
atcaaataaattg

SEQ ID NO: 585213 - DNA, 13 bp, D. melanogaster
atcaaataacttt

SEQ ID NO: 585214 - DNA, 13 bp, D. melanogaster
atcaaatacattt

SEQ ID NO: 585215 - DNA, 13 bp, D. melanogaster
atcaaatagaaat

SEQ ID NO: 585216 - DNA, 13 bp, D. melanogaster
atcaaatagaatt

SEQ ID NO: 585217 - DNA, 15 bp, D. melanogaster
atcaaatataaagta

SEQ ID NO: 585218 - DNA, 13 bp, D. melanogaster
atcaaatatatca

SEQ ID NO: 585219 - DNA, 13 bp, D. melanogaster
atcaaatatgttt

SEQ ID NO: 585220 - DNA, 14 bp, D. melanogaster
atcaaatatttatg

SEQ ID NO: 585221 - DNA, 13 bp, D. melanogaster
atcaaatatttgc

SEQ ID NO: 585222 - DNA, 14 bp, D. melanogaster
atcaaatatttttg

SEQ ID NO: 585223 - DNA, 14 bp, D. melanogaster
atcaaatcaaaatc

SEQ ID NO: 585224 - DNA, 14 bp, D. melanogaster
atcaaatcaaatca

SEQ ID NO: 585225 - DNA, 13 bp, D. melanogaster
atcaaatcaaatt

SEQ ID NO: 585226 - DNA, 14 bp, D. melanogaster
atcaaatcaaattt

SEQ ID NO: 585227 - DNA, 13 bp, D. melanogaster
atcaaatcaattc

SEQ ID NO: 585228 - DNA, 13 bp, D. melanogaster
atcaaatcatcaa

SEQ ID NO: 585229 - DNA, 14 bp, D. melanogaster
atcaaatcattttt

SEQ ID NO: 585230 - DNA, 13 bp, D. melanogaster
atcaaatccattt

SEQ ID NO: 585231 - DNA, 13 bp, D. melanogaster
atcaaatcgaaat

SEQ ID NO: 585232 - DNA, 13 bp, D. melanogaster
atcaaatcgaatc

SEQ ID NO: 585233 - DNA, 13 bp, D. melanogaster
atcaaatcgaatt

SEQ ID NO: 585234 - DNA, 13 bp, D. melanogaster
atcaaatcgataa

SEQ ID NO: 585235 - DNA, 13 bp, D. melanogaster
atcaaatgaaagt

SEQ ID NO: 585236 - DNA, 13 bp, D. melanogaster
atcaaatgaattg

SEQ ID NO: 585237 - DNA, 13 bp, D. melanogaster
atcaaatgaattt

SEQ ID NO: 585238 - DNA, 13 bp, D. melanogaster
atcaaatgatttg

SEQ ID NO: 585239 - DNA, 13 bp, D. melanogaster
atcaaatgcattc

SEQ ID NO: 585240 - DNA, 13 bp, D. melanogaster
atcaaatgccaaa

SEQ ID NO: 585241 - DNA, 13 bp, D. melanogaster
atcaaatgcgaaa

SEQ ID NO: 585242 - DNA, 13 bp, D. melanogaster
atcaaatgcgaat

SEQ ID NO: 585243 - DNA, 13 bp, D. melanogaster
atcaaatgctgtt

SEQ ID NO: 585244 - DNA, 13 bp, D. melanogaster
atcaaatggaatt

SEQ ID NO: 585245 - DNA, 13 bp, D. melanogaster
atcaaatggatgt

SEQ ID NO: 585246 - DNA, 13 bp, D. melanogaster
atcaaatggcaat

SEQ ID NO: 585247 - DNA, 13 bp, D. melanogaster
atcaaatggcatt

SEQ ID NO: 585248 - DNA, 14 bp, D. melanogaster
atcaaatgttgcca

SEQ ID NO: 585249 - DNA, 13 bp, D. melanogaster
atcaaatgtttat

SEQ ID NO: 585250 - DNA, 13 bp, D. melanogaster
atcaaatgtttca

SEQ ID NO: 585251 - DNA, 13 bp, D. melanogaster
atcaaatgtttta

SEQ ID NO: 585252 - DNA, 13 bp, D. melanogaster
atcaaattaaact

SEQ ID NO: 585253 - DNA, 13 bp, D. melanogaster
atcaaattaaagt

SEQ ID NO: 585254 - DNA, 13 bp, D. melanogaster
atcaaattaagca

SEQ ID NO: 585255 - DNA, 13 bp, D. melanogaster
atcaaattaagtg

SEQ ID NO: 585256 - DNA, 13 bp, D. melanogaster
atcaaattaagtt

SEQ ID NO: 585257 - DNA, 13 bp, D. melanogaster
atcaaattatcaa

SEQ ID NO: 585258 - DNA, 13 bp, D. melanogaster
atcaaattatgca

SEQ ID NO: 585259 - DNA, 13 bp, D. melanogaster
atcaaattcaaat

SEQ ID NO: 585260 - DNA, 13 bp, D. melanogaster
atcaaattcaata

SEQ ID NO: 585261 - DNA, 13 bp, D. melanogaster
atcaaattcaatt

SEQ ID NO: 585262 - DNA, 14 bp, D. melanogaster
atcaaattctggca

SEQ ID NO: 585263 - DNA, 13 bp, D. melanogaster
atcaaattgaaat

SEQ ID NO: 585264 - DNA, 13 bp, D. melanogaster
atcaaattgaatg

SEQ ID NO: 585265 - DNA, 13 bp, D. melanogaster
atcaaattgaatt

SEQ ID NO: 585266 - DNA, 14 bp, D. melanogaster
atcaaattgcattt

SEQ ID NO: 585267 - DNA, 13 bp, D. melanogaster
atcaaattggaat

SEQ ID NO: 585268 - DNA, 13 bp, D. melanogaster
atcaaattgttgc

SEQ ID NO: 585269 - DNA, 13 bp, D. melanogaster
atcaaatttaatg

SEQ ID NO: 585270 - DNA, 13 bp, D. melanogaster
atcaaatttatga

SEQ ID NO: 585271 - DNA, 13 bp, D. melanogaster
atcaaatttcaaa

SEQ ID NO: 585272 - DNA, 14 bp, D. melanogaster
atcaaatttgattt

SEQ ID NO: 585273 - DNA, 13 bp, D. melanogaster
atcaaatttgcaa

SEQ ID NO: 585274 - DNA, 13 bp, D. melanogaster
atcaaatttgctt

SEQ ID NO: 585275 - DNA, 13 bp, D. melanogaster
atcaaatttgtat

SEQ ID NO: 585276 - DNA, 13 bp, D. melanogaster
atcaaattttcaa

SEQ ID NO: 585277 - DNA, 13 bp, D. melanogaster
atcaacaaaatgc

SEQ ID NO: 585278 - DNA, 14 bp, D. melanogaster
atcaacaaagatca

SEQ ID NO: 585279 - DNA, 13 bp, D. melanogaster
atcaacaaattat

SEQ ID NO: 585280 - DNA, 14 bp, D. melanogaster
atcaacaacaacag

SEQ ID NO: 585281 - DNA, 13 bp, D. melanogaster
atcaacaacaact

SEQ ID NO: 585282 - DNA, 13 bp, D. melanogaster
atcaacaacaaga

SEQ ID NO: 585283 - DNA, 13 bp, D. melanogaster
atcaacaacattt

SEQ ID NO: 585284 - DNA, 13 bp, D. melanogaster
atcaacaaccact

SEQ ID NO: 585285 - DNA, 13 bp, D. melanogaster
atcaacaacttcg

SEQ ID NO: 585286 - DNA, 14 bp, D. melanogaster
atcaacaacttcgt

SEQ ID NO: 585287 - DNA, 13 bp, D. melanogaster
atcaacaactttt

SEQ ID NO: 585288 - DNA, 13 bp, D. melanogaster
atcaacaagtgct

SEQ ID NO: 585289 - DNA, 13 bp, D. melanogaster
atcaacaatttat

SEQ ID NO: 585290 - DNA, 13 bp, D. melanogaster
atcaacaattttc

SEQ ID NO: 585291 - DNA, 14 bp, D. melanogaster
atcaacacatttat

SEQ ID NO: 585292 - DNA, 13 bp, D. melanogaster
atcaacagagacg

SEQ ID NO: 585293 - DNA, 13 bp, D. melanogaster
atcaacataaatt

SEQ ID NO: 585294 - DNA, 13 bp, D. melanogaster
atcaacataatca

SEQ ID NO: 585295 - DNA, 13 bp, D. melanogaster
atcaacatatttt

SEQ ID NO: 585296 - DNA, 13 bp, D. melanogaster
atcaacatcaaca

SEQ ID NO: 585297 - DNA, 13 bp, D. melanogaster
atcaacatcaact

SEQ ID NO: 585298 - DNA, 13 bp, D. melanogaster
atcaacatcagca

SEQ ID NO: 585299 - DNA, 13 bp, D. melanogaster
atcaacatcaggc

SEQ ID NO: 585300 - DNA, 14 bp, D. melanogaster
atcaacatcatcat

SEQ ID NO: 585301 - DNA, 13 bp, D. melanogaster
atcaacattattt

SEQ ID NO: 585302 - DNA, 13 bp, D. melanogaster
atcaacattcagc

SEQ ID NO: 585303 - DNA, 13 bp, D. melanogaster
atcaacattttat

SEQ ID NO: 585304 - DNA, 13 bp, D. melanogaster
atcaacattttgt

SEQ ID NO: 585305 - DNA, 13 bp, D. melanogaster
atcaacccactgc

SEQ ID NO: 585306 - DNA, 13 bp, D. melanogaster
atcaaccgaaaaa

SEQ ID NO: 585307 - DNA, 13 bp, D. melanogaster
atcaacgccaacg

SEQ ID NO: 585308 - DNA, 14 bp, D. melanogaster
atcaacgttttcaa

SEQ ID NO: 585309 - DNA, 14 bp, D. melanogaster
atcaactactttaa

SEQ ID NO: 585310 - DNA, 13 bp, D. melanogaster
atcaactctctga

SEQ ID NO: 585311 - DNA, 13 bp, D. melanogaster
atcaactggctga

SEQ ID NO: 585312 - DNA, 13 bp, D. melanogaster
atcaacttattta

SEQ ID NO: 585313 - DNA, 13 bp, D. melanogaster
atcaacttcaatt

SEQ ID NO: 585314 - DNA, 13 bp, D. melanogaster
atcaacttcagcg

SEQ ID NO: 585315 - DNA, 13 bp, D. melanogaster
atcaactttaaat

SEQ ID NO: 585316 - DNA, 13 bp, D. melanogaster
atcaacttttaaa

SEQ ID NO: 585317 - DNA, 13 bp, D. melanogaster
atcaactttttgg

SEQ ID NO: 585318 - DNA, 14 bp, D. melanogaster
atcaactttttggc

SEQ ID NO: 585319 - DNA, 13 bp, D. melanogaster
atcaagaaaggca

SEQ ID NO: 585320 - DNA, 13 bp, D. melanogaster
atcaagaaataca

SEQ ID NO: 585321 - DNA, 14 bp, D. melanogaster
atcaagaaatacaa

SEQ ID NO: 585322 - DNA, 13 bp, D. melanogaster
atcaagaaatatt

SEQ ID NO: 585323 - DNA, 14 bp, D. melanogaster
atcaagaaattaaa

SEQ ID NO: 585324 - DNA, 13 bp, D. melanogaster
atcaagaacatat

SEQ ID NO: 585325 - DNA, 13 bp, D. melanogaster
atcaagaataacc

SEQ ID NO: 585326 - DNA, 13 bp, D. melanogaster
atcaagaatatac

SEQ ID NO: 585327 - DNA, 13 bp, D. melanogaster
atcaagaatatat

SEQ ID NO: 585328 - DNA, 13 bp, D. melanogaster
atcaagaatatgt

SEQ ID NO: 585329 - DNA, 13 bp, D. melanogaster
atcaagaattaaa

SEQ ID NO: 585330 - DNA, 14 bp, D. melanogaster
atcaagaattccat

SEQ ID NO: 585331 - DNA, 13 bp, D. melanogaster
atcaagacaaaga

SEQ ID NO: 585332 - DNA, 14 bp, D. melanogaster
atcaagagttattt

SEQ ID NO: 585333 - DNA, 13 bp, D. melanogaster
atcaagatatata

SEQ ID NO: 585334 - DNA, 13 bp, D. melanogaster
atcaagcaaattg

SEQ ID NO: 585335 - DNA, 14 bp, D. melanogaster
atcaagcatacgcc

SEQ ID NO: 585336 - DNA, 13 bp, D. melanogaster
atcaagccaaaaa

SEQ ID NO: 585337 - DNA, 13 bp, D. melanogaster
atcaagctgcaaa

SEQ ID NO: 585338 - DNA, 13 bp, D. melanogaster
atcaagctgttgc

SEQ ID NO: 585339 - DNA, 13 bp, D. melanogaster
atcaaggacaaac

SEQ ID NO: 585340 - DNA, 13 bp, D. melanogaster
atcaaggctctca

SEQ ID NO: 585341 - DNA, 13 bp, D. melanogaster
atcaagggcttaa

SEQ ID NO: 585342 - DNA, 13 bp, D. melanogaster
atcaagtaataaa

SEQ ID NO: 585343 - DNA, 13 bp, D. melanogaster
atcaagtatacgc

SEQ ID NO: 585344 - DNA, 14 bp, D. melanogaster
atcaagtatacgca

SEQ ID NO: 585345 - DNA, 14 bp, D. melanogaster
atcaagtatacgcc

SEQ ID NO: 585346 - DNA, 13 bp, D. melanogaster
atcaagtatatat

SEQ ID NO: 585347 - DNA, 13 bp, D. melanogaster
atcaagtgaaaaa

SEQ ID NO: 585348 - DNA, 13 bp, D. melanogaster
atcaagtgaaatg

SEQ ID NO: 585349 - DNA, 13 bp, D. melanogaster
atcaagtggaaaa

SEQ ID NO: 585350 - DNA, 13 bp, D. melanogaster
atcaagtttacaa

SEQ ID NO: 585351 - DNA, 13 bp, D. melanogaster
atcaagtttatta

SEQ ID NO: 585352 - DNA, 13 bp, D. melanogaster
atcaataatcaat

SEQ ID NO: 585353 - DNA, 13 bp, D. melanogaster
atcaatacaatgc

SEQ ID NO: 585354 - DNA, 13 bp, D. melanogaster
atcaatacattca

SEQ ID NO: 585355 - DNA, 13 bp, D. melanogaster
atcaatagaaaat

SEQ ID NO: 585356 - DNA, 13 bp, D. melanogaster
atcaatagaagaa

SEQ ID NO: 585357 - DNA, 13 bp, D. melanogaster
atcaatagattta

SEQ ID NO: 585358 - DNA, 13 bp, D. melanogaster
atcaatataaatc

SEQ ID NO: 585359 - DNA, 13 bp, D. melanogaster
atcaatatatgta

SEQ ID NO: 585360 - DNA, 13 bp, D. melanogaster
atcaatatcaata

SEQ ID NO: 585361 - DNA, 14 bp, D. melanogaster
atcaatatcaatat

SEQ ID NO: 585362 - DNA, 13 bp, D. melanogaster
atcaatatcaatt

SEQ ID NO: 585363 - DNA, 13 bp, D. melanogaster
atcaatatcattt

SEQ ID NO: 585364 - DNA, 13 bp, D. melanogaster
atcaatatgttta

SEQ ID NO: 585365 - DNA, 13 bp, D. melanogaster
atcaatatttgcc

SEQ ID NO: 585366 - DNA, 13 bp, D. melanogaster
atcaatattttca

SEQ ID NO: 585367 - DNA, 13 bp, D. melanogaster
atcaatattttct

SEQ ID NO: 585368 - DNA, 13 bp, D. melanogaster
atcaatatttttc

SEQ ID NO: 585369 - DNA, 13 bp, D. melanogaster
atcaatcaaaatc

SEQ ID NO: 585370 - DNA, 13 bp, D. melanogaster
atcaatcaaaatg

SEQ ID NO: 585371 - DNA, 13 bp, D. melanogaster
atcaatcaaactt

SEQ ID NO: 585372 - DNA, 13 bp, D. melanogaster
atcaatcaaagtg

SEQ ID NO: 585373 - DNA, 14 bp, D. melanogaster
atcaatcaaatcaa

SEQ ID NO: 585374 - DNA, 13 bp, D. melanogaster
atcaatcaaattg

SEQ ID NO: 585375 - DNA, 13 bp, D. melanogaster
atcaatcaacaac

SEQ ID NO: 585376 - DNA, 14 bp, D. melanogaster
atcaatcaatcaaa

SEQ ID NO: 585377 - DNA, 13 bp, D. melanogaster
atcaatcaatcag

SEQ ID NO: 585378 - DNA, 14 bp, D. melanogaster
atcaatcaatcagt

SEQ ID NO: 585379 - DNA, 14 bp, D. melanogaster
atcaatcaatcatt

SEQ ID NO: 585380 - DNA, 13 bp, D. melanogaster
atcaatcaatcga

SEQ ID NO: 585381 - DNA, 13 bp, D. melanogaster
atcaatcaattag

SEQ ID NO: 585382 - DNA, 13 bp, D. melanogaster
atcaatcaattca

SEQ ID NO: 585383 - DNA, 13 bp, D. melanogaster
atcaatcaattgc

SEQ ID NO: 585384 - DNA, 13 bp, D. melanogaster
atcaatcagccaa

SEQ ID NO: 585385 - DNA, 13 bp, D. melanogaster
atcaatcagtcaa

SEQ ID NO: 585386 - DNA, 14 bp, D. melanogaster
atcaatcagtcaat

SEQ ID NO: 585387 - DNA, 13 bp, D. melanogaster
atcaatcatacgc

SEQ ID NO: 585388 - DNA, 14 bp, D. melanogaster
atcaatcatacgcc

SEQ ID NO: 585389 - DNA, 13 bp, D. melanogaster
atcaatcatatca

SEQ ID NO: 585390 - DNA, 13 bp, D. melanogaster
atcaatcatattt

SEQ ID NO: 585391 - DNA, 13 bp, D. melanogaster
atcaatcattttg

SEQ ID NO: 585392 - DNA, 13 bp, D. melanogaster
atcaatcccagcc

SEQ ID NO: 585393 - DNA, 14 bp, D. melanogaster
atcaatcgatttcc

SEQ ID NO: 585394 - DNA, 13 bp, D. melanogaster
atcaatgaaataa

SEQ ID NO: 585395 - DNA, 14 bp, D. melanogaster
atcaatgaagaaat

SEQ ID NO: 585396 - DNA, 13 bp, D. melanogaster
atcaatgattttg

SEQ ID NO: 585397 - DNA, 13 bp, D. melanogaster
atcaatgcaaaaa

SEQ ID NO: 585398 - DNA, 13 bp, D. melanogaster
atcaatgcaaatt

SEQ ID NO: 585399 - DNA, 13 bp, D. melanogaster
atcaatgccaaac

SEQ ID NO: 585400 - DNA, 13 bp, D. melanogaster
atcaatggagcaa

SEQ ID NO: 585401 - DNA, 13 bp, D. melanogaster
atcaatggcaaat

SEQ ID NO: 585402 - DNA, 13 bp, D. melanogaster
atcaatgggttaa

SEQ ID NO: 585403 - DNA, 13 bp, D. melanogaster
atcaatgtccacc

SEQ ID NO: 585404 - DNA, 13 bp, D. melanogaster
atcaattaacatt

SEQ ID NO: 585405 - DNA, 13 bp, D. melanogaster
atcaattaattag

SEQ ID NO: 585406 - DNA, 13 bp, D. melanogaster
atcaattaatttg

SEQ ID NO: 585407 - DNA, 13 bp, D. melanogaster
atcaattatcaat

SEQ ID NO: 585408 - DNA, 13 bp, D. melanogaster
atcaattatttca

SEQ ID NO: 585409 - DNA, 13 bp, D. melanogaster
atcaattcctcaa

SEQ ID NO: 585410 - DNA, 13 bp, D. melanogaster
atcaattctttca

SEQ ID NO: 585411 - DNA, 13 bp, D. melanogaster
atcaattgaaaag

SEQ ID NO: 585412 - DNA, 13 bp, D. melanogaster
atcaattgaaaat

SEQ ID NO: 585413 - DNA, 13 bp, D. melanogaster
atcaattgaaatt

SEQ ID NO: 585414 - DNA, 13 bp, D. melanogaster
atcaattgcaaat

SEQ ID NO: 585415 - DNA, 14 bp, D. melanogaster
atcaattgcaagct

SEQ ID NO: 585416 - DNA, 13 bp, D. melanogaster
atcaattggaaat

SEQ ID NO: 585417 - DNA, 13 bp, D. melanogaster
atcaattggcaaa

SEQ ID NO: 585418 - DNA, 13 bp, D. melanogaster
atcaatttaaaga

SEQ ID NO: 585419 - DNA, 13 bp, D. melanogaster
atcaatttaactg

SEQ ID NO: 585420 - DNA, 13 bp, D. melanogaster
atcaatttacaat

SEQ ID NO: 585421 - DNA, 13 bp, D. melanogaster
atcaatttatttc

SEQ ID NO: 585422 - DNA, 13 bp, D. melanogaster
atcaatttcaata

SEQ ID NO: 585423 - DNA, 13 bp, D. melanogaster
atcaatttcaatt

SEQ ID NO: 585424 - DNA, 13 bp, D. melanogaster
atcaatttcacta

SEQ ID NO: 585425 - DNA, 13 bp, D. melanogaster
atcaatttcatat

SEQ ID NO: 585426 - DNA, 14 bp, D. melanogaster
atcaatttcatatc

SEQ ID NO: 585427 - DNA, 13 bp, D. melanogaster
atcaatttccatt

SEQ ID NO: 585428 - DNA, 13 bp, D. melanogaster
atcaatttcgaat

SEQ ID NO: 585429 - DNA, 13 bp, D. melanogaster
atcaatttctgtt

SEQ ID NO: 585430 - DNA, 13 bp, D. melanogaster
atcaatttgaatg

SEQ ID NO: 585431 - DNA, 14 bp, D. melanogaster
atcaatttgcaaaa

SEQ ID NO: 585432 - DNA, 13 bp, D. melanogaster
atcaatttgcaat

SEQ ID NO: 585433 - DNA, 13 bp, D. melanogaster
atcaatttgccat

SEQ ID NO: 585434 - DNA, 13 bp, D. melanogaster
atcaatttggaaa

SEQ ID NO: 585435 - DNA, 13 bp, D. melanogaster
atcaatttggcaa

SEQ ID NO: 585436 - DNA, 13 bp, D. melanogaster
atcaatttggcca

SEQ ID NO: 585437 - DNA, 14 bp, D. melanogaster
atcaatttggcttt

SEQ ID NO: 585438 - DNA, 13 bp, D. melanogaster
atcaatttgtaaa

SEQ ID NO: 585439 - DNA, 13 bp, D. melanogaster
atcaatttgttaa

SEQ ID NO: 585440 - DNA, 13 bp, D. melanogaster
atcaattttaatg

SEQ ID NO: 585441 - DNA, 13 bp, D. melanogaster
atcaattttcaaa

SEQ ID NO: 585442 - DNA, 13 bp, D. melanogaster
atcaattttcaat

SEQ ID NO: 585443 - DNA, 13 bp, D. melanogaster
atcaatttttcat

SEQ ID NO: 585444 - DNA, 13 bp, D. melanogaster
atcaattttttgc

SEQ ID NO: 585445 - DNA, 13 bp, D. melanogaster
atcacaaaatgtt

SEQ ID NO: 585446 - DNA, 13 bp, D. melanogaster
atcacaaacattt

SEQ ID NO: 585447 - DNA, 13 bp, D. melanogaster
atcacaaaggact

SEQ ID NO: 585448 - DNA, 13 bp, D. melanogaster
atcacaaggtctt

SEQ ID NO: 585449 - DNA, 13 bp, D. melanogaster
atcacaatcacaa

SEQ ID NO: 585450 - DNA, 13 bp, D. melanogaster
atcacaatggtca

SEQ ID NO: 585451 - DNA, 13 bp, D. melanogaster
atcacaattaaag

SEQ ID NO: 585452 - DNA, 13 bp, D. melanogaster
atcacaattttct

SEQ ID NO: 585453 - DNA, 13 bp, D. melanogaster
atcacaattttta

SEQ ID NO: 585454 - DNA, 13 bp, D. melanogaster
atcacacatacgc

SEQ ID NO: 585455 - DNA, 14 bp, D. melanogaster
atcacacatacgcc

SEQ ID NO: 585456 - DNA, 13 bp, D. melanogaster
atcacagtcaaaa

SEQ ID NO: 585457 - DNA, 13 bp, D. melanogaster
atcacatatttat

SEQ ID NO: 585458 - DNA, 14 bp, D. melanogaster
atcacatcacatca

SEQ ID NO: 585459 - DNA, 13 bp, D. melanogaster
atcacatcgtggt

SEQ ID NO: 585460 - DNA, 13 bp, D. melanogaster
atcacatttaatt

SEQ ID NO: 585461 - DNA, 13 bp, D. melanogaster
atcacatttattt

SEQ ID NO: 585462 - DNA, 13 bp, D. melanogaster
atcacatttccaa

SEQ ID NO: 585463 - DNA, 13 bp, D. melanogaster
atcaccaaagaaa

SEQ ID NO: 585464 - DNA, 13 bp, D. melanogaster
atcaccaacatca

SEQ ID NO: 585465 - DNA, 13 bp, D. melanogaster
atcaccaccatca

SEQ ID NO: 585466 - DNA, 14 bp, D. melanogaster
atcaccatcagcat

SEQ ID NO: 585467 - DNA, 13 bp, D. melanogaster
atcaccatcatcg

SEQ ID NO: 585468 - DNA, 13 bp, D. melanogaster
atcaccatcgcca

SEQ ID NO: 585469 - DNA, 13 bp, D. melanogaster
atcaccatctcca

SEQ ID NO: 585470 - DNA, 13 bp, D. melanogaster
atcaccattaagt

SEQ ID NO: 585471 - DNA, 15 bp, D. melanogaster
atcacccaagccgaa

SEQ ID NO: 585472 - DNA, 14 bp, D. melanogaster
atcacccactcgaa

SEQ ID NO: 585473 - DNA, 13 bp, D. melanogaster
atcacccagctgc

SEQ ID NO: 585474 - DNA, 13 bp, D. melanogaster
atcacccatttat

SEQ ID NO: 585475 - DNA, 13 bp, D. melanogaster
atcacctgaatga

SEQ ID NO: 585476 - DNA, 13 bp, D. melanogaster
atcacctgtttgg

SEQ ID NO: 585477 - DNA, 13 bp, D. melanogaster
atcacgcatacgc

SEQ ID NO: 585478 - DNA, 14 bp, D. melanogaster
atcacgcatacgca

SEQ ID NO: 585479 - DNA, 13 bp, D. melanogaster
atcacggacaaac

SEQ ID NO: 585480 - DNA, 13 bp, D. melanogaster
atcacgtatacgc

SEQ ID NO: 585481 - DNA, 14 bp, D. melanogaster
atcacgtatacgcc

SEQ ID NO: 585482 - DNA, 13 bp, D. melanogaster
atcacgttcattt

SEQ ID NO: 585483 - DNA, 13 bp, D. melanogaster
atcactaaatgaa

SEQ ID NO: 585484 - DNA, 13 bp, D. melanogaster
atcactaagtgaa

SEQ ID NO: 585485 - DNA, 13 bp, D. melanogaster
atcactattatta

SEQ ID NO: 585486 - DNA, 13 bp, D. melanogaster
atcactcatacgc

SEQ ID NO: 585487 - DNA, 14 bp, D. melanogaster
atcactcatacgca

SEQ ID NO: 585488 - DNA, 14 bp, D. melanogaster
atcactcatacgcc

SEQ ID NO: 585489 - DNA, 13 bp, D. melanogaster
atcactgaaaaaa

SEQ ID NO: 585490 - DNA, 13 bp, D. melanogaster
atcactggagcgc

SEQ ID NO: 585491 - DNA, 13 bp, D. melanogaster
atcacttaaaaac

SEQ ID NO: 585492 - DNA, 13 bp, D. melanogaster
atcacttacactt

SEQ ID NO: 585493 - DNA, 13 bp, D. melanogaster
atcacttaccaaa

SEQ ID NO: 585494 - DNA, 13 bp, D. melanogaster
atcacttatttat

SEQ ID NO: 585495 - DNA, 13 bp, D. melanogaster
atcacttgaaaaa

SEQ ID NO: 585496 - DNA, 13 bp, D. melanogaster
atcactttaaaac

SEQ ID NO: 585497 - DNA, 13 bp, D. melanogaster
atcactttttaaa

SEQ ID NO: 585498 - DNA, 13 bp, D. melanogaster
atcagaaaaaagg

SEQ ID NO: 585499 - DNA, 14 bp, D. melanogaster
atcagaaaaaagga

SEQ ID NO: 585500 - DNA, 14 bp, D. melanogaster
atcagaaaacggaa

SEQ ID NO: 585501 - DNA, 13 bp, D. melanogaster
atcagaaaactag

SEQ ID NO: 585502 - DNA, 13 bp, D. melanogaster
atcagaaaattaa

SEQ ID NO: 585503 - DNA, 13 bp, D. melanogaster
atcagaaatcaga

SEQ ID NO: 585504 - DNA, 13 bp, D. melanogaster
atcagaaattaaa

SEQ ID NO: 585505 - DNA, 13 bp, D. melanogaster
atcagaaggaggc

SEQ ID NO: 585506 - DNA, 13 bp, D. melanogaster
atcagaagtattg

SEQ ID NO: 585507 - DNA, 13 bp, D. melanogaster
atcagaatcagaa

SEQ ID NO: 585508 - DNA, 13 bp, D. melanogaster
atcagaatccaca

SEQ ID NO: 585509 - DNA, 13 bp, D. melanogaster
atcagaatgaaaa

SEQ ID NO: 585510 - DNA, 14 bp, D. melanogaster
atcagaatgaaaac

SEQ ID NO: 585511 - DNA, 13 bp, D. melanogaster
atcagaattgatt

SEQ ID NO: 585512 - DNA, 14 bp, D. melanogaster
atcagaattttacg

SEQ ID NO: 585513 - DNA, 13 bp, D. melanogaster
atcagacaaattt

SEQ ID NO: 585514 - DNA, 13 bp, D. melanogaster
atcagacaccatc

SEQ ID NO: 585515 - DNA, 13 bp, D. melanogaster
atcagagaaattt

SEQ ID NO: 585516 - DNA, 13 bp, D. melanogaster
atcagagattttg

SEQ ID NO: 585517 - DNA, 13 bp, D. melanogaster
atcagagcatttg

SEQ ID NO: 585518 - DNA, 13 bp, D. melanogaster
atcagataaaaga

SEQ ID NO: 585519 - DNA, 14 bp, D. melanogaster
atcagataaaagat

SEQ ID NO: 585520 - DNA, 13 bp, D. melanogaster
atcagataattgg

SEQ ID NO: 585521 - DNA, 13 bp, D. melanogaster
atcagataccctt

SEQ ID NO: 585522 - DNA, 13 bp, D. melanogaster
atcagatagaaat

SEQ ID NO: 585523 - DNA, 13 bp, D. melanogaster
atcagatataaat

SEQ ID NO: 585524 - DNA, 13 bp, D. melanogaster
atcagatatccgt

SEQ ID NO: 585525 - DNA, 13 bp, D. melanogaster
atcagatcactca

SEQ ID NO: 585526 - DNA, 13 bp, D. melanogaster
atcagcaaaaaat

SEQ ID NO: 585527 - DNA, 13 bp, D. melanogaster
atcagcaaaaatt

SEQ ID NO: 585528 - DNA, 13 bp, D. melanogaster
atcagcaaaataa

SEQ ID NO: 585529 - DNA, 13 bp, D. melanogaster
atcagcaaaattt

SEQ ID NO: 585530 - DNA, 13 bp, D. melanogaster
atcagcaaataaa

SEQ ID NO: 585531 - DNA, 14 bp, D. melanogaster
atcagcaacaacaa

SEQ ID NO: 585532 - DNA, 14 bp, D. melanogaster
atcagcaacagcag

SEQ ID NO: 585533 - DNA, 13 bp, D. melanogaster
atcagcaacatca

SEQ ID NO: 585534 - DNA, 13 bp, D. melanogaster
atcagcaactagc

SEQ ID NO: 585535 - DNA, 13 bp, D. melanogaster
atcagcaatcaaa

SEQ ID NO: 585536 - DNA, 15 bp, D. melanogaster
atcagcaatgaccaa

SEQ ID NO: 585537 - DNA, 13 bp, D. melanogaster
atcagcaattaca

SEQ ID NO: 585538 - DNA, 13 bp, D. melanogaster
atcagcagaaaaa

SEQ ID NO: 585539 - DNA, 13 bp, D. melanogaster
atcagcagaactt

SEQ ID NO: 585540 - DNA, 13 bp, D. melanogaster
atcagcagagtgg

SEQ ID NO: 585541 - DNA, 13 bp, D. melanogaster
atcagcagcaaaa

SEQ ID NO: 585542 - DNA, 14 bp, D. melanogaster
atcagcagcaacaa

SEQ ID NO: 585543 - DNA, 13 bp, D. melanogaster
atcagcagcagaa

SEQ ID NO: 585544 - DNA, 14 bp, D. melanogaster
atcagcagcagaag

SEQ ID NO: 585545 - DNA, 13 bp, D. melanogaster
atcagcagcagcg

SEQ ID NO: 585546 - DNA, 13 bp, D. melanogaster
atcagcagcagga

SEQ ID NO: 585547 - DNA, 13 bp, D. melanogaster
atcagcagcatca

SEQ ID NO: 585548 - DNA, 13 bp, D. melanogaster
atcagcagcatct

SEQ ID NO: 585549 - DNA, 15 bp, D. melanogaster
atcagcagcatctgg

SEQ ID NO: 585550 - DNA, 13 bp, D. melanogaster
atcagcaggaaaa

SEQ ID NO: 585551 - DNA, 13 bp, D. melanogaster
atcagcaggcatt

SEQ ID NO: 585552 - DNA, 13 bp, D. melanogaster
atcagcataaaaa

SEQ ID NO: 585553 - DNA, 13 bp, D. melanogaster
atcagcatcagca

SEQ ID NO: 585554 - DNA, 14 bp, D. melanogaster
atcagcatcagcag

SEQ ID NO: 585555 - DNA, 14 bp, D. melanogaster
atcagcatcatcat

SEQ ID NO: 585556 - DNA, 13 bp, D. melanogaster
atcagcatcatcg

SEQ ID NO: 585557 - DNA, 13 bp, D. melanogaster
atcagccaaatca

SEQ ID NO: 585558 - DNA, 13 bp, D. melanogaster
atcagccatcagc

SEQ ID NO: 585559 - DNA, 13 bp, D. melanogaster
atcagcgccgata

SEQ ID NO: 585560 - DNA, 13 bp, D. melanogaster
atcagcgtttgat

SEQ ID NO: 585561 - DNA, 14 bp, D. melanogaster
atcagcgtttgatt

SEQ ID NO: 585562 - DNA, 13 bp, D. melanogaster
atcagctatcagc

SEQ ID NO: 585563 - DNA, 13 bp, D. melanogaster
atcagctcataaa

SEQ ID NO: 585564 - DNA, 14 bp, D. melanogaster
atcagctccagtca

SEQ ID NO: 585565 - DNA, 13 bp, D. melanogaster
atcagctgtttgt

SEQ ID NO: 585566 - DNA, 13 bp, D. melanogaster
atcagctgttttt

SEQ ID NO: 585567 - DNA, 13 bp, D. melanogaster
atcagcttaaaaa

SEQ ID NO: 585568 - DNA, 14 bp, D. melanogaster
atcagcttaaaaaa

SEQ ID NO: 585569 - DNA, 13 bp, D. melanogaster
atcaggaatagat

SEQ ID NO: 585570 - DNA, 13 bp, D. melanogaster
atcaggagcagca

SEQ ID NO: 585571 - DNA, 13 bp, D. melanogaster
atcaggatcaata

SEQ ID NO: 585572 - DNA, 14 bp, D. melanogaster
atcaggatcaatag

SEQ ID NO: 585573 - DNA, 14 bp, D. melanogaster
atcaggcaatagcc

SEQ ID NO: 585574 - DNA, 13 bp, D. melanogaster
atcaggggagctg

SEQ ID NO: 585575 - DNA, 13 bp, D. melanogaster
atcaggtctggca

SEQ ID NO: 585576 - DNA, 13 bp, D. melanogaster
atcaggttatcta

SEQ ID NO: 585577 - DNA, 13 bp, D. melanogaster
atcagtatcagta

SEQ ID NO: 585578 - DNA, 14 bp, D. melanogaster
atcagtatgaagtt

SEQ ID NO: 585579 - DNA, 13 bp, D. melanogaster
atcagtcaatcaa

SEQ ID NO: 585580 - DNA, 13 bp, D. melanogaster
atcagtgtatgta

SEQ ID NO: 585581 - DNA, 13 bp, D. melanogaster
atcagttataaat

SEQ ID NO: 585582 - DNA, 13 bp, D. melanogaster
atcagttatcagt

SEQ ID NO: 585583 - DNA, 13 bp, D. melanogaster
atcagttcctttt

SEQ ID NO: 585584 - DNA, 13 bp, D. melanogaster
atcagttgcattg

SEQ ID NO: 585585 - DNA, 13 bp, D. melanogaster
atcagttggcatt

SEQ ID NO: 585586 - DNA, 13 bp, D. melanogaster
atcagtttagttt

SEQ ID NO: 585587 - DNA, 13 bp, D. melanogaster
atcagtttcacaa

SEQ ID NO: 585588 - DNA, 13 bp, D. melanogaster
atcagtttcagtt

SEQ ID NO: 585589 - DNA, 14 bp, D. melanogaster
atcagtttcagttt

SEQ ID NO: 585590 - DNA, 13 bp, D. melanogaster
atcagtttcattt

SEQ ID NO: 585591 - DNA, 13 bp, D. melanogaster
atcagttttctta

SEQ ID NO: 585592 - DNA, 13 bp, D. melanogaster
atcagttttttgc

SEQ ID NO: 585593 - DNA, 13 bp, D. melanogaster
atcataaagaatt

SEQ ID NO: 585594 - DNA, 14 bp, D. melanogaster
atcataaagaattt

SEQ ID NO: 585595 - DNA, 13 bp, D. melanogaster
atcataaatcaca

SEQ ID NO: 585596 - DNA, 13 bp, D. melanogaster
atcataaatcatt

SEQ ID NO: 585597 - DNA, 13 bp, D. melanogaster
atcataaatggtt

SEQ ID NO: 585598 - DNA, 13 bp, D. melanogaster
atcataaatgttt

SEQ ID NO: 585599 - DNA, 13 bp, D. melanogaster
atcataaattcaa

SEQ ID NO: 585600 - DNA, 13 bp, D. melanogaster
atcataatcataa

SEQ ID NO: 585601 - DNA, 13 bp, D. melanogaster
atcataatcatat

SEQ ID NO: 585602 - DNA, 14 bp, D. melanogaster
atcataatgatgat

SEQ ID NO: 585603 - DNA, 14 bp, D. melanogaster
atcatacgcaccgt

SEQ ID NO: 585604 - DNA, 13 bp, D. melanogaster
atcatacgcactg

SEQ ID NO: 585605 - DNA, 14 bp, D. melanogaster
atcatacgcactgt

SEQ ID NO: 585606 - DNA, 13 bp, D. melanogaster
atcatactgcttc

SEQ ID NO: 585607 - DNA, 13 bp, D. melanogaster
atcatagccactt

SEQ ID NO: 585608 - DNA, 13 bp, D. melanogaster
atcatataaaaag

SEQ ID NO: 585609 - DNA, 13 bp, D. melanogaster
atcatatacatat

SEQ ID NO: 585610 - DNA, 13 bp, D. melanogaster
atcatatatacac

SEQ ID NO: 585611 - DNA, 13 bp, D. melanogaster
atcatatataccg

SEQ ID NO: 585612 - DNA, 13 bp, D. melanogaster
atcatatatgtac

SEQ ID NO: 585613 - DNA, 13 bp, D. melanogaster
atcatatatgtat

SEQ ID NO: 585614 - DNA, 13 bp, D. melanogaster
atcatatcaataa

SEQ ID NO: 585615 - DNA, 13 bp, D. melanogaster
atcatatcatcat

SEQ ID NO: 585616 - DNA, 13 bp, D. melanogaster
atcatatcttaat

SEQ ID NO: 585617 - DNA, 13 bp, D. melanogaster
atcatattaattg

SEQ ID NO: 585618 - DNA, 13 bp, D. melanogaster
atcatattcaatt

SEQ ID NO: 585619 - DNA, 14 bp, D. melanogaster
atcatattgaattg

SEQ ID NO: 585620 - DNA, 13 bp, D. melanogaster
atcatatttcata

SEQ ID NO: 585621 - DNA, 13 bp, D. melanogaster
atcatattttgaa

SEQ ID NO: 585622 - DNA, 13 bp, D. melanogaster
atcatatttttca

SEQ ID NO: 585623 - DNA, 13 bp, D. melanogaster
atcatcaaaagat

SEQ ID NO: 585624 - DNA, 13 bp, D. melanogaster
atcatcaaaatca

SEQ ID NO: 585625 - DNA, 13 bp, D. melanogaster
atcatcaaaattt

SEQ ID NO: 585626 - DNA, 14 bp, D. melanogaster
atcatcaaaatttg

SEQ ID NO: 585627 - DNA, 13 bp, D. melanogaster
atcatcaaagtta

SEQ ID NO: 585628 - DNA, 13 bp, D. melanogaster
atcatcaacatca

SEQ ID NO: 585629 - DNA, 13 bp, D. melanogaster
atcatcaatcaaa

SEQ ID NO: 585630 - DNA, 13 bp, D. melanogaster
atcatcaccatcg

SEQ ID NO: 585631 - DNA, 13 bp, D. melanogaster
atcatcagataca

SEQ ID NO: 585632 - DNA, 13 bp, D. melanogaster
atcatcagatcac

SEQ ID NO: 585633 - DNA, 13 bp, D. melanogaster
atcatcagatgaa

SEQ ID NO: 585634 - DNA, 13 bp, D. melanogaster
atcatcagcagcg

SEQ ID NO: 585635 - DNA, 13 bp, D. melanogaster
atcatcagcgaac

SEQ ID NO: 585636 - DNA, 13 bp, D. melanogaster
atcatcataatca

SEQ ID NO: 585637 - DNA, 13 bp, D. melanogaster
atcatcatatcat

SEQ ID NO: 585638 - DNA, 13 bp, D. melanogaster
atcatcatatttt

SEQ ID NO: 585639 - DNA, 13 bp, D. melanogaster
atcatcatcaaaa

SEQ ID NO: 585640 - DNA, 13 bp, D. melanogaster
atcatcatcaaat

SEQ ID NO: 585641 - DNA, 13 bp, D. melanogaster
atcatcatcaacg

SEQ ID NO: 585642 - DNA, 14 bp, D. melanogaster
atcatcatcaacgt

SEQ ID NO: 585643 - DNA, 13 bp, D. melanogaster
atcatcatcaact

SEQ ID NO: 585644 - DNA, 13 bp, D. melanogaster
atcatcatcaagt

SEQ ID NO: 585645 - DNA, 13 bp, D. melanogaster
atcatcatcaatt

SEQ ID NO: 585646 - DNA, 13 bp, D. melanogaster
atcatcatcagga

SEQ ID NO: 585647 - DNA, 14 bp, D. melanogaster
atcatcatcatcca

SEQ ID NO: 585648 - DNA, 14 bp, D. melanogaster
atcatcatcatccg

SEQ ID NO: 585649 - DNA, 14 bp, D. melanogaster
atcatcatcatctt

SEQ ID NO: 585650 - DNA, 13 bp, D. melanogaster
atcatcatcatta

SEQ ID NO: 585651 - DNA, 14 bp, D. melanogaster
atcatcatcattac

SEQ ID NO: 585652 - DNA, 13 bp, D. melanogaster
atcatcatcattc

SEQ ID NO: 585653 - DNA, 13 bp, D. melanogaster
atcatcatcattt

SEQ ID NO: 585654 - DNA, 13 bp, D. melanogaster
atcatcatcgccg

SEQ ID NO: 585655 - DNA, 13 bp, D. melanogaster
atcatcatcggca

SEQ ID NO: 585656 - DNA, 14 bp, D. melanogaster
atcatcatcttcat

SEQ ID NO: 585657 - DNA, 13 bp, D. melanogaster
atcatcatcttct

SEQ ID NO: 585658 - DNA, 13 bp, D. melanogaster
atcatcatggaat

SEQ ID NO: 585659 - DNA, 13 bp, D. melanogaster
atcatcattaaca

SEQ ID NO: 585660 - DNA, 13 bp, D. melanogaster
atcatcattaatt

SEQ ID NO: 585661 - DNA, 14 bp, D. melanogaster
atcatcattaccat

SEQ ID NO: 585662 - DNA, 13 bp, D. melanogaster
atcatcattatca

SEQ ID NO: 585663 - DNA, 14 bp, D. melanogaster
atcatcattatcat

SEQ ID NO: 585664 - DNA, 13 bp, D. melanogaster
atcatcattatga

SEQ ID NO: 585665 - DNA, 14 bp, D. melanogaster
atcatcattattat

SEQ ID NO: 585666 - DNA, 13 bp, D. melanogaster
atcatcattattt

SEQ ID NO: 585667 - DNA, 13 bp, D. melanogaster
atcatcattcccc

SEQ ID NO: 585668 - DNA, 13 bp, D. melanogaster
atcatcattggca

SEQ ID NO: 585669 - DNA, 13 bp, D. melanogaster
atcatcatttaaa

SEQ ID NO: 585670 - DNA, 13 bp, D. melanogaster
atcatcattttca

SEQ ID NO: 585671 - DNA, 14 bp, D. melanogaster
atcatcattttttg

SEQ ID NO: 585672 - DNA, 13 bp, D. melanogaster
atcatccatcatc

SEQ ID NO: 585673 - DNA, 13 bp, D. melanogaster
atcatccctatat

SEQ ID NO: 585674 - DNA, 14 bp, D. melanogaster
atcatcgtcaccat

SEQ ID NO: 585675 - DNA, 13 bp, D. melanogaster
atcatcgtcatca

SEQ ID NO: 585676 - DNA, 13 bp, D. melanogaster
atcatcgtcatcg

SEQ ID NO: 585677 - DNA, 13 bp, D. melanogaster
atcatcgtcttca

SEQ ID NO: 585678 - DNA, 13 bp, D. melanogaster
atcatctattaat

SEQ ID NO: 585679 - DNA, 13 bp, D. melanogaster
atcatctattatg

SEQ ID NO: 585680 - DNA, 13 bp, D. melanogaster
atcatcttcatca

SEQ ID NO: 585681 - DNA, 13 bp, D. melanogaster
atcatcttcatcc

SEQ ID NO: 585682 - DNA, 13 bp, D. melanogaster
atcatcttcgttt

SEQ ID NO: 585683 - DNA, 13 bp, D. melanogaster
atcatgaatattt

SEQ ID NO: 585684 - DNA, 13 bp, D. melanogaster
atcatgatcatca

SEQ ID NO: 585685 - DNA, 14 bp, D. melanogaster
atcatgatcatcat

SEQ ID NO: 585686 - DNA, 13 bp, D. melanogaster
atcatgatcatga

SEQ ID NO: 585687 - DNA, 13 bp, D. melanogaster
atcatgatgatga

SEQ ID NO: 585688 - DNA, 13 bp, D. melanogaster
atcatggaatttt

SEQ ID NO: 585689 - DNA, 14 bp, D. melanogaster
atcatggaattttg

SEQ ID NO: 585690 - DNA, 13 bp, D. melanogaster
atcatgtcctggt

SEQ ID NO: 585691 - DNA, 13 bp, D. melanogaster
atcatgtggaact

SEQ ID NO: 585692 - DNA, 13 bp, D. melanogaster
atcattaaaaagt

SEQ ID NO: 585693 - DNA, 13 bp, D. melanogaster
atcattaatcatt

SEQ ID NO: 585694 - DNA, 14 bp, D. melanogaster
atcattacaaattt

SEQ ID NO: 585695 - DNA, 13 bp, D. melanogaster
atcattacaattt

SEQ ID NO: 585696 - DNA, 13 bp, D. melanogaster
atcattaccaaat

SEQ ID NO: 585697 - DNA, 13 bp, D. melanogaster
atcattatcataa

SEQ ID NO: 585698 - DNA, 13 bp, D. melanogaster
atcattatcatct

SEQ ID NO: 585699 - DNA, 14 bp, D. melanogaster
atcattatcattat

SEQ ID NO: 585700 - DNA, 13 bp, D. melanogaster
atcattatcgtta

SEQ ID NO: 585701 - DNA, 13 bp, D. melanogaster
atcattcacgcca

SEQ ID NO: 585702 - DNA, 13 bp, D. melanogaster
atcattcatgttt

SEQ ID NO: 585703 - DNA, 13 bp, D. melanogaster
atcattcatttca

SEQ ID NO: 585704 - DNA, 14 bp, D. melanogaster
atcattcctaatta

SEQ ID NO: 585705 - DNA, 13 bp, D. melanogaster
atcattcgaataa

SEQ ID NO: 585706 - DNA, 13 bp, D. melanogaster
atcattgaaataa

SEQ ID NO: 585707 - DNA, 13 bp, D. melanogaster
atcattgaatatt

SEQ ID NO: 585708 - DNA, 13 bp, D. melanogaster
atcattgacagtc

SEQ ID NO: 585709 - DNA, 13 bp, D. melanogaster
atcattgatttat

SEQ ID NO: 585710 - DNA, 13 bp, D. melanogaster
atcattggagcag

SEQ ID NO: 585711 - DNA, 13 bp, D. melanogaster
atcattgtaataa

SEQ ID NO: 585712 - DNA, 14 bp, D. melanogaster
atcattgtaataat

SEQ ID NO: 585713 - DNA, 13 bp, D. melanogaster
atcatttaacatt

SEQ ID NO: 585714 - DNA, 13 bp, D. melanogaster
atcatttaatcat

SEQ ID NO: 585715 - DNA, 13 bp, D. melanogaster
atcatttacaaag

SEQ ID NO: 585716 - DNA, 13 bp, D. melanogaster
atcatttacaatt

SEQ ID NO: 585717 - DNA, 13 bp, D. melanogaster
atcatttagtttt

SEQ ID NO: 585718 - DNA, 13 bp, D. melanogaster
atcatttatacaa

SEQ ID NO: 585719 - DNA, 13 bp, D. melanogaster
atcatttatcaat

SEQ ID NO: 585720 - DNA, 13 bp, D. melanogaster
atcatttatgttt

SEQ ID NO: 585721 - DNA, 13 bp, D. melanogaster
atcatttcaaata

SEQ ID NO: 585722 - DNA, 13 bp, D. melanogaster
atcatttcaaatg

SEQ ID NO: 585723 - DNA, 13 bp, D. melanogaster
atcatttcaaatt

SEQ ID NO: 585724 - DNA, 13 bp, D. melanogaster
atcatttcaataa

SEQ ID NO: 585725 - DNA, 13 bp, D. melanogaster
atcatttcacata

SEQ ID NO: 585726 - DNA, 14 bp, D. melanogaster
atcatttcattaat

SEQ ID NO: 585727 - DNA, 13 bp, D. melanogaster
atcatttccggtg

SEQ ID NO: 585728 - DNA, 13 bp, D. melanogaster
atcatttgaaatt

SEQ ID NO: 585729 - DNA, 13 bp, D. melanogaster
atcatttgaattt

SEQ ID NO: 585730 - DNA, 13 bp, D. melanogaster
atcatttgatatg

SEQ ID NO: 585731 - DNA, 13 bp, D. melanogaster
atcatttgttatg

SEQ ID NO: 585732 - DNA, 13 bp, D. melanogaster
atcattttaaaac

SEQ ID NO: 585733 - DNA, 13 bp, D. melanogaster
atcattttaattg

SEQ ID NO: 585734 - DNA, 13 bp, D. melanogaster
atcattttcaaaa

SEQ ID NO: 585735 - DNA, 13 bp, D. melanogaster
atcattttcatat

SEQ ID NO: 585736 - DNA, 13 bp, D. melanogaster
atcattttcatct

SEQ ID NO: 585737 - DNA, 13 bp, D. melanogaster
atcattttcgacc

SEQ ID NO: 585738 - DNA, 13 bp, D. melanogaster
atcattttgaaaa

SEQ ID NO: 585739 - DNA, 13 bp, D. melanogaster
atcattttgttaa

SEQ ID NO: 585740 - DNA, 13 bp, D. melanogaster
atcattttgtttc

SEQ ID NO: 585741 - DNA, 13 bp, D. melanogaster
atcatttttagcc

SEQ ID NO: 585742 - DNA, 13 bp, D. melanogaster
atcatttttcaat

SEQ ID NO: 585743 - DNA, 13 bp, D. melanogaster
atcatttttctgg

SEQ ID NO: 585744 - DNA, 14 bp, D. melanogaster
atcatttttctggg

SEQ ID NO: 585745 - DNA, 13 bp, D. melanogaster
atcatttttgttg

SEQ ID NO: 585746 - DNA, 13 bp, D. melanogaster
atccaaaaatgtt

SEQ ID NO: 585747 - DNA, 13 bp, D. melanogaster
atccaaaaccgaa

SEQ ID NO: 585748 - DNA, 13 bp, D. melanogaster
atccaaaagccaa

SEQ ID NO: 585749 - DNA, 13 bp, D. melanogaster
atccaaacacttt

SEQ ID NO: 585750 - DNA, 13 bp, D. melanogaster
atccaaacagaag

SEQ ID NO: 585751 - DNA, 13 bp, D. melanogaster
atccaaactattc

SEQ ID NO: 585752 - DNA, 13 bp, D. melanogaster
atccaaagccttg

SEQ ID NO: 585753 - DNA, 14 bp, D. melanogaster
atccaaaggaaaag

SEQ ID NO: 585754 - DNA, 13 bp, D. melanogaster
atccaaaggacac

SEQ ID NO: 585755 - DNA, 14 bp, D. melanogaster
atccaaaggacacc

SEQ ID NO: 585756 - DNA, 13 bp, D. melanogaster
atccaaatatgga

SEQ ID NO: 585757 - DNA, 14 bp, D. melanogaster
atccaaatcaaaat

SEQ ID NO: 585758 - DNA, 14 bp, D. melanogaster
atccaaatccaaat

SEQ ID NO: 585759 - DNA, 13 bp, D. melanogaster
atccaaatccaag

SEQ ID NO: 585760 - DNA, 14 bp, D. melanogaster
atccaaatccgaat

SEQ ID NO: 585761 - DNA, 13 bp, D. melanogaster
atccaaatcgaaa

SEQ ID NO: 585762 - DNA, 13 bp, D. melanogaster
atccaaatcgatt

SEQ ID NO: 585763 - DNA, 13 bp, D. melanogaster
atccaaattgaat

SEQ ID NO: 585764 - DNA, 13 bp, D. melanogaster
atccaaattgttc

SEQ ID NO: 585765 - DNA, 13 bp, D. melanogaster
atccaaatttccg

SEQ ID NO: 585766 - DNA, 13 bp, D. melanogaster
atccaacaagctg

SEQ ID NO: 585767 - DNA, 13 bp, D. melanogaster
atccaacagacat

SEQ ID NO: 585768 - DNA, 13 bp, D. melanogaster
atccaacagatac

SEQ ID NO: 585769 - DNA, 13 bp, D. melanogaster
atccaacatccaa

SEQ ID NO: 585770 - DNA, 13 bp, D. melanogaster
atccaaccagcca

SEQ ID NO: 585771 - DNA, 13 bp, D. melanogaster
atccaaccatcca

SEQ ID NO: 585772 - DNA, 14 bp, D. melanogaster
atccaaccatccat

SEQ ID NO: 585773 - DNA, 13 bp, D. melanogaster
atccaactatcca

SEQ ID NO: 585774 - DNA, 13 bp, D. melanogaster
atccaagaaggta

SEQ ID NO: 585775 - DNA, 13 bp, D. melanogaster
atccaagcatcca

SEQ ID NO: 585776 - DNA, 13 bp, D. melanogaster
atccaagtggatg

SEQ ID NO: 585777 - DNA, 13 bp, D. melanogaster
atccaataaaatt

SEQ ID NO: 585778 - DNA, 13 bp, D. melanogaster
atccaataaatat

SEQ ID NO: 585779 - DNA, 13 bp, D. melanogaster
atccaataataag

SEQ ID NO: 585780 - DNA, 13 bp, D. melanogaster
atccaatacaagg

SEQ ID NO: 585781 - DNA, 13 bp, D. melanogaster
atccaatagtaat

SEQ ID NO: 585782 - DNA, 13 bp, D. melanogaster
atccaatatatgt

SEQ ID NO: 585783 - DNA, 13 bp, D. melanogaster
atccaatccaaat

SEQ ID NO: 585784 - DNA, 13 bp, D. melanogaster
atccaatccaata

SEQ ID NO: 585785 - DNA, 14 bp, D. melanogaster
atccaatccaatcc

SEQ ID NO: 585786 - DNA, 14 bp, D. melanogaster
atccaatccaatcg

SEQ ID NO: 585787 - DNA, 13 bp, D. melanogaster
atccaatccaatg

SEQ ID NO: 585788 - DNA, 13 bp, D. melanogaster
atccaatcccatc

SEQ ID NO: 585789 - DNA, 13 bp, D. melanogaster
atccaatccgatc

SEQ ID NO: 585790 - DNA, 14 bp, D. melanogaster
atccaatccgatcc

SEQ ID NO: 585791 - DNA, 13 bp, D. melanogaster
atccaatcgaatc

SEQ ID NO: 585792 - DNA, 13 bp, D. melanogaster
atccaattaatat

SEQ ID NO: 585793 - DNA, 13 bp, D. melanogaster
atccaattaattt

SEQ ID NO: 585794 - DNA, 13 bp, D. melanogaster
atccaattccaaa

SEQ ID NO: 585795 - DNA, 14 bp, D. melanogaster
atccaattccaaat

SEQ ID NO: 585796 - DNA, 13 bp, D. melanogaster
atccaattcgatt

SEQ ID NO: 585797 - DNA, 13 bp, D. melanogaster
atccaatttaaat

SEQ ID NO: 585798 - DNA, 13 bp, D. melanogaster
atccaatttagaa

SEQ ID NO: 585799 - DNA, 14 bp, D. melanogaster
atccaatttagaag

SEQ ID NO: 585800 - DNA, 13 bp, D. melanogaster
atccaatttgaaa

SEQ ID NO: 585801 - DNA, 13 bp, D. melanogaster
atccaattttatt

SEQ ID NO: 585802 - DNA, 13 bp, D. melanogaster
atccacagcaaaa

SEQ ID NO: 585803 - DNA, 13 bp, D. melanogaster
atccacataacca

SEQ ID NO: 585804 - DNA, 13 bp, D. melanogaster
atccacatcaaca

SEQ ID NO: 585805 - DNA, 14 bp, D. melanogaster
atccacatccacac

SEQ ID NO: 585806 - DNA, 13 bp, D. melanogaster
atccacatccacg

SEQ ID NO: 585807 - DNA, 13 bp, D. melanogaster
atccacatccact

SEQ ID NO: 585808 - DNA, 14 bp, D. melanogaster
atccacatccactt

SEQ ID NO: 585809 - DNA, 13 bp, D. melanogaster
atccacatccaga

SEQ ID NO: 585810 - DNA, 13 bp, D. melanogaster
atccacatcttct

SEQ ID NO: 585811 - DNA, 13 bp, D. melanogaster
atccacccatcca

SEQ ID NO: 585812 - DNA, 14 bp, D. melanogaster
atccacccgaaatc

SEQ ID NO: 585813 - DNA, 13 bp, D. melanogaster
atccactctgcat

SEQ ID NO: 585814 - DNA, 13 bp, D. melanogaster
atccacttccact

SEQ ID NO: 585815 - DNA, 13 bp, D. melanogaster
atccagaagcact

SEQ ID NO: 585816 - DNA, 13 bp, D. melanogaster
atccagaatccag

SEQ ID NO: 585817 - DNA, 13 bp, D. melanogaster
atccagaatctat

SEQ ID NO: 585818 - DNA, 13 bp, D. melanogaster
atccagatacaga

SEQ ID NO: 585819 - DNA, 14 bp, D. melanogaster
atccagatacagat

SEQ ID NO: 585820 - DNA, 14 bp, D. melanogaster
atccagatccagat

SEQ ID NO: 585821 - DNA, 14 bp, D. melanogaster
atccagatggtaaa

SEQ ID NO: 585822 - DNA, 13 bp, D. melanogaster
atccagcagaacg

SEQ ID NO: 585823 - DNA, 13 bp, D. melanogaster
atccagcagcagc

SEQ ID NO: 585824 - DNA, 13 bp, D. melanogaster
atccagcatccag

SEQ ID NO: 585825 - DNA, 14 bp, D. melanogaster
atccagcatccagc

SEQ ID NO: 585826 - DNA, 13 bp, D. melanogaster
atccagcatgtcc

SEQ ID NO: 585827 - DNA, 13 bp, D. melanogaster
atccagccaacca

SEQ ID NO: 585828 - DNA, 13 bp, D. melanogaster
atccagccatcca

SEQ ID NO: 585829 - DNA, 14 bp, D. melanogaster
atccagccatccag

SEQ ID NO: 585830 - DNA, 13 bp, D. melanogaster
atccagctaccca

SEQ ID NO: 585831 - DNA, 14 bp, D. melanogaster
atccagctacccat

SEQ ID NO: 585832 - DNA, 13 bp, D. melanogaster
atccaggatccag

SEQ ID NO: 585833 - DNA, 13 bp, D. melanogaster
atccagtatccag

SEQ ID NO: 585834 - DNA, 14 bp, D. melanogaster
atccagttcaataa

SEQ ID NO: 585835 - DNA, 13 bp, D. melanogaster
atccataaacaat

SEQ ID NO: 585836 - DNA, 13 bp, D. melanogaster
atccatagtggtg

SEQ ID NO: 585837 - DNA, 13 bp, D. melanogaster
atccatatacaca

SEQ ID NO: 585838 - DNA, 14 bp, D. melanogaster
atccatatagaaat

SEQ ID NO: 585839 - DNA, 14 bp, D. melanogaster
atccatatatgtat

SEQ ID NO: 585840 - DNA, 13 bp, D. melanogaster
atccatatgcata

SEQ ID NO: 585841 - DNA, 13 bp, D. melanogaster
atccatcaaaatg

SEQ ID NO: 585842 - DNA, 13 bp, D. melanogaster
atccatcagatac

SEQ ID NO: 585843 - DNA, 13 bp, D. melanogaster
atccatccaaatt

SEQ ID NO: 585844 - DNA, 13 bp, D. melanogaster
atccatccaatcc

SEQ ID NO: 585845 - DNA, 13 bp, D. melanogaster
atccatccacatc

SEQ ID NO: 585846 - DNA, 13 bp, D. melanogaster
atccatccagcca

SEQ ID NO: 585847 - DNA, 14 bp, D. melanogaster
atccatccagccat

SEQ ID NO: 585848 - DNA, 13 bp, D. melanogaster
atccatccatcca

SEQ ID NO: 585849 - DNA, 14 bp, D. melanogaster
atccatccatccag

SEQ ID NO: 585850 - DNA, 13 bp, D. melanogaster
atccatccatccc

SEQ ID NO: 585851 - DNA, 13 bp, D. melanogaster
atccatccatccg

SEQ ID NO: 585852 - DNA, 14 bp, D. melanogaster
atccatccatctat

SEQ ID NO: 585853 - DNA, 13 bp, D. melanogaster
atccatcccatcc

SEQ ID NO: 585854 - DNA, 13 bp, D. melanogaster
atccatctatcca

SEQ ID NO: 585855 - DNA, 13 bp, D. melanogaster
atccatctccatc

SEQ ID NO: 585856 - DNA, 13 bp, D. melanogaster
atccatgaaaaaa

SEQ ID NO: 585857 - DNA, 13 bp, D. melanogaster
atccatgagatac

SEQ ID NO: 585858 - DNA, 13 bp, D. melanogaster
atccatgtttgct

SEQ ID NO: 585859 - DNA, 13 bp, D. melanogaster
atccattaaattt

SEQ ID NO: 585860 - DNA, 13 bp, D. melanogaster
atccattatacca

SEQ ID NO: 585861 - DNA, 13 bp, D. melanogaster
atccattatccat

SEQ ID NO: 585862 - DNA, 13 bp, D. melanogaster
atccattcgattc

SEQ ID NO: 585863 - DNA, 13 bp, D. melanogaster
atccatttaaaaa

SEQ ID NO: 585864 - DNA, 13 bp, D. melanogaster
atccatttaaata

SEQ ID NO: 585865 - DNA, 13 bp, D. melanogaster
atccatttcgatc

SEQ ID NO: 585866 - DNA, 13 bp, D. melanogaster
atccatttgaaaa

SEQ ID NO: 585867 - DNA, 13 bp, D. melanogaster
atccatttgatgg

SEQ ID NO: 585868 - DNA, 13 bp, D. melanogaster
atccatttgcttt

SEQ ID NO: 585869 - DNA, 13 bp, D. melanogaster
atccattttataa

SEQ ID NO: 585870 - DNA, 14 bp, D. melanogaster
atccattttataat

SEQ ID NO: 585871 - DNA, 13 bp, D. melanogaster
atccattttgttt

SEQ ID NO: 585872 - DNA, 13 bp, D. melanogaster
atccatttttaaa

SEQ ID NO: 585873 - DNA, 13 bp, D. melanogaster
atccatttttgga

SEQ ID NO: 585874 - DNA, 13 bp, D. melanogaster
atcccaaaaatat

SEQ ID NO: 585875 - DNA, 13 bp, D. melanogaster
atcccaaaccaag

SEQ ID NO: 585876 - DNA, 13 bp, D. melanogaster
atcccaacaagcc

SEQ ID NO: 585877 - DNA, 13 bp, D. melanogaster
atcccaacatccc

SEQ ID NO: 585878 - DNA, 13 bp, D. melanogaster
atcccaacgattt

SEQ ID NO: 585879 - DNA, 13 bp, D. melanogaster
atcccaagcattc

SEQ ID NO: 585880 - DNA, 14 bp, D. melanogaster
atcccaatcccaaa

SEQ ID NO: 585881 - DNA, 13 bp, D. melanogaster
atcccaatcccag

SEQ ID NO: 585882 - DNA, 14 bp, D. melanogaster
atcccaatcccatt

SEQ ID NO: 585883 - DNA, 13 bp, D. melanogaster
atcccaatcgatt

SEQ ID NO: 585884 - DNA, 13 bp, D. melanogaster
atcccaatcgcaa

SEQ ID NO: 585885 - DNA, 13 bp, D. melanogaster
atcccacacgatt

SEQ ID NO: 585886 - DNA, 13 bp, D. melanogaster
atcccacatccca

SEQ ID NO: 585887 - DNA, 13 bp, D. melanogaster
atcccagagatga

SEQ ID NO: 585888 - DNA, 14 bp, D. melanogaster
atcccagagatgac

SEQ ID NO: 585889 - DNA, 13 bp, D. melanogaster
atcccagatataa

SEQ ID NO: 585890 - DNA, 13 bp, D. melanogaster
atcccagatccca

SEQ ID NO: 585891 - DNA, 13 bp, D. melanogaster
atcccagcatccc

SEQ ID NO: 585892 - DNA, 13 bp, D. melanogaster
atcccagccagaa

SEQ ID NO: 585893 - DNA, 13 bp, D. melanogaster
atcccagcccaag

SEQ ID NO: 585894 - DNA, 13 bp, D. melanogaster
atcccagctgcgc

SEQ ID NO: 585895 - DNA, 13 bp, D. melanogaster
atcccatataata

SEQ ID NO: 585896 - DNA, 14 bp, D. melanogaster
atcccatatcccat

SEQ ID NO: 585897 - DNA, 13 bp, D. melanogaster
atcccatattaga

SEQ ID NO: 585898 - DNA, 13 bp, D. melanogaster
atcccatccatcc

SEQ ID NO: 585899 - DNA, 13 bp, D. melanogaster
atcccatccgatc

SEQ ID NO: 585900 - DNA, 13 bp, D. melanogaster
atcccatcgcatc

SEQ ID NO: 585901 - DNA, 13 bp, D. melanogaster
atcccatgccatc

SEQ ID NO: 585902 - DNA, 14 bp, D. melanogaster
atcccatgccatcc

SEQ ID NO: 585903 - DNA, 13 bp, D. melanogaster
atcccattcactt

SEQ ID NO: 585904 - DNA, 14 bp, D. melanogaster
atcccattcccatt

SEQ ID NO: 585905 - DNA, 13 bp, D. melanogaster
atcccattctttg

SEQ ID NO: 585906 - DNA, 13 bp, D. melanogaster
atccccaactgca

SEQ ID NO: 585907 - DNA, 13 bp, D. melanogaster
atccccataccca

SEQ ID NO: 585908 - DNA, 14 bp, D. melanogaster
atccccatacccat

SEQ ID NO: 585909 - DNA, 13 bp, D. melanogaster
atccccatcacca

SEQ ID NO: 585910 - DNA, 13 bp, D. melanogaster
atccccatccaca

SEQ ID NO: 585911 - DNA, 13 bp, D. melanogaster
atccccatcctca

SEQ ID NO: 585912 - DNA, 13 bp, D. melanogaster
atccccatctcca

SEQ ID NO: 585913 - DNA, 13 bp, D. melanogaster
atccccatgccca

SEQ ID NO: 585914 - DNA, 13 bp, D. melanogaster
atccccattccca

SEQ ID NO: 585915 - DNA, 14 bp, D. melanogaster
atccccattcccat

SEQ ID NO: 585916 - DNA, 13 bp, D. melanogaster
atcccccggctac

SEQ ID NO: 585917 - DNA, 13 bp, D. melanogaster
atccccgatcccc

SEQ ID NO: 585918 - DNA, 13 bp, D. melanogaster
atccccgccagct

SEQ ID NO: 585919 - DNA, 13 bp, D. melanogaster
atcccgaaatttt

SEQ ID NO: 585920 - DNA, 13 bp, D. melanogaster
atcccgattccga

SEQ ID NO: 585921 - DNA, 14 bp, D. melanogaster
atcccgattccgat

SEQ ID NO: 585922 - DNA, 13 bp, D. melanogaster
atcccgctcgcac

SEQ ID NO: 585923 - DNA, 13 bp, D. melanogaster
atcccggccagaa

SEQ ID NO: 585924 - DNA, 13 bp, D. melanogaster
atcccgggaaatg

SEQ ID NO: 585925 - DNA, 13 bp, D. melanogaster
atcccgtaagacc

SEQ ID NO: 585926 - DNA, 14 bp, D. melanogaster
atccctatcacttt

SEQ ID NO: 585927 - DNA, 13 bp, D. melanogaster
atccctatcccta
